United States Patent 9,328,346 (POLYCOMB-ASSOCIATED NON-CODING RNAS) - sequence listing, part 112

SEQ ID NO: 21580 - RNA, 152097 nt, Homo sapiens
guuauuuuuucuaacuaaauuuuuauuaaauuauuuuuucuuugaaggcuggaaccaucgaaguccuuagaucagcuuuaagcacuggauggaguaaaaaccacaagggacuacaaggugaucugugaacagacuggcagacagaugacgagagagggagugacgacaacaaaaauagacaaacaaaaauaauggucuucuggcgaccuaguuaaauuacucgcuuauuaaaauuuauuagaaauaaacaaacauuaaugaaauaaaaaucuaaaacugagccccagacucaagacuacuagaaaggcucaccaaguaaaacccucgguugggucaagugagcucucugaauguuuuguacaaccugcugcaguuuguuccccuugagcaaggugaugcuuuguccugggcugcaaucucuaacaccaucaccauccccaagugcagcucccauucuaaaaaaaaaaaacagaugcccccacccccaauuccuggugaacugcucaucucuccugacugcagaaacugacucugaaggaggaaguugcaccagugguggaggcaggugggcaagcggguagggcagggaugguuuccuggagaauccaucuuuucuccagaugccuagcaugugcuuaagaguuuuuuguuuuuuuuuuuaaguuugaaaaaaacuccauugugaaaagugaguuaugaagagugcucuuuauuugaaaccuccacaacacagacgccaaucuugucucgcauugaaucauuagcugugcacaucaacacauuccaagcacaaauuaagaaaugcaaacagaacaaaaaaauauauauauauauaauuuuuuccccuauccaaagguuucaagucucaaugcagcaaauccuucugaacacagaaucugaggagcacacuguucaaacaguugggacagacaggucccugcaaaggcuacugccuuuuuaaaacacaugggguggggaucauggacggcauggaaaggggagagaaggugaggaaacaggcggcggggagagaaugagaagaggaacagguaugcgcuggggaagauggggcagcugggacacacacggugaguugguggauuucauuuauugguuuuugacaauuucuuucugguucuuuuuuuaacuccccccuccccagguccaacaaugguaaaaaaaaccccacggaguugggcagggccuuauuaggccagcccaaagccuucagagcacuccuggauagccaacaguagcauguggcggagcuucucaaagcucucauaggcaggcagauccagcugauuaaaacuaaggaaagaagaaagaucaguuuguggugagggaugacagauaaccaaaucuguguguucccauggugcccaccagccccuccccucccugaagaaaccaacucccugcuucuugaugacucccaaucuugucucagcccaguaugucccccuuuaucuggcucccaaacuggccaucaggcaccaaaaccaaaaaucugacccugucacuccuccuuaaacacccuggccucacucgcccauaggcuaaagugcaaacuugaaggugguuuucagagucacugguaaucggaccucugcugagcucuuuagacuuuugcucccugcaacuccuccuugcuccagucacgcuggcccuggaauacaccaugcucucuuguggugcuguuuaccugacagugucuccccagcccccacugugucuagcacaucucaucucaaacaucaccuccauagaaacaccaaauugugaguuacccaagguccaggacucagccacauuuguguucccaaucuuggguaggguccugaaaacaucaaguaugcaagcucaaccuaagcacugaaaaggagaaacaaacccuuccuuuuaccaugugugagcugaaggcaggcgaucuguggaccugucaucucgauggaucugaaacuucugaaugccauucaugccuucgagggcagcaaagccuugcagggguaccuuggaaguacccgugacaaacuggaggaacuuggcacggucagcuugaucgaaagaacgcaaugcucuccagaaccacuggaucuguaggaagggacccaugaagccaguguuagguagaaagcuccuagaagcagggugggggggauggaaucuaggaaacaggacuggacuugguaucugaggcaagucccuucugugggaugagcuuuagcuccuuucauucauaagacggccaagagaagucugcuaugcuucaggagaacaaagaguuagauauagguagacugucuucuacaugcaacuuccucuaagaguacuacugguuuauuugguaucacacaaacuagcguugccuaggguaagaggaccauaugaggagggaugccagcagcagcucaccugaauagaguuggacugguacuugugguauucaguguuggauuucagaucaucgaugucaauggugggcaguccugauauaagcagcucuaacuccugcucagugaagauggaaaugaggcgcuuuggaaugaucucauagaagccuucuaagaaagccgccaacugcuugcggauggcuccuggugagauaaccaaaaagccaaaugacuucuaaacucacacaaccguagaggucagagaucccccaucuggcucccaucuaccacuguuagcugggacuacaggcaugcaccaccacaacugguuaauucugcccaggcuagucucaacccccugggcucaagcuauccuccugccucagccucccaaagugcuaggauuacaaaugugagccacuguguccagugaaguuaagcuggguuuguuuuuuuuuuuugagauggagucucacucuguugcccaggcuggagaagaguggugcgaucucagcucacugcaaacuccaccucccggguucaagcaauucuucugucucagucucccgaguagcugggacuacaggcgcacgcugccacacuuggcuaauuuuuuauuuuaguagagacgggguuucaccauguuggccaggcuggucucaaacuccucaccucaacugauccgcccaccuuggccucccaaagugcugggauuauaggugugagccaccgugcccaaaguuaaguauuuuugaucaaguguuuugucuuuugugcaaggcauuuguggcucugucauagcagaggaaaacaaaacaugccuaucaaaugaaucaaguccgaccucuucucauauugagcaacuagaggucuaggaacauuuccccuaccugucauucucaucuggcauaccagguguacauacuccuucuuauucuccucuguuaccaagauguuggccccauuggguuugaggucacgaacuucacaaacuccaaacucuuggaccuagaacaaccaaaacaccaaucauacauaucagacuucaucuaggaugggauuagauaccuaggaacacacccuaaaccccuugccauguccuaggcagagagaugaggcaaguccauacaaaacagugacuuuuucuacuacucauagcucgcaacuccccuuauagggaaaggcuuuggguaggaaagaggaaaauacucuuuggcucuaagaccuacaaaaaaggcagaagagaguaaggcaacuaucagugguaaaagggaaaagggaauggcuaacauauguaacggaauguaaucucuuaggaaaagaauuuaggagaagaguaaccuuaacugccuucauuuuccccccacuuacauuuguacgauuuuucuacaaagaccuacccuugggaaugaggaauuauguacuggaguuuuuuuuuuuuuuuuuuuuuaauaaaggugaaacuaggaaauggccugcaaauucugguuuuccuguuugugaugucacucacaaacaccugcuacagcuuuaagaagucaagaugcuuccuuagaacuaugagaaggucacgcagugcuaguucuaaggugaaccuggaauggaucuuccagauuggcugggaugugcugugauuaggauuuccugaccuaccucagugcugaaggugaggucauagccuaguguggagacaucauuuuccagcagauaaaccagaccuugguagaagugguaaucuucacucuccauaucuguauaucuagaaaaacacaauuauacagggucaugguuugcgagugggggggaagaaggagcacaaggaugggacacaaaaagaccagacccccaggacugaagacagucccaggacuaugccucauccucaccugacugacuugcccaagauguguuuguaaaaggaucgaguaaaguagcacuccagaagacgguugucauauacagcuuuggccacaaugcguccgacaaacuugaaguagcugaggugguugggguugcagugggaagauggauugaugguguaggugacucgaucaccaggugagguacggaacaaggcauacauaggguuaaacaucucucgagagaugaucauauaccacucccgcaggagcccaccagcauccugcccuucuucuccuucaaauacuauauaccugcauaagaaagcagaagcagaaaagagcugugcagaaaacccaggauacauccagucauuugugugagugagagacugugaagcagugucuggggagugcagugucagaugaagagguaaacagagagugccaggacagcccagaaaugggguggagaucugggagcaaacaaaagcaccacugacagaggagaugucccaaaauagucaagguuaacagauauuccagaaaacaccaauaggaaagguaucagagaaauaaaugaggccuugcuuaggugaaguggggaggggagaaaagugguauuagagagggauaagcccagaguccaaauucucuaaagguauuuggugguggaagaacauggcauacagucugucuagggagacucccugacuucuugugauuacacaguuggagagcccacaccacaagagauggggaggaaucauuaaacaacuccaauaggucuuucaucucaucagcuccuacgcucaguauuacaaacugcugaucuccucuagguggcuucagaaucaccagugagcaguuaccaguuugguggaggccacucauacauggucauuccuaguauagcaauauuaaagcucucauugcaaagccagcagguauauccuuauaaacaccaaagacuuuccugucugucugggaauuguuggguagcuuagcuaaagggccagccagcagggcaggcccagaagauaggagacaacucaguaagauuaucuaaaaccagauuccuauggggaauuccuauuagggagggcagcaccucccuaaauuugaggcuagagcaagccaucgcuacugugcaggaggccccaccucccacccgccaucuuuucuccguuccugggcccuuacaaucgauucuucauuucuucgggggauuugcgaugcagcucacgauaggagucuucaaacacauggucacgacggacaugcacagccaugucuucuuuccggagccccucaucuaaacgcuccagcucuuggcggaaauaucuugggagguagaaaaggaaggaagauaggauuaaggguggcagaacaaauuuguuugugugauuaggaagaagacccacaaugaugcuccuucuauccuccaaacacuuugaucucugcuccacaccuguuugggaaaugcccaguaguugggagagguagaucacucauuaccaacucuaaauuuuucuuaccuccacugaguaagggcccacaaagauugugacaugugauuucugccacaagcagguaagcauguauacaugcacgaggagaaggagaggcauagggaugacuccaggaguguuguggaagccccuggaacccugcuguguguguucuauggccaccugugccuccuguacuacccccaacggauggaacagaacuuuagaaacugugugguucaaaaaucaugugacucuguuuugcugaugaaaaaugcagaugggguggagaagcccaggaguauuuagguaugauggccaucaaugcuacagcugucucuucccuccucaccaccaccauuccaagugcugucaccaaaggaaauuuguggccucaagaguaacuucagaggcgaguuaccauuuggggaguucucaccaccccucuaccccccaauauccaggacacauacuugcgcuugacaucaaagucgaggacacgaauguagucuaccaggacagcaaaaggcccaucagcaaggugggucguggacugccguaggaucugguuuaacacagugcggugagucucugaggggagaagugacagcaggaauuaagcacaucaucugccccagaagcuguaagacagccaaccagcuagcaacucucucuuccuuccucuuccuuauuucagggcucuaaaaggacuagucaaaaccaagggccagcccuugaggugugaacgugaaucugagcauuucuauucuaaaccugaguauccugaggccaagggaaaccaugcaggguuuacgugcacggguguguguauguacacacacacacacacacacacacacacucucucucucucucucucucucucucucaucaacuaaggauuaacuguaugaaacaauccuguuuaaaaugaagccuucuacaccuggcagccuaaaaguucccuguaccugcaaagcgaaggaacuucugugugucagggggcaggcuugaggagaugugcauagaugagggcucccgggagaagaaugggucaagggaggaaggcguggcugggguuaagggggcaggggagaguggaggaggcucguccuugaugugugccagcuggcucucacgggugucucggacaggaggcuugcucucccgcucuguggcauggaccagaaagaaggccucgacagcaggcuguagcacuaggguuaggaaugauggagaaguaacauuuuacucugcaaacuucaacaugcaaaccucuuugccaucauaaacaaauuauaaaaauaaauaaggaagaagaaauagugaaaacuaggcuaggugugguggcucacaccuaugaucccagcacuuugggaggccgaggugggaaaauugcuugagcccagcaguuugagaucagucugggcaacauagugagaccucauuucugauuuaaaaaaaaaaaaaaaaaaaaaaaagaaacaaugagaacuugcagggaaauaugguagaaucaagucacagaggaacuuccuugaagccaaagaaaaaugggauagcuaaccaguuauaaagauuccccuugucuauaaagugaaagacaccaacuauuaaaagagaaggucaaucuuuuuuauacugaagucagagaaaaaacacuucucuuuugaauucucauuacagagacacugagggagaggaguaaccuggaaggaagaaaaacaagcuggcaggaagggccccagagcagaccacuggguugggaccugggccuuuaggacacaacucaccuagcaccgcaugcuggucaugggauuccucuaguuccuuuagacacuccccaagcaugucccacagcucguccaaacucagcugcucgcugagcagggguaacucagguggucuuucuuccuuuuccuucucccccugugggguuccaucggaggcuggagggcacacagaagagagucagaaagucuucaaaauuucccuucugcuuagaucuuucuagaccacacgcaccaacuaauauacagaacaaguagaggggaccacuggccacugagugguacucaccgagcaacaucugaaacaaggucuaggaccugcauuggauggcauuuacauuaaacagaauaaauaaaauaaugaaucugguuccucaguugcgcuagccacauuuaaggugcucaaaagccacaggugcuacugcagauccagauagugcuagucuagucacugccucacuaguuucaagagaaucuguggauuauuucaggguaauguaacaacaguggagcuuuggaugguugccuuccaguuuacacaggauguuuuaggacacuuuugucauugaauucugacagcuggccuuggaaaguaggcugucuuuuccucauuuugguuucugaggaagacagcaccaggacaucaaacuaaaucuuucuaaccuuaagucuaaugccuuuuuuuuuuuuucccugagacagucucguucugucgcccaggcugcagugcaguggugcgaccuuggcucacugcaaccuccgccuccuggguucaagcgauucuccagccucagccuccugaguagcuggaauuacaggcacaagccaccaugcccggcugauuuuuguauuuuuaguagagacuugguuucaccauguuggucaggcuggucuugaacuccugaccucgugauccaccugccuuggccucccaaagugcugggauuagaggcgugagccaccacgcccggccuucuaaugccuucuaaauuagucaucuuguccuggggcaguuuaaaacccugagaagccaugguaugacagauggaaucccauggcugguacuuuuccugauacucacugggggcuuauucuaaccucugcucaguagcuaagcagcaagacacaaccccaucuucuggguggggaguaagugacuguuuucucaucaaccccugauccccauacaccuggcccugcuuagguuucuuccugaccuuugcuguucauccuuuacccaaauccugacuauucuucaagguucugacagccuuagguuugaauccuggcuccgguacuugcaaaucauaugaccuuagguaaaagaaggugaauacagaacacgaaaauaauaucuaucuccccaaauccugaugaaagguaggauaacaaugguuguccuacaagaauacuauuccaugggaauguguuaugagggugccaaaauguauucuauguaugacugacuuugagaaaugcugcuaacaauagcauucaucgugugcuucucuaaccacuauacauguuuuaacucauuuaauccuaacaacugaacauuccuauuuuaaacaaggaaaccuaacaaagagguuugccucaggucccagaagcaguaaaugggggagccaagauuuaaaacacgggagacuaaggcuggucggccguggcucaugccuguaaucccagcacuuugggaggccgaggcagguggaucacuugaggucaggaguuugaaaucagccuggccaauguggcgaaacccugucucuacuaaaaauacaaaaaaaaaaauuagccaggcaugguggcaggcgccuguaaucccagcuacuugggaggcugaggcaggagaaucacuugaauccaggaggcggagguugcagugagccgagauugcaccacugcacuccacccugggagacagagcuagacucugugucaaaaaacaaaaaagaaagaaagaagacaugggagacugaagugagaggauggcuugaggccaggaguucaagaccagccugggcaacauagugagacuccauuucuacaaagauaaaaaaaauuagcugggcaugguggccugucccuuacaguuccagcuacucagauagccaaggcaggaggaucgauugagcucagaaguuugagguugcagugagcuaugacuauguuacuguaucuuagcuuaggugauggagaaagacccugccucaauaauaaaacaaaagauuuaaaacacaugcugggcugggcgcaguggcucaugccuguaauucuaacacucugggaggccaagacagguggaucaccugaggucaggaguuugagaccagccuggccaacauggcgaaacucgucucuacuaaaaaaaauacaaaaacuagccaggugugguggugggcgccuguaaucccagcuacuugggaggcugagacaggagaauugcuugaacccaggaggcagagguugcagugagcagacaucgugccacugcauuccagccuggcgacagagggagacugucucaaaaacaaccaccacaacaagagaaaaccccauaaaaacaugcugucugaaugcaugauaucccaccauuuucuuuccuuuacuacaggaaagaaaagugugccuugguugucaaacaccugucaucauuuacagaaaccaggguuuacuggaacaaaugggaaaacacugggcuuauauaugcugggagcaggggauucagcagacauuccagaagacuggcuaucccuuuugcucggcuggaaacaggaaguaguacugaccaauggauugaguaucuugagcacugggagauggcugguccacauccaugggugauuccucccuccggacagacgccucugacuggcuagacuccgacuggauaaaagggagacaaaaaucacauaagggugcaacucugcuuuccuuagagacaggcuagagguuggcccuuccacuucucauacauugagcuugcaaagaagcuucccauauuuggguggggaaaacuguagcuauccaggacaaaaggaugccuuucccaacucuucugcuuuucuccacuguguuuuguaagcuuuucccaacagcuccuuggaugcuuacauuuccuacagucuacaauccagaccugugaccagucagaacuagccuccuguauauagacuucaagucuucuucuguuguguguguguguguguguguguguguguguguguguguguguguguauaaaaaauucagauggguggaagguaggucugcucuuuguuucuguuugcucacaaaaggggaaauaauaggagaauuagagcaaccucucaugagcgggauuauuuaaaaagccgacaucuuuucguguaaugggaaagagacucggcagaaaaaauacuccagaauaacagcuuuauuuucccuuucuaccuuccuggagucacugccccuaaguucaaggcuuuucccugccuacucaauaaaaccauacuguauaauaguaauuauacgcaaagaaauaucgggucuuaggauaccuuucuuggaucuuggaaagguaacuuacauguugcaaggacaggaaaacaaugagggagugccacagcauacacaugugaugccaggcuuuuacugcagccacucaaugccgggaccccaacacugagcuggcuacuuaaguaccugaagguuuccuccuaaaagugccugagugccuaggugccaagggauuauggagaauaaaggcagagggcaggguggagggagcagccacagacagaaguggcugugugggauauguaccaagcuugggggacuuucaaugguaggauuccugagauguuucugauguaccugcauuguuccaugggacugaaaaaaaacuucaccccauaaccccucagaacccagacaacacuuagcaucaggcaguuugcaaaagcgccacuguugacuggauagcugggagugggguaugauggccaagcuuuaaaucaaaucaaaccaacaaaccaaucaacaaauaggaaaacaccaacagaaaguaacccuuuuguccagaagcauucauauagcaaacuuaaugcaaaagcauacaagguaaaggcaaugaaaccccacugaugacaugguggggggaugaguggagagacaaaugaaugaggggccacaggcaucaugcuaaccguugcugcuuguugcugucuccgcgcccuuugacccucacguaccauuuguauaauggcaucagccucagccuccagcugccgaacagcugccuggaugcugcuagcugagccuaaaccggaggaaccugggagaaagagaaagaggaaggcaagauauaaaauauaggaagagggaaagcccaauauucucucuccuaucuccugggcugccacagggcaucuugcugaggucuuuugagcuuuagcucaggaagcuucagagugcucaucaucaggcgcuaagauuuaccauuacagauaagggcagggggcaugaugcuagacagacggaugguuuugugcgagaggguucugugggacaggaggaaagagguagggaaaaugauuugucaagccacggcuuaguuagaaaugaccaaggaagcagaaaggagaugcaccuagugaguuaagucuuguucagcaaaaggcuggcccccaacuucccugccagauuuccacucccccuuaauucccacucccccuaaugaauuuccuacgcagauagcuugaaugagauguagaaugcagccaucaacauucugaaaaaaggauaaucauuuuccuuuuggaaaggucaaacaggaaggagacaggccguuaaguccugcaccuccaaggaaucuggcuuuaccgccaccaacccuuccccucaacuggacacucuaguuccauaccuagccugccugucugcuuggcuuucuuguuagcccggcgcgugucgucccggagcuggaugaugaccuguaguacccucaagaagaacuucuggguagaugucuuggaugucaacauggacauagaaggcagcuggagcucccggccacccaaaggucgcuucugagaugccacaauuaccacauucucagccaugucaaaccuggauaguguagagguggcuugcguauauugacagcaucaaaguauaaacacccaaagcaagcaaggcuuccuggugucaaccagagggguaaggaaacucagaaggaaaucuuccaaguaggaaguagaaaaaaaugggucaaguguguauaggaaagauacgaaaaucacccagagaaauaaaaaagaccaggaaaccagcaagagccaucuuccagaauaucccagauucaagcccccagccaaaggguggcuaccacccaccugcucugcauuuugcccuucagcuugguggucuguggcugcuccucaggcaggccaucaggagagaggguuucacauugggcucgccgcugcugcucgagguuguauucccgcagcucggccagcaggguaccugagcaggcagaggagucagcaaguguucagagacuccccugguaaaguggcuaaaagccaaaucucucuaagacaccugcuuaggccacucuucauugcucagcugcagagaaccuagagugagcuggaaucgugcucuguucagcuuauuaugcguguccacgaaccgucaccugggacuaccaauuuaccuauggccacagggaucugcugaaucugcaugaaaugaguuucauguagaagagaaacaguaucuccucuggagcuaaacagaccaugguugaaaucccauauaucucucaaaauuacugagguucuguggugguuucaggcaaauuucuugaccccuuacccaauuugcuaaccaauauuaauacugggaugggaauauuacugccuaaccucauaacguugcugugacaauuaagagauaauuauaugguagagugccuagacagugccuggcccauagguguggaauagaugguggcagccaagagagaaaggucagaggccaaauucuuucuggaagaacguuguaauuuucaugcagcaaagaacacccugaguuauacaggccaaccaacucuccuaucaccccagacuuagggacaugggggugaaggagagagagaacuaaguauguagccaagaucuagggagacucaugauugggaugagggugggacaggguagacagacucuauguugaaagaaaaccuggcuguacuccuugguccaaucacuuuaucacccuggguuuuggcuuucuucucaguaaaacagggaggaagaugauagaaacgagguaauuuguaacuguucuuagaauuuuuauacccucaaaauuacacaaaagcagagaguacuauucugacucuguaauuccugaggcugaaugcaguguagggacauacuuugaaggggugaagcugccucagcugucuuauggggcucuuacgagugcccagcauggagaagaaaggaggcgcugcuguucccauguguucucuuuucucuucauuaagcaccacugugugccgggcagcggggaugaggagacaaacccagccuugcuuucaaacaacugagcagaggaaaacagaugauaacccaggguaaucuguguuacgacagagggagcauggaggcuguguuauagggauauggagguaucugauucagcuuggggauucaggaaaggauuccagaaagaggaagcaccuaaguggaaaccuucagaaagagaaaaugcuuuacuucugcuauuaccuauuuguuuacaaaggguauaacccagauggcgggcuccauucaguagcagcuugagaacagugucccgggucccagaguccccccgggagagcugcaguaguacguuggcugcauccucuaagccuuccucagaacaagagugggaugucaacaccugagaaaaagaagacagaaggaguaagccccagccugagaacaaaaucauuaucuacccuguuuauccuuucuccccaagucuuagcagaucagaagagcuuggacucaccucuacagagagcuguagcugguuuucagugaggccagaggacaccaucuuaaagucuguacugcugcugcccccaucacucaccuucgcuggagauuugcugcccuuaguagugggagaaacuuugaggaaacagacagaacacuguaagccucucugaaacucacaagccagggacuaagugacaaaaucaaggaaucgcugaauugcccagggcuucaaaaugggaaaguacugaaaaagaaaacccacccaccaaaggcaaaucuaaaugacuugggaugauaaaggcuuuuuauuuuuuauuacagacacggucucgcucuguugcccaagcuagaaugcaguggcacaaucacgucucaccauaaacucaaagaggacucuuaugacuguaacuucuaagcugaaaaagaaaccccaggcauuucuuccaacuauucccccaccaucauggcccacucuauucuuuaaaaccuacuucuucagauaauucuuucuuacuaaucuguggcagggcucauuaccuuuauuuccugggaugaucugguuacucugaaucacacuguauccugcccgcccuugaacuauuucccaugagaacuggcucccucaacacaacuggaaaggcugggaauucccugaggauggaacuuaacuuucuuuccuccuucuggugccuagccuagggaagcuacauucagugaaugccugcugaccuucaaaagagugugugugugagaggcaggggagagagagaaagagagagacacagagagacggggauggaggaagggagacagagugagagaacugggacagaugagggugagaaugaacacauucuguucucacaaacacaaaccaagcugauugcuaucacugagggagaacuaucuggauggaaaagggggugaagugggugccacaguauauaccccacagcucccagucuacauccacacuuacuugaaacaguagugguagcagucguggggguagucacuguggucgaagcagcuacgacaaugguggaaauagccguggcagcaaccagggcuggagcagaagugacaggggugggugcaguagggggugugggcgugguggaggcggcaguggugguggugguagaugugguugagguggcaguggugguggaggaagcaccgcugccagaauuagccugugcuucugacaccuuguuuucugggagagcaauugagaugagagaaaggagucugaggaguuucucaguuaagagagagcuccggcggaugacugggugugacaacauguucaugagcugccccaguggagaggccucgaggcuguauggagagguuucccccucaccgccagcgcucacuggcacugacuucacggaguucuugccuuuccggcugacauucauguuguccaguuuuaccaauaagucccagaagucugugcaaaugccacugcuggaggacugugaggagcaugggcuacaggccuuauugccccuuucccgaucacucucacaguuuguuucuuugguccgcugcugugugaaguggcugggaaauaccugccgggaaaaggaggacaaggcuuggucuaggacgucuucacagaggaugagccuuccugauagggaaaagacaacugguucccagacuccuucagacaauuuugguaaauauugggggauaugucauauaagaguuuuauccaacagacaguaaagcagccuagagaaaugaaugagggcuuuguagcaauacagacucacgagcaaacuuuuccugagcuuuagucucgcacuuauaaaauggagauaacuacacuuccuugcaaaguuguuggagauuaaacgacaugauguauuuugcacagugccuggcacaaggcaggccuuugauagauggcagcaaugcuuauuauugaaagaacacuaaauucuagguccagcuccaucacuuucuaaucauaagacaaaaugaauaaaauguucugaaucucagguucuucaucuguaaaacaggaaucauacagcccaguuguuuugaugacuaaauaagacauacauaaaaauggaaaagaaugaagaaaaaaccccagaaauauauaggacaauccccuagaaacaauacagggcucaacacuuaaaauaagagcaaaaagacacgcuagccugcuuaguguucaacuuucacccaggcucuugcugccacccuucuuccauccccaggaguuggguuugaaacccucaccuuggccaauugaaugaguguauccaaaacgugucugcagacaacaggagcagcuuggggauggauguggacgguggagccaccgcuugcaugcuucucgguauguuuacgccccccugaacgcuggaucugaaauauauuaguccugcagccuagggcugcauccauggauacugagagccaggaaagcugguuggagcucuuugacuccaucuuguguagcagguccaggggacgguucucauggcuacuugacccacagcucuugcucgacuuuuugcccuuuuccucacuuguagugaguuuggguguuucaaugcauagcucacucucacugcugcgcugcaagauggagagcagacugcggaugacccaguggcgggucugggcaugguagcagagauuucucaguacucgguguagacggcuaguauugagcuuuggcucauccacaaaaaguaggaccaagagacaagaaagggcuucgugguccagaaggagccguccucggaggcggaggagaguaucuacauuacugccagaaggccuggaaacagaacaugguuuuuggguaacacuucaguggcuagagcucugggauuaggcauaagaaugggggaggggaaugagcuagguaucuccaaggaggcuugagaaagguggguguccaguccaagggcucuucauaguaacagcugcccucuuaggugucuacuauguaccaggcacuuuacaaugacuguacaucauccuuucagggcugcuguacagcuuagagaaugaagccccccacccccaccagcuuuuuguugagauggagucucgcucugucacccaggcuggagugcaguggcgugauaccggcucacugcaaccuccacccccuaggauucaagugauucucgugccucagccucccgaguagcugggauuacuagugcgcgccaccacacccgacuacuuuuuguauuuuuaguagagauuggguuugccauguugccuaggcuggucuugaacuccuggacucaagugauccaccugccucagccucccaaagugcugggauuauaggugugagccacgacaacuggccgagaaccacccauuuuugagaugauaaacaagaggcucaaacagguuaagugacuugcccuacaucacacggcgacugagaagacagcagagauuccagcccagguaucauccaucgacugguaaaaucugaccauaccuaagucuaggagacaaugcuaguuucugccuucucuagacuaccaggaguuuguggccuuguaggaaccaaucacuccuuucacauuuuggcaugucaggcccacucuguuuuagccuggcuaacucacuccucuauacuuccuuagccuagguguuacaaacucaaggcaggugguuaguuguuuuacuacuugcaugggagacaagugguguuccuucuuguuaaaaccauaguuagcaccugcugccggccugcuuuugcgauuguggucuuugguagcaagacuaaccaaaagguguaguuuucugaauggggaguccaaagaucuggcucucucacuuauucaaggaaauggcuuagagagaccauccauccugccugucaggauuucagcuucuccaccuauaaaacuaagggagcugggcuaauagacuugaguggugauaugguaagguaaaaauagacaaagguaccuguuauggcugcugcuaccccccaucuggaaggugccaccucucugcacagcaaggcgaguauacuggaccccacgguugccacuuaagcgacuggugaaagcuggaaggaaagaaaaagaaaacugagauuguggagaggguguaaacuggauauagguaauacaaagguaagaaaacauagccucaucuggcuaaagcuuuccagagcccucccacuugccucccucuguacccgggcuucggagaauagcagagagugcggaggugcuacugugcccaaacagacgcucaugcaugagcugucgcugccgggcuucuugcucucgucucagggcuugagccucagcugcaaugucagguggcaucacagcuaacacacuguccuccauauccucuaggacacuacggcgcaggucugagggcagagucuggaugaaggucacaggguccauaggggugucugagcuggcauucugugcuaguucucgucgcugcugcucagcucucugcugugccaguaccuauggagcagaaaaagucaaugagggcauuucuccugccaggcagccuggccccaccaccuucccgcucacauacuuccuccugaauggcuggaggcagggcagccagaaacucagggcucacuucagucacaccaggauuccccaccacugcaggcgcugagcuauuuguggagggggcaguccggguugguggacgaaugccuagcugguucuguagaacuucccgacggaugucaucaggcagggcagccagaaaagagggguccacaccuucagggagacugauaccugaagggagauauaacauguaaagggauucacgccuuauuaauugcuugagacggggucuuggucuguugcccaggcuggaguguaguggugcaacccuugccucacugcaguguugagcuccugggcucgagucuuccugccucagcaucuugaguagcugggauuacaggcaugcaccaaaaugccuggcuaauuuacauauauauuuuuguagagauggggucucccuauguugcccaggcuggucuuaaacucuuggcuucaggugauccucugaccucugcuucccaaauuuucaggauuacaggcacgagccaccgcgcccagccucucacaccucuauuggugccuaauauguacuuggagaaaauaaacccaugucacuccuugagggaaaccaguguauaugucuucacugcuugcaagacaugggacacagagaaggcccaccccaccuucccugggcucagaacagcuuuuguuauuugcuagacugcaugcacuguuacuuacccuucauaaauaaccuaccacgcagauaucaucacccccucgguaucauucaugaucacagaaauuaaauaaugacccuagguuguaaaagguagaaguggcagagugggggaauuugagugagccaagaucaguuugacuccuaaggcuggacccguuucauuaugccauaccagcacccccgcuuauugucaguccucccacauacaugcccuccaucuaaauggaacuguuuggcuggugggcauuuccaugccaagggcuacuagaagccaaaacaaucccaggaugaccugggcauacacggaacucacccgcaaggggaucuucuucuucacugcuuguugaaggcaacggcucuucuaggauuccucgggaaucugcuccagaaauggccacggcagaaucucugguggaagagcucucagaggaugcagguggggagcugagggaaaucaugcucagguugcugucuguauuaugucuucucguuuauaaaacacugcuacaauaccccuuucucacagaaaccagcuuuaucuccccagcauaacaagcauguccauuaguugacgaguaugaaaugugcuuugaaagacccuccaauauauccuacccuucuuuugcccacacaugcuuaccuguccucagguggcugggcagauuccccugacccaucacuccugccuugcacuuccgccacagcugguggggcauccccaggaguggagcugccugcucugggcugcucagaacugccagcugcugaagugucacccacagccuccucuaagguacaggaagccaggcugcuuguauccauaggagagccuucuagcugacugcugacagccgucagugcaucagaauccucagcucucucuggggaaagugaggcuaggaagaaguugcagggagagguuagguuucuaucuggaaccggggcaaaaugacagauaaggucuuugauagggcugcuuccuuaggggcaucucagcucagacuucucacuucucccuugcugucccccucucaaucucacuuugagauuucuaagguucagcugaagcccuuucuaucaauucuugaacauuuacuguguuccaggcaugccugugaaacaucuucccuaggcaaaccagguaagggauuuuuuuuuggcagggggauggagucucacucuguugcccaggcuggaguacaguggcacaaucucggcucacugcaaucuccgccuccuggguucaagcaauucucugccucagccuccugaggagcugggauuacaggcaccugcuaccacgcccggccaguuuuuuguauuuuuaguagagaugggguuucaccaucuuggccaggcugaucuugaauuccugaccucaugauccaccugccucggccucccaaagugcuuggauuacaggugugagccaccgcgcccagcccggguaagggauuuuuucacuuugauucacugcaggcaccacuugcacgugcauaucccuguaguucucuaaauaaacaagguuucgguagggcgcaguggcucaugccuguaauccaagcacuuugggaggccgaggcggguggaucaccugaggucaggaguuccagauaagccuggccaacauggcaaaaccucaucuuuacuaaaaauacaaaaaucagcugggcaugguggcgugcaccuguagucccaguuacuugggaggcugaggcaggacaaucacuccaaccuggguggcggagguugcagugagccaagaccacaccacugcacugcagccugggugacagagcgagacuuuuucucaaaaaauaaauaaauaaaauaaaauaaaauaaaauaaacaagguuccuugaaagaaaaaacugacaccuuagggucucuccagagaacuucacaagcaagaugguauagagcagggauggcaagcagguaucaauuuauccuguugaaauacugcugagaagacuuuucaggccccauuucaaaccagugagaaauagugucaugagauaaacagugucugccaggagaaugggagagcucuaagugugggaugacaugcuugccauccugggaacuguggaaggagagaguaaucuuuaaagucagacagaucuggguuuuaauucuaguucaaccacuuacagagugacuugggcuaauuauuucauuucugaguuucaguuuacucauguaaauaacaccaucgauuuuggagaguuuuuuuuuccccccaauagagauggggucuauguugcccaggcuggucucaaacuccugagcucaaaugaucccccugccucagccucccaaagugcugggauuaugagucaucauacccagcuggagaguuguuuuuaaauaauaagccuggggugauagcccagaaacagaguaauugccucaaugaacuguugguaucaucaccaauaucauuagacauucaacuaucaccaguucaggaccucaacuucacuuaagaaagugaaugcgcaagacgagaucuuauuauuugagaaguugaacuccuacuauuucucucaagcaaaagagcaaagagaagcuacaaagacauccuuucuucccucuuguuucauccuccccaaauguugaaauucuacucacuuauagugggagcuggggauaacuccaucugaguuguuucugcuuccccacuuggccuugugggacccaauuccucuggcucuacaggcaucaauagcuguguagagcugcccccuucuccagcuggagacugcagcuccugaggaaccucucccaaagcuggugggguugggaguguugguugcuguugugaggauugcagagugccaagggucuccuuggacucagauguagcugcaucaguugaagaugggguuguuggguagcugucaggcauaggcgucccaucuuucucggaaagaacaauaauagugguuaaggggcaaccagccaaugaugaggggagccaccccaaucagcaaauguggccugauaaguaucccacccagccagugaucauccccacaacaaaaauacuccaaggaacaucucuggucugguauacuaaggaugaagguuaaggcacagugcuaucucugucccaagaaugcaagaacuggagcucugacucuguggauucuaagaauaaaauccuuucugugcccugcagguggaagggggaagauuucaggccauauagggugaggcuaaaugucucugaccuauagguacacagaaaaucuaacuaccaaaauccuauugauccucccacuucaucuauuuggagcaagaaauggucagaauuucguucaaaacucuauuuguuuuuuuuggagacagggucucacuguugcccaggcuggaguguaguggcacaaucauggcucacugcagccuucaccucccgggcucaggugaucuucccaccucagccucccaaguagcugagacuauaggcaugugccaccauaccugacuaauuuuuuguauauuuaguagagacagggucuugccauguugcccaggcuggucucaaacuccuaagcucuagcaauccacccaccucggccucccaaagugcugggauuacaggcgugagccacugcguccagcccuucaaaaucuuuuuuuuuuuuuuuuuuuuccugagacagagucuugcucuguugcccaggcuggagugcaguggcguguucucagcucacugaagccuccacuuccuggguucaagcaauucuccugccucagccuccugaguagcugggaccacaggcgagugucaccaagccuggcuaauuuuuguauuuugaguagaggcgggguuucgccguguuggccagguuggucucgaacuccugaccucaggugauccacccgccucggccucccaaaaaugcugggauuacaggcaugaaccacugcgccuggcccaaaauucuuaaaguaugcuuuccauucccuugcacacauuccuguucuauuacuaauaaaaugcaaucauuacacaguugaagaauagcaaaaugaguucaugcccaaagguaaaauaauuauaugcuccaauuaaugaaagacaagucacuuuauaaugacaucugccucacccuaaacaccaucuguccccuuccaugucucuuuucuuccaguccaaauuauccaaggaacaucuacaacuuugucugauggaggcaacacugcuaagacuaagugugaauaugccacacaccagggaaaguaguaaguuguauaguuaucuucuaauuggggccuaauaucccuaccccacaacaauacaacuuacuaccucacccuggcaugagcagaauccucuaauaagggcagcaggcaaaaggccauuuuacauggugacagacucuuuuaaagaucuuuugcuagauuaaggguaccaaggcaucuacccuacuucacugcuuuaaaaaauauugugcaggcuuugguacaaucauuuuccaacucaagugcgaaaggagacagguguagggaggcagaagaauguucugaggaaauaugggugggggagacauaugauaucacaugaaccaacugauagaaucacaaaauggcuacugaccauuguuaagaagaucagagggaauaggaaacauacggcagucauaccacuaagcccagagagcuaccuucaugaacagcacacuauccaagacaauguuccuagacuuuuagauuccauggaccaauaaaauuuaauuaaaaaaagaacaaaaaguagagacuaauguagggguugccaacuuuuaguuuagccauguaagaaaaaacauccaaucaacaucauuuaauaaaaauauuuugguaccacagaauuaggaauaugaucucuaaauacaaaaacagccuuuuaaauggaauaaauucagcuuuaugaaaaaggcauuaaagcuccuugauuuuguucguuuccacagaggacuggcauuugagaaccacugucaucaguuauucucaugaagugccacaccaugguggucaucaaaggaccagccacuucaaagauguacaugaacaugcuguuucagaggacagaguugcagucaggaaaugaacaagacacaugaccucauuacccaugccagaacaaaguagauaauaaccagaacaagaaccugaacagagccagucggagaagaaguguaccaccgugggaaagacaguagacuguauaguuaucuccaagaugggguaugacccuaaaacuauacaaucuacuaccucaucccacagagcaccaguguccaucuucagccuaugugggccagcuacucggaacuaucaggauaaagaagcaaccaauugauuaguaagaagggagaaagggaaggagaguuaccugagagauucuguucaguggagucauuugacuuagaugcaguacacugcaaaaagaagggauagaccaaugugggacuuugcaagcaccuaagauagaggucaacuguaauagucaccauccuccacccagaccaucuaggaguucagugaucuaauggagaaugcuuuggccaugugaccaaaggaaggugaucauuucacugugcaaauauaugaccaauuucucuauacauacucagguucaagaauuguuuggggcugagggggaaauaaauauggaaggaaaggauaauaaaaaccccuuagggaugggcacgaucaugaucauucuagcaagaauuucuugguuucaucuauguauuuuuucccuucauggggcuuauuuuuuauuuuguccacucuagucuuuucagucacaggcuagguucacuuauuuuucauccuauaucaaguuugaaacaauguguguauuagguaaaaaguucuauauaaagauauuuguuagaucaaccuuguuauuuuaacugaacacuucacuacccuuauuuuuaaucuaccugauuccuuaacugcugaguaggguauacuaaagucuuucacucucaagucuuauuucuuuguauuucuaucaguuuuucccccuuuuauaucaagugauacacuguaauguauaauucuaucaacauuuacucagacauuuaaaagaucucugucugaggucccagaaguuucagaaaaaaguagguaacuuccuucuaaaccaaaauuguauuagugauuuuauacaugugagcccuagaaaaaaugacauguggugaugggguucagaguacaaacauuuucucugaucugacaccuaggcugaucuuacucaaaugacggaauggggucaucucgguaagauuccccacacuggcaguucaccgacagaaauggaagugggcgacuaagagcauggacuuagauaagguuuuucuccuugucuugaugcuguccuuggcgguagagacuaugcagugugacuguugagugagaagccauucugcuucuggcuccaguuuuucccuugacacuugagaaaucuccccucuagguuugaauucuuuccccuaaaaaccaggucaauguauggugaauuugaaauaaaaaauuucccagguucaacgugaacguucuaggauucuucagugauuccuggugccauguguaugccaaaaccacauuacggcagacacagucaaagaugaauccucccagcccuugggaaucaccugugcacucugaucccuguucuccuuaucuucuuugccuuuaucaguuaucuuuguuucuuccucagccaguuguuuccugcgcuucucucgccuuucuuccagcuccucaucccucaggaauuccaggugauugacaauggacacuuuaaccacuguuucaaagaggcaaaaaucaaaggcugcucugguggggucagggaggaagccaagaggcagagcuuguagccacagagaaccagggaaacaacucuccacacguuugcccuagcucuggaaggcucacuauugcccugauaaccaagcugccacgcaccugaaacacagucaugcaugcucucagcaucgagaacuuugcauucuucuguccagcgggucagggcuguggggaugcuggacaggguuccuguagggacagcaaaggggaaugagauucuuggccuugucaagcauuaacugauccaccgauccaaaaauugcaguauuucccuaaaaggacccaaggucuaucacaauguuuagaacauaacaaguaccuagagacaauaaaguuuuuguugcccauggcuaagucacugagugguucuggcuccuauaaaauggggguuuucuauagggcagacacugucuugcuuuuccucagcagggaaaaaguagaaucugacaaauucuacccucccuuucaccacacaaacuugccugcuuggcugguagcugugcucugaucauggaaaaagucauccagcagcucaucaucagaacgggcgaugauguggacgucaucguugccuaccaggaggcgggcccgaccccggcuuuguaggggaaggcugcugcucagcugaaggaugucagcagcagcugagggaccaagcaaccuguaggguaaugguggguaccaugaucacuguuaaguccagaggugcccugcaaccuguuaccaugagauccucuucaugcauccucuauuaaaugcagaacaugauuauaaaccugaugaugugcacacaagucuaaguuauuuuucugaauaccacccugguuuuguacuuaaguuguauauuauuccauaguuccuggcaccaagugggugucaauaagcucccacgugccaggcacugcgucaggucacauugccuccacuacacccucucugucgucuguacaccaaccauuacaacacuuauaugccuuucuuuuacuucuuaagauuguuugucucacuaaacucuaagccugagggcagggaucuugucccgucuauaucuaaaguguuaagugcuuggcaugagacacuuaauaauugcuaaauacaugcgcagaacuauugacauaauuugguauuccccaaaaggcugcacuccccaaaaggcuacacauguaauccacaaagaaauggaacaaauaccuuauuuguguguaugacaagaacauuaagugauggacuauuucccccaagguuaagacaaugcuaaagcacagugaaaauucuuacaagagcuccgaugaauccaacagaucucuguaacucaccucugcaguauaagaggaggguugggcuggcgauucccaggguagugaacaugaaugguguggccaguauuggccgucagcugccuuaggguccucugacugcgcccgaugcccugggugagacgaguuguugaagagccacugcccagugucagagaacuguggucugcauggcgcaccaucaguggaugggugguagggauauuuccuggggauggggggaugucugcugcaaggacaauauguaaaagggucagugucaaaaagaaauuucuuccauguuuguucaagcagaaucaugucuccugggccuuacuuccucacacggaaaccugagcuuuguccuuucucccucauucccacaacucaucuacaaucacugacacuaccauagcuuaugccaucaucucucacuuagauacugcaacggccuccuaaauaguaccuucucccaauccauuuuccacacuacagucacagugaugcuucuaggccccucagauacaugcugcucccuucaccuugaagacuccucucccgcuucuuuaccugcucuucucuucuuggccuaagaugucacuuucucugugaagccugacuuccacagauuggguuagguaacucuuuaccucugugcucucuuacuauagugcaauguaaugccugcuuaguuaugauuccuaauaaaccacuccuaugaggaacgaggacuguuuucuucuuuacugcuguaucccuaguaccuaggauacaguaggcacuccucaaauauuguucaauuugcugaauggacagaggcucaacucuaagggaaacugaugaaaaucacaaaaaugcaaaauaaucauagauguuaucuucaaaguuaucuaauccaacccauuuuuuucucgaacuuuucauuuacaggugacaaacugaggcucaaagagguaagagauuaauuggccaagaaaacagaccagaacaguucaguguuuucugcuacaucaugcuugugauuuaaguugucaagaccugcccuaucaagacagcuugauucuaagaacucgauucuaacuugacgcuaaaagggaaguuucacggugaugggggaggaagagauucacucguucucccgaaaagacgcauccuggaugaauagagugaguauguucaaaucugcuccccaaagccaagcucaaaggugaccauucaaacccucaagaucuuguguuauggacauaaggauuauugauugcccugccacuguggugugcacaugggugccugaugcagucagccuuggucucuuucuuuuuuuuaaucaagcaaaucaucaaguuguccaggcucuaaaauggcugccuauuuacugaggugaagggaacaaaagcagccucucacuauuccuucuccuaaguauacacuaaugagacagauggauucagauaucccuugccccaggaagucagcauaggaaaagaagugcugucuguaucggaucgguuugguccacugcuuggcuuacccuagagaaggguauaagaaucaagagagaaaaacccagcugagccccuguaucuuacuagcacuggagaacauguugucaaacucaaugaugagaucauccucccggucaaagcgcucaaaucggaccaagggagaagcguucauaucaggauaauccucauccaauuccaucucagagccaucgucgucaucgucuucaucucccucuucaccuucaucauccuccuuaagggaaaauaggagauggagaauugcuggagguaaggguuuucugaagccuggugccauggccacaugugcacaugagggagggagacgcugaggcuagcaacccagacuguugguuuucugcagcucuauguucccauggaagaggucaucugaaccaacccaaacgcaguccccccucaccugaucaucuuccucaucuuccuccuccuccuccucuucauccugacuaucauccucauccucguuacugccacugcuguccucuuccugagugugcuccuccucauccucaggguccaggauauucauggaaucuaaaacaaagggagcacauuggaggacuaaacugaguagcuagaaaacaggcuacugugcaggccagcaggcugagugggaaggugaugggauaucugacucuaugagaggaagaaccagaucuggggugauguacagacuuagugagccagacccgauuuccugagagugccaaucaaugcaucaacacacugagcaggguggcugaauguggaggcuggcuagaggguggugcuugaggagccauggucuaggacuuggccaagucugcuggugcccccuugccuuuucagcccuacuuugcuauugacuauauccuguuggcaagagggaaccuggagcgaugauagcaggugggugagaagaaagcgaaccaaguaagaagugacaaacuuugggcaagcaguaguaacauguuauuugaaaaacuggcugaggauaaaguggaugguguaugucagcgcaugcagacagaugcuuccuuauucugcacaugugggcagcugccuccaggaaaacccuaguguagugucugucagacgugcagggcaagaagggaggccuuucuggccucggcacucucaccuucucgguuggccugcaagguggaagcuuggcugagguuggaaggagcuucauccaucagcacguccucuugugauucauccucuccacuucugcucacugaagguuacagagcagagccuucacugaacaacagaggacuucccuuuccagacugggugcgucuaaaguagcuauguacaccuagcagauauccacuuuuuuuuggaugagggagaagaccuggauugucugcugucagcuagcuaggugagcuuggccagucacuuuaccugucugagucucaguuuccucaucuguaaaacaggaugaucacaucugcccugccaaucccacuaauugugaaaccacagaggauacuggguauaaaaaagcuuuguaaaacuuaagaauacgugucuacuuccauuuauccuuugauuuccuugaucaacaaaguaaaaacaaguaacacauacacccucagagccaggugacaguaggguaccuuugccauuuucccucugagauuuauaaagggccacccucagggaaugaucauucuuuuuacacuacugagacucaggggcagaaagccccuggacuucauugaagaacugaaaggcagcgcuuucucacccuacagccuccucuaggccuccaugaauaaacacucuuuugaugugcuugauguaucaucuguaucaauggccacucccaccaccucccccacacaggcaacacuuuagacugccacaggccuguagacgucuugugaauuucucaucuguaagaccgucaacaucaagacaagcagcgaucuaggcuggcuaugagcccuuaggcagagcugagcaagcagaugaugagaaaaaggguccucccaagagagacugaggcaaaggaagaggcuauacucaguucuggggcucucaccuauaauuguacuguucccagauccgccaucccucucaagcaacucaucuaucagguccuccagcucauucucaaccuggagagaaauagaacauauauauggaugcacacaagucuaucauugugcuagcaccgaaacccuaaaaaaggccagcaaagcagcauacauuucuaggauaacaugugacagaggauguuacgugaaaccacacauucggugcuaauuagcacagaaacuaccacgugcuaccaauccacaaccagacuauccuucaaauggguccaucccaguuaucugauacuggguugucuuuauacuguccaggaagacauaauagaucucuuuaaagccagcagcuuaggaccacaggcccaauuucuuacccaaugcuaccagcuccagaaauuacaaugcuuuccuuuagggucuuuagaagacugcuguuuuaaugccccagcaagagcuggugcuauaggcauaaggugguguuaaggagcuuccaauaaugaccagagccaaaguaaaucaaagacccggggcccaacggucucaggucagcuuucuacuucaacauuucaccugugccuaaguuuucugguugggaucuauaucauuucauaguacauggcauccuggcccugcccccaccccucuuuuaauacaguacaaacacauuuacugagcaucuacuaagcauaucacccaugcuccucugcaaagcagccagcauugaggcaaggaucuaaaguacucacccacccacaccaccuggcaaggguuugguucagcgccgcaacagggaaaugcugggugaucugccucccuaccugcaucucuugugaacugagcaccucaggcugcccagcaaucaccacugagucgguuucagccuccccauccaugauauccccaucugccaccucugucugagugacaucaugauccuccuccugcacuucugcuuccccaggcucgccugaaacaaucaaccaaccagcaaaauaaucaaagagugccuaugugcugggcaccaugaggcaagcgcaaagacaauaaggucccuuccuugggcaaguuuguaaguucucagagaauaaacgaaugggugacaaaggaaaagacaaggcuacgugugaggauagccaaacaaggcugcauuuugaaggaauucuuuguggggcagauucccacgccacuaugacagaucucuggaaggccagcaaguucccagggaaacaccaccaagccagaacaguugugaucccaggcccauaaagcaacuacucccaccucuccaguccauuggcucugauucccuaccuggguccugcugguugcuacuggaaucuugagaggcuccuugggcauccugcucagacuuguucuugcuagaagcacucuugcugccaaaaaggcuacugggcugguucacaauccgggaaaguguuuccaaaggcuucagagcagcauugacuguguuggccauguugggacugagauaagggaagauaaagagauggacugagcacagaaauacuaggugucuaucuucuaaaugacacuaagcuucuuacaauggaaucuacuaagagaaaaggggcauaaggucguacaacuaacacucuacuuuuguuuagaaaaaaaaaauuuugacuuaaaugucuucaaggaacccacccuaaaagcaagaguuaaaucaaugccauauuucauggggccauggaaagcacaugaguaacaaauucuugacuggaaaucagaauguauucuggaugaccacaugcaagcaagccacuucucggauguacucaggauuuuuuuuuuuaaaccaccagcauuuaguccccaaacccuaaaagcucaaaggaaggaacaugauaaaaguuuuccuuuuuuuuuuuuggagacagggucucgcugugucacccaggcuggaguacauuggcacaaucucagcucacuguaaccuccaccucccaggcucaagugauccucccaccucagguuuccaagucgcugggacuacaggcgugagccaccaugcccagcuaauuuuucuauuuuuuguagagaugggguuucgccauguugcucaugcugaucucgaacucgugagcucaggcaaccugcccuccucgcccggcugauaacaguuugaaguccugugaauuucaaauuauacucuguagggcuuccuagaguucaauaaaaguacaauaggggcugcaguuggaggugugguaugauuucuaaguguaauaaggugugugagaccaaccaggugcccacuaacaccagagcagcucugcuuuuaucugcuuuauguguguauuuaugugugagucuauguauguauguauguauguauguauguguguguguguguguauauauauauauauauauauauauauauaugcucacuaguaguaccaagauggcagucucugauaucacaucacacuaaaaguaaccaagacucgucagaacaagugaucccaggaauagggcaaggaagggauaagguaagccugggauaucucauugugccaaaaagcuuucaaaaauuaaugggacagcugggcgugauggcucacaccuguaaucccagcacugugggaggcugagaugggaggauugcuugagccuagccugagcaacauagugagauccuguuucuauaaagaggaaaaauaacaacaaaaauggggaaaaaaaauuaaugggaucauuaccacaggcccagcugaguaucagaaagaauaaugauaguaauggaauuauucauuacaaaguggaaaucuaacagaaaccacccucccaccucagccucccaaaaagcugggacuacaggcguacauguccagcuaauuauuguauuuuuuugcagagacagggucccacuauguugcccagguuggccucgaacuccuaggcucaagugauccaccagccucggcugugaucaaauuuagcaucacaaguauugggaccaagugguauucaccugucuccugacgugaugugagaagggcaaauaucacccauguaguauuuuugccaaaaauguuuaaccugacccuaaccauuaagggagcaauuacaucaauguagacugugagauguucuauaagacaucaagccuggauucaucaaaacaggaaaaugucauaaaaaaaaaaaaugugacaaccaaaugcaacaugugauacucacugaaucccggaucaaaacacucucccucagaguauaaagacauaauugaaauaacugggaguauguguauauaaaauuguauaaauuuaguauuauuauauuauugguaaauuuuuuggauaugacaauggaacuguacccauauaaaggaauauuuguucuuaggagacagaugaucaaguacuuagagguaaaguuuuacaguguuuucaacuaauuucaaaugauucagcuccugaaaggacaggaagggaagaaauaaagcaaaauguucagcagugguuaaucuagguagacacaugguguucauuacaguacugugaguuugacauuuauaaauguuucaaaaaauugauagguuuguagcaaaaggacaauuuagucaucuugaaggggccacauaggucaaagguguaauaauuugagcaugaaaaagugacugcagugauccaaauaaauucaaucacuaguuucaaaacaaaacaaacaugaaaagucgaguccauaauacgacuuaaaaauagaaagccagaaaaaaaccuacauuugaaucucaaauguaaauagaaagaaauuaaguuuuuauacugccuuuauaauagaaauuauauuuuagcacaaccagacauucccugugaggcuaacacagaaaaaugccaguuaauaauguauucgaaaugagaaauuagaaagcuuuuauucauaagccucaaagaaauuaauugauccaggcaagaauuaucaacugauguuaaggcuauuauuuagguauaugauugauaguguagacauuuguaaagugccaaaauaacaacagagaugacuuucuaguaagaacaaaaagugacaauuaucaugggagaugugucucccacgauacaauaugagcuauacaucaccuaggcuacacauuucagcccaaaauguuuaaacugcuucaauaagccucuaaagccucuagaucuaacuagaaguuuacagaaaauaucaggaaguaaaggauuaaguuaaacuacacugcaaggaagcaacugcaccaaguuuagaaggcaaaaacacggucgcuucaacaagcuggaaucaugaacaacaaaaacaaaauaaagaucgaaauaaugaaaaaaaauuguuuuagaauaagagagauucagaaaacauagccagauguaauacaaguccuuaauuggauucugguuuggagaaaaaugcuuaauuauggauuugggcauuagguaggaugaaacuuauuuucauagcaaggaagugaccaguaacugaaaauaaaaacgaaaaugccccaaauuucccccaacacaauagcauguaucauaucauguuaguaaagaauacauuauuuaugcaugcaaagaaaaacacugaauaauaaaccaauaagguaaucaugguaucugggugguaggaauacagugucuacuucuuauuuuuacucaucuguauuucuuauaauauacauauaaucuucuaauaagugguaauuuuuaaaguggggggaagcuugaaaaaaaaaucacuauuauaguucaacucuugaguuuauagcaaguaagaaccaaggcuuuaagaaagacaagugcuaaaagccacaauaagaaagacuugggucucccacuuguacccaaaguuuucccacuacaccagcuaccuccacaucauucguguagugaggcugaagagaaggaaaagccuggggcuggggcaugauuuuaccuggacaggucuaagcugugagguacucuggccaggucauuaaccagucccuucuucaggaaaagccgaaugauguuguucaugccauugugcugggucuucgcuguggcacugcuguagaagcuggagguggaggggcaggacuccaugauaguacugaugauacacaucacugccugaagccugggagagaaguuuugacaucucuaucauaugaauauagccauuucucaggccaagucuucacaaaauagccucagauaacccuccuguaacuuuuguauuuccuucuggaaauaacaucuaaacaaacaggugagaacacacucccuaaggugauagcauucguuuucucuuuuuuagacagggucucacucuguagcaggguggaguacaguggcgcaaucuuggcucacugcaaccuuccugggcugaagugacacucccaccucagccucccgaguagcugggacuacgggagcgugccacuacgcccagcuaauuuucuguagagacaggguuucgccauguugccaaggcuggucuucaacuccuacuccugggcucaggcaauccaccggccuuggccucccaaagcgcugggauuacagacgugagccaccgugcccagccccuacuuuaaauaaaauuuaaaauauaagaucaaauaaccugcucaacuuccuugaagaccuuaaaaguacacuuaacauuucccuuuguuuucucuagguuuacccacuuacucuaaugguaaucagugcucuggcuauuuccaaccgccagaacuauuugagcggaccagagaguauaugaugccaguaugacaagaaguuuuguucaagugcaaaaccacccauggacuaagaagaagaauaaggggauguucuuggcuauuagcccugggacagguaugaaucuuaccuggcauguuucucuguacucucagccauagccagugcccguccaagggcugcuuuuacuucauucacuagggccaccugggcaucugugccacucccugcagcagccaggcuugcgaggaacaggcgggccaaggcagggguguccuugucuucugcauucuggguaugugggagcaggugguccagaacaaaagcuagcacacugcaguccugaaaagucaugaaucacgacauuuacuuacaagcacaauuaugccauaucauuugcacaggaccaaagauacacacacacauaguauuuccuuaagucacccaaugagugauuauuagguccacuuuauagaugaagaagccaaggcucaaagauacaagcaaguaaggagcaaacccagauuuuagaaaacuuccaaaugccacccauuucccacugcacagcuuauacacuguuauguagaugucauguauuuuuaaaaacauuuuuuaaaaacuuuauuuuuauuaaaauguuuuuaagaagaugaggucuugcuauauugcccaggccagaguacaguggcuauucacaggcaugaucaucgcacaccacagucucaaacuccuguguguguguucucacaccucagccuuccaaguagcugagacuacaggcaugugcuauugcaccuaucuuaaaauauuuucacaugugauauuuaauagaacuacuuacagcaaaucuauaaauagauaaguauuuucucauuugauaagcgguaaucugaagcccccuaaagaaguggcuugcacagaagaauuuaaucaagggcugaggauucaaaccuugauucuuaauuaagugcuauaaacccuucaguguucaauuaaauugaaauuauuuacugacaccuacaaugugcccaggacccugugcuacaauagaagcugguaagagcugagcaagagacagcagagucacagaaacuaauaugcaaaaauauuuaaugcaagguuauuuaaaguaacgaaaaaggcucaauagaggaaggaaauuaagucagacucuucuuuuuucucuaacuacaauuccugccuagacaauuccuuaucuuagaaacaaauucuauugucauucaagcaaauuuuggaugaaaauacacugaacauuuuuggaacuacauaggugacaguugcacaacacugcgaauguacuaaaugccacucaacaguacacuuuaaaaugguugacuuuauauaaauuuuaccucaauaaagaaaaugcauugaauaauuugagagucugagaaacugaauaaagugaccuugucaaaacaaaacaauuagaaauaacaauuaauuucccaguagugaauacauacaaaguuaaaacuauuuucucaauaaccacguagaaaggacuuagcuuuggaaucauagcccuagcuuccaauuuuagcucugcuacucuguaguauggucccaggcaaguuacuuaccucuuugagccuucucuccucuauuaaagagaucacuaucaacaaccuugcaguguggaggugaggauuaacaauaguauuuauaaagcacuuaccaguacccaguacugguaggacacuggacacauauuaggcagauacuuaauaaauuuguaauuaaauauguuaacccacagguaauacuauuauaaauuaugaauacaacuggcauaaaugaguuaaagcuuuggaauaaagccuggcuaggugugauggcucaugccuguaauccuagcauuuugggaggcugaggcgggaggaucacuugaggccagaaguuugagaccagccugggcaauauagcaagaccucaaaaaauaaaauuagcugggcgugguagcaugugccuauaggucccagcuacuugagaggcuaaggugggaggaucacuugagccugggaguucaaagcugcagugagcuaugauuguaccacugcauucuagccugggagacaaagugagacucuuaaaaaaaggaagccuauuuauguauuuauaggacuuauguccagaauauauuuuaaaaacucaauaggaaaauagaguaaaagagcugaauagacauuucccaaaagagaaugaacaaauggccaauaaagacaugaaaaaaauggucaacagggaaauguaaauuuuaacuauaaugcaauaccacuacaaacccauuaaaaucaguaaaaugaaaaaacaccaacuguugaucucccauaugcugcugguaauaauauaaacugaccuggccacucuggaaaacuuuuagcauuagcagaacaacuaucauacucuagagcucagcaauucuuacucuuaggcauauacuacccaacagaaauuggguaguucacgaacuuauauauauucauaagaaugcucauagcagcacuaucugugauagcuccaaaggcaaaauuacccaaauguuuauuagcaguagaauggguaaaagauguauuuguuuugguacaugguacauuccacaguggaauuuuauacagaugaaaauaaacuucaccugcacacaaaaugaaucaaguauguuaagcaaaagaagccaggcaaaaaagagaguacauucuaugagauuccauuuacaugaacuacaaaaccaaauuacggcacgagaacucaagauaaugguuaucuugagugaaggugaaaugggugggaggagaugcacuaaagaacaaggagggcagcuucuagggagcuuguaaugcuuuauuuaacuuggcuagugguuaccuaggaaaaacagacuauuuaagauuuguguauuuuucuauguauauuaaacuuggauuaaaguaagaauagcuuuaaaaauggcgguugcuuucaaagauggcaacacuagugccccuacucacucucagacccuuuugccacuuacuaaccauaaaauuacaaugugauccacaaaacaaggcacccuuacgggaaaaaauauuugggcacccauuuuacauaugcgggaacaugugauacaguuucucaaaaugccccacucacuuaaaaaaucuaaccugaggauaauucugcaucaggacacuucauucuuuuccacagcucuacuaaugaacauuuaaggcuuuuccuuuauuuuuauuaccaauacugcuaccacaucuggugucuuugcacaugugugaguacaucuggaagaugaacaccuauauucuuauuuauaugguuuauucaacuguccuuuagacacuuuuacuuagaugucccacagauacuucucaaaacuccucauuuucucuucaaaccuuccccaccccauucuauuuucuuguuagaugccaacccauaaaagcaauuaaaaaaacccccacaaaucaagaaacauccuugagucuuaauuuccuuuuucaucuuccaaacccaauucuuguccauuuguaccuuaaaaauauuucuucaacucacccauuuuccuccaacuucaccaagaucguacguuacuagauuacucuaucagauuccuaacuguucucucugacuccagucuucccucuucaaucuccacaaugcauaaaaagggacuuucaauagaacaaaucucauuaacucucucucucagugaaccuaaugaaaaaaggccuagcucuuucagguuuuuuuugagacagaguuuugcucuuaucacccaggcagguguacgauggugcgaucuuggcucacugcaaucuuugccuccuggguucaagugauucccgcaaucucugccuccuggguucaagugauucccgcaaucucugccuccuggguucaagugauucccuugccucagccucccgaauagcuggaauuacaggugcccgccaccacgccuggcuaauuucuuuuuguauuuugaguagagaugggguuuugccauguuggccaggcugaucucgaacuccuaaccucaggugauccgccugcuucagccucccaaagugcugggauuacaggcgugagccaccgcacccggccuugcaugucugaagaugccucuucucacucauuacuuggguuagcacuuagcaugcacagcuucccagcagugucugacacaggcgguacccaaaugauggaaguacaguguaacaucuuaaauagaaguuggaaauauuaccucuuugaucaguucagacuggcccacaguguagcuguaguuggcaaucaggguagcaauaccaacauaggaccucaccaacucugccagaagacgaaggauaguggagguaggcauuaaagguuugcugcccuugccuuucuguuugccuuccucagaggcccgguccccuucuuuaucuuucuucccaucucgagacuccucuggaguugaagcuguugagaaaagucaaacacugguucaauuccacacuggaacacuggcaaaaucaagucuuagguggaaaagaaugcuauuucuccuccacuuuaagccaccuguacaaacugaaugcucucgugacacugcagugcaagagcagagaaccaggauaacucaggucucagauuuaugugguuacaguacaacagggaugcuuuguccaacuauuugugcaucucccuccauuucccuccuuuuacauacuccagaaacacucuacuaacaguucuucaaacuugucuugcucccuuacuucuuucuuccgucugccuggcacacuuuuaucuaguucagcucaaaugcugaccuccuccauaaaugcuuuccugucucaucuagacauacugugagauacuuuacauguccauuauaucuuauccaaguaugccuucauucuggcaguuauccugcauuauaacucuugcaggucucagucacuggacaaaguacuuuaaguacagggaacaaaucugauccauuuugguguccaauauagucugccacauaguggguaaugcuucccuugaaucagcaccaucauccacgcuauacacuacauauggccaguaaacccaguaaaaugaguuaaccaauuauuucacuaauguuagccuuuuaaauuuaucuccaggaacuaguaugauuuuaaacaaaaugucuccuaaauuggaucacaaagaccuuuccuaucuaaggagaagcagcucuuuaaaggucucauuagacuuacucccagggacauuuuucuaguucauggugaguagucaaugggcucuguuaacauugcuggaagacaggcauccaccacguaaagcauguagcuagaacaauaucacuggcauaaaaucucuauaagccaguuuuuagaaaccccccaaauaauuauggugugauuuaaaaaguaaaacuaaaauauguuaccacagcaaccauuacuagguugguuaacuuacaguuccauuaacuuuagcauauagagacccuuuauuacagaacacugagcucaccugagaaaguucacuuagaccaguaaacguaauaauuaagucuguauucuccuacccccugcacaggacaccuacaguuuuuucaaguuguuuuccuaaggaauaagaacaugguagugagaaaagcaaaucauuacccucuccuugggaggucccagaugcggaagucucaguggaggcaccaucugcagcaaagaccugacucugaagaagaagaaaacuccugagcuauuaugaauuucaaaagcacccgucugcaaauggcagaacuccuucccagggcacuggcugggaaugccacagauucucuuuggccaaccuuuuaaccaccuuacaccuuuauacuauaaucugugggaggcuauuauaaauacagugacugggagacugugggggaggcggggaaggaaagggaaaagaaaaaaaauuaaagaacaguucuaauccuaggagagaaaaaaaagucuccagggacaccccaauuuugucuuuacaggcaacagauaauuuacagauacaucacaauuaauaucuuugaaauuccccggggauagcccuaaauacugagaccacacaggcauugaaaaaugagaagaaagauaaaacgcuguuggaauugacuuacauuaauggaaaaaccugacugcguaucaaagucacugcucugacgcguaagugaccgguacugcugguauacaucaucacccaugucuugcaggagcuggccaaccucuugggucauaaccccagguuuaggaucagauuuaucugcuaggaaaacaguaacaaccaucaaaaacaaaauaaaccucuucuacaauuggacaauguuaaggccuaucuagucagucuuggucaauuucacaucaaguggcuaugacuguuuacauggugcuauuacagauaauguuagagugccucacccuaaaauuacaaaaacuagucuugugaccacaggcaauuaacuuagucucacuuuccuaagcuguaacuacaaaccuuaagugaacauaccuggcacuauugcucaugcaguggugggucaauaaaugguugccacagcuauauagcuaaacuauuucggggaggugauaagagauaggguaaagauucuggggugauaggagaaccaaggaauucuauauggaucaggguucuguacagaugaaaagcaccaaggucaagacucagauuucuuuugcuuauuaaaggcagcauucaucaauuuuuggcaauucuguggaccuaucaaauaaguauguccugaauaaaauccagaaggaccuuacuauaauggaaaccuauguuccaagcaaaucaaucaugacuuuccuaaugcuuauaagaugcaccuuaacuaggaauaaagguggaugggugugguggucucaacaguuaggaaacucagacacaccuccuaauauugccuccagcucuucagacaauaaaaagguuuugcuugaguaugaaaacauuagagacuuccuggugucuuauuuucaaccucucacagaaugcuauuaucuccuucuaaaucuuuguucauucuucccccguaugguguguauucucauauaacagaacucuggcaaucucauccauucaagguucauuuuagaaaucauguacacaaagaaauuuucuuaccugugcacccucacuagguaaggugccucacccuaaggacuuaccaccauccugguaugucauacuauaugacuauuagcuucuucacagacaugcaauggguaucuuauucaucuugagccccagaguaugggcacauagugagugcucacuaagccaugaguuggcugaaaugacccaggcaaaguaacauauccucuagugcccagccuccugagguaggcuagccacauaccuuccucuggagcaugguaugcagccagagcauucagcauaucauagaucacuuccuugauaguaucagggaugacaggcagaggugagggcuucaaagggguggucuucaccagcuguacagcauuagggccuuuaauucuaagauucucaaauucaucaucugaagcuaagccaaaaugagagagaaaaaccagucaaucaugaagcaguaccuaaacuagguuacuaauaaagacucagaagggggcauguaugauauagaaggcuugagauaggagaccauuuucaauuaauguucaaguacucuacuauaaaaccugguuuauacuuuccuuaaauuccacaggauuuaauauagcaguaccaaauaguaaaggcuugaguuagagaaaacugguuuugaaauccaguuguuaauucaacaaaccucaauuuucucacucuccaaauuuauguugaggauuaaaugaggauauaacugagaaaugcccagcacaggggcaggcacauagcuggaacuuccaaaauaauuucauccccuucccaacguuuuauuaaaaaaaaaaaaaaaaaaacucccucucccuccucucccuccucucccucucccucucccucucccucccucuccccacggucuccuuccauggucucccucugaugccgagccaaagcuggacgguacugcugccaucucggcucacugcaaccucccugccugauucuccugccucagccugccgagugccugcgauugcaggcgcgcgccgccacgccugacugguuuucguuuuuuuuuuuugguggagacgggguuuugcuguguuggccgggcuggucuccagcuccuaaccgcgagugauccgccagccucggccucccgaggcgccgggauugcagacggagucucguucacucagugcucaauggugcccaggcuggagugcaguggcgugaucucggcucgcuacaaccuccaccucccagccgccugccuuggccucccaaagugccgagauugcagccucugcccggccgccaccccgucugggaagugaggagcgucucugccuggccgcccaucgucugggaugugaggagccccucugccuggcugcccagucuggaaagugaggagcgucucugcccggccgccaucccaucuaggaagggaggagcgccucuuccccgccgccaucccaucuaggaagugaggagcaucucugcccggccgcccaucgucugagauguggggagcaccucugccccgccgcccugucugggaugugaggagcgccucugcugggccgcaacccugucugggaggugaggagcgucucugcccggccgccgccccgucugagaagugaggagccccuccguccggcagccaccccgucugggaagugaggagcgucuccgcccggcagccaccccgucugggagggaggugggggggggucagccccccgcccggccagccgccccguccgggaggugaggggcuccucugcccggccgccccuacugggaagugaggagccccucugcccggccagucgccccguccaggagggaggugggggggucagcccccggcccggccagccgcccaguccgggagggagguggggggucagccccccgcccggccagccgccccguccgggaggggggagggggggucagcccccugcccggccagccgccccguccgggagggaggugggggagucagccccccgcccggccagccgccccauccgggagggagguggggggaucagccccccgccuggccagccgccccguccgggaggugaggggcgccucugcccggccgccccuacugggaagugaggaccccucugcccggccagccgccccgucugggagggaggugggggggggucagccccccgcccggccagccgcccaguccgggagggagguggggggucagccccccgcccggccagccgccccguccgggagggagguggggggaucagccccccgccuggccagccgccccguccgggaggugaggggcgccucugcccggccgccccuacugggaagugaggagccccucugcccggccagccgccccguccgggagggaggcgggggggggggucggccagccgccccguccgggagggaggugggggggucagcccuccgcccggccagccgccccgucugggaggugaggggcgccucugcccggccgccccuacugggaagugaggaccccucugcccggccagccgccccguccgggagggagguggggggggucagcccccgcccggccagccgcccuauccaggaggugaggggcgccucugcccggccgccccuacugggaagugaggagccccucugccuggccagccgccccguccgggaggguggugggggggucagccccccgcccggccagccgccccauccgggaggugaggggcacuucugcccggccgccccuacugggaaguggggagccccucugcccggccacgaccccgucugggaggugugcccaguggcucauuggggaugggccaugaugacaauggcgguuuuguggaauagaaaggcgggaaggguggggaagaaauugagaaaucggaugguugccgggucuguguggauggaaguagacaugggagacuuuucauuuuguucuguacuaagaaaaauucuucugccuugggauccuguugaucugugaccuuauccccaacccugugcucucugaaacaugugcuguguccacucaggguuaaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaaaaaaaaauuaaaaaaaaaaaauaaaauaaaaaaacaaauccaacaaaccuacagaaaaguucgaauaguauaauaaacaucuauauacuuuucauccagaauuaccaagugacuacuccuaaauacaucuacuuguagcuccuaagaucaaggacauauauuuucuuuuuuauuaccaaaaaagucagcagaggggagaucaaggguauuuuuauacagaacugcaauaccauuauaauaccccccaaauuuaacagauacaauuacauuaccuaauacauagcacucaaauuucuccaaaucuuuuaucuggauccacagcccaaccaaggcugguggugauuaucucucuagucuacuuuucucuauaagaaaugauccuguauuuuuucuuucauaacauuaauauuuuugaagagucuaggccaguugucuuauauagaacaucucacaauuuguauuuaucuaauuguuuccucauaauuaaauacaggucaaacauuucuuggcaggaauacacagaugacgucuauuucgcacuguguuacacgagacauacauccauuuaacccuuaauuaucacuugauuuguaaaccauuaacuauauguaaagccuacugccccaccaaaaugagcucuuugaagugaaggacuagaaugaaugaguccucagugucucuggcagggauuacaacagggcaaggcccagagaagcuacugaaguaccuaauaaauugacccaaacaaucaauuagccagcaaauguccuaauacuugccuaaggaggcucuucaaguuacagaccuccucauaaauaaauuucuggauuuauaccaggccacaaacuuaauaucaaaggccaggagcaagcgaaacuuaccaguuccugagccucgaggggcaggaagggcgaugcggauacagcaguuggccacuucugugaauaugucuggauugcggcaugcggcuggcccaaggacacgaaggauguaguugaucucccgagagccgaggcugccagacacaacaccagagguagugcuaccagcuccacuuguagcugcugagcgaacaaccuaguaaagagagaaagaaacacugucgauuaaacacuacuuucuaaaaauacaacugcagucaagaguuaccaagacuaaaagcuuuugauuuuggggagaaugacauuuuauuuuuaagucccgucccaucccuucuugauucaaaaaaccuggcuuauaaaaaaguugcagcaugucucaaaacuaucaauuauuagaccagacugcaugugaucuuuauagaaacugggagaugugucaagacuauaaaccccacauaacuuccacauuaaaaugucagcuccugagccucuccaaaugcugucacaauuuuaaaccagaaugguucaaaaacauguaacacuguaauccacuuaguguacaggaacacaauuaaauauuuucuuuaugccucaaagucaaccaucagucugagauaaugauagccacuggagauacugaacuauuuauauauuguuugccuugauaacacagggcuuacauauagcuaugcuucugcucuucucauaaaauugcuuguuaauaauggaaaaauccaugaaagcacgaagaaaauaacucaauuguauuauuuuccauuaucuguuauuucacaaacuacaugcucacaaugaaaaacaucuuuugguaucuuaauuuuuuuuuuuuaaaccaaaucaaucaugcccuuuagcacauuauacccucuguaucuugccugucuggcuguaauuauaaaauaauuuccauuuaauaaacacagaaaaguuuaauuucaauauuaaggauaagccauaauuuauccagcccccaacugcuggacauuagaccucuaguuucuugauauuacaagcaauuccacagugaacacucuuauauaugcaucuugguauacuugauguuaguuaucagauaaauucuuagccauagaauuucuaggucaaaggauaucuuagaccaagaguaccaaauugcccucccauguggcuacaccaauuuccacuccuaccgaaaguuaagaguaugccugguuuuccacaccuguacuagcaaugaauaguaccaagacuuuacauuuugccaucuugauacguuaagacugucacugauguuccuuuguuucccacaccccaacuauaauuuaccuaaaguuaaaacuuuaaaaguuuucccucauccaaugaggaccuacacuuucuccuagcacuuugaacuuguaacuuuuaaacauuucuuuauagaaagcguuucaagcauuucaaguuucuaaaaucagaauuuaguuguauauaguuguuccuucccugcuggguuaucuccuggacuguggaucaccauacaagcuaccuuuaacagcucucuuucucuugauuuggcacaugugaggugaaaucaagcaggcuguguaaagaacugucugaagaaucuaaaauguauacucagauauacaaaaacugauaccacuuuucuggcaagcaaguuaaaaaauacuuguaaugccuuuugauccaauuacuaaaaaucucuaaguaacgaucuuaaacaugaacaaaguuaggcacaaaaacgcauauugcaacacugcuuauaaaugugggaaacaaugucccaagagaggaaaacggaagcaaagucuauuaacagucauuauugaugacaaagaaucagcagaagaaaggauuuuguauuaaguacugaggaggaaaagccucacuacuaggacauuugccccucaacccuccacuguugucuucuuuuuuuuuuucuuuugagacagagucucgcucugucacccaggcuggggagcaauggcaccaucucggcucacugcaaccucugccucccaaguagcugggauuacaggugcaugccaccacacccaccuagucuugaacuucuaaccucaggugauuuaccugccucccaaagugcugggauuagaggcaugagccaccacacccagacuauugucuuaacuuuacaaauguuuuuauuuuuuauaaguacguugcuauuucuuccacugguuuguaaguuuccuaaaauauaauaaccuguuuucugaucugcacaauggauauuuguuaagugucuaucacagugccuggcagauuacaaacauucaaaaagcuuuaacuauacuuuuauauuccaaaauacaguguuuugagaauagucucuuggcugaacacccgagagguacuccuacaaaggaaugauucugaagguaugaacuugggggaagguaucccaguucuuuacuaacgguuuuuggcuugguuaaugaaaccuagauuaaaaaaaaaaaaagaaaaaaagaaaaaaaagaaaaccagauugcuggagaggacuuucuagcaauaggaucauccuaccauaccuaagcaagcucccaagcauagaguuggaaaauucuguuggguggaguauacaguauacauaucuagcuauauacccuaagaagaaccagaagucuauuuguucucagaccaaggagaacauagguaugauguaaagcuaaaccagaaucugauacaaaacacacucaccuuuuccaugguaugacgaaggguacagggguccucaaugaugugucuuaagagaagggugaccaggggaguaaacccauugaagccugagcucugggucaaauucaagaucaugcggguacucuucaguucugcaaacaucauggcauauuuguggucccgggugagccucagacagagacgaaggguggcaugcaaaguaucuggguccacagggacucccagcaugcucacgcaggcccggauuaaaacagucaccauaucuucugucaagcccuggaucaggaucuccccgauuuuuguuuccuccaggcuugucuccuuuucaguguuuguacucucuagggccaaagggguaucuauaaaaugggaaaauaacaguuuuagacaguuuaacuugauguuuauuuccucccacgccucccuccuaaguaauuggccaagcacuuggguccuauuaagagaagcaugccaaauaccaauuuuaagaucagaugaaaaagcauaagggaggccuacguaucuuuaaucuguuaaucaagcugaugaaaauaacucacaaugaaauuggccagaccuuaagccacaaaggcacauuagcuuuagguaaaacacucuugguacauaccauugccuuuauuuucuuuacguuugauauccauuucuuugcuuucuuccagcgucuucucuaguuccuguccauugcuguuuuuugaauuuuuauucagccgagguacccugaggagagucagcaucacagggcgucgguucccuguuuccucauuaaccuaggaauucaaacagacauuaaaaaaaccucuaccaaaaaugaauuauaaaggugggggaggggagggacaucucccagguaaaaugcuacaacaggaaggaacucuggcaauuuaucccaccuuuaucauuuacagagaaaaaaccugaaaguccccagaaggcaaguggcauacacaaggccuuauaaugaacuguagaccuuccaacagagcaaauaccaucccuaaccacucccuagcccuugacuaaacacuuaaaaucauuucuaagagggauaguaucaaauugcuacagacccaaggucuaaucaaugaccuuaggaagacucgauuuucugaaaucuauacuuaauuagguaaugguaacucuccuccuccuaacacguuaggaaugcugguucagaaagaagaaaaccaaaacacauaccccucuuuuugauaaaguuuacaguagggguguccaaucuuuuggcuucccuggaccacacuggaagaagaauugucuugggccacacauaaacuacacuaacgauauuugauaagcuaaaaagaacaacgacaaaaaaaccucaaugugugguguugggcugcauucaaagacauccugagccauauguggccugugguccacggguuagacaagcuuggugagugagcauguaccugcaccauuguagugaauuggaccguguaucuucuucggccugcagugaaucgcacgcuugucucuccagauuuccaggcagaaucaauagugcuauuguugcuugcacuguaacuacaccaacgcccagagcgaucaucaaaccagcgccaguuguugcuguuggauugcagguacuaaacauaaaaguacaaaguuucuuuguauuucuuucaagguugauuagaagaaauaguaacuucaucaguguucacugcuaaaacucacccaggaaaaagaaauauacuggacaauaaauuuuaaaaaccaaaagaacauuuuucauaugcauuuacucucacauuccuuagucucucugcuacacgcuuaaaaacaugucuucuaaaguucagguguugaaaacuuaaucccuaauuuaacagugcugggagguggggccuaauaaaagauaauauuaggucauggggacuccgccccucaugaauggauuaaugucauuauccacggacuggguuaguuauugugacuggguugguuauaaaagcgaguuuggacaccucuugcucuuccaccuucugcaauagaaggaugcagcacuaaggcugucaccagauguggucccuuagaucagccucuagaacuaugagccaaauaaacuuguacaguuuauauuaaauauuuuuuuuggagacagggucugacucugucaccuaggcuggagugcagugacgcgaugccggcucgguucacugcaaccucugccucccaggcucaagugaucuccccaccucagccaccugaguagcugggaccauaggcacacaccacuaugccugguuaauuuuuguauuuuuuggagagaugggguuucaccauguguugcccaagcuggucuugaacuccugaacucaaguaaucuaccugucucagccucccaaagugcugggauuacagacgugagccuacagugcccagccuaugguuuauaaauuaguccgugguauuacguuauagcaacagcaaaacggacuaagauacuuuuccuagacaaaaaaacuaucuacagccccuuaucuugccauuuucuacuuuccuuuuguuucuacugauuuucccuaaaaggggaauguucaccugagauguacugaaacaaaaauucuguuuccaagaagguagugagaugauguggcacaauaaucuucaucuaaggaguguuugcuuuuugguaggauugcuguauacucagucccuuacauaacagaaaagccgcuccuccucuggagauagcacacuccuucaaaauuuacuuccagaguaaauuauucagaagagaaaccuagcuaugaaaaucccuuaagagauuuauacauuggucagagacuucuauauucuucacuacucucucauauucucuucuggucuacucuugccucaggaagcuaaaccguccugcagucauacauacuacauuacacaccuuagucaucugggcucuccuuuuugaggagauggcugucuuuucauagaaaucaaucaggagcaacacuggugugauccaccuaaaaaagaaaaaugaucuguuuugggaaagcaagaaaccugcacaaauugggaaaauauaucuuaauuucaucagaugcuuccuuuauaauuuuaaaacuacagaaguaccacaaauuugccccauacaugccccagaagagugccugauucaggcccaugucccagggaaauagaaacgaaacuaggguagauauaggguuacucacuuuggggucuggacuuccuucugcuccuuggcugccuggaggcagggcugaaccacuuccaagaguuugauuaggacauuaaggaugccacuugauucaaccacccaagcacaagguagcuucaacuccugauagaucaaagggaaaaaacaacaacaaccagauaccaauuucuacucaguaacaaagauuagcaugggauaggggaggggaacauaaggguaaauaauaauagaauugguugaguucaaauuuuaccucuuaccauuuaccaguuguguaaucuaagauguguuaaauuuucuaggcuuugguuuccucaugggucagaggaaauaauuuuuaccugcagaauaauugugaugauugagguuuuauauauauuaauauaaaguacccagugccuggcacuaauguauaugcuuaauauggaaaugguuuaucaccaagguugugcagucuauguugaaguuguaaagcuuuagauuuacagagaaauuuuauaaucuuucaaggaaaauggaauaauuaaacacaguuaaugguucgucuuacuggggcuacaccaaaguguuacuuuuaacaggaaaucacuggaaguaaauguccaaggauagguaauuauuuaaauaaauuagagaacauucaaaagauggacuaauguauauagcaaaugggaaaauagucauaauacuuaacaaaaagaauauaaaacuuucuauacagucuuaucccaauugcuuaaaugaacaggaaaaaacacuaaaagaaaauacaagacuguuacuugugauuuguuuuagauggggguccaugaaugauucucucuuuaguacucugaaaccuuucccacaaguaucuauuuacaaagugcuacaguaagaguuaucacuuccaugauaaaggaaacccccaagacagcuguuacacaguuugacucuuauauuggauuuauccccugaguuugcuguauguaaaggguucaguucauuaaguucagguuuuaaagauaaugagccacaaaugaagucauuuguccaaggucaauugccuccuaguuccuacguugguuggaucaggucuugcccaaaccacucucuugccucaaauaaucugcugacuaaauaggcaaggaaaagagagaggaaucugauuucaucuaaugucuauuaccucaauauugaccacauccaauuugcauacccuacucuacuauguggcugccaguuagguuuccucagaagagcaaaaaauauucuaugaccaagcucuguuaguaauuuaaauacuuuuuuuuuaaacuaccaccucacaauucugacucaauucaauuaaugcuuguucucagaagcccuucucacaugaauccaaagugaugcauaugacuuuccuaaacccagauaaaacuguuaucauucuaacacagaaugcuguauuuuauacguaauuauaugcauuucagccuaucagaaacugggcucaugaaaugcaggacucaugccuuauucuucgcuuuaucgucuucaaugccucauauauguuaaguguuugauaauucuuucaugaaugaauuacaaggccccaaagaucuaaaucuuaccucaaaaaguagcguuaaaagcaagauucuaguagccaaauuggaggccuggggcaguguggccaucugacuuauccacucugacacgguuuuugugucacuuguugucaggggaagagcagcuuugaucaauacaucagcagcuucccacaccuagaaaagcaaaaaaaggguuaagucacggaaccgcagagcaagaugagguuucugaaaauauucucaaccuuuuaaaauacucccucugccuccaacacauucacuaaagaaagguagguaaaucuaacauauuuaccauagggauuuagaaucuauaucaaaagauguaugcuacuaaaggaucaccacuaaacaauuacuuuauuaggcuagacuauaagcagccuaaaaucuaaguuaaaggaaaugaguauuuuaaaacuuccuggugcauacagucaaccccaaaaagguucuaucaacuuauacuuccaucagcaaucuuucauuuuaucucucucucucagaauuauuguuaaaaaauagacacuaaaacuuucugugaaaaaauguuuuauccaguuuuccuuuacuuguguucuugugcauuaaaguucuauuuuacaaagcccagaaaaaaguuuucccuuuuuuaauuucuuucccugcuucuagaaugaaacauuacauaaaacaagauuccaguaacuuaaauacaaucgaaauguuaacuggcuaucuggguguggggauuuaagguaauuccuuucuuaucccacuucuauaauuagcauaauuucauaaugagagaaaagaaaaagaggacaaauaucaggucacaaguauucaucaggauggggacucaguuguucaagcggcuguuacauaggaaaaaacauuuauucaguauuaguccaggggacgaaccugacucaagggugaggcacauuuuagacauuuuaagagaaaaguagaaaaggagagcuuuguuuuucccuucuaaagacauuuuugugugugcgauguaguuaacacacuguuucaggauuaccagaucgaaagaauccaaauagagaauauacccauaucagguagaaugaaaauaugcugauuuuucagaaaucagguuuugacacaggcaggcaaaccacuucacauacuccccucuucugaccccuugagagcucaccugauugacuacuugcuucagaaucaugucacgauaaucugcuccauuacguuugauugcugucaugaucaggucacacacacgguauacugugucuggcagcucaucaagaagguggaagcagccuggcaacauaguaucugugaaaguguggagcucaucuuguuccaacgggucagcauccuggaacuucucuagacauuuagccucuuccuccuccugcuuuucccgagcuuuccguuccucuuccuccuuccggcaagcaacuuccuggaagcagggaaggaagugugaauaauacacaggagaggugaaggaggaaagauaagagagacucugagaauguuuuugcucuaccauaugauuacccucaaccuucuccucaagcgguugauacuuucauccaggauguggcagccacaaaguuuaaggcaagacagggaagguagaagggagggaugcuucaaacaacuuucacugucaagucacuuguagcauucuauacuaccucccgcaaaaucauuucuagacacuguucuauauucugugccagcagggaaaauuaaaguaacugucaccuagaaauauacagccaaguucggccuaauggcacuacugaguacacauugggucucuuauuugacaauaaagauuaacgcuucauaugccucccuuaaagcuucaggucaauacaagguagcucaauaauggauggcaaagcugggaugaauuaguacucuucucaugucuuccuuuagauuugaauucuaucaauuaguuugcaauacuagcagaauguucacagaauacuaagauucaugugccaagcccuuuaggaugcaguguuccauaguuaccucaggugacucugcccuuugauccauuggaauauccugucccagagacauagcaauugcucucaucaucugguccucuucagacaugcugagauccuagaguguuaagagaauauccaguaaggauacacacucaaaacaaagaaacccaacaagaccacugcaacucacaggcaaucagacaucuugugcucaagcuaaagagagaggaagggccucaaaaugcugcucuuguauaagucaaacccuaucaggcuuaugugguuacuacaaacaagaacagaugaggaaaaucacacguaaaacuaaguauaggaaggaggcuuacagugugaucaucuauucuacaucuuagaaaagugugccucuucuauuguuuugugacuggggguucuugugcaaacaaaguauaguaauuuguauugcugggggacagaaaacuucuguuauuaugaaaagaaaauacuggcauggacaugucugaaaaugagaagcaguuuauagaaaggaagaccaaugacagaauaauaaggggaaaaaggacuucagcagucaaaccaauauccuggaaaaucacugcuucugagccaacuuacccgaacaacuccucccaugauuggaggaggguggguuaaaagguacucuguggccugcuccauggugcugguguucaacagugccuccauugcauguucccuugugaagcccauguccaugagcuacauaaagaaugcaagggcucagaaucacauaacggaaauccaaauacauuuuuaaaaggaaggaaccuuuucaagauggaaauaacuuuuucuaacuucaucugggcugagagcauuuaugagcuagggcaauuagguaaaaugaacaauccuuucuguuuggugcuucuauagcauucuaagcuacacauuggguaaggagccaagaagauucucgauuucauccucuaagaaaguuagggggggaugcaugguuauuaugauuaacaggguuauuauaauuaaaagauugagacucauacaaagaaguauaaauuggucccaacuuucuggaaaacaaacugguaacagagcaagugccugaaaaacugaccuaguuaaucuacuaccaggcaauaaucaugagauguauguaaggauugguacguaaggaaacuauacaacacaguguuaaaacaucaaacuguaagaaaauuagcauccaacaauaaaagaaugaccaauuaguaaaaaaaaguucuugauaacagcaauacaaguauauguauuauuugauguuaacgacguaaaaauuaggcacaagacugacugaaaaaggagacaaugacuaucuugugugauaaaauuacgaaugccuuuuaaaagucuuguauuuuccaaauuugguaaugagaguauuuauuacuuuaaugauaaaaaacgggacaaguguauauaguagacagauuugaacaggacuccagacauaaaagcugacacacauacauacaaacuccaggaagaaaaucuuaaaaugcucuuugagauggaaguggcaggacuuuacaugccuuuccccucuccucuuucuggccucccaauuuuuaaaaugccccuuauacauuuuauuugcaagugaaaacaaaaguuuuguaggugacuaagguuucagaaagcucuuguuggagaauaaaucugguucacaauauccauucucuuuacagguuaaccagaaaguaacugaggacaguuugccuccacugaggcagcaggaggcuacugagaauacucaucaacaugcuugaaaggaguauuaccugugcagagcaucaggacuauacuccaguuuuccucaggagaaaaaaaauaaauacuaagagaaggaggaaaucuaaacugucuccugguuaaugugaccagggacucagugguaugugagcuuagaaaauccguaagcaucacacuccauugggugcaaagucuggacccuggagugugaggccaguacccuaccuguugcaguuguugcugguugacuugagguucccggcgggagccaccuuccucuugcccuguauccucuucuccucgagaccccuccuucuccuugcuuagucucucucgaaucacagguucuccucggaggauguggcauagaauggccagcaucgauucagccauucguccaccauauaccuucagggguuuccgguuccauaaguuuuugaugcaaguaaaggcugccuguaaguaauuugaaaagugugugaaaaucauuuugcuucaauucaaagcucagaaggauuaaguuaaagaccuauggaacaguccuuccacaacuaguaccagcaacaaaauaauuggccaacaugaggaggucuaaggaggcacagagaagaggcauuuuacucaaccuuaagcagugauacaguuuggaauauuugcucugcccaaaucucaugcugaauuguaauccccaaugcuggagguguuugggucauggggguggaucccucauuguuuaguguugucuucaugauagugaguuaguguguaccacccccuccaccuccuggcuccugccaugugacaugcaagcucccacuuaaccuuccgccaugacugugaacuuccugaggccucccuagaagcccagcagaugcuagcaccaugcuuccaaagcuugcagaacugugggccacuuaaauaucuuuucuuuauaaauuacccagucucagguauuucuuuauagcaaugcaagaacggccuaaugcaaguaccaaucugaaauuuacagcucaaauguuuaucacggaaaauucucaaauggucuauauucccuuacguaaggcagcccuaucugggaguuggauccagugguucuuaaauaagcauguuauuucauuaagcaggacaaaauagagugggaacgacuuagcaugagaaauuccuuuugauuuuagaauacugaauacucacuuucugaguuaccacaaggaagcgcagugcacugaacuggggaaaguucuggacaccuccaggcaauuuggcaggcagcgaauguggagauucaagcaccguggugggauucaccaucuucuccaccagcauaagccaggcaucuaggaauucuccugugccaucaggcaagucugaguguuccaaucccucagaaacaggaacuuuaccucccauggacagagcccaguugaaaguucuaaauucaaauaaggaaaaguagacagaauauuaguauuuuacccuggcaagggggguuuacaucuaaaagguccccaaucucuauauuggcccuacacgucccucuucuuagagcuauuacgucuaaucuguccaacaguuuucagcuauacuauuuuuuucuuuuguuccgccucuccuccguuacuuuuuagagucuuaaaaaccuaaaccagcugggcgcgguggcucacgccuguaaucccagcacuuugggaggcugaggcggguggaucacgaagucaggagaucgagaccauccuggcuaacacagugaaaccucgucucuacuaaauauacaaaaauuagcuggacgugguggcgggcgccuguagucccagcuacucgggaggcugagacaggagaauggcaugaacccgggaggcggaccuugcagugaguugaguuugcgccacugcacuccagccugggcgacagagccagacuccaucucaaaaaaaacaaaaaacaaaacaaaacaaaaaaaacacaaaaaaaccuaaaccagugaaacucaucuugaaaucaucugaccaagaauagcagaaaaauuauauucagagaaacaacagaaaaagacaaaccuauuuuaaaaacccauacuuggaacuggaagccacaugagaaaaagcagagacccuuacaaacacaacucuaggggaggcuaaauccuacccuccaagguaaauggagacaaacaugguuacuucccagaacacugaaggauacaaccaauagcuauuucuauauaucccacuguuacaagauaggguacuuaaaagcagugggcugggaaggcacacagcaaagaucaaacuccaagaaaugcuccucugugaagcaacuugauccuuacucaaaaagagcauuguggccuccggagcagagaaauuuuugcagcaugaggugguagggauacuuccucucaucaaacagcauuggggaugugaaaccaacugaacagaugaagaaugucagccugaaaguggaaaaaaaggcaaaacuuuaaccuucuguaaagcagagacagaagcaauaggaaauucauguaaaaggcaagaguaaaauuuacacacugaagugacaccucccaccuacuaaagaauacaggaugaguaucccuaucagaaaauucaaaauguuccaaaaucugaaacuucugauugcugacgugacgcucaaaguacauguucaugggagcauuucagauuagagaugcucaacugauaaguauuccgcaaauauuccaaaacccaaaaaauuccaaaauucaaaacacuuucuggccccaagcauuuuggauaagggauacuaccuauauaagaccacugaaaugcaguuugacuguaaauacuuaaaauauuacccauguucuguacuagguacaaccaaaacaaguaacuuacacuucauuuucuagaguaaacaagggaccuccaaauucucaaauucaguggcucacacuccauuuuaaguaguauaggaacaacuuacauauuuuuuauuguaacuuucuagucccugaaucucaagcugaacuucaccugaaucggggaguagguguauauggugggggcugccaagauaaccccuuagucaagagcuuagugagagcugaggcuguugaucgcgcggcaggugucggugcuguaguggugcuggcagcaugauggcuccuucucuggcggacaggagaucccacacaaaguuuaacaagaaguccaaauagcucagcaagugcucggccuaaucuggaggaagcugaaacccagaaaucagaauaagacuguacaguauucucagaaugguuuaauuacaacagacauauuaccauuaacauauuuuuaugacucaccacuuccuccuacaaccccuaguuaacacuuggauuuguucuacauucaauaauccaaaaaggaagucccacaaggaacaaaugccacuuuugacgguaggagacagauauguggcacucaacagauaccaaauguaaaagacaaauaagcacucauacugcuagaggaacauaaauugaaaccauauuuaaguuaaaugauaucuaguggaugauaaagucacuuaaaaugccuacagaaaacuuuuaaaaugccaaaaaugauuagccacuuagauaagaaaagaucacugacaauauacauagucugaucacaacaaaaaauauguagucccagaggaaaaaauaaacuaggaaaagcaggaaaauuuuuacaaguagcuucuuaaggaauugggcagauuauggacaucucaaauuuuccauuucauaggaugcuuuucaauauauaauucaacaaggaaaaggcagcauacaaauauaaacauauguaaaagaaaacacaaaaaacugagugcuuuccagcuucucuuuaaauauuucauguguuuuuauauuucuacaaugaaauauacuuuuaaaaucauaaaugaaaauguugccauagcauuuuaaaaauaaacguuauuucacguuuuuucaugaaacguuauuucaugauccagagacaagaagggcuaggucugaaucaaaguacagcugacgcuugaucaacacagguuuucaacuauagaugccuacuuaugugugaauuuuuuuucaauagauauacugaaaauuuuggagauuggugacaauuugaaaaaacucucagaugaaacauguagccucaaaauauugaaaaauuaacaaaaaguuagguaugucauaaacgcauaaaauauauguagauacuagucuauuuuaucauuuacuaccauaaaauauacacaaauuauaaaaauuuaauauuuaucacacuuaugcacauacacuuauacacggugccauuugcaguaaauaagcaguauugaguaacuggauaaaauuuaguacauauuauacucuguaauaauuuuguagccacgaccugcugauacuguggugagcucaaguguugccacaaucugcuuaaaacacugugugaggcuaagcacuucuacaugaacaguucaucucuccaguaaauuguguagugaucucucaugguucucgcauuguuuuucauguuuaccgcaauacugaaaaccuggaauaaaccugggucacucuaugaccccauaugaagugucacuagugacguuggaagugcucccaagaagcagggaaaagucaugacacuucaagaaaaaguugaauuauuugauauggauugcagauugcccaccacuucaggaaaaaugaauucaguguaaagaccauuguaaaacaaacaaaaggaaauuagugaagcuguugcugcagcuacaccagcaggcuugaaaaccuugcacuuuugugaaaucuuuuuauuucauauugaaaaugcacguuuauguggguacaggauugccauaauaaagacaaaucuauagauucuaaugcaauucaagaaaauaaugaacucacuauaugaaaacuuaaagcaaaaggaaagugaaggaucuaaagcuggagaauguaaagccaguaaaggauaauuugauaauuuuagaaagagauuuggcuuaaagaaugucaagauaauaggagaagcagcuucugacaaccaaccaacaggcaacagauaaguucccagacaccacuaagaacaucauugagaaaggguaucugccugaaaggguuuuucauacagacaaaagugcccuacuuugaaggaaaaaaaaaaaaaggccacaaaggacguuuauuaguaaggaauagaagugagcagaaggauuuaaggcaggaagggacagacucacuccucuauuuugugcaaaugcuacuggguuuauaaucaggacugcccuuaccuauauagcuccuaacuuccgagccuugaaggagaaagauaaacuaccagcugcuggucuuuugguuguacaagaaggccugggcaacaagaccccuuuucuggauugguuccauugauguuuugucucugaagucagaaguaccuugcuaguaagggagugccuuuuaaaguucuuuugacauuagacaaugccucuggugacccagagccccaugaauucaacacaaaaggcacugaaguggucuacuugccccccaaaaccacaucucuaauucagccucuagaucagagagucauaaggggcuuuaaggcuauuacacacaguacucuaaggaaaggauuguuaaugcuguggaagagaacccugacagagggaacaucacgaaagucuggaaggauuacaccacugaagaugccaucauugucacagaaaaagccaucaagccugaaauaaauuccuguuggagaaaacuguccugauauugugcagaacuuaacaggauuuaugacagcgccaaucaaggaaaucacgaguuuguggauauagcaaaaaaaaggucaugggugaagaauuucaggauaugaaucucagugaaauucaagagcuaauaaacaccacaccagagcaaguaacagaagacgucuugauagagaugagugcuucugaaccgauaccagaugaugaggaagaagauguagaagcagugccaggaaccaaagugacauaagacaaucuggcagaggguucugauuacuaaagaauacuuuugacuuuuuaugauguggaccuuacuaugauaugggcaccgaaacuaaagcaaacgguggaagaaaaauugguauuguacagacacauuuuuagagaaaugaaaaagcaaccaagucagaaagaaaguacuguguauuuccacaaaguuacaccaugcauaccugccuuuccuucuaccuccuugaccuguucugccucugcuaucucagagacagcaagaccaacauccccccacuuccuuccuccuccucagcuacucaaugugaagaccacccagaugaagaccucuaugaugauccucuuaaugaauaguaaauauauuuuucucugaagauuuuaacauuuuccuuuaucuagcuuacuuuaagaauacaggauauaauacauauacaaaacguguguccaucgacuguuuauguuacugguaaggcuucuggucaauagauagcuauuaguaguuaaguuuuuggggagucaaacguuauacauggauuucugacuguguggaggaguugccucaacccccauguugcucaaggguuaaaucuaugucuuuucaggauauacaugcacauauaaacucaguguguaaaaauaggcucuacuugagccuagguuacauauccugcuaaaauuuaguaauaagcucaaauguauacaguauaggaacaaggaaaacaguccuuucuucuuccuauuacauccaaauuaagauuucuuuauccuaauuagggaauagucuacagauauggguauacccagacuuugaaaaccuaaugaauccaaucauuggguuuacacuuucucaccacugcuuucaggugaacagauagcaaagugcuuaaagguaguccaaagacaagaggauggcaaaaggccaguaaccaaagagaaacaguauauggacuggguucacacagaaaccucugaaugcuccaagaucaaagaaauaugacaaagcaaggagagagaaauaugaacaucuucuugcuuggucaauuuuccuuugaagguaauguugguagacuuucaaauuaaaauaaauggagaauuaaacuaauuaaaaguaaaauguaaaaugcaaugggaauuugagguaacaaauggaaacaccaaaggccauuuucuguuugcuuuuacgaagggccccagauuccucuaaguuaggucuccauuuuccucuauauuaaggugccagaaagugacgacaauuuacgaacacacaaauagguucccaaacauugguauuacauuaaaggggaaaaaaaagggcaaacagaccagugcaaaucauuaaugcaguuuuguaugcugccaauacagucucaauaaagcugccaaagugacuuuaauauaaaacaccuaucagacuaugucucuugccaguuauguucaaggaacacaaaaagagaagacuagguggaagagccagauaguuauccgagaaucaagauagcuuaauaacacaagcaccaaaggaagaauauuucuagauggagauggugggucaacuaccaugcugcagacaagugagaagggacuuaggacaaggacguuguagaugccuugcugagacaucucagugaaauggaaggagcagcaacaauaugcaauaguugaagaguaaguaggaggaagaaauuaaagaagggaggguaguagauauggcucucaggaagggauucugucaugucuguauccguagcagcuaguacaaagccugucacauagcagccacucaacaaaggacacuuaaaaaugagucacagaaguuuuaaacuuccuuaggugaaacaacauagccuuuccaacucaaucuguuucaagacuaagggacugaaagccagaaaagguaggagaaaggagaaugacucaccugauaacaaaggcuugauuugcuuaauucuggcagccauugcuggugugauuuuagauuugcccuuagagucugaagcaguagguucaucugucuccaugggagccaaugugucaccaucuagcccaaugccuucuaauaagcccuggguagaagcauccauacuuccagcugcuccauccuguuccccaucuacagauguauaagaggggagcaauaggacaauguagagccaacauuuaccugguuccuugagaaguacugacaagauuaccuaugguuuuuguuacucuuucaauucccauggcuuccuaaauuugaaaaacaaaaacacgacccaaauauuuuacugauaugcuccucuggaguucuaaguaccuaaugcugacaucuucaaaugacagcauaugaauaguauuaacccagggcuaccuuggaagacuguuguaggcacagcccaacccaggggguaccauucacauggacuacagugugcacaguacccaaugcugucaauguggaugcccuacuagaauguuauagcuuguuaaguucaaacuagacaucacagauuaccacuggacaauuuuauuuccuagcauuuaagaauuauguauaugaaugugacaugugucuuuuucuuugguauaugcuugcucuuagaucuaagaaugagcuuuaugcaaacuuauaaaacaagucaccaaguuguucucuuaacauuccagaaaaacuguggagaagcugagucguuuuuguuaaauguguuaaauugcuagaaaaaauauaucuguuagagaggcaauucuuugacagugaaucuaauuucauucucaguucuuagucaauuuauucuuucccugaguuaaauuuaguauguuuugacuaaauuugaaauucucauuuugucagguuucuuuauaguuuauuaauguuaucccaucccucacaauaaccagcugucauauguaaguccuuguuuguugguucuaagccuaugucagcuuuauuaguuccuuagaaauuucccuuucuaguaauuucuguacaaguuuuaagccugauaccuuuuuuuuuuuuuggagacagggucucgcucugucaucuaggcuugagugcagggguauacucauggcucaccauagccucaacuuccugggcucaagcgauccucccaccucagccucccuaguagcugggacuacaggcauguaccaccauggccggcuaauuuuuguauuuuuuuuguagagauagaguuucgucauguugcccaagcgggucucgaacuccugggcucaaacgauucaccugccucagccucccaaaguguugggauuagagacgugagccacugugccuggccugaugcauuuuuauacacagaauuaucuucauugcuuucuuaauaguuuauccuuuuuuauuuccucauugauacugaacaccagagaaaaaacauucuggaaaaguugcuuguauucauuuuagguuuguagcauuagagucagaaaauuguguaugauuucuacuuacugaaauuuggaauuuuuuuuuuuuuuuuuccugaggcgguguuucgcucuuguugcccaggcuggagugcaauggcgcgauuucggcucacugcaaccuccaccucccagguucaagcgauucuccugccucagccucccgaguagcugggauuauagguaugugccaccacgcccggcuaauuuuuuguguuuucaguagagacaggguuucuccauguucgucaggcuggucugaacuccugaccucaggugauccacccgccucagccucccaaagugcuaggauuacaggcgugagccaccgagcccggccaaaauuuggaauuuuuaucaugagauaauauaaaagcaaucuucuuuauaaaacagcacugucgauagaaauauaacaugaaacacauauauaauuuaaauuuucuaguagccacauuaaaaaguauuuguuaauacccucugauacaguaauuucuaggaaucaauuuuacauuuguagaaaaguagauacaaaaauguucauuuuuuaaaaauagcauauuagaaacuuaacagggaauaguuaauucguguaccuuuauaugguaccuaacauuaagugaagaaagagaucuacgaaauguuuuuaucuaagacacuggcaaauguauucagagaaaaaagacgggcagacacuuccaaaauguuuuuuuuuuuuuuuugguggcagaaauacggguaauucuuucaacuacauuuucuaaauuuuaccauuauguauauauguuuuuauggaagaaaugacuaaaaauuagugagaggaugaaaacuagacuauggaugauagaacuaacuaaaaauuuucauaauaaaccuauaaagacguaggaacaaaacuuagaaguaaugacuaacauuuuaguuucuuagaguuaccugaucuuuuuccgcccugggucguaccugccuucucauccuuuggaaccaguuucugcauaucugccuggccaaauucacacccagaugguaggcugcaaaaagagaaaugcugagcaaaagaaauauauauauauauauacugauaauucaccucuuauauuguaaauggucucuaauuugcuuggcugacacuaucccuccuauagcaggcagguuaaacugaauguaauaaagcaucuauaauuccugagguagcaccccacaagcuuuccaauucuuuuuuuuuucuuuuuuuuuuuuuggagacccagucucacucuuucgccugggcuggagugcaguggcaugaucuugggcucacugcaaccuccaccuccgggguucaagcaauucuccugccucagccucccaaauagcugggauuacaggcgcccgccauuacgcccagcuaauuuuuuguauuuuuaguagagaugggguuucaccauguuggccaggcuggucucgaacaccugaccucuugauuugccuaccuuggccucccaaagugcugagauuacaggcgugagccaccguguccagccacaacucaauuuuuuguaucuggcuaauaacaggaacacauuuuaaacaucuaccaugacgacaaagcauuugucaucaaguuccuaggcugggaagagggaaggacaaggaggccucugaacucucuuccauacccuccuauccccaaccaaagcaauccuccaggcucaccgaacuuagauaacaaaguaauaagagagagagccauucucuuaccuguuugggguacacagagagaggaggacagugcuuucccacaccagggaacaguauaacuggcucagcuugcucaaaacacucagacccaauugagagccccacugguuuacggagauggaacgaauuucacucugcaaucauaacaagaauuucaccuuugggauguucucugaacaauuauacuuaaaaaaaaaaauugaccuucaacaguuuuauaaggguaagggauuuuucuucauugcuauucucagaguuauccaccucaucaaaauguccacacucaagacgacaguuccacaagguauccucuuacaauauuuacaaacuauuuccacaacauccguucucauuguuuuuuauaaagugaaagaaaggcaucagaggcuacucuuuuuuucugaaucaaagaaaugguuuuacagguucauuaacuacuuucuaaauuauuugguagggguauuauuauuuccauucaauuucuuuacuucaguaaguaccuagauuuauuuaauuccuugaauguuucauuuucauuuuauuucauuuaauaaagaagucauaaaaaucaaucccuaagcuuuguuaaguaauuuaauuuucuaaauccuuuauacuugugcuuuuuuaaacuucagauuugauugauucacaauuaacagagaacacacuccugcucaauagcauaaaacagggcuguugaacccuguuuuguuuaauguugauaccauaaaucuuuagaaucaauuaucugaggaauaaauguaguaaaacugugaggacauacacaaaaugccuucuuucuggaacuauggauuauggauuacaggucaaacguuugauauguagaaaauuuuuaguaauuuguuaauuacuauugauuuaaauguucuuugguaaaauguccuaccuaugccaucccauuaucagaccuauaaggacugguggaaagauuagaaaguacuaaggccagaugaauacccaauugauguuugucuguaauaacauguuucgcucucaagaaaguccacuucaucacauaauaaguuauauagucacucaacuuuuugacagucaaaaaaaucucauccuaaauuggacuguucuuuuagcugcuaccucaggcagaccuccuuucaagcauaguaacccugcuagguguaugcccuagauauuucacugccuuuaaauuaauauguucaccccuaagguuauuuuuaccuguccaacucugcaaguaugaacaaacaucaugauguaggcaugggcagcagugagugcaugcagcagagguguggccugggcugagaggguagcaucagcaacauugccugcgcaagccaguucucgcaacaacacugagcccccaggggauucaauggggcgguguaagggcuccagggaggagaggauggaguccaacugaaggagacccucuugaaggacuuuggguucaugugacagugucugaaacaggaagaauaauuaaaguguuaauauacaaugaacuucaaauucaucaugucuuuuaauagucacaauggaagugacaauuaaauggaagccucucagauuuuggauauggccauggucucucaccugguaaaugguggaacccaaauaugaagucagguacaacauaccuuaacaucucuuucuagagcaacacacuacuuucaaacuuggugagccaauaacacuuaaaagcuuaugauggucaaacugaauacuguuacggcaaggauucuacacuauaggauuaauuccaaauuuugcucgauaggaaacaauguuaggcaaaguuccaaagcauggaagugagucacuauuacacuguucuuuucuucuuaaaacaaaagcgauuauucugagauaggaaucagguaggcaauuuguuuuuaucagacaacccaaggauuauacgacccuugugauuuccucucaagucuggagaaaaaucugacaauaaaacaccaucacuugccaugcaaagauaggagaaaucaugugccuuccuauggcuuuaaauaaaucuaucuauccuuccacagcaucuuauaggauauuuuccccucucugugaugaagagcauuuaauucaauauuucaaagaguaaaacaaaauaaacuaaaugaagucacgucacaauuauggaucuuuccaagucuguaagcaaauggauuucucauucagcaggaauuacuuaucacucugcagcccagcuaacaaaggaguuucacagauuuaaugcaaucacuaucaaaauuccaaugcuguuuuuuguuuugguuuugcagaaauagaaaaaucccuucuaaaauuuauaugaaaucuuaagggaccccaaauagccaaaacaaguuggggaaaaauuuuuggaggucucacucuuuuugauuucuauuacaaaguuacagugaucaaaacugugauacuggcauaaagacagacguaaagaccaauggaauagaauagagagcccagaauuaaaucuucacauauauauggucaaaugauuuuugacaaagguaccaagaccaugcaauaggaaaggacagacuuuuaccauauaaaaaaucuaaucaaaauggauuaaagaccugaauauaagagcuaaguuauaaaacuccuagaagaagccacagugggaaagcugcaaaacaucggauuuggcaaugguuuuguggacacgacaccaaaaacacagguguuuacacaggcaacaaaaacaaaaaaagagaagcugaacuuuaucaagauuaaaaauguuugugaauccaaagacaaccaagaaaaggcaacucacagaacaggaaaaauauaugcaaaucauauaccugagaagaaauuaguaucagguauuaauacguguacaagaauacacaacucuuacaacucaacaaaacaaauaacacgauuaaaaaagaacaaugaauuugaauagacauuucuacaaagaagauauauacauggauaacaagcacaugaaaagauguucauuaucacuaugcauuagggaaaugccagugaaaaacaaaaugagauacacuuccuacccaccagaauggcuauuaucaaaaaacagaaaauaaguauuggcuaggaugugggaaaauuagaauuaaaaguagagucucaaagaguuacauguacauccauguucacagcaucauuauuauucacaacagccaaaaggagaaagcaacccaagugucaaucaacagaugaauggauaaacaaaaugugguauauacacacaauggaauauuauuaggccuuacaagggaaggaaauuaugacacaugcuacauaaugguugaaccuugagggcauuaugcuaagugaaaaaagccggucgcacauacaaaauauuuuaugaucccacuuauauaagguaccuagaguagucaaauuuagagacaaaaaauagaaugguaguugccaaggucuggggagaggggaggaugagaaguucaauggcagaauuucauuuuugcaagaugaaaagaguucuggagauuggcugcacaucaauaugaauacacauaacacuacugaacucuacacuucaaaaugguuaagaugauacauuucauguuauguguaguuuaccacuaugaaaaaauaaagaagcuucauuuuuggcaaaauaugagcaaugaacuaccaugucaauuaugcuuaaaauacaugacuaucgggcuugaaaaggggggaauuaaguaucggcaaugaacuacaugucaauuaugcuuaaaauacaugacuaccaagcuugaaaggggaggaaaauacaugguuaaacauaaccauaaacauaaaauguguuuaaaaugcaccuauaacaaagaagggagagguacuaauaaaacccaacuagaaaagcuuucuuggagauacacuuuucccuccaauaaacucuaaugauguagaacuacauacccaaccgaugaacaaagaaaaaauacuuugacuuuucaaugagaaauaacauggcacacuauauauuagucacaaaauucacuuauacaacauaacacaaauuuauucauuauuuuuuaguugaagggagaccauaguaaaaacauauauacagaaguaucgcaaaauugauuuccagaaagaaaugaaaacauuuggccagaugcuucuuaccaauauggauuugcagacaccugcaacagccugacaggcagcagaugugggaaagucaaugggcagauugggaagacccaaaaugguaaccaaaggcaacaguccuuucugauucacaaauuccuggcaguggucaucuguuguauuguugcucagaauagauuccacaaauuucaucuagguaauaaaaauuuuuuaaagaaguuagagccugacagguggaacuaaauggccagccuggaauaaggaugggguagccuucuagucaugauauuaguguuuucuauagaguaucaaaaccucagauaaaccagauguaugauacggauucuaaaacauccaggaaguaaagaauaucuacaauuucugcccaaucuccauuuucaagcacaccaagaaucagauauuucgagauaacagagaaguuaagugacuugcucagggccacauuaugaauuagugguacaaucauguuuaaucucuuaauuugcuauuuagugcuccuugccuaccucucuccugcaggcaaacaucauggaaaauuucccccaaaugugcuuauaaugcaaaugaaacgcauaaugcaaaugaaacacugaacucuggaagaguuuguuucaaacaaagaauuuuuuuaagaguaaaaaaguaaaaugugggcaauaaacacacaggcacaagacaaacuaucucuggaagucuuggaagugauuaguaggcugaaacaaaugcuaagaggucucucccuuauugguaaacaauucugggaaaauucaaacucuucacuuuuuuggugagauacccaggaaguaaugggaaaaaagggggaaaauauauguuggacacauuuggaaaacauauuacagguuguauauuucauauucgaaaugcuugggcaccaugaguguuucagauuuuuauuuuugaauauuugcauuauacaguacaggcugaaaaugcuccagugagcauuucccuucaguguuauguugguacucaaaaagguucaaauuuuggagcauuuuggauuugggaugaucagccuguacuagacuggcaaaacaaaaccuguuacagauuccugucuggauucuaauggagaaugguaacagugaacaaaaaaaucuggaauacaaaauaauggggcuuguguuggcuaauuucuggcaaaccagucuagaacaaaaacaaaaggguggcacaucuuuccccucuuaauuggauuccaauuaaaaugaauacgguaauuacuggacucugauaacgaaacacauuuuccagaaaagcacauauacaucuuuacucaguuugcccuguguugaaucuuaccacauuaaggauguaauccaugaggggaauaggaauacguuccucuguaccaacaacccuguuaggggagaaaagagugaguuacacagaaauucacaauaccaauauuaagagaacagaggaggaggcacuguauaaaauucuaggccuuuuucuauuuauuuauuuauuugcuuauuuuuuugagacagggucuugcugucacccaggcuggagugcaguggcacaaucauggcucacugcagccuuugcuucccaggcuuaugggguagagaugagccuuuagacucauauaccgcaggaaaaaaacagcugaaaucaauccugaaucuaccuuuccaagccugaccaagguugaaagcauaaaggggacaaccaagccuuuaaaaacucaacauuaguauacaucacaagagaagcuauccuaucuuuggcaaacuacuguuagggaaauuuauccacaugagaacacuaaaaauaaguucaauuaaaagacucaacauuugcuugaagaaagaggcuagacaaagaaacacuuaaacaucauacgauguuuuugcaucacguuuaaaguuauggagaguaggaaauacaauuuaauuuaguucaaagauucauacaccugaggucucccuucccuaacaauugguauuugcagcaugacaguuccugaacuaucaaaaaacugaucaggucuuuugucuuuucaguugcuucaauauugcacagcagaugagaaggcuacaacaugccacagcugcagaaaaugcagcucaaugcaaaaaacuacacauauaguauauugugaugaaucaaaauauaccucuaagauaaaccccaggaaggaacaaauacuuuagaaaauggaguauuuuggacacaggcccuugaaacagauuugggcacagggugcaggagagcgggauggggcagagacagagggagagguagaggaagaagacaagaaaguuggcaagaagcuaguaguucucaucuuugagcaagacaaaauguaaacaaagauuugccaggcacaagaacauuuggcagcagaauauagaacaggaaaagagaguggagaggcauuaugaaugacuucagugacaaaaauacccagaaccagguuuggguaggauguugugaaccuccucaaugaaaaauguggggaagaacuuuguagaaagggaguauaccuauaaggcaagacugaaaugauuccaugagaagaccacaaaccuuucuuuaaguuccuccucagaaccacugcagcauuccauguuacuuauaucaauuaccuauauagauccaccucuaucgauaaggagugcagguguggaucccgcccagagacacccaacccuuugaagaagccagauauaauggcaaagagccuaaguaguaaaaucaaaugagaccuauaugcccccuucauuugcuacauggaaacuggggagaagaacagagagaaagcaaaccaauagugguucuuaauauaauuucaggaauaaauuuguucaguaaccacuuuucuccuuccccucaucuuuuggcucucaggcccaagaagccauacaggaauaaucaaaaugaucaacucuuuccaacaggacucaacuuaccaacugauuucaagaaaaguccuucuaaacuuccugucucucucccuuuccccaaacauacacacauucccaaacucuggucaauuuucaguauuuauggugguggagccccagcucaugcccccaucaaaaguaaaggaggauaucaauuuagugucauaguaugauguauaugggguuuuuugggauggggggauggucaggugcuuccuccagcuuuugaggagacagcugacucugacaaaggagcccucccagugggccacauuucagggaacaacugcgucucugcacucauugccuuuaaauuccagacaauugcuauucaaguucuaaagaugacaaagacuuuauauaguccauuucuuucaagcugcucaugaguggugggugguaagcuaggcacacuaaugcaaucaaccacaaagugaaccgugaugcaccaacuacaaacccugguuacuuaacugcuaaguauauucauccccagcaauaucagauuuucugagaucaaacaauucagaaggcagaagaaagggggcaaaagacagguauuuagaacuacuuguggugagugagucugaguguagaaaggcaccccacguaccuggcguagacuauagugccuaaguuuccuuacuccaaaucuccagcacaaaaccauguauuucaagaguaaauacaaacaccauuugcaaauacuagcugcugauuuuguaaaaaaaaaaaaaaaaaaaaagaaaggguagugucuaagccuggaaaaaacucagaaacccaaguccaucaacaggaaaauggauaaucacuauacaauuaucacauaacagaauacuacucagcaaugaaaaguaacaaguugcugacagaugcaauaacauggaugaaccuccaaaacacaucaaacaaagaagcuagauacaagaagguauauacgucagauauaauauacacauaagacuuuauauggucauuuuauuuaaacauauucuggaauagacauaauaauaugaugacagaaguaagaugaguaacagucucaauuuugggcagggaaacuggaaauguaaaaucuguauggaaaucauaccugaauuuaaacugcugauaaauuggccaggugcggcggugcacaccuguaaucccaacacuuugggaggccgaaguggguggaucacaugaggccaggaguuugaggccaacauggcaaaaccccaucucuacuaaaaauacaaaaauuagcaaggcaugguggcacgugucuguaaucccagcuacucaggaggcuaaggaccgagaacugcuugaacucgggaggcggagguugcagugagcugagcucgugccucugcacuccagccugggugauguagugagacucugucucaaaaaaaaaaaaauaaauaaauaaaauaaaauaaagauaaaaguuaaucauuuuauguguguauaaggcauuggaaaacaaaugagagcaugggaaacagaaauucggaagaacuauggauauggaggaagggaugggcaagacuucuggggagaagggugacacauauuccaaaucuuucuaagcccuuucaccauauugugagaaaguacacaauuccccuauaacaauugccugggauagaagauaaaaagaacuuuugcuguuaauauauugugguuuucaaaaugaagcuaaguuuagacagucucuugcuuuuucuuccuucccuaauaauuuacuuagugacccaaucuaggccucugaagauggcaaaagugaaaaaauguaugugucaacaucugugagacuccuggauuauccaaaugaggcagugaugagcauccagaauguagaaaacuacugauacugggguacaguaacuacuagaguccucugcaucuuagaaguuacauauaacuaucacugugguagaauauuaaugcuacuggguuuauauuucuaauuucucuucauuuucauucaugucucauuaggccuagcucucuaagcauuuaagacuucaggaauccuucauuuaaggcucuuuauucauuucaauaaacaaaccuacugacuaccuacuauauacaaagugauagggauacacuggugaaugaggcaaugucuugcucuugaggagcuuauaggugagugaggaaaaccauuaacauguaugaauaauuuuaacaaaacuguugggagaacacaagauugaguucucauuuggagguaaaaaaccaaccaaccaaccaaccaaccuaccuccuucaagaauaagacauuugaacuagccuuacagaaaucugguggauguaaaaggaggugaugugggaauggggauggcuguggauagaacacagugauacaugauagcccaagaaaggaaaggaggguaagcaaaugaggguagugugcugauuaacugugucagcuugaaaucugggcacaucagauguaaggcaucuggaaaauauccagguagggacgucacaugcagaugaauauauaugagcuugaauuaaaaccaccaccaccuacaccuuaaaauuuuuccuuauuuguagccaggaaaaggaaccccacacuccaguagggucacugacauucaagggugugacaaaggaagcacuaagacucgucuacaaaaaaaagucgugcuuuuuuccaggguguccuccucuucuagaaaaagaacauuuaaaagagaacaaaagauacugcuagaaugaagauagguuugccuucucagacaggguaagguaucuguucaacaaagcaauauacuuaguaguuaaugccucuccuuaaaacacuugacacccacaggcucaucacuauuuagaguuccaagaggacauaccaguuucggauucuaggccuuugcuccuguugucaacuccaccuuaaauuuuaagucccaaggugccauucaggaccagcucaaaugcauucauagcugugccuaaaaugcucaagcuuuucucagaaugacuuaccuacacacuaaaagaccacuuauuauaugagggagugcaggacuguccagaaagaucaaucccauuuucagcaugcaggugacuaaaaguuacagguauacaguuacaguucaucccugguaugugaauacugcucaaagagccugguggacuacccccuaccaaucacuaagccuuuaagcaaacucccugcuuccaucuaagcagucaauucuugacuauuuacagucauauaguaaauuccaaagccuucuacuaauuaaucuggaacgaacagauaguaacaaaaugaacaaaaauaaaaaaacaacaagcaacaacaaaucuucacacaccccuuaaggacuucuuaggagacaggcuucaaaaguacauuguuuuucacacgugccugaaaaaaaucaagcagucgauguggaauaucaaaucaacaaagggaaaauaaggucucugugcaaaguccauuaacuugauggaccaaauucugauucaauuucaucaacagcuuuuaagaaugagcacuuccuggccggaugcgguagcucacgccuguaauccuaacacuuugggaagccgagguggguagaucaccugacgucgggaguuugagauuagccuggucaacauggugaaaccccaucucuacuaaaaauacaaaaauuagccaaguguggugguaggugucuguaaucccagcuacuugggaggcugaggcaggagaacugcuugagcccaggagguggagguugcaaugagccgagaccacaucauugcacuccagcaugggcaacgagagcaaaacucucucucaaaaaaaucaauaaaaauuaaaaauuaauuaauuuuuuuaaaaaaagaucacuuccuaaggcaaccaauacaauuaaauaccaaagcacaaaugacacacaagggucaaaaaaggaaaaacuaauacauucuuagaaccgguuagaacuuuaaaaugaucuaauacaacucucuugcuuuuuauagaugaaaguguucauuaagacuuagagaggugauaacaugcccacgauuauauggcuagaugaucuguucuguaaacacuuacugcugauuaggcucaguuucauuuugcuggguagaauuaaagcucugcauggccuguacuuccucuuccuccucauccucacuagaggcuucuucugcggcaugauuagaccuugggggaggagcaguggcagugccaucugccuucuggauugauggcuucugacagauguauuuggggucccuuccaagauuacagauuucuucaaguaacugaaaggcacaggaaauaagauuacuuauuaguaaucauggaauggggaggaggagacagcuaacauauuuagagcguuuucuauguguuguguauuugcccaaacacuuuguauacauguuauauacauaauucccagaauauggucauuaauuacauuuuauaaacaagggaauagaagugcugcaaacuuaaauaauuuguugagcgucacacggcuguauaagugacugacgaaccugacucccugucccaauucaccaagcaccaggaacuuauauaccaauuucaacaacaauucuaaaaggaaacuggcagagcuaauaaggcggggguggggggcagccacagggaucaacaaacggagacuagaaaggguaauaugcuuuacaaacuuaaucuaagccaugucugcuuguccauauaauauauaaaagaaaucauuauauacagguuacauuaaauggaaaaaaauuuuuaaggaaaacaauucucaaucuaaaauacuuuuuuuuuuuuuggagacagagucuugcaguggcaugaucuuggcucacuacaaccuccgccucccgaguucaagugauucuccugccucagccuccagaguagcugggacuacaggcacacgccaccaaacccggcuaacuuuuguauuuuucauagaaacggggcuucaccauguuguccaggcuggucucaaacuccuggccucaagcgauccaccagccucagccucccaaagugccaggauuacaggcgugagccacugcacccaggcuaaaaaaauuuuaacagagacuucuuucuaagaugaacuaaaaugacaacaucuuuuuauaaaggaccaaccuaaggacauggaaacaaugaggcagacauaaugcucuuacagcuauagcccaagaauccuaaugaccucuaguaggccaaucuucuaaaaccuuccccuucucugcucucucaugcucauggucacauccuuaucacuuucuaccuugaugauggcagucguugcaucuguuuuaagggugggcugaugucucaugagcucaucgacagcacuccccagguuggaugcaguauccccuuaaggcaaaaaaugaacuguuagaauuagaaagacugaagaaaauagagcuugggcucuuuucuguaccaacauauaaaguggaaagaagaaacugagccugguuaugauuuucuuuccuuuaaagacuuuaugucacccagacuggagugcagugucacgaucuccuggacucaagcgauccucccaccucagcccuccaaguagcugggacuacaggugugcgccuccgugacuggagaaauuuuuuuuuugguagagaugggguuuggccauguugcccaggcuggucucaaacuccugagcucaagugaucugcccaccuuggccucccaaaaugguaggugugugccacugugccaggccaggcuguugugauauuuuuuuccuauuuuuuuuuuuugguugugauuuucuaaugccacaacuucuuuaaugaauuuacacccagccccuauccccccaaaucacuagggaaaaggaaggaaucaguuuaguaaacuauuuuaaaguaacuaugugugcugcacucuacucuggcaaucuuugcugucaagaucuaaacuaguauuacagagugagagagaagaaagauguacaaaccauuaacccucuggcugcuccaguuaagaaugauagugucuaaaugcuacaguggugguugaaaaguacaaagcacauuuuugaaaacuguaaucuuucuggagcccuaccuuuuugcuaauaaucucucaauuaucuggucucaaguauacugaguaaaaaaaaaauauccaugugucguuaucuuagagaguuggacaucagaacacuagauuaccagaugaacaccucaggacuccauauuucucauugcugcagaccagauggugaaccuggaaaucuaccacugcuucuuaauaccuauuuucuaccaguaccaugaaaguacaauggugaacuguugagaagcauggaaauauuaugagcagagaagcugaaguauuccuucugaaguauaauagaauguaugaugauaauucccauuaaacuuagcacaccuaaccaguaaaacgaugagagagaugaucaaggaagaguuuccuugcaaacuaaaucaauuuucuacuauaaaauaaaucuuaacaacuuaccaaggggaucagaacuucuccuccuccgcauggcugggagguaaucuggagacagaagaacuuugaagaggcguucaaaaggcugacacugaacaaaagacugaagaccucgggcauucaaacagagugcacugaauacauuugggagggagccaaggacuucacggguagcaggaaccuaaagagaaaacaaagugagcuugaaugcaucuaaaagaguguagaugcuaggaaaauccggccauggguaucaagcugagauagaaggaauuuugacaaccaggucccaauuagauucaacacuacacacagaagagauaggauuuucacgcccuaagacauucuuuacagaguagcagaaaagacuuacaucuuugauaagcagugcaugcagcaugacaucugucaauccauuguccuggagugaggagagcagugaugguucuugaaauacaaacacagucaccacuucaguagcuaaaaaaagaugagaaaauauggaaaacugagagauuccucacagaaacugaaaacaaaacaccaaaagcuuaaaaaaaaauacauacucaaugucuagcaauuuaaacccuugugcuuacuaugaaauuaaagauccuaauacugcuccaucagagauucaauacuauaaagaaucuagugacuacacuuacaggauuuuuaugggcauauuuuuacauaaaugagguuacacuguuuuauauauuuugcuuuucccccacaacugucauaccguauaauguccucucccgacacaacgacccauucauuuugaauggcugccuacuauuccacuaaaugcauguaccacauguauaaaaaccaguccucaauugugaaaaugauaaaccuaaacauauauccguuuuugucugcuuuuaacaggaaaaaaaaucuaugaugugggcuugcuggguuaaagcaaaugcaagcuuuacugaugaaaauagauaaacugccucauacaaagguuauucaacaauuuuaaacuaucaccagcaaugcaagaguccuugaauauuaaucugaucaguuuuugacauuauaauauuuuaaaaugugcaguaauaacuaccaaagcuucuggaacaugggaaaaacucuacucaagaggaaauaguacagcauuaaaguauuuauuaaaaaguaaccaaacaagcuaugaagaauuaacagaaaaaagaauucagugaaaacgaaagcaaaaaggauaaacgaagccaauaucuagcuuugugaagacacuggaaaagcuuauaaaccuauagaaaauagagcaauaauauaaauuagaaacaagagcaguaauauacauuaggaaugagaaaggagauuuaacuagauacagaaaaaaaaaauuuauucuacaaaguguaugccaacaagugaaauaauauaaauuagaaaaaagagcaguaauauacguuaugaaugagaaaggagauuuaacuagauacagaaaaauauauucuacaaacuauaugccaacaagugaaauguauaguuuaauaagaaaaugucauaaaaaucaaaucucaggaagugacagcaaagcagacuagaccaguaagaauuuucuuuuuuuuuuuuuuuuuuagacggagucucacucugucgcccaggcuggaguacaguggugcaaucucggcucacugcagccuccaccuccuggguucaagcaauucuucugccucagccucccaaguaguugggauuacaggcacccaacacgccuggcugauuuuuccauuuuuaguagagaugggguuuuuaccagauuggccaggcuggucucgaacuccuaaccucaggugaucugcccgccucagucucccaaaguacugggauuauaggcgugagccaccgugcccguuccagaauuuuuaaaaggggaaaaaaaaaaaaaauccagguaauagagaggcaccaagccaauaguuuuauuaaaccuucuaggaauaauuaagacaaagcuucccaacucauaagacuacaauaacuacaauaacuuuaauuaaaaaaccugaugaagaggaauauacauacaacacccauaaaccauguauacagaacaaacuuguuuauggugaugccuaagaucuaaaagaaaccagaggauuuucuauucaagauggugaauacagcaucucuccuuuaucccaaaugcuaggggaauggcagauauauagcaguuaccggggaccaacaguuuucaauggccuuugggauuccucaugggcuauaaacuucugaaaaauuuaaguccuuuuugggguuccuauugguaugacacuccccucgauugacuuacauuuguagaaauguaugaauucuauagaguuacuaaaauugaguauuuaaaaacuaaaauuaguguucuacaagcaauuacuaagacaucaaaccuguuauuuuaucaagaagucgcaacgacacuaugcacugggaccccuauacaaaaacacugauaaccaagaauuagaauuaaaggguauauacacgcacagagcaaccagcuguguguggaaccaagcaacuaagaaauggaaaaaagguaauuaggguuuccaggagaaaguuaaaaggaaucagagaaauagaagaaaaaaaaaaaaaaaaaaaaaggcagaagcaggaacuauauacagauaagaacaagaaccagugugacaccaugguuaucuacaauaauguagcauuagaauacaaugaagaaaacagccaccaacuucugaaagagaagucugacaccuuaaaaauuacccacagauguacuucaauagaacugaaaaugaauccaacagaguuuggaaagucaagguuacagagaagagaguaaaggaaggcagaaggucaucacagucccugggcccaaaugccauugcauccccaugccacuagcccuacucaaacccuagccucccaauauguucuuugugcccugucgugccaucggcaucaucaccagugggggcucaccauaccagagguaaacacuccuuuucucacuggcaaaucaauuuuauugggccacugccccaaucugcuggcacaaaucgcuaugcccucacaacugauuguuauacagacccauucuuggcuuauccuuccugcccaacuacugccaacaccaccacuauuauagcccucaguuaguucccuuugggcuucugguaacaccgacucugaccaggguacguacguuaccgcucauucagucugggcaugggccuuuucaaacaaggcaucaccuuggagcuuccauuugucuuuuuuuuuuuuuuuugagacaaggucucacucuguuccccaggcuagagugcaggggugcaauuauagcucacuacagccucaaccuccaguacuuaagugauccucccaccucagcuuccugaguagcgcaccagcaugcccugcaaacauuuuuauuuguuguagagacaggauuucaccauguugcccaggcuggucucaaacuccugggcucaaggcucaagcaaucugccugucucagcaucccaaaaugcugggauuacaggugugagccagugccuggcccaucuguuguacuguucacagaaagcaggccuaauagaggcauaauggcuuguucaaugcucucuuaaacuuacuaaauggacaauggucucuuaaauugaucucucuuuugccgauugccuuaguuguaugacaucugaaaaaacacaauuagugcuuccuuuguccccuuucuagccucaaaaugagauacuuuccaucuaugagucuauaauacccaaacagaaucccccucacuuaacgacaccuccucauuugauauuggugcgauccacgguggacaggagccuagguugaaaguagguaacaggaugggacccacagaaaauugagggcccucacccucuaagacuaugcagaaggucucugccaaaguccuuuccuaauaugaugguuuuaaaggacugcuaacuggagaucccucuucauaggaaaugaaggucuuagucucucugccuggguugacauacacaacuguaugguucuuccaaagaggaaagaaaaaucuuaaguuaguuccuaguaccaacauucuuagacaggaagccaguucuggaaccaccuuauuacagagguauugaaugggagacuauugcaggauaugggauggcaaugccugugauucccauaauaaacuggcacuucggcaugccaaaagucuacgcaccacaggccugaaaauaucuuuguggaauauucuggcucuaguuggccugucuauaccucauuuggcucauggucugggucugggauacuacuaccccagcucaaugccaaacuucuugggcuccuuuuugcccaugcugugaucccacuuguuuagggguaaucagugcauagcuucccuaucugaaauuauucuaaaacucuuguaggcaaagggauacugaguuacuuuuauaauaauuucucaagugcgagccuagggcuucuauccauccagcauaccaaagcauccuagaugaugauuucaguacaacugacagucccagccuugacgcuaacacccucaagaugguaacugcccuuguaacugcccccacauaacucaucauaacuccacugccccaucaacucuuugacagcccacacuccacuuucacuauuuacacucuaauuucacuauuccagucacuaccuauauuuccugcuuccccucacucaaccugauagauuguaucuauguauuaguaacagagaaugccaccuacauacuaaaccuccagcaauacuaacagauacccuagcccaggcaacuacucauacaacuauaucuugcucccuuggaggauuucaauacucauauugacaacuugcuacacucucugguuaaguggucaaucauaagcaugaugacauuagcauaggcuacaaacagacccgaacagauaacaugagggguaaggcaggaggugagaaagaagagaggggaguuggggaaguuaaaugggauacuacaaaugaaauacagguggcuaaaaguggcauagaagagccagaggucggacacgugagggagaaggagucagaauauuuaguggguuugagugugaaauuauaagcaggacaucgugaccucacugggugcuuccauauuaaacuucccccuuaaggauuucaugucuuucccagccucugccaccaacugauaguacauacaaugaugccccccuguugagaauguccacccugauauaaguuugcccccuagaaacuccaacuuccaaccucuugggcuacugauucuucuguguuacaacuccugcucagcaggguuauacauuuuauucagcgauccuguucccuucuacccauacaagcugaccuauguacuauggacauuuagugcccagggcaccucaaauucaacuagaaagucuagcuguuuuaucaagucuugccacaaaaaggagcacuuuuuaccuauucugggccucaucagaaucuuugguguaacgggcacaaguuuagguauuuccaauucuguaacacagacucaacucauagagguuaccgagacauguuguaacuccugacagaccacauuaaccaaacaguucaggccuaagaagcccucaaugagggacaaagcaguuuaguuacuaugauaguugauaacagacuggcaugaaacuaccuacuggcauuucaagauagugcuugugccuuaaagggacuuccuguugcaugaucauuaauaaagaaaagguauccagaauaguucaacaaaaauaaacccaaacugccaauuauauuauuaaaauacuccaagagguucucagaacucccugaugucuuuccugggccaucuccuuccaccuggagugaaaggcucuguacuaucauuuggggagcuaaaauaacaauggcuagucuaauuauuuagguuucgcuuugcaaauuuguucucucucaaguacaaguguauuuuaugggaaaacugggagguugcuaugcuaauuuaaaugugagggaugaauuaagaaaaccauagggaaggaaguuggaccuucacugaccuuugauuuagugcucuaagucucauuuccugcccgugucccucacuucuggcaucauccucauagggcucaccugcuccucaccacuaucccagcaccuaagcacuauauccucuugcugccucccucuuuuaaacaauaucccugucaauggcaauugcuccuucuucuaagcuucccauuuauagaaaaaugccuguguauccuuuucucuuucucucuguucuggacuuucucccagaagacgggcauucucccugccccuggccuugagacguccccaccguaaaacaaaucuuaaaaaaaaacaaaaaaaccccaaagaacuauugucugaauuuugccaucugaacauaaccuuagcagagagcuuuuccauagcaugguagaguugcuacaccacaagaagacuuccucaaccugacaaaauugacaaaaccuucaacacaaaaccucugcuaacuucauucuuaauggugaaauauuaaaugcuuuucccucuaaauucaggaacaaagcaaagaggcccauucuuauuucuauccagcacuguaucagaaaucuuugcuaaugucauaagacaaaaaaaaaggcacaaagaccauaaacaaaguaaaaaugcauuugcagaugacaagauuauguagaauauucuaagaaaacaaaacaaguauguacuaauaagugaacugugcaagauuaaaagauacaagguuaauauacaaaaauccuaaauuucuucagcaagggggcaaggaaguaucuaaguuguaguagccaaaacuagucuccccaacaccccaaacuguaaaacacaaugcuugcuacuacaaggagacuuucccuauuuccacgucuccuacuaaauuccuuuagcguuuuaagaauucuagcacagauaaacaaaauguaugauaauguuacuuacuacaaauguacuacuuaucgaagguauauucagcacccagaaaauagguauuuacuuaaaacugaauucugaccuuuauuucaucaccaauaagacagauaucuacccggccucucuguuuuauauccuugcaggauuuuacuauugacauuugucuacuguccagguagacaguagagaugggguuuugccauguuggccaggcuggucucaaacucauuaccucaggugaucuacccgccucggccucccaaagugcugggauuacaggcaggagcuuccaugcccggccucucuguguuuuauauccuugcaggauuuuacuauucauauuugucuacuaaaaauacaaaaauuagccaggcaugguggcaggcaccucuaaucccagcuacucgggaggcugaggcaggagacucgcuuuaacccgggaggcagagguuguagugagccaagauugcgccacuacauuccagccugggcaauagagugagacucugucucaaaaauaaauaaguaaauaaguaaguaaguaaauacagagagagagagcucugccagguuaucccaaauuguuauaaccaacuaucaacuccacuuaccuaggaggaagagugaugggccauaguauucugcauugcugaugauguguuucagggagguaggcagagaaccauccaucacuaaaagaaaagugaacauuauggagaauacgaauagucuggaaaggugugaggaguggggauaauugagugauauguuauguauuaucacacugugguccucaaagccuguguuaauucuaaucuaauggcccccaguugucuccuccuauuuuauuauuuguccaugcaauaggcuuucuaacauggguuaaaaaaagaaagaacacaaacacuuaagagucagaaagggguaauaagacggaauuaagcacagagucgaaagcuggaaaaggggaaaaaaaggguaaaucauuaugaaaauagcuaagcaacacuuacaucuaggaaaagugacacaaaacaacuaaaagcuauugaaaauggcauggccuuuaccaaagacugccuuguaaaacaacaggugccagaauaguaugaaaagaaccaaucuuugagagaguaaaauauccuccaaaaaaaguuaucuggaaucaaauaccaugucguaugccaucugagaaagcagggucuuggauggccuucuugaggaaauucaacauggauuucagaagugcugcucguuguggaauacacuggacuccuggcaaugaagaaagacaaaagaauuaugcugaguucgccauuaaaccacaaugaucaagcacauaaaacaaaauuuuaagagauccaaauacacuauaauaaaauuagaagacauucgaagugaggucucugaauguuaggaagaauacuuaauuaagcuuugaaauuggaaaaauuacuaauacuuuuaauuuuaccaauacuaaaagucuaaaguaaaaaagaaaaauuacaaaguaaaaagguucaacuuuuuuuuuaccucacucaguucccauuuuggauauuaucugcccuccaacauggcuguuuugauaaucaaugugcaaauuguuggaaaaguauaaaaugcuaugaaagacauguuaauauaagaaaauggaacaccagaauggugaaggagcaugaauagucaugggaugcuaaccuccaaauguaccauuuaaguucugccuaaagccgccuucuucaauaguuuaauaacucuaccacucugaaagacugcacaucuauguguguacgcaccaggacgggggccagggccagggccggggccagggccgggaccaggaccggggccggggccggggccagggccggggccggggccggggccggggccggggccggugccgggacugggaccagggcuggggccagaagagauguuagugcugcugcuggaaccugaugcccuuaauucaacauccagccugugcuccauagagauggaugagccuggacugcuuuccauagccacaucugcaacuaaaguacaaguuaugauaaagaaacuuacuagaauaaaagguaccacaaaaagaaaaauuuuguuugagaaaauuucuuccauuaaugugaaaugaauauaaaaaugaagaucaggaauacugaaccccaaaaugaaaauauaucacuaguugcauguauuaauacguacauacauacacguguguguguguguguguguguguguguguguguguaaauuaacaauccuacagaaguccuucaauauuucucaccuaccaaauuggggaagagggggagagugguaaguaaaaugugcaauuucauauacuacuaguugguaguauacaaauagguacagcuuuucaaaagaguaauuaauaaauauaaaaagcaugaaaagauuaauacucaauauuccgaucuggaagaaugucuaugaaacacugaaugagcaaugcaagaugaacaguauguuuaugaucucaucuucccauucuaaaauacuacauacauacuuaacaucaacauguauuugaauaugcauaaaaaagccuggaaagauccgcaccgaaacuaguagcuaugguagguaagugagcauucauuuuuacuuuauacacuugaauaacugaguauaagauacacaaucauugacuacaguuuauaaaauguauuaaggcuccaucagugauaaaauacuauuuacauuuugaaaucacugcagccucaaacucccaggcucagaugauccucucaacucagccucccaaguagccgggaccacaggugcaugccaccccacccggcuaaguuuuguauuuuucguaaagacaagauuuuugccauguugcccaggcuggccucgaaccccugggcucaagugaugugccagccuaacggauguuguugccuacccaacaaccuuuuuaccucuccuuucucuucucaaaauagguaaaguuuuaaaaggucccauuuuagucucucucucucuaccaagcauauuucuaacaccuaggauguuaucaggcacugcggcagugaaaaagacaauauccugaucccauggagcuugaauuuuaguagaaauaagacaauaagaaauacauaagaaaauuacgugaugaaauaaaacagauuaacaccacagcuauagcaucugcuuuaccugccaucucuacuccaaagaacuaguaccuuucuuuucuuauuaucuuugugaaaaacaaauuugcaaaucacuuacauagaaaaaaaauuuuuguugcugaaaguauauacucaaguuaauuguguacuuuggaauuuaugaggaagaaugaaaacuggggugggaugacaaaaaaucucaagcacaaaaauacugacuuaauaacuguuaauuaccauccauaucaguuuccauuuccucuccuucuuguguaguauugggucucuggaucuuuggcuugaucacaaacggacauucuuuucggcacaaaucuacuucaugcuacaaucaagagaaagguuauaagaaaaucaaguauauauauauauauauauuuuuucagggauuaaaaacuauuauaauggaaaaacacugcaagcagauacacaguugauuucuagaaacagaagagacuguaagaucgcucuuuaggguuaucaggacaauccuuagguucagcucugaguauuaaauucugugcaaagcauuccuuguauaauaauaccucaagucuauaaaugaagauagaaaguccacuaugggauugaaaagcugccauauccagguuggugauaaggucaaccacucugacggcucuggugacaaauguuaucugguccuguucaucgccaagaaacuuuaugaccuaucacggagaaaaagaggcaaaaacaaugaacuauaaagacacaaaguuguaaaaauugcaugcuuuuguauacauguagucuggggccucaguaaggcagcacaguaugggggaaaacauguguuuuauuuuuggugccugccaaaugacaguucuaugacuucugcgacucaaccucugagguaauggggacaucaauuacuuugcaggauuaaguaagauauuuagggagaaaaaagcuggugcucauugcccugcacauaguaaaggcuauuacuacuacaacacaacuuacaaaguacccugacauauauuuucccuaugguuguguaaaggcaugauaacauguggcaauguuuuaaccagaacccaugaccuccugaccauucuacacuaugauaaaagucucaauaauggaaguagcugcucuuaaacauuguuaauuagauaacuagaaagccaaacuggccuucuacuuaaguauaacuuuuucuggauaagcuuucuuauauuauuugcccucacugugaaacaccccaaacuugcaucucuacacccuuaguugauuuccccauguaguuuaaaaaaaaaaaaaaaaaaaguacagcaccuucaauaaggcuuccaucauuccacaggagaccaaggcuucaccaccagcaucguagcuggccagaugguauaaaaaagagaagagagcaguggcaaacuggugaggguauggauccauggaaggaucuacaagggagguggggagagggagaacaaaaacaagcucaaaauugcuguuaagcaggcaggauauuaaaaagacaaaggcagagggcaaauguuucuucuugccuaagauaaucaccaucaaaacuuaccaaucauggccuggauacaguuccuuacaagcacuggcaaaaauccaugguaggaggcaguuccaguacagucaauaauacugcugaguuugggaguucucuccaaguggacaauugauguuaauguucguaaagaagcugcuuuaaucuccuauuaaauuagaagguaaacacauaaugugucaaauauaauaagaugacugaaccaaguuccaguugcuaauauccaaacuuuaaaauauaagucauucuacugguaacugcuugaggggauggaggucuguugagagcaacaaugaaaaucuaguauuuguuaguuuugcaguuuaauacccaaagagggaaguacugggaguucuuucuaacccucugggaaaaaccaaaaggcaaacaaguauaagccugauauacagagaacauuaaugcaggaucccugauucaaaaaucugaaauauucccaaauccaaaacuuugggaauaccugcaugccagaaguggaaaauuccacaccugaucucaugugacaggucacaguuaaaaugcacaaaauuauuugaaauauuguauacaauugccuuaagacuacguauauaauguguauacgaaacaucaaugaauuucguguuuaaacuugggucccaugcccaagaugucucauuauguauaugcaaauauccccuccccccccaaaaaagucucaaauccaaaauacuucuggucccaaguguuacagcuaaggguuacucaaccuguaaaauacuuaccauaagcugcuuauccguuaucugaaggacaucuaccaacuccucuaucaagccauuauacaagauacuguuugcugauuccugcaaggcauuggaauacacugcaaaaggagaaacaaacacuuuaggcaagaaggcaguggucaagccacugcccaauaacaaacuuuuugguaucuauagguucuggggaagaauuccauucccaaccagcaauggagggcagaaucaucaccaaauuaaauucugaaggacuggaucaaauacaacugauaaucucuaaacagacacugaauugacagauuccacuacuaaagguauuauuagucuugagaaagaauuuuggggauggaaauaggaaaagcucugaguuaauuuuucauaacauuacuacuugauguaacuccacuaugccuucaauauaagauuuccauuuuagccucuuccuaugcuucugcuuuuacuguaaacacuuguaaagaacagaauuuauggaccauugcagaguaagucagaaauuugugugacacuguaguaaaacuucagaauguguguaauucacauucaaugaauuccacgaugagguuaauaccggacacaguacccugaagcauaaacuaaugggauuuaggcauauucauuuaguuuucaacaaagauuuccugagcacccacuaacaugccagaaaucaugcuagauaugaguacacauaaaagagcaagaauuucacgccaagaaacucauaguuuaagagaaggcaagucauaacauaaugaacaucaauaauaacagcaaugguuaccauuuuauaucuucuaugugcuuguucugugcuagauugcuuucuagguuuucauuuaaucuuuagaccagccucuacggugaguaccucaauauuaaacgaauaagcugaggcugagaggauaaguguggcuaauaaucuacagaaucagggacagaguacaggacugauuacaaaaccacguguuuuccauuuuacugugccacaguaaaagaaguuaaaugcacaguauugacuacugaauauuuugugacuuaauucaaaaugauaucccugaaaggaugagagaggaggaagacacaauggcaagagaaagaguagggggacagugaacgauagcuacaagcauaucuauuaaaaaaaaaaaaaaagagacgaauaccaagaauaaacccaggugacaugucaaucaacaucaucauacccucuuucucguccaacauuaaggagcucaaggauaaugaauaaauacagugaacacugggagggguggaaguauuuaaguugcuaccuagguaacuauaauaggacucauagcaacaaagaugaaugaaguucaaaggaaaucaggcccaaacugucuaauacggccugguaauuaaaguauucuucucuuaccuaauauagauauugcaugcagucuggccugaacugccugcaaucgcuuccugugauuagaaaagccaugggccagucguauguguguaaauaacagcaucuguagagagauaagacauacauuuuaaaaacaucaaugaaaaaggugaauauucuuuaugagggcuaacucaaaaaacaacacaacuaaacguuuucuccuuugauauccgaaguguucagaaagcuaccaccacuuauuaccugcucacggugagguaguuuauguuuuccucaaacucucauaaggccuaggaaguuauuaaguguuaaccucauaaaagacaaggaaacuaaggcucagagaagcuaacaauuugcccauggucugacuccaaagcugacauucuuucugcuaugcaaucucccaccccaguacauaucauuaaucuauuuagauaacaaccacauccuguggauguuuuaaagccacaucauaccugcuuauccuuaggaaugcuguacauuuugguaagagauuccaugauuucagaagggcuuucugaaaucuacauuaaaaaaaaagauauaguuaggaacaaaaagugaaccaaacauuaagaaacgagccaagagucaaagauuccucuuaccuugucaaguugcucuaugugaauauaauguaguguguuacuaguugucuaaaauuaaaaaagacaagagagcuguaaggagucacugaacacucuagcuuccccuuccauagagcuccaaagggcugucugaaaaccaagaugucaccuaauaggcugaagccuaagugaaugcucuuaaaaucaagguaaauugagaaucuuccaaaacauccaucuuauauguagaauauucuuaggaaagcuccuuuaaaaccaguaguaucaaacuauaaugcacauagccaggcacauuucauauucuucuuuguccuuuuuuaacccuccacugacuuaauauccauagcaguauuaauagcaaagaccaaauucaugaaaauauuuucucucugaauauguauuagaguugcuuucaaggcaauuaagcuagaaagauuauuuauuuauugaauaguauagguagaagagaaauuguauuuucacuaagcuacuucuaaaccaaacucuuuaguaccuccucaaacaauacaaaaugaccagauaauuuaagcaggacacuauccacaauacauaaagacuuuugcaggcuuccuaauuagagaaaccugagccaucaccauccaaacuacuauacuacauguuggaauucucagagacugugggaaaagcacauaggucauagcagugccucauaauggaugggacuugcaucuuuuggcagcucccaacauaagacccaacccuaucagaguuggggaugcaauuaacacuccugaggagcugcuagguauauuuauaguuugcgagggcagcaguguagcucaaaaccauuuauucauuuaacugaggaguucuagaagaggcaaucccaguuacaguaaauuguagacuuugucagaacaaaucugaaucagacucacccuuuucucaauuuugaccucggccccaggaucugcauagaauucaaaguguaguguaguugcacuggguggauauuucuguguauaaagcacaucaaagaaucagacauugaguuucaacugauuauaaacauuaucccccacaucuucccucaaaguccuagccacuuguucaacuuauuguggcagaagaauaagcaguacauucaguaccuacagugccuuuaacuguuugucuuagagcagagcucagauaggaugagacuuuucaaacagaaucaaaaggacagagcccagagcucccaaaccuucugcauuucauacuuauaaauuuccaguuucccuuuaagagaucaauuuugacuguggcuauucccaagggggaaaagaggggcaagacugccaagcaguaaugaauaagaauccaagaaaggauggagaacaaauaccagggcccagaaaccagcuaaagaauggaaaagaacauuccuacgaaaaaccuuguaccuaucaucagccuucugaaauauuuaauucaaaguaugccucauaggcauaucuucauaauucuucaaacacuuuccuucuauaccauucuacaccacuucucaugguauguuuucugcacagguagauaccaagacaacauaaaccagacccugacaaaacauucucuuuaacucuagaaaagcaacaugaugaacaaaauuaagaugacagcagaaugcccacuaaaaugucucacugaaagacaccacuugcagugguugccucuggaaaauuaagaaguuaccacugcauaccucuuuauacucugaauuuuuuaacauguauauguauuacuuccuuuuaaaguacacguuaaccuuuauguugucauaauuagaauuccaaacucugaauauacuucaagauuuauguaguuuugauuauuaaacagacaacacucaccuacuguaucacccaauaucucuucauaaaauaaucacuaaagaaaaguaugccagcuaacgugggaaaguaacuugaucuaaucugugguuuucugagaccagaaaagagccauucucuuuaggaaaaaaaggcuugcuaagauaaauacacuaaauuucacugcagccauuugugcuaaacacgacaaacugacaagacaaaucccacguggaaaauauaguugcuuccagaugcaaaauaauuauugaaaaucaaauuguguuuuguagcuccacagcaacauaucaaagcagaaaggaggauggccugagcucauaacuuaaacaugggugaaaggcagagagauaaacaaggaaagcacauaaaacauuauaaguucucaauaaaccuaaugguagaacugcucuccaagcagccauuccuaaaucacaccacacuguccagaguucugauacaauaguuccagugugagaaugcaagcgaacauacuuucugggauuuaaaaaaaaucacauuaaaauuaauucaacaaauacagcuaccuacucaagaacuggguaugaacacacacucuauuucucagauuuuuuuaucuaccaccagcacaucaagagcccaagcacugcuagacugcuuccuauagacgugguucagcuaugucugaacugaucuuagguuccucaaaggucucgaugugaaggcgucacuucauauaccacaauucauuguaaaguaagguucacagagaggccacagcucugucaaaagacacccauaucccaaagaguuacuuaccaucauaugcaagucucugcaacauucugcaaguccaaagccauucuccuuuccaccccagcucuugaaaaaggaaaaagauaguguuaagacagugcuuauggugacuuugcgccacugcacuccagccuaggcaacagagugagaccuuaucucucuuucucucuauguauauacacauacauauauauauuuaagaguguguggcugcuuggaacauaauguugagaagacauccaaugugaaagucaaacaagaggaaaaaacgaacagaaauaagaacuuaagaaucaaggcaagauggucugccuaaaggugauuucuucaaugagaucaauuucacuguucagugaggaugcuccuaggaagaacucaagcagcaacugccagccauuauauuccauaccccuguagucacgugugcugacaggucccuccuguccuaucaggccuugccugaggcucugccuacucaccuuccgcacuagggaggaaagcacuagggaggaaaucaugcuuuccaguuccucucuuuuugacaugagcugaguuacaaagcagauucuaccuuauuuauuacuacuguacuuugccacucaaaucuaaaaccucaucaacaagcuccugagauaauggggggaguggcucaacuggcuucuaaauacaaaacuucagccacauagucucacuuacuaacuagccugcaucuuaacagccuuuaaaauaucacuuuaacauuaagagcauuaacguauuuuuauuuuuaaaucauucauaauuauuuuacauauauuacauaaaauauguauuuauauauguaaaaaauauauaucucccugccucauggggcaaggcauauaguucaggcaaacaauugacgaagugaaagaaaugagauauuauuugaaacaaauuuauuaauuuguuaugucaaacugaagagauuuuuauauuacaaauauaaaacauuucauauaaaaagauauuuuguauauuuuuaaaaaauuauaaauauguaaauuauauaaauuuuauauaaaauuuauaaaaauaaaaauuauauauauguagcuauauaugaagagagugugagagauagacaaggucucccucuguugccuaggcuggaguggagugcaguggcacaaucacaacucaccacagccucaaauuccuggggucaaaggauccuccugccucagccugccacacagcuaggacuacaggcauaugcugccaccacgccaggcuacauuuuaaaaauguuuguaggagccuugccauguugcccaggcuggucucaaauuccuggccucaagugauccuucugccuuggccucccaaagugcugggauuacagcugugagccaccuugcccagccaagcauuaucauauuuuuaagucuggcaugauugaagcacaaaaugcuacuuauauucuaugucuucauuuuauuccugucuagugugggucccaaucaccucggaucugggcugccaccaugaacuaacauggcucucucucuacaucuaaguguuuccucuuuguuaaaugcuauuauaucacuacuugccaaagaagucucaaaaacaaacaguguaaaccacugaagaugccagucacaaagguacauacuauagaaugcuauuucuaaaccuguaaauaaauaaaugaauaaauaaaacaucaucugacuauccugugagaaauaagcuuucucaaacuacacuugaucuacuggcagcauuucucaauccagguaucauauaugaaacacagaacauggugaaugaucauuuuauucuccaaauaaugguacauaacuagcaccaccuuagaugcacaagagagaagucucuuugcuacauuaauaauggauaccuuagggcauuagggcuuacuucucuagugaaaaccuaagugagaaagucugccuggacacagauauguauaucccccacucccagcugguuaaaaacagacuguucuacuaggaaugcugucagugaaaauggcagaauggggaaccccauaagcccacaccuucacaaaaacagugaauaaacugacugucggaauucaagucuaucagaacucuaaaaaauaaucagaaguuuaaaacaacuagggaaguuuaaggcaaugagacaagaaucuguaaaauacaagguucgacauucauuaagauguuuaacagacggccaggugcgguggcucaugccuguaaucccagcacucagccagugggagcccgaggcgggcagaucaccugaggucaggaguucgacaccagcuugcccaacauggugaaaccccgucucuacuaaaaauacaaaauuagccaggcauguggugcaugccuguggucccagcuacuagggaggcugaggugggaggauggccugaacccgggaggcagagguugcagugagcugaaauugcaccacugcacuccagccugggcaacagagugagaccccaaaaaagguaacaaacaccuggugcuaaauauggccaaauagucacguauuaaagauauucacuguagcauuauuuaccacagaaaaauacuggaaauuaccuaaguaagaagaaaacugugaaguaaauugagauaaccauagauggcacaauugacaguaccuaaaauauucacagacagaagguauaaaaucauacuguaauggaaucaauuucuucuuucauggcauuagucucauucuugaaaauaucuugccacuucaagcagcauacaaccaugcaguuauacuuucuuucaaugcuuguauaacuucauguuuuuaacauuucagcuuuuuauuacaucuuaauuuuacuuugaugagguagaaucuaccuuaauugccucccaaagaguaagccaguuuuuacaacaccaucuuauuugaauaauccauucuuuuucugcuaaucugaaaugccaucuuaaccauaaauucgauucuuacacauuggaucugcuucuggaaccuacugauuggucaauuccacucuuaauuaccacacuauuuaaauuacuauagcuuuauaaaaugguuuaauaccuaauaaguacuucauuacauuuucaauauuuucuuggcucuucccaggacaucuagugaagacgaagacacaugcaauuugcugaaaaccauaaaguaaggaugaggguauaaaggcuugaugcuacagagaacagacagguaagucaaaccaaaagucugaaucugcaaggcagaauaagcuugaaaggcuguguaucuacacaauuauuuuccuuuuguuucuucuguuauuccaacuaauuguuucagaauacuuuuauuagugucaccacaaaauccuucuugccaacuuuugcaacuugauaaaaaacaagcaccuuuaauuagaaaguuuugguaagcugagauccuuaaaaaacccugccaacucaaacgugacucacgaaagucugugcuguuguuauauuuaugaacuaguaacauuauaugaaauauaaagaaauguuucuugugaagaaauauucaucagauaaagacuaagaaaauauaccaaaaugaguagauacacaauuaugauaaauuuuguugcauacauaaaacaccaagcaccuauuuuuaucaggaagacaaguuuguuucgcugccaacaaaaucaacauauuaaauguuaagauucuaggguacuuuuuagucaguacuauucagaauaacacuaguucuuugcccuuauuauuauuaauuuauuaucuauuuaucuugcuuucucaaguacuaaguaagcuuguuuuuauuuaaaaaaacgaacaugaccaugcucaaagaauccccaaaugccuaagacaggaagaacagauauuauucuucacauuuuagcagaagcaaagagcccagggccuuuguccaaaaauaauggugaaaccccaucuccacuaaaaauacaaaaaaauuagccgggcauggugacgggcgccuguagucccagcuacuugggaggcugagacaggagaauggcaugaacccaggagguggagcuggcagugagccaagaucgcgccacugcacuccagccugggggacagagcgagacuccgucucaaaaaaacaaaaaacaaaaaaaaaauacauaaguaacuucugagccucacaguauucaccuaucugguaguguuacuguaacauccuagcccuuaaguagauaacccauaaauaacuauauucauuaugccacagaggcauauacaacacuaccucacacuagacaggauuugcuaaauauucagacaucaggaaaaaggcuugaugcucucuaagauggaauuauaagaauuugauaaaaguuuguaacuuaauaaaauagacuaggccagugguucucccuggaccagcagguuaguauuaauauuaccugggaacuuuauagcaaugcaaauucugaggcccacuccaagccuaaugaaucagcaacucaggaguuaggugggauggaggugaggaagacuaauauauuuuuuaauaaagugauucugaugcauccucaaguuuacuagaccuagaguauaccagaccuucacaaaagccagccaacuggcuuucaacugauucaacaagucuuucuggagaauuuucccuacaucuguaguuaacuaaucacuguucacauucacaauuagcccacaucacuggguugaccuagucauuaaaaacuacuaugaggaaagacaccauauccaaagucacuuuucauaaagaccaaaacacgauauucaaucuuuuauauaaaagcauugacugaaccauuuuugaaaacaucacauacaaaacacaauaaacaaagacaauauacaugaagauuaggggaaaaaauacuuuuaagaugacaaaggacuaauaucuccaauaugguuuuacagaguaggaaaaaguaaccaaauggaaaaauggacaaaagauaaaaccuuucacaagaacaaauccuaauggccaagcauaaagaugcucaaaaucauuacugaucagugaagugccaauaaagucacacugagauuucugggacucuaucuuaugaucuccauaucaucucuuauaauaucauauuaaauguaucaguaacuaaauucauauauaagauugcuuaauguagcaucauucauaacaaauauaaguaugcaucaauagggaacuugaguaaaauaugguacauccaaagcauggaauacuaugcagccaucaaaagaacccuauaguuauacaggugacuuuaaagugauuuuugaacaaggucugaaauaagaaaacaaggauguaagguauccugcauuuguaacugaaggacaaaaacacccucaacagucaauauaauaugaagauaauauauagagaagaauacauuugagguuauggggaggugaaccaagagggaaaaggcuguacugaaaauaaucaugugacaauaugcaugcacuuauaaaauaaugcauguguaacauuuuaaaagaaagcaaauacaaaagaauggcauguaguuucucugguugacauccaucuacaaaugacagcuguuuauuaaguacuuccaacaugauggcauuaacccuacagguuuuauuuaugacuuccuuuacucugauccuaaaaaaacuaugagguagauauuguaacccccaauuuacagacacagaaacagguuaauauuuguuggcaaaaguagguuucacauccaaauccagguucuuauacacaugcaagugaauguguuuguugcaaaggaaguugccugaaaagacugaaaagacaugaaccaagauuucuaugagcauuguuaaagaagcccacaaggacaggcaguggcucacgccuguaaucccagcacuuugggaggccaaggcgaguggaucgccugagcucaggaguuggagaccagcaugggcaacauggcgaaaccccaucucuacaaaaaauauaaaaaauuagccgggugugguggugcaugccuguagucucagcuacuagggaggcugaggugggaggaucaauugagccugggaagcggaggaugcagugagcugauaucgugcaacugcacuccagccuggguaauggagugagacucugucucaaaaaaaauaaauacauaaauaaaagaagcccacaugaacaagucaaguuuuuagagaaauuuuacauuuuagagaaacaugaaauuuuuaaauuuuaaugagggauauuaguauuggagguaccauuacuaaauaccuaauuaucucuaaaccucaaaaaccuguaaaaaucuuuuauugcaaagcaccaaacacaucaaucuauuaccaaaggcugcaauguacugcaccugucaagauuccaaauucuccaggacuagaaauuaaccuccaaucuacaaucucuuuagaucaauucagagcaaaaaguagcaagccucucaaagguaaaaagugucaaaaaugcaaagggacaaaaaagcaaucauuuaagcaguccuuucugugguaaaaucauccaaaggaagaacaacaacuggaucugaauuaccuaaaaaacaaaacaaagaaacauacccgauacuuuauauaugugagccacuuauaccaaaaacaguuugcauuuuaacuucuacuuaaauugucagaacauuuaauuaaaguaugaaauauuaguguguuuguaucagccuaaaaguagggugaugugaauucugucagaugcuauugugguccuauacaaauaaccaaauuaacaugaucaaagcuguauuuuuaaugacuucuaggucuguuaacuuucuuagcaaacucuuaucaaagaucuuaaaagucaccuguauuuaccucuaaauacguuccuaggauuuaugucaagugugaagaaaaguucuaaacacauuuuccccucaaaacagccuacugucccacuguucuaagcaacauaagguauacucuuucauuuugcagauguauugucuauuccugugccaacugcaagacuuggcuuaaucauaaaaagccuuaugauaaaaacuuggcuuuauaauaaaaccacuauagcuuuaugauauuaucugauacagcaacucacccugauucauuaucaguguuuucucauuuauuucugugucucaguugaugcuauuaacagacuuccacuuaaucaauuugacugauuuaaaugagaaagggaauuauuucacaaaaacuaagucgaauauuuugcaaaauauucaucuaaaaggcaagaugcuaaaauaaaaagugucaaauuaugaagagauucagggguaaacucuaaaaaauuuagaauccuguaugcaggcuccuuuucuucaaucggugcaacaccauaaaguaaucacagauuauaguuguaguuuaugucagaaaacagacugcuucuuacuaagucuuauggcccacauaagaugggaaagggaauuauuuuaguuuuuaaaaaaucauauguaucaaucacuuuuuaaacauuuccugcuuuaacaagauuuuuaaaauaauuaaacuaccaaucauugguccuaauuucauuaaagggcuucuacuacauuaagucuucccauuuaaaaaauguuacuugucucuauuuagaccaucuuuuaaaucuguaaguaaagguuuaguguuggucuaacagaucuuaaauacugcugguaagauuuauuuucccuuauccauagggauacauuccaagaccccuaguggauacccgaaaauacagguaguggcaaacccuauauaauacacccacacacacacacauuuuuucccuauacauacauacugaugauaaaguuuaauauauacuauaauacaaguuaugugaauguggcuucucucuuaauauaucuuauuguauuauacugcaaguaacugaaaccauggcaaucgaaaccucggauaaggggagacuacuguacuuguucauguaucugucccauuauugcccauucagauucccuucuaucaaagguauaacuuuugaugucuguuaauuuuucuuucuugaaacuauauguugcauuguguacaucuuuuuaaguuucagaaaugguacugagcaaugaaaacuguugcuuuuacuuuuuuaugcacuaaccacuauguuuagaagccaucaauguugcuguauuauuugguccacuguuucuaacugcuacauacuccauagugugcaugugccacauuuuacuuauuugaguaucuacuaaugauggauaccaagguugcuuccaacuccucacuaccacaaaugaugaugcaauacucugacagagaucacguuuauggaaaugaugcgaucucaccuuugaaauauauacccaugagaaccagucuacacuccuaugaacaauguaugaggguucccauugcuucacauaccugccaggacuuaccauuauauaguuuucuaauuucugcaaaucugaugcuuacaaagcuguaccuuguuuuauuuuuauuucucuaauuacugaguaugggcaucuacucacaugaauuuccuguucuauaaauugccuauccauauccuuugcucauccuuguugaucuggaagaguuccuuggauauucuacauuagcagucccuuuucaguuuuaaaacacuguuaaacauuuuuaaucuaccaugggucuguuaacuucuguuguacaaagugcugccuaauuuuguaugcagaccagcugcuugcuauuacaccaauuguuugcaaguuuuauugguccaugacaaaaugagguuguaccagaauguuauuuaacuacauugguaacuauacuauuuaguacaacugacauuuuucuugaugaaggaagcaguguguugauuuauauucuaguguaagggccuaaggaguagccuggagcuauguguuuuuuguugggaaguauauuuuuaaauacaauauucaaaauuuuacuuucagguuuaugccauggggauuuuaagaauucuuuccccaccauuguuauuacaacacaaccuccuacauuaacugcucuuaaauuuacaguuuuagccaauaugacuuauuuuacagacagaauauuugcuuauacugugaauggggucuuuucaccaaucauuuucuuuuuuuuuuugagauagagucuugcucuugucacacagccuggaaugcaguggcacaaucuaggcucacugcagcuuccgccucccggguucaagcgauucuccugccuuaccguccugaguagcuaggauuacaagugcccaccaccacguccagcuaauuuuuguauuguuuuaguagagaugggguuucaccauguuggccgggcuggucucaaacuccugaccucaggugaucugccugccucggccccccaaaguguugggauuacaggcgugagccaccacgccuggccucaccaaucauuuucuaauugguugcuauuaauacauggaagagcuaucuguuucuguauauugaucucuuggcuaccucacugugcuuuuacuaguuauaauaauuuuacauuaucuccccaagaaacaaagagacucaucaccuacauacaaauaguaacaaauauucucuuuucuuuuuuagagacagagucucggucucacucuguugcccaggcuagaaugcaguagcacgauccuggcucauugcagccuucaccucccaggcucaagugauccucuuaccucagccucccaaguaacugggaccacaggggugugccaccacaccuggcggauuuuuguacuuuuugcagagacgggauuucgccauguugcccaggcuggucucaaacuccugggcucaagcgauuugccugccucagccuccccaagugccaguaauaacaggcauaagccaucaugcccagcccaaauuuuuucuuuuaauauguauucuucgcuucuuucuuuucuguugguuagcaucuguacuacaaauguaaaugacagaaguuaaugucugacauuuuugugugacuuuugaauccaauggaaaugccucagcucccccauuaugacuucugguagguaacucuaguuuucuuaaaguuuauaugaagcuuuuguuaaugagauaaauuuuaucgagugcuuuggaagcaucuauugaguaauaguuccuuuuuccuuuuaacuguggacuugggaauccaauguuaaaccuccuugugguuuuuaauaguaagaggaaauauuuacaguaucuuaagaaaacaggucacaugcauguauacauguguuuccaaaugcaagaaaaaaaugcuccaacuuuaagggaggucucauagggaugaauuauaggugauugacauuuugucuacauuuuccuagaauuuucagaauacauguuauauuuauaauuauacaaaacuaauuuauaaguaaucauggcaccugaauuagccugaaaacuugaauuacuuugagguaagcauuaaauaugcuuuuaaaaagccagccauaacacuuuucuucuaagaaagcuuuccaacaguggguuaccucucaaagcuaaguauguauuaagaaguugccucugggaacacuggacaauaguuugguagagcugaacuuuuauaugagagcuucuggcuucaauuacaaucacuacgacuuacugaucacagcacugaguaccccacaauucauuucauucuaaaucaacccugaaguagauauguuaaauucccagaagaggaaaccagugucggcgcuaguaagcagggccaggacucaaaucuagaucuuauuauugcauuauacuuccuucucacacagaauugaaucuaauuuugaacuuuccuuucagaagugaaauugccacuuuugaacagagagauuuuguuuggugagcagagauuaaagaauuccuucaaaauuacuuaauaacugagaauacuuagguuuuaaaacagggcaccaauaguucuaacucaauuaggccagugaaguuaacuuagggauucuaauauauuuuaacacuccaagaaacaccuguugaaaggaaccauaugcuccaauuuuugcaccccuccaacucuucacccaagacucaccucugccaaauguuguagccgaguuagcagcgggguccucuugucagaucccagacgagugauguaguuugaucuuuugcuaaauacauauaggagauugaggacugccagcaccacuugcauaucagaggaagccaauaaaguugucaaaugcuaaagggacaaaaaagggcaaagcucaagguaucaggcacaacuggccuugaaaacaaaacaaaauguacuugucaacauuuacaaagcuaucaagaaguuuagucacaacaauacaaaaaauauauaaguauuuguacucgggaggcugaggcaggagaauggugugaacccgggaggcggagcuugcagugagccgagaucacgccacugcacuccagccugggcaacagagggagacucugucucaaaaaaagaaaaaaaaaaaaaaaaaauauauauauauauauauauauauauauauguauuugauaaucuacaacaugcaaccuuauccccaaggagcuuaaaaucuggcaguuagcuauaaagugcaauaaaaguaaaaaacguaaauagugguucaaaauugcgcagguuuucccacaggaaggaaaagagacaaauacacaugugggacucaagaagaacauuaagucucuaacuggacuaaaaguauugugaaagaaagauauuuuauguucucuucuguauccuuuaugacaaacauaaaauugaaauuaauuaaaacaggguccuucauauagaagcuaaagauaucgauaacagcucguggcaauuauauaacauauaaguguuacaguacaguauaugcucauaaggaaccugagugacuacucuggauuuuguuguuguugcuguuuggagacggggucucucuguugcccaggcuggagugcaaaggcaugaucauagcucccugcagccuugaccuccuggguucaagcaauccucucaccgaagucucccgaguagcuaggacuacaggcacgcaccaccacgccccgcuaauuuuuguauuuuuuguagcgauggggucucacuauguugcccagacuggucuugaaccccugggcucaagugaucuucccgccucaaccucccaaagugucaggauuacagacaugagccacugcaccuggccuuacuuuggcuuuuaaauacaauuaaaauucaccaauacauugaagcaguuggucagaauuaaaaucaguauguaauauagcuagaaaugaaccaaggcauuuccaguugccaauuauaccgaaggucauggacuuccaugggcagcauaucuauuucaucuucaacagacugccuauuuaccucccacuuaaagcucuguauguuaggccuuuaguucaguuaucccacuucuuuuccuaagccauuuucuuuuaaguuguuuguucugauucuguuucucuacugaagacguaggaaaacacaccuaaaauuaacagggcaccuaacuaaugaugauaaaaagucuaaaguugggcuucuauaaaaagaaaauaauuucuucuuacagugauuuuuaaccaauuaaaaagcucacugauugcugcaccuaccuuacucuucaaggacacaaaggaugcuaugaauauauauuuugggauggguguggcagaguacagagagacuuuaaagcagcacacuaacacuuagaggaguaguaaguacauuaaugugaugagaaaaucaaacuauuucuaggaauuuaaaaguaauguggggcugcucuaacaaccuagggcaaaaaucaauucaugcaaauuuccuuaaauacuuuaauacauauauaacauuucucauucauuucuugaaucuugaaaaggcaaagcaaaggugauaguacagaaucuucccaucaacccuaugaaggauaguaucuauauccaagaaacauucuacuauuaucuuugacaaugaaaaacccagagcuccacaaugaaaaggaaagaagcaauagaaauagcaauuuccuuauuucuggauguacacaauucuagucaagaacaggguacacaggcuuuaaccuccccuaccucuauggaacuguacagaugccgggaaaagcuguacucaaugagcaaggcugugaaguucaacacagccaagagaagcauuuucaguugcucucuuucuggccuaucacauacgagcauccaugacauauucuccacugucuguccagcaucugccaguauuccaucgaagcgguccaacagguccacccagugauauaacucgcacuggagaggggaggaaaaagaggauguaagaauaagguagaagcgccgcaugggugcuuucuaacugagcuuuguuacaagagauugcugagcaugacaccuagacaaguucacgucccacccuugcccauaugagaaagaucauacucugagcuaaaagugcuguaguucauugucauacccaucuagauauaugugcuaacaccaauagacaccauaaaaccccuagagcuaggucuuuagauggagaacuccgguuacauucuaagaucuacgaagacaagagaacuauccuugccagaauccauuuuaucagaaaaauucauuuuuagaguuaucuaauaaaaauucuucuaaacuaaaaauccagaaauuaucucaaacuuauauugucaaaccacaggaauucugugauugagauucuuaagcaucaccugugaaaucaauucuccauccucagccagcaaaauuuuccuugccacugguuuaaagcuguguuaggcacauggcacaugcuagaugcuuauuaauugcugaaugaggcuaucccauugugguuucuuauuccauaucagagcauacaaaaugauguauuaguauggugaguccugucuuuugggagcuugacuucacauaccuuuccaauguuccauguuuugaucugcugcaguuccaagagaaguugcucaucauuacaaacuuugaguuugucuauuaaggcucugcagucugcaggcugagaaaagaaaaguauucacaaaagauguuuuggaaugagggaguugcaaauaaggagaaucagaaaaggaacccuuaagcucacacagcaauuuuccuuuugcuaggauuuacuacuuaagaaaacgagaugugccagacaaucucuugggauuaaaauggaaaccucaugagaaaaugcuuuuauucccccaacaauccaccugggcuuaaaaaacaaaaaaaaacaaaaaaaaacaaaaaacaaaacaaaaacccaccuuggauuuggauaaagguagaugcagacaaacuauuuggaaaggugcugacaacaaaaacaauaauaaguuaaacaucuaaaaaaaaaaaaaaaaacaauuaaggaaucuauaccauggucugaaaguuaaccagaaugccugguagguuauauugaaucagagacugaaaaguccuagugaauucacaauuaaaggugaagauuagcacuagcuauauuuuucuguuacauaaaauccuucacuuguaagaugguaaacagcuuccgaacuucguaaaacuaggacuccauucuuucuugggguuccuauuuccauacauuucugcucucuucuacugaugaauggguccauuugucagguaacaaggaguggauugagcauuuauagucaaguuucugaaaguggaaggagggaaagggauaggggcugggagagagaagccuuccguuaaugaauggcagcugggagaagugauuauuacacuuguucuuuaacuccauaaaggcaguacagcauccugggaauggaccagaggucuggaaccaaacaagucuggauucacuuuuuaacuucauguuuacuaagcuguuugaucaugagcaagucuaaccucuaagccacagcucucuuaucagaaaaacagaccuaauagcuaccucacaaauaugaaacucaaacgucugccacauacauaaaauacuuaucucccauuacaggagcuuaaauauucagagacagcauacuauuaaaaagaguaugacccuuggaaucagguaguugguaagcuaccucuuugaaucucagcauccucuucugcaaaauaaacuaacauguaccuauauauccagcaaugcugucgugagauucaaacugggagaaacguauuuucggcaucugaaacaacauggaaccuaacagggguuucuuuaagcuaaguccaaaccuuuucucccucuaagcauuauuaagaucuaccucaaauguucaugguaauuaaauauauguaaaauccuuggcacaaaauccuuccauaaaccaggccugcacuuuuuccucuucuccucuaagauguaaguugagggagaggcagugaagcagcagaaauagauaacauggaaauuugaaccaccugcuuaugcaguucacuugugccugcuggaccuacuuggguccagcaucaaacguguuacuucuauuucuaauggaaugcagcuguacaaauccaauuuuacgauguguagguaagaugcaguucaugaugaacauuuggauccuguaauaauuugguaugucccauaaccaggcauucagucuuuaccaaggcccaguagcaagccagaagcugcuuuugugaauguagaauagcugguggcagaggacagcacagccaagaaucuaggggucuuacuuguaauucuauuggggcuugccaaaagcacaacauggcaucuuuagcugacaccuaagucagucaccugggucuacuaggucauaauguccaagugauagggcaacuuguaucauagccuggaccuuuugcagagucuuuucuagauccaaaccuuacuaacacuuuagugguuccccacuaaauguguuagagguuauccaguaaauaggucaaaauagcaugccuaaaugugaccaaccaauauguuggcuccaaaauccaaacgcaucacacauuguuccucuuucuucacagugugugguacaagguacagcaacuucccucucacuuuagaagggauaucccaauauuucccaaacccuggggccacuagaaacuuuccuaaugugaaaaggcccucaagcuuccacaagguuuguuucugacucucuggcacaaauaugucugaggcaucuaaggugugcuuguguuuucugcucacaagauccaguuagcauaauggcaucaauuuaauguaccaguacuauggucucuguuuuaucagacuaucaaggucccuugcauuuugcaggagaaagcagcaagcacaacguuaagauauaagaaagcauuugccaguucgauagcucaauaacaauugccaggguuuacagugauuuauuucaauagauaccaaaucuggggaaaaaauccuuugcacagcuacugauacacaaagugaucaauaaaagccuuucauaauaguaccuagcauugaccacaguaugggaaaugggggcaaucauguaugcugcucaaggaaaauagacaacucaagucuuaaaaauguccauaaccagugacauaaaaauuccacuucuaggaguuuaugcuaaguaacuugcuaguaacuaggaaauaagagccagaaaucaguauaugacuccaagagcaaccccuuacaauccacuagguuaaaaauuguuuuuuaauuugcauuucuccaauuacccgcuaaguugaaucuugcuggacguuuacuggguuuguucuuuucuuaaaugcccuaugcccauuuugucauugggauauucauuucuccugauuuagcuacugaaaauauuaacuacacuggguuacaaauauuuuccccagcuugucaugugucuucccccucccccaccccaccugagcuuauuaagggguaaaugguauacaaaaaaacugcacguaauucaugcauacaacugggugaguuuggauguauguauacacucacguugccaucaccacaauccagguaauaaacauauccaucaccuccaaguuuccuugugucccuacgugugugugcaugauugugugugguaagaauacuuaacgugagaucuacccucguaacaaauuuuuaaguagaguagucccucuguauccacuggggauugauucuaggacccccaugaauaccaaaaucuaugcugcucauccuuuguauaaaauggcaaugguauuuguauauaaccuauacacauccuccuauauacuuuaaaccaucucuaguauuacaauacugaauucgauguaaauagcuguuacacugcauugcuucaaaauuucuauuuuuacuuuuguauuguucuuuuuuauuguuuuuucccccaaauauuuacuauccaguugguuccaucugcaaauguggaacccacacacggagggcagacuauacucaauaccugacuguuaacuauaggcacuauguuguucuacagcagaucucuggaacgaacuugccugguauaauuuuauacccacugagcagcaacucccccuucucucucccaccauuuccugguaacuaucauucuacugccuaccuuuacaccuuugacuauuuuagaugccucauauaagaggauucaugcacuauuugucccucugcggcugacuuauuucacuuugccuaaugucuuccagggauuaauuuccaaaauauauaaggaacuccugcaacucaauagcaaaaaaaucccaaauaacacaauuuaaaaacgggcaagggucuugaauagacauuuauccagaugucuauuuacauacaaauaguuuuaaaauauauaaaaaggugcucccuaucaaggaaaucaagggaaugcaaaucaaaaccacaaugagauauuacuucacaccuauuaggauggcuauugucaugucuuuuuaauuuuggauacaguauuuaacauuuccauuaugguuuuuuuccuuuguuuuaaugcuuggaaagaccaugcccacuuaagacaaaguaaacauucaccuacauguucuacuucuccuauagcuuauuucuuuuaaaaacauuugacuuuugguuuaucuaaaauuuaucgcaauauaauagucccacaugcucuacaagauaaucauucuagcaugguuuccuaauacugucccuucuuuccaauuuauaaucccucuauuaccauauaucuaguucuuauauacacuaggaucacuuuucuaggucuucuauucucguagcaguagauucuuacauugguuccacuuuaaauuuuuaaauuauaguuucuuaagcaaguuuucuuuuuguccuucaguaaaagacauucaaguacacaguugucaaaacuucuagaugccaaaacacaucaaaaacaaaaucaaaagcaaaugaagauauuuccaacagauaugaaaaugaguacguucaauauauauggcauucaguaagagaaacacugauauuccaaugucagauacaaaaugaauggcacaagaagauaacugauauagaacagugaaauacuuucuuccccacuuaugaaauuaacaaaaauuuaaaagacaaucuguaauacugacaaggguauaugaagaaagugcugcucauacucauuaguacaaugcuaaaugaaaagggcaggauaauugugugugcacauguaauaauuuuuuaaaagacuggaagaagccugggcaacaaggcaagauccugucucuacacaaaauaaaaaauuagccaggcaugguggcaugcaccuauggucccagcuacucaggaagcugaggugggagcaucgcuugagcugggaggucaaggcugcagugagcugugaucgugccacugcacuccagccugugugacagagcaaaacccugucucaaaacaaacaaacaaacaaaaaaaacuggaagaaaugcagcaaaauguuauuguuaucuuuuggugauacuugccagguacuuuuacauuuuuugaaaaccaaguggcuuguauuuacgauaugaacuaacuuaugugccagauacuaugcuaagcaauugccucacaucaagaaggaaaaaauuuucagccccauuuugcagcuguggaaaccaggcaaguuaauaaccucucagccacaaaagucugguaagauucaaaccuaggucuaauuucaaagcuugugcucucugaacuaagcacaaggggucaacaggacuaucacaaugcaauaccacuuccucaaccuuagaaagcaguucaagcuagcugguggaauauuacuagauuaaagcugggauuucuacugucgacaaaggguuaauugauaugaccacccaauacacaaguuaagcugaauugugugauuaagaaucaguaauaaagacaagcuaaaacacuggccuuaacaaaaaaacuaguaagaaagauguuaccacuuucauuuucuaaaaaacaaaauugcaagaucccagaaguacauuaaaaaucugaacccauaucugcucuuuccauuauaccacacauccuuucugcauaggaaggaauugcacagcagccugagagcugacuucaggcacacacagcuacgaagaacuaacugaucgguguucacuuuccacuggucucuuggcuauccauuuuuuugauccagggaaguucaaaagaaaaucuuacuguuucuagacaaguuguuguuuuacugccuuuuguauauaugggugaugagauuugaagagcauggaugaacuguucacaaauauuuuuuuauuuuuuaaugaagaaaaaauaagcaaaguaaacuuuuggauacuuacagccucaguaggugucuucuucaguuuaguccugucuacuuucaugauuucaauuuucagcuuuacgaucugaaaaaagaaaaucccaaaagaagugagaacuuaaagcuacaaucuugagcucuacaagcuuggacacagacaauacagaaugaagagcaaugcaaaaugcuuaaaguaaaaacacuggaguuaugaugcuaugccaacucagaggcacagcuaucagguagagagagguaaagaaucucuccagaucaaacuggcccacaucccuauguugcacaagacugaaaccaaaucaggucaaaaugaaaauuuuuucucuuuuacaagcaucucaaacucuuaauugaaaauaagaguguacaauguuugcaacacaucucaggauggaaaaauucaccauagcccugcaguuuccugauaacuuccauuucuaggaauuaauccaaagaaagucguaaagauguacacaaauauuuaaccacaagaauccauacugcaugaccauguauaauaguaaaagacugaaaaagaccuacuguuccaucacaaggcuaaaaaaaagaucaaauguccaaaauacgacugguuuaaaauggaaugucacacaacuguuaaaaauauugcaaacuauguaauacacaaagauguucaugaugaaauaaaaagauuacaacacagaacauacgguauaaaacuuaugucuaaagaaaacagcuuagaggugcuaggcaucagaauauuaauucauuguuaaccaaaaggauuaaguaugacuguuuuaccuaugcaccuuuuacuguuccuaccaauaaaaauguauuaguuguaucauaagagcaaaggcaaaacaacacuuuuuucaacuagaaaaugaaguauaaggaucacaacagaaauauucugagcacagaaaacaaucauuuuauuaagccauguaauuuggaaggcucaaaagcagacaacagccugaucagauccacuguauaaucccuagaucuuugauggcagacaaguccuccaaagcacaagaagaaauaaguuucuccuguuagcaacuaagacacaugcacagagguagaaguggguugcaggcucuuuacacacaaaagauucugcuauuaacaauguauuuaacucaguggcagucacuagaaaucaauguuccucccccgagaaggcugccauaauauaaagcugaccaauuacaguauaaauuuuaggcagcuuuuugccuagauuuaguccaauauacucaguacuauggaaauagcguguauuugccuguacgaccuguauccauucaaucagcaggcauucaaggaagaguuugugaaaaauucagaauacguucuaaaacauuucugcagagaccauuccuuaagaagaaaaaauguuuucuaugguugauauuuaggguguguaauuccagauuacuuuuuaaaaaguuaucucaguaucaauacaaaaugaacaaaaugccugaugccaacaaccucaaaauaucucaaaugaagccaacaggauucuggcaacaauccuguccaugugguggaaacuauaagcugagcuauuuguacgcuuacucucaaggcuuuuuuccuccccuuuucucauaaacgucuuacgcaaguggcugucacacuauugucgcuucagucauuugcagggaggcuauuaaacugccccugcugcaagacguagcagccagccucaauacaacucaaauaacugaugcuuucccucuaagauuaggaacaaggcaaagaugucuguuaucaugacuuuuauucaacauacugcugaaaguucuagccaauauaauacaguaagaaaaagaaauaacaggcacacagauaagaaaagaaaaaauaaaaauggucccuauuugcagaugucaaaggaucauccacauagaaaacccaagaaaucuauuuuaaaagccucccagaggaugggcgcaguggcucacugcacuccagccugggcaacagagcgagacuccaucuuaaaaaaacaaaggccaggcaggcgcaguggcucacaccuguaaucccagcacuuugggaggcugaggcgggcggaucaugaggucaggagauggagaccauccuggcuaacacgguaaaaccccgucucuacuaaaaauacaaaaaaaguagccgggcguggaaggacaagccuguaaucccagcuacuugggaggcugaggcagaagaauugcuugaaacuaggaggcggagguugcagugagccuagauuguaccguugcacuccagccuggcgacagagcgagacuccaucucaaaauaaaaaaaaauaaauuagccaggcgugguggcgagcaccuguagucccagcuacucaggaggcugaggcaggagaauggcaugaacccgggaggcagagcuugcagugagccgagauagugccacugcacuccagccugggugacagagcgagacuccagucucaaaaaaaaaaaaaaaaaaaaaaaaaucaaagcucuaaauacauggagagaucuaagacucuaguaaagaugucaaaucuccuaaaauuguuauauagguuuaauauaauuccuauucaaaucccagcaagauguuuuuuuguaaauaagcugagauuauucuaaaguguauauguuguauaagaacaacaauggcugaaacaauuuuggaaaaaaauaaaagagggaggaauugaauuacccuacccacuuuuaagacuuacuauauagcuacagacaucaaguaguacugauauauauacaaguaucaauagagcagaauagagaacccagaaauagacucauacaaauaugcccaacugauuuuugacaaagguuaaaaaaaaaaacaauucagucaaggaaagauaguuuuaucaacaaauggugccagagaaagcagacaugcacaggcaaaaaagaugaacuucgaccuaagccucacacuuuauauaaaaaauuaacucaaaaugaaucacuuaaauauaggacaauaaaauuuacuaggagaaaauauuugcaaaccauauauaguaucuaaaauacauaaagaacucucaaaauucaacagugaaaagucaaacaaucucaguaaacuaggaauagagaacuucuucaaauugauuaaaauaucuacaaaaaaagcuacaacuaauaucuuaauggucaggaacuaggagcauucccccuuaaauaaucacaaacaaaaaaggccaggcgcaguggcucaugccuguaaucccaacacuuugggaggccuaggugggcagaucauuugagguaaggaguucaagaccagccuggccaacauggcaaaaccccuuaaucccagcuacucaggaggcugaggcaggagaauugcuugaauccaggaggcagagaucgcagugagcugagaucgcgccacugcauuccagccugggcgacagagugagacuccgucucaaaaaagaaaaagauguccucucuuaccacugcuuuccaacacuguauugaaaguccuagcuaaagcaguaaaggaaauaaaaauuauaaagauugggaaggaagauacagaacugucuuuuugucagagaugacaugaucauacaugcagaaaaucugaaauaaggaaaaacacccuggaacuaacaagcaauugcaccaaguuugcaggauauaagguuaauauacaaaagucaauugcuggccaggcacgguggcucaggucugcaaucccagcacuuugggaggcugaggcgggcggaucacaaggucaggagaucgagaccauccuggcuaacacggugaaaccccgucucuacuaaaaacacaaaaaauuagccaggcgugguggcgggcgccuguagucccaacuacucgggaggcugaggcaggagaauggcaugagccugggaggcugagcuugcagugagcugagauggcgccacugcacuccagccuggggcgacaaagcaagacuccgucucaaaaaaaaaaaaaaaaaaaaaaagucaauugcuuuccuauauaccagcaacgaacaagcagaauuugaaauaaaaaacauuuauauuagcaccccaaaacugaaaaacuuagauauaaaucuaacaaaauauguauaaggucuauacaaggaagacuauaaaauucugaugaaagaaaucaaagaacaauuaaauggagagauauuccaaguccauggauaggaagauucaauacugccaaaauguuaagucauuuccaacuccacagauucaaugcaacuccaauuaaaauuucaacaaguuauaugaauacugacaaacugauucuaaaauuuauaugaagaggcaaaagauccacgauagccaacacaauaucaaaggagaagaacaaagucagaagaccuacauuacccaaaaucaagucuuaucauaagacaacaguaaguaagaguacuguaccgguaaaagaaugaacaaaucaauggaacagaauuagggagcccagaaguagacccacauaaauauugucaaccgaugaucuuugacaaagaagcaaagucaauauaauggacaaaagauaguuuuuucaacaaauggugcuggaacaacucgauacauacaugcgaaaaaaaaaaucuaaaccgaaauuacauguuucacaaaaauuaagucaaaauggaucacagaccuaaauguaaaauauucugcucuguaaaagacacugucaaaagaauaaguggacaagccagacugacagaaaauauuugcaaaagacauacaaaggacuguuacccaagauacacaaagaacucuuaaaacucaacaguaagaaaacaagcugauuuaaaaaugggccaaugggccaaagaccuuaacauacaccucaccacagacagacagauggcaaauaaacauaugaaaagauacuccacaucauacggcaucauggaaaugcaaauuaaaaccaugaugauauaucacuacggccaaaacccagaacacugacaacaccaaaugcuugugaggauguggagcaaguggaacauucauucauugcuggugggaaugcaaaauaguacagccacuuuggaagucaguucagcaauuucuuacaaaacuacucuuaccacaugacccagcaaucaauacucccugguauuuacccaaaggaguugaaaacuuauguccacacaaaaaccugcacauggauguuuauaguaccuucauucacuauugucaaaacuuggaagaaaccacaauguccuuugguaggugaauggauaaacugugguacauccagacaauggaguauuauucaguacuaaaaagaaacgagcuaucaagccaugaacaaacauggaggaaaccuaaaugcauauuaguaagugaaagaaaucaguacaaaaaggcuacauacuguaugauuccaaccacaugacauucuagaaaagaaaaaacuauagagacaguaaaaagaucagugguugaggaggguuaguggggagggaagaaugaagagguggagcgcagaggauuuuuuggccagugaaacuacucuguaugauacuacaaugguggacacauguuauuaugugucuaaaccccaaaaguauacaccaugaguaaacccuaauguuaacuauggccuuugagugauaaugauguaucaauguagauuaaucaauuguaacaaguguaccacucuagugggagauguugauaacaagggaggcuaugccuguguggaggcaggcaguauaugggaaauuucuguaccuucugcucgauuuugcugggaauguaaaacuacucuaaaaauaaagucuauuuuaaaaaaacaauccuccaaaacaagagcacagaguaacuuaugcacugaaauaagcaaaucacaaccauuuuacuuuuuuaaugcagaugagucacugaugaaucuucaaacaaauaagcaacuugcucuaaugcuguuuugaccuaguguacuauacuagucaagugucuguaacuacagaaagacuggauaauuaaugcagccaaguaauuuacuggagaguaucugauagcucacagaacugacagaaggcuagagcuccacgugcagaaaacuaagaggaaccaaggaagcuagggagccuggaacuacagccagaccccccacggaaacagcuuagcuugggguacuucugcugccaacacaagacucuggaugccuagaaacuaugcugguggcauaauucuaaaucaucucagguuauuugcaugaguggcgcuagacucuaagucccaaguguaagcauuugaugcacccaauaaaauaacagagccaauaugaaugcacacacacaaauguucccauaacaagugcaguccuaccuuggugucuauaauucuacugcaagaaacauuuguaguuuaaaaaaccaagacaucacuguccaugagacaucaacuuuaaaaauuuagaaguuguuguguucucauauuucuaaaacugguuucaacagugggaggggggaacguuaguauacugaguguccauuacaagccagacaauacugagacuggaguuccccaaaguguguuagaaugucuugcucuauaaagggagacaagaauccuguaauuugggaaauguuauagacagaauuucucuuccacuagggcagucacauagcuaauugacauuauuaauggcucuaagacaucuuagguaaaggaggcuuauuagcgcacagaaccauuuucucaaguggcaucuacucaaaguccaauugaaguauuccaaagaauacaguuugagacaugcuaccuagggaauucauaugauauuuuuucauacaguccucaccacucaagucaaguuuugccucuauuuacagauagaaaacugaaguaagagagaaaaaaaguaccuuucuuggucaguaaauguuagcaccaagaucuaaauccaggucugacuaccaaguccaugcuuuaauaacaugcgauucacuuuuuuuuuuuuuuuuuugagauggagucuugcucugucgcccaggcuggagugcaguggcgcaaucucggcucacugcaagcuccgccucccggguucacgccauucuccugccucagccucccgaguagcugggacuacaggcgcccgccaccacacccagcuaauuuuuuguauuuuuaguagagacagaguuucacuguguuagccaggauggucucgaucuccugacguugugauccgcccgccucggcuucccaaagugcugggauuacaggcgugagccacggcacccagccucaccuuuuuuuaaaaccaguuuuauuacuacaaaauauuggcagauaagaauaaaaauuugugacagauucuucuagacugcugaauccuauuuguuugaaaaaauuacuccaagagaggaaacuagggcccaagaugagaagcugagaugcuguaauuucacuaaugaaaggaacaguaacuggggaaugaguucuaccucuuagaaguuaaucaggugaaaacccuauuacauuuaaaaaaaaauccuuccauaaaaauaaguuaguuugaaacaaauuccuagaaauggccuacugccuuuguugggucagaaccagaacucagggcaccaagcaaucucuauauauaauaaacauugcuuccuaaacuuagguuagaaagauagccaacuuaaaagaaaacaagugaauuacuaugaaucaccauccauaucuauuaccauuacuucaauacuuuuaucuaauauuuuuuuucacuuccuuauucccccaaccuuuccuuacaccccugagguuugaaucuugguuuuguacaguuuaccugcagaacaaguguacacaacuaaaauauccugagggaagccacucaaagcgugacucauauucuauaguaaucaccuccaguugauaauauuuaaaaauaaugacuuucaauacugaaucaguuuaagggcacaggacaccuguaguucccaaaucuggcucaagagcaguuggauguagugaaagacuagccuuacuaaucaagugugguccaaggaucagcagcacugacaucaccugggaguuauuaaaaguugcagaauuucaggccccaccuagauaugaggagucagaacccgcauuuuaacaagauccuuaggugauccauauaacaaaguuugagaagcacuagaucagaauacagacucagaaaaccugggcuagaaucccugcuauaucacuuacucacugcauaaccgcagacaaauccaccucucuaugcuuguuuccucaacuguguaauuauucuuuccauuuaguucuuggaacacucuaauuucuaaguucgccgcuggaauguuuuugccaccccuccuuucccacaacuaguuccauuugaggaacugacauuuaaacuaagacccagagaggcuuuccaugacaacccaccucaaguuggucccacuguaauuuuucuauuauagcacccaguuuauuuccaauuuccuucauaacaaguaucaacuguaauuacugguuugauuuucuaagauguuaagcucucaguaccuagcacgguaucuuccacaugauagguaugcaaauauuuguagaauggaguucaggaaagacguaugcauuaagaauaaaaucugugauugucagcacacauauauuacuugaagccaugggucuggagaugacugcuuacaaagaaggaaaggaggaggcccgcaacugaguuauuugcucuagcauuuaaagguaaggcaaagaaggggccggguacaauggcucaagccuauaaucuuagcacuuugggaggcugagggcagauuccuuaaacgagaccagccugggcaacauggugaaaccccaucucuaccaaaaaaaauacaauacaauaaaaguguaaagguaaggaaagaaggaaaacccagcaauggagaggcuagugaggaaagagcaaaacuagcuaauuaugcuaucacgagagacgaaagauggcaagagugaucaacugcaucaaaugucaaaaugagguauguccacugaaauugguaauagagacaauuugacaagcaauuguuucagugggauggagggaauggaagccagacuagagucagggaaucaauggaaagugagaaagcauaaaugguauguguaaaaaccucuucugaaaauguugggccaggggcaguagcucacgccuguaaucccagcacucugggaggccgaggcggguggaucacccaaggucaggaguuugagaccagccugaccaacauggugaaaccccgucucuacuaaauacaaaaaaauuagccgggugugguggcgcaugucuguaaucccagcuacuucggaggcugaggcaggagaaucgcuuaaacccgggaggcggagguugcagugagccgagauugcaccauugcacuccagucugggcaacaagagugaaacuccaucucgggggaaaaaauauauauauaggcuguaaauggaagcagagaauuauggggucacugaaauguagaggaaaagguaaauaaagacacuagcuuauguucucaaguggcugcaaacugucuugaaaagacggaguaacuguaagaaucccuuugaaaauuggggguaggggaccauuuagccucuauuucacuguaauauaauaagcacuuaugcagguuugaacagaaugauauccagaauuuggacaaucuucucccgaaccccucaaaucuugacuggauaucccaccauaugugauuacauuguacucuguaccuaucacuucccuauuuaugagaaaaugucugccacagggugggaaaguuaaaaaaaaaaaaaaaccugggaagggaagaaauacacauuauuaguaguuggccuuuaaugguugccucuagcuggcaggguaacacauaguuuuauuuaugcuucaugcuuuucuaauccuuccaaauuuccuauaaaucauggauccauuuauaaucagauuuccuuuuguaauuuguuuuuuuaaagaaacagggucucauucugucaccuaggcuggagugcagcggcaugaucuuggcucacugcagccucaaccucccaggcucaagcaauccucucaccucagccuccagaguagcugggaccacaggcacacucuaccacgccuggcuaauuuuuauauuucuuguacagacaggguuuucgccauguuguccaggguggucucgaaguccugaguuaaaacaauccuccuggccucagccucccaaagugcugagauuacaggcguuagccacugugccaggccuaaaauuuuccuuaaggaagaaaacacuggccccugagccaaaggacaugcaccagauuaagaacaccaucuaaacaaaugccuuagauuagcugcugccuacucuaggagcuucuucccuacaucuucugguguuuggagcuuggcacacaggaggcacuuugguugauuauuagcagguaagagauguugcacguaaguacgggaguggggaugaaucaaaaugagccuaaaauccccauagaaaucauggaagcauuacggcaguucuuaaacaaaaaaugcuuagagaaaacuaaacuccaaaguaccacaaagcaaaauacuuuauuuuuugccuugcaacgauuuccuuuugccuuauagucucugaaaguaaauucaggugagagcugcccugagcauucuucaugucaacaagcaguaagaugcaucuugaaauccagccugcuauucacuauuugauuauagaggaauaggugucacugauuaugauuuguuaaaggggacaccacauaauugucaggccuuuccauccuaucuaguuucugauuaucuauuaauacauuaauauccacucaacaaauauugugaaaaacauuuaugaucauaaaaaaauagcuaacacuuacucuauaccuauugugcauuaucuuuaauccuuggagaugaagacugugcccaguuuacugagaguggccacauaccuauuaagugguaaaacguggauucaaacccaaaucuguuccacaacucuacauugcacauaaugucuauaugcacagcccaccuugcuacgccccucuccuacagacaccagucucccuauccuuagccacauaaaacaugacucucaagugcccugagaacugcugaccuagguuuuacugggcacugacaguaaagugucauaauaaagcaacugaaaaauagccuuuacucacccaagacaaaucuggaaauuauuugcagaaauaccuugaaggagucucucauuuaaaaucugaaaacacacuauaccucagauuaagaguuuaugcuggcucuggguguuucucugcacugcaguuaugcuuaagcaaggaaaauaugggcagggagggauacuaagaaagaggaaucugaaaccuccaauguugacuuugaacgugagaauaguaucugagaacacaucuccugccacauccucuauucaaacagucuggggaagcugcagaucugggaguuauccuucccggauacucccaauuacuuagagaaacuggcaucagaagaacuaggcaaccaaacauggcucaccaaaguugcagauuaucaauuuuaccaauacagaggaaaugacagcaugcuaaggagcccuucuugguauucucaacaaaaaauaaaaacagcaaugccuaaguguaaguuaagcaaauuaagcaggagaggaacagacuccuugucuacacauuuuaaauugguacucuggaauauuccuagucuacaccuuaagaauugucaguuucuggcugcaugccuguaaucccagcacuuuggaagccugaggugggaggauaagccugaggugggaggaucacuugaggccaggaguuuucccgagaccagccugggccacagagugagaccuccgucucuacaaaaaauaaauaaaaauuuauaagaaaagccugccuguaucgaauaggugaauuucacccagaagggccacaggcagcauucaaugaguucaggaaaguauuuucauuugucagaaguuauuuuaaaauuaucuuaaaaauaacuuacuucacccgagacuuauuuugaaaacuaaaaaugccugaccacacaggcauuucaaagcuaucuaauucaguaggucugaaguggggauuauuuuuuucaagcuguacaggugauuuggcagcacaggccagccuugagagccauggcauuagauuauuauucaauauaugcuuugccauucugugacuuaggaacuugcuuuaauaaaaauagaggggaggagcgggguauaaauagaacaauagcccuguguugaucacuguucaagcugggugacaguuacauggguguucauuaugcuuuuuucuauuuuuguauauguuuugaaaagucucauaaauugaaguuauuuuaaagugagacuuuuuccugcuggauccauccauucuauccuccacauuguugccagagcaaucucccuaaaacucaaaaccuaccuacaucaaguacaaacuccuuauuuaaaccagcauccaagaccucuaggaccuggucccugcuuaccucucuuaccagugcuaugauauuacauaauauuucccucagcuccccacaugcuuuauuuagccccaacuauauccugcauauugauccucaaucagcacaccucuuuacuuaccugacagucuccccacuaugcuugcugaguucugcaagagugggacuguaucauauuuaucuuugcauuccuguaccagcauaugaacugucauuuauuaauagcagauuaauaaaugaauaacuauccaguaaaugcuuaacaaaacuaaaaaaaauccaagucacauuaaacucuuggugaacugaaaaaaacaauuuagauucauuuaaccuucaucuuuccauucaacaauuauaaacauacuauaugcagggcauugagaugaauacucagauagccagguguacagaaauguagaaaauaaggaaaaaaaucagaaauaaaauagauuagaagcaaucguaauauaaaggcaacgaagucaauacacaaaaaaagagaauuacaacuuccucaugcccaaaggcugaaaacacaaccaauuauaagaucaauacagaagauaaauuaaauuugcauaauacagaguauaucuuuaagcaaaagugacacaguuagccaagcuuacccuugaccacuguguagaaaaauaagucuagaaaaauauauacaguugcucuucaacauaugaugggauuauaucccaguaaacccauuguaaacuggaaauaucuaagucaaaaaugcacuuacuguacccaaccgaccaaacaucauagccuagccuaccuuaaacaugcuugcaauauuuacauuagagccuauaguugggcaaaaucaucuaacacaaagcccguuuuauaauaaauguucaaugucucauguaacuuaauaucgacugaaaguggaaaacaaaaugguuauguggguacucaaguaugcuuucuacuaaauguguuucgcuuucacaccaucguaaagucaaaaaauccuaaguugaaccaucauuaagucggggacgccuguacuaagaaauacaagaacaaacaacauagcaauuuagacaucuuaaugacauauagagaaaaacaaguguagaggaaucuuuagaauuccucauccuauacugaaggaugaccacuacaaaaacccugaaauucugugggaaauuuuacauauguuggucuuuuucccagaagacggucaacagcuuucauuggcuucuuaaaaggaucuaugaccugaagaacauuaggaaccaaugcccuaaagaaaguuaagacacugucuaucuagccaugacaauguuuucccuuguauuucccuuucauuuaugaaacacagguauaugguauuuuuuucccaaagccacaugauagacuacugucaaauacaauaaagaugguaccagauaccaaagaaacagaauuccaccccuuuugcauuauucagcuccaauucucucauguccuuggguuugcagagaaacaagcagcaucucuaaagaucaaaccuccccggccgggcgcgguggcucaccccuauaauccuagcacuuugggaggcugagguggguggaucaugacaucaggaguucaagaccagccuggccaacauggugaaaccccgucucuacuaaaaauacaaaaauuagcugggcgugguggcacacaccuguagucccagcuacucgggaggccgaggcagaagaaucgcuugaacucgggagguggagguugcagugagucgagaucaugccacugcccuccagccugagugacaaaguaagacuccaucucaaaaaaaaaaaaaaaaaaguagaggcugaagacuaccacuggaagaaaaguaaaaaugaaguaaaggacaacagcauaauggaaaagccugggaaacagacagaucugggccuaaauuccauuuacuaggugugugaucuuagacaaguugccauacaucucugaguccagucaccucuguaaaauaaacaagucuaucucauaggauugugcccagcaaagaguaagccguauugcuauuuguucuauuucuuuuggcuccagauuaaucuaaaggcagaaaccuuaugcuagguauucuacagauugauaagacagaaauacagauauauaaaucugaucauaugcaaaagagcuggccuucucaaucuuucuacacauuaccugcauaugaaggagaacauacaguauauacuaaucuccauacuguuagccauaacugcagacaaccaacaacuuaaacucuacuuugaugacaaugagauugggaggcuccaguuucauucucaaauuauacaguucugcaaaagguaaacagucuacuaaauaaugugcaggccaugccacuuaaucaaaaauuuuaacugggucucaacuguuuugagcugguucaaaugaauuuggaaggaauggagacaaagauucuuuugcaugguuuaaaagagcaaguuauuuauagcaauuaucaaccuggcagcaaacucuuuccaggauguugaaaagaauuccaacuucacagguuuguuaugaggcucaaauuaguucacugauaagaaaguuguaaaacaaagccuuuaaaaacaaaggugucccaacauauagaaaaaaauggcugucugaguaaauuuuauggugcuccacacagccugacacauaguuauuucaaauguucuuaaauaaaccagacaauucugaacaaucuacugcuuuaaaacauaucuauuacaugaaagaugcuugcuagaaaugaaagugaaguaugcaaagguacucuaguucucagccaccaacuggcuuuaagaccuuaugacauucugggcuuccaacaugauguaaaauggaaguacaauaacuaagaucccuuaaagcacuaucuguaguacuuugccuucagucuaagacaaauguuaaauauuaaacaugaacaaucugaauuauuuucaaaaacuaaacagcuaaaaguaaccaugcuaguuuucuacuugccacaaauuccuagguuuuuaaaaaauaaaacuacacuucugcaaauaauucacuuuuaagcuaagaauauuuuuaaagaucaaauagacuuugccaggaagaaaaacaggagcuacuggcuaaccauuuggaugaaaauaaaaguacacaccuacuucacaccauuacuucagcauaaaaagcuuaacauaguauaaaaauacuuaacauaaguauauacuuaacacaguaauacuuaacuauaaugcuaaaagguguaaacuauuauuuuguuucaaucuuuuuaaaaauagcaaacauguuauaguuuaaaacaguugaaaaaaggaagggaaaauaagauggacuuagaaagcagcccuuuaauuugaaaaaguuuuacaagcaggaaauucagucucaucuacugauuuauagcauccauaaaugcaugaaaacacauggccaaaucgaacuguuccaugaaagagcuccaaguugaucucaugucagaaaguaguaacuacgguuaaaagggcaaagaaacugagcuuucuuuggauuuuugccuuucucacguugacuuucuacuuuaaaauuccccuauuuggggaguaacuuucucauaggaagaggaccacuuacuuuguauuucuacagaugacaccagauggcacauuuagaaauaaaguucaguuuuaaggagagauaaaacauagugaaaacaauacuggacuagguaaccuggguuugaugcucaauuucaccacuauccagccauguuaccauggauauguuauuacuccuacaacugggccuauaaaauaaggaguuugauauggauaauaggaaauauaggguaucauccagcuuuucuguuggacaugaagacuacccuuuuaaagcuguugguaauuugcuagagggagagaucugaauucacccauaaaagcagccugucuuuacuuuuuaaaagcaaaaaucuaaaauucucuacguaaaaggauaucuucuagugaugucugcaucucuccagacuauacuuccuuuuaaggcuggucucaccaagauauuuaaagaaauguaagaagccggggccuggacuccagauuggguuaacaaacugcaaagcccuccaaaguagaagagucaaacuagccccuggaaaaauauggcagcagauauguauaugucuauguauauacguguacguacguauauguauauacguguauauaugcagugagccaucuacaacgauacuggcuauauccagauuuauacucuucugauuuaucaaggcuuauccugaugugcuacaauauuguaaaucaugauggaucauauacuaaacauaucacagugaaaaaugcaagguuagccuuucuaaaggccaauuuagcaaugaguauuaaaagccuuacauuuuuacauuccgguuguagaaauuucuuaaggauauaaauauggaugucacgcaauggacuuuggggacucagggggaaaggaugggaaaggggugagggauaaaagacuauaaauuggguucaguguauacugcuccagugaugggugcaccaaaaucucacaaaucaccacuaaggaacuuacucauguaaccaaauaucaccuguuccccaaaaaccuauggaaauaaaaaauuaaaaauauuaaauauggaucucauaaauauuuaucuauuaggauguaccuaugcuucuuucauucgacacuuauuuacugaaugcugaauuaccuguauguuaggaggcauuacuuaaaaucaugagaaacugggacuggaaaagugugaacacagcaaacugguuaaauaaauucugcauacaauaaaauacaauguagccauuaaaaaugcuacagaagcugggcacaguggcucacgccuguaaucccaguacuuugggaggccgaggcgggcggaucacgaggucaggagaucgagaccauccuggcuaacacggugaaaccccgucucuacuaaaaauacaaaaaaaaauuagccgggcgagguggcaggcaccuguagucccagcuacucaaaaggcugaggcaggagaauggcgugaaccccggggggcggagccugcagugagccgagaucgcgccacugcacuccgaccugggcgacagcgagacuccgucucaaaaaaaaaaaaaaaaaaaaaaaaagcuacagaaguauacauaaugacagagacauggaacgggucaauacgugggaagagcaaauuuaacaauaccauuucuauacuaguuuggagaaaacagcuugaaaaaagacaguuuggggacaccugagggaaaaguaugaacacagcaaaaggugugaacaaagcaaacugguuaaauaaauucugcauacaauagaauacaauguagccauuaaaaaugcuacagaaguauacauaaugacaaagacaugaaacaggggucaauaugugggaagagcaaaguuaaaaauaccauuucuacacuaguuuggagaaaacagcuuggaaaaaaagacaguuuggggacaacugagaaaaugugaauaugaaccggauauuagauaauauuaagaaaaaauaaacucccuaggcgugauaaugguauugugguuuuguagauguccuuacuuuuuuuuuuuuuuuugagacagagucucacucugucgcccaggcuggaaugcaguggcgugaucucagcucacugcaaccuccgccuccuggguucaagugauucuccugccucagccucccgaguagcugggacuacaggugccaccacacccagcuaauuuuuuuauuuuuaguagaggcaggguuucaccauguuggccaggcuggucucgaacuccugaccucaaaugauccacccaccuuggccucccaaagugcucagauuacaggugugagccacugcgcccggcugagauguccucauucuuaagacaugcagcugaaagauuuaaggauaaagugucauccuuacuucuaauguugagaaaaauuaaacacacaucuguacauauaaaucuaauauggcaaauacuuaauuguuggauccagcugaugguauacagauguucauugugcuauguuuucagcauuuuuguuugaaauuuuucauacaaaauugaaagcuggaagggagguaaugaauuacauuuuaaaaagagcauuucugaaaaaauauauaauauggcuacagagcaguuaagaaaagccuucgaagaagauacugcauaccaaaauguuaagaguauuuuaucugugaguuugggguuugcggaaauuugucuguuuaucuguauuuuucaacaauaagccauguauaauucuacagucaugaagauuacuuaaaaacaaauucaggaaaacguuuucaaacaagaguuaacaagaaaaugagcaaacgaaaaaaaguucuauucccaaagcauucuuacuaaaaucagaaugcuucuuacaaacucuaaaauacuguacaaauuuaauauuauuuaauaauagguuuuuguguggccaccacaucgguuuugaacuuuuacuuacauucauaauuuauaccauucucacaguagaaaaauucaagcaauucauuguacugauuguaaggggggaagggaaugcuggguauuaaaaaaguaucuccuguuuaccuauacagguuaaguaucuccuauccagugcuugggaccagcaggauuucagauuucagauucuugaauaucugccuauacaucaugagacaucuugaggaugcggcucaaguuuaaacaugaaauccauucauguuccauacacaccuuauacauacagccugaagguaauuuuacacaauuucucguauaaauuuagguggcacaaguacaguucuguuacauggguauauugugcaguagugaagucuagacauuuaguguaaccaucacccaaauaauguucguuguacccuauacaauauuuuuaauaauucugcucaugaaacaaaguguuaaguacuuaggcguagaauuuuccacuuguggcaucguguugaaacucauuuuggggcauuuugaauuuuggauuagggacacucaacuuguguuacuuccaacuccacaaaaaaauguaaggcaaaaauaaauguuaaaaaugaucaauucuggaguggggguagggacagggauuguuguauuauucucuguacuucucaguauauuuuucagaaguagaaaugcacauauuacagaaaaagguaaaguuccccaugaucccuccucccaaauaaaguugucaguuugccaugguuuuuuuuaaaacauaaauagcaucacauaguauguacucucuugcaacuugccaaaauugccuccaaaauagcuguaucaauuuacgccacuuguaggcaguauuauaaggccagacucuuccuuauaccuuuuacgaugacuugauauuaucaaauuauuuuuuaucaaucuaaugacuaaaaaugaccuuauuuaaauuugcauuucugauuauuaguuugaguaccauuucuuguuaguggacguuuuuaguuuccuauucugggaaaugccuauccuuaaaauuuccuacuagauuucuuuucuuauuccuuaaacacuacccuuaucauuaagaugugaauacaccaaaauguuaacagugacuaaacauugugguggaauuauguauauccucuccccaaauaugcacacauuuucuaguuuuuccugaauucagugauuaaaaacuagaaaaugauaaaauggaugaaaaaaauccuuuuagacaaaagcauuaacuuucaggauacucuacuacagguuacccuuaaggaggucauaaaaucuagcucaaagaaauaaaugcaucuaaagaguaagucuugugaagaaaugaaacaauaaugguuugagacuauugauucauuugggguacguuuaacuaacuuauuuguauagcauuuuugaauucaugaaguacuuuucauuuaucuugcuuaacccuaacaaaacucugugacauucucugaugccuucuuguaaacugcuauagcacauuuuguucauuccucauauuaccauacugacccuuuugugugauuugcaagucuccuuccccuagaccacacuguccuacauucuccagucacuuaucuuuguauucccaggauguagcugcaaugacuacguccucaauaaauauuuguuaaaugaauaucaccaucuucauuuaaaggaugaggaaacuggcucagugaugagguaauuugccccaaguaacauagcuacuaaguauuuuauauaaauuauaaugaccuuaucuucguacuuuacaagcauuuaaaaauacaucaucucgcuuuaaugcucacagcaaccuaugaaauaggcuuuccgauuacuguuuuauagauaagaauggaaauuuagugauauacccuaggcccacucgaauccuaguuuauaugaaguacagcuguuucuuuacauuguacuugaucacuaccuggguaugggagccucuauuuuuauguaccaaguacauuaaggguaggguauaggggaggaaagauggaaguaaggcaguuuaaaggcacaggaaagaggcuggagcccagguguacaggcccaucuaaagaccauaaacugguauuguaaugucaacugcacaugccacucugaaauccaauauuggcccaaagguuuuucuugauauuacccuguauuaauagaagacaauuguuggcuuucucacauaucagcagucucaaaggcuggggaggcacacagaauuaggaaagcugugagaaacaauggacaggcuauaucaugcauagacagugcaggggaagaaaugaugacacaaaggaaaaggcuaaggaacuuuaaacaugauuucacaguccuuaacucgacugugaguuucucaagggcagagaccaagucucauucauuuuaugucccuuacuccuuauacuuagcaacauucaguaaauguuauguuaaaagaaaaaaaaagauauauuaagcuaaaaacugaacaaugacuuccauuuauucagcagcacuuauuacaugccacauacuauacuuuagauauuauguguaauguuuaaaaaaauaagauuuaccuguuugcugaccugccaugcauggugcugcccaaauguguuaacaguggugauacugaugacuauuaggaauacuuauuauagguuacuaagguuacaacagaaccuugaacaccuugaauaggaggggccaguauagacggagagagaucaagguaaccaauguaauacacauuacagaacuagcuaagacccuucagaggguauaaaugugacuccuaaggaguuccaaagugaaaaacuacucuauggaacauucaguuaucacuggccaaagucucagacccaaaauaacucaagaacaaacccuauccugccucaccacugaugaucccacacagaccuaaaggguccagacacauuuuguuaaauggccauuauuuucaccacccugacugcccaccucugagcuguugaaggaguuaaguaaaauaguacauuaaauaaauuaccaucuacugaucaccuaccauguacuaacaccuuacauuuucucuuuaauuccaauaaccauaugaauaagguauuuccccacaucauaacugauauagguuaacuugcccaaacugacagaccuaguaaguggccaggccccaaauccggaacugccugggcuccaugaucuuccuaugauuaucaaggcuucucaaaccuuuccaccuuaacucuaauaaaaagguagagaagaaugaagaggcaggcuagggagguuaaguggaaagagaaaaguggaacuugauagaaaguuccaagcuacccuuggcaaaaacagaauuucuuuugacuucaccuuuuaucuuaaucccauuagcuaauuccaggucuggggcagaaaugcacaagaaugcgccuggaaacaucuugacauaccagauagcaaggaagcuaucaaagacuacuagagagcaugucaguaagaaucaggagccaacuuuaagagaguuccacuagccacaagaagggcaauuugaacuucgcuaaggaucagaacugcaauguauugaaacccaucaaauguuuacaucuauggaugcauaguuauauauacacuuauauguguaaccuuuugaagaugacaggggaccaauucaucaucuugaaagcaauguuuuaaaaaauugaguauuuauccugcucuuccuauauaaacuauauugcugaguaaccaaauaaaagaugaggggaaacaaaauuauuccagcuaacagaugaaaacaaaaugauagcaucagaacgucaccauuuuguagccccccaacaaauuaauggauccaaaaaauucaagucaucguaacauaaucaauguugugaaugaacacccccccaccccacccccccgcaauauauuugccaaagggaacgaaccugaaauuuaucaagucucuggauccagcugccaauuugcaggaaauagagaaguaucaccugggaacuuaucagaaaugcaaaaucuggggccccuccuagaucuacagaaucagaaacucugggaguggggaccagccaaucuuuuaggaaguccucuaggugauucugauguucccuaaaguuucagaaccauuguucuaagcacuuuauaugcauuaacucagcuaaauuucuucagaacucuauaaggcaggcaguauuaucaucauuuuacagaugaaggaccguguggcacaaagcaguuaaguaauuugcacaacaugacacaccugguaagaaaugggagucagaacuugaacucugugaaucuagcuccagaguccauguucuuaaucgcugugcugaaaggucuuuccaccuguaagaacucaauugucagaaugccguaauaaagaauauuggaaguuuaaaaaaaaaaaaaaaaaaagcaaagaccaggagaaacaugccucacuauaaaauagacaggaauauaagaaaauaaucauagcaaauaauguacccaaaguaaucuuccaaaaucauuccaaaacauuaacagccaccaaauguaauauacccacgcacuucuggggcaauuaucucugauaucuaaucacaaggaccuaaaaccuggauugugcuaaaggugguacauaaauucaugacaguauccucagacucaucaaucuuuuaaaucuaaaugguuauagugaaaggucauuccagaauaauucaucucccuacuuuuagucaccauuuacuuaaugacuacugaaaggaaaaacugcugucuuucaauaccuaagauuauaccaucagaaucucagaguugaagaauuuuaacauucaucuaguucaaucagcaauccagacugaaucagaucuacaaucccaaucuccacguaaugguacauucauaauaaauuaaaacauuccaacuuucuguaaaaucacauuaugggaucauucuaugccaccaacuguaauuuuuaaagccaaaugacuaaaaacuuuuaaagagaacuuaaaaguugaaaaugcucagguuaacagcccaaacaaaaccuacaguuguuuuacucauagagccacuucuucacuaccugaaaggauuucuauauccagaagaccaagcuggucaacaaguacaucaaguuuuaacaacaccaccuaugaaacaucaaacgacuuaaaaguugaguuauuccugacauuaacauauauaaacaucuaguaaccagucguugaggaaacaacgaauaauacagcaaaacaccaaaagcccaaguacuuaugaauaucaaccuuauagauagugagaucaucauaaagcagccuaaaaguccuuaaaggacuuuaugcuaaggaaacauaaauuucagaugaaaugaaaugaaaaaucacaguaggaaaacuaagguuguguauaauagcugaaaaucaacauguaaguagaagcucucaaaaacuguuuuaguauugccauuucaagaacuguaugacagccaggaacucauuauuaggucuuaauagcuuagaaguuaugggucagaacagcugagacacuaacaucaaaagaauaaaaagcaacauuauaaaguaguauaaaaauaacuaaaucaccuaaggaaauugaaaccaugcaugaaaaaccccaaaggcacaaucaggucauuaggaaacacuagcuucuuccaccaggaggccuacuuuucauguggagcaaugagcaaggccaagacauggaacugaagucagguaucaaaucagacuuugccacagaaaaaggaauccaugacuaguuauuuuaggauagugccuaugacagcacuaucaacuccaacuaggauacaggagauuauagccauuguuccauuauaauggguccuccagggucuuuaauugagcaagaauggguuagacaccacuacugggcuguaauccccaaauauggggggcgggaaacuauauauaggacaauuucuucaacaaauaaauuggaagaaaaaaaaaacaaaagacagaaccugcagauuaaaauagauuuaacagcuguaucaaugcuuugcaauaaaugugcuuucucaggauccugauucaaacaaacuguaaaagaaaaaaaacaaagcuuaaaaaaaaaucagaaaucugaacauuuuauauuugauauuuuuaaauaucuguuaauuuuuucaguugugauaauaguuuugaucuuauauuuaaagagcccuugccuuuuagaaauacaaacaaguauuuuacaaauaaauaugacagggauuuauuccaauauaauccauugaggggggcagugguuagaaguauagaugaaacaggcugggccugguggcucacgccuguaaucccaacacuuugggaggccaagaagggaggauggcuugagcccaggaguuugugaccagucuaggcaacacgaugaaaccccaucucaauuuaaaaaaauuaaaaaaaaccaaacaaacagaaguauagaugaaauagaaugugcaaguugauacuauuaaagcuggugauggguaaguggggggauuauuauacuauucaauguuugcauguuugaaauuuuucguaacuuuaauaagaacugguuagacauaaugacuugcaauuuuauuuuuugaacgaugccuagggugauuuaaaaaaucauguacagacaucauucauuuaaacaauucccuuuaauucaguaaugagcuccacuuuaaaaaaagaagcaaccaguaccacaucagauccagagaauggaagaaaccaaaguagcuccauuacagaaugggaauacauccaccccuacuaucuccauuccaggaaguaaaauacaaauacuucccacaagauuuacaaaaacuaaccuaaaaucacagccaaucauacucauccuggugggaaauuccccacacugcuccaacagcuucccgaaccuuccugaccaaguuggccugcugguuucucuggaucacuaacccacucaggucaggcugcuggaggaccuacaaaaaaaaaguugggggagaggagugagauacacaacacauuuauuagggugugugaggaggguuaaccauucuauuauguucaaacauaacuaguuauuauuucuaaagcaauaguccuuacauaucuauuugcauuuuuuaggaccugcuuugagaaguaacugaggaauucagaaccaacaacucuaauacuucuaacgcuuagacaacauuccugaaaacugaguucucaacccaaaugaaauuauagaagacaguuuauuuuuuagacaaguuuauacccucaauauaaacacuaaggacguauuuguuucauuguuucugugaaaaaaaacaacaacuguacauauaaaaauuauucuucaccuucauacaugcuuuuuggccauauugggagacaaacgauaaacauccuggcaacucagguugaacuuugccauugaaccuuagacaaaguuuuuauuugguauugucacuccuuccucucuucucagagaucuaccuagaauaaguuaaacuuuuaggucacaccuagauuaucauucccagauuuauucuauugcucaauaagggucaaauugaaauugagguuuaauaaauuugugaucacugcuuaacccacgguaaaaugcaccaaugcaaaaucucaaaacagaaagugauuuccugcccuccaaugaaaauggaagaaaauuuuauuaccuacaaagcacuucaaauuaaauaaagcagacccugaaguucgaaacuagaguccacauacagcuaauugugggaugguuaccuccuguaaauuuuaaauccuaguaaacuuuucaccacguuucuacuucaauucccaucacccagccgaaguaaaauaauggggauaguugugcuuguauuaaaggguuguugcuagaauuaguuaaaaaaaaaauuguaaaaugcuacacuuuaauauuggucuaaucaauauauuaacaguaaggaagccuguaaucucagcacuuugggaggccgaggcgggcggaucacgaggucaggagaucgagaccauccuggccaacguggugaaacuccgucuuuacuaaaaauacaaaaauuagcugggcaugguggcgcgcgccuguagucccagcuacucgggaggcugaggcagguaaaucgcuugaacccaggaggcggagguugcagugagccgagaucgcgccacugcacuccagccuggcgagagcaagacuccaucuuaaaaaaaaaaaaaaaaaaguaaggaaaacuuucuccaagucaaauagucacaucuguuuaauaaguacguuagaaaauauaaaauggcaauaacacaacaggaaguaguguauuaaagagccagcaguaauuugcuauggaaaagaagcuggguauuccaaaugaucuuucucucucggacaggaauuaucuugcucagguaagaagaugccaaauagcagauccccacacugaucugaggaaccaaacaaaugagggaggugaaaaguagcaugaauacuucaaaacuagcuaacagaaguuccuuuuaccacugugaaaugcaugacaccaaauuacuuuuguagagugaaugacaggacagacugccuuugaaggaguggaagaaaugaguaggcagggcaugaggcaccccuuccaaaagguagaacacuugggugugguucuugacaggaacauuauggcugguggucauuccaggauagugauuacgcacugaaauuccuagaccauuagaaggaaacaaagagugggaaucacguucaaacaucaugaaccacuggagauaaaaaguuuggccuaugaggaaaaaaaauauaaacguuauagaucuggccuagaaauacaccaagaauguacaguuaaagaaacaaaaaucucuuacucuuucccaggucauaaaauuagcauaugacacagguacaucuaccaaugcauucuuacaccaaaaaguaauccuaauuuauuaugugccuaccaugagcuaaacauuuuauuuuauuuuauuuuaacuaauucuagcaacaauccucuaauguaagcacaacuauucccauuauauagaugaacugagaaucugaaaauuugcccaaggucacaagguucaaugugaacccaaaacacacccaaaacacacacuauuaauuucaccauaccagaccgccgccuaugacuggggaauguugguaucuccucaaucuaugcaacacuggggcuaaaagaaaacaaugcugaacauguaaucuacaaaggagaaacaaaugauagggaauuaacugccuauaguaacgguggcauggggggaagaggaaauaaagaacagggcagacuggggggcaggacaaucaaugcuguuuucuaguaaauggaagggguaaaauguaguggagccugagaggaggguuaucuuccuucuaagggauucagcuccuggaaaaggaguauggggagugggggauagaaagauuaagaagugagaagcagguaagaggugcucagcagcaaaaauagauguccacagaccaagaggcuccagaaacucagagcaaggcagggaaaaggggcgguucccaggcuugcaggggaaauggaagaggcagggaagacagaaagcggguuuacuggagaguuauccucuacagccuucugagggggaggaaugaggaaggcaaggcuaauggccguaaacgaaaaggccacuuaaacugcaauauccaaacaccgacccguucauaguuucgcuuaauagugguuuagcagcaugcagagcuaagaaauccggaucagagucauacaaacaugaagacuuaaggaaauggaaggcuacuauggcaccauccacaaagauggaguaaaugcaggcaacaggauaagcucuauucaacgccugcgccaaggggaccaauggaagggggagacagagcgggcuagaggacuuaggcuaaacucgaauuuagaacuggggaaggagucacagggaaaagcuuugacuccccccucccuuaaauaccagccucaacuauccacguagaugaagauuagaugggacgacagaauuaggagggguguggggagaggaggaggaguacaccagugacacuacugcuugaacccuaagccuuagcucuaaaaccgcgagaguuggcgaagaugaccccaccucgagaaaaaccaggguauucauccgggucgucggaggugcugagaacggagguuggccggcagaaaagguaggggaaaggggccacucuucauugguugcuccucuuucccaccguucaauuuaacccccaaccccacuccccagcgaacuccagacuccccucccacccuucccaauccgcccacugcggcggcgacaacggaggcguugaccgaucgguggggcaaaggcgggcccacacgcggccgaggcccaggaaauggugucgccucaacggacaagaaacgagguggucuucgccucaggucuaguuuaccggcaccccggcguuucgccaaucgucaccuccuuaacgcugggcaccucagaggcgucauaaaggcagauagccaacaccucugugcuggguccuggccggacagacaucagccuccgccgccaucuuaacagcaggcggaccgacccuagucacugcccccccaccccccacccgcgagcuaccucagccaccgccaacgaaucccacgaggacguaacccugcucccgcgagaauucuccggcuuagaacggcacgagccgaagaccuugccgccgccuccgcggcuacugcagucaguaaccgagccaccgccgccuccgcgcgaucccgcgagaaccucuaccggacgggaaaagccugagcccagcccuuuccagaccccuccucccucccaccaaagccgaaguagcuacagcuucacccuacgcgaagcgaaaagcaaaugacgcacaaccuaacgaagcagugaggggcggagccaaccuaccacggccggcucccgcaugcguugagaacuaucg

SEQ ID NO: 21581 - RNA, 6222 nt, Homo sapiens
uggcgcggagggaguagagcgggcgcugugggagggaacgccagagcgagguggugaggagagcugguugcgugagucuccucagcucugcuuaccggugcgacuagcggcagcgacgcggcuaaaagcgaaggggcgagugcgaguccccugagcuguacgaacgcggucgccauggaccgcccagaugaggggccuccggccaagacccgccgccugagcagcuccgagucuccacagcgcgacccgcccccgccgccgccgccgccgccgcuccuccgacugccgcugccuccaccccagcagcgcccgaggcuccaggaggaaacggaggcggcacaggugcuggccgauaugaggggggugggacugggccccgcgcugcccccgccgccucccuaugucauucucgaggagggggggauccgcgcauacuucacgcucggugcugagugucccggcugggauucuaccaucgagucgggguauggggaggcgcccccgcccacggagagccuggaagcacuccccacuccugaggccucgggggggagccuggaaaucgauuuucagguuguacagucgagcaguuuugguggagagggggcccuagaaaccuguagcgcaguggggugggcgccccagagguuaguugacccgaagagcaaggaagaggcgaucaucauaguggaggaugaggaugaggaugagcgggagaguaugaggagcagcaggaggcggcggcggcggcggaggaggaagcagaggaaggugaagagggaaagcagagagagaaaugccgagaggauggagagcauccugcaggcacuggaggauauucagcuggaucuggaggcagugaacaucaaggcaggcaaagccuuccugcgucucaagcgcaaguucauccagaugcgaagacccuuccuggagcgcagagaccucaucauccagcauaucccaggcuucugggucaaagcaguauccuucuaaucgauacuccguaggucagaagcccgugacaggaaaggggaaggugggggagggacagaaaagguaaagcggguggaggagagccagaggugggcaugaucccccuaucggaagacggacuagacuggguggaagagggauggaaggaggagggcaaaacagcagagaagcuggacuggagaugaugaagggugguggagggggggcggacauaaaaacuggaccacagaugggaaagggggaagaggaggaacauagcauuaaaaaaaggaucacagaugauaaaaagggggaggguaguaaaggggcacacagcaaaaaaauuggaccagagauggugaaaggaggaggggaggggcacguagaagaugaacugacucagagaccuugaagagggaggggaauggcacacagcagagaaacugcccagaaagggugcuugagccauacaaggcucuguaaaccuagauuuuugcuuaagauacuaggagaccccaauccuggcuggagugccuugcauuggagggaggggggcuggagccccugaaagaucaagagagggagugucuagguauagagaaaaaggaguuaaaugaaggaaaggggagaguagacacauacacauacauguaacauguuaggaacaugagucgaacauccuaauagaauuauguggauacagacccuuagcccucauaugaaacagcacaugguaagaggcccuuagcacccaggcauacaauaucauuuagacauaggaccucagcuccuagacacaguauuaugugaccacagguccucagcauguagacacauggcauaacuugaccacaagccaucagagccauucacacaucauguggacauggaccuucaacacccauacauacaauaacgugaccacaggcccucagcaaucaguuacagcaucacuuggacauggcccuuaagcccccagacgugcauuuugugaacacaagcuuucagcacccagugacauauaccacaugcacauggauugucgacacccuguagggccaccuaacauagagguuuaucaugggaauaaguauggguuaugucccaugacucacuugcuuuauacacaccacauaagcacagaaggaauccucaugcuccagccucucuuacugugcccuuccuggccuucccucccucccuuucacggaauagucaauccuugaccuaaacugcuccacucaucaguuccucaaccaccccagaauuucaauuuugaucaaccgacgugaugaagacauuuuccgcuacuugaccaaucugcaggucaggccagagagacauuuuuuaguaggaucgggcacgaaucugguucuuggaggugacgggaggugggugggaagggccgugguguguugggggggggacagauuccaccaucacccccaccuggagcagguacaggaucucagacauaucuccaugggcuacaaaaugaagcuguacuuccagacuaaccccuacuucacaaacauggugauugucaaggaguuccagcgcaaccgcucagguaaguggcaguaccagaguaaauccauguucccccccucaaucuguccuuguuuugucccaucuccauagccuucucucucccuaggccggcuggugucucacucaaccccaauccgcuggcaccggggccaggaaccccaggcccgucgucacgggaaccaggaugcgagccacagcuuuuucagcugguucucaaaccauagccucccagaggcugacaggauugcugagguggggcccuuccuggcaucaccagagaaggccuugcuaggcuuguuccugggugcguggggaauuaagaggaggaucuggagcuuguacuaauggcugucuuauuccuucuccccuuuuucaacagauuaucaagaaugaucuguggguuaacccucuacgcuacuaccugagagaaaggggcuccaggauaaagagaaagaagcaagaaaugaagaaacgguaaugggaguuuggucgcugagaggugguuuguuggggauggggaaaagacuaguguaacacaggauuuauggagccaaaaagggaccuuugagauaaucccaguggaauauguuuuacaagugggaaaucaugcccagaaauggcuugagguuacacagucaggggcagaagugggacuuuacccacccuagccccauuccugggaucccuuauagccuacugcuuccccaguuacuucccaccuuugagugcuaugaguacaccaccucccaccaacccuauacucagccacagccuuccuuacaguaaaaccaggggcagaugugagguggugaucauggaagacgccccugacuauuaugcaguggaagacauuuucagcgagaucucagacauugaugagacaauucaugacaucaagaucucugacuucauggagaccaccgacuacuucgagaccacugacaaugagauaacugacaucaaugagaacaucugcgacagcgagaauccugaccacaaugagguccccaacaacgagaccacugauaacaacgagagugcugaugaccacgaaaccacugacaacaaugagagugcagaugacaacaacgagaauccugaagacaauaacaagaacacugaugacaacgaagagaacccuaacaacaacgagaacacuuacggcaacaacuucuucaaagguggcuucuggggcagccauggcaacaaccaggacagcagcgacagugacaaugaagcagaugaggccagugaugaugaagauaaugauggcaacgaaggugacaaugagggcagugaugaugauggcaaugaaggugacaaugaaggcagcgaugaugacgacagagacauugaguacuaugagaaaguuauugaagacuuugacaaggaucaggcugacuacgaggacgugauagagaucaucucagacgaaucaguggaagaagagggcauugaggaaggugagcuaauccccccccacccuugucuucccucuuuucuuuucucagagcaagccuggccaaggacaggguaucaaggcaugaacacaaucugcuuuuauggaggaaagaaaaagcauucugagcaacuuuuuaaacaaaggaaguccagugaacauuuaacuuaaaaauguaacaaaaccccaaaaaaucauuuuaguucuaggugauggauagaugguuguaacagcagaagaugaagaguacacagagauaggagacaguggguggaaaacugaaaaggacacuucacaucgaggugggggaguggcaaaacacagugcauuucagcacagucuguacccggccuuggccuuuggcgcauuuccaggcuuguguugggagcagagcaugaagugaacagugugcucucugaguccagaaaagggugcagccaguucuaccucaagaaucggggugggggggguggcgggggaagagcuagaggaaaaaggugacauuugaacuggaggaugcauucacacugaggagcuuuauggagcauucuccguggaguggaucaucugaacaaggaccuggaagggugaaaaugcaucguagguugggcaggguuuccaaaauuauguccugaggaucacucaccagaucugaaagcugcuucccacaaaagguuucaguggucguauauguuggacaaguacugcauauaguaauacccucuuguagagucacauuagcaccuuaaaggcucugagaauaacacgagaauuauaaaggugcugagaaguacucagaugggagguggaaggggcaggaaaaucaacuacucuucggguuuuuuuggcuauggggucccuggcaaacuuccauugagggcaaggccagggcacuaagggaagaggaaugaauguggagccucaaucuagacauguucagguaggagagagaaacagggauucucaguucucuuccccucccaccugauggcaucucuuuucucagaaggggaggcagagcuaucugcccagcccugagggugggaguggggguggggaauuggguugcagaacacaaacuagggccucuuuggaucagacugggggagaaagcgaggaagcugccuggagaugaauagguuuauucagcugaggucagagcucaggaagagacacacauugaggaguacaagggggagaaaaagcuacuaucagagauguaucaguuuugacagaggcagggaucccacacugccuuccugccucccuccaucucccucucauucugugggcuugcuugaguacacccacacacacucuuggcuguuuguuccaagcagaggcgcugacaaguugucccaggccgcuaaaaacccuggcuauggucucuguucccuuuuagagugacaccuaucugcucaucuaacugccuuccuccauuuccccuuccuugcuucuccccuaugcaggcauccagcaagaugaggacaucuaugaggaaggaaacuaugaggaggaaggaagugaagaugucugggaagaaggggaagauucggacgacucugaccuagaggaugugcuucaggucccaaacgguugggccaauccggggaagagggggaaaaccggauaaggguuuuccccuuuuggggaucaccucucuguaucccccacccacuaucccauuugcccuccuccucagcuagggccacgcggccccacauugcacuucuggggggugaccgacuucguacacggguuuaaaguuuauuuuuaugguuuagucauugcagaguucuuauuuuggggggagggaaagggggcuaguccccuucuuuuggcccuccgcccccgcaggcuucugugugcugcuaacuguauuuauugugaugccuuggucagggccccucuacccacuucucccagucaguuguggccccagccccucucccugugcuguguggaguggacacccugacccccgaagcggggagggccgcuguggccuucgucacagccgcgcagugcccauggaggcgcugcugccaccuuccucucccaaguucuuucuccaucccucuccucuucccgccgcgccgcuagcccgccucggugucuaugcaaggccgcuucgccauugcgguauucuuugcgguauucuuguccccgucccccagaaggcucgccucuccccguggacccuguuaaucccaauaaaauucugagcaaguucagagugc

SEQ ID NO: 21582 - RNA, 26018 nt, Homo sapiens
gcuaaacacacugcuuuauuuuuacagcccacgucuuucaugaggauacgaauuguuaagaggcagucucguuuugcuuuucaaagacauuuuguagagauuuuucacuaaugugaaucugauuuuaucuacuugauucuguauagauuaaguaaauauguaugauaaacuuaacagcuucuguguauucuuucauuauccaugugaccuuaacuguaggaguccaaagguaccauuuuacccauuucuacucaaaaaguagacucccccgcccccccccacuaagcuuuuaaaaaaacacaaguuuuauuuuaaaacuuuauuucugcaaagccaaucaagaaguguuggaaggaaaaaguguaaaaguuauucuugcauauuugggaacagcaagcacuuaguuugagaaaaugaggacuuaaaacaguugaaucaaaggcaauacccugcuacuuguauuuaaaaucaauggugauguucuuucuuaagcaacauucuucucuucccuaauagcuacaauaugauacaguacgcaacagcucacuugaaagugcuagaaucagaggauaaagaagccauaagccaccccacuuacauuuccuacuauacaaugccuuuuuggcgcuugauaaaucaagcauucauguagcauuacauucaacagaaacauuucucguacuuuggguuuaagauccuugucccuccaguucggaugucgugacaucugacucuucaucauuguaaauauuuucagccuggagauaaccaaauaaauucacagguaaaaacucccuaugguuuucacauggucauguaaaaacaauuuaaucuauuuagaacuuaauaguuucauuuuuacauuucucucuuaaaaacuucaauaaggaaaugguaggcuagccaguauuuugaaaaauucuuugccaguguguaauuccguauguauacuuagccacccaucgaugcacuacuuauuucaaucacuguucauaagagauguuuuccaaaggcacuucaagcaucguuuagaggaagugguagcccagauguuauggaagucucgguuaacaacaacuuagaaaugucagcuacuuagugcucauccucagagaacuugcugucauuugaaugccuugaccucuccuuccuguaucccucaugccuaccacacagaacagacacuggagacagaguagcgacgccaagacuccaguguaugaagagcacaacaacaaugaaaaucagugcagaugcagagauuucuccugaccugacaggugcuacaaauagcaaacaguggacgaagcaccauaugggacuaaagauuguauuguugaaauggaaaaaguucuuuuaaacgguuucuguaaauguuuggcauaauaugcaccuacauauucgaaauaacuuuauuacauuauguaaguaguaaaucucuccuuuacaagacagucauucaagaaaaacauuuuaacucaccauuugccauaucugcaugauguuauccucagacacugagcaaaugacccaaggcucauugggguuccagcuaaaaucugaaaucuuagcaguguguccuccaugaauaaacuguuacaagaacaaaaaaagcuuugauuucauauacucuccuguuaauccuaacaaagguuuuacuaaguuuuuagagcuaucaguauuucaacugggggugggugcugucugguuuuagaaggugguacaggcucaguaaucuauuuauacuuauuuugcaaauuuccaaaccuccagaauaggugacagaauauaguacaauggauaccuguauacccuuuaccuagauucaccaagugauacuagcauaacugaugcuuuauccaugagccuauacaaugaaauggcugaagacuucagccugcaucccuuaagaaugaggacauuuuccuagucaaaaugccauuuccauacugauuaugaugaacauuaauccagcaucauuugcucauauacaguuaggugcaaacaucuaagguaaucaauccguuauaugccauguaacauacucuucuauuauacaaggggccugaggagucuucugguucuuccccucuccacuuuacugagagaggcauacuucuugcccaucuuuccaacguacacagacagcaccagggugaaagaaaaucccuggcuccaaaagcauagcuccagauagucccucauaagcuaugccuaaggugagagcuuugcuaaacaauucugaagagagcaguuguuccccgcaagagacaaccucgucggaaugcacuaugccuuauuuuuuuaucuuagaauuaagauuuaaacgaaacacuucuucacaaggacaguacuaaauacacuguuuggaacugggacaucacacuuucugacaaagucugauuugacucuaguuugacaaugaggucucugccugccaacuagguauuaugcaauguaucuauuuuaccgaauaaucuuaucggguuaaaaauaugagguggggcuggguaaaacucacgccuguaaucccagcacuuugggaggccaaagcaggcggauggcucgagcucaggaguucaagaccagccugggcaacaugacaaaaccccgucucuacaaaaaauacgaaaauuagccgggcgugguggggugugcccauagucccagcuacucaggaggcugagaugggaagacagcuugaaccugggagguggagguugcagugaacuaagacugcgccacugcacuccagccugggugacagaaccagaccuugacuuaaaaaaaaaagagguaaauagcuuuuuaaaguacucuuaagggguacacaagugaauauacuggccgggugugguggcucacgccuguaaucccaccacuuugggaggcugaggcgggcggaucacgaggucaagagaucaagaccauccuggccaacauggugaaacccugucucuacuaaaaauacaaaaauuagcuggacaugguguugcgcaccuguagucccagcuacucgggaggcugaggcaggagaaucacuugaacccgggaggcagagguugcagugagcugagauugcaccacugcacuccagccugggcgacagagagaguacucuuaagggguacacaggugaauauauuuuaagaucacuggggcuuagaaaacauacaggaguuaucaaagcauacugguggaauaguuuacuacuuuguuuuugggacagggucucacucccauugcccaggcuggagugcaguggugugaucauggcucacugcagccucaacuucccgggcucaggugauucuccuaccucagucucccaaguagcugggacuacaggcacgcgccaccacaccuggcuaauuuauguauuuuuuuuuuuuuuugguagagacaggacaggguuuugccauguuucccagccuggucuugaacuugugggcucacgugauccaccugccuuggccucccaaagugcugggauuccaggcaggagccaccaugcccaggcccaguuuacuacucucaaaugucccuugauuucaagcucucuuguaaaaagcaaaauccuaguguauuuucucaaggaccuuggaauuguugcagaggcauaauauacaaaguaauacgcuuuccuuucucccuaaaaaaaauagcuggagaccuugaaaacauuguacuaugugaaagaaucagucccaaaagacaaaagucauauuuauaugaaauaucuagaauagcccaaucuuauagugccagaaaguagcacaguaguugccaagggcuggaggaagaagagaauugggaggugauagcuauaguuucuuuuggaggggaugaauaauguucuagaauugauuuguggugauaguuuuacaagucuaugaauauacuaaaaaccacugacuucaagaacaaaaaaagaaaaaaaacccccaaaacccaagaacacucccuccccacugaacuguacacuuuaaagaagugaacugugugguauguaaauuauaucucaguaaagccgucaucaaaauaaaagggucuggagcauucuuacaaggugggcuuagugaacaucuucugugugcagggcuugcucucaaggaccuucuuuaccuuugaaaacuuguggacauucaauauacuccauagguucacagaaaaaaugaauaaauaaaacucauggacaaaguacaagugugccaaaaaugaguacuggcauuagaacuaaaaucguaaaugacagagugaugagugacuaucggccaaauaaugggaggagacaaauguuggauucagagcaaggacagggaaccauugcuaaauccggcaaugcuucauagaaaaaugacgaagugagcacugaaggacucagacgggaagaaugaggaugggcagauaccaccacauaagcuuucaaagggccaaggagaugcgugaugcuucaaucaggcaugggagggagauagugggcucugcuaacaucaagauugagaaagcacuccuuuucugggcaggaaacuuaaaaagcauuuaaaauuuuuucuauacuguuaggaaauguuaaguacugccaacugaauagcaauuauacucacuccccauccccaaaccaucacaaauaccagaguugaaaucagugagaaauuacuauauacuauuuuccaggaccucaaaccauucucagugaaacauucauaaaaaccuacugggcuccauuuacuauuuuugauaaaugucaaagcccaguugcaauaaccuucagggccuccauuuugaaaccaucugcaagagcuagaauucgaaguucugacccauucucgaaauaaagagaucaaugacaauccaaucugcauaugacauuucaucuucuauaagccaaugcguaccaggaguucuggaggcccaucuucugcaucuucugcugauuguucuuccccaauuuuacuguaagaauaaagaauauaacgcuuucaucagugaaauucuuguagcacgaacaucugcuaaaccaguaucagcccagaaaguaaucuuaaaacauaaacacacucacaaaaacaacuuauuucuauacuacaaucaauuagguuuuuuuuuuccuuagagacauggccucgcuauguuucccaggcugcagucaguagcuauucauucacaggcacgaucacugugcacuacagccuugaacuccugggcucaaaagcgauccucucgccucagccucaccacaucuggcuacuguuuauauuugguguaaggacgggauguuuacuuucuggaaauaaguuagaguuguucauaauugaaguugcagaaugaggaauuauugucaauaauaaacauuaacucaaaaucccuucauuaacuguuuauugccuuagaauuaaaaggugaaauguauaguuaaaaaaaucuacacauaaacugaugugcaaucccuauacuucacucaaagccuguugcaucccaggaguaaaauauaauuacaaaucaguacuauagaucugucuaaagauauggcaauaaaacuuugagaaauguguaagccaaggaaauguuuuuaugguuuuucucuuaaaaacuucaauuuguagaauuugccagugcucaacagugaaaucacucuuuauguaucaauaucagcccuguccuuauaccuagcccaaagacuuuaguaguaacaacuacuaaaaaacaaaacccagcccuccaagugagacauuuuuuuccuucccacaaaacuaaccaaacaaucucaaaccugugggauugcuagacaauacuuaucuuccaccugucaguauaguugcuaaaacucaccauuuuaaucccaaauuuuaucuaauguaauuuuacaauuuuuuguagagacagggucuauguugcccagguuggucucgaacuccuggguucaagcgauccuccugcuucagccucacaaaguacugggauuauagacaugagccgccaugccuggcccccuaucuaauguaauuuuaauauuaaacaagcuaagaaauaauucuaagaagaaauuacacacaaugcucacaaauuauuggcaccuucaggggcaauucaguugccagggcaucagacuuccaaaccuugcuguacgcuucauacaaccucuuuauaguuuugauuuagguuuuauuuuacuacuaaaauuguuuuuaaaucaaauacaaugcccccaacugucugcuuuaaagguuuucuacaucuucaaguauuuaucacggcaagaguuugcuccaucagaacccugaacauuagcuauuuuaaguuuuacauacaagcauuuuauucuccagcgucucuucuauauacugaggauuacugccucuauaauuaaggcagccuugguuuuaauauauagguugagcaucccaaauccaaaauguuccaaaauccaaaacuuuaagcaccacgugacacucagaauuuggacuuucacaccgagugcaauggcucaugccuguaaucccagcacuuugggaggccaaggcgggagaaucacguggggucaggagucugagaccagccuggccaauauggcaaagcucugccuuuauuuauuuauuuuuuuaguaaaaaauacaaaaccgggcaugguggcuguggcagugcuuguagaccuguagacccaccuccucgggaagcugaggcaugagaacugcuugaaccugggaggcagagguuacagugagccaagauugcgccacugcacuccagccugcgugacagagcaagauucagucuccaaaaaaaaaaaaagaaaagaaaagaaaagaaaaagaagaagaauuuggacuuucaguucagauuugagaugcucaaccaauaaaguauaaugcaaauauuccaaaauccuaaaaauuccaaaaccccaaacacuucuuauuccaaguauuuuggauaagggauauucaaccuguacuaaauucaguccacuucaaagcaauauauuuaauacaagcaggaaauaaguuauuuuuugguaauuuuaugauuuaaacuuaagaugacaucuuacggaggaguauguaacugagcaacuuuauuaaguucuaaaggcucagaugaacaaguaaaggagucuaaaauucuuagaacagcaagucugaacuaaaggaacuuuaaaaauuggcagaaacucuuuauacaaugaggccccagagaacauaagcucucugacagcuugggcuguccuuguccccuucacaaaggucuccccagcaguuacacaacccacagcaggagugcacaucugcagaaugaaucacugaaagcaaaguaaaugguacaaaaacccagaaaaaacaguccugccuacacguacugagauccaaugagacauaaaacagcuaacaucuugauuucucuauaucaaguguguuuuaaauacagucauuugaaugcaaaaacaaaaacagacacauacaccuucaugccugaauauuaagagacaaaacucacacuagagaaauuuauuuuaugguccauuugcugcuucacuucuauuuuacagaacaaaggcucuuuaggaagaugcuuagaaguuucuuuaauauuagguuucuugaaggggggauuaccaaauugcuuuucuaguuuaugaaugacuauguaacuugccagauaggcacauuuaugcaguaucuugucacaggacuguaaguuaccuuaaaucccacacauucaggcggcggucaguaccacuugaagccagaauaguuucauuauguggagaccaguggaccuaguaauagauaauuuugaaaauguauuuaaagaaucauccgcugcuagguuuguggcuguuguucuaaucugauauuuucccaucuugcacucuauuaucuuauccuuggccugauggccucacucucuuguccccgacuuucaagugcucugcaagggcucagcuccauccuguccucaggaaggcugcacuccccagcacugaggaacucagccugggaucucaauaaauuuauucgaccccauaaccaucccagaagcuuuuuaauucuucaacaagguguaccuuacccuaugagcaucuccauguaacaccacguacaagacauuuuuuucaauaguggacccacgagucugguauagcuuaacugaugaaucccuggauuucauuuccugacauacagacaccagaaaacugucacauaccuggaaaauuucaucuuuaugagauucgaagguauggaguuuuaauuuuaaguuacgcagaucccauaaagcuacggucuaaagaaaaauaacaagugaaaaugauuucuaugcuuuaccuaagaauuuucaaauaucugauuaaggcacaagagaacuggguuuuauaaacaccaaauaaugcaaaaacuucgaaaccuuauccgcagagccgguggcuagaauaaauucgcuguagggauugaaugagaggcaguugacuucggcagugugcgcauccaccaagugacucggcuuggaggugguauuggaccuggugucccaucuaaaacacaaagguaaaggcacacggcacccagggaugacacacucacauucggccucacaucacugucacugcacuccacaacuagcuccacuaugugcuccccuucaugaagaaaccaaccacacagcuggugauucagaccucgaccacuaaaugauacauucgaaaccuacagagaacaagcuagggcuguuaguccuguuuuuuaaauuagauuccuauuuuaauuaccaacuauuucaaguguacacaaaauacagacuauguagagaauaaugucacaaucugauaccuaaaacuaguuuugacaaaugcccaguauuuugucacauuugccucagguauuucuuuauaagauuauaagugaaugaagcccuguggccacaccuugaugaaaucauuuuccuccucgaccuccaacuggcaucacucuggaucucaauuuugauauuuaccaccacaccaaguauguuccuucacauguccauaccuaguuuucuuuuuuucuaaauaauaagugauccucccacuucagccuccugaguagcuaggacuacaggugcacaccaccauacccaacuaauuuuuuguuuuuaaauuuuguguagagucucacacuccuggucucaagcaauccuccugccucagcuucccaagguauugagauuacaggaguaagcuaccuaaagcuguuuuuuaaagccauaacuuaaaaaaaaaaaaucaaacuacagccugcagcaaucacugauggucauucaggucacccauuuaacaagaucccacugaauuuuccaccuuacaucauaaguuucugaucaucagcaacagauccaaacaaugacucgugcagcaggugccaggccacauccucuacaacagcugaguggccaguaaagauggcuuuagcauccacaauuuugccuucuuuugguccugcguuuauaucccacagacaaacagucuaagagagaaggagagaaaaaaaaaagaacaagggcuauaagagacugauuuuuuuuuuuuucccucgagacagugucucagucugucacccaggcuggugcgaucucggcucacugcagccuccgccuccagggcucaagcgauucuccugccucagccuccugagcugggauuacaggugcaagccaccaugccuggcucauuuuuuuuguauuuuuaguagagacgggggucucaccauauuggccaggcuggucuugaacuccuggccucaagugauccgccugccuuggccucccaaagugcugggacuacaggugugagccacugugcccggucaagagauugaauuuaaaugcuaacaucuuauuuaaaauaauuucauuacaaacaaaacuauucaacuauauaaguuugagguaaacacaagagagaaaauauaagcaaacagaagaguauguggcugcagccuccaugugaggugcagaggaaaaggacacuccacuguaaugagggggaggggagacugaguacaguggcaggcaaggacacugaugcuggaauuucuaccuacauacauucagacauucaaguaccccaaauucacuuagacaacacaacaaaucaccaagagcccggcgcucagcaucuacugaacacaaaugcacauccuaaaaguuuacacugggaugggaagacugggaauuaaaauuaaacucugccucucacauagcaaaagccucauggacaagucuuucacuucauggcagaaaccaccacagacaucaggagaugggacagguaaacgacacugggccagaaaccucuacuagucuacucugagaggucaaggccuggcgcccacagacagauccccaaugaugugcuccuugaaacgucagcagagcccaagcagaggccauggggccucugcuugggccucaaaggucacagcagcccacaaauaaggaggccucaugaugugggccuugacauccuaucacagaaagaguuaagaggaaaguuuuaaugaaaaaauauugcaagguauagggcaacgauucucauucaauaguuaauaagaaauaauaccaugaagguauauuagcacuaauuauaguuccaccgacacugguauggguuuuuuuuuuuuuuuuaauucauagcacgugaucaugaaagggcuucaucuguuuuuauuaaaucaccuuuuuuuuuuuuuugagacggagucucacucucuugccuaggcuggaaugcaagggcacaauuuuggcgcacuacaaccuccgccucccggguucaagcaauucuccucccucagccucccgaguagaugggauuacagguguaugccaccaagcccagcuaauuuuuuuguauuuuuaguagagacggaguuucaccacguuggccaggcuggucuuguacuccugacuucaggugacccacccaccuuggccucccaaagugcugggauuccaggcgugagccacugugcccagccacaugaaggacuuucuguaacaaagcuauuucccaguaauggcuauuuucccaguaacaaaauuuuuuuuuacacaauacauaugcccucagucucuguuguuacuuacacaugaagacacucaaugugugugaacugaagagaaaggaacauguggugcuccugccauucacacugacucagaaggaccuggcaagauuagcaugaugcuuggcauguggguagccccugguaaaugucagcuauuauuauuacuaccaauucccagccuggucucuucaaaagguacuaguaauuggguuacugaguacaauccacuuauccacuuucccuacuugggaaaccgucucauacacacuuugagggaagcauccuuucagagagccuauaaucccagcucuuugggaggccaaggaagguggaucacuugagcccgggaguucaagaccaguuugggcaauacggcaaaacuccaucucuacaaagaauacaaaaauuugcugggugugguggugggcgccuguagucccaccuacuugacaggcugagguagagaaccacuagagcuggaaagguggagggugcagugagccgagacugagccacugcacuucagccugggugacagagcaagaccuugucucaaaaaaaaaaaaaaaaaaaaaaaaaaagugaaaagacaacagaaugggagaaaauuuuugaaaaucauagggacuuauaccuagaauacauaagaaacucuuauaacuugacaauaaaaagacaaaauuaaaauauggacaaagaauuugaauaccuauuucucuaaaggagauaugcaaauggccaguaaguacaagaaaagaugcucaucaucauuagucaucagggaaaugcaaauuaaaaccacaaugagcugggcguagugacucaugccuguaaucccagcacuuugggaggccaaggcaggaggauugcuugagcccaggagcucaagaccagcauggccaacauggugaaacccugucucuacuaaaaguacgaaaauuagcuggguuucauggugcauggcuguaaucucagcuacuugggaggcuaaggcaggagaaucgcuuggaccugagagguggagguugcagugagcugagaucgugccacuauacuccagccugggugacagagacagacuccgucucaaaaaacaaacaaaacaacaacaacaacaacaacaacaaaaaccaacuccccacccccaagccaaaaacaaacaaaaaaaaacccaggaaauaccacuuuaugcacacuaggauagcuauaauaaaaaagacaagcauuagugaggauguagagaaacuggaacauuuguacauugcuuguggaaauguaaaauggaaagccacuuuggaaaacaguuugguaauucuucaaaaaauuaaacagagauaccauaugauccaauaauuccacuccuagguauauauccaagagaaauaaaaacauacaucuacacaaaaacuuguaaacaaaugcuuguaacauaauucaaaauagccccaaaguagaaagaacucaaaugguucaucaacugacaaauaagcuaacugugguauauccauacaguggaauauuguucauccauaaaaaggaauggaacauaaguaauguuacuugaaaacauuaugcuaagugaaagaagccaaacagaaaaggccauauaugagauuccauuuacaugaaauaccaagaacagauaacucuauagagacagaaaauaaauuagugcuuaccaggagcugggggaaggcagggaaugaguggggagucacugcuuaauggguauggaauuucucuuucagagagcgaaugaaaacauucuagaauuaguggcaauaguugugcaccuuugugaauauacuaaaacccacugaacuguacacuuaaaaaauacuuuauauuaaucaggucccacaaacacucuacaguuuccauuuuaagggccuggaggguccucuuuuaaauaaugggaggccuuuugccuaugcucccuccauucuaaggcuacuucaaaagagcucuguggaauccgaagacucauacagggcaguaugaaaaccaucucucuaaaguccugggggaauguuaccacaauaaucagcaguauuaucuuagaaaaccuuucaucuauauaguacuccuucagcacagcugugacacgucagcucucacuauaugaacaaauuacaaagaauacguuucucacauggucaucagaugcacuuaggagauguccacucaaauuugaauuccaggagagaccauagccuuccuucuggugaccucuuaaucugagaucaggauuacauucuccacuugggucuaagaaaagaugaaaaacauuaaguuauucucuguuuaucagaacuggugagaauaaauucucacuccuucauugagugaaccauuacagcaacugcacacgaacgagaucuggucuuuaauacccaaugcaaauugagccucaugaccauuagaugauugguuucuuuggaaaaccuaauacuauccccaacacaaaaauauuaaaaacuauagcuauccuacaaauuugggcaguggugaccguauccccgcaaccccccaauuuuuuagaaauauuucuaacacaacaggucugguugcucaguccuugcaugccucuaggguagccugcaaccauaaaugacccuuggccaaccccugggaaugugacccucagaaaguucuucacgucacugacugauaaaguuuuguaagcccagagcagugggguaugccauagggaccugucaagacuuguaggauuguuuagcaagauucacaauguauuuggcuucacuauugggguccucaauuuuguuaccauggcuggucauagaacaggaugugcccacgccaacagaccuccacaaaaaucccagauucugaaacucaaaugggcugcccuggguagagacauuuagcacauguuccuaugguuugcugcuagagacaaaacaugucccacguggcccuggaugggaaggacucagacgccuguagcuaaccccucuggacuuccccugauguguaucuuuuucuuccuacucuugcucuggauucuuugcuguaauaaacuuuagcuguuaguauaagcugcuuuuagguaguucuggcaaaucccugaacuugaggaugguuaugggacccccaaagcaauuuuuaaaccuuuaaauauuauaaaguaugcuacuuugaccuuaaaaacauuaccaguuugaaucaagaaaacugcucaaguaaugaccuaacucuauuauuacauaccugguuuagcaggguguuuuguauagucaaaaaccaacacaucagaagaugguguuuuuguagcaaugaugugaggauucugcggcauguaacgagcacgguuuacuucuccuucgugauugauuuuaauuucacauucaauuuuuccuguuacagaaccaaagccaccaaauucuaaugugaggagaaagaaacacacacacacacacucaggauuaaaauucacaaaucacuuaguucaaucaaccuaacagauuuugaccuggcagaauacaacacaaacugacaagacaaagacagaaacaugcauagagaaaacccaaaaauguggguucauuugccacaucaauuuauucuuaaagcccauuugcacuggaaaauauugguagcugccuuaugcaacuuaauucaguuccaccuuggaucuaaaacaacuguccucuuucaguuaugaagaugauauaguuauucacugaaauuucaaguaaccauauaauaagcagaccaauagcuuuuuaguucaaauacaacucacuguaaguacugcacugaauuagcaucuuauuuuaggauucaucaaaacaggaaagguuuuaacccuccacaguaugaacacccuuugagucugaagucagaagcauccucaaaucaaucagaaacccacgcuaaccccuaccugucccuaaacacacauacauuggcccugccagcauacuugguuuaacugcuagugcagugccaagguuaaccucuccgcccaucuggugugugaauaagacuauaguauuaaauaaucaugaaaaaggccuuguaaaguaacaaagucauauaaaaaguacgguaacuuccaagaaguagcaacauguuagcagaaagaauacaaguagagaacaucuaagcaaauacagcaaacaagaacauucuuuuuugugcucauagauaaaaaaaccugaauuaguugcugacgcuuaaaaagauaggaggguucacauuacaauuguguuauucuuccugaccuauauugccuuuucuuugcacauuccauuuuagcucacccugugucucaggucagggacaacuaacacaaaugccuacuggagccagacagguaagaaguaaaauagaccggggccuggagcaaccaccaaaaggagcaaaccauuucucaguuccaggcagcuccuucuauguggaaugcuuaaugaacacucgcuuccaugucuuaauaucaguaucuagccguuccucucugaagcaaacauagcuuacuauuucagugugguugaaaaaaccguaucucaaauccacgauuacuccaaagcuccucuacccacuacucucaugugaccacaugcaaaaggauccuuuuuccucguagcaccuucuguuccauggugucaauggaagaaaugugccucggcaugcuaagaccccuccugauccaaucgucuccucccuccugagacugcuccaaaucugcuccacuuugaccuucaacaucccauuccauggacuccaguggcucuaacccuucugcuacaaagauacucaaguuuccugauuccuuuagcuaaaacaaccugaagagcucuccuuuaaaaaaaaaaggggggggggcggggcuuccaaguaggauuuacuuugaacacagaguuuuguuuucucaaacuuaaaauuuugaaaagucacugucuuaaugauaauauccauuaaaaaauguaacucaauauuggccgggcgugguggcucaugccuguaaucccggcacuuugggaggccaaggcgugcggaucaugaggucaggaaagcaagaccauccuggcuaacaaggugaaaccccgucucuacuaaaaauacaaaaaaucagcuaggugugguggcgggcgccuguagucccagcuacucgggaaaucgcuugaacccaggaggcagagguugcagugagcugaggucacaccacugcacuccagccugggugacagagcgaaacuucgucucgaaaaaaaaaagaaaaaaaaaaagaaaaaaaaaauauauauacugaauauuaacaaagguauuaacugaauuauuucagcuacuuguuagaauacacuggauguguaacuuuaauaauauauuaacaucauuaugcagagacuguuaaacugcaagcccgguaaauacauacuucagggcuaaaagccauuuaaaaauuucugauuacaauauauucaggccgggagugguggcucaugccuguaauuccagcacuuugggaaguuuaggcaggcgaaucacuugaggccaggaguucgagaccugccuggccaacaugacaaaacccagucucuacuaaaaauacaaaaauuagccgggcauggugguggacgccuguaaucccagcuacucuugaggcugagguacgagaaucacuugaacccaggagguggagguugcagugagccgagauugcaccacugcacuccagccugggcgacugagcgagacccugccucauaacaaacaaaaacaaaacacaaaaaaaccccaauauuuaaagaaauaaugcauacaguugucggggaaugaacaguaaauugugggaguaguaaacuggguaaaucacuuuggaaaauaguuuucuaugaaguugacaaugaauacaccauacaaccuagcaguuucacuacacuagagaauguaguauuuuugagacaggaucuugcucuguugcucaggguggagugcaguggugugauccuaguucacuacagcuucgaacuccugggcucaagcgauccucagccucccaaguagcuaggacuacaggcaugcgccaccacacauggcugauuuuuaauuuuauuuuuugauagagacaaugucucacugugugcccugaguggucuuaaacucccaggcucaagcguuccuccugccuuggccucccgaaguguugggacuauggguauagccacugcaccuggccaguauuuuauuuucaauaagaaaaaaacccuaaggcacauauuagaaagugcuaauagcguuaagccauuugggacugugaagaaagaguuaauacagcagucugggugcuuagcccuggagucucugaggaacacugggacccuauuacugacccuuggcuaacuccugggaacaugcaccucagaauguucuuucugucacugaugaacugaugauuuuguggugugcaccuggagcaauggaccgcguuguaccaguuugucaggguuacucugcagauaucaagauugaugacacguaccuucuuuuauuacuggguccucaguuuguauuacugggguccucaaguuacaguugcuguggcugguugucagcaggaugugccuaugcaacuagucccccaagaaagccucagaccccaagacccaaacaggcuucccugagcagagauauuucacacaugucccugcaguuugcugccggaagacacauccuguguggccuuggacaagacuugugccagaccucccugaacuugccgauguacaucuuuuuccugcugcuuuuguguucuuuacuguaacaaacuuuagccacaaguauaauuugcucuugggaguccuagcaaaaucaccaaacuugggguggucaugggaauaccaaaacaggagaguauauguuugacaaauuaaaaaaagaaaaaagcagccaacagauuccugaauuaacccuaccacuacugccucucuccucaaacaaaaaauacccauugcacacaccaacacauauuacuuuuaccaaaguggaauacuguaauuacacauagcaguuagucacuuaauuuaucuuggauaccuuccuauaccagugccuacagauuuuucucauuaaaaaaaaaaauuuuuuuuuuaaauuuuugguagaaaugaggucuguguuuuucagacugggcuugaacuccugaguucaagcaauccucccaccuuggccucccaaagugcugggauuauaggcgugagccauggcaccuggccuuucuuauuaauugcugaguaguauuucaaacauaccaugugcuuaaccaacuuucuaugaaccaacaucuggguuacaagguugauccuaauuuuucaauucugcaauuacgacuaaaauccuugugcacaugugggugggaaguucuguagaauaaaguccuagaaguuaaauuacugggccaaaagcuaauaguauaguuuuaauagcauaugcuuugaaagagacauuuucccuuugacaccaauauuggaauauaugauauaccuaccacccuugucacugucacaaugggaagcaucaaacugugcaucaucauugggaauauguacucgagcaaccaccagaugauucugcucaucagacguaugaguccccagcacuagccaaugaagggcauaaucuuuuccuucaggucuguuuaagaaagaaaauaagucacacuaauccuacaagaaaucuccaauugcuaacaaauucagucuaguucccucaaaauacauucauauuucuuuagcaaauauauacuuagcaucaacuguguaucuucucccccucugguuaccaacuuuacaauccccacauaugcaaauauaagaaaauauucuagcuacaacaugcagagggcuugcuucuuucccaaagagccauccuccugugccucaauuaucagcgugaacacuaccuuuuauagagcagcacuccggggaagguaggcccaacucaguaaacacagacaaacaucuacacaggaauccaccaacaauccccacacucauaaaucacaacuucccaccuaaagaaaucuucuucccaccuaaaaauaucuuauacacuagauguuucuuauuucccaauaagaaauucuacaagguaguauggacagaaaguguugaaucaaaaaaacuuagcuuaaauccuggaucaaacuaaaaugcaguugcuuaaaacacaaccucccuggggccucaguuucuucacugaauaaaauaggcuauaagugcaaauggcaugaugugaaacucacugacguuuaugauaccuaaguuuaugaaacgaacauucucaauuuuaccgagguaucuuuguuaccuuguucuguggaaacaccuugaggcugaagaacuugcccaaaccucuuggcaccuugguccgagcagugauuuuugcaucaguaucuauuaaaaaggcuuucccauuuguauuaucuagaauacaauuuucaacugugcuccauggucccacuucaaugaagaggacugagaaguaggggucuaggcccuaacacaagacaaguuaggccauuuaucuguuucuaaauuucagcugcacaaaggauucaauuuuuuuuuuuuuucuaaaaagauugaagauuacuucuaggcaaguaauuuaguaauaagaaaauacaagaugcaauuuuaccaaaauuuggcuuacgguaaaaaagugugugcacauggagaagagacacacacacacacagacacacuccccccaaaacagaguaaggcagccgugacuaagcaauagcaacguguuugaaaaaaagacaaaugggcgccguggcucacgccuguaaucccagcacuuuaggaggccaaggcaggcggaucaccugaggucaggaguucgagaccagccuagccaacguggagaaaccccaucucuauuaaaaauacaaaauuagccgggcaugguggcgcaugccuguaaucccagcuacucaggaggcggaggcaggagaaucacuugaaccugggagguggagguuguggugagucaagaucucaagaucacaccauugcacuccagccugggcaacgagugaaacuccgucuccaaaaaaaaaaaaaaaaaaaaagaaaaagaaagaaaacaugggucuugguugauacaugcacagugggccaagaauaugauguggcuaucaaaaaauuaauuaauuccaucuuagguggucuuuauauguauguagggggcaaugcacaugagcacaugugccccccacccccgaccuuuucuuuuuuuaagagacaaggucucacuauguugcccaggcuggccuccaacuccuggacucaaguugauccuccuacaucaaccucuucagcagcugggacuacagaugugugccaccauaucuggcuugcccacuuauuuuuaaccaguaaaaccauuaaaauuaggcucuaagcaacauacuuuaugaggacuuggauaaaaaucaaaccuuuacagggaauaguggcuuaaaaugaaaggguaagccaggugcagugcugugcacccguaguaccagcuacuagggcuacuacggaagacugcuugagccuaggaguucauguccagccugggcaacauagcaagacccugucucaaaaaaaaaaaaaaaaaaaaaaaaaaagaauaaauauuuggccggaugugguggcucacgccucuaaucccagcacuuugggaagccaaggcaagcggauugcuugaacccaggacuucgagaccagccugggcaacguggcaaaaucccaucuccacaaaaaacaaaaaacacaaaaacaaaaaacaaaaauuuaaauaaauauuuaaaaagagaaauaauaaugcuugagagaaagaaggcaccacagagcaaugcugguacugucaucaaaggaaaaaagucacuuguuuuuuguggaguugagcaggaaaacuaagaccaacaaguaaaaaauaacagguaggucaguuuaucacaggcccuuucuaaggaacacugucccaagacggacuggaggagcuuaaaaaucccucuggacucaaauuuaauuauuccaguuuuccccaacuugaucaucauaugaggacuuuucuuuuuacuagaaaucccuucaccuccaucauuaaaacacagccuguuuuccuaaacuaaucaauaugacacuauuuuccuccaauacuggauguaccuaaaggcugcagaaggacuaaugguuaagaaagccuauucauuuucagugcagaauccuuugaccccaguaacuaccacuaggaaauuuagccaagcaucacauaaaucuggccuauugcaagauuauucucagcaguauuguuuauagaaggaaaaagacugaaaauaacuaaguauccaucagcaaggaacugguaucauacauuacacaguguauccauaaacaaaauucuauggcacucuugaaaagaacaagcauauccaagcaugcugacaggaaaaucuccaauacauacucuuacugacaaacucaagugaagaacuugcuaccauaaaaaaugaagauacagguaugcacuucuacacgcuggcaaggauggguuaggaaauugaaaacaaugacuggggaaaggaaguaggacaguaagggauguggaaaggggacuuauucuucacucuauguccuuuuauacuuccugaauuugaaaaauuacaaagcuuuuuagguagacaauaaguuagucucaauauauuuaagacauuauucaacaagagauaugaaauaacuaucuaauuaaaacaaauuucuuagagauacuuaaauaaaaccuuuuaaaagccaaaucaacaccuguaaucccagcacucugggaggccgaggcgggcggaucacgaggucaggaguuugagaccagccugaccaacauagugaaacccugucuuuaccaaaaauacaacaauuagcugggugugguggcacaaaccuguaaucccagcuacucaggaggcugaggcaggagaaucgcuugaacccgggagguggaggcugcagugagccaagauggugccacugcacuccagccugggagacagagcgagacugucucaaaaaaaaaaaaaaaaaaaaaaaaaaaaaaaaaagaaagaaagaaagcaagaaagcaagaaagcaagccagccagccaaaucaauuauuuggacaauuaccuaacucaauugaaggacaauagcuaagaaaguccaaguaaucguuaugaagcauguuguaagucagcagaagaaaggccuaugagguggaguaggaucuuguuccucagagucaggcauugagaauagucaacauuuuuacuguucuguauggugauaaaacacagucccuuuauaccccaaacugaacccugcaaagcaccacacaacaauccucaacauccaagaaugcaggcugcuuggcauuuucuuacauucucuaagccacugcacaucccacaacccaaucccacaacagcuuuguauacaaagaacaccaugauacacauuaaauaauuuaauuaaagcauuuuguuacauuccuaaguauuacauauuauagguaacauuuuuuuaaaaaaaacuucagcaaguagcuuucauugaaauccaaaugaagaaacagagcuauuucaauccugacaaauuauuucugaacaggaaggggugggagaaucagcaucagucaccacuuaccguguacuuaugcugcaccaggcacuuuaacaugcaugaucuuauuucauucccucaaauguagguagucaguaugaccaacaucuccauuuacagcccagacaacacggccccaguucaugaagcuaagaaguaggggcaugauuuuaacccaggucucuaaguuuaaagccccugcuguuuucuauuauguuacagugggucaaaaagaucccccaaaagguaaauuuaguuaauacauuuuaaaucugcuuaacagaccaaagaggcaaaugcacacgaugcuccaaaccagaacuugaauacccgaguauaugaugcuuaaucuauuuuucaaucuguuguggcuguaaacgucaaugcuuccaagucuccaucauuuaguucuucucuacucuucccacaucuguacauuuauauuuagauuuuugggaagccuaguggaaauuccuaucuguauagaaaucaauguuugcauauggagaacccggccacuguaagagcaguuuuauauacauuagauuauuauuauaauaauuauuuuuauuuuuaagagauggagucucgcucucgcccaggcuggagugcaguggugcgauguuggcucacugcaaccuccgccucccagguucaagcaauucuccugccucugccucccuguagccuguagcuaggacuacagguacacgcugccacgcccgguuuuuuuuuuuuuuugguauuuuaguagagaugggauuucaccuuguugccugggcugguuuugaacuccugagcucaggcaauccgccugccucggccucccgaagugcuacgauuacaggcgugagccaccgcacccagccaaaauuagcuuauuauuuuuauaacuuguugcaaaauccucuuuuuagguuagaguuucauuuaauccucuuuaaauuauauguccgcaacacccaaauuuaagaugcuuguuuuuuguuucuuugagagacacggucucacucuguuggcuaagcuagaaugcaguggcgcaaucauggcucacugcagccuugaacuccugagcucaagcuaaccuuccaaagcacuaggauuacaggaguauaaaccacugugccugaccccauauuuaauacacuuuaaaaguacauggucaaguuccuacuagaaaaggugcaagugaaugagaaaggcagucuaaugcagggaccagcugugugaucuugggauggcacuuaaacucucacucccaguuuccuuaucaguaaaacaaggaugaugaaaaguaccuacagcauaguacuauuaugaggauuacaacaaacaacaggacguagauucuucagaugugccaggcccuguucugagugcucaauaaaugccagcaauuauuaccagagaaacugcagauguaacagaaaagaauacucuuaugaagacuaacagcaaucucaaaguguauuccauaagccgauaacaucuuuucuuuggucaauuguugacaaggucuuuuucccuuuaccaauuaaaauguauuuaucuuggaugacuguuacguguguucacuuuguaaaaauuuaucaagccauacaacacuuaagaugugugaacuuuuccguaaauauucuauuuuucaguaaaguuuuaaagaaacgcauuaguuugggcccagaaagaugcugcucuacauucaagcccaggaaaugucaaauauauucagugcuuccuccaaacacgauuaaucucacaacagcuucuuucuccccuuuuaccaccacacuauacaccagaaaucaucccacaaaucacguaaguuuugaaaauaaaaaccaccugccaccucaugcaagggcugauuacauacuuauguucuaugcauaaaacgccaaaacuaggaaauucagaacgacaguuaaauuuaaacaaaauaaaaguugccagaaacccuuacuuagucacuucaggaagccacugaacgguaagacugggccacugaagagcaugggucauaaccaggucauauagaaacgguguauucuucuuccagauuuuauauucuucauugaugacacgcuccuccacaguaucuucaaacacugaaauuuggagaaagcccacacgauuaaguggcugagauagaucaaagucagaaauuggaggucaccucaagauggccacaccucauguacucuuuccuuuuaccucuaauuuggacacggacaacuaacugcucuuccagaagguggagaaaauacuaacaaucaggaagccuauuuuuuccauugagaucaauacccccugcguacaccauguuggguagucaauuacacggacauggaaauuguuuacccuguuacagcuguucgcaccuguucuaagaugacgaccuguacguacaggggcugcgcgacccagucgggaagacaaaugcacguguagcagaagcccacaggccuggucucuccaauccccaucaggggaggccccagcucccacgacgcccgccucggcagccauaggccugaggaccccagcaacccccggacaagggccgcgaccccgaggcggucaacgcgcgcgcgcgcguagaaagagccgcggcgcucgcuucccagcggcgggggccgccuccgccccggggccgagggcgccggagggagcgcagccgcuggaggagggaagggaagaggggggcccagcccucggccccgcgcccggcuccggaagugcucggagcccucggcgcggcggucccgucccgcgcaggccccucgaggcgcgcgcccagucucgcgcccggccccgcccccugcuccgcacgccaauucgcgccuuucgccggcgcgugccgcggccucgcgcgcccgccgccccccgcggccccggcgcgcgccgccccgcagggccucuuacucucuuuacucgccaucuugcgucgggucguucgccccucgccgccgccucggacuccucucguuagccaagagcagcccgaccgcuggcgcuccugccuuucccaagcgcgucacacuccccacugucgaaagcccgggccccgucuugcugccugggugcuccccagacgccgcguccuucuuuccugccuccuccccgcucgcggguaccgaggucugaggcgcucuucucucucucuccaaacuuggaacgagacuuuucaacccgcgccucccagcccgcccaggcagcugagcgcaggcgcauccgcccugggaaaagug

SEQ ID NO: 21583 - RNA, 45 nt, Mus musculus
ugcccguuuccuugacauccaucaguccugcuauggccaccagac

SEQ ID NO: 21584 - RNA, 43 nt, Mus musculus
cccuggaaaaugauggggaagcccugcugaggcagccccuccc

SEQ ID NO: 21585 - RNA, 46 nt, Mus musculus
uugaaccucuugggguucuuaaggaaaccgagauuaaagucuagau

SEQ ID NO: 21586 - RNA, 44 nt, Mus musculus
gcucauuuuuccacucuggcuccacuuguaagggcaggcccccu

SEQ ID NO: 21587 - RNA, 45 nt, Mus musculus
uuggauugguaaaagcagacucccggcuagagcaaagugauccag

SEQ ID NO: 21588 - RNA, 42 nt, Mus musculus
ggggggauccugaggaggugaaugcagcagaaaaggcagcag

SEQ ID NO: 21589 - RNA, 46 nt, Mus musculus
gugccggcagcccagacauaguguaugugcagagcagcccacagga

SEQ ID NO: 21590 - RNA, 42 nt, Mus musculus
ccgcagcggugcaguugacaguucgugaagcuaauaaucaag

SEQ ID NO: 21591 - RNA, 45 nt, Mus musculus
ccauugggcccccugaauacuaugggcacagggugaaggccagcg

SEQ ID NO: 21592 - RNA, 46 nt, Mus musculus
aauaaguccuuuugcauccucggaauuccaggggcugaccacuuuu

SEQ ID NO: 21593 - RNA, 42 nt, Mus musculus
accucacauucaauucccucuuuagacaauacagcugcagcu

SEQ ID NO: 21594 - RNA, 58 nt, Mus musculus
uaccaucucgugacuguggaaggaggcuggccacaauuuggaguaggagcugagauuu

SEQ ID NO: 21595 - RNA, 46 nt, Mus musculus
uaauucuggcacaaaucucagcuccuacuccaaauuguggccagcc

SEQ ID NO: 21596 - RNA, 57 nt, Mus musculus
ugucacuggugcugaugucccuaugccuuacgcaaagguccuagaagacaacuccgu

SEQ ID NO: 21597 - RNA, 46 nt, Mus musculus
aauuugcccucuuucacuagaaggggcaagauaagaaugcccccac

SEQ ID NO: 21598 - RNA, 46 nt, Mus musculus
gaaauugauuucuaugcagacaggcuauggucaaaguucuccucag

SEQ ID NO: 21599 - RNA, 45 nt, Mus musculus
guguucuuucgaaaaguauauuuaaaaguaauuugugugugugug

SEQ ID NO: 21600 - RNA, 45 nt, Mus musculus
cuacauuauaaaagacuaagaacaaaacuuccugagacuggagag

SEQ ID NO: 21601 - RNA, 41 nt, Mus musculus
caguggcucacaauuacuuauaacuccaguuccaggggcuc

SEQ ID NO: 21602 - RNA, 42 nt, Mus musculus
ucuguguaccauguucauacaguccccguggaggccagcaaa

SEQ ID NO: 21603 - RNA, 46 nt, Mus musculus
uccgaucucuuggacgucuuuccuacaagaaaaagugaguuuuaag

SEQ ID NO: 21604 - RNA, 42 nt, Mus musculus
aagcuaagggccuaaauuuagucuucaggaaaaagcagcugg

SEQ ID NO: 21605 - RNA, 56 nt, Mus musculus
ccguuuucuggaguuaggacugggcuucagguuggccaggcucacucucggcaagg

SEQ ID NO: 21606 - RNA, 45 nt, Mus musculus
gccaugacccgcggugcuucaagggcgcccaggaagcggcguaga

SEQ ID NO: 21607 - RNA, 52 nt, Mus musculus
uuauuucuccacuaguaaauaagccaaaguauacaugggcagauuugcagcc

SEQ ID NO: 21608 - RNA, 47 nt, Mus musculus
gcacgaccgaacaauacugaggucgauaauaggucaacagcaucaag

SEQ ID NO: 21609 - RNA, 44 nt, Mus musculus
uggcaucuuugcaaggguggggcggcccagagucagaccaggua

SEQ ID NO: 21610 - RNA, 44 nt, Mus musculus
ugagagguuacugaagauagaaugccaggauugagggguaguag

SEQ ID NO: 21611 - RNA, 46 nt, Mus musculus
augaccaauaucaauugcugguuuagaaaggagguuagagaagcag

SEQ ID NO: 21612 - RNA, 45 nt, Mus musculus
uguuaucaccuuucccaguuccuccccuuucuggaaacacccuau

SEQ ID NO: 21613 - RNA, 42 nt, Mus musculus
gcaaaggguugguauaguuuucuucaugugugggagccuugg

SEQ ID NO: 21614 - RNA, 46 nt, Mus musculus
uaguacaugaaugguagcugcagagaagccagggaaagacaaugag

SEQ ID NO: 21615 - RNA, 24 nt, Mus musculus
ggugagaccauaacagagagcaug

SEQ ID NO: 21616 - RNA, 42 nt, Mus musculus
uuggaagagcagucaguguugagccaucucaccugcccccga

SEQ ID NO: 21617 - RNA, 42 nt, Mus musculus
aagaugguaugaaauauaaagaagugaauuauuacaggggag

SEQ ID NO: 21618 - RNA, 96 nt, Mus musculus
ucagcuuucccaugaccugcccuacuguuuauauggguccuugggauuugaacucuauccucuugauuaagcagcgaguacuuuugacccguggaa

SEQ ID NO: 21619 - RNA, 42 nt, Mus musculus
uucaaaucaauuacuccguugaauuucuccuccagcccccua

SEQ ID NO: 21620 - RNA, 46 nt, Mus musculus
cuacccaugcucuuaaaguaaccccaguuaaaccuuaaaaagaaag

SEQ ID NO: 21621 - RNA, 46 nt, Mus musculus
cagcaccagguucugguggucaauggaggagaaugcauggcugcag

SEQ ID NO: 21622 - RNA, 41 nt, Mus musculus
gagggauuauacuuaaguauuaaggaucauacugugggcug

SEQ ID NO: 21623 - RNA, 46 nt, Mus musculus
cccgggcucaguucccaguucccagcacccacauggcaacucacaa

SEQ ID NO: 21624 - RNA, 46 nt, Mus musculus
aaccauuuauguuagaaugccaucaaacuauugccaaacuugauaa

SEQ ID NO: 21625 - RNA, 45 nt, Mus musculus
uuaagauaaucagaguuacuuuuaaacgguaccaauucuugccag

SEQ ID NO: 21626 - RNA, 46 nt, Mus musculus
ucaccaagcuucuauagacuuggauucauuagcagaaagcccugag

SEQ ID NO: 21627 - RNA, 46 nt, Mus musculus
cuuuaaaaauugaguaugaauguaaacuugaugcucuaguaaaaga

SEQ ID NO: 21628 - RNA, 53 nt, Mus musculus
gauuaaacaugaaaaggaugcuauugucugugugcagcaagaaaaggaucaga

SEQ ID NO: 21629 - RNA, 46 nt, Mus musculus
gacaugagauguaaguuagagguugaacuugcacuaaaggaagcag

SEQ ID NO: 21630 - RNA, 57 nt, Mus musculus
aauaaguaaacuaaaccaaaaaauucaugauaauaaugagaguuaccagguggguuu

SEQ ID NO: 21631 - RNA, 42 nt, Mus musculus
uuaaggcugaauuagacaauguuacaucuuugcaucgccaag

SEQ ID NO: 21632 - RNA, 51 nt, Mus musculus
acucagaauugagugcucuugaaaaacagaaagaugaaaaaauaacccaac

SEQ ID NO: 21633 - RNA, 47 nt, Mus musculus
ugaaaaaaacaaagcuguucaaacugcacuagaugaauuuaaggugg

SEQ ID NO: 21634 - RNA, 47 nt, Mus musculus
uggggaaauguagaaucucugccuugaaguauguaugagauugcaaa

SEQ ID NO: 21635 - RNA, 46 nt, Mus musculus
gaaacuuuggaguuucauuaggucccacuuaucgauucucgaucuu

SEQ ID NO: 21636 - RNA, 46 nt, Mus musculus
aagggucauacauguauuaugccauguguagauaucacauguguag

SEQ ID NO: 21637 - RNA, 46 nt, Mus musculus
cuuuauaacauguguauugucucuccuguuacauacaugcaccccc

SEQ ID NO: 21638 - RNA, 41 nt, Mus musculus
ugccaggcaucccuuguaugacuugagauauugauccugca

SEQ ID NO: 21639 - RNA, 45 nt, Mus musculus
gcuugaugccccagaguagaggaaugcuagaguggcgaggcggga

SEQ ID NO: 21640 - RNA, 45 nt, Mus musculus
uaaagcuccaguuugcuuguuauaaguugugauuaucgccaggca

SEQ ID NO: 21641 - RNA, 49 nt, Mus musculus
cauaauaaaugaucuuagugauaagcuaaaaaguacaaugcagcagcaa

SEQ ID NO: 21642 - RNA, 46 nt, Mus musculus
cuugcauuuaugaauuaagacuuuaugauuaauuugagagggccug

SEQ ID NO: 21643 - RNA, 46 nt, Mus musculus
gcuucauaguggaaaaaggcuuucuaguugacuuugucagccggag

SEQ ID NO: 21644 - RNA, 45 nt, Mus musculus
gccugcucaaggcugggggaagggcacaacaaugauuugauucag

SEQ ID NO: 21645 - RNA, 42 nt, Mus musculus
uugguguaaaaugaaagauugggggaaaaaaugaacuggcau

SEQ ID NO: 21646 - RNA, 45 nt, Mus musculus
aaccauccguaaugacaaacaaauaaaaaauggagcaagccgagc

SEQ ID NO: 21647 - RNA, 42 nt, Mus musculus
uuggugguauaccucugaccagagcacuugaagccaaggcag

SEQ ID NO: 21648 - RNA, 46 nt, Mus musculus
ugauugagucuguuagugcagucuauuucacuuaauuggugcucuu

SEQ ID NO: 21649 - RNA, 45 nt, Mus musculus
ccuucaguaucccauuggacaucaucuuguagagguuguggaccc

SEQ ID NO: 21650 - RNA, 47 nt, Mus musculus
aucacaucuguggcccguuugaugccaucuaugagggacucccggca

SEQ ID NO: 21651 - RNA, 43 nt, Mus musculus
cauagcccuccauggcagcuugcagugcauugauggggucgau

SEQ ID NO: 21652 - RNA, 49 nt, Mus musculus
cggccaaggaugauauccacacagccugugguggugacaaagauguugc

SEQ ID NO: 21653 - RNA, 84 nt, Mus musculus
ggcccggaacaaggauggcagcuggaaggugaaggacagccccagcacucaguagcgguagugaucaggcuugaaggggccguu

SEQ ID NO: 21654 - RNA, 46 nt, Mus musculus
aaaggaagagaugugcacagagcgggaauugacacacacuuuguag

SEQ ID NO: 21655 - RNA, 44 nt, Mus musculus
uggcgaacuggucuuccauggggucggcgcucccaggcaccucg

SEQ ID NO: 21656 - RNA, 44 nt, Mus musculus
gcgggccgcccuuucucuugcccgaagguccuugccggcccccu

SEQ ID NO: 21657 - RNA, 42 nt, Mus musculus
uggggcggcacuccuuucuucuugccagcuaaagcagaaggc

SEQ ID NO: 21658 - RNA, 45 nt, Mus musculus
ccaagcagauucuuacaaagaccaaaacaccacuaugccucaaaa

SEQ ID NO: 21659 - RNA, 45 nt, Mus musculus
ugcugcuauagaaaguagcagaaucggcuugcugcuaugagagau

SEQ ID NO: 21660 - RNA, 42 nt, Mus musculus
agaauuuuguugaauguauuguacaguauauaggagcaagaa

SEQ ID NO: 21661 - RNA, 46 nt, Mus musculus
uuaggaagcacagaggcuuuaugaaguacuuuugcaugugugcuga

SEQ ID NO: 21662 - RNA, 54 nt, Mus musculus
acuuaucaugacugaacaagcgagaagauaucugaguacuuacacagcuaccag

SEQ ID NO: 21663 - RNA, 46 nt, Mus musculus
auugaagguuuguuuuaagguugggaaggugguagguaugguagua

SEQ ID NO: 21664 - RNA, 41 nt, Mus musculus
acgucagucuuguacuugaagggaaaaagaacagucguaau

SEQ ID NO: 21665 - RNA, 43 nt, Mus musculus
gagcucgaguugcuucuuaugucagccgagaaugaaguuagaa

SEQ ID NO: 21666 - RNA, 47 nt, Mus musculus
cuaucaaaaaucauuggaauucuaccaugcgaagaaaaguggaacag

SEQ ID NO: 21667 - RNA, 45 nt, Mus musculus
uugugauucaugugauacuugacugggucagaguagcagcgaagu

SEQ ID NO: 21668 - RNA, 46 nt, Mus musculus
accuggguaacuuagugagacccuguuuaaaaaucgaaaugaagaa

SEQ ID NO: 21669 - RNA, 45 nt, Mus musculus
uuauuuuacaguauacuuguucaucauaccaauauucgcauauua

SEQ ID NO: 21670 - RNA, 46 nt, Mus musculus
aaaaaaaagaguaugagaauaucaucuacauaccagggguggagga

SEQ ID NO: 21671 - RNA, 46 nt, Mus musculus
ccauccauaacgagaucugacucccucuucuggaguaucugaagac

SEQ ID NO: 21672 - RNA, 42 nt, Mus musculus
auauacagacucagugcuuuaaauaauuuaaauggcauacuu

SEQ ID NO: 21673 - RNA, 46 nt, Mus musculus
uuauagcuguguauguguuuagucaaauggauuugauaagucagag

SEQ ID NO: 21674 - RNA, 47 nt, Mus musculus
aaaucccagccaccacaugguggcucacaaccaucuguaacaagacc

SEQ ID NO: 21675 - RNA, 46 nt, Mus musculus
auaauucugaugcuacaaagccuacuuacuaggcauagguuaagau

SEQ ID NO: 21676 - RNA, 46 nt, Mus musculus
ccaucucuggucuguuucuuuggguuuucuucagugaguuccaggu

SEQ ID NO: 21677 - RNA, 55 nt, Mus musculus
aacuucaaagacauaacauucccaucuucauaaaagaugcagauuuaaagauaag

SEQ ID NO: 21678 - RNA, 46 nt, Mus musculus
cucagguugcugcauugacggauucucccacagcucacgcccagac

SEQ ID NO: 21679 - RNA, 42 nt, Mus musculus
gggugggucucggagagggagcauuggccccaggcuggagga

SEQ ID NO: 21680 - RNA, 51 nt, Mus musculus
accauugaauugauggagccacuugacgaggaaaucucugggauuguagaa

SEQ ID NO: 21681 - RNA, 36 nt, Mus musculus
cguacugcgcagacucagaugccaccauauugugug

SEQ ID NO: 21682 - RNA, 46 nt, Mus musculus
ucuaagcuaauuacaaagugggauuuuuuuagaaaaaggcauuugg

SEQ ID NO: 21683 - RNA, 46 nt, Mus musculus
ugaaccauuuauaugaaacuuccaaguuagacaaugauagcaauag

SEQ ID NO: 21684 - RNA, 46 nt, Mus musculus
ugcuucugccucuugaguucuaggauuaaagagguguaccccaaag

SEQ ID NO: 21685 - RNA, 45 nt, Mus musculus
uuuaagcuuuucauuuccuuuuguucuuugauugugugacugugg

SEQ ID NO: 21686 - RNA, 45 nt, Mus musculus
uuuuucuguacauuaaccuacauuguagccuauucugugauauug

SEQ ID NO: 21687 - RNA, 61 nt, Mus musculus
uuuuuuucagaaucuacaaaauggcagauagcuuggaugaauuuauugaagagcaaaaagc

SEQ ID NO: 21688 - RNA, 63 nt, Mus musculus
gaaacuggccaaagacaaagcagaauuggaaagugauccaccguacauggagaugaaggcaag

SEQ ID NO: 21689 - RNA, 45 nt, Mus musculus
cagggaaaggcgucagagaaacucucugaaaacaguaaaauauua

SEQ ID NO: 21690 - RNA, 46 nt, Mus musculus
agcaucaauacagauaaaauaaaaauaaauuauuaaauaaaaagag

SEQ ID NO: 21691 - RNA, 45 nt, Mus musculus
cuuuuugucuuuaaauauuuacuagggguuuuuauuccaucucag

SEQ ID NO: 21692 - RNA, 60 nt, Mus musculus
auugaauauggcuuaaguuuaccgcuuggagaagauuaugaacagaagaaacauaaauua

SEQ ID NO: 21693 - RNA, 45 nt, Mus musculus
uacagcuguaaaguagugguauuuucuuagaaccuuuggguggua

SEQ ID NO: 21694 - RNA, 46 nt, Mus musculus
acaggacuguaaucccaguacucaggagguggaggucaagggucag

SEQ ID NO: 21695 - RNA, 44 nt, Mus musculus
cuuaagcuacaugaaaccuugcaaaaaaaacaaaacaaaccaau

SEQ ID NO: 21696 - RNA, 45 nt, Mus musculus
ggauguccacacuuguaagguuagcacuagaaggaaagagcagag

SEQ ID NO: 21697 - RNA, 45 nt, Mus musculus
uguugcaaauccaaauuaaagcuugaaucucuuuuuuagggaguu

SEQ ID NO: 21698 - RNA, 45 nt, Mus musculus
cccgcagggcuaacggggagcgggugcuugacagacaacauugca

SEQ ID NO: 21699 - RNA, 31 nt, Mus musculus
uacuuaauacugguguuuuauaguuacauua

SEQ ID NO: 21700 - RNA, 45 nt, Mus musculus
auacuguuuugugaaacaccauuuuaugugucauugaagggggga

SEQ ID NO: 21701 - RNA, 46 nt, Mus musculus
cauugaccugcuaacuugaaagauuacuuguaaauuuuggggccug

SEQ ID NO: 21702 - RNA, 46 nt, Mus musculus
ccuauuaaaguuuauguguacaaugugaauguacaaaauaguggag

SEQ ID NO: 21703 - RNA, 57 nt, Mus musculus
ccauuuaaacagauuuuuuuccuucacauuaaagauacuaggaaaauacuaacuaua

SEQ ID NO: 21704 - RNA, 46 nt, Mus musculus
uauaguucagacugcccucuaacacgggacaaucauuuugccucag

SEQ ID NO: 21705 - RNA, 41 nt, Mus musculus
gugcuaauucaugccucugaauauuaagggcaauauugacg

SEQ ID NO: 21706 - RNA, 46 nt, Mus musculus
caucguaagcuagagagagcugagaguaaguauaucagauguuaag

SEQ ID NO: 21707 - RNA, 46 nt, Mus musculus
gugugcaucaccacuguacugccuacccaguauuuucaagucccug

SEQ ID NO: 21708 - RNA, 42 nt, Mus musculus
gugugucaugucaggucccuaacaccauuucugagcugggug

SEQ ID NO: 21709 - RNA, 41 nt, Mus musculus
cacccagcaggcagcaauaauuuaguguaguuauaggacag

SEQ ID NO: 21710 - RNA, 46 nt, Mus musculus
cagcaaacuugaauguaaauucuuacuauuucuugcuagcuagcag

SEQ ID NO: 21711 - RNA, 46 nt, Mus musculus
guggggguauuucauauaaaaacagauuucaaaucuguggacccag

SEQ ID NO: 21712 - RNA, 47 nt, Mus musculus
gagagagagagagagagagaaugauagauugagagagagagagagag

SEQ ID NO: 21713 - RNA, 45 nt, Mus musculus
agaucuaucuucagggccuugcccaugguacacaauuguuggaac

SEQ ID NO: 21714 - RNA, 46 nt, Mus musculus
gaaauauaggcaagaacuacuagaacagauagcugagcaacagaag

SEQ ID NO: 21715 - RNA, 46 nt, Mus musculus
aaagauuuagcauuuggaauuacaacuucuggaguacaagacccug

SEQ ID NO: 21716 - RNA, 46 nt, Mus musculus
cugugugcaugugaguuuccuuccaccauauaguuuuuggggggga

SEQ ID NO: 21717 - RNA, 46 nt, Mus musculus
uugguagcagguucuuugaccuucugauccaucuuuuuggcccuag

SEQ ID NO: 21718 - RNA, 41 nt, Mus musculus
gagcuauguccugauuugcaggguugcgggggagggagaaa

SEQ ID NO: 21719 - RNA, 42 nt, Mus musculus
gggagggagaaagaaaacaagagagagagagaagaagaagag

SEQ ID NO: 21720 - RNA, 82 nt, Mus musculus
auaagucaauauuuacauuaagcauaucuuauguugucaagauucgggaaagagaagcaagaaggaagaaagaacguuuaga

SEQ ID NO: 21721 - RNA, 46 nt, Mus musculus
aauaugaagcuaaauuagaagccgaaaugaggaucuacaaccccug

SEQ ID NO: 21722 - RNA, 31 nt, Mus musculus
gcuuuuaaaugaauuauuuccagcauuuuaa

SEQ ID NO: 21723 - RNA, 45 nt, Mus musculus
agggcacaggucugauguagugggagugugugugggcacaggucu

SEQ ID NO: 21724 - RNA, 114 nt, Mus musculus
ugugggcacaggucugauguagggggagugugugagggcacaggucugauguagggggagugugugugggcacaggucugauguagggggagugugugagggcacaggucugau

SEQ ID NO: 21725 - RNA, 58 nt, Mus musculus
caggucugauguagggggagugugugugugggcacaggucugauguagggggagugug

SEQ ID NO: 21726 - RNA, 47 nt, Mus musculus
gucugauguagggggagugugugugggcacaggucugauguaggagg

SEQ ID NO: 21727 - RNA, 77 nt, Mus musculus
ggcacaggucugauguagggugagugugugugggcacaggucugauguagggugagugugugugggcacaggucuga

SEQ ID NO: 21728 - RNA, 84 nt, Mus musculus
cacaggucugauguagggggagugugugagggcacaggucugauguagggggagugugugugggcaaaggucugauguagggug

SEQ ID NO: 21729 - RNA, 58 nt, Mus musculus; identical to SEQ ID NO: 21725

SEQ ID NO: 21730 - RNA, 154 nt, Mus musculus
ugugugggcacaggucugauguagggggagugugugugggcacagaucugauguagggggaguguguuugggcacaggucugauguagggggagugugugagggcacaggucugauguagggggagugugugugggcauaggucugauguaggg

SEQ ID NO: 21731 - RNA, 188 nt, Mus musculus
ggagugugugagggcacaggucugauguagggggagugugugagggcacaggucugauguagggggagugugugugggcacaggucugauguagggggagugugugugggcacaggucugauguagggggaguguguuugggcacaggucugauguagggggagugugugagggcacaggccugaugu

SEQ ID NO: 21732 - RNA, 81 nt, Mus musculus
gagggcacaggucugauguagggggagugugugagggcacaggucugaggacaguuuguggauauugauuucucuuuacua

SEQ ID NO: 21733 - RNA, 45 nt, Mus musculus
uguguguguguguguguguguaucuccugguccauucccagggag

SEQ ID NO: 21734 - RNA, 46 nt, Mus musculus
ucauauacugagcauuguuuuccuauguauguucacguguuauuug

SEQ ID NO: 21735 - RNA, 42 nt, Mus musculus
uuuuuguuaguuguuuuuaggagagcugaugguuugggacaa

SEQ ID NO: 21736 - RNA, 86 nt, Mus musculus
aagaagccgagcgcgagaagcugagaguugcugaagagaaggaagaaaagcggcuugcggagcagagggcaaggauucagcaagag

SEQ ID NO: 21737 - RNA, 33 nt, Mus musculus
gaggaggugugucuguuucuccagccaaaguga

SEQ ID NO: 21738 - RNA, 58 nt, Mus musculus
augaagaacuuauucgguuagcugaagagaggcgaaaggaagcggaaagaaagaagaa

SEQ ID NO: 21739 - RNA, 42 nt, Mus musculus
ugcaaacucaaagguggggcaagccagcuaaagaaccugugg

SEQ ID NO: 21740 - RNA, 43 nt, Mus musculus
gcuuguggauugcacacaugugaucuaccagaauaagcauaga

SEQ ID NO: 21741 - RNA, 45 nt, Mus musculus
gacagucugauucauuuguucugugguugaaaaugcauggggauc

SEQ ID NO: 21742 - RNA, 45 nt, Mus musculus
acaagaugcuuucgugaaaguccaaaugugagauuaaggacuuag

SEQ ID NO: 21743 - RNA, 47 nt, Mus musculus
ugaugcuuacuaaauuaaugugauuguacagguauguauauagagga

SEQ ID NO: 21744 - RNA, 51 nt, Mus musculus
cccagagggacaaagagcagugaauaagaaucagagacagcagagagagga

SEQ ID NO: 21745 - RNA, 54 nt, Mus musculus
ggaccauagcgaaauagcaguuuauaaagguaaaaggggaaaccuguguuaggg

SEQ ID NO: 21746 - RNA, 45 nt, Mus musculus
gacuucaauacuuugauagcuggaccuugguaguuagccucagga

SEQ ID NO: 21747 - RNA, 45 nt, Mus musculus
caguaaguacacuuaacugcugagccaucucucagacccugugaa

SEQ ID NO: 21748 - RNA, 43 nt, Mus musculus
ggaucacacuuagaagaguaaacaucagagugguaggagacgg

SEQ ID NO: 21749 - RNA, 45 nt, Mus musculus
ugaccaauuauauggucaauuuuggagaaguuaauaugaggugcu

SEQ ID NO: 21750 - RNA, 46 nt, Mus musculus
aacuucuguuaguuucaaugugucucuguuuccaggaucuguccau

SEQ ID NO: 21751 - RNA, 41 nt, Mus musculus
cuuuaaucccagcacuugggaggcagaggcagagggaggcg

SEQ ID NO: 21752 - RNA, 46 nt, Mus musculus
caggacagccagggcuacacagagaaacccugucuugaaagaacca

SEQ ID NO: 21753 - RNA, 45 nt, Mus musculus
ugccuagcaagcccaaggcccuggguucgguccucagcucugggg

SEQ ID NO: 21754 - RNA, 45 nt, Mus musculus
ugaguggguaugcauuagggcucauuuuugaugugcuuucuguca

SEQ ID NO: 21755 - RNA, 45 nt, Mus musculus
agaguucugucuuuggagaaacgugggaacacugccaggcugcag

SEQ ID NO: 21756 - RNA, 46 nt, Mus musculus
auugcuuuuauuuacugccaguguuggagcaaagugcagagaucag

SEQ ID NO: 21757 - RNA, 45 nt, Mus musculus
agcgaggagggacagccuugucagccaucuuuuuugucuuggugg

SEQ ID NO: 21758 - RNA, 44 nt, Mus musculus
cacuaguaagccucaacccuuaguuacuuauucagccccaagau

SEQ ID NO: 21759 - RNA, 44 nt, Mus musculus
aaaaaaaaaaagaaaaagaaaaagaaaagaaaaaaaagagaaga

SEQ ID NO: 21760 - RNA, 96 nt, Mus musculus
auggguacgggcaaaaucaagaggguacacaaagcacaaggauguggccccaguggcaccaccugaugccagguucccugcaaaguagcaccaaaa

SEQ ID NO: 21761 - RNA, 42 nt, Mus musculus
aagccuuugaauucccuuucagcuccaguuuugcccacauca

SEQ ID NO: 21762 - RNA, 58 nt, Mus musculus
aguauucuugggaucugggagcauucccuuugcagugucauagauaccaacguaggca

SEQ ID NO: 21763 - RNA, 46 nt, Mus musculus
acaggauuaaguuaccacagccaagcaauuugcacuaccuagagau

SEQ ID NO: 21764 - RNA, 45 nt, Mus musculus
aaaaggacauuugugaggguggcaucugauucaugcacuguagaa

SEQ ID NO: 21765 - RNA, 79 nt, Mus musculus
gagaauuuaagagcacagcccuagccgcuuucagccccggccuuugaugcuaaccuggcuaugugaccuugagcaaauc

SEQ ID NO: 21766 - RNA, 46 nt, Mus musculus
caugggacugacuagaacauucaaugcuugccgugccgggguagug

SEQ ID NO: 21767 - RNA, 42 nt, Mus musculus
ucucugccaaagauccuuugaaaagcgcgaccgccuccggau

SEQ ID NO: 21768 - RNA, 42 nt, Mus musculus
caaggagcagaaccugcuggccgugcagcaccaagggcagau

SEQ ID NO: 21769 - RNA, 45 nt, Mus musculus
cuauaguaggaauuuggguauagauguuaaauuucauuuuauaga

SEQ ID NO: 21770 - RNA, 41 nt, Mus musculus
gcaauauacuuuaggaugauaaccugugauuuuggcaaugu

SEQ ID NO: 21771 - RNA, 46 nt, Mus musculus
gcgcaugccccaggcuacagucacuuuaggaaccucgccaccaccg

SEQ ID NO: 21772 - RNA, 44 nt, Mus musculus
uaguucgguuuggugugggaguuugugccuuuuguguuacuuuu

SEQ ID NO: 21773 - RNA, 46 nt, Mus musculus
uguucagcacauacaugcuccaucguuucucacucugucaccagcu

SEQ ID NO: 21774 - RNA, 46 nt, Mus musculus
uaaugggcuuguuguaaguuugauaugcauagcaucuuaaugagau

SEQ ID NO: 21775 - RNA, 42 nt, Mus musculus
auguuacaucccauucaaaaguacugauggcuacugcaagau

SEQ ID NO: 21776 - RNA, 45 nt, Mus musculus
uaaguugucuucaggguaaaauggaaauacuauaaagucagaugu

SEQ ID NO: 21777 - RNA, 46 nt, Mus musculus
ucuaaaaauacaguuuaugcucuuugauuucugcuguuguccuguu

SEQ ID NO: 21778 - RNA, 49 nt, Mus musculus
aacggagcagacuccccucggaacaggaaagagaagucuucguaaugga

SEQ ID NO: 21779 - RNA, 44 nt, Mus musculus
cugacucuaauucuuucaguucuuacuguugguuuuggucucgc

SEQ ID NO: 21780 - RNA, 53 nt, Mus musculus
cccugcagcaugcacaccagaaauaaugaaauugcuuucaaaaggagagaaaa

SEQ ID NO: 21781 - RNA, 46 nt, Mus musculus
gagaugcucaacagaaaagccugcagaccuagggucguccccagaa

SEQ ID NO: 21782 - RNA, 47 nt, Mus musculus
acggcugcaauagcauggcauucuuuugggaaaaugagcgauagaga

SEQ ID NO: 21783 - RNA, 74 nt, Mus musculus
aguugagcuaacuugucuuguaugaaggccugcugaugcuucguuagcauauuggggaauuaagugcuugagag

SEQ ID NO: 21784 - RNA, 46 nt, Mus musculus
auaagcuauuauaaguauugagaauauaauagccaggcauggaagc

SEQ ID NO: 21785 - RNA, 45 nt, Mus musculus
gcuuuuccacuuuccacucagagggaagagggaggagaugguaag

SEQ ID NO: 21786 - RNA, 46 nt, Mus musculus
acucacugaauacuugguggucuaaaaacaagagaaaaauucacaa

SEQ ID NO: 21787 - RNA, 45 nt, Mus musculus
ugguucucccucuggacuugaugagguggugcguugccugcagcc

SEQ ID NO: 21788 - RNA, 46 nt, Mus musculus
aaauuaaccgacggaugcacuucuccaaaacgaagcacagcaaguu

SEQ ID NO: 21789 - RNA, 48 nt, Mus musculus
guucuacaugcuaguggcgauaauuauucaugccauaauucaggagua

SEQ ID NO: 21790 - RNA, 41 nt, Mus musculus
uaaacggagaagacuuuccaacaaagaaagacucuggcagg

SEQ ID NO: 21791 - RNA, 41 nt, Mus musculus
gguuugauuguggcccuguaguaaaugcuugcuuugauuau

SEQ ID NO: 21792 - RNA, 46 nt, Mus musculus
ugagcgauuuccuuucuugaagcagaggcgaugagacugucaggag

SEQ ID NO: 21793 - RNA, 41 nt, Mus musculus
gagcucggagcggggcggaggaagcaccugcaggcacaggc

SEQ ID NO: 21794 - RNA, 40 nt, Mus musculus
uucucgggccgccccggcggcugcguacuggcugugggau

SEQ ID NO: 21795 - RNA, 46 nt, Mus musculus
uuagugauguauugcuaucauugcuaaugucuuacugugucuuuua

SEQ ID NO: 21796 - RNA, 46 nt, Mus musculus
cuuggcccauagggaguggcacuauuaggagguauggccuuguugg

SEQ ID NO: 21797 - RNA, 46 nt, Mus musculus
gagacaguucaguccguguuuucacuguuugcaaggcuggccucag

SEQ ID NO: 21798 - RNA, 45 nt, Mus musculus
acagugaaggcaggugcaaaccuggauuugccuggacguucagag

SEQ ID NO: 21799 - RNA, 45 nt, Mus musculus
aaagaaaugaacauucaaggacaggagacauuuagaaucccccac

SEQ ID NO: 21800 - RNA, 46 nt, Mus musculus
uuacuggaaaguacacagaaaacuacucaagagggaccauggguaa

SEQ ID NO: 21801 - RNA, 45 nt, Mus musculus
aacucacuaguucuauuagaaagcaguaacagauagauuagcaaa

SEQ ID NO: 21802 - RNA, 56 nt, Mus musculus
aacgauguuuugggcuagaccauggaacuaaacaucuuguggcuagugggaaucau

SEQ ID NO: 21803 - RNA, 64 nt, Mus musculus
cacagguucuagugacagggauagagggagacuagaaaggggaaaggcuggagacugccuguua

SEQ ID NO: 21804 - RNA, 46 nt, Mus musculus
cauuuuaauuguucauaacuacauguuuauuuauaugugggugcug

SEQ ID NO: 21805 - RNA, 46 nt, Mus musculus
uaaaagcugcugugaauuuuuagucauuucuauucuguguacccug

SEQ ID NO: 21806 - RNA, 42 nt, Mus musculus
uaccauuauugauguuuuuacaaaugucuacaaugccuccag

SEQ ID NO: 21807 - RNA, 45 nt, Mus musculus
cucuccuguguccccacaaaucugaaagaaaacaccaagccauga

SEQ ID NO: 21808 - RNA, 42 nt, Mus musculus
gaagaacacagcugccacacuuacauaugugcacgcccccag

SEQ ID NO: 21809 - RNA, 44 nt, Mus musculus
aagaucaacucaggaaggccugugcuucacuuuaguaggguuca

SEQ ID NO: 21810 - RNA, 46 nt, Mus musculus
aguacaaaacucugauaaagauggagaaugagagaccagcagcuag

SEQ ID NO: 21811 - RNA, 46 nt, Mus musculus
acuugggaagccugugcuuuucuuacacccucuguccuccgcagag

SEQ ID NO: 21812 - RNA, 46 nt, Mus musculus
agguacguguuggugccuugcagggucaugggacccggguugcagc

SEQ ID NO: 21813 - RNA, 46 nt, Mus musculus
aggguuucuuaguccuuggaggccauguaggccaugagguccacca

SEQ ID NO: 21814 - RNA, 45 nt, Mus musculus
ggagaucaugccccaaaaccagaaggcaauuggaaaugcccugaa

SEQ ID NO: 21815 - RNA, 47 nt, Mus musculus
gugccugaggauaaauacacagcccugguggaccaggaggagaagga

SEQ ID NO: 21816 - RNA, 46 nt, Mus musculus
ccgugagggcuggacagauucggauucuccagagcaggaggaggug

SEQ ID NO: 21817 - RNA, 45 nt, Mus musculus
cuuccgugacggccgcuccgaggacuuucgucguacucgugacag

SEQ ID NO: 21818 - RNA, 54 nt, Mus musculus
auugaaaacuguguauauaugucaguuuuugacaagaguugcaucuggaaaggc

SEQ ID NO: 21819 - RNA, 45 nt, Mus musculus
uuuuaucuuucuagaacagugacucucaaacuuuagccugccuca

SEQ ID NO: 21820 - RNA, 45 nt, Mus musculus
ggugagcaguacugacaugaaacugcuuaguuauuuaaacuccca

SEQ ID NO: 21821 - RNA, 46 nt, Mus musculus
gggcuauguagguuagggccuuuggcugaaaaagauaauaggcugg

SEQ ID NO: 21822 - RNA, 45 nt, Mus musculus
auccaauauuuuuaaaauauaccaaguaauauagaaaagguugag

SEQ ID NO: 21823 - RNA, 45 nt, Mus musculus
uuguagagaaauuuuaauucagcaacauagcugcucugacaagag

SEQ ID NO: 21824 - RNA, 46 nt, Mus musculus
uguagaaggaagcagccguguuugaaagugaaaucuaauuggggga

SEQ ID NO: 21825 - RNA, 53 nt, Mus musculus
cagggauaggauacauccaacucucacgaggacaggaaagagaggcaacuuga

SEQ ID NO: 21826 - RNA, 46 nt, Mus musculus
cuagacacaggugaagacaaaaugagccagagaaugagaaagccaa

SEQ ID NO: 21827 - RNA, 46 nt, Mus musculus
uucaagcccagcauaaacuauauaggaagaguuccaagauggccag

SEQ ID NO: 21828 - RNA, 45 nt, Mus musculus
cgguuguguauggaaugcagcauaugcuggguaaaauggagacag

SEQ ID NO: 21829 - RNA, 52 nt, Mus musculus
augcacaguuugaaguugaugagcguauuacacccuuggaaucagcccugau

SEQ ID NO: 21830 - RNA, 42 nt, Mus musculus
uguggugguuuagguggcccuguggugaauuaggaccuggag

SEQ ID NO: 21831 - RNA, 46 nt, Mus musculus
accugacuuugugccgcagacccucuggaucccuuugucugcguag

SEQ ID NO: 21832 - RNA, 46 nt, Mus musculus
aaggcuguagcuguuuguauggaaauuggcagcuuuaaggaagcag

SEQ ID NO: 21833 - RNA, 46 nt, Mus musculus
aauagaauuaauuuuaugacucgauauggggugaagaaaacagaaa

SEQ ID NO: 21834 - RNA, 46 nt, Mus musculus
uuuacaguauguccaacuugauagucaacacauuuugagggcucag

SEQ ID NO: 21835 - RNA, 92 nt, Mus musculus
ugcauaucuuccucucugggguguaaauugauagguuagagagacuagugaaauaugcaugcacacaucccagcaagucucauuucuaggua

SEQ ID NO: 21836 - RNA, 50 nt, Mus musculus
cuguucaaguucuauaguauuuacugcauauccagcauucagacaacuac

SEQ ID NO: 21837 - RNA, 48 nt, Mus musculus
cagcuaaauaaacaaaugaugauugaucaguauacuagacagugguac

SEQ ID NO: 21838 - RNA, 46 nt, Mus musculus
auugccaagaauauagaaaugaggaaaacauagcaaguuuuagggg

SEQ ID NO: 21839 - RNA, 95 nt, Mus musculus
cuugccaugcaaaagcaugaggacaugaauuuagguucccaacauacagacacgguggcagaaaccuauaaucccaggguuagugaugcaugcag

SEQ ID NO: 21840 - RNA, 65 nt, Mus musculus
cuauugcuuauagacauaaauauacaaguauagagagauuuauuuuuggggagguggcaagacug

SEQ ID NO: 21841 - RNA, 45 nt, Mus musculus
auuuguguuuuauaucaauacauuucuguuguuuuuuagccuuua

SEQ ID NO: 21842 - RNA, 46 nt, Mus musculus
gucuaaggauaggccagaugccaccaacacuggaauggacacugaa

SEQ ID NO: 21843 - RNA, 45 nt, Mus musculus
accaucccagcauuccugggaugaagccuacuuggucaugaugga

SEQ ID NO: 21844 - RNA, 42 nt, Mus musculus
caauguaucucuguuuacuuuuuguuuccagaaucuguccag

SEQ ID NO: 21845 - RNA, 46 nt, Mus musculus
uauccucaauaagguaaaauaugauacuugucuuuguccuuaaaau

SEQ ID NO: 21846 - RNA, 45 nt, Mus musculus
ugcuggcuucaaacuugcauugaucauccugccuuaaccugcuaa

SEQ ID NO: 21847 - RNA, 46 nt, Mus musculus
uuuuuagguucuauuuugcuucuguauaaaauuagaaugaugcaag

SEQ ID NO: 21848 - RNA, 45 nt, Mus musculus
augugucugaauaaaauaauauguaacucuuuaauauugcccucu

SEQ ID NO: 21849 - RNA, 80 nt, Mus musculus
uugagaauugaauuuuaggaccucuguuugcuccugucagcccugaucggucagucccuguuuguuccggcccaaagauu

SEQ ID NO: 21850 - RNA, 61 nt, Mus musculus
aacgauggaaaggaaccgaagaaccaguggaaggaauagauugugugucucagagaaucag

SEQ ID NO: 21851 - RNA, 70 nt, Mus musculus
aauuugucucagaagguggcugacacauuuaauuuuauguuguauuggaacuuucaguuuaauuuuuuuu

SEQ ID NO: 21852 - RNA, 104 nt, Mus musculus
auaucuuaaacaaaaguauuugagccugucucauucaaauuuguagagccuuuuauaaacuuacuccauugagggaaaaaguaaaugccuuucagaaguaaacc

SEQ ID NO: 21853 - RNA, 45 nt, Mus musculus
uuacaaaugugaacaagcuuuucucuuacuauaaauuaggucauu

SEQ ID NO: 21854 - RNA, 45 nt, Mus musculus
augcugguuucucuggcauuuagucaucuguaaaacaauauccua

SEQ ID NO: 21855 - RNA, 46 nt, Mus musculus
gggcaggcagauaugggagggcugccagacgcuuuccacuuggccu

SEQ ID NO: 21856 - RNA, 46 nt, Mus musculus
uauagccccaggguuaugggagagagguucccaugcaggugagagu

SEQ ID NO: 21857 - RNA, 55 nt, Mus musculus
cagggggaaagagaaaagguagaaagagaaagagaggccagccauggccaagagg

SEQ ID NO: 21858 - RNA, 48 nt, Mus musculus
aaggcuagagaguaagagggagagaaagggagaggagaggagagaaga

SEQ ID NO: 21859 - RNA, 45 nt, Mus musculus
uagcugaugaacuuucuuuccaucguuuuuaaguguaccguguag

SEQ ID NO: 21860 - RNA, 56 nt, Mus musculus
acuaucccauuauaaguucaacaaccgaacaagugucauguuaaaagauagaugga

SEQ ID NO: 21861 - RNA, 44 nt, Mus musculus
uuccuggucaguaaugauaaagcauuaugguggugguggggcag

SEQ ID NO: 21862 - RNA, 41 nt, Mus musculus
uguuugguggcugauuuugggauggaucccuggguggggca

SEQ ID NO: 21863 - RNA, 46 nt, Mus musculus
ggaauaaauggaacacaucuccaccucaugacaucacccaugcuag

SEQ ID NO: 21864 - RNA, 45 nt, Mus musculus
uucaaagugucccccugcucugagagagaccuugccuuucagaag

SEQ ID NO: 21865 - RNA, 45 nt, Mus musculus
aguaaugagcacacuuaacugcuaagccaacuuuccagcccccaa

SEQ ID NO: 21866 - RNA, 46 nt, Mus musculus
gggucaagagaguagcgaaccaucuucacaggugaccucuggccgc

SEQ ID NO: 21867 - RNA, 45 nt, Mus musculus
ucacaaacacccagacaggcaggcagugguuccaggcuacacuca

SEQ ID NO: 21868 - RNA, 46 nt, Mus musculus
ggagagaagaaucgacuuacggaacagccuccaugguuccagccgg

SEQ ID NO: 21869 - RNA, 46 nt, Mus musculus
uuuuuaguaauguuucaagacaugcuggccauagcuuagugcaauu

SEQ ID NO: 21870 - RNA, 46 nt, Mus musculus
ggccagaucucugccuuggcauggagagcacugaagugaaugagau

SEQ ID NO: 21871 - RNA, 46 nt, Mus musculus
caguuugcugagaaugaaaccaacgaggucaauuuuagagagaucc

SEQ ID NO: 21872 - RNA, 46 nt, Mus musculus
agagagagagagagagagagagagaguaguugcagugguccaagcc

SEQ ID NO: 21873 - RNA, 42 nt, Mus musculus
ugaugcuauguaugugaaauuaauaucuucugauggccauga

SEQ ID NO: 21874 - RNA, 56 nt, Mus musculus
acuaaaguuccucugggcucagauagaauuuuaucagaacauaauggguaaguuau

SEQ ID NO: 21875 - RNA, 46 nt, Mus musculus
agucauuacuuuuaaauaaucuuccaggaaugccccuacugaaguu

SEQ ID NO: 21876 - RNA, 46 nt, Mus musculus
aguuguuuguguuugugguuuacgugugcauuuuugaugagcagag

SEQ ID NO: 21877 - RNA, 46 nt, Mus musculus
ggaggcagggcuacacagagaagaccuaccaugaaaaacugaagag

SEQ ID NO: 21878 - RNA, 42 nt, Mus musculus
gagccucuuccaaagccuuaaacacuuuucaucccagcagag

SEQ ID NO: 21879 - RNA, 46 nt, Mus musculus
auuagauguuucugacuggcacucagaguagguauagaacuaggga

SEQ ID NO: 21880 - RNA, 46 nt, Mus musculus
ugcuucagggaaagauugggguuuugugcagggguguaugucagau

SEQ ID NO: 21881 - RNA, 54 nt, Mus musculus
augccucuggcuuccaagcacugggauugaaggaguagaucaccacacccagau

SEQ ID NO: 21882 - RNA, 46 nt, Mus musculus
agaaagcaauugaaauaguuuuacaacuugguccauacuaccagau

SEQ ID NO: 21883 - RNA, 52 nt, Mus musculus
aggaguuuggcgggaccuuaacuagcucagcucggugggucuggaaagggga

SEQ ID NO: 21884 - RNA, 42 nt, Mus musculus
aguuaucccucugcucaccccuucccgucugggcggggaagg

SEQ ID NO: 21885 - RNA, 41 nt, Mus musculus
uuugagaaugcacucaaaaggaagguugaacuugaggcaau

SEQ ID NO: 21886 - RNA, 56 nt, Mus musculus
uugccaaacaucaaaaugaggaaacuuugugcugauaaugcaguuccuaagaagcg

SEQ ID NO: 21887 - RNA, 46 nt, Mus musculus
aagaggaugaggaagaggaggaagaagaggaagacgaagaugaaga

SEQ ID NO: 21888 - RNA, 45 nt, Mus musculus
agcuaaaggaaaaccugaugcagcgaaaaagggggugggugguca

SEQ ID NO: 21889 - RNA, 41 nt, Mus musculus
ugagcaaugagcugaggcaggaaauaggaggugggacauug

SEQ ID NO: 21890 - RNA, 26 nt, Mus musculus
ggaaggcaauaaaggcaggauggauu

SEQ ID NO: 21891 - RNA, 77 nt, Mus musculus
ucuaugguuuuagagcuuugcuguagaaaggcagggagaaaggagagaaaguggagagagagagagagagagagaga

SEQ ID NO: 21892 - RNA, 46 nt, Mus musculus
agaagaaauagagaguaagagagagagagagugagaggagaguaug

SEQ ID NO: 21893 - RNA, 45 nt, Mus musculus
caaaugaucaaauauuuucugaaauacaugaauaaagggcacaga

SEQ ID NO: 21894 - RNA, 46 nt, Mus musculus
acaggagaggucgucaucaucccuuacagaagugucagucccuucc

SEQ ID NO: 21895 - RNA, 44 nt, Mus musculus
cagcacccucuuccuaucuguuuuaguuccauguagcccagagu

SEQ ID NO: 21896 - RNA, 42 nt, Mus musculus
accaggaccagaagauucuaaucacuaccucagcagccacug

SEQ ID NO: 21897 - RNA, 45 nt, Mus musculus
gcucuucuagaacauaaggucaguaguaggaguuugggguguuca

SEQ ID NO: 21898 - RNA, 45 nt, Mus musculus
gcauaacuuuagaccaauggaagaaaaaagcagcaaaaguugaac

SEQ ID NO: 21899 - RNA, 46 nt, Mus musculus
aggcuuugagccaaagaaagaagaaguaaaacaacugaucgcugaa

SEQ ID NO: 21900 - RNA, 41 nt, Mus musculus
uugccaucaugagcguaaaaaugagugaaaaagaugaaaaa

SEQ ID NO: 21901 - RNA, 46 nt, Mus musculus
gaucuacagaccauggaguagagaagucgcuggaggcuggggagga

SEQ ID NO: 21902 - RNA, 46 nt, Mus musculus
ugacucggguuuggccugugggugugaaccaucuuuccagcuggau

SEQ ID NO: 21903 - RNA, 46 nt, Mus musculus
uaccuuuaauuugauccaaauuguucuuacuccccacuuuucugau

SEQ ID NO: 21904 - RNA, 42 nt, Mus musculus
gaacuaaaauggucuacugcaaaaucgaucagacccaaagaa

SEQ ID NO: 21905 - RNA, 46 nt, Mus musculus
ugagacuccucaccuuuaugggaauggcaguggaaaacaaagagau

SEQ ID NO: 21906 - RNA, 46 nt, Mus musculus
uccaaaugccuuucuuuuugaccaucuucuuauucuaaagccaguc

SEQ ID NO: 21907 - RNA, 44 nt, Mus musculus
ugagguacacaguguacugcagccucaucaaaguggcggcauca

SEQ ID NO: 21908 - RNA, 41 nt, Mus musculus
uuuuggagcgggcggggagaacaaauacaagugcggucggg

SEQ ID NO: 21909 - RNA, 24 nt, Mus musculus
auagccccugggauggcagccuga

SEQ ID NO: 21910 - RNA, 57 nt, Mus musculus
cacauuaggaaguaggaaauuguugagcagcgggcaaaugguuaggaggaagaugga

SEQ ID NO: 21911 - RNA, 41 nt, Mus musculus
uaggaacaaccaaucauuguggcuuagcucaauggccaugu

SEQ ID NO: 21912 - RNA, 45 nt, Mus musculus
cuuggcuguguguucuuuuuugaaucauuguguaacaaagucaua

SEQ ID NO: 21913 - RNA, 46 nt, Mus musculus
aauaaauacuugcuauuauucuuuuauuuaauauucugucguucag

SEQ ID NO: 21914 - RNA, 41 nt, Mus musculus
uaagaaaaguagguaacagucuugguacuaaauaugugcag

SEQ ID NO: 21915 - RNA, 44 nt, Mus musculus
acaagucagaugcucucagguugcaccagcccaccagguggaga

SEQ ID NO: 21916 - RNA, 91 nt, Mus musculus
gccccaggaggguuuuccuucucccucacuuggaagcccgggcuuuguaaauaauaggagaauuuuuuuuuucucccggguuuaauuucag

SEQ ID NO: 21917 - RNA, 47 nt, Mus musculus
aacagaauuaaagggcaaagcaaucuuuuguuugaauucaggagaga

SEQ ID NO: 21918 - RNA, 46 nt, Mus musculus
caggcaaugucacugucuuuugccugacaugcugagccagggaguu

SEQ ID NO: 21919 - RNA, 46 nt, Mus musculus
acuccagaggcaauguuaagaauagcuuuaguagaaagaaagaaag

SEQ ID NO: 21920 - RNA, 46 nt, Mus musculus
aacaguuguguaaugaaugcuucuauuuaaaaagaugugggugugg

SEQ ID NO: 21921 - RNA, 42 nt, Mus musculus
aguagcccagacucaaaauuauagaucacccuuagcccccag

SEQ ID NO: 21922 - RNA, 46 nt, Mus musculus
ucauagcuucuguuaauuuucacaaaacaagguauauagcagguag

SEQ ID NO: 21923 - RNA, 29 nt, Mus musculus
gucuacauggauaggaaggagcaagguag

SEQ ID NO: 21924 - RNA, 45 nt, Mus musculus
cugugcuugcucggcaaugguucuuaaacuaaguacaugcccaga

SEQ ID NO: 21925 - RNA, 42 nt, Mus musculus
cauuuuuccaacccaauauaauaugcaaauaagcuaggcuag

SEQ ID NO: 21926 - RNA, 45 nt, Mus musculus
uaucaaguuauauaggaacuucaguuuccuagaacacaccugcau

SEQ ID NO: 21927 - RNA, 42 nt, Mus musculus
cugugagauuugucuccuugauauacuugguggcagcuauag

SEQ ID NO: 21928 - RNA, 46 nt, Mus musculus
uggggaacuaaucucaauuagugacaagaaaaauaucgauaaugag

SEQ ID NO: 21929 - RNA, 42 nt, Mus musculus
uuaggguacaugugugcagcacuuagggcuuucccuguguua

SEQ ID NO: 21930 - RNA, 46 nt, Mus musculus
gagugagugagacacaguugcugaauaggugcugcauagaacagag

SEQ ID NO: 21931 - RNA, 45 nt, Mus musculus
aaucuuugagccaggcgugguggcgcacaccuuuaaucccagcac

SEQ ID NO: 21932 - RNA, 42 nt, Mus musculus
cagguuuauagcuuaaaaaccucaaucuaguuguuggcacag

SEQ ID NO: 21933 - RNA, 46 nt, Mus musculus
aguaaaacuaaacuaaacuucccaggaaacuugguuuuauagagag

SEQ ID NO: 21934 - RNA, 46 nt, Mus musculus
ggcccagauuuuaccagagaucaguggaggcugcuuuggaagagag

SEQ ID NO: 21935 - RNA, 45 nt, Mus musculus
uuguuuguguuaauuuuuaauaguaaccuucaguuaaggggcagg

SEQ ID NO: 21936 - RNA, 46 nt, Mus musculus
ccacuaaagaauauuuggucuugauugggggaggcaugcacaguag

SEQ ID NO: 21937 - RNA, 41 nt, Mus musculus
uuggcuacaggacuccaauaccagagccagaaauaaagcaa

SEQ ID NO: 21938 - RNA, 44 nt, Mus musculus
cauggcuuaauggcuguggucucucugggaaaagaaugguauaa

SEQ ID NO: 21939 - RNA, 46 nt, Mus musculus
aggacugagaagacuuugcuacuuagugaacgcaguaaaggagaag

SEQ ID NO: 21940 - RNA, 46 nt, Mus musculus
gaacgccuaaacgcagggauuuauuuccuauuuuauacccuaaucg

SEQ ID NO: 21941 - RNA, 46 nt, Mus musculus
gauuaggguauaaaauaggaaauaaaucccugcguuuaggcguuca

SEQ ID NO: 21942 - RNA, 46 nt, Mus musculus
uuucauuuuguuuuguucuuuuuggauggauguuugguugguugau

SEQ ID NO: 21943 - RNA, 45 nt, Mus musculus
gaagaaaugaagaaaagcuaccuuuguuguccguugagaaggggg

SEQ ID NO: 21944 - RNA, 42 nt, Mus musculus
ugguuugcaaaacaaguguuugaauagugugcuuauguggug

SEQ ID NO: 21945 - RNA, 45 nt, Mus musculus
cuugcugcccagggacccuauaacccagaugaaaugagagcaaag

SEQ ID NO: 21946 - RNA, 42 nt, Mus musculus
cucuuugaggaaugaaauuccccgaccaguuacagggcuaca

SEQ ID NO: 21947 - RNA, 56 nt, Mus musculus
aggaggaggaggaggaggagaaggaagaagaagaggaggaagaaagaggaggagga

SEQ ID NO: 21948 - RNA, 60 nt, Mus musculus
guaguuuguuaaguagaguugugaagagaaggaagaagaagaggaggaagaaggaggagg

SEQ ID NO: 21949 - RNA, 46 nt, Mus musculus
aauaugguguuggaagaugucacagaauuugaaauuacaccagaag

SEQ ID NO: 21950 - RNA, 68 nt, Mus musculus
cuucaucacaaugugaauucuugacccuauacauuuguccacaagcucuaguggcaggaguuggguuc

SEQ ID NO: 21951 - RNA, 42 nt, Mus musculus
uccugccacuagagcuuguggacaaauguauagggucaagaa

SEQ ID NO: 21952 - RNA, 45 nt, Mus musculus
uagaccuaccagcaaaagccaaagaacaaguaccucaggccaaac

SEQ ID NO: 21953 - RNA, 59 nt, Mus musculus
aacucauccaacacaaagguacucuugggcaggugagcgaaaggguccuuggccuuggg

SEQ ID NO: 21954 - RNA, 43 nt, Mus musculus
uucuguuucuccucucgugaacccuuaucuuuccuugggguau

SEQ ID NO: 21955 - RNA, 66 nt, Mus musculus
uugguauuggggaaggccuggcgaaaagaaggcucuaagaccuguuuauagagccacaacagggua

SEQ ID NO: 21956 - RNA, 46 nt, Mus musculus
gguuguuguggugcauaaugcccaagguggggaacacccagguacu

SEQ ID NO: 21957 - RNA, 42 nt, Mus musculus
guacugcggggcugacuagaacagagacaauguuucgagcag

SEQ ID NO: 21958 - RNA, 42 nt, Mus musculus
aguuccucuggaagaaggccuuuguaugcaucaugcugagcc

SEQ ID NO: 21959 - RNA, 46 nt, Mus musculus
ucaccuacuuugugugugugauuugaaauucaguaguaaaagagau

SEQ ID NO: 21960 - RNA, 90 nt, Mus musculus
ugcagacaagaaaccggacaggccuaaaggcgaagaccacgaaaaggagaaagagagagacaagagcaagcacaaagaaggggagaagga

SEQ ID NO: 21961 - RNA, 47 nt, Mus musculus
cgcggcucucacacggcgaccgggcaccagaugggaaagcaagcaga

SEQ ID NO: 21962 - RNA, 47 nt, Mus musculus
ccagauaggccauuuaauagggguaaaggggaccgacagagauuuua

SEQ ID NO: 21963 - RNA, 42 nt, Mus musculus
cccucgcgcgaguacaaacuuuucaccuaugaggccacagca

SEQ ID NO: 21964 - RNA, 96 nt, Mus musculus
gcuucugaaagcaaggaugcagagagcugcagaaauggagacaagcaugcugcgucugcuccaccacacaacaaagagcccuuagcagaggcuguc

SEQ ID NO: 21965 - RNA, 58 nt, Mus musculus
ggccuggcacugggaagggaggcauggauggggaugggagcgggagcgggagcgggag

SEQ ID NO: 21966 - RNA, 91 nt, Mus musculus
uuaacaaauuuaucaauucccucaaaacaagaggaaaguguggaaaacaaagagagaacauuaaaaagacugcugcuccaagaucaagaga

SEQ ID NO: 21967 - RNA, 98 nt, Mus musculus
acucuuaaagaaauuccuuuuauaaaugaucaagcuaacccaaaaguagagaaaauagauaaaguggaggugacugaaggugacgccaaggagauaaa

SEQ ID NO: 21968 - RNA, 51 nt, Mus musculus
cuuuugggcaccacuggucaaguauaugagcaggcucagccacuuguagaa

SEQ ID NO: 21969 - RNA, 77 nt, Mus musculus
agacuccugagagcgccccaauaguguugccccccgacaagaaagguaaaauggagucaugcacagaggaagcagca

SEQ ID NO: 21970 - RNA, 45 nt, Mus musculus
cuguuguugggccugauuauccgucagaagcugaagcggccgcac

SEQ ID NO: 21971 - RNA, 45 nt, Mus musculus
ccugguaugucuaugcucugguaauagaaugggcuugaagugagu

SEQ ID NO: 21972 - RNA, 46 nt, Mus musculus
gaagcagguuaaagacauguaccucauuccauugggcgcugcagau

SEQ ID NO: 21973 - RNA, 45 nt, Mus musculus
gcuuccaucaagcacagaagucacaggucacucagcagcagcaga

SEQ ID NO: 21974 - RNA, 46 nt, Mus musculus
cagacaguuugggauuauguggaaaaaauaaaagcaucaggcacca

SEQ ID NO: 21975 - RNA, 45 nt, Mus musculus
agaaacaaaaagaagagguugacuccacaucuaaagacaccacua

SEQ ID NO: 21976 - RNA, 26 nt, Mus musculus
uccuuggugcuuuguaaauagugcag

SEQ ID NO: 21977 - RNA, 48 nt, Mus musculus
ucuuugguuuugguuuugguuuuaagguguguauuguagaaagguaga

SEQ ID NO: 21978 - RNA, 46 nt, Mus musculus
gaccaaucacgaaaauaacucacaaaggugagauagaaaucgagag

SEQ ID NO: 21979 - RNA, 45 nt, Mus musculus
aguuucuuucuuuuaauugccaguguuaacuaaaaagguccagga

SEQ ID NO: 21980 - RNA, 42 nt, Mus musculus
uuguggcuuagacauuaaccuucccugggcugugcuugaggu

SEQ ID NO: 21981 - RNA, 41 nt, Mus musculus
auaugucuuuggguuucucuugcugugcugcaaccccaggg

SEQ ID NO: 21982 - RNA, 46 nt, Mus musculus
uucucuucucuccucuccucccccuccccucccccucaccccaccc

SEQ ID NO: 21983 - RNA, 46 nt, Mus musculus
aaaaggagaaguaaccccugaucaucuuauaagaaugagcccagaa

SEQ ID NO: 21984 - RNA, 46 nt, Mus musculus
caauuuacucuaaacuauucuucaaaaucuauguuaagccuaagca

SEQ ID NO: 21985 - RNA, 45 nt, Mus musculus
gcuagccccucuucgcaaguugagccaaccacauuuaccucggag

SEQ ID NO: 21986 - RNA, 60 nt, Mus musculus
aaacacagacacucagaugacccugggaagcacaaggucaaaauuuuaaaacggguaagg

SEQ ID NO: 21987 - RNA, 90 nt, Mus musculus
uggagacuguguuggauuaagucuuucucaagcacagcaaaugggagaggaagacaaagaauauguuuguguaaggugcugugcugaaga

SEQ ID NO: 21988 - RNA, 45 nt, Mus musculus
uucaucccagacaacauagcuacuguaaaaaaagaagggucagau

SEQ ID NO: 21989 - RNA, 42 nt, Mus musculus
uagccaugugaaggaugagcaugaccauccagucagugagca

SEQ ID NO: 21990 - RNA, 46 nt, Mus musculus
cugugaaaagccaagcucauucuguauugaaaagaaugccccagga

SEQ ID NO: 21991 - RNA, 81 nt, Mus musculus
caaagcaauugaauauuacucaaaguauuaaaauggaaacagccaaucuucaggaugauagaagugguuuagagcccaaaa

SEQ ID NO: 21992 - RNA, 82 nt, Mus musculus
ugcuugugccaauaaaaauaaggcagaaaagaaugaaggggcagaaugucauuuggaauugaagaauacuguggauauuguu

SEQ ID NO: 21993 - RNA, 62 nt, Mus musculus
ucgggugaacugaaugacaccauugaaggaaaggaugcagggggaaaaccugaucaagaauc

SEQ ID NO: 21994 - RNA, 55 nt, Mus musculus
uguaaagcuaagacuaacaguagcccguuauuuaaguuuccaguuagagaagaug

SEQ ID NO: 21995 - RNA, 42 nt, Mus musculus
aucugaacacccuaaggagaguagaaggaguggccggcaugc

SEQ ID NO: 21996 - RNA, 46 nt, Mus musculus
gggaagaccuuaucuaccucuaaaguaggggugaagccagcagaaa

SEQ ID NO: 21997 - RNA, 45 nt, Mus musculus
augaucaagaguagucucaguaaauuuuuauugauaugaucaggu

SEQ ID NO: 21998 - RNA, 45 nt, Mus musculus
uacaacagccuuuaauguaaaagggaaaugcauugaagugggaau

SEQ ID NO: 21999 - RNA, 47 nt, Mus musculus
acaaauuuuaguuacucgcauaggaauaguauagggacuggagaugu

SEQ ID NO: 22000 - RNA, 46 nt, Mus musculus
aaagaacuguguguuucuucucuugggaagauuuuuaggcucagga

SEQ ID NO: 22001 - RNA, 46 nt, Mus musculus
gugagagugcuguuagcuacaccaggaccugcugcaucaccuggau

SEQ ID NO: 22002 - RNA, 46 nt, Mus musculus
gcccauaauuuuguaaaguuguugacugugucacauguucagagau

SEQ ID NO: 22003 - RNA, 46 nt, Mus musculus
uuccgguucuuucugcgguccauuagcauauuuugguaccccgaga

SEQ ID NO: 22004 - RNA, 46 nt, Mus musculus
acuguuucuaaaacaguauuucaugacauggaaguuuggggaauua

SEQ ID NO: 22005 - RNA, 72 nt, Mus musculus
ggcuucucaugccugggcuugggguuuuuuguuagauugucguuggcucugggaaggaguauuguuagucca

SEQ ID NO: 22006 - RNA, 24 nt, Mus musculus
cuuguguaggguugaagcuuccug

SEQ ID NO: 22007 - RNA, 45 nt, Mus musculus
ucuaccugccacucagcugauuguuagggucucuauagcccagac

SEQ ID NO: 22008 - RNA, 57 nt, Mus musculus
auugaugaagaagaauugauuuuaccuaacaggaguuugagggacagaguagaagac

SEQ ID NO: 22009 - RNA, 49 nt, Mus musculus
uaucacauuaaaacacuuugauuuuuuuuccaugugcugcuuuuaaauu

SEQ ID NO: 22010 - RNA, 45 nt, Mus musculus
cagaugugggugcuuacugguaaaguaccucauauguuagcagua

SEQ ID NO: 22011 - RNA, 45 nt, Mus musculus
gguuuggacaugaaccuagaauuaggagcuuuucaaggcauagau

SEQ ID NO: 22012 - RNA, 53 nt, Mus musculus
uccuuucuuuccuuucuuuucuuccuuauuuagccaucuguaaauuaccugca

SEQ ID NO: 22013 - RNA, 45 nt, Mus musculus
aguucauacaccaucccacuagauccuuacaacagcacugugaga

SEQ ID NO: 22014 - RNA, 47 nt, Mus musculus
uggaaaucuauuuguugccgaauugcuccucaaaaagaccgugucau

SEQ ID NO: 22015 - RNA, 42 nt, Mus musculus
aacucaaagacucagugagucaaguaagacacauccauuuac

SEQ ID NO: 22016 - RNA, 45 nt, Mus musculus
accaccaaagcccuuuccugagggcuuuguguucauggcucaagc

SEQ ID NO: 22017 - RNA, 46 nt, Mus musculus
acugaaccuagaaaaacauaaagguucuaaguuuuuugaggcaggu

SEQ ID NO: 22018 - RNA, 46 nt, Mus musculus
cucuccaccuuucaaauucuaggauugcagauaggugcccccccac

SEQ ID NO: 22019 - RNA, 45 nt, Mus musculus
ucaggaugaagcaucuuccuggugugguuguguaucuauaugaga

SEQ ID NO: 22020 - RNA, 45 nt, Mus musculus
uugaauaauuauccuuggggcuuucuucaagguuacgcggcauua

SEQ ID NO: 22021 - RNA, 45 nt, Mus musculus
auacauauacauacacauauacauauauuauucauacaggcagua

SEQ ID NO: 22022 - RNA, 47 nt, Mus musculus
aggauaaagagacuagauuuuuuuuuuuaauacuggguuuaggggag

SEQ ID NO: 22023 - RNA, 42 nt, Mus musculus
uuuuccuuguaagucagugcauggguguaaggcuuguuagau

SEQ ID NO: 22024 - RNA, 25 nt, Mus musculus
uggaauaauggaucguuauucagau

SEQ ID NO: 22025 - RNA, 46 nt, Mus musculus
ucuguccccuguccucucucuauaaaacuccuagcccccugccccc

SEQ ID NO: 22026 - RNA, 47 nt, Mus musculus
aaaaucuuugcuugugcuaauuuacuucugagcagggugcuggguuu

SEQ ID NO: 22027 - RNA, 46 nt, Mus musculus
uaaucucaguguuugagaggcugagguaggaggaucgucaggaguu

SEQ ID NO: 22028 - RNA, 46 nt, Mus musculus
uauucauauguguaugauacauacuuuuuaagucaugcaggagaau

SEQ ID NO: 22029 - RNA, 26 nt, Mus musculus
uuucaacuacauuuucuucuaaacag

SEQ ID NO: 22030 - RNA, 46 nt, Mus musculus
uccaaccuggagaaugaagucugugaggauuuuaguacaagucaaa

SEQ ID NO: 22031 - RNA, 46 nt, Mus musculus
auuuaguaggauuucugguaagauauuauccuauaugcaugguaaa

SEQ ID NO: 22032 - RNA, 42 nt, Mus musculus
aguccuaggauuaaaggcgugagccaccacacccggccagga

SEQ ID NO: 22033 - RNA, 46 nt, Mus musculus
uugugugcaaaucuaauaagacccacuuaguuaguuagccucguua

SEQ ID NO: 22034 - RNA, 46 nt, Mus musculus
auuaaaauuuuaaacuuauauucuguuuuagaaucagcgaagugaa

SEQ ID NO: 22035 - RNA, 44 nt, Mus musculus
aagaaaaaacuggccuauaaauguagguaggaauuaaguuagau

SEQ ID NO: 22036 - RNA, 46 nt, Mus musculus
cugaaguuuucuccugccuguuguacacuuuauugguguuuccuga

SEQ ID NO: 22037 - RNA, 42 nt, Mus musculus
cuuuuuaaaaaaggaucgaacaaucuagacuugccccacauu

SEQ ID NO: 22038 - RNA, 43 nt, Mus musculus
cugcgggcucucgcggcgccgcacaggcuccacgaggcgagcg

SEQ ID NO: 22039 - RNA, 45 nt, Mus musculus
uauugaaguuucaggaaauguuaauuuggugagaaugcuucaaau

SEQ ID NO: 22040 - RNA, 46 nt, Mus musculus
aaggucagagcuuucuacacccagacaacuaacugccugccuagug

SEQ ID NO: 22041 - RNA, 46 nt, Mus musculus
cagauaaaucaugcauagugguaugcagagauuagaaauccaaggu

SEQ ID NO: 22042 - RNA, 46 nt, Mus musculus
uguauauauuuugaaauuaauuugaaccugaguauuuggcacauga

SEQ ID NO: 22043 - RNA, 46 nt, Mus musculus
aacauuuaaauaaaugaugaaccgcauucgucacugaggacacuuu

SEQ ID NO: 22044 - RNA, 46 nt, Mus musculus
caaaauacccagcacaauacuuguauauuuuuagcaucauacagaa

SEQ ID NO: 22045 - RNA, 72 nt, Mus musculus
uccacaggaauacugaaaaaccagucuuaccaggccacaaguuugacagaauugcaaccucuauauuugggc

SEQ ID NO: 22046 - RNA, 42 nt, Mus musculus
agacaguaaguaacgccgccguccucuuucaugccugcauaa

SEQ ID NO: 22047 - RNA, 32 nt, Mus musculus
acaggacucauaacaaacacuaugcuauacuc

SEQ ID NO: 22048 - RNA, 42 nt, Mus musculus
cuguucugaaucauaaagaucagauauggaguccacagguug

SEQ ID NO: 22049 - RNA, 42 nt, Mus musculus
acucacugcuucuuguuaggagguucauuucauugcccguuu

SEQ ID NO: 22050 - RNA, 40 nt, Mus musculus
uuucccuuucuugcuuuccuuuucuucuaaacagcaguuc

SEQ ID NO: 22051 - RNA, 46 nt, Mus musculus
auuuauauauauauguauauauauaaauaaauaauauuuuugagau

SEQ ID NO: 22052 - RNA, 45 nt, Mus musculus
cgcuugcacacgcgcuagauugggcgcguuaccugaaaccugagu

SEQ ID NO: 22053 - RNA, 63 nt, Mus musculus
ucuucgaaguagagaggggugucauauucacuggggagggucugaauguauggcugccagaaa

SEQ ID NO: 22054 - RNA, 45 nt, Mus musculus
agucaugcagaauacucagagaaaagcuagaagcugggcagagau

SEQ ID NO: 22055 - RNA, 32 nt, Mus musculus
guugucuuauauguuuuuaaaagaagugaggc

SEQ ID NO: 22056 - RNA, 46 nt, Mus musculus
ugcacucacagcacacaguguaccuagaaggauaagcauaucagaa

SEQ ID NO: 22057 - RNA, 42 nt, Mus musculus
gaacaguguacucacagcacaguuugaacagagcacccagcc

SEQ ID NO: 22058 - RNA, 46 nt, Mus musculus
agcagcaaaagucccacugcccuuuccuugacuucagcacagagca

SEQ ID NO: 22059 - RNA, 46 nt, Mus musculus
uggagaugauccacaguauccaaaacagccaggacaugaggcagau

SEQ ID NO: 22060 - RNA, 45 nt, Mus musculus
agccccaggaaccgggagguucugaagaguaagccgggaagagau

SEQ ID NO: 22061 - RNA, 46 nt, Mus musculus
aauuaaauuacauugucaaaaaguaugucaaaucacgccccccccc

SEQ ID NO: 22062 - RNA, 46 nt, Mus musculus
uuuccuuuccuuuccuuucccuuuccuuucccuuuccuuucccuuu

SEQ ID NO: 22063 - RNA, 46 nt, Mus musculus
uucugcccuguggucugagcaccggaacugccugaugaacugugau

SEQ ID NO: 22064 - RNA, 45 nt, Mus musculus
gaagagguaggggugugugugugugugugugugugugugugugua

SEQ ID NO: 22065 - RNA, 42 nt, Mus musculus
uggcucuuuacacaucucccaaaaccgaucccgcccgcagug

SEQ ID NO: 22066 - RNA, 46 nt, Mus musculus
aaacauaagcgauuaaauuacguuacuuauuaacaguugcgcugaa

SEQ ID NO: 22067 - RNA, 46 nt, Mus musculus
gccucuguggacuuugaacaacccacucgggauggauuaggcagug

SEQ ID NO: 22068 - RNA, 67 nt, Mus musculus
ucggcgagcccacuugucagaaaacgaauuggaagcacuagagaaaaaugacacggagcaaaugaag

SEQ ID NO: 22069 - RNA, 58 nt, Mus musculus
aagcccaccucgagggcugguggcagccuauaguggggagagugacagugaggagaaa

SEQ ID NO: 22070 - RNA, 62 nt, Mus musculus
aacuucaaaaacagcuuccagccuauuagugcucuacgagaugaugaaaggcgggaaucggc

SEQ ID NO: 22071 - RNA, 46 nt, Mus musculus
ggacaugagggcaucaucaaaggagggaaaagagaagaaagagaag

SEQ ID NO: 22072 - RNA, 46 nt, Mus musculus
augaucccaauuaccaguauuacuacaaugcucagagucagcagua

SEQ ID NO: 22073 - RNA, 41 nt, Mus musculus
cucacaagcccugucacagggcucagagccaagcuccgaga

SEQ ID NO: 22074 - RNA, 46 nt, Mus musculus
cacgagaguauggcagacaggagggcaagcaugaguaugacgacuc

SEQ ID NO: 22075 - RNA, 46 nt, Mus musculus
ucauuuucuucauaagaagaaagcggugacaucuagauggcccugu

SEQ ID NO: 22076 - RNA, 46 nt, Mus musculus
cagcagcauucacaaacuggaagaccuuguccaggaguccauggua

SEQ ID NO: 22077 - RNA, 46 nt, Mus musculus
gagcuccugcaguaccggagugugguggcagggcugauggggcgag

SEQ ID NO: 22078 - RNA, 46 nt, Mus musculus
ugaagagugucgucuccuggcacuaucuagucaaugaaaucgacag

SEQ ID NO: 22079 - RNA, 47 nt, Mus musculus
gauagccaggaaucccagauauucucaggcucggauauaagucaacu

SEQ ID NO: 22080 - RNA, 46 nt, Mus musculus
aagagaugauuuacaugaaagcaugcucaggaucacggagcaggag

SEQ ID NO: 22081 - RNA, 61 nt, Mus musculus
gcccuugucaaacucuacgaaaccaaacugugugaagaggaagcaguuauagcagacaaga

SEQ ID NO: 22082 - RNA, 46 nt, Mus musculus
gccacccucuaauccuucccaaacagucccaccaacuggaaccaag

SEQ ID NO: 22083 - RNA, 59 nt, Mus musculus
guccauugauucauguauuucagcaauggcgaucagaaguagaugagaagagagaggug

SEQ ID NO: 22084 - RNA, 46 nt, Mus musculus
uuugacuggcacaaagaaaaggcagaccagcuugucgaaagguggc

SEQ ID NO: 22085 - RNA, 63 nt, Mus musculus
gacuccuaccacccucucgaugacuggauccagcacauugaaacgacccagagaaaaauucag

SEQ ID NO: 22086 - RNA, 46 nt, Mus musculus
gaugcuggugucugaaauagaggugaagcagagcaaaauggacgag

SEQ ID NO: 22087 - RNA, 42 nt, Mus musculus
uugcaaacaaugaccuacagggcuaugguggagucccagcag

SEQ ID NO: 22088 - RNA, 48 nt, Mus musculus
cucuuaugacgcaguauauuaaauuugcuggugauucguugaaaaggc

SEQ ID NO: 22089 - RNA, 48 nt, Mus musculus
aaggguauuugcagcuuugauccugaacuuagaauugugcugagaaac

SEQ ID NO: 22090 - RNA, 47 nt, Mus musculus
aaacaagcaaaagauauguaacuaacuggaguuuuagaccccuagug

SEQ ID NO: 22091 - RNA, 46 nt, Mus musculus
guuauugaucccucugcagagagcugagagaccuuucagggagcug

SEQ ID NO: 22092 - RNA, 46 nt, Mus musculus
aaaaucuaguuaguuagauaacauagacuuauuaauaaaccaccaa

SEQ ID NO: 22093 - RNA, 46 nt, Mus musculus
agauuuuauuuuauuuuugcugagguaaacaaauucugacuaagag

SEQ ID NO: 22094 - RNA, 46 nt, Mus musculus
gcuucggcuucagaauauuucacaccgaaagaaaugaaacagguag

SEQ ID NO: 22095 - RNA, 53 nt, Mus musculus
accaguccacgguagaagccgucaacaaagcaggaaaugaucucaucgagucg

SEQ ID NO: 22096 - RNA, 51 nt, Mus musculus
aagcaaccuccaguacaagcucagaauucucaaucagcgcuggcaggauau

SEQ ID NO: 22097 - RNA, 45 nt, Mus musculus
gguggugcaccuccauccucacuauguuuauggacuuggggaaaa

SEQ ID NO: 22098 - RNA, 27 nt, Mus musculus
gcucugacaagggaccugucuucuuca

SEQ ID NO: 22099 - RNA, 46 nt, Mus musculus
caaaaggcaaugaugccugaagcaaaaggcagucaauggggcagau

SEQ ID NO: 22100 - RNA, 41 nt, Mus musculus
cuuugcuacagcccaugucccugaggccauuuaucaggaga

SEQ ID NO: 22101 - RNA, 46 nt, Mus musculus
agcuguauaaauguugaguauuuugccuuuuuccauuuuuaaggcu

SEQ ID NO: 22102 - RNA, 42 nt, Mus musculus
auggggagugguaauacaaaguucuugccucgaagucugcau

SEQ ID NO: 22103 - RNA, 46 nt, Mus musculus
agcccuuucgucuauauauagaugaaagcaaaggcauagcuaaaga

SEQ ID NO: 22104 - RNA, 46 nt, Mus musculus
uuagcuaugccuuugcuuucaucuauauauagacgaaagggcuugg

SEQ ID NO: 22105 - RNA, 46 nt, Mus musculus
gagguucuggacuagucuauaguccuuugaguugugcuucuugaug

SEQ ID NO: 22106 - RNA, 46 nt, Mus musculus
uaagaaacuaauggauuuccccuccacuuuaaggguuacucugggc

SEQ ID NO: 22107 - RNA, 45 nt, Mus musculus
gcuuacagaauaucuaguuuuuauuuaguuuuaaaacauugccuc

SEQ ID NO: 22108 - RNA, 46 nt, Mus musculus
ucccuauuuugcuuuuguaucuaaggaacuucaugucucccgccug

SEQ ID NO: 22109 - RNA, 46 nt, Mus musculus
gcugguguucccaggugcccagcgcaugaaccgaggucggcaugag

SEQ ID NO: 22110 - RNA, 42 nt, Mus musculus
aguguauaugauucgccugggcacacuggagcaggaggccac

SEQ ID NO: 22111 - RNA, 42 nt, Mus musculus
cgguuggccuacugucugucaggacaaaccugaagcccacag

SEQ ID NO: 22112 - RNA, 44 nt, Mus musculus
agaacacaagagauucucucugcacccucccucuuucccaggag

SEQ ID NO: 22113 - RNA, 45 nt, Mus musculus
uucuucaggagucuccugugaggagaaaaguugaagcuuggagcc

SEQ ID NO: 22114 - RNA, 42 nt, Mus musculus
cuuccccaagggcggcauuuggucugugacgaagggcuccau

SEQ ID NO: 22115 - RNA, 46 nt, Mus musculus
cccagaaagcuacaacaucaagagacugaaaacaacagaaagcaag

SEQ ID NO: 22116 - RNA, 45 nt, Mus musculus
ucuacacguauagggauuguuagauucugugcauauauaccuuga

SEQ ID NO: 22117 - RNA, 45 nt, Mus musculus
guccuccugccccugucccacugaaugccucgggugcacugauga

SEQ ID NO: 22118 - RNA, 42 nt, Mus musculus
ggcugugcuguagaagcagacuguaacuguaggaucagccua

SEQ ID NO: 22119 - RNA, 45 nt, Mus musculus
uuggcuaugaggcaaaguccaagaaucacaccuuauuaugcgcag

SEQ ID NO: 22120 - RNA, 46 nt, Mus musculus
gagaagguaaguggggcuucaaaucccacaggaaacgcucggcagc

SEQ ID NO: 22121 - RNA, 42 nt, Mus musculus
ucacagugauggaaagguagcuaaggcucugaggagcccuga

SEQ ID NO: 22122 - RNA, 42 nt, Mus musculus
cugaguugcugaaagaugagcugagagcccagugcuaaagaa

SEQ ID NO: 22123 - RNA, 92 nt, Mus musculus
gagaaacggggugguguggauaaggcuggaagaaauggcagguaguggagaguguugggguguucgauggaagacaaaaacaugggccguuc

SEQ ID NO: 22124 - RNA, 58 nt, Mus musculus
ggacucuucuucucaccagagggagaaaugccggcagcaacugcaagaagcccagucc

SEQ ID NO: 22125 - RNA, 45 nt, Mus musculus
gacuaacugcuguuuucucugaucuuucgauacgacugcugauga

SEQ ID NO: 22126 - RNA, 46 nt, Mus musculus
aguuuuguaguccuccccccaacacuuguuuguuuagucagaagaa

SEQ ID NO: 22127 - RNA, 46 nt, Mus musculus
cugccgugcggaucgucccugaguggcaagacuacgaccaggagau

SEQ ID NO: 22128 - RNA, 42 nt, Mus musculus
gugugugugugugugugugagagagagagagagacuugucug

SEQ ID NO: 22129 - RNA, 45 nt, Mus musculus
caggaucccaacagucuuucaaaucuugaucaaguaagugaccgu

SEQ ID NO: 22130 - RNA, 50 nt, Mus musculus
uugaugguuugucuguaacaagugucuccucuccacucagugcgcuguau

SEQ ID NO: 22131 - RNA, 39 nt, Mus musculus
uuaauccaaaucaucucuucuugucuuuuagugguggcg

SEQ ID NO: 22132 - RNA, 46 nt, Mus musculus
uuuuuauuuugacuaguuugugucucugcuucccacugcacaaaga

SEQ ID NO: 22133 - RNA, 44 nt, Mus musculus
cccgcugguuguugacaaguuccucuuuguggaugcugaucagg

SEQ ID NO: 22134 - RNA, 45 nt, Mus musculus
ggaagcaggacggaucauugcuugacauuguugaugugguuaaga

SEQ ID NO: 22135 - RNA, 48 nt, Mus musculus
agguucagaagaaggcagacauggcuaaugaagacuugcugagugaug

SEQ ID NO: 22136 - RNA, 45 nt, Mus musculus
agcucuggcuugggcgcuuucauacccacaauucauagaguuagu

SEQ ID NO: 22137 - RNA, 47 nt, Mus musculus
gcaaacgacguuguugucauccucaauaacuucaagagcaagaucau

SEQ ID NO: 22138 - RNA, 46 nt, Mus musculus
gaacacuucuuuguccuguaaagguguuucuuucagacugugagga

SEQ ID NO: 22139 - RNA, 33 nt, Mus musculus
agcggcuccagggaugggccugagugugcagac

SEQ ID NO: 22140 - RNA, 42 nt, Mus musculus
cuguguagucugacugucgguccuggucccugggcugcaguu

SEQ ID NO: 22141 - RNA, 49 nt, Mus musculus
gauaaagccaagcuucucagaagaguaagugugggagaaguuguagggg

SEQ ID NO: 22142 - RNA, 46 nt, Mus musculus
ggauauuuucagcucaaagccaauccgggagccuggauucugagac

SEQ ID NO: 22143 - RNA, 46 nt, Mus musculus
agaaggucauuguuacgacaucaccacaggccagcccccucgagga

SEQ ID NO: 22144 - RNA, 26 nt, Mus musculus
ucgguggcagccagugcuuucccccu

SEQ ID NO: 22145 - RNA, 45 nt, Mus musculus
gccacagucuccgcuguuuacuuugaaucugaacacaccugagag

SEQ ID NO: 22146 - RNA, 46 nt, Mus musculus
cugucugucugucugugaguacacaugucacaguauguggguagag

SEQ ID NO: 22147 - RNA, 46 nt, Mus musculus
uuguggugcaagaauguacuagguacuugggaggcugaggcaagag

SEQ ID NO: 22148 - RNA, 42 nt, Mus musculus
uuaggcugaugcuauucagcaaugguuagaaaaucugcagau

SEQ ID NO: 22149 - RNA, 45 nt, Mus musculus
acacacacacacacacacaucuauuuauguaccuaccuuuggguc

SEQ ID NO: 22150 - RNA, 44 nt, Mus musculus
cucuguauuuauuaagcaacacagaaaguauugcaugggaaaga

SEQ ID NO: 22151 - RNA, 46 nt, Mus musculus
aucgggacagaaaauaaagucucauauccaacagcuucgaguagaa

SEQ ID NO: 22152 - RNA, 45 nt, Mus musculus
uuuugucucaugcccuguacugcagggauguucugaagcugaaga

SEQ ID NO: 22153 - RNA, 45 nt, Mus musculus
guaacaauguuaggauaaguaugaucaacaaucccagccaagaga

SEQ ID NO: 22154 - RNA, 46 nt, Mus musculus
auuuaugggaaaagacauauacaugguacggugcauauauggagau

SEQ ID NO: 22155 - RNA, 65 nt, Mus musculus
aauggaaugcccuuugaaaaggagcaguuagacccggaugagcuggaaaccaucacaaugcacaa

SEQ ID NO: 22156 - RNA, 45 nt, Mus musculus
aguggagcacguggucagugucuuggagaagaaguacccguacgu

SEQ ID NO: 22157 - RNA, 42 nt, Mus musculus
guuccaggcgagccagggcuucauggugagacacugucauga

SEQ ID NO: 22158 - RNA, 46 nt, Mus musculus
cucaggaaguggauggcuaucacgccuuccagacucucacacaggu

SEQ ID NO: 22159 - RNA, 93 nt, Mus musculus
cugcuccccucugcaggauugguuuuaucuuuguggucaaugacucugaagauguugaugggaugcaagaugcuggagucgcuguucugagag

SEQ ID NO: 22160 - RNA, 45 nt, Mus musculus
aaaucccagcaaccacaugguggcucacaaccaucuguagagcua

SEQ ID NO: 22161 - RNA, 31 nt, Mus musculus
aauccugaguuugagaccagccuggacuuua

SEQ ID NO: 22162 - RNA, 46 nt, Mus musculus
acaguacacaguggacacuaacuaaacuuuuguguuguacugaggg

SEQ ID NO: 22163 - RNA, 45 nt, Mus musculus
uacaggaguuacuccgccccacguuuccuggugucauacggcaga

SEQ ID NO: 22164 - RNA, 46 nt, Mus musculus
augaacccuuccccacuggucacuaauuaagaaaaugccuacagcu

SEQ ID NO: 22165 - RNA, 32 nt, Mus musculus
ugaucucgaugucaucgguaaaaagaacgugg

SEQ ID NO: 22166 - RNA, 45 nt, Mus musculus
agcaauaacgaaaacggcugugagcgcgcagcuuagagcggaagu

SEQ ID NO: 22167 - RNA, 42 nt, Mus musculus
uaucugagcagcaaaugucacaucaggaguagggccacacag

SEQ ID NO: 22168 - RNA, 54 nt, Mus musculus
ucaccaccagagauaaugccccagaagcagccaagauucgggcagcagucugga

SEQ ID NO: 22169 - RNA, 35 nt, Mus musculus
ucauugugcaucuauagaauguuaaaggcacggaa

SEQ ID NO: 22170 - RNA, 46 nt, Mus musculus
gacacagucgucuagcuuggcauccagggccucuuagaacuuagug

SEQ ID NO: 22171 - RNA, 46 nt, Mus musculus
gaguaggggaauccccuccugcuuuggguuaguguagucuggaguc

SEQ ID NO: 22172 - RNA, 26 nt, Mus musculus
accccgccuuggaaggacagcugaaa

SEQ ID NO: 22173 - RNA, 46 nt, Mus musculus
cagaagauuauuuuaaugauggaauuuguuucauaauuacacagau

SEQ ID NO: 22174 - RNA, 44 nt, Mus musculus
gaagugccagggucagggauacaggggagccccacccacucaga

SEQ ID NO: 22175 - RNA, 44 nt, Mus musculus
ucacccaugucuuugaucugcgucuaggaagcagcagcaggcag

SEQ ID NO: 22176 - RNA, 42 nt, Mus musculus
guggaacuggcgaucaagagcacggaguacaaggccaaggau

SEQ ID NO: 22177 - RNA, 45 nt, Mus musculus
caggcugcuucaugaccaggaagaauuuuucuuagcaggccuuca

SEQ ID NO: 22178 - RNA, 46 nt, Mus musculus
aucucuuucauuggcauggccucccuggggguauuuggccagaggu

SEQ ID NO: 22179 - RNA, 46 nt, Mus musculus
uguuggcucuuucuccauccuuucuuagaguaagaaacugcuaugg

SEQ ID NO: 22180 - RNA, 46 nt, Mus musculus
ugacugggguggaggggaagcaaauucaaacauuugccucagaguc

SEQ ID NO: 22181 - RNA, 66 nt, Mus musculus
ccugggcugccuugccgucugucacaggagacuuuaaauguuuuaauagaaucagggcaaaaagac

SEQ ID NO: 22182 - RNA, 60 nt, Mus musculus
cucugggggcaggagaugcaccagauucuaaugcacucaugaccgugucuguucccaaug

SEQ ID NO: 22183 - RNA, 78 nt, Mus musculus
guccaguggucauccuuuauucugagauuggccaugaagaauuuucuaauauucaccaccaacuuauaucaaaaagca

SEQ ID NO: 22184 - RNA, 46 nt, Mus musculus
caggagccuguaggggacauuuuccauucagaccaccacaguagau

SEQ ID NO: 22185 - RNA, 45 nt, Mus musculus
aacagggagcugaggaucaugccucauucucacacagggagcaga

SEQ ID NO: 22186 - RNA, 24 nt, Mus musculus
ccuuauaucaggguauagugcccu

SEQ ID NO: 22187 - RNA, 45 nt, Mus musculus
aguaaacucuuuugacuccagugacccaucuuuccagcccacaga

SEQ ID NO: 22188 - RNA, 45 nt, Mus musculus
gccuguuuuccuuagcagaagccaauucaaaagccauuaccaccu

SEQ ID NO: 22189 - RNA, 46 nt, Mus musculus
auuuauuuuauuuauaugauuacacuguaccugcuuucagacagac

SEQ ID NO: 22190 - RNA, 46 nt, Mus musculus
uucuuaaucccuucaugaaugagccagugucuaucccauuguuagu

SEQ ID NO: 22191 - RNA, 45 nt, Mus musculus
agaagccaccaugucaguggcuucccucuguuucuugcccugccc

SEQ ID NO: 22192 - RNA, 45 nt, Mus musculus
ggauuggguguuuccuguuauuuuucuuugcuauacaccacacac

SEQ ID NO: 22193 - RNA, 81 nt, Mus musculus
ucuccccggacccaaaauuuuauuaaaagagguaaaacaauacuuuguaaaguagcaggguaucuuagugugcauuuaacu

SEQ ID NO: 22194 - RNA, 45 nt, Mus musculus
ucuauaucaagaggugggagagagaauaugaauuuguuauguaga

SEQ ID NO: 22195 - RNA, 49 nt, Mus musculus
uacccacagagccaucuugcuaaaacuuucuuuuuugcuuucuugaggg

SEQ ID NO: 22196 - RNA, 44 nt, Mus musculus
gagacauuuuacaaagcuaguuaacacuacaaaacuggagcaga

SEQ ID NO: 22197 - RNA, 46 nt, Mus musculus
guauaaaguucuuuauuuccuaguaauaccuuguacacugccaaac

SEQ ID NO: 22198 - RNA, 46 nt, Mus musculus
gcgcggcccgggcaugugcagccggggggaugcgaacacugcggau

SEQ ID NO: 22199 - RNA, 45 nt, Mus musculus
gaaggagcaggggaucugaagcgugugaccgucaaaccaucagca

SEQ ID NO: 22200 - RNA, 28 nt, Mus musculus
gcccucgguccacuaaacacccccaguc

SEQ ID NO: 22201 - RNA, 42 nt, Mus musculus
ccuggguagccgccgagggcgcaggcugcccggagggcggac

SEQ ID NO: 22202 - RNA, 46 nt, Mus musculus
acaaaugguugugaggcaccguaugggugcuggcaacaaaacccag

SEQ ID NO: 22203 - RNA, 44 nt, Mus musculus
aauguggaccccuaggggacagguggcacauacauucaguccca

SEQ ID NO: 22204 - RNA, 44 nt, Mus musculus
uuccugggagaugguauuuguuagcgcccagcaaauuagccuuu

SEQ ID NO: 22205 - RNA, 46 nt, Mus musculus
cuauacagagaaacucugucuugggagaaaaaaaaaguguucgcag

SEQ ID NO: 22206 - RNA, 45 nt, Mus musculus
gccuggccgcacaccauuaucuguaccagcgcagccagccaguag

SEQ ID NO: 22207 - RNA, 46 nt, Mus musculus
ugaugggagagauaaccuguccaccucuguugucuucccagggcag

SEQ ID NO: 22208 - RNA, 45 nt, Mus musculus
ccgacacugcgggcagcuucccaggcuggggugcgcuucucucac

SEQ ID NO: 22209 - RNA, 45 nt, Mus musculus
gcaccccauagguaccauggcucaugcauguaaucucagcacccc

SEQ ID NO: 22210 - RNA, 42 nt, Mus musculus
gggccguggcgccugcuguaccugucuugugcucuugcccug

SEQ ID NO: 22211 - RNA, 61 nt, Mus musculus
gcggauuucuggaaccauucuuaaaagaauaugggcccuugugagacuuggaagcuaagag

SEQ ID NO: 22212 - RNA, 56 nt, Mus musculus
aacagugguacgcuugcugaaaaaaauauuauaacagaauguacucugagaacaaa

SEQ ID NO: 22213 - RNA, 46 nt, Mus musculus
caggugccaugacguuuaccuuaaaaaagaaccugccuggccuugg

SEQ ID NO: 22214 - RNA, 46 nt, Mus musculus
ucuguauuccuuuccaugugucugugcaucuccaccccacccccau

SEQ ID NO: 22215 - RNA, 46 nt, Mus musculus
aaggacauuaaccguuugcuaggugacaaguuuucacuguggaaga

SEQ ID NO: 22216 - RNA, 42 nt, Mus musculus
gguaaauuggucuguggcacagugacauaaaccaaagagguc

SEQ ID NO: 22217 - RNA, 30 nt, Mus musculus
ucaucauaaaggagaaagaugccagccagu

SEQ ID NO: 22218 - RNA, 26 nt, Mus musculus
ucaggagcuugaggcgacaggacagg

SEQ ID NO: 22219 - RNA, 45 nt, Mus musculus
uaaaaacaaguauuuuucaggcaacuguguuaaauuacuguucag

SEQ ID NO: 22220 - RNA, 45 nt, Mus musculus
uuuauuugcuaaaggaaagccauuuaaucaggauucagacccaaa

SEQ ID NO: 22221 - RNA, 65 nt, Mus musculus
uuagcaaauaaagaccauuaaccccuuccuguccagggcacggagggcacgaggagggaguagca

SEQ ID NO: 22222 - RNA, 46 nt, Mus musculus
ccugaggggagcuccuggcugucccucccuucagccuacuccagag

SEQ ID NO: 22223 - RNA, 42 nt, Mus musculus
caaauggagcaugugagucuggucucagagcuucaaggccag

SEQ ID NO: 22224 - RNA, 46 nt, Mus musculus
gcaaaaccuucuaaugcccgaggaggguggacauacugggagagag

SEQ ID NO: 22225 - RNA, 42 nt, Mus musculus
ucuaugagggcuuugccaugccacacuccaucaugcggguug

SEQ ID NO: 22226 - RNA, 46 nt, Mus musculus
ccuguucuucuaacggaggccccacugaaccccaguaagaaccggg

SEQ ID NO: 22227 - RNA, 46 nt, Mus musculus
aaucccguaccacaccguguuccaugggguaucggauggucagcag

SEQ ID NO: 22228 - RNA, 23 nt, Mus musculus
ucuguaaacuacuuccugcugau

SEQ ID NO: 22229 - RNA, 42 nt, Mus musculus
uggagcuucagugguguucauggcucauuaugccagcugcug

SEQ ID NO: 22230 - RNA, 42 nt, Mus musculus
caagccuaaauagucuuggguuuuuuuuaagggguggaggau

SEQ ID NO: 22231 - RNA, 41 nt, Mus musculus
caaccaacuuucugauuagacuuacauggccggcuccacag

SEQ ID NO: 22232 - RNA, 46 nt, Mus musculus
cccuauacuggcacccucagagucugauucaaugugcaguccccag

SEQ ID NO: 22233 - RNA, 42 nt, Mus musculus
gucccuaaguugaguuugucagucauagaucuagcuggugau

SEQ ID NO: 22234 - RNA, 42 nt, Mus musculus
ccagggagugccaaugguaacagggugguucugucccaaaga

SEQ ID NO: 22235 - RNA, 46 nt, Mus musculus
aggucucuggcuuccucccuguccagccuugguagaacugccagcu

SEQ ID NO: 22236 - RNA, 46 nt, Mus musculus
ugguuccccuccauggacccaguauguggucucugucugcugguga

SEQ ID NO: 22237 - RNA, 46 nt, Mus musculus
gcuuccagcagggacagggacugccucuccucuuacuacccaagaa

SEQ ID NO: 22238 - RNA, 45 nt, Mus musculus
auguuauuuuggcccuaauagagacugguaggcaaagggugugag

SEQ ID NO: 22239 - RNA, 44 nt, Mus musculus
ucagagaggcuaguccuggacuuugggggugugcuuggggcagg

SEQ ID NO: 22240 - RNA, 42 nt, Mus musculus
uucccacgugagccccugauggcaucuuuguggcugccuuuu

SEQ ID NO: 22241 - RNA, 46 nt, Mus musculus
gcugucuuggcuuaaaagcagauuacagaaauguaagccagcguaa

SEQ ID NO: 22242 - RNA, 46 nt, Mus musculus
uaccaaguuugguuuuuaauaauuucacaauauuaugcgccaagau

SEQ ID NO: 22243 - RNA, 46 nt, Mus musculus
aaaaaacgaagugggggccccucaucuagaucaugauaugccaguu

SEQ ID NO: 22244 - RNA, 48 nt, Mus musculus
cagcuccaucugguccagcaacaucaacagcaaccuuccuuucuccac

SEQ ID NO: 22245 - RNA, 42 nt, Mus musculus
cgcgcauggccaguggauagugcugugaagauggggccauag

SEQ ID NO: 22246 - RNA, 42 nt, Mus musculus
ucagucgucccagagaaguuggaaugaguucaacagcggccc

SEQ ID NO: 22247 - RNA, 88 nt, Mus musculus
uguuagggacacuuaguacaggagacauggcugccaucugagcagaggguaucuuuuucaaugcaacagcuggugauagguuauaugg

SEQ ID NO: 22248 - RNA, 46 nt, Mus musculus
gguaccucccucagucuccuuccucaauuucccagaaaccccucau

SEQ ID NO: 22249 - RNA, 46 nt, Mus musculus
cucugcaaacccucaaugcagacauuuucuuaaaacaacgccagac

SEQ ID NO: 22250 - RNA, 98 nt, Mus musculus
uggcaggcuaaagcaaugauaaagguuaucggugccacuggggguguaggagaaaaaaggugaccugaccauggagaauggagccgugggcuucagga

SEQ ID NO: 22251 - RNA, 47 nt, Mus musculus
cuccuccaccagaaugggaugcugugccaguucacaagcccagcagc

SEQ ID NO: 22252 - RNA, 46 nt, Mus musculus
guacaaauaaguuaguggaaaacaggccaguugcccucucaaaguu

SEQ ID NO: 22253 - RNA, 46 nt, Mus musculus
gaacuaccguacacucccucacuggaaaauaaacagcguagaaauc

SEQ ID NO: 22254 - RNA, 41 nt, Mus musculus
agagaccuccaaccccgacacagagccacuccucagggagg

SEQ ID NO: 22255 - RNA, 45 nt, Mus musculus
cuccuccccccuagacguguuuacagagcagccuccgucaccgau

SEQ ID NO: 22256 - RNA, 51 nt, Mus musculus
agaggggcaaagcagggccagcacagcagccagcaccacagccacagccac

SEQ ID NO: 22257 - RNA, 65 nt, Mus musculus
gcagcugccucacagucuacaagcaaaaccagcccccuagucucagagacagcugcagcaaccca

SEQ ID NO: 22258 - RNA, 46 nt, Mus musculus
uuaucuuuacucggaauuuuuuaaaaaacgauucuggugcucagau

SEQ ID NO: 22259 - RNA, 63 nt, Mus musculus
uagaaaccauugagaucaguggauaugcgugugagggauaugguuuuaaagugguuaacuguc

SEQ ID NO: 22260 - RNA, 69 nt, Mus musculus
uaagagaaccaaauuucacauugaaaagaacauucaaaguagagaauacgggacaacuugaaauccgug

SEQ ID NO: 22261 - RNA, 44 nt, Mus musculus
uacgcuucaaaaucacagaagcauuguuaaaggauugcauagac

SEQ ID NO: 22262 - RNA, 45 nt, Mus musculus
aaauacagaucuucagaaaaauaucguaucaaaagucagugccga

SEQ ID NO: 22263 - RNA, 46 nt, Mus musculus
aaaguacagccugggguggccaugcaggaggacuugugggaugccg

SEQ ID NO: 22264 - RNA, 45 nt, Mus musculus
auguaagucuuccaucccgccuuccuuuacucuccugccucggua

SEQ ID NO: 22265 - RNA, 61 nt, Mus musculus
acagcaaauaaggucuuugucagaagacguacgauucuacuacaaacgauuacgggguaau

SEQ ID NO: 22266 - RNA, 55 nt, Mus musculus
aaauaguucaucagagcuuaaauauuaugaauuccuucucacagaaggugaagau

SEQ ID NO: 22267 - RNA, 46 nt, Mus musculus
ugagaucugucgcccucuucuggagugucugaagacagcuacagug

SEQ ID NO: 22268 - RNA, 48 nt, Mus musculus
cuagaagggguccaugauggggccauacagaucacaaccgacuacgag

SEQ ID NO: 22269 - RNA, 28 nt, Mus musculus
aguagaugaugagggcacagaagaauug

SEQ ID NO: 22270 - RNA, 46 nt, Mus musculus
ucggcaaguacugugaccuguuucccgguggccaugagcgcuagac

SEQ ID NO: 22271 - RNA, 46 nt, Mus musculus
ccccccaaaauagaagaacgcuucauagauuuuggaguacugagug

SEQ ID NO: 22272 - RNA, 46 nt, Mus musculus
ccagagaacuccaaaacuaaggguugcuauucuucaguguccagug

SEQ ID NO: 22273 - RNA, 45 nt, Mus musculus
aaacaguauguacaaucaggaaaccuaagcagauguguuaggguc

SEQ ID NO: 22274 - RNA, 50 nt, Mus musculus
guuacguuaaaagcuucugaaaguaaauauaccaagguugccagcauuag

SEQ ID NO: 22275 - RNA, 42 nt, Mus musculus
uuuucauauucuucucacuucuguuguggcuucaagggacuc

SEQ ID NO: 22276 - RNA, 45 nt, Mus musculus
ucaucagucagugcucuuaaccacugagccaucucuccagcccug

SEQ ID NO: 22277 - RNA, 48 nt, Mus musculus
ggugagaaaauagggugagguaacuugaaucuucagguagaaaacgga

SEQ ID NO: 22278 - RNA, 46 nt, Mus musculus
caccauggccaaggcaacuuauaaaagaaagcauuuaauuuggggg

SEQ ID NO: 22279 - RNA, 46 nt, Mus musculus
uuccucaacugaaauguuagauuuuggaacacuuagaacacaaggu

SEQ ID NO: 22280 - RNA, 42 nt, Mus musculus
acuaucucacagcaauauggcaacacaggaaaaugcccagag

SEQ ID NO: 22281 - RNA, 42 nt, Mus musculus
ggccauuucuuggggccagaguccccguaaacagcagcuuuu

SEQ ID NO: 22282 - RNA, 45 nt, Mus musculus
ucccugcuaucucuuaaagucuuucccuccccucuuugcugaaga

SEQ ID NO: 22283 - RNA, 45 nt, Mus musculus
acagccaaggcuacacagagaaacccugucucaaaaacccaaaca

SEQ ID NO: 22284 - RNA, 46 nt, Mus musculus
caucucucauuuguuaauuuagauuuugucucucuuuugauuagau

SEQ ID NO: 22285 - RNA, 44 nt, Mus musculus
caucuuuccuucucaaagacuguggggaggggugagccguugag

SEQ ID NO: 22286 - RNA, 46 nt, Mus musculus
aaauuuugacugaugaugucaguuguuggaugugaaguugguauuc

SEQ ID NO: 22287 - RNA, 48 nt, Mus musculus
ucuugugucuuuucccucucccgcugcuguaucugcccaagcugaccu

SEQ ID NO: 22288 - RNA, 45 nt, Mus musculus
uuggaaugccaaaaauggaaaaagucuacuuacauaacccuaguu

SEQ ID NO: 22289 - RNA, 44 nt, Mus musculus
cuggacuaaauaaagacccugcgucaaagcugggaugggguggg

SEQ ID NO: 22290 - RNA, 46 nt, Mus musculus
uagaaugaggagcaaaaguguuggacauuugcaguaggagaggaac

SEQ ID NO: 22291 - RNA, 46 nt, Mus musculus
uagcagcuaucuauuuuuuuaaugcguguauuugugugugugugug

SEQ ID NO: 22292 - RNA, 46 nt, Mus musculus
ggcuacuauacccagcaaaacucucaaacaccauagacggagaaaa

SEQ ID NO: 22293 - RNA, 46 nt, Mus musculus
uugcuuucugaaucauguauuucuuuaggaaagaauggccccucuu

SEQ ID NO: 22294 - RNA, 46 nt, Mus musculus
ucccagguacuauccaucuuguuuuaagacagucucugucauuggu

SEQ ID NO: 22295 - RNA, 60 nt, Mus musculus
auugauaauucagagcaaauaauugcugaagaaagugaaaaagcuaugacaacaucccag

SEQ ID NO: 22296 - RNA, 45 nt, Mus musculus
caguuagucuaggcugauggaccagcaagcccccugccaucuguc

SEQ ID NO: 22297 - RNA, 46 nt, Mus musculus
agagaaccgacucuccuuccccagcaacugucagaugccccuagcu

SEQ ID NO: 22298 - RNA, 46 nt, Mus musculus
aggagaacaaagggaccaaaaagcagucagaaaaaaacccgcaaaa

SEQ ID NO: 22299 - RNA, 45 nt, Mus musculus
gacuacuuuaaaaacaaagacauagcuaauacacaagucacagag

SEQ ID NO: 22300 - RNA, 46 nt, Mus musculus
uguaaaauaaacuuuaaaaaugaagacauuuccagacagagguaag

SEQ ID NO: 22301 - RNA, 46 nt, Mus musculus
ucacccguucagcaaauauuuauuagaauucuuauguauagcagac

SEQ ID NO: 22302 - RNA, 65 nt, Mus musculus
ugccccucuuuaggaucuuggaggauagcagagauacagaucugaaagacucuaucuagcacacu

SEQ ID NO: 22303 - RNA, 42 nt, Mus musculus
aaaacaaaacaaaacagacaacaacaguguggagggggaggg

SEQ ID NO: 22304 - RNA, 45 nt, Mus musculus
ugaauuuccuguucuuguucuuuguuuacauuucaguccccaccc

SEQ ID NO: 22305 - RNA, 42 nt, Mus musculus
cccugugaccuugcugaggaaguugagcuauugugagcugca

SEQ ID NO: 22306 - RNA, 83 nt, Mus musculus
gagcucacuagccagcuagucuuggcaaauuugcaagccccagauucagugagaagagacccuugucugaagagauaacaugc

SEQ ID NO: 22307 - RNA, 46 nt, Mus musculus
caugugaagauauguuacaugaugcugucguaggaaaggcugccgu

SEQ ID NO: 22308 - RNA, 45 nt, Mus musculus
uuccacugugcugcugaauaugaacuuauuguccccccaccccca

SEQ ID NO: 22309 - RNA, 46 nt, Mus musculus
uaagucugucugucauccauccucccucccucccucacucccuccc

SEQ ID NO: 22310 - RNA, 59 nt, Mus musculus
gagcugcgguuccagccuaggaaggggagaaaggacagugagugcuucucugccuucug

SEQ ID NO: 22311 - RNA, 56 nt, Mus musculus
gugucuaagaaauuugacugaggaagagccacucagaauguugauagcaccacccc

SEQ ID NO: 22312 - RNA, 46 nt, Mus musculus
ccuuucuugaagcaaaaucuugaacaaacagaacuuuuaagaagcu

SEQ ID NO: 22313 - RNA, 46 nt, Mus musculus
cuccauguuugcaagaaaacguacaggcacaucagaagucacagau

SEQ ID NO: 22314 - RNA, 75 nt, Mus musculus
uaccaaguggguuacucuuacaaaguuuuaagacaggacagaaauuacauaaaaaucuuuugcaaucuaaaagca

SEQ ID NO: 22315 - RNA, 80 nt, Mus musculus
augcucuuauacaaauaaaguaccuuuuuaaagaguaaagacacaaagcacaaucauaauuuucagaauucaagaccaag

SEQ ID NO: 22316 - RNA, 45 nt, Mus musculus
cucagcuugccaaaauagcuagagcuuauuaacaaugcugcagaa

SEQ ID NO: 22317 - RNA, 45 nt, Mus musculus
uauuuuaguuaacaaaccuaccaguugacaaauccaggcccacuu

SEQ ID NO: 22318 - RNA, 41 nt, Mus musculus
gguuucuucuaccuuguaguccauuauugaaagaagucaga

SEQ ID NO: 22319 - RNA, 45 nt, Mus musculus
uacuuauagaaugauagucaaaccuugucccaagaguaggggguu

SEQ ID NO: 22320 - RNA, 42 nt, Mus musculus
agccaggcacagugacacacgcuugugaucccagcaccagag

SEQ ID NO: 22321 - RNA, 41 nt, Mus musculus
ucaacuaaacuaguguggccuuuucucuagugacgggggau

SEQ ID NO: 22322 - RNA, 45 nt, Mus musculus
aaaucccagcaaccacaugguggcucacagccauccuuaaugaaa

SEQ ID NO: 22323 - RNA, 46 nt, Mus musculus
uuuacaaagguuuguguguuuguguagaauacacaggcuaggagua

SEQ ID NO: 22324 - RNA, 42 nt, Mus musculus
cacacauucacauggugcacagacauaaccugugagcaagac

SEQ ID NO: 22325 - RNA, 46 nt, Mus musculus
uguucucuuuggccauuuguagaacuccuuuuguuuucagucagau

SEQ ID NO: 22326 - RNA, 41 nt, Mus musculus
aaaaaaaaaaaaaaaacaaaaacaaaacaaaaaaagagcug

SEQ ID NO: 22327 - RNA, 31 nt, Mus musculus
uuuuaauugagaaaggaaacgaggucuuuga

SEQ ID NO: 22328 - RNA, 42 nt, Mus musculus
uccccuggaacugaaauaacagaaaguugugagccgccacau

SEQ ID NO: 22329 - RNA, 45 nt, Mus musculus
aaaagauagccacaggaaacagugguggaaggcauugcugcagga

SEQ ID NO: 22330 - RNA, 42 nt, Mus musculus
aagauaggcauuuaagugucugccuuaagagaagggggaggu

SEQ ID NO: 22331 - RNA, 41 nt, Mus musculus
aguccacaggaggagagguggaccacaccagccgcccggga

SEQ ID NO: 22332 - RNA, 46 nt, Mus musculus
ucugccuaaauucauugucugcugaauaggucagagguucucagau

SEQ ID NO: 22333 - RNA, 26 nt, Mus musculus
ugguagcuauucaggucuccugaguc

SEQ ID NO: 22334 - RNA, 46 nt, Mus musculus
uguuugugcaggcauuugugcaugugucgaguucugcauuggagua

SEQ ID NO: 22335 - RNA, 50 nt, Mus musculus
acauaguaaggacugacaggguuuucuugguugaauaaugaugguaaagg

SEQ ID NO: 22336 - RNA, 46 nt, Mus musculus
auacuacauuuguggcaaagaaugcacuagcuaaaagcugccucug

SEQ ID NO: 22337 - RNA, 43 nt, Mus musculus
acaccccaccaacaacaacaacacaaacaaaaauggggagaaa

SEQ ID NO: 22338 - RNA, 45 nt, Mus musculus
cuucuucacguguacccgaggcaggcucugcaucauaggccagcu

SEQ ID NO: 22339 - RNA, 45 nt, Mus musculus
auuacagaugagucaccaugugguugcugggauuugaacucauga

SEQ ID NO: 22340 - RNA, 45 nt, Mus musculus
ugucagugcaccaguuaguugguuuugucauuuucuacgacgagg

SEQ ID NO: 22341 - RNA, 42 nt, Mus musculus
cguguguuuccauuaauugguaguuaaaggcaaggccaaguu

SEQ ID NO: 22342 - RNA, 46 nt, Mus musculus
uacucuaaauuuaccauuuacuuaccuaguacauaaagcuuggggc

SEQ ID NO: 22343 - RNA, 46 nt, Mus musculus
agagcagaaaguacucuuucccugcuccgcccucacaugcccagcu

SEQ ID NO: 22344 - RNA, 46 nt, Mus musculus
aaagggaccuuugauugcgcuugaauguuuguaaagacuuugagau

SEQ ID NO: 22345 - RNA, 46 nt, Mus musculus
agaaaaucaagacaauguagaagucccugucuccuaagggaaagcu

SEQ ID NO: 22346 - RNA, 46 nt, Mus musculus
uuguuuuuuuuguuuuuguuuuuguuuucaggaaguuuggucagac

SEQ ID NO: 22347 - RNA, 82 nt, Mus musculus
aacguucucaauaaauguucuacucucaaaacaugcugcuucuagaucaaauuccagucauguuuuuauuuugaauaaguag

SEQ ID NO: 22348 - RNA, 132 nt, Mus musculus
cuggcugaaucagacagcuuuugugguuaugcaguaucagggggaacaguuuguauggaccaaauaguuauuuaaguaagauauuaggaguaauuauauuaauauagaucauaugacuuagucucucauaag

SEQ ID NO: 22349 - RNA, 48 nt, Mus musculus
cucucuaauauucauaaauauauauaagggcugagccuguagaauagc

SEQ ID NO: 22350 - RNA, 46 nt, Mus musculus
uuauuuuucaauugucauuuuauacacuaauuuuggggguacaguu

SEQ ID NO: 22351 - RNA, 45 nt, Mus musculus
ucuaccuguuuaccucuccucagaggguuuauagaaacuuucacu

SEQ ID NO: 22352 - RNA, 42 nt, Mus musculus
gauuuguuugucuuuucuaaaacaugagaaaacuggcaagaa

SEQ ID NO: 22353 - RNA, 45 nt, Mus musculus
cugggcaaagggugaugauguaacaaguggcuucagaagguggag

SEQ ID NO: 22354 - RNA, 45 nt, Mus musculus
aaggccgggggcugauuuggcuuuugucccccauaguuugaucaa

SEQ ID NO: 22355 - RNA, 41 nt, Mus musculus
gaagggaugcccagaaugguguggugguaauagggugagga

SEQ ID NO: 22356 - RNA, 41 nt, Mus musculus
ccgagucagguuggugggaugcuugcugcagaggugagcag

SEQ ID NO: 22357 - RNA, 89 nt, Mus musculus
gcagugguuacacggacagacuugugagcaggagagcagugguuacacggacagacuugugagcaggagagcagugguuacacggacag

SEQ ID NO: 22358 - RNA, 105 nt, Mus musculus
acuugugagcaggagagcagugguuacacggacagacuugugagcaggagagcagugguuacacggacagacuugugagcaggagagcagugguuacacggacag

SEQ ID NO: 22359 - RNA, 89 nt, Mus musculus
acuugugagcaggagagcagugguuacacggacagacuugugagcaggagagcagugguuacacggacagacuugugagcaggagggca

SEQ ID NO: 22360 - RNA, 43 nt, Mus musculus
uacaaguacagagugaagugagcauccuagagaaacugucugg

SEQ ID NO: 22361 - RNA, 46 nt, Mus musculus
gagucgugcugcgacgcgcgugucucugagagucucacucguguag

SEQ ID NO: 22362 - RNA, 45 nt, Mus musculus
ugggaauucgaagaagagagacauuuguugauuucagagaacgcg

SEQ ID NO: 22363 - RNA, 47 nt, Mus musculus
uuuucaggaauguucacuccucguuauagauauauaccuugacccuu

SEQ ID NO: 22364 - RNA, 45 nt, Mus musculus
cugauguaaauuaguugguuuaggucugcugcauuugugguguga

SEQ ID NO: 22365 - RNA, 46 nt, Mus musculus
acaacugaaaagaagcuguacucccaggaucccuaacucggggaag

SEQ ID NO: 22366 - RNA, 41 nt, Mus musculus
uucacacagguuucaaccucgcagcaauuguuaagggcaga

SEQ ID NO: 22367 - RNA, 57 nt, Mus musculus
aucgcuugucaacggcgcucgcggccccggccccucgguucggugucucacagaccc

SEQ ID NO: 22368 - RNA, 60 nt, Mus musculus
ccuagguccaagccccagcaucacaaaaguaugguaagagaugauacagcuguuauagcc

SEQ ID NO: 22369 - RNA, 43 nt, Mus musculus
gccaagaagugggagaggaugaguaggggaaaaggguggaggg

SEQ ID NO: 22370 - RNA, 45 nt, Mus musculus
acacagggucccuaauggagaagcuagagaaagcacccaaggagc

SEQ ID NO: 22371 - RNA, 46 nt, Mus musculus
ugcuacuauaauuacuuuaccucugcauauggcaaaacuuccaaac

SEQ ID NO: 22372 - RNA, 46 nt, Mus musculus
gaauggugccaugugacuuuaauucuagcacuuggaaggcagaggc

SEQ ID NO: 22373 - RNA, 52 nt, Mus musculus
agccaccgugugguugcugggauuugaacuccggaccuucagaaagccacca

SEQ ID NO: 22374 - RNA, 46 nt, Mus musculus
uuuuuuagaaaguuuauuagaaucaucagcauccucacucccagaa

SEQ ID NO: 22375 - RNA, 41 nt, Mus musculus
aggaagagucaucguccucauucccacugucuacgguagga

SEQ ID NO: 22376 - RNA, 46 nt, Mus musculus
ucucucuucugucucuccuccuccucuuugagcuuagccaaagcuu

SEQ ID NO: 22377 - RNA, 42 nt, Mus musculus
ugagcuuggaggugucuaagggucacuucggcucuggcucug

SEQ ID NO: 22378 - RNA, 42 nt, Mus musculus
cagcagcaccauggagacagcaauagugucagccggccagau

SEQ ID NO: 22379 - RNA, 44 nt, Mus musculus
uuuucuuuggcaacgagucuuuugauggcacuucaacaccuaag

SEQ ID NO: 22380 - RNA, 46 nt, Mus musculus
uugguccacagcuuccacaggagcacuuauuuccaaaguuucagau

SEQ ID NO: 22381 - RNA, 46 nt, Mus musculus
uuccagaagugugacauuacgcuuggacauacaaaaagacaugauc

SEQ ID NO: 22382 - RNA, 46 nt, Mus musculus
aagaggaacauuuguggcaccaaucugcuguguaauaccaccugcu

SEQ ID NO: 22383 - RNA, 46 nt, Mus musculus
aaggagaaagucuuaaaaguaagcaauauaaaaaacacgcagagua

SEQ ID NO: 22384 - RNA, 46 nt, Mus musculus
ccccaucucagaaaaacuaacaauaaaacagcaaaagccaggagag

SEQ ID NO: 22385 - RNA, 46 nt, Mus musculus
ugcuggucaguagguaagugcuuaucuaaacacucaagccccgcau

SEQ ID NO: 22386 - RNA, 46 nt, Mus musculus
ccacauuaauuucuccacaccaccccaucuaccccacacccaagac

SEQ ID NO: 22387 - RNA, 43 nt, Mus musculus
gagccacguggaaagaagaaagaaccaguaaauggcugcaguu

SEQ ID NO: 22388 - RNA, 47 nt, Mus musculus
auacaauguucugaaugcaggggaggcuccuacaaacaagcacggag

SEQ ID NO: 22389 - RNA, 46 nt, Mus musculus
ggaucuuggcgaaucacuuacacagauacagagaagaggucuccag

SEQ ID NO: 22390 - RNA, 45 nt, Mus musculus
agcucaaaacagauccagggaagugguccaaagggcaagguugug

SEQ ID NO: 22391 - RNA, 46 nt, Mus musculus
agccagggcuacacagagaaacccugccuugaaaacaaggaggagg

SEQ ID NO: 22392 - RNA, 42 nt, Mus musculus
cacaagagagagagacagagagagagagagagagagaggcac

SEQ ID NO: 22393 - RNA, 45 nt, Mus musculus
cgcacacauacauacacacacauacauauacacacaaacgcacac

SEQ ID NO: 22394 - RNA, 45 nt, Mus musculus
ggcagguugcuuauuuagagggguguguuuaaauaacaugcagag

SEQ ID NO: 22395 - RNA, 45 nt, Mus musculus
gaguucuuuccgcuagauaggguggaacuucaguagaugggguag

SEQ ID NO: 22396 - RNA, 46 nt, Mus musculus
agaagcuuuuuaaaguuuucucuuauuuacugugaaauguacccug

SEQ ID NO: 22397 - RNA, 42 nt, Mus musculus
cagugccaugguguggagcacuaggguuucccuuugccccag

SEQ ID NO: 22398 - RNA, 46 nt, Mus musculus
aggccugagagggaagagcugaguuccaaccugagaucacacaagg

SEQ ID NO: 22399 - RNA, 46 nt, Mus musculus
gaguuuccuucaaaaguuucuuagaauauuuuuaugguggugguaa

SEQ ID NO: 22400 - RNA, 58 nt, Mus musculus
ugugaacaaugaacaagaaagucagucugugccucuguguaguuuaugagcccaacgu

SEQ ID NO: 22401 - RNA, 52 nt, Mus musculus
guagagauucuuugcgugagucauagcuaugugaggagaaauagauaguagg

SEQ ID NO: 22402 - RNA, 46 nt, Mus musculus
ggaauguguuuagaguaguauuugggaugauacccagagaauggag

SEQ ID NO: 22403 - RNA, 45 nt, Mus musculus
agcuguguagcaucagugugugucagugaauauaacgcucacuac

SEQ ID NO: 22404 - RNA, 67 nt, Mus musculus
acagugaauauagaccauuccuaaccuuuuccugaucuuacuagaaaaggauuccauagauauuaau

SEQ ID NO: 22405 - RNA, 72 nt, Mus musculus
uccaguuuucaaaguaugaaguucccuuuguuuuauuuuguuuuaauugggcauugucagcaucaaacccca

SEQ ID NO: 22406 - RNA, 45 nt, Mus musculus
gcugaaaauauuuucuguugcuugcuuacuguuacacaaaaucag

SEQ ID NO: 22407 - RNA, 47 nt, Mus musculus
guuuguuuuguuuuguuuauuuuauaaguccauuuucuuugccaggu

SEQ ID NO: 22408 - RNA, 44 nt, Mus musculus
aucagguuucucuuucuagaccaggcuggccuccaacucaaaga

SEQ ID NO: 22409 - RNA, 61 nt, Mus musculus
uuaugaagcaaagcugaaggaggaaggguuuaucuuagcuuguaguuuaagggcgcagugc

SEQ ID NO: 22410 - RNA, 53 nt, Mus musculus
auucuggggggaaggcauggcagaaggagagugggugucuggugcagcaggaa

SEQ ID NO: 22411 - RNA, 46 nt, Mus musculus
ccccuuuuccuuucuccgaguugaaaacaacuuggugugugugugu

SEQ ID NO: 22412 - RNA, 46 nt, Mus musculus
gucagaucuccugcacaucaaaugguuauguuacgauucacugcag

SEQ ID NO: 22413 - RNA, 42 nt, Mus musculus
agccauuucaagaucuuaacaaucuuauaaauuaugggccau

SEQ ID NO: 22414 - RNA, 46 nt, Mus musculus
gcuuuuagugaggguucuagguuuucuaggacuuaguggagacagg

SEQ ID NO: 22415 - RNA, 45 nt, Mus musculus
cauuuugguugcuagagcacaucuagcagagaaggaacaguguuu

SEQ ID NO: 22416 - RNA, 41 nt, Mus musculus
ugcacacccguccccguuuugaucgcgugcucuuucuugca

SEQ ID NO: 22417 - RNA, 41 nt, Mus musculus
ccuccaaaagcaugcaggacauguuuucuacucuaugcaga

SEQ ID NO: 22418 - RNA, 45 nt, Mus musculus
cucgguuaaccacaaacacugugccacuguacaaagcuaccgguc

SEQ ID NO: 22419 - RNA, 45 nt, Mus musculus
ugccuuggcuacucaaaggcugggcaguucuaauccuccacccag

SEQ ID NO: 22420 - RNA, 42 nt, Mus musculus
uuggcaucuuuauugaucgaucaaaaaccaguuggggacaag

SEQ ID NO: 22421 - RNA, 46 nt, Mus musculus
ugguuguguuacagacuguugagagagaagagggaaagggagagga

SEQ ID NO: 22422 - RNA, 49 nt, Mus musculus
gaaaugaacacggaggugcauggaagcaaguguaagugcuagagacagg

SEQ ID NO: 22423 - RNA, 42 nt, Mus musculus
ucgcuguuacuaauuguugucucauuugaugaucacaguaag

SEQ ID NO: 22424 - RNA, 45 nt, Mus musculus
caaaacaauggaagauaacuuagugcuuugagaguugcauagaga

SEQ ID NO: 22425 - RNA, 46 nt, Mus musculus
ucucucaaggcugaaugucgcaguuguuacugcugcugugcuggac

SEQ ID NO: 22426 - RNA, 45 nt, Mus musculus
augucugugcauguguauguguguauuccuuauauauguuugugu

SEQ ID NO: 22427 - RNA, 48 nt, Mus musculus
uccuugcauggcuuaguccccaaacccuggccggggugaugugggagu

SEQ ID NO: 22428 - RNA, 45 nt, Mus musculus
ugcagaggaaguuuucugcacacaccacaucaucugcauuuguac

SEQ ID NO: 22429 - RNA, 46 nt, Mus musculus
aggcugcuucagauuguccacagcagcugacucugauuugccacau

SEQ ID NO: 22430 - RNA, 45 nt, Mus musculus
aauuuagcgguguguguguguguguguguguguguguguguaugu

SEQ ID NO: 22431 - RNA, 45 nt, Mus musculus
guguugcacaggacaaaauguguauacgggcauuuguguuugcau

SEQ ID NO: 22432 - RNA, 51 nt, Mus musculus
uuuggguggguaggggccgggauauaauauguaugguaaugaauuugagua

SEQ ID NO: 22433 - RNA, 42 nt, Mus musculus
ccggaauauguacaaguacuuuggguuuucaaccaaggggau

SEQ ID NO: 22434 - RNA, 46 nt, Mus musculus
aaagaaaaugucaaguaaaaguggcucuaguuuucuuuguaugcag

SEQ ID NO: 22435 - RNA, 45 nt, Mus musculus
cauuaucaagaugggaacaugguagcauaguguaggcagagcuga

SEQ ID NO: 22436 - RNA, 41 nt, Mus musculus
uuuuaaagcccaagcaucagaccuaaucuaacucuccucca

SEQ ID NO: 22437 - RNA, 45 nt, Mus musculus
caggugguugugagcuaccugggcuagcagucaaacucagguucu

SEQ ID NO: 22438 - RNA, 46 nt, Mus musculus
aaaacgggucagcuggccgccaucaagguuauggacgucaccgagg

SEQ ID NO: 22439 - RNA, 46 nt, Mus musculus
aggaacagugugggugggaaggccaugguauggugaucuuguugga

SEQ ID NO: 22440 - RNA, 46 nt, Mus musculus
uguauagaugugaguuauccauuuguauuuacauaagggcuguaua

SEQ ID NO: 22441 - RNA, 43 nt, Mus musculus
caugucuccucaccucuguguguguguguguaugagagagaga

SEQ ID NO: 22442 - RNA, 46 nt, Mus musculus
uaggggaaaaauaccugaauagaacagcaauggcuuaugcuguaag

SEQ ID NO: 22443 - RNA, 46 nt, Mus musculus
cagggagccaacugaaagcuuguccacugucagaacccagccccag

SEQ ID NO: 22444 - RNA, 48 nt, Mus musculus
agaaugucuucgucccuagaggaagagagagaacucugcagugcccag

SEQ ID NO: 22445 - RNA, 49 nt, Mus musculus
ugucuaggggguggaacaguggucuuggguuaauggaacacgauggaga

SEQ ID NO: 22446 - RNA, 46 nt, Mus musculus
aaggaugaagaggaagaaaucaaacuggagauaaauaugcugaaga

SEQ ID NO: 22447 - RNA, 24 nt, Mus musculus
gaguuaagcugaagguauuaaaau

SEQ ID NO: 22448 - RNA, 46 nt, Mus musculus
uugccgggugacuuguccuuccauggguuagaaauaaagacucugg

SEQ ID NO: 22449 - RNA, 45 nt, Mus musculus
cuuuggcuucuugugugcugcaaaauuucaaggauagagcaccac

SEQ ID NO: 22450 - RNA, 44 nt, Mus musculus
uucagggauuggcacaucuccauauucaccacguuauucaccga

SEQ ID NO: 22451 - RNA, 45 nt, Mus musculus
cguuagaagggggaugagugagagaggggagaacaagagagauag

SEQ ID NO: 22452 - RNA, 38 nt, Mus musculus
agagugaccucugguccuguggcaucacagccaucgag

SEQ ID NO: 22453 - RNA, 42 nt, Mus musculus
cugugacaugcauccaaugagagcgcuguuucucauccccag

SEQ ID NO: 22454 - RNA, 53 nt, Mus musculus
agguucgaauccagcuuaaggaucacauagaccggaccagaaagaagagaggc

SEQ ID NO: 22455 - RNA, 31 nt, Mus musculus
cucuguccuugaguuuauuuacaccauguau

SEQ ID NO: 22456 - RNA, 43 nt, Mus musculus
gaguacagcgggagcgaggaggaggaggaggaagugccugagc

SEQ ID NO: 22457 - RNA, 42 nt, Mus musculus
cagcuucugcaggagcagcagcuccgggagcaggaggaguau

SEQ ID NO: 22458 - RNA, 31 nt, Mus musculus
cuuggaaagccagugagccucacugcgggag

SEQ ID NO: 22459 - RNA, 42 nt, Mus musculus
uaaacguacaguaaaucuaaaaaagacaagaaaggagggcag

SEQ ID NO: 22460 - RNA, 42 nt, Mus musculus
uaagugcuuuguagacauuucaauaacaggcaagucgggcag

SEQ ID NO: 22461 - RNA, 42 nt, Mus musculus
ggcuugugaacuuuaccacuuuucucuuucugggagggugag

SEQ ID NO: 22462 - RNA, 84 nt, Mus musculus
aacgggaagccaggaggcagcaggagcgugagcagcggcggcgugaacaagaggagaagaggcgucucgaggaacuggaaaggc

SEQ ID NO: 22463 - RNA, 64 nt, Mus musculus
ggcguaaagaagaggaagagaggagacgggcagaagaggagaagaggagaguggagagggaaca

SEQ ID NO: 22464 - RNA, 46 nt, Mus musculus
accucuguuuucugcauggauuucuugguuaacaaaugcuagagag

SEQ ID NO: 22465 - RNA, 45 nt, Mus musculus
aaugagagaaaugucagucuuguuuaagacuagcaugaggaggca

SEQ ID NO: 22466 - RNA, 42 nt, Mus musculus
ccaggcugucuggaucgugcaggagcaggggaggcuugggaa

SEQ ID NO: 22467 - RNA, 45 nt, Mus musculus
acagagaaauuccaccagguaaaaaaagagaacugacaggaggag

SEQ ID NO: 22468 - RNA, 42 nt, Mus musculus
ugauggagaggccugcagugguuugauuuuuguguggcccuu

SEQ ID NO: 22469 - RNA, 46 nt, Mus musculus
aagguaaaaaacauauucuuaacugcauaaaagaagaauacuaagu

SEQ ID NO: 22470 - RNA, 46 nt, Mus musculus
agacuacucauccuccagugaggagucugggaccacagaugaggag

SEQ ID NO: 22471 - RNA, 45 nt, Mus musculus
cuuuuauacacacacacacacacacacacacacacacacuauaca

SEQ ID NO: 22472 - RNA, 80 nt, Mus musculus
aaaacaaugaucguucaugaugauguagaaagugagccagccaugaccccguccaaggagggcacccucaucguccgcca

SEQ ID NO: 22473 - RNA, 41 nt, Mus musculus
ugagucucacagucuguguuggagugguagagaagccacag

SEQ ID NO: 22474 - RNA, 46 nt, Mus musculus
caucaugagagcaauggcuuugcgggucgcauucaccucuugccag

SEQ ID NO: 22475 - RNA, 61 nt, Mus musculus
acuuccuccaccucuuccuccccauccuccagccagccgacacccaccauguccccacaga

SEQ ID NO: 22476 - RNA, 42 nt, Mus musculus
uuuuaaguuacguuauuaacaccagugcuccuaaaaggccag

SEQ ID NO: 22477 - RNA, 56 nt, Mus musculus
cacaguagauaggagaucacaccaguuagucuguuacacacaguagauaggaaauc

SEQ ID NO: 22478 - RNA, 66 nt, Mus musculus
acaccaguuagucuguuacacacaguagauaggagaucacaccaguuagucuguuacacacaguag

SEQ ID NO: 22479 - RNA, 75 nt, Mus musculus
cugucacaguagauaggagaucacaccaguugucugucacaauagauaggcgaucacaccaguuagucuguuaca

SEQ ID NO: 22480 - RNA, 45 nt, Mus musculus
aaacacaaaucuuccuccuccuuuacaccuuuuauagaccccagg

SEQ ID NO: 22481 - RNA, 51 nt, Mus musculus
caaugugaaccccacgaacacuaggccacagagugauacccccgagauucg

SEQ ID NO: 22482 - RNA, 46 nt, Mus musculus
aagguguaccguguggcucaguggguguauaagaaaacggggauca

SEQ ID NO: 22483 - RNA, 57 nt, Mus musculus
gcuugugucugccagcugucacgugauuagaaagcauggaguauugggcagaggagg

SEQ ID NO: 22484 - RNA, 52 nt, Mus musculus
cauagugggcauguguaugauuagcgcuggcaguguccauggaagaaauaga

SEQ ID NO: 22485 - RNA, 46 nt, Mus musculus
cgguuccagcaaauggaugugcucgaaggccuaaauguccugguga

SEQ ID NO: 22486 - RNA, 55 nt, Mus musculus
aauaagauucuucauaaugauccagagguugagaagaagcagggguggaccacug

SEQ ID NO: 22487 - RNA, 46 nt, Mus musculus
caguaaaauaugaaagaaucaaguuucugguaauugcuuugaagag

SEQ ID NO: 22488 - RNA, 46 nt, Mus musculus
uugcuguuguugaccuugccuucuguucuaaucaagacacaacugg

SEQ ID NO: 22489 - RNA, 45 nt, Mus musculus
auuuggagaacugcuacauaagccauuacugguggaucucacugu

SEQ ID NO: 22490 - RNA, 45 nt, Mus musculus
aacacguacggaaggaucaccaaggacgugguucugcagugggga

SEQ ID NO: 22491 - RNA, 46 nt, Mus musculus
cuggacuccaccaucggugcuaggagugcuugggaauggacucaga

SEQ ID NO: 22492 - RNA, 47 nt, Mus musculus
auuuaauugacauuucucuuuuuguaaugugacaguauguggacaga

SEQ ID NO: 22493 - RNA, 45 nt, Mus musculus
uuaggccuaagugcagcuccccguggccugcacacaccguaggag

SEQ ID NO: 22494 - RNA, 46 nt, Mus musculus
aaaaaaacaaaaaauaaaaaacaagccugucuaugacagcagggag

SEQ ID NO: 22495 - RNA, 46 nt, Mus musculus
gguguaaaaucgacacucuggcuuuucuccuuuucucacgugcucu

SEQ ID NO: 22496 - RNA, 46 nt, Mus musculus
agaugacagagaagaaaggcaguaaugaugagaaaugucggcagaa

SEQ ID NO: 22497 - RNA, 89 nt, Mus musculus
uuucucuucuggacccuaccucagagagcacuugucaaccgccuagugaacacaccauuacuauccugugccauugccauagagagacc

SEQ ID NO: 22498 - RNA, 91 nt, Mus musculus
ucagccaucaaucacuagcacaugauugacagacagagaaugggacuuugggcuuuggcaauucugacacuucccauguauuugacaguua

SEQ ID NO: 22499 - RNA, 61 nt, Mus musculus
aaaucguccuggggucuggaaaaugaggcuuuaauugugagaugcccccaaagaggacgcu

SEQ ID NO: 22500 - RNA, 83 nt, Mus musculus
gauacaaaugaaaguauuccuacucaaaaaagaaaucggaucuuugucucaagagaucgucugaaguuucuaccagccagagu

SEQ ID NO: 22501 - RNA, 58 nt, Mus musculus
uaagacuggauacuugaaugucaccauacauaaaaagccgccaagcugcaauaucccu

SEQ ID NO: 22502 - RNA, 56 nt, Mus musculus
gauuauuugauguacucgacaguacguggaucagauaaaaauuucaagauaacgug

SEQ ID NO: 22503 - RNA, 59 nt, Mus musculus
augaugaugaaggugacuacacuugucaauucacacacgcggagaauggaaccaacuac

SEQ ID NO: 22504 - RNA, 46 nt, Mus musculus
gcuuuucuauguuuccaguaauuacaaauccuccauacaaccacac

SEQ ID NO: 22505 - RNA, 105 nt, Mus musculus
uugcuuuggcaaaggcucucacuucuuggcugauguccuguggcagauuaacaaaacaguaguuggaaauuuuggugaagcaagaauucaagaagaggaaggucg

SEQ ID NO: 22506 - RNA, 81 nt, Mus musculus
gugacagaaaaggaccugucccuggaauaugacugucuggcccugaaccuucauggcaugauaaggcacaccauaaggcug

SEQ ID NO: 22507 - RNA, 84 nt, Mus musculus
uggcugaaucagcugugcacugcauccguuuucuccgaggacuguguguuguagcuuggucccagggaauccaucaugaucaag

SEQ ID NO: 22508 - RNA, 106 nt, Mus musculus
ggaaucucugucauuguauccuuccccucucuguguccccuccuccuuguucuccccgcaguccuccccaucuccucaccucccuuaauguguucuugacccccuu

SEQ ID NO: 22509 - RNA, 42 nt, Mus musculus
ccuugucauggaaaacaacuuacaaacuuucauucugagcag

SEQ ID NO: 22510 - RNA, 107 nt, Mus musculus
gcaauacaacuaauaugaaaacauuuuuaauuucuuucaaauaucaagagggcaugggagggagagagacacuaacucuaagaucauagcaauauguggggcauuua

SEQ ID NO: 22511 - RNA, 41 nt, Mus musculus
cuucuuuuguuuguuuuuacuauagaaacuauucugcccuu

SEQ ID NO: 22512 - RNA, 72 nt, Mus musculus
aacauuuuuauaaaacagaauuuugauuccuagguggccagaguugugacucauagagggauuuuugugcug

SEQ ID NO: 22513 - RNA, 46 nt, Mus musculus
guuucuugcguguuuugugaaacaagggaugugggacucggcugag

SEQ ID NO: 22514 - RNA, 45 nt, Mus musculus
uguucuggauugagguugcucuguucuggagagauauagugacac

SEQ ID NO: 22515 - RNA, 45 nt, Mus musculus
gauggcaagcucuacgaugcguacaucauuuacccucgggucuuc

SEQ ID NO: 22516 - RNA, 46 nt, Mus musculus
accugcaagauucucuccagcaucuugugaaaauucaggggaccau

SEQ ID NO: 22517 - RNA, 46 nt, Mus musculus
aagcagucucuaaguuccaaauucuggaagcaugugagguaccaaa

SEQ ID NO: 22518 - RNA, 26 nt, Mus musculus
cuccauaagaccuccccucucauuca

SEQ ID NO: 22519 - RNA, 46 nt, Mus musculus
aaggaaauauaaugaaaaucauaacucuuaagauuaauuuugguag

SEQ ID NO: 22520 - RNA, 69 nt, Mus musculus
uuguacacuacagacuaggcagcuuuuccuauuuaccaccauaaugaaaacugguggcugauuucuuua

SEQ ID NO: 22521 - RNA, 77 nt, Mus musculus
ucugucacugugcgacagcuaacuuuugugauacuccuaugaaauguguagggaauuuggacagaacagaaucaauc

SEQ ID NO: 22522 - RNA, 53 nt, Mus musculus
uauagucagagguccucuggacagucuuuuccaggagcacacacagaccguga

SEQ ID NO: 22523 - RNA, 45 nt, Mus musculus
gcucagucggugaugggacuccaggcugaggugacaaugaacaca

SEQ ID NO: 22524 - RNA, 46 nt, Mus musculus
uucugcagcuucaucuacuucuuagugaguugccaaaacugaccac

SEQ ID NO: 22525 - RNA, 87 nt, Mus musculus
auuuguucccgagauucuucugauaagucuaaacuauuugcauguaauugagcugggcagcauggcacacuugggaggcagaggcag

SEQ ID NO: 22526 - RNA, 49 nt, Mus musculus
acaacaacagcaacagcugcagcagcaacaacaacaacaaagaaaaaga

SEQ ID NO: 22527 - RNA, 46 nt, Mus musculus
ccauuucuacuuuuguuccccucauuucuucaaagugcuuguccag

SEQ ID NO: 22528 - RNA, 46 nt, Mus musculus
uuuccucguguugccucuuguagccaucucuguauuagauuaggaa

SEQ ID NO: 22529 - RNA, 46 nt, Mus musculus
ggaucagguagaacugguggacuuugauccaaaucaggaaagacgg

SEQ ID NO: 22530 - RNA, 46 nt, Mus musculus
uuggggucagacuugggucugaacugagagacuaggagauuagaua

SEQ ID NO: 22531 - RNA, 46 nt, Mus musculus
cccuucagguggaaggguuggggugcgugauguaauugaaguuugc

SEQ ID NO: 22532 - RNA, 46 nt, Mus musculus
gggggaacggcccuccgguuccuaggccuacugcuaguccuggcag

SEQ ID NO: 22533 - RNA, 44 nt, Mus musculus
ucccgcaaauggcacagaaauggcaucaagaaaccacggucgca

SEQ ID NO: 22534 - RNA, 46 nt, Mus musculus
ggugcccaggccccugugaaggccccauagaaaugacuccugccag

SEQ ID NO: 22535 - RNA, 45 nt, Mus musculus
guggcugugagagagagagagagacuguguguuugugugugucug

SEQ ID NO: 22536 - RNA, 42 nt, Mus musculus
ucgccaggaagauauggaguggggguaagaaaagaggagagg

SEQ ID NO: 22537 - RNA, 44 nt, Mus musculus
auggauggugaugacaacuuucacuuauugaucuaguucgagga

SEQ ID NO: 22538 - RNA, 54 nt, Mus musculus
gaguccuggcuuacaagaagccugcagucuauuggagauaauuaugaaaggaga

SEQ ID NO: 22539 - RNA, 44 nt, Mus musculus
aucaagccuuggguguucuggaaguaguggcgccacagcggcgg

SEQ ID NO: 22540 - RNA, 35 nt, Mus musculus
gcuggcaaacaccaagagaacagcaucucggagcu

SEQ ID NO: 22541 - RNA, 46 nt, Mus musculus
agugauguuuaagagauacucguuuuggcaaggccagcaaagugag

SEQ ID NO: 22542 - RNA, 60 nt, Mus musculus
aaaaaucauugauaucauugauacaacaggaaguggugauguaaauacugcuacagaagu

SEQ ID NO: 22543 - RNA, 46 nt, Mus musculus
guucuaggagcuuaggugugaucuugauggauguauauaguugcgg

SEQ ID NO: 22544 - RNA, 45 nt, Mus musculus
cacaccuguaugaagugaaaacuuaagaacucuuuguaaagucag

SEQ ID NO: 22545 - RNA, 45 nt, Mus musculus
agaacaugugaucuuuggaggauauaaauaggacuugauggaaug

SEQ ID NO: 22546 - RNA, 52 nt, Mus musculus
agauagcuaaguagauaaaauaucuauuaugugaguaugaaaacgugagugc

SEQ ID NO: 22547 - RNA, 57 nt, Mus musculus
gaucucaguggucagcuaaucuuugagcuucgguuuaggcagagacugucucaaaaa

SEQ ID NO: 22548 - RNA, 43 nt, Mus musculus
acgggcauaacccccccacacacacacacauuacaaagagaag

SEQ ID NO: 22549 - RNA, 46 nt, Mus musculus
uuauauuuaguacauagauagcaguuuuuuuauacuuaggaugaau

SEQ ID NO: 22550 - RNA, 60 nt, Mus musculus
cgaaucccagauuucaugauaaauuaagcuuuaaauaacagaugaucuuaauccuggaga

SEQ ID NO: 22551 - RNA, 44 nt, Mus musculus
uguauugguccugugcuggcagagccucucagggaacggccaua

SEQ ID NO: 22552 - RNA, 49 nt, Mus musculus
gcuucuuagcaucagugauagugucaugguuugccgccucacuuuugag

SEQ ID NO: 22553 - RNA, 43 nt, Mus musculus
cuuccaaaaacauuagagagaccacauacaugcccccugcccc

SEQ ID NO: 22554 - RNA, 46 nt, Mus musculus
uucccuuguacaaagaaggaaaucauuguauccucccuucccacac

SEQ ID NO: 22555 - RNA, 46 nt, Mus musculus
aagauuuuugaguuuuuuuuuuuaauuuuuguguuuuuuuagagag

SEQ ID NO: 22556 - RNA, 46 nt, Mus musculus
aaggaaaaaaucugggauccaauucacagaguugcacuugcagaag

SEQ ID NO: 22557 - RNA, 42 nt, Mus musculus
cuuaauucuuuugagaaaaaguauagugauccaggcccugua

SEQ ID NO: 22558 - RNA, 41 nt, Mus musculus
auguguuuaaaauauguaucuuuuaauuuuuagcaguaaua

SEQ ID NO: 22559 - RNA, 46 nt, Mus musculus
gacuugaguaaaugugccguauugagaaacuacaaagaggcccaag

SEQ ID NO: 22560 - RNA, 46 nt, Mus musculus
guaaauauguuuauacguguuuguuggauacugggacaaaggugag

SEQ ID NO: 22561 - RNA, 46 nt, Mus musculus
gaaguuauaaaucauaagugugaucuugucaacuacaguuauggag

SEQ ID NO: 22562 - RNA, 45 nt, Mus musculus
uguguguguguguguguguuucucuugugcauaacaucuauggag

SEQ ID NO: 22563 - RNA, 46 nt, Mus musculus
gagcuuucugcauuuuggauuuucuuugauaaagaacucuugucag

SEQ ID NO: 22564 - RNA, 46 nt, Mus musculus
ugauuuaccaacugacauugucagaugguggaacaauaggaguaag

SEQ ID NO: 22565 - RNA, 45 nt, Mus musculus
guuuuuguguagaacuaauuuacuauacuaaccuaauuucuuaag

SEQ ID NO: 22566 - RNA, 41 nt, Mus musculus
uccuuucuuuuuuuuuuuucuuuucuuuuuuuuuuuuuuuu

SEQ ID NO: 22567 - RNA, 45 nt, Mus musculus
uuuagggcugaaagcaaauaauguugacuauacuguacacucagu

SEQ ID NO: 22568 - RNA, 41 nt, Mus musculus
acuauaaucaaaaagggcacaaaggcucuuuguagguaaaa

SEQ ID NO: 22569 - RNA, 48 nt, Mus musculus
caaagcuuaugacuaccucauucaaaauacaucauuugcuaacagauu

SEQ ID NO: 22570 - RNA, 45 nt, Mus musculus
uuauaugaauuaaugucaguaaucuaguauuaacuuaccugcuag

SEQ ID NO: 22571 - RNA, 45 nt, Mus musculus
auauacguccucguagcaaauaguuauuuuccccucugugcuccc

SEQ ID NO: 22572 - RNA, 46 nt, Mus musculus
cacuuauugaagcuuuuccuguuuugguaaguuuauguaacaagaa

SEQ ID NO: 22573 - RNA, 45 nt, Mus musculus
uuagcauuugagacugaggcaggagaaaagcaaguucaaggcuac

SEQ ID NO: 22574 - RNA, 37 nt, Mus musculus
acgauguggcccaggccacgcgcaugcccagcaccag

SEQ ID NO: 22575 - RNA, 46 nt, Mus musculus
cagaccuuuaggaucaagagauguuuugccaaauaaucgccagcuu

SEQ ID NO: 22576 - RNA, 46 nt, Mus musculus
aacaaucucugaggagagagcaaggauuaaagauaggaaaggcaga

SEQ ID NO: 22577 - RNA, 46 nt, Mus musculus
ugugcauacacaugaauguuuauuuuagauaauauacaaaucuaau

SEQ ID NO: 22578 - RNA, 46 nt, Mus musculus
uucuuauguauaacacugauugugugaauauguugauacgcuuggg

SEQ ID NO: 22579 - RNA, 48 nt, Mus musculus
gggcuuuaaguccaucguucagaagggguaaaagaauacuugcaggga

SEQ ID NO: 22580 - RNA, 45 nt, Mus musculus
ugaaggcuugcuguggucuacaagaccucagcaauuacguggaua

SEQ ID NO: 22581 - RNA, 45 nt, Mus musculus
aaggaagugccauuuuaccuuacuuugccuuucauuguagcccug

SEQ ID NO: 22582 - RNA, 42 nt, Mus musculus
auauacuauuguaucauuuuauaccccagaauugaguaucag

SEQ ID NO: 22583 - RNA, 46 nt, Mus musculus
cccauucuuucguuuguuugaaacucauuuauuuauucugugugag

SEQ ID NO: 22584 - RNA, 46 nt, Mus musculus
uguucucaagacuuauaccaucaacaguuauaaaacauagcccaau

SEQ ID NO: 22585 - RNA, 46 nt, Mus musculus
aagucuuagaagugaccaaccacuacagucuucauguccccagcug

SEQ ID NO: 22586 - RNA, 45 nt, Mus musculus
ugggagcuuccuuguuccagauuucauuccagagauguccaccau

SEQ ID NO: 22587 - RNA, 46 nt, Mus musculus
gcaaaauuggucugagguucucuuucuuuguugacucuuugugugg

SEQ ID NO: 22588 - RNA, 44 nt, Mus musculus
uuaauugaucuugagacauauuaaugccauauuuuguuguugga

SEQ ID NO: 22589 - RNA, 32 nt, Mus musculus
aagcaugcauuaguaaauaagauguaugggag

SEQ ID NO: 22590 - RNA, 45 nt, Mus musculus
auucaauuaguggggaugguggggggcauaaacaaauggcaacug

SEQ ID NO: 22591 - RNA, 56 nt, Mus musculus
cauguaaaauacaugaauaaacgugcaaaaccacaggcacaguacaccauaugcac

SEQ ID NO: 22592 - RNA, 41 nt, Mus musculus
uggaagcugcuggagugcucgggccaccgggucagcccgga

SEQ ID NO: 22593 - RNA, 42 nt, Mus musculus
ucacagcagaguggcuacagaguugucgcggagaauaaggag

SEQ ID NO: 22594 - RNA, 44 nt, Mus musculus
cugggaguggaguuucuucuggguguugugggacuggcuacaga

SEQ ID NO: 22595 - RNA, 41 nt, Mus musculus
gcugauguguccucuucaccucugauccuaugauccugggg

SEQ ID NO: 22596 - RNA, 44 nt, Mus musculus
cacaucauauaaguguauaucuggaaguguuaguugaggccagg

SEQ ID NO: 22597 - RNA, 46 nt, Mus musculus
uuaagguaaguuacaggaucuggcaaagaggagauucaugcuucgg

SEQ ID NO: 22598 - RNA, 111 nt, Mus musculus
caguauaggggagacccaggcugggaggggagagccagacaaggaaaagucagccauuguccuugagcaggguuugaauaauaagucagagaagaggauugacccaagaug

SEQ ID NO: 22599 - RNA, 47 nt, Mus musculus
uguuucccagacaugaagcgccacccagucucacucagguucaaaga

SEQ ID NO: 22600 - RNA, 46 nt, Mus musculus
auggcucaguuuguaaaagacuugacauacaaguaugagaacccaa

SEQ ID NO: 22601 - RNA, 42 nt, Mus musculus
gaaaauguccaaaaggaaaugaaccagcagcauucagggcaa

SEQ ID NO: 22602 - RNA, 46 nt, Mus musculus
agcaacagcaaugggcuauauuguuuugggaacuucaugggggugu

SEQ ID NO: 22603 - RNA, 46 nt, Mus musculus
ugaagauccugagcuacaaaacggacucuacccacuugagaccaag

SEQ ID NO: 22604 - RNA, 45 nt, Mus musculus
gaggcaaugaguaacuuagaaaaugcguugccuucuaaugcugaa

SEQ ID NO: 22605 - RNA, 57 nt, Mus musculus
cagggagcugauuucagcuccaaagcccaugggaccaauggagauggagucugaaga

SEQ ID NO: 22606 - RNA, 41 nt, Mus musculus
caucccuacauuauugggaugaagcauaucugaugguggaa

SEQ ID NO: 22607 - RNA, 46 nt, Mus musculus
ugaaaacgcuugguuggaaguggcagauaggcaucuguggugcacu

SEQ ID NO: 22608 - RNA, 47 nt, Mus musculus
caaacagagucauccgaggcuucuacacaucucucugaaaaagaugc

SEQ ID NO: 22609 - RNA, 50 nt, Mus musculus
cacagagugccuccuacaggacagcucugacauugaggcaauggaaggac

SEQ ID NO: 22610 - RNA, 42 nt, Mus musculus
gaggcuuuguuuguggcagucuugggcaggcuccuuaaggaa

SEQ ID NO: 22611 - RNA, 46 nt, Mus musculus
gggaaugggggagguggugauaacagugguuaauauuggagagaag

SEQ ID NO: 22612 - RNA, 46 nt, Mus musculus
ugggaggaaagguucuagauuccugguucugggccaguaguagagu

SEQ ID NO: 22613 - RNA, 65 nt, Mus musculus
aggaugaugaggacaaagccaagacuguccuagugacugcuagaccuguauuugggaagaaaaaa

SEQ ID NO: 22614 - RNA, 43 nt, Mus musculus
ugagcuuugugcaaaguggaaccugguuucuucucacccuucu

SEQ ID NO: 22615 - RNA, 45 nt, Mus musculus
ucaagcauuguagaagagagcaagucuucggaaaccaugcuggga

SEQ ID NO: 22616 - RNA, 46 nt, Mus musculus
uuaaccacuagaaguucugucugugccuaacaaaaacauagcccaa

SEQ ID NO: 22617 - RNA, 46 nt, Mus musculus
auacuagauucaaaucugaauuccuuuaaguauuuuaccuggauaa

SEQ ID NO: 22618 - RNA, 46 nt, Mus musculus
uuggucaguccuaugagucuagagaugucuggaagccagaaccaug

SEQ ID NO: 22619 - RNA, 59 nt, Mus musculus
aucuguccuuugcgaugacauaaucugugaugaggagccacuagacugccccaacccag

SEQ ID NO: 22620 - RNA, 46 nt, Mus musculus
aaggcccagcuggcaugccuggauucccugguaugaaaggacacag

SEQ ID NO: 22621 - RNA, 46 nt, Mus musculus
uggcccuccuggaacugcaggauucccuggauccccuggugcuaag

SEQ ID NO: 22622 - RNA, 48 nt, Mus musculus
gugaacccggcaagaacggugcgaagggagagccaggagcacgcggug

SEQ ID NO: 22623 - RNA, 68 nt, Mus musculus
gcgaagcugguuccccaggaauuccaggaccuaagggcgaagauggcaaagauggaucaccuggagaa

SEQ ID NO: 22624 - RNA, 45 nt, Mus musculus
guccugcaggacccagaggaguagcuggagaaccuggccgagaug

SEQ ID NO: 22625 - RNA, 45 nt, Mus musculus
cccagcuggugacaagggagauucuggacccccugguccacaagg

SEQ ID NO: 22626 - RNA, 42 nt, Mus musculus
gugcuagagguggagcuggacccccuggcccugagggaggaa

SEQ ID NO: 22627 - RNA, 46 nt, Mus musculus
ggcccuccuggugcuucugguucuccuggucugcaagggaugccag

SEQ ID NO: 22628 - RNA, 46 nt, Mus musculus
gggaacgccagggccaaaaaagggggaguggguggguaggggauug

SEQ ID NO: 22629 - RNA, 83 nt, Mus musculus
ugaaccaggugcuaaaggagaaagaggugccccuggagagaaaggugaaggaggcccuccaggaccugcaggacccacuggca

SEQ ID NO: 22630 - RNA, 42 nt, Mus musculus
caggcaugccagguccacgggguagcccuggaccucagggua

SEQ ID NO: 22631 - RNA, 46 nt, Mus musculus
uccuggaccccaaggucuuccuggucagccugguacagcuggugaa

SEQ ID NO: 22632 - RNA, 30 nt, Mus musculus
aggcccaccuggcccuguugguccaucugg

SEQ ID NO: 22633 - RNA, 46 nt, Mus musculus
aaaggguccccaagguccacgaggugacaaaggugaaacuggugaa

SEQ ID NO: 22634 - RNA, 48 nt, Mus musculus
gugggcauccagguccuauuggaccaccagguccuagaggaaacagag

SEQ ID NO: 22635 - RNA, 88 nt, Mus musculus
gucccugcuguggugguggugcugcugccauugcuggaguuggaggugaaaagucugguggcuuuucacccuauuauggagacgaucc

SEQ ID NO: 22636 - RNA, 104 nt, Mus musculus
aauggauuucaagaucaacacugaagagauuaugucuucacucaagucuguuaauggacaaauagagagucuuauaagcccugaugguucucgaaaaaacccug

SEQ ID NO: 22637 - RNA, 42 nt, Mus musculus
ggagaauacuggguugauccuaaccaaggcugcaagauggau

SEQ ID NO: 22638 - RNA, 68 nt, Mus musculus
ccccaugacugucccacguaagcacugguggacagauucuggugcagagaagaaacauguuugguuug

SEQ ID NO: 22639 - RNA, 86 nt, Mus musculus
uuuccagccgggccucccagaacauuacauaccacugcaaaaacaguauugccuauauggaucaggccaguggcaauguaaagaag

SEQ ID NO: 22640 - RNA, 76 nt, Mus musculus
ucucugaagcugaugggaucaaaugaaggcgaauucaaggcugaaggaaacagcaaauucacuuacacaguucuag

SEQ ID NO: 22641 - RNA, 76 nt, Mus musculus
ggggaauggagcaagacagucuuugaauaucaaacacgcaaggcaaugagacuacccaucauagauaucgcacccu

SEQ ID NO: 22642 - RNA, 45 nt, Mus musculus
acauccauguguucaucuuguuuuaaucuuaucaaccagugcaag

SEQ ID NO: 22643 - RNA, 44 nt, Mus musculus
uuuuuaccaauuccaacuucaaaaugucucaauggugcuauaau

SEQ ID NO: 22644 - RNA, 45 nt, Mus musculus
uagagcguuaacuagaauuaaaaaaaacuagacuauagagcagga

SEQ ID NO: 22645 - RNA, 31 nt, Mus musculus
cugccagaaauauugacuggcaugccacagg

SEQ ID NO: 22646 - RNA, 45 nt, Mus musculus
auuuugcuuggcugcagucugaaaaguagagaguaaugcccccug

SEQ ID NO: 22647 - RNA, 45 nt, Mus musculus
auccucaaguuuaauugacuuaauuuuuucaauauggccguuuag

SEQ ID NO: 22648 - RNA, 46 nt, Mus musculus
augaccaccacaagaacugugacuguuuaaaguucauccugagacu

SEQ ID NO: 22649 - RNA, 62 nt, Mus musculus
ccuugauauugggccaguuuguuucauguaacagaagcccagacauaucgacaaugagcacu

SEQ ID NO: 22650 - RNA, 45 nt, Mus musculus
gcaaaacuaucuuugaauacagaacacagaauguggcccgcuugc

SEQ ID NO: 22651 - RNA, 48 nt, Mus musculus
agcugugguccuuaaagggucaaacgacuuagaaauaaaaggagaagg

SEQ ID NO: 22652 - RNA, 82 nt, Mus musculus
uggagauuaccagucuccuaacacagcuaucacucagaugaccuuuuugcgucuuuuaucaaaagaagccucgcagaaccuu

SEQ ID NO: 22653 - RNA, 45 nt, Mus musculus
ggccagcaaauccccugacaauaagccugugugguacggucuuga

SEQ ID NO: 22654 - RNA, 51 nt, Mus musculus
cagcugaagaugcaaucaaaguuuacugcaauauggaaacaggagagacau

SEQ ID NO: 22655 - RNA, 66 nt, Mus musculus
ugguuccaagaaacacccagcccgcacuugugaugauuuaaagcuuugccaucccacaaagcagag

SEQ ID NO: 22656 - RNA, 67 nt, Mus musculus
cagacccugggauccauguuacccugaagucucucaguagucagauugaaaccaugcguagcccuga

SEQ ID NO: 22657 - RNA, 41 nt, Mus musculus
uuggugauaucaugggacacuaugaugagaacaugccagau

SEQ ID NO: 22658 - RNA, 46 nt, Mus musculus
aaacccugggccacuuggaccaauuggaccuccuggugugcggggc

SEQ ID NO: 22659 - RNA, 42 nt, Mus musculus
aaggaccucgaggugacaagggugacaauggagacagaggug

SEQ ID NO: 22660 - RNA, 45 nt, Mus musculus
cccuggaacuccuggcccuguuggugccccuggagaugcaggaca

SEQ ID NO: 22661 - RNA, 46 nt, Mus musculus
cggcugguaaugaugguaccccaggacgggauggugcuguuggaga

SEQ ID NO: 22662 - RNA, 44 nt, Mus musculus
aggguacaccaggaaaaguaggaccaacuggugcgacaggagau

SEQ ID NO: 22663 - RNA, 99 nt, Mus musculus
cuccuggucuucguggugacccuggcucucaugggcgagugggagauagaggaccagcuggcccaccugguagcccaggagauaaaggggacccaggag

SEQ ID NO: 22664 - RNA, 46 nt, Mus musculus
uaaauaaagcuguaacagaaaagcaauguaccucuaccagcuaauc

SEQ ID NO: 22665 - RNA, 42 nt, Mus musculus
ggugucaagggugagccuggagagccaggacagaagggagau

SEQ ID NO: 22666 - RNA, 46 nt, Mus musculus
aggguucucguggugaaaaugguccaacuggagcuguugguuuugc

SEQ ID NO: 22667 - RNA, 45 nt, Mus musculus
caggucccuugggaccuccagguccugcaggcccuacuggagaaa

SEQ ID NO: 22668 - RNA, 44 nt, Mus musculus
agagaaaggugcugaaggaacagcaggaaaugacggggcaaggg

SEQ ID NO: 22669 - RNA, 46 nt, Mus musculus
agacacagggccaccaggucuucagggcaugccaggagaaagagga

SEQ ID NO: 22670 - RNA, 96 nt, Mus musculus
aaagagggaauccuggagaaagaggagagccagggauaacuggacugccuggggagaaaggcauggcuggaggacauggcccugaugguccaaagg

SEQ ID NO: 22671 - RNA, 45 nt, Mus musculus
uuccuggagagccuggagcaguuggcccauuaggaccucggguag

SEQ ID NO: 22672 - RNA, 45 nt, Mus musculus
ccuggaccuccagggccaccuggagaagguggaaaggcuggugau

SEQ ID NO: 22673 - RNA, 27 nt, Mus musculus
uagcuggggaaagaggagagcagggac

SEQ ID NO: 22674 - RNA, 46 nt, Mus musculus
uuggaaaaccaggagaagcaggaaaugcuggugugccugggcaaag

SEQ ID NO: 22675 - RNA, 45 nt, Mus musculus
ggacagccuggaagcaugggccuuccaggccccaaagguagcagu

SEQ ID NO: 22676 - RNA, 46 nt, Mus musculus
gcgugguccuguagguucuucggggccuaaaggaggccagggagau

SEQ ID NO: 22677 - RNA, 45 nt, Mus musculus
ucgugguuuuccagggucugaugguuuaccuggaccaaagguaag

SEQ ID NO: 22678 - RNA, 42 nt, Mus musculus
ggcacaguugguccuccaggaccaaugggagaaaggguaaac

SEQ ID NO: 22679 - RNA, 48 nt, Mus musculus
ccacaugguauucagggucccauugguccaccuggugaagaaggcaaa

SEQ ID NO: 22680 - RNA, 42 nt, Mus musculus
ccuacuggagcccgaggcccugaagguccucaggggcagaga

SEQ ID NO: 22681 - RNA, 45 nt, Mus musculus
gaagaacaauaauaucaaccaaccagaucccccagagcucccagg

SEQ ID NO: 22682 - RNA, 24 nt, Mus musculus
uuuauguacagauuguuuuuaucu

SEQ ID NO: 22683 - RNA, 41 nt, Mus musculus
aagaggaaugccaggagagaggggaagacuugggccacagg

SEQ ID NO: 22684 - RNA, 46 nt, Mus musculus
aggucuugaaggccccaaaggugaaauuggagcaccuggugcuaag

SEQ ID NO: 22685 - RNA, 46 nt, Mus musculus
gcucgaggcuucccuggugcuccuggucucccuggcuugaaagguc

SEQ ID NO: 22686 - RNA, 44 nt, Mus musculus
cuaauguguccugaaauccuuuauuaauauccugggcccuaaaa

SEQ ID NO: 22687 - RNA, 46 nt, Mus musculus
ugaacaucaguaaacucugucuacauauuucauuuacuacuugagg

SEQ ID NO: 22688 - RNA, 45 nt, Mus musculus
uagccuuuuucagcucagauggcugggcuggaugaaaaaucugga

SEQ ID NO: 22689 - RNA, 45 nt, Mus musculus
gauaaccagcuccuagcacaaggccauuuggccuguuagggagau

SEQ ID NO: 22690 - RNA, 43 nt, Mus musculus
agaggggacuauaauucagcuuuuacagccucagguuccagga

SEQ ID NO: 22691 - RNA, 45 nt, Mus musculus
acacaccucacgaucagcgauuucaaaaccuacuaccggguagaa

SEQ ID NO: 22692 - RNA, 46 nt, Mus musculus
gcggguccgcucagugcugagcuacucucucccaccuagccgaguu

SEQ ID NO: 22693 - RNA, 51 nt, Mus musculus
gugcuguccggugugcccacaaacuggagguggagauacuaguuuugguaa

SEQ ID NO: 22694 - RNA, 85 nt, Mus musculus
agauguauuuaaauagagacauuuggaaaccuucuccaugucagaucugugucugugacaauggugccauucuuugugacaagau

SEQ ID NO: 22695 - RNA, 27 nt, Mus musculus
cagaugaauaugaugaagaaauagccu

SEQ ID NO: 22696 - RNA, 23 nt, Mus musculus
auaaaaggcuggugauagaugug

SEQ ID NO: 22697 - RNA, 46 nt, Mus musculus
uuuaaacugaaauguuuauuuuuuuuucaaaucuuaggucuaagaa

SEQ ID NO: 22698 - RNA, 45 nt, Mus musculus
ccucuccucauucuuucuguuuuauuaggguacugugucucaaua

SEQ ID NO: 22699 - RNA, 46 nt, Mus musculus
agcugccacuucugaagaacugcugguuccugggcggaggcggcgg

SEQ ID NO: 22700 - RNA, 44 nt, Mus musculus
acuagcugagcugacaaaaucaaaacaagaaauuugacugugua

SEQ ID NO: 22701 - RNA, 46 nt, Mus musculus
ucgauucccaccuccuuccuuucuguuuaaaagcugaaacuguuag

SEQ ID NO: 22702 - RNA, 46 nt, Mus musculus
uauaguuuuauaauuguccuauccuggaacucacuguguagaccag

SEQ ID NO: 22703 - RNA, 46 nt, Mus musculus
gcaaaguuaaauucccugggccuggaaagacagagcaugauagcaa

SEQ ID NO: 22704 - RNA, 41 nt, Mus musculus
uaaaucagagugcauuggcaaguucuugugguaagaccugg

SEQ ID NO: 22705 - RNA, 44 nt, Mus musculus
gucucccuuucuauuucugauuuuauuaauuuggauucuaucga

SEQ ID NO: 22706 - RNA, 45 nt, Mus musculus
gauucagccuaaugaagcuuuggauuuguggaacagugccuggug

SEQ ID NO: 22707 - RNA, 42 nt, Mus musculus
ugcugaguggcgggcgggagugugugcuuguggaguggcgag

SEQ ID NO: 22708 - RNA, 45 nt, Mus musculus
uucauaaauucuucuuuguggcauggauuguuacgugaucgaguu

SEQ ID NO: 22709 - RNA, 49 nt, Mus musculus
gaguguuugucccacgagaugucccagaaucauucacgucagaaacgca

SEQ ID NO: 22710 - RNA, 46 nt, Mus musculus
caguacaaagucuccagaagagaaacucacaccaacaagcaaacag

SEQ ID NO: 22711 - RNA, 44 nt, Mus musculus
uucuauucaaacauggcuuaucaccuugcugaacuuagggccuu

SEQ ID NO: 22712 - RNA, 45 nt, Mus musculus
caguaaaauauguaguacauuuuagaaaaugaaauauagcagggu

SEQ ID NO: 22713 - RNA, 42 nt, Mus musculus
ugcugcauccuuccagguugucgcugugugaccuugccccag

SEQ ID NO: 22714 - RNA, 46 nt, Mus musculus
cagagaacauaccugcaauuacugaggugagugaucaguacugcag

SEQ ID NO: 22715 - RNA, 46 nt, Mus musculus
guaccugggugaggagaugggaccacacagugcaggaaacuggaag

SEQ ID NO: 22716 - RNA, 46 nt, Mus musculus
ccugaugauguagauauggagggaaacaaagaaagugaugauucag

SEQ ID NO: 22717 - RNA, 46 nt, Mus musculus
aauggcugaggacauucuguaucccgagucuguuccuugcccagug

SEQ ID NO: 22718 - RNA, 45 nt, Mus musculus
gcugaaauccgucauguccuagucacacugggcgagaagaugaca

SEQ ID NO: 22719 - RNA, 45 nt, Mus musculus
cccaugacggugccauuuccuuccuugucaaacacacgaaggccu

SEQ ID NO: 22720 - RNA, 31 nt, Mus musculus
cgccgaggugcucaagguccuggggaacccc

SEQ ID NO: 22721 - RNA, 46 nt, Mus musculus
agcuguuugaccgaacaggugauggcaagauccuguacagccagug

SEQ ID NO: 22722 - RNA, 49 nt, Mus musculus
ugauguuuuauccuuacaaugugaauaauggcacugaucggugcuucua

SEQ ID NO: 22723 - RNA, 46 nt, Mus musculus
acagagcgggguugaggggcuuggggaugaggaggacgggcagcag

SEQ ID NO: 22724 - RNA, 42 nt, Mus musculus
ucuacugggcagggccuucaccaaggcugccagguaccgcug

SEQ ID NO: 22725 - RNA, 43 nt, Mus musculus
aagaggaagaggaagaggaagaggaagaggaagaaaagaaaga

SEQ ID NO: 22726 - RNA, 41 nt, Mus musculus
uccuagguuacuuaaagacaaaagacuuuuuggugcuccaa

SEQ ID NO: 22727 - RNA, 45 nt, Mus musculus
agcauggagaccaaagcaccuuuacacucccauauguuccugcag

SEQ ID NO: 22728 - RNA, 73 nt, Mus musculus
aggacaauaaagacgacauuuaaguuuuucaguccggccuuaaugucuuuuauaaaaaguggagggucguuga

SEQ ID NO: 22729 - RNA, 69 nt, Mus musculus
agagacccacuaggcaaggcuucccacccucggggaggggcaggggcagagccggggagcaaccugggg

SEQ ID NO: 22730 - RNA, 46 nt, Mus musculus
caaaccaguccacaaacacagagagaugcgugggcugacaucugcu

SEQ ID NO: 22731 - RNA, 48 nt, Mus musculus
cguguccgccgugguggucguaaacgcccaguuccuaagggugcaacu

SEQ ID NO: 22732 - RNA, 46 nt, Mus musculus
agaacccaggugcagggugagcagugcugaaugaaaauccagaggg

SEQ ID NO: 22733 - RNA, 46 nt, Mus musculus
gaccuuccuccuaaccaugucagucuucuccuaauggccuucagau

SEQ ID NO: 22734 - RNA, 46 nt, Mus musculus
uugagugaaggugucuuaguuaagguggccauugcugugaagagau

SEQ ID NO: 22735 - RNA, 23 nt, Mus musculus
uuaaggcccagguugcaaggacu

SEQ ID NO: 22736 - RNA, 42 nt, Mus musculus
agguuugugaauuuuuguauuuuaggcaaagaaaaugcugau

SEQ ID NO: 22737 - RNA, 46 nt, Mus musculus
uucaucagggauuuuugcucuuaaccgcugagccaucucaccagcc

SEQ ID NO: 22738 - RNA, 46 nt, Mus musculus
gaguguaugugaguguguguguauguuuauaugagugugcaugugu

SEQ ID NO: 22739 - RNA, 46 nt, Mus musculus
ggccauuuuuacuauguuaauucugccaaucuaugagcaugggagu

SEQ ID NO: 22740 - RNA, 46 nt, Mus musculus
gcggucaugcuaggucccuuuuugugaacacuccauagccucagua

SEQ ID NO: 22741 - RNA, 67 nt, Mus musculus
cccugucuccauaaugauguccucaccccccccccaugccaccugugaugguuuguauauucuugga

SEQ ID NO: 22742 - RNA, 83 nt, Mus musculus
uaauuauuuuuuuacacuccauauuuuauucccccuauccacccacccuuugacuguuacacaucccaugccuccuccacacc

SEQ ID NO: 22743 - RNA, 46 nt, Mus musculus
uuuugcuuguuguauacuaacuuaagcccaaagccagccagcagau

SEQ ID NO: 22744 - RNA, 46 nt, Mus musculus
uauauacacacacacauauauauaauucuauaaggugggcuuuugg

SEQ ID NO: 22745 - RNA, 46 nt, Mus musculus
uaaacucauugaauaggcgguggacauuuucuuaucaaguugagau

SEQ ID NO: 22746 - RNA, 82 nt, Mus musculus
gcaaauaagaggccuuugucuucuagaaugauuagaguagaggagaauuggauaguacagaauaugcucuaguuucagucag

SEQ ID NO: 22747 - RNA, 31 nt, Mus musculus
ucaaaguguauguauggucuaacaucuagaa

SEQ ID NO: 22748 - RNA, 46 nt, Mus musculus
uugcaggaaaaugggugaacuuagaaaguagaacauugagugaggu

SEQ ID NO: 22749 - RNA, 31 nt, Mus musculus
ugugagagugcaaauuaauauuguggaaguc

SEQ ID NO: 22750 - RNA, 98 nt, Mus musculus
ccuuuccuuaguguucauuaauuaggucauuguuuauaacaucaagauuuuggaagcaccaauagguaucugcuuagacagauugugguauacgagga

SEQ ID NO: 22751 - RNA, 46 nt, Mus musculus
uauaaaaacuuaauuauuuucuauaaucuucuagaagguccuggua

SEQ ID NO: 22752 - RNA, 46 nt, Mus musculus
cuaggaucgaucccuagcacugaaaacuaguucguauaacaaagau

SEQ ID NO: 22753 - RNA, 45 nt, Mus musculus
uguuuuccaaguuguacuuccaagaagguaucuaugggaauaguu

SEQ ID NO: 22754 - RNA, 105 nt, Mus musculus
uaaaugcugaaaaauuaguuaucgauuuauaguuccuccaaagguuuuccaaauugaaagaauuugaaaauaaugcaagucuuuauucuauaauacaggaaucua

SEQ ID NO: 22755 - RNA, 44 nt, Mus musculus
acuguugcgagauucucaggaaguugaagggaacuacuaggaaa

SEQ ID NO: 22756 - RNA, 42 nt, Mus musculus
ggaugauguacuaaauuaacaaauuugauuauucauacaaca

SEQ ID NO: 22757 - RNA, 45 nt, Mus musculus
uauaaacguauguacguguuuauacuggcuuuguauguaaggaga

SEQ ID NO: 22758 - RNA, 45 nt, Mus musculus
caugagguagagugcuugcuuagugccaaaaauaaaccggaaagc

SEQ ID NO: 22759 - RNA, 23 nt, Mus musculus
aguguagugguagauuaguguau

SEQ ID NO: 22760 - RNA, 45 nt, Mus musculus
augaauacaagacauugacuguguuaauaaaauccuguuuggaga

SEQ ID NO: 22761 - RNA, 45 nt, Mus musculus
uccuggccuuucuccuuuuuucagauguuucauaaagccccuuuu

SEQ ID NO: 22762 - RNA, 46 nt, Mus musculus
uuuaacaguauauagccugaaguuguacauggucucugcaugagau

SEQ ID NO: 22763 - RNA, 41 nt, Mus musculus
gcaggaggaauucauguucuuaaggggacagaggggugggu

SEQ ID NO: 22764 - RNA, 24 nt, Mus musculus
caaaagaugaaauuaauccacuua

SEQ ID NO: 22765 - RNA, 78 nt, Mus musculus
acuuuuguuuuuuugauguuaaacaguaaauggcaguagugaccaaggacagugcuuauacacacuauacuggaggga

SEQ ID NO: 22766 - RNA, 47 nt, Mus musculus
aaccugcuucaaucugaugauauaaacuuguaaaacauugccgauca

SEQ ID NO: 22767 - RNA, 46 nt, Mus musculus
uacauuggcucccaggaugcucucauagcacauuacccacgaaucu

SEQ ID NO: 22768 - RNA, 42 nt, Mus musculus
uuuccaauauacgucucugacuuuccgagcuggguggaacag

SEQ ID NO: 22769 - RNA, 46 nt, Mus musculus
uaaauaugaugcaugguggcacacacauuuaaauccuagcacuuag

SEQ ID NO: 22770 - RNA, 46 nt, Mus musculus
guggccuaauguguuugagacaucuccccauguaauccaggcaguu

SEQ ID NO: 22771 - RNA, 31 nt, Mus musculus
gcucccauaacugccuggauuacauggggag

SEQ ID NO: 22772 - RNA, 53 nt, Mus musculus
cuuuacuugaggaugcguuaauggacaggcaagugacuaaaggaaaugcagaa

SEQ ID NO: 22773 - RNA, 45 nt, Mus musculus
auccucaaguaaaggcgucacagcauagauguagucuuuccccau

SEQ ID NO: 22774 - RNA, 84 nt, Mus musculus
ugcaaaauggaguguuaaaaucacucuccuucuuguuugaguauaucggcgaaauggggaaagacuacaucuaugcugugacgc

SEQ ID NO: 22775 - RNA, 45 nt, Mus musculus
cacauuaaguucaggaacucuguauucauucauuaaggcaggcag

SEQ ID NO: 22776 - RNA, 31 nt, Mus musculus
ccuuuccugaacuuugagguuguuuaaaagu

SEQ ID NO: 22777 - RNA, 46 nt, Mus musculus
ugauguuuuuuucuuuauuuacauuccagucauuguccccguaguu

SEQ ID NO: 22778 - RNA, 46 nt, Mus musculus
acccacauggcaauuaucaaccaucucuaauuccaaauuccaauag

SEQ ID NO: 22779 - RNA, 59 nt, Mus musculus
cucgguggauuuaauaaaaacaacauaaaguuggggaggaugauggaggaagggagaga

SEQ ID NO: 22780 - RNA, 34 nt, Mus musculus
cuaccgucaauacauuugguuauaucgcaaaggc

SEQ ID NO: 22781 - RNA, 46 nt, Mus musculus
cuuuuucaugucuguucuuuaaaaugggggugagucuaggcaggag

SEQ ID NO: 22782 - RNA, 42 nt, Mus musculus
caccaccaauuaaagaucuccugccuagacucacccccauuu

SEQ ID NO: 22783 - RNA, 46 nt, Mus musculus
ccaauacuucaggguacucuucacccaaauauucauacagcaccac

SEQ ID NO: 22784 - RNA, 42 nt, Mus musculus
ugauggaaacaauugagaaaauuauggguaaucuaggcgcag

SEQ ID NO: 22785 - RNA, 46 nt, Mus musculus
guuaguugauacaacuguggaguuggcaaacaaaguaggugcagca

SEQ ID NO: 22786 - RNA, 46 nt, Mus musculus
aagauuuugagaccagcuucagcuacaaaguaaaauuuugucucaa

SEQ ID NO: 22787 - RNA, 42 nt, Mus musculus
agagauucuuccaccuuucuuuaaacacuuuuggcaacacag

SEQ ID NO: 22788 - RNA, 46 nt, Mus musculus
ugcccugggcaucccuucuuuauugccuuucuuaaaagcugugugc

SEQ ID NO: 22789 - RNA, 46 nt, Mus musculus
uguugauugaugaagauuacuaugcuagaguggaaggccgagagau

SEQ ID NO: 22790 - RNA, 35 nt, Mus musculus
guuuaaccagauucuuccucuguugauguccccua

SEQ ID NO: 22791 - RNA, 93 nt, Mus musculus
gauguagaugaaucaacacuuaguccagaagaacaaaaagaaagaaaaauaaugaaguugcuuuuaaaaauuaagaaugguacaccuccaaug

SEQ ID NO: 22792 - RNA, 46 nt, Mus musculus
uuaaaaccugaugacauucaguacuuugauaaacuauugguaagug

SEQ ID NO: 22793 - RNA, 44 nt, Mus musculus
aaccgcccacuuucugaugaagaauuagaugcuauguucccaga

SEQ ID NO: 22794 - RNA, 46 nt, Mus musculus
ucuguuuugggggucucaucccaucuguuuuuacgagcacuggaag

SEQ ID NO: 22795 - RNA, 45 nt, Mus musculus
gcauggccuggugugucgccucgcccaggaguagcagcucccgca

SEQ ID NO: 22796 - RNA, 46 nt, Mus musculus
ugaaacaccuggcgcaaccccaggcucaaaaauaugggacccuaca

SEQ ID NO: 22797 - RNA, 45 nt, Mus musculus
cgaaaaacagagagagagagagagagagagagagagagagaagag

SEQ ID NO: 22798 - RNA, 42 nt, Mus musculus
ggucaaggcugaaaagagcaagaaaaaaggaggaggaggagg

SEQ ID NO: 22799 - RNA, 45 nt, Mus musculus
agagaaauuaggcaacaacuagcagaaaaagcuaaagcuggagaa

SEQ ID NO: 22800 - RNA, 56 nt, Mus musculus
uccuaaaaugaaugcuagaaccuacauggauguuaugcgagaacaacauuugacua

SEQ ID NO: 22801 - RNA, 42 nt, Mus musculus
agcuaguguuagaaagaaugacacuaccaauugggcaugauc

SEQ ID NO: 22802 - RNA, 38 nt, Mus musculus
uuuacaaauuagacuuucagccugcaugaauuaauagg

SEQ ID NO: 22803 - RNA, 46 nt, Mus musculus
uuuggcaugcuuaugaauuugcuuuucguuuuuaaagaccccuuua

SEQ ID NO: 22804 - RNA, 57 nt, Mus musculus
ccgaucgggaagaugaauacaaaaagcauaggcggaccaugauaauuuccccagagc

SEQ ID NO: 22805 - RNA, 42 nt, Mus musculus
uuugucuuaaauaaugguuuauucauuuguguguguggugag

SEQ ID NO: 22806 - RNA, 46 nt, Mus musculus
cacacacacagagagagagagagagagagagagagagagagucugu

SEQ ID NO: 22807 - RNA, 30 nt, Mus musculus
uuucucucaaaaaaccaaaacaaaaauccu

SEQ ID NO: 22808 - RNA, 45 nt, Mus musculus
uauaucuuucugauuuggguggucgucauacuauacugaugaggu

SEQ ID NO: 22809 - RNA, 46 nt, Mus musculus
ggcaugggccaccaauauaaaaagucuuaucuaauggugggguuau

SEQ ID NO: 22810 - RNA, 45 nt, Mus musculus
ugcauaugcaugacacacauacaaauauuaaucuguuacuugggg

SEQ ID NO: 22811 - RNA, 46 nt, Mus musculus
cugagaaucuucugaauugagaggaaaagaugauuuagccuuaaag

SEQ ID NO: 22812 - RNA, 45 nt, Mus musculus
accaaacugauguaccaaaacuggguuuuaaauaccccuuuucag

SEQ ID NO: 22813 - RNA, 45 nt, Mus musculus
gaaaaaaaaaggaaggaagcaagcaaacaaggaaggaaggaagca

SEQ ID NO: 22814 - RNA, 42 nt, Mus musculus
ggcgcugauaaaaaaggaucaaucaguuuuaaauuaggggag

SEQ ID NO: 22815 - RNA, 42 nt, Mus musculus
gagaagcaaccagauuccauaaggaaaguaaccagagaagac

SEQ ID NO: 22816 - RNA, 44 nt, Mus musculus
cuucgccauuuuguccacucgaacacacagacggaacuggcgcu

SEQ ID NO: 22817 - RNA, 46 nt, Mus musculus
cucucugaacaacaccucagggucagcacagcagguaccguuugag

SEQ ID NO: 22818 - RNA, 43 nt, Mus musculus
gcgcgcgacgucagguagcgagcggagguuuuccgggcggcgg

SEQ ID NO: 22819 - RNA, 47 nt, Mus musculus
gauuagccccuuugcugaucuucucaaagcccuccuuggcaauagau

SEQ ID NO: 22820 - RNA, 46 nt, Mus musculus
ucuuuuguuacuuugggacuuccccaacucuguucaauaaucacag

SEQ ID NO: 22821 - RNA, 43 nt, Mus musculus
acuuguccaacggugcuucaaaacaugggaggcuagauuggag

SEQ ID NO: 22822 - RNA, 42 nt, Mus musculus
ucucaaguuaaucuuucacugccaaagcggccuugggagcag

SEQ ID NO: 22823 - RNA, 45 nt, Mus musculus
uagcccgcccuugcuccggcgcucggccuggaucgcguggucccc

SEQ ID NO: 22824 - RNA, 46 nt, Mus musculus
uggcuaagcugguggaagcuauuaggaccaauuauaaugaccgaua

SEQ ID NO: 22825 - RNA, 46 nt, Mus musculus
ucucauguaguacaggcugaccugaagcauauuguauagccaagga

SEQ ID NO: 22826 - RNA, 45 nt, Mus musculus
gcaguucaugagcauccuacugcuaacuuaaguguuacugaugga

SEQ ID NO: 22827 - RNA, 44 nt, Mus musculus
guguguguguguuuguuuguuaguuuuguuuggugauagcauag

SEQ ID NO: 22828 - RNA, 45 nt, Mus musculus
acuucuuauucccuuauauauuuguagacauucauugaaacccag

SEQ ID NO: 22829 - RNA, 44 nt, Mus musculus
augugccugagccaucuuucugucucucuuccauguuuuuugau

SEQ ID NO: 22830 - RNA, 46 nt, Mus musculus
uuucaaugccugcuucuauuuccuuaggggauaugggacugcuuag

SEQ ID NO: 22831 - RNA, 46 nt, Mus musculus
uaaaauaguaacaccaaaagaucauuaaccacagguuagcauacag

SEQ ID NO: 22832 - RNA, 41 nt, Mus musculus
gggcagacugcuccaauauugacaaaauucuugaaccaccu

SEQ ID NO: 22833 - RNA, 45 nt, Mus musculus
aguuauaaggauccaaaucuccuaauagcccauauugaaccucug

SEQ ID NO: 22834 - RNA, 44 nt, Mus musculus
agauggcucagccguuaaaggcuaggcucacagccaaaaauaua

SEQ ID NO: 22835 - RNA, 45 nt, Mus musculus
agugggaacccaguguucuuccuguccccaacacuguuuccuuag

SEQ ID NO: 22836 - RNA, 46 nt, Mus musculus
caacagcuuuauuuauugaugggaugcacuucaugaucauucugag

SEQ ID NO: 22837 - RNA, 46 nt, Mus musculus
aaucaucuguagcaaaacuaggaucagugugccguaggauuuauag

SEQ ID NO: 22838 - RNA, 59 nt, Mus musculus
aaauuugugaugaaauauaaucugaugucgaaggauaaccugauuguaccaauuuuaga

SEQ ID NO: 22839 - RNA, 42 nt, Mus musculus
ugagcccacaguuaucuucuaagaaguuauguuugcagugaa

SEQ ID NO: 22840 - RNA, 46 nt, Mus musculus
cuuggaccauguguaacgggacugcuaucugaauaaaauacuaggu

SEQ ID NO: 22841 - RNA, 45 nt, Mus musculus
gguuugguggccacugagguguggaugugguuuuauaucggagag

SEQ ID NO: 22842 - RNA, 42 nt, Mus musculus
uggcgacgccggggaagcgcgggccuacuucaccacaccuau

SEQ ID NO: 22843 - RNA, 45 nt, Mus musculus
uuagcuugaguuauggaggaaggcucuuagauaagauguggcuag

SEQ ID NO: 22844 - RNA, 46 nt, Mus musculus
ugucuuuuacccaaguauuuggagacagaacauguuuuugcagcaa

SEQ ID NO: 22845 - RNA, 46 nt, Mus musculus
ggguagggaaggaacuaaagucagauuaggguacccaagagcagaa

SEQ ID NO: 22846 - RNA, 46 nt, Mus musculus
acggguaacuaaguaugcacuuaucgagucaucuccuuagccccag

SEQ ID NO: 22847 - RNA, 65 nt, Mus musculus
gugugggucuuauuucugaagacagcagcaaagccccagcuuaaacugcugauaacuauuuaaac

SEQ ID NO: 22848 - RNA, 47 nt, Mus musculus
uuguagucuugggcuacccaaaauuaugccuuugaagucaaggaaca

SEQ ID NO: 22849 - RNA, 46 nt, Mus musculus
auuauauauguagccagggcaugggcuuaaacacauaagccccugu

SEQ ID NO: 22850 - RNA, 42 nt, Mus musculus
ccuauuaucauuauauugauaagcagggcagcaugcaggcau

SEQ ID NO: 22851 - RNA, 56 nt, Mus musculus
agucaugagagcugucuuaggguuccauugcuggggagagacaccaugaccaaggc

SEQ ID NO: 22852 - RNA, 42 nt, Mus musculus
cuguuuccagaucuuuggcguuggcuuuaccugcaggcagug

SEQ ID NO: 22853 - RNA, 45 nt, Mus musculus
ucugugaggcgcuuuuguccguguguauuaucauaguggcgagaa

SEQ ID NO: 22854 - RNA, 46 nt, Mus musculus
aguggagauagagaaagauacuagagcauccaugagaacaaaagga

SEQ ID NO: 22855 - RNA, 45 nt, Mus musculus
gcuguagguacaggugcacacaugcuauauuuacaguguagaggu

SEQ ID NO: 22856 - RNA, 46 nt, Mus musculus
guuggaagacucacaauuuuccauuucaaaacugcaguccuguguu

SEQ ID NO: 22857 - RNA, 45 nt, Mus musculus
cccauguggccacuuugccugauugucaugugauggcggguagga

SEQ ID NO: 22858 - RNA, 45 nt, Mus musculus
guaucucuaagauaauugaggccuuugagaaauacaaaagaagaa

SEQ ID NO: 22859 - RNA, 44 nt, Mus musculus
agguugacugauuagugaaauaaucauaugcugaagagaacagg

SEQ ID NO: 22860 - RNA, 42 nt, Mus musculus
ucuggcuccacaccaagucuagcacauuccuaguugguagag

SEQ ID NO: 22861 - RNA, 24 nt, Mus musculus
cuacagaccaagacaaccccagcc

SEQ ID NO: 22862 - RNA, 46 nt, Mus musculus
gcuggcacauacauguaaucccaguacucagaagauggaagcugga

SEQ ID NO: 22863 - RNA, 80 nt, Mus musculus
cagaaaucaugcugggugcuggugaugcaggagagccuggucuacagaguuaagggcagccagggcuacacagagaaaaa

SEQ ID NO: 22864 - RNA, 44 nt, Mus musculus
acauuuuauguuuuuuagaugcuuuauuaaauacauggccaaac

SEQ ID NO: 22865 - RNA, 46 nt, Mus musculus
uucucuuugaccucauugggaaaauguuggaguaugaucccgccaa

SEQ ID NO: 22866 - RNA, 46 nt, Mus musculus
gugaacauuuaacuguuuuaggaaacgcagauauuuccaucaugau

SEQ ID NO: 22867 - RNA, 45 nt, Mus musculus
gcagagagacgauaugguguaauccaguagugcucuugguguggu

SEQ ID NO: 22868 - RNA, 46 nt, Mus musculus
cagguauguugucugcucaauacuaacccgaccuacacaugcagaa

SEQ ID NO: 22869 - RNA, 45 nt, Mus musculus
augaugaacaccacagcacauugguaucuacaagacauuauagag

SEQ ID NO: 22870 - RNA, 46 nt, Mus musculus
uuugcauaguaauaaauugacucauacagacuugaagccugaaaac

SEQ ID NO: 22871 - RNA, 46 nt, Mus musculus
gauagaaccuuguauggauggaaagcauuuauuaucagacauagau

SEQ ID NO: 22872 - RNA, 47 nt, Mus musculus
guaaaaauaguuaaaaauguggauagauacugugaagcugcucaauc

SEQ ID NO: 22873 - RNA, 46 nt, Mus musculus
uuuauuacaguuagcagggagacagcacgugauacaucucuuagau

SEQ ID NO: 22874 - RNA, 45 nt, Mus musculus
caacuaaauaguauuugcagcuuccuggcuggagaagggacagag

SEQ ID NO: 22875 - RNA, 45 nt, Mus musculus
uuuuuuuucuuuuuuuuuuugcuuucauuucuuuuggugggaggg

SEQ ID NO: 22876 - RNA, 97 nt, Mus musculus
ugccgcccacuugacguguccagaagagucaccgaaggaaaagaucgaggaguguagaggaugaugaggagggucaccugaucugucagaguggaga

SEQ ID NO: 22877 - RNA, 48 nt, Mus musculus
guaugagugccuuuuaaacguucugaaagguuuuauuucccauggaga

SEQ ID NO: 22878 - RNA, 54 nt, Mus musculus
uggaagcagauaccagaugcauaguagcaaguccucugguaggaguggaagaag

SEQ ID NO: 22879 - RNA, 29 nt, Mus musculus
cauaaaugagaaagcuuaucauagucgac

SEQ ID NO: 22880 - RNA, 46 nt, Mus musculus
uauagaacguuugccuaccguguauaaaauccugggggccauauau

SEQ ID NO: 22881 - RNA, 42 nt, Mus musculus
gcugggaagauagcuuagcugguacuuaagcuuggcagagga

SEQ ID NO: 22882 - RNA, 53 nt, Mus musculus
agacugggauuauggaacauggagaagcagcagcagucacaaaagaaagaaga

SEQ ID NO: 22883 - RNA, 48 nt, Mus musculus
auuagggucacuugugguuacguuggucggagacuugguuuggguaga

SEQ ID NO: 22884 - RNA, 44 nt, Mus musculus
gguugugaggcaccaugugguugcugagauuugaacucaguacc

SEQ ID NO: 22885 - RNA, 45 nt, Mus musculus
aaaucccagcaaccacaugguggcucacaaccaucuguagagggu

SEQ ID NO: 22886 - RNA, 46 nt, Mus musculus
uacauauaauaaauaaauaaauaaauaaauaaauaaauagaaaaua

SEQ ID NO: 22887 - RNA, 46 nt, Mus musculus
gugacaauguacucacauacauaaaauaaguaaaucuuuaaaaagg

SEQ ID NO: 22888 - RNA, 44 nt, Mus musculus
aaccaucuguaaugggaucugaugcccuugucugguguaucuga

SEQ ID NO: 22889 - RNA, 45 nt, Mus musculus
acaugucaccuguauguaugucuucaaagcuaagcaguuggcagu

SEQ ID NO: 22890 - RNA, 46 nt, Mus musculus
gaaacuuugacuacuuaaucuguugaaaugacaaggauaaaaggaa

SEQ ID NO: 22891 - RNA, 42 nt, Mus musculus
ggggaagccuccaaauaguuuucuucaucucugagguaaaga

SEQ ID NO: 22892 - RNA, 64 nt, Mus musculus
aggaagacugcuccugcugcaacccuggcugcacagcaagauuugacucaaaaaaaggggggag

SEQ ID NO: 22893 - RNA, 41 nt, Mus musculus
gucggugugaugaggagagacugacgggagaguagggcguc

SEQ ID NO: 22894 - RNA, 46 nt, Mus musculus
uccugcccauuuuuuaaacugaguaaagcagaggucgcccuaaauu

SEQ ID NO: 22895 - RNA, 46 nt, Mus musculus
uuuaaucuaguuaaauauaaaugaaauguuaggggccagccaagcc

SEQ ID NO: 22896 - RNA, 30 nt, Mus musculus
ugcaguccaaauuucuguauucaagcagac

SEQ ID NO: 22897 - RNA, 59 nt, Mus musculus
ugcucuuccagagaccuggguucaaaucucagcacccccauggcagcucacaauuaucu

SEQ ID NO: 22898 - RNA, 46 nt, Mus musculus
uaagugggguuaacuaaugaaaugaaaucguuaagcuuuggggcug

SEQ ID NO: 22899 - RNA, 46 nt, Mus musculus
accaugugcaggccuaaugccuauaagggccacaagagcaucagau

SEQ ID NO: 22900 - RNA, 46 nt, Mus musculus
aaaucccagcaaccacaugguggcucacaaccaucucuaacaagac

SEQ ID NO: 22901 - RNA, 46 nt, Mus musculus
gaaaaaaguuuaaauucuaugaggaucaucacaaaugugaacagac

SEQ ID NO: 22902 - RNA, 42 nt, Mus musculus
agugauggguaguaaugaccuguguaaugcugguaaugggau

SEQ ID NO: 22903 - RNA, 46 nt, Mus musculus
ccagaggaacauucuauucugcgcaucaccuauaggcuggcuccag

SEQ ID NO: 22904 - RNA, 46 nt, Mus musculus
aaaaaagaaaaaaaagaaaacugaucagggcagcggugguacacac

SEQ ID NO: 22905 - RNA, 42 nt, Mus musculus
auccaacgaauagcuguaaucuuuuuuuuuaaagggccagau

SEQ ID NO: 22906 - RNA, 49 nt, Mus musculus
accucuucuauuuugcguuuuuuagaacaaguuggaaguguggagucac

SEQ ID NO: 22907 - RNA, 45 nt, Mus musculus
uuuauacaauacuuagaauuauacaccuguuaucaccagucugag

SEQ ID NO: 22908 - RNA, 42 nt, Mus musculus
gacccagucggugggaaggauuuguugaugucgaaauccgag

SEQ ID NO: 22909 - RNA, 52 nt, Mus musculus
aauuuggggagccgagacaccccguccuaggcgaaugaagccccccagccac

SEQ ID NO: 22910 - RNA, 46 nt, Mus musculus
cauuuguccuuucaaacugcauuguaauccgggcaggauaaaucag

SEQ ID NO: 22911 - RNA, 46 nt, Mus musculus
gcuucuuugcuggcccagggaugacuuccucgcugcaucggcccuu

SEQ ID NO: 22912 - RNA, 46 nt, Mus musculus
aaauaauauuuuaaucacuagugaacugucuauuagauuuuuggag

SEQ ID NO: 22913 - RNA, 45 nt, Mus musculus
uacuggcugguuuugugugucaacuugacacagcuggaguuacca

SEQ ID NO: 22914 - RNA, 46 nt, Mus musculus
cauacaggcuagaacaucuuuugaguaguacauuuaaagagcccag

SEQ ID NO: 22915 - RNA, 46 nt, Mus musculus
uccuuuuauauaaaggguaaaaaauaucuuugcaugugaauaggag

SEQ ID NO: 22916 - RNA, 46 nt, Mus musculus
acuuucauccuguuuauaguguauauuaugugacacaaugugguag

SEQ ID NO: 22917 - RNA, 46 nt, Mus musculus
cccauuaugggugcugcuaucccugggcugguggucuuggguucua

SEQ ID NO: 22918 - RNA, 44 nt, Mus musculus
guugugagccaccaugugguugcugggauuugaacucagucagu

SEQ ID NO: 22919 - RNA, 42 nt, Mus musculus
gcuaguugccauguggaugcugggaacugaacacaagcccuu

SEQ ID NO: 22920 - RNA, 42 nt, Mus musculus
auccagcccccagauauauagauauuuaauuucagcuaggga

SEQ ID NO: 22921 - RNA, 46 nt, Mus musculus
uugaagacagcuacagugaacuuacauauaauaauaaaucuuuggg

SEQ ID NO: 22922 - RNA, 42 nt, Mus musculus
cacacacacacacacacacacacacacacacacgagauaggg

SEQ ID NO: 22923 - RNA, 42 nt, Mus musculus
guaucacacagagacacacacacacagacaaugugauuucag

SEQ ID NO: 22924 - RNA, 49 nt, Mus musculus
agaggguagaguucaagguuaucuauccacagccauagagggaguucca

SEQ ID NO: 22925 - RNA, 42 nt, Mus musculus
gaaaaagggggaagaggggaaaaugagggaaaaagggaaaaa

SEQ ID NO: 22926 - RNA, 68 nt, Mus musculus
aaucaagaacggcugugugcauuuaaagauccauaucaacaagaucuugggauaggugagagucgaau

SEQ ID NO: 22927 - RNA, 60 nt, Mus musculus
cucucaugaaaaugggacaauauuauguuccaaagggagcacguguuauggucuguggga

SEQ ID NO: 22928 - RNA, 45 nt, Mus musculus
guuucacagaucccuagguucaaucccuuggguuauaauaaauaa

SEQ ID NO: 22929 - RNA, 46 nt, Mus musculus
ugaaaagacugucucaaaaagaaaguagaaagugaaaaaggaagac

SEQ ID NO: 22930 - RNA, 46 nt, Mus musculus
cuuccuguuucucuugcggaacacuauuuuagucuagacaggccuc

SEQ ID NO: 22931 - RNA, 45 nt, Mus musculus
gaaaaagcaggaaacacacacacacacacacacacacacacacac

SEQ ID NO: 22932 - RNA, 46 nt, Mus musculus
aggaaggaaggaagaaagaaagaaaauacucauuaauacggucuau

SEQ ID NO: 22933 - RNA, 23 nt, Mus musculus
cuucaugacugguuuugacagca

SEQ ID NO: 22934 - RNA, 66 nt, Mus musculus
cccuuuucuggugugucugaagacagcuaaaguguacuuauauauaauaauaaauaaaucuuuggg

SEQ ID NO: 22935 - RNA, 45 nt, Mus musculus
ugaguacacuauagcuauacagaugguugugagccuucauguggu

SEQ ID NO: 22936 - RNA, 46 nt, Mus musculus
ugaacaugauggaggcggcagcagcagagcccucccuugaccugga

SEQ ID NO: 22937 - RNA, 46 nt, Mus musculus
aauaagccuuucugagccuggucgugcacaccuguaauuccagcag

SEQ ID NO: 22938 - RNA, 42 nt, Mus musculus
uccaagugcugggauuaaaggcgugcaccaccacgcccaccg

SEQ ID NO: 22939 - RNA, 45 nt, Mus musculus
uuccuuggguuuacuuuucauuuuguccagaguauuuugcucuca

SEQ ID NO: 22940 - RNA, 46 nt, Mus musculus
ugauuggacggggucgauacggagcaguauauaaagguuccuugga

SEQ ID NO: 22941 - RNA, 84 nt, Mus musculus
gagcguccaguugcuguaaaaguauuuucuuuugcaaaccgucagaauuuuauaaaugaaaaaaacauuuacagagugccuuug

SEQ ID NO: 22942 - RNA, 41 nt, Mus musculus
cauacuggcuugcucaucugcuuucuuguuuuguggugggg

SEQ ID NO: 22943 - RNA, 45 nt, Mus musculus
gugacuagaggacuggcuuaucuucacacagaauuaccacgagga

SEQ ID NO: 22944 - RNA, 43 nt, Mus musculus
agugagauccugucuuggaagagagagagagagagagagagag

SEQ ID NO: 22945 - RNA, 76 nt, Mus musculus
uccugguccucuggcucuuguggucuguucaccccuucuugugauguucugagucuaguguagguguuguguugug

SEQ ID NO: 22946 - RNA, 69 nt, Mus musculus
cgcaaucucccaccgagauuuaaacagcaggaauguccugguaaagaaugacggcgcguguguuaucag

SEQ ID NO: 22947 - RNA, 68 nt, Mus musculus
ugacuuugguuuauccaugaggcuaacuggaaaucggcuggugcgcccaggggaagaagauaaugcgg

SEQ ID NO: 22948 - RNA, 45 nt, Mus musculus
auauggcaccagaagugcuagaaggagcugugaaccugagggacu

SEQ ID NO: 22949 - RNA, 45 nt, Mus musculus
augaucaagauucauuaaccaucacaauaccuauaauuuugccau

SEQ ID NO: 22950 - RNA, 45 nt, Mus musculus
guucaaaucccagcaaacaugguggcucacaaccauccauaauga

SEQ ID NO: 22951 - RNA, 57 nt, Mus musculus
acugcuuucugacaggaagauugaaacaugcaagaguuaaaugacuuucccgaggaa

SEQ ID NO: 22952 - RNA, 46 nt, Mus musculus
uucuuguguccagagagaagcagagacccaaguucccagaagccug

SEQ ID NO: 22953 - RNA, 46 nt, Mus musculus
ucuuacuuuuggauaauuuucuuucuuugcugaaguuccacuuaag

SEQ ID NO: 22954 - RNA, 60 nt, Mus musculus
aggucacucaaggaaacaauugaagacugcugggaccaggaugcagaggcucggcucacu

SEQ ID NO: 22955 - RNA, 48 nt, Mus musculus
gcacagugugcugaggagaggauggcugaacucaugaugauaugggag

SEQ ID NO: 22956 - RNA, 46 nt, Mus musculus
ccucuuccucauauauugaagacucuauccaucauacugacagcau

SEQ ID NO: 22957 - RNA, 46 nt, Mus musculus
uuaauuaugaacgacagcaagcacaagcucgaaucccuagcccaga

SEQ ID NO: 22958 - RNA, 46 nt, Mus musculus
gucugcuuacagcugacagaagaagacuuggagacuaauaagcuag

SEQ ID NO: 22959 - RNA, 46 nt, Mus musculus
uccugauguuccaccugcucagaucuauccucucccuaagcaacag

SEQ ID NO: 22960 - RNA, 43 nt, Mus musculus
guagaaacuggaguugccaagaugaauacaaucaaugcagcag

SEQ ID NO: 22961 - RNA, 42 nt, Mus musculus
aagggguucuggaucguuugguagauaggagggaacggccau

SEQ ID NO: 22962 - RNA, 42 nt, Mus musculus
aacaagauauccuuacacaagguguuacaagcacagcugcag

SEQ ID NO: 22963 - RNA, 42 nt, Mus musculus
uucucuggaucuuucagccacaaauauccuggauggcagcag

SEQ ID NO: 22964 - RNA, 46 nt, Mus musculus
uuaaauuacauuuucuauuuauaauaacuucagaaguaagugauag

SEQ ID NO: 22965 - RNA, 46 nt, Mus musculus
cuggagcucaguucuuaggauuaaguuuaucucacuugugcccagg

SEQ ID NO: 22966 - RNA, 46 nt, Mus musculus
uaggucauuuuaacaaauuuugaagucuauaauacacagcaugcag

SEQ ID NO: 22967 - RNA, 44 nt, Mus musculus
cacccccaacacacacacacacauaacuauaaaugacagaggag

SEQ ID NO: 22968 - RNA, 45 nt, Mus musculus
aggcaucauaucccccuauagaugguugugagccaccaugugguu

SEQ ID NO: 22969 - RNA, 46 nt, Mus musculus
cuguaaguguccacauuaacccagaggaaaucuccaagugcccaaa

SEQ ID NO: 22970 - RNA, 46 nt, Mus musculus
cuguuccucucuuuaaguuucucaugguuuauagagccugucccuu

SEQ ID NO: 22971 - RNA, 49 nt, Mus musculus
agaauugagaauaaagauguuaccauugaauuuaaucaccagaccaccu

SEQ ID NO: 22972 - RNA, 46 nt, Mus musculus
guuuucauuuuaccuuuucagugauuaaagcuagguauuugcauag

SEQ ID NO: 22973 - RNA, 46 nt, Mus musculus
uacaugauggggcaaauauuucauucuguuuguuuuuaauaacaag

SEQ ID NO: 22974 - RNA, 46 nt, Mus musculus
uuuguauaagccaucugagaccuugcuaugcuguauaaguugugug

SEQ ID NO: 22975 - RNA, 46 nt, Mus musculus
auaaagcagaucacuuuccuuuuguauuaucuauggaugccacuau

SEQ ID NO: 22976 - RNA, 42 nt, Mus musculus
agacaguucccaaaugggugcugggcauagaaccuggguccu

SEQ ID NO: 22977 - RNA, 45 nt, Mus musculus
caucagaucucacuacagaugguugugagccaccauucggaggcu

SEQ ID NO: 22978 - RNA, 42 nt, Mus musculus
guuuaggaugaaugaaguagaaauugagauagaagaaucuag

SEQ ID NO: 22979 - RNA, 92 nt, Mus musculus
aucguguccggcuggagaacuagcacuuuaaagacaaaacagccagagaggaauucucagaacuccguagguugagaagauuacuauugaga

SEQ ID NO: 22980 - RNA, 45 nt, Mus musculus
aggugaugucugagaguaguuugacuaucagaucaagguagugag

SEQ ID NO: 22981 - RNA, 46 nt, Mus musculus
aaguaugauauuuuuaauuggucugcuucuauuugugagcuucaag

SEQ ID NO: 22982 - RNA, 45 nt, Mus musculus
aggagccaagaguucuacaucuugauccacaggcagcaaggagga

SEQ ID NO: 22983 - RNA, 46 nt, Mus musculus
gccaagguaggguaaacagaggacugccaucugcucugccccugac

SEQ ID NO: 22984 - RNA, 45 nt, Mus musculus
aaagaaagaaagaaagaaaggaaggaaggaaggaaggaagguuaa

SEQ ID NO: 22985 - RNA, 45 nt, Mus musculus
gaaugauaguaggauugaagaaucucugaauaucuaagaauuggu

SEQ ID NO: 22986 - RNA, 42 nt, Mus musculus
gcagagagaaagagagagagagagagagagagagagaugaau

SEQ ID NO: 22987 - RNA, 46 nt, Mus musculus
uauauguagucuaguauuugaaauuacuuuuuguauguuauggcag

SEQ ID NO: 22988 - RNA, 46 nt, Mus musculus
agagagagagacacagagagagagagagagagagagagacagacag

SEQ ID NO: 22989 - RNA, 45 nt, Mus musculus
gaauuagagaauggcagcauguauuggcuagguccaagugcuagg

SEQ ID NO: 22990 - RNA, 46 nt, Mus musculus
uuaaacauuguguguugagggaggggcagucagaguuaucagacag

SEQ ID NO: 22991 - RNA, 48 nt, Mus musculus
cucagagacuuguuuuccugccuagggauauugccaccuauagaaugc

SEQ ID NO: 22992 - RNA, 46 nt, Mus musculus
acacucagauaugagagagggcagguuuaaaaagauugcuagggaa

SEQ ID NO: 22993 - RNA, 41 nt, Mus musculus
cauuuugcauuuugacaucuuugaauacgguguucugucca

SEQ ID NO: 22994 - RNA, 47 nt, Mus musculus
ugguuccugucugaaggaaauacaaggacaaaguguagagcagagac

SEQ ID NO: 22995 - RNA, 81 nt, Mus musculus
ccagacaaauacagagauagauacucagauguucgcagccaagcaaccauucgacugagcauggggucaccaauggaggag

SEQ ID NO: 22996 - RNA, 46 nt, Mus musculus
caaccccauaagaagaauaacaauaucaaccaaccagacacccccc

SEQ ID NO: 22997 - RNA, 46 nt, Mus musculus
ugugccuucaugaaagugugaaaagcagagggugaugucagggguu

SEQ ID NO: 22998 - RNA, 46 nt, Mus musculus
aaauuauuuggcagaacaucuuaucaggguacaugcaagguaugag

SEQ ID NO: 22999 - RNA, 56 nt, Mus musculus
ugcaaaauuacgccagcaacugcagagaagcaaacacagcagucgucaccaccgag

SEQ ID NO: 23000 - RNA, 56 nt, Mus musculus
auaaagaaaggcagucuccauuccauggcaaccaugcagcuauuaaccagagccag

SEQ ID NO: 23001 - RNA, 45 nt, Mus musculus
gcuagguauacugacagaaggcuguuaucuguauuaggaggcuga

SEQ ID NO: 23002 - RNA, 45 nt, Mus musculus
acuuaugcuaaagcaaaaaaacaaauuacuguaggucacauagaa

SEQ ID NO: 23003 - RNA, 45 nt, Mus musculus
gagaaugacauggugcugucugauuaaaagcuuuaagugggccag

SEQ ID NO: 23004 - RNA, 47 nt, Mus musculus
cuuaaggcuccugcuccaaagagcacgcucguucccgcuggccccau

SEQ ID NO: 23005 - RNA, 52 nt, Mus musculus
aacaguguggaagggcugaaucaggagauugagaucauaauuaaagagacgg

SEQ ID NO: 23006 - RNA, 46 nt, Mus musculus
cuuuacugugacaauccuuuguauacuuuuagaaauaacaguacau

SEQ ID NO: 23007 - RNA, 71 nt, Mus musculus
auuccagauggucaucgugcgccuccgccccucgcacagagaagcagcagcacacgaagcauugacacaca

SEQ ID NO: 23008 - RNA, 41 nt, Mus musculus
ggagcacagugcagcuuugccaaggggcucugauggugcuu

SEQ ID NO: 23009 - RNA, 46 nt, Mus musculus
ccaauuaaaaaaugugugugugugugugugugugugugugugagag

SEQ ID NO: 23010 - RNA, 47 nt, Mus musculus
agcucaggaccccaagaccaaguucucagcaauuuuaguuugcccca

SEQ ID NO: 23011 - RNA, 36 nt, Mus musculus
gcuuucugccucgugaguauccucaaaccacuucuc

SEQ ID NO: 23012 - RNA, 45 nt, Mus musculus
cuuugcuccagcccaucucuauggccucccugucuacaaacacag

SEQ ID NO: 23013 - RNA, 45 nt, Mus musculus
agucagugugaagacagguugcuuuaacagucagugagccaaaag

SEQ ID NO: 23014 - RNA, 44 nt, Mus musculus
ugggggaaagagaagaggauuagagcuuagaaaacagguaccuu

SEQ ID NO: 23015 - RNA, 46 nt, Mus musculus
agcugcucuuuagaaaugaauuccaucaguguugguaaacauuguu

SEQ ID NO: 23016 - RNA, 46 nt, Mus musculus
ugcuguguacaacagguagauggcaaacccugcaugagagggccac

SEQ ID NO: 23017 - RNA, 53 nt, Mus musculus
ucagaaguacagaagaaaggcagcuggcagucuguugaguugaucugaaggga

SEQ ID NO: 23018 - RNA, 46 nt, Mus musculus
ggaagaagauugugaauuugcaaauaaaugaauuauaaggugacca

SEQ ID NO: 23019 - RNA, 42 nt, Mus musculus
aaacuaaaguaaacuugccauuacuaaauuuguaaaguugag

SEQ ID NO: 23020 - RNA, 45 nt, Mus musculus
uggaaaugcuggauuugcuaaauaaagccaagaugcauagcccug

SEQ ID NO: 23021 - RNA, 45 nt, Mus musculus
cagaguggcucugaacaguacuuuguuuauacaguccuguuggag

SEQ ID NO: 23022 - RNA, 46 nt, Mus musculus
uaacuauauuugauugcuuagguaacagcaacaaaaacccccagag

SEQ ID NO: 23023 - RNA, 44 nt, Mus musculus
auaacaauccuuacggaaggacuccaucugauccuugcccuuuu

SEQ ID NO: 23024 - RNA, 46 nt, Mus musculus
aggagaaaugcuuguuaagaaacaaacuagucaauuuccagugcgg

SEQ ID NO: 23025 - RNA, 45 nt, Mus musculus
acaaugucuaaguucuacagucaggacuaaguaggugccuuaagg

SEQ ID NO: 23026 - RNA, 53 nt, Mus musculus
cauuuguauuuauuuucuaguccauacuucuguacccccauuuuuuucucccu

SEQ ID NO: 23027 - RNA, 44 nt, Mus musculus
gaacagcaaguagaugaaagugugugugugugugugugugugug

SEQ ID NO: 23028 - RNA, 46 nt, Mus musculus
ugagugcacucgugcgcacgcacaagcaugugauuaccagcaugga

SEQ ID NO: 23029 - RNA, 42 nt, Mus musculus
uguuguaggauaaaggaaaugacacuuugaggaacuggagag

SEQ ID NO: 23030 - RNA, 45 nt, Mus musculus
uuccagcaagaauaaaggugaagacagacugacugccaggaccca

SEQ ID NO: 23031 - RNA, 46 nt, Mus musculus
aacacaaagacauaauuauaggagaucccacaaaccuagccccgga

SEQ ID NO: 23032 - RNA, 45 nt, Mus musculus
uugcaaagggagugugugugugugugugugugugugugugugugu

SEQ ID NO: 23033 - RNA, 45 nt, Mus musculus
uaccaaggaaaugggggaagagagaaggagagaggaaagacagag

SEQ ID NO: 23034 - RNA, 46 nt, Mus musculus
caaguagcaucagcguggaggacacgaguggaccgauuguccuaag

SEQ ID NO: 23035 - RNA, 45 nt, Mus musculus
ucaaacuuacauuuucccauuaaaugaggguugguuuuagcauuc

SEQ ID NO: 23036 - RNA, 42 nt, Mus musculus
gguggaagguguguacaaaauagcugccaaacaaggccccag

SEQ ID NO: 23037 - RNA, 46 nt, Mus musculus
uccauugggugcauaaugaaauaauaaaucaaauuuguggugugug

SEQ ID NO: 23038 - RNA, 46 nt, Mus musculus
uagucuccuggguugccauaaaagguucucaaacaguuguaaucag

SEQ ID NO: 23039 - RNA, 42 nt, Mus musculus
cgguccucacccaccccgccaccgcucccccacaccccaucc

SEQ ID NO: 23040 - RNA, 45 nt, Mus musculus
uuauuguuauuauuauuauuauuauuauuauuauuauuauuuggu

SEQ ID NO: 23041 - RNA, 46 nt, Mus musculus
aagaaaucuccuaugugucaugugugcagguugauguaaacugcag

SEQ ID NO: 23042 - RNA, 45 nt, Mus musculus
uuauuuguugggcaugcgccccagcggaaaacaaugugucuguaa

SEQ ID NO: 23043 - RNA, 42 nt, Mus musculus
cgggauggggacagugagucagcugaccuccugggcaagcac

SEQ ID NO: 23044 - RNA, 27 nt, Mus musculus
gaaguagaauuuuaaagaaggcagcaa

SEQ ID NO: 23045 - RNA, 46 nt, Mus musculus
caaugucccuuugggaauggagucuggccggauugcuaaugaacag

SEQ ID NO: 23046 - RNA, 62 nt, Mus musculus
cuucugccuucacggucuggaacagaccauagguuaaugagaggucauaagucuuaaguauu

SEQ ID NO: 23047 - RNA, 78 nt, Mus musculus
caguaguuagaagaaacuugauauuacccauucagauuggcaaguggaagggaaaccaaaaaaauaagcaagagagaa

SEQ ID NO: 23048 - RNA, 46 nt, Mus musculus
guugaggaguuacugaggucugggaauaaaaggacauaaccccaag

SEQ ID NO: 23049 - RNA, 41 nt, Mus musculus
agcuccuuugcccuccccucccgcucccuuagauggaauag

SEQ ID NO: 23050 - RNA, 46 nt, Mus musculus
cccauugcaucuauaccaucccagacauauggaugcugcagcagag

SEQ ID NO: 23051 - RNA, 50 nt, Mus musculus
guccguacuuuaaaaaagaaguccagcgaaagugacaugacuacggcuag

SEQ ID NO: 23052 - RNA, 45 nt, Mus musculus
gggggggaugcaaggagaaaaauagagaccuuguaaauccauugg

SEQ ID NO: 23053 - RNA, 41 nt, Mus musculus
gccucauugcugauacccagaucucugccuccuccacccga

SEQ ID NO: 23054 - RNA, 46 nt, Mus musculus
ccugucuggcauagugaaaggguguguuuugagaaagcaggaccag

SEQ ID NO: 23055 - RNA, 46 nt, Mus musculus
acacagacucaaagcccacaguggagacgcugggacccaccgugaa

SEQ ID NO: 23056 - RNA, 46 nt, Mus musculus
cauggaugaggaugccaccgaguguggggaaaacugcagcuuugag

SEQ ID NO: 23057 - RNA, 46 nt, Mus musculus
gagcuugcucacagcugggaggcaacauggaaaacugccuggauag

SEQ ID NO: 23058 - RNA, 44 nt, Mus musculus
gauuugagguuucuuugauggccccucccuucuuuuuaggcaaa

SEQ ID NO: 23059 - RNA, 42 nt, Mus musculus
uuagagauuuguggagaacauguucuucaccucgccugggau

SEQ ID NO: 23060 - RNA, 46 nt, Mus musculus
cgcaaacaaaccagccuuguuuccaaggucacuuuccuugcaucag

SEQ ID NO: 23061 - RNA, 46 nt, Mus musculus
gcaacuuccuucaggauucaacugcaacuuugauuuuccggaagag

SEQ ID NO: 23062 - RNA, 56 nt, Mus musculus
aaguggcuccggagcacguggaucagcagcgcuaaccccaaugacagaacauuucc

SEQ ID NO: 23063 - RNA, 45 nt, Mus musculus
gagaggauacuaaugggcacagaaugacuggcaccucgccccaaa

SEQ ID NO: 23064 - RNA, 44 nt, Mus musculus
agugucuagagugccuaagucccaucccuagcaccacuggggug

SEQ ID NO: 23065 - RNA, 45 nt, Mus musculus
auacuaagccagaaaacuggggcuauggaucgugauagauaauua

SEQ ID NO: 23066 - RNA, 44 nt, Mus musculus
uggacuccuuaacgccuuaugaguaaaaugcuucuaagucauag

SEQ ID NO: 23067 - RNA, 42 nt, Mus musculus
gggagauaagauagacccagaugaaaauccuugcagcccgcc

SEQ ID NO: 23068 - RNA, 46 nt, Mus musculus
auacacacgcauguuaaauaaauaaguacuuuuuuaaaaaucugag

SEQ ID NO: 23069 - RNA, 114 nt, Mus musculus
gucacuauggaaaagucuaaacuccuuuuaaagguaagcaagaucaggaaggagggggugacuauugcccgugccagaaugguuagaaguuggcagcagagccaggcuaggugg

SEQ ID NO: 23070 - RNA, 45 nt, Mus musculus
gcaaaucugaguuguaauuauuaucauuaauagugauagcaggaa

SEQ ID NO: 23071 - RNA, 42 nt, Mus musculus
cccagaugacaagaacuucuugaaacugcagagugauggccg

SEQ ID NO: 23072 - RNA, 92 nt, Mus musculus
gaaagcaaacuccuuugggucauccgugaggaccagggcagcgaguggaagcacgggcgcauuauccugcccagcuaugacauggaguauca

SEQ ID NO: 23073 - RNA, 41 nt, Mus musculus
uuugucuccguuuuugucuuuguuugaguuucuccaggcag

SEQ ID NO: 23074 - RNA, 63 nt, Mus musculus
ccaggaagauuagcuaaucuuggcucuuguccuuccggcucuagaucguguucgagggaguga

SEQ ID NO: 23075 - RNA, 46 nt, Mus musculus
uggcugggaacagaaagggacacuuccucccuaagaaagcaacuag

SEQ ID NO: 23076 - RNA, 60 nt, Mus musculus
gcaucucucucuaacaacgcagccuggcaagccucaguuuuaagccuaaguucuagaaga

SEQ ID NO: 23077 - RNA, 45 nt, Mus musculus
uucuaguggauccaagcuuuuucucauguuuuuauaaucccacag

SEQ ID NO: 23078 - RNA, 45 nt, Mus musculus
uaugccuguucucagcuggcacagaaaagccccccacacccacag

SEQ ID NO: 23079 - RNA, 47 nt, Mus musculus
agcucuuccaggucccagugacauuucaugaacauagcugugagaga

SEQ ID NO: 23080 - RNA, 47 nt, Mus musculus
ggauccccaaauugacggaagcaguaauucagaacuagcaagauggg

SEQ ID NO: 23081 - RNA, 47 nt, Mus musculus
augagaucugacauacuacucagcuaucuggggaccaggcugugggg

SEQ ID NO: 23082 - RNA, 64 nt, Mus musculus
cagaaguaaagaucaugucugccuuuggcaagcucaaaaccgccuuagucccuuucugggccag

SEQ ID NO: 23083 - RNA, 42 nt, Mus musculus
gcuccacuaccaccgguuccgcuaugcggccaagaagaccga

SEQ ID NO: 23084 - RNA, 46 nt, Mus musculus
cggggccccucuggcggucgagcccacccuaaccauuaagcuagag

SEQ ID NO: 23085 - RNA, 46 nt, Mus musculus
aaugugucucauguugccuuauaaaaagaaaaaagaaaagaaaaaa

SEQ ID NO: 23086 - RNA, 46 nt, Mus musculus
guggaaugucauaaagaauaacacaccugggaugauguaaacucag

SEQ ID NO: 23087 - RNA, 46 nt, Mus musculus
augccccaugcagcaucauauucauguacaugucacaaaugagaag

SEQ ID NO: 23088 - RNA, 28 nt, Mus musculus
gacgaagcagugaucccaacuguucaaa

SEQ ID NO: 23089 - RNA, 45 nt, Mus musculus
aggaagucucaaguccagaugcucccccaagggguguugcccuga

SEQ ID NO: 23090 - RNA, 42 nt, Mus musculus
gggccauguaugugccuugugggcuuuaucuuaucugccaaa

SEQ ID NO: 23091 - RNA, 46 nt, Mus musculus
uuugugacagcaacugcccauccuucucuuaccuugucuuugccag

SEQ ID NO: 23092 - RNA, 46 nt, Mus musculus
ggugaaucuuggcagcuuguuccgguguccuuuucuagagaccgau

SEQ ID NO: 23093 - RNA, 44 nt, Mus musculus
uucuuccucuaccucaggggcuggugaccccucaucuggcaaag

SEQ ID NO: 23094 - RNA, 30 nt, Mus musculus
cucuacgauggccucaagcacaaggucaag

SEQ ID NO: 23095 - RNA, 52 nt, Mus musculus
uuccagaauacugaagguauggacaggacagacaggccagucuagggagaaa

SEQ ID NO: 23096 - RNA, 23 nt, Mus musculus
aagaggauggcuuauccggggca

SEQ ID NO: 23097 - RNA, 46 nt, Mus musculus
aaauggaaccuaagaaacaaaagccacccagcuuagcucacccuca

SEQ ID NO: 23098 - RNA, 47 nt, Mus musculus
auugaaguaggauguuauugccuuuagcuuuuuuuaauccaggggaa

SEQ ID NO: 23099 - RNA, 80 nt, Mus musculus
gugggagauuuugcagucucuauucuuuagucucagagcagagagaaagaauaacaaaggaagagagagaaacgcagccu

SEQ ID NO: 23100 - RNA, 46 nt, Mus musculus
accacugucucacaaguuaaggcuccuccugcuucuccugccccag

SEQ ID NO: 23101 - RNA, 42 nt, Mus musculus
ggcuucggcaagagucuuucccugucuaacacgaggggugag

SEQ ID NO: 23102 - RNA, 46 nt, Mus musculus
uacagcaccacuacaggcaccgcgaggacauaacaccacagagcag

SEQ ID NO: 23103 - RNA, 46 nt, Mus musculus
agcccauacuugagaaaaagcagggaagaaacagaaaggaggucgu

SEQ ID NO: 23104 - RNA, 42 nt, Mus musculus
ucucaggacagcugagcaagccaguucaucuaucagcccaag

SEQ ID NO: 23105 - RNA, 47 nt, Mus musculus
ucugugaguuuuuccuccuucauuggugggaaaaacugugggcauua

SEQ ID NO: 23106 - RNA, 42 nt, Mus musculus
aaauguaaauaucacacaaccucacaaguaagacuuccaacg

SEQ ID NO: 23107 - RNA, 42 nt, Mus musculus
agucacaucacccacucagcccaguauuuguucugucccccu

SEQ ID NO: 23108 - RNA, 52 nt, Mus musculus
caaggcuagccugguuuauauucaggagugcucacucuagauagguagguag

SEQ ID NO: 23109 - RNA, 46 nt, Mus musculus
ucagaauaggaaagugaugaggccagagccuucuguuugccugcua

SEQ ID NO: 23110 - RNA, 46 nt, Mus musculus
aagauucuaaacauuguuuacccaugagucaaaaagaaugugugga

SEQ ID NO: 23111 - RNA, 46 nt, Mus musculus
ucaauauuuaaaauaagguauuuugacugggacuugcuggggagau

SEQ ID NO: 23112 - RNA, 46 nt, Mus musculus
acacaacuccuguggacacagagaugguucgugacugugggaagau

SEQ ID NO: 23113 - RNA, 47 nt, Mus musculus
aacaucguccugggcagggcaacaggaagcaccuguguguccuacca

SEQ ID NO: 23114 - RNA, 44 nt, Mus musculus
auuugcagccugcaugggguacacaguaucaggcuacccagagc

SEQ ID NO: 23115 - RNA, 53 nt, Mus musculus
cugaacccagagggaaguaccacugugcccaagaacaggauuggagagcuagc

SEQ ID NO: 23116 - RNA, 46 nt, Mus musculus
caaccagagcaauaaggaaaagugaaugauucuuuuaagcagggag

SEQ ID NO: 23117 - RNA, 23 nt, Mus musculus
uuccuauguggugggaaaaaaau

SEQ ID NO: 23118 - RNA, 46 nt, Mus musculus
aaacaaacaaacaaaaaagaccuaagaaaacaaaaaaaaagaaaag

SEQ ID NO: 23119 - RNA, 44 nt, Mus musculus
augugcguguuugccugaauggauauuauaugugugcccaagga

SEQ ID NO: 23120 - RNA, 41 nt, Mus musculus
gcgugguggcgcgcaugccuuuaaucccagcacuugggagg

SEQ ID NO: 23121 - RNA, 46 nt, Mus musculus
aaaacgcuuuaaaaaauauucaagagccgggugugguggcgcacgc

SEQ ID NO: 23122 - RNA, 45 nt, Mus musculus
uucuccuuuauuccucuggcccacagacacuggguggagccaucc

SEQ ID NO: 23123 - RNA, 43 nt, Mus musculus
caaaaguggaaacgaauuaagguggaggagagggggaggaaga

SEQ ID NO: 23124 - RNA, 41 nt, Mus musculus
ugugggagagguuuauugugcauggauagggggguggcaaa

SEQ ID NO: 23125 - RNA, 45 nt, Mus musculus
cagaugagaaacaaccugcaaugggauagaaaacuuaugcuagaa

SEQ ID NO: 23126 - RNA, 46 nt, Mus musculus
aggaagugacccuauuauuauuuauauaugcaaugaaccaccucag

SEQ ID NO: 23127 - RNA, 34 nt, Mus musculus
uuuucuuuagaucuauuuaaaagauuaagacugg

SEQ ID NO: 23128 - RNA, 46 nt, Mus musculus
ugaguucgaagccaacagccagugcuauacagagaaacccugucuc

SEQ ID NO: 23129 - RNA, 44 nt, Mus musculus
ucccagcaaccacaugguggcuuacaaccaucuacaaugugauc

SEQ ID NO: 23130 - RNA, 43 nt, Mus musculus
uuauccgaaaaugguauuguacuuaucaaaaauccuggcaguu

SEQ ID NO: 23131 - RNA, 53 nt, Mus musculus
ccaagugugucaaagcugucaccgagggcgcucaggcaguagaggagccgucc

SEQ ID NO: 23132 - RNA, 42 nt, Mus musculus
auucccagcaaccacaagguggcucacaaccaucuaucugua

SEQ ID NO: 23133 - RNA, 44 nt, Mus musculus
cugaacuacgauuucauucauuaaggcuaaguuaguggcauaac

SEQ ID NO: 23134 - RNA, 46 nt, Mus musculus
accaaaguagcagugacgccuccuggcuuggcacgagaagacugga

SEQ ID NO: 23135 - RNA, 46 nt, Mus musculus
cucccauggcugauguuauucucccaggggcugcuuacacagaaaa

SEQ ID NO: 23136 - RNA, 44 nt, Mus musculus
caaaucccagcaaccacaugguggcucacaaccaucuggucuac

SEQ ID NO: 23137 - RNA, 46 nt, Mus musculus
agacaaacgagaauuagacuuaccauacucacaaauaguuuugaag

SEQ ID NO: 23138 - RNA, 46 nt, Mus musculus
cacccaaauuuuauucugucuaaaagaaaugcagagagggggcuaa

SEQ ID NO: 23139 - RNA, 46 nt, Mus musculus
aacccauagccaaacacuggauggagcuuggggacucuuauagaag

SEQ ID NO: 23140 - RNA, 46 nt, Mus musculus
ucuagagucacauugcaauuaaugucaugacauuucgggccccauu

SEQ ID NO: 23141 - RNA, 42 nt, Mus musculus
cucauuauaggugguugugagccaccaugugauugcugggaa

SEQ ID NO: 23142 - RNA, 45 nt, Mus musculus
acccaaaauacauuaaauuccuugacuguaugaguauuuugagaa

SEQ ID NO: 23143 - RNA, 85 nt, Mus musculus
uuaugauggacuaaaacgucaaagacuuacugaaccaauggucagaaacgaaaaagggcuuuuaacuuauaccuccugggaagau

SEQ ID NO: 23144 - RNA, 46 nt, Mus musculus
auacauuuuugaaaaauuugaguuuuuauaaagagaaugagaagaa

SEQ ID NO: 23145 - RNA, 46 nt, Mus musculus
ugucuaucuauaucuauaugaaucuaaguuauguaugagcccuaug

SEQ ID NO: 23146 - RNA, 45 nt, Mus musculus
uacauagcuagcacuuaucuccuaaaccaucuccccagccccgca

SEQ ID NO: 23147 - RNA, 46 nt, Mus musculus
uagguccccuuaccuaacccugcauacuccacucuccgccccuuuc

SEQ ID NO: 23148 - RNA, 46 nt, Mus musculus
gugugccacucauacucaacauuacggauuuuuagaguagucaggu

SEQ ID NO: 23149 - RNA, 45 nt, Mus musculus
augugcauauguacuugaguagucuuuagucuuuaaugaggagag

SEQ ID NO: 23150 - RNA, 45 nt, Mus musculus
auggaaaauaacuacuuaaguugaaagguaggacaagccucagca

SEQ ID NO: 23151 - RNA, 42 nt, Mus musculus
uguguucaugcacagcugggugguacacgccagugugcacau

SEQ ID NO: 23152 - RNA, 42 nt, Mus musculus
gaugauuugggaacaacaggaagaggaaaugacaugcaaguu

SEQ ID NO: 23153 - RNA, 88 nt, Mus musculus
aggaccaguccaugauguuuggaagugauaggagccgauuucuagaggggaagcgugcuguggaggacaagaacauugggccccuagu

SEQ ID NO: 23154 - RNA, 42 nt, Mus musculus
agcaaaucacccauuggauuguccuauuugugaccagggagg

SEQ ID NO: 23155 - RNA, 46 nt, Mus musculus
uaggcuggccucaggccugcagccucugccuucugagugcugagau

SEQ ID NO: 23156 - RNA, 42 nt, Mus musculus
cauuaucaucauggugggaagucuggcaugaugcaggcagau

SEQ ID NO: 23157 - RNA, 46 nt, Mus musculus
cagcugagcuguauugcaagcucuuaccgcuuucuucuggcuagau

SEQ ID NO: 23158 - RNA, 45 nt, Mus musculus
gcugucucacacuugguaccauugagccacauuuccgucccuuac

SEQ ID NO: 23159 - RNA, 42 nt, Mus musculus
guaguagcacaugccaguaggauauguucaagaagcacagac

SEQ ID NO: 23160 - RNA, 48 nt, Mus musculus
ucuguaauuccagaaaggggaggcugagaugugaggauugaacggaga

SEQ ID NO: 23161 - RNA, 41 nt, Mus musculus
ugagcaccggcacuuagaagugcacauuacccacacacaga

SEQ ID NO: 23162 - RNA, 42 nt, Mus musculus
aaauacaaaacuaucguaauuaauuacuuuguggcaccaggc

SEQ ID NO: 23163 - RNA, 46 nt, Mus musculus
gcccuaauaaauagauuaauuaguagggucguuuaucccacgaaau

SEQ ID NO: 23164 - RNA, 46 nt, Mus musculus
augauuuaguggccugaacucucuauaagggaccugggggucaguu

SEQ ID NO: 23165 - RNA, 42 nt, Mus musculus
uccaguuuauuuccagagagagugaggucuaagugugcaggu

SEQ ID NO: 23166 - RNA, 46 nt, Mus musculus
ucucaugcugguuaagggauaguccuaggcucaguggcagguagga

SEQ ID NO: 23167 - RNA, 42 nt, Mus musculus
cagaaaacaguuuacuuccaagauuauagguuuauuacagag

SEQ ID NO: 23168 - RNA, 46 nt, Mus musculus
uuuccuagccuccgaguucuggggucugucugucuguauacaggag

SEQ ID NO: 23169 - RNA, 49 nt, Mus musculus
uuagagauuguggacaggauucguccuuagugcaggaguguuuucuucu

SEQ ID NO: 23170 - RNA, 63 nt, Mus musculus
agguugugccucaaggcacgagagcggcucgguucggggagagucggugggguuggcggcggg

SEQ ID NO: 23171 - RNA, 42 nt, Mus musculus
gcuuggagccggugucccgagccgagcgggccacgcgcgggg

SEQ ID NO: 23172 - RNA, 42 nt, Mus musculus
ugaaaaugcgcguugcuguguggggagaccugagggcccugc

SEQ ID NO: 23173 - RNA, 46 nt, Mus musculus
cuccucugcuuugcacgagaaaucuuagugacuaaauucagcacgg

SEQ ID NO: 23174 - RNA, 42 nt, Mus musculus
ggaaagcauaauugcuacccaguguugagaagcaggcgggga

SEQ ID NO: 23175 - RNA, 50 nt, Mus musculus
ccucucuaucucuccuccccccucugugugugugugugugugugugugag

SEQ ID NO: 23176 - RNA, 45 nt, Mus musculus
gguuagaccaagucuggaggacaugauuagaaguguguugauugg

SEQ ID NO: 23177 - RNA, 44 nt, Mus musculus
guguagaaaaaaagaaagagaagaagaaagaagaagaagaagaa

SEQ ID NO: 23178 - RNA, 46 nt, Mus musculus
ugaaguguucguuuuagagaagcuaguucugauguuucagauccag

SEQ ID NO: 23179 - RNA, 46 nt, Mus musculus
uuaccugucuuaaaaagcaaaacagggcaacaacaaaaaccacaag

SEQ ID NO: 23180 - RNA, 45 nt, Mus musculus
cuuccugcugauggccgcuaugugaguauccucucucuuuuuugu

SEQ ID NO: 23181 - RNA, 28 nt, Mus musculus
uaaaaaucuuuaaaaaaaaaauaaaaaa

SEQ ID NO: 23182 - RNA, 46 nt, Mus musculus
ccuguuugcaacucucuuuuuacacuguuauccugucuuccucuaa

SEQ ID NO: 23183 - RNA, 45 nt, Mus musculus
acagcuaaugucuaggagagcccuacugguaagagagggggugca

SEQ ID NO: 23184 - RNA, 42 nt, Mus musculus
agcuggguaaaaccuaccugacuuaccaauugacccccaggu

SEQ ID NO: 23185 - RNA, 42 nt, Mus musculus
gcggggaccccucucugcgggccgcucccggaaaggcggaaa

SEQ ID NO: 23186 - RNA, 46 nt, Mus musculus
ugagguggcgagcgcagguagcaggagaaggacgaggagcaggcgg

SEQ ID NO: 23187 - RNA, 46 nt, Mus musculus
ugucauaaugagcaaucagaauaauacaauguugagcacacuggug

SEQ ID NO: 23188 - RNA, 46 nt, Mus musculus
ucaagacugguguauuacaucaaccaggacucagaaagccccuauc

SEQ ID NO: 23189 - RNA, 47 nt, Mus musculus
aagcauuacuaugaugucuugucaggaaacaauucagcauuucaaga

SEQ ID NO: 23190 - RNA, 42 nt, Mus musculus
cauuggcuuuccuuuuagguuggucgugaaaguggcccggag

SEQ ID NO: 23191 - RNA, 45 nt, Mus musculus
ugcggagaauccucagauugcuuggcgugugggaaagaagaccgg

SEQ ID NO: 23192 - RNA, 42 nt, Mus musculus
ccuguuauaaucacacugaaauuaaaaacaaauagccuacag

SEQ ID NO: 23193 - RNA, 45 nt, Mus musculus
accuuugcucaaggaaagcagagggaagaaagaacugggcugcuc

SEQ ID NO: 23194 - RNA, 42 nt, Mus musculus
ggauccuugucuuugauuuuuuuuuucuucuaucaagucuag

SEQ ID NO: 23195 - RNA, 46 nt, Mus musculus
uagucacuuaccaagucuugaugcugcuccccgaauccacccccuc

SEQ ID NO: 23196 - RNA, 46 nt, Mus musculus
cacuuauuucaucacgcgacucgauuucuccacaugcagcaagcag

SEQ ID NO: 23197 - RNA, 42 nt, Mus musculus
ggagagggaggaaagggagagggagaggaagcugggaggggg

SEQ ID NO: 23198 - RNA, 46 nt, Mus musculus
cugcugcccacugguuuagugcaccaucaccucucccuuacacugu

SEQ ID NO: 23199 - RNA, 42 nt, Mus musculus
cuccuauccucacuacagaguuucccauuuugggcccuagau

SEQ ID NO: 23200 - RNA, 88 nt, Mus musculus
auauccacacgaaagaaggaagggagggagggagggagagagggagggagaggaagagggagagggagagggagagggagggggaggg

SEQ ID NO: 23201 - RNA, 45 nt, Mus musculus
agaccaucuuuucucuuugaaacugccuugguauccuugcugaag

SEQ ID NO: 23202 - RNA, 49 nt, Mus musculus
uuguauguuuuguuuuacaaguuucuuuuaaaagaauuucagauuaugg

SEQ ID NO: 23203 - RNA, 47 nt, Mus musculus
cguaagugcaccuaugcauguacccgcaccaacucguagggccgagg

SEQ ID NO: 23204 - RNA, 46 nt, Mus musculus
aaugcuugcuaaaaucacaaaaauuaggaaagaaagcaugucagaa

SEQ ID NO: 23205 - RNA, 46 nt, Mus musculus
guaagcucauugugcagggccuuggaagguugauagugaaggacag

SEQ ID NO: 23206 - RNA, 46 nt, Mus musculus
uguuucauauuuccugcuguguucuuugcucaagguaagaaagagc

SEQ ID NO: 23207 - RNA, 46 nt, Mus musculus
uuaaaaaggucaucuggcaguccuauucaggauggacagcuauagg

SEQ ID NO: 23208 - RNA, 46 nt, Mus musculus
gguggccucaugagagcacugaggcccauauggggcagacggauag

SEQ ID NO: 23209 - RNA, 54 nt, Mus musculus
auaacaauuuauguuauuuguagcuuaaauuuuuauagacauucaauagagcag

SEQ ID NO: 23210 - RNA, 46 nt, Mus musculus
ugcuuucaucugcagucuuaaguaccagcccugggaauggaugcag

SEQ ID NO: 23211 - RNA, 46 nt, Mus musculus
agguugaacucaggcuuucccacugagaaaucucaacagccccuaa

SEQ ID NO: 23212 - RNA, 46 nt, Mus musculus
uucugucacagaguauauuuucugcugaauugauuucuuuccucag

SEQ ID NO: 23213 - RNA, 33 nt, Mus musculus
aucugaacagcacgugcauaccugaugccccca

SEQ ID NO: 23214 - RNA, 42 nt, Mus musculus
cacacagacauaccaauaauuaaagauaaaaaggcccaggau

SEQ ID NO: 23215 - RNA, 46 nt, Mus musculus
gaugcuguacucaacucggaauaaaaucacucuggaggcuugcgag

SEQ ID NO: 23216 - RNA, 46 nt, Mus musculus
gagaccaauacaucggccaagcacacuccggucacaggccacagau

SEQ ID NO: 23217 - RNA, 46 nt, Mus musculus
uccacaucugaugauuaaucuugcuuauauuuccccuugaugacag

SEQ ID NO: 23218 - RNA, 52 nt, Mus musculus
caauuaaauaauaacaaaaaauuaucugucaucaaggggaaauauaagcaag

SEQ ID NO: 23219 - RNA, 41 nt, Mus musculus
guuguuuuuguuuauggagcgccugcaauuucccugggcca

SEQ ID NO: 23220 - RNA, 45 nt, Mus musculus
gcaacagcugucuccaguccuucagggugcuaauucccagcccag

SEQ ID NO: 23221 - RNA, 45 nt, Mus musculus
agcgguguguagcauccugucaauuccgaacacuuguuagagcaa

SEQ ID NO: 23222 - RNA, 37 nt, Mus musculus
agaauccgugcucugugcaccggggcaucgugaagaa

SEQ ID NO: 23223 - RNA, 46 nt, Mus musculus
gaauucacaggguuuuuguuuuuuauaugagcaaagaagaucagua

SEQ ID NO: 23224 - RNA, 45 nt, Mus musculus
ggaggacgggaggaugaggaccagagaguucuuucugagggugug

SEQ ID NO: 23225 - RNA, 45 nt, Mus musculus
ggggacugggaauauaaaaucuuuagaggauguuuaaguuggcug

SEQ ID NO: 23226 - RNA, 45 nt, Mus musculus
ggccuuugccuauauccuugucuuuuucuuuuuuuuaacuuggua

SEQ ID NO: 23227 - RNA, 42 nt, Mus musculus
aguucuucguugauuuguuaauuuacguuauucagggcacuu

SEQ ID NO: 23228 - RNA, 46 nt, Mus musculus
ccucaccuuuucuaaucucuuccccaccucaaauaaccaccccauc

SEQ ID NO: 23229 - RNA, 46 nt, Mus musculus
ucuaguuugagaagguucuuugcuucauaauuccacauugauguag

SEQ ID NO: 23230 - RNA, 45 nt, Mus musculus
caugcuaugucagcagugugccugcauaagagauugucuugccaa

SEQ ID NO: 23231 - RNA, 46 nt, Mus musculus
agaguuacagaggcagaccaggaauuaccuaacauuuaacaugcag

SEQ ID NO: 23232 - RNA, 45 nt, Mus musculus
uuuggguaagauguuuauuagaggaaucaauaccacagauaaaca

SEQ ID NO: 23233 - RNA, 42 nt, Mus musculus
cucuuuguugaaauuuucauaaauuacaaggguaagacagag

SEQ ID NO: 23234 - RNA, 46 nt, Mus musculus
acccaguacuuaggaggcgauuaaagggcuuacucgaugguuaaag

SEQ ID NO: 23235 - RNA, 46 nt, Mus musculus
auuagacaguuugcaucuagaggguaguuuaauaaaacuaguggag

SEQ ID NO: 23236 - RNA, 45 nt, Mus musculus
gaggaggaaagaggcagaauaaagagagcugggagauaggcagga

SEQ ID NO: 23237 - RNA, 63 nt, Mus musculus
ccagcugauuugucacuggugguugucagagagugguuuuaguaaagccggggguuguugggg

SEQ ID NO: 23238 - RNA, 46 nt, Mus musculus
cagagauagaaucugcccaacucucacaugcauagcagaggaagau

SEQ ID NO: 23239 - RNA, 49 nt, Mus musculus
agagcuguguaucuuucaucugagcaaauaaaagcaacauuuauaggug

SEQ ID NO: 23240 - RNA, 45 nt, Mus musculus
cuaucuuuuugugaugaugagcaaguugauaaccugagagaugga

SEQ ID NO: 23241 - RNA, 46 nt, Mus musculus
ggggccagucaccagucacuaguuuagaaaauaacaggauugggag

SEQ ID NO: 23242 - RNA, 64 nt, Mus musculus
guccucagggaaugcugugcuugggugaaaacuguaaaacucagugaucgguggcuguaaccua

SEQ ID NO: 23243 - RNA, 41 nt, Mus musculus
agacuaagaggguugcuuuauuaguaaccaagugagcugag

SEQ ID NO: 23244 - RNA, 42 nt, Mus musculus
ucuucucaugacguacccacacaguguaccccacccccagag

SEQ ID NO: 23245 - RNA, 79 nt, Mus musculus
ggacagauucaggugacuuuagggccucaaggucucugcguggauggcaguggccccagugaugaguuaaguaggaaaa

SEQ ID NO: 23246 - RNA, 45 nt, Mus musculus
gaaaauggccgccuaggucacucugcuuuugugaaugaaugggau

SEQ ID NO: 23247 - RNA, 41 nt, Mus musculus
aggucuuuuaaaagauaauuagaauacagacuuuugaggga

SEQ ID NO: 23248 - RNA, 47 nt, Mus musculus
gaaaucugaguagucaugaauggacauagagaaaccauacaagauca

SEQ ID NO: 23249 - RNA, 45 nt, Mus musculus
uaggaaaaggaacccacaaagcagcaaagacacauaugcccuccc

SEQ ID NO: 23250 - RNA, 42 nt, Mus musculus
uagucagcugcuauggacaguucaaaacaaccccacauccug

SEQ ID NO: 23251 - RNA, 46 nt, Mus musculus
gaagcuuguuuuuaagaacuggcuauguagacauuugaaaguagag

SEQ ID NO: 23252 - RNA, 45 nt, Mus musculus
ugugacuucucucuagucacuuucucuuaaucaaagucuccagau

SEQ ID NO: 23253 - RNA, 46 nt, Mus musculus
ugcagguguuuugccagcauguauauccguauaagugcaccagauc

SEQ ID NO: 23254 - RNA, 47 nt, Mus musculus
caugcuggcaaaacaccugcauuaauaaaaauauuuagagagagaga

SEQ ID NO: 23255 - RNA, 46 nt, Mus musculus
gagagagagagacagagacagagagacagagagagaaagagaggag

SEQ ID NO: 23256 - RNA, 46 nt, Mus musculus
ugucaaagccucaguucauuugugaaacuguugcagauuagcccag

SEQ ID NO: 23257 - RNA, 46 nt, Mus musculus
ccugcaguucuggagguggagaagucuaggacuaaggugcaagaag

SEQ ID NO: 23258 - RNA, 46 nt, Mus musculus
cucuugauuuuguauggauuuauauaaagucacaguuugauaccag

SEQ ID NO: 23259 - RNA, 46 nt, Mus musculus
uauuaggcugaguaauucaaggaugacuaaguuguucaggcaggaa

SEQ ID NO: 23260 - RNA, 46 nt, Mus musculus
aaccuuugcagaugauaucugggaaggagccuguuugaaacuuaga

SEQ ID NO: 23261 - RNA, 48 nt, Mus musculus
caagagcauuaagugcuuuuuaccaccgagccaccuuuccaggccuga

SEQ ID NO: 23262 - RNA, 46 nt, Mus musculus
accaaaauuauuagcaucuuauguaaaguccaggcaauaacgucag

SEQ ID NO: 23263 - RNA, 42 nt, Mus musculus
ggaagcagagaagagaaggaacagaagaaaggcaggggagaa

SEQ ID NO: 23264 - RNA, 41 nt, Mus musculus
uucucuucucugcuuccuuucuuccccacccccagccccuc

SEQ ID NO: 23265 - RNA, 46 nt, Mus musculus
gcuaaaaucaaggaagauguacagucuggcucaagguuauugagau

SEQ ID NO: 23266 - RNA, 52 nt, Mus musculus
aucucauucucagaaggacucauuuggugaguuacgcagcaggugucuugca

SEQ ID NO: 23267 - RNA, 41 nt, Mus musculus
gaaacaguagcuuaccauguagcuuuaguacuuagcaggca

SEQ ID NO: 23268 - RNA, 42 nt, Mus musculus
auccauaagaccaaacauaaacauaaacauauggccccaaaa

SEQ ID NO: 23269 - RNA, 45 nt, Mus musculus
gaauucccaaguccacagagagacauucuugaaauaucccagaga

SEQ ID NO: 23270 - RNA, 46 nt, Mus musculus
aauuccuaggaacaagucucagucaaugggaggucccucuucagag

SEQ ID NO: 23271 - RNA, 65 nt, Mus musculus
ucuuaaaaaacaaaaaaagacaagaaaagcuaaaaucaaaccaaaacacgaaaaauauaagaaau

SEQ ID NO: 23272 - RNA, 46 nt, Mus musculus
guguuugugaccugcccugggguauggcuggccuucccagugucag

SEQ ID NO: 23273 - RNA, 46 nt, Mus musculus
uccaucguuuuccuccucaguaucgaccaggauuaauagcaccguu

SEQ ID NO: 23274 - RNA, 46 nt, Mus musculus
uucuuuuaaagaagaaguuaucucuauaguucucuugaggccacag

SEQ ID NO: 23275 - RNA, 43 nt, Mus musculus
ucgucuuauguguauguagacgcuaauaacauugauuugcagg

SEQ ID NO: 23276 - RNA, 26 nt, Mus musculus
uuccuuugugguaggaaccucugaca

SEQ ID NO: 23277 - RNA, 46 nt, Mus musculus
auuagccauuucagaaaugucucugguuuuagauauuauuaaucau

SEQ ID NO: 23278 - RNA, 46 nt, Mus musculus
ugcuuugcuauccugcaauuacugccuuuccccucucaauauuccc

SEQ ID NO: 23279 - RNA, 46 nt, Mus musculus
gcuguuucuagagagaaggagaaagucccccucuuucccggugcuu

SEQ ID NO: 23280 - RNA, 45 nt, Mus musculus
aaaauccacaaaaauccaacuuacaaaauguggcaauaauaggag

SEQ ID NO: 23281 - RNA, 46 nt, Mus musculus
aaccuacuauccuacagcaagcgcaccuaccucagugcccauagau

SEQ ID NO: 23282 - RNA, 45 nt, Mus musculus
agcagauucaugauuuuugauauggcuuccuuggauacgaaucag

SEQ ID NO: 23283 - RNA, 45 nt, Mus musculus
uuuguuuguaggggguguauuagcuacuacugugucacuggcaga

SEQ ID NO: 23284 - RNA, 46 nt, Mus musculus
ggaugccuuuucauauucagaccauaaaaucauacagcgacugaga

SEQ ID NO: 23285 - RNA, 46 nt, Mus musculus
uguuccugguuuuuguaagggacaagguagcuucaccagcgugaga

SEQ ID NO: 23286 - RNA, 46 nt, Mus musculus
uaguuacgcaagaauggccacguuucuagcaaauuccuuccagaag

SEQ ID NO: 23287 - RNA, 47 nt, Mus musculus
gcucuagguaaaucauaaauguuuaaaaagcaauucaaggccaguga

SEQ ID NO: 23288 - RNA, 45 nt, Mus musculus
ucaauuuucugaaugauaacuaaaaaccuguauguguguguggua

SEQ ID NO: 23289 - RNA, 45 nt, Mus musculus
acauaggaaggaccucggcuauacugucuacgcgucucugguuua

SEQ ID NO: 23290 - RNA, 46 nt, Mus musculus
ccagccuuuauucugggguccuggaaaucgaccuccagccccauga

SEQ ID NO: 23291 - RNA, 46 nt, Mus musculus
aagaccaauuauauuuggagguauaggcagauguggggggugggga

SEQ ID NO: 23292 - RNA, 46 nt, Mus musculus
cuggagcugaagcucuccuucacucauuugauuaauugcuggagau

SEQ ID NO: 23293 - RNA, 70 nt, Mus musculus
uuuucaagggagagaaagaaugaauaugacauugugugcauggaucugggaagaguuggaggagaggaaa

SEQ ID NO: 23294 - RNA, 52 nt, Mus musculus
aguuuuacuaggauuagcauaauuaaauugauagauaauauacccauaauug

SEQ ID NO: 23295 - RNA, 92 nt, Mus musculus
aggccagugagggcuacauagugaaacccuaucucaaaagaagaaaaggaaagaaaggucaccaagcaucagugaagaaaguuuugguaagc

SEQ ID NO: 23296 - RNA, 46 nt, Mus musculus
aucugugugagugugugcgugugaaugugaauaugcaugaguguag

SEQ ID NO: 23297 - RNA, 46 nt, Mus musculus
ccuuguuucuuuucuucaucaaauccucagagucagagugccugga

SEQ ID NO: 23298 - RNA, 46 nt, Mus musculus
aauaaggagaacaagaaacuugggaguguggauucauagugcagag

SEQ ID NO: 23299 - RNA, 46 nt, Mus musculus
agaauuacagguuggauagaggcuuugugugaaguaaggcaaagau

SEQ ID NO: 23300 - RNA, 38 nt, Mus musculus
uuagacuuagaagugaaaugguuuaucaauugcuauuu

SEQ ID NO: 23301 - RNA, 46 nt, Mus musculus
cuucaaucccuagaaccuguguaaaaaacuguccaaaugguggcac

SEQ ID NO: 23302 - RNA, 45 nt, Mus musculus
aaaaaaguuuuuaacugggauuaccgugucagaagguaaggguuc

SEQ ID NO: 23303 - RNA, 42 nt, Mus musculus
uaaauggauuuaaaaauucaaaauaauauuauuucaugguac

SEQ ID NO: 23304 - RNA, 45 nt, Mus musculus
gaccacacagcuggcagagcugcaguguuuacuaucuggcacuua

SEQ ID NO: 23305 - RNA, 45 nt, Mus musculus
guccuuuccauugccuauguuuuauguuucugaaucuagacugag

SEQ ID NO: 23306 - RNA, 46 nt, Mus musculus
uacguggagauccacuaugaagacgggaagcagauguacucuaagg

SEQ ID NO: 23307 - RNA, 41 nt, Mus musculus
aacuaugacacugucuuacaggcccucaaaaaggggugaga

SEQ ID NO: 23308 - RNA, 45 nt, Mus musculus
ggcacuauuaggaaguuuggcuuuauugaaggggguguggcuuug

SEQ ID NO: 23309 - RNA, 46 nt, Mus musculus
gaaagggagaaaggaagaaagaaagaaagaaagaaagaaagaaaga

SEQ ID NO: 23310 - RNA, 45 nt, Mus musculus
gaagagaaaggaagagagggagaaagggagaaagggagaaaggaa

SEQ ID NO: 23311 - RNA, 42 nt, Mus musculus
ugauagugugugacaagcaagugauuucuaugagucaggcag

SEQ ID NO: 23312 - RNA, 45 nt, Mus musculus
caaaaucuaaugagcuuauaaauucuuuagucuacaugauaccuu

SEQ ID NO: 23313 - RNA, 24 nt, Mus musculus
guggaacauacugcagagacagaa

SEQ ID NO: 23314 - RNA, 41 nt, Mus musculus
gugcauacuucagcauaggcccccacacacuuccaugccua

SEQ ID NO: 23315 - RNA, 46 nt, Mus musculus
uuggguugacugaagaucuuuaugccuaugagggcuuuggcagcag

SEQ ID NO: 23316 - RNA, 23 nt, Mus musculus
gguuuguccauguuuagcauaga

SEQ ID NO: 23317 - RNA, 54 nt, Mus musculus
acauacuuccuccacuaaggcacaccuaauccaacaaggccaccucuccuaaua

SEQ ID NO: 23318 - RNA, 46 nt, Mus musculus
gcacuauuaggagagguggccuuguuggauuaggugugccuuagug

SEQ ID NO: 23319 - RNA, 57 nt, Mus musculus
gugccauuucccauggggcaaguguauuaaaaccaccacaguuccuaacccaaagau

SEQ ID NO: 23320 - RNA, 46 nt, Mus musculus
agaacuuuuauauuagauauaaaauuauagucuuuacaauuucuag

SEQ ID NO: 23321 - RNA, 46 nt, Mus musculus
guauucugaacauguucuagaauauaaaaggaacauggagagccaa

SEQ ID NO: 23322 - RNA, 23 nt, Mus musculus
aaagaaucuuccaguaauguauu

SEQ ID NO: 23323 - RNA, 112 nt, Mus musculus
auauaguuuauaugaaguauuuaaguuauaugacauggacagagcugaagugguccaauacuauuaucaauacauuacuggaagauucuuuucaccccugaauuugaugaag

SEQ ID NO: 23324 - RNA, 46 nt, Mus musculus
cucuuggaguccuuggcugugaggagaggcguggcugagagagaga

SEQ ID NO: 23325 - RNA, 42 nt, Mus musculus
ucugaggcuuucuuaccuggaagaagagaugauagccagcag

SEQ ID NO: 23326 - RNA, 46 nt, Mus musculus
accaaguaaaggcagcaguaggagauagaugccuaugcaauuucag

SEQ ID NO: 23327 - RNA, 47 nt, Mus musculus
ucaaaguuacaacauaaacaucaaauagcagcuuaacccaagauggg

SEQ ID NO: 23328 - RNA, 46 nt, Mus musculus
uuuaaauucuuucucaaaaacccuaauaaaacagugaagcccccuc

SEQ ID NO: 23329 - RNA, 45 nt, Mus musculus
auaucuuguucaacuaucauuagaggagcuuccuccugcugcaga

SEQ ID NO: 23330 - RNA, 42 nt, Mus musculus
auagggcuggaaaagcauuaaacauaacaaguuugcauaggu

SEQ ID NO: 23331 - RNA, 41 nt, Mus musculus
cacccuggaauccuugacgccucugaugcuuccgugguagu

SEQ ID NO: 23332 - RNA, 46 nt, Mus musculus
ucuagagagcuaaaguccucucuucuuuaacaccuagauuuugcag

SEQ ID NO: 23333 - RNA, 45 nt, Mus musculus
cuuuacacguuugugcuggcaagcugccuagucgaguccuuggag

SEQ ID NO: 23334 - RNA, 42 nt, Mus musculus
uuuguguauaugauagagccgcuggaacugacugaugaugag

SEQ ID NO: 23335 - RNA, 46 nt, Mus musculus
ugaugcugggaaaaccaaauaccauaaggaaauugauggcccaggc

SEQ ID NO: 23336 - RNA, 46 nt, Mus musculus
ggcugcucagugcaaaacaaaagcccucccuguucucucuaaagac

SEQ ID NO: 23337 - RNA, 46 nt, Mus musculus
ucccccucaccuugguggcucuuugcucucuucagcaugugccacc

SEQ ID NO: 23338 - RNA, 42 nt, Mus musculus
agagccaccaaggugagggggaaucuugaguaaaggcuacaa

SEQ ID NO: 23339 - RNA, 48 nt, Mus musculus
cucacacugucuucaccugcuaaucucccaagccagagccuuuguguc

SEQ ID NO: 23340 - RNA, 93 nt, Mus musculus
caaaggcucuggcuugggagauuagcaggugaagacagugugaggucacagcaggagguggggcagccuuggggaguagaucuagggagggaa

SEQ ID NO: 23341 - RNA, 46 nt, Mus musculus
ugcagcccaggccucccgaguauucugugugugccgccaugcccag

SEQ ID NO: 23342 - RNA, 45 nt, Mus musculus
gcacauguguauauauguauguguguguguguguguguguguaua

SEQ ID NO: 23343 - RNA, 54 nt, Mus musculus
aaagcacaggccgaccacacauaauccagaaaaccuuggcaggacaguauucua

SEQ ID NO: 23344 - RNA, 42 nt, Mus musculus
auagcugugguauguguggggcugugucuugcagaccucugu

SEQ ID NO: 23345 - RNA, 51 nt, Mus musculus
gcagugaccaguggccuuugcuaccugaauuacaauggcugagaagaagga

SEQ ID NO: 23346 - RNA, 42 nt, Mus musculus
cuaaaguguuaucugucggcguuuguuccugugaggggcugg

SEQ ID NO: 23347 - RNA, 45 nt, Mus musculus
guguguuugaagaaaugaaguauuuggagcuuaugauuguuaaug

SEQ ID NO: 23348 - RNA, 45 nt, Mus musculus
aguagagguugagacagguggaccgacacauagauagacagacag

SEQ ID NO: 23349 - RNA, 46 nt, Mus musculus
cagcaccugagcauccuggcucaaggcugugcacuacugcacucag

SEQ ID NO: 23350 - RNA, 46 nt, Mus musculus
auuaaacugcauaacugugacaaaauaaucacuagccgaaugagau

SEQ ID NO: 23351 - RNA, 23 nt, Mus musculus
uaagcagcucaaagaaauguuug

SEQ ID NO: 23352 - RNA, 42 nt, Mus musculus
uucaugggguugugaggaguggauauuuguugugcgggggac

SEQ ID NO: 23353 - RNA, 45 nt, Mus musculus
uaccaacacugaauacagaugacggucgucaucaucaucaucaug

SEQ ID NO: 23354 - RNA, 42 nt, Mus musculus
aacuauaauaggagagagagagagagagagagagagagagag

SEQ ID NO: 23355 - RNA, 44 nt, Mus musculus
cucucucucucuccuauuauaguuguuuaauaucugaccccuua

SEQ ID NO: 23356 - RNA, 42 nt, Mus musculus
agucagauacuuuacucaacauacauugaggaggaggaggag

SEQ ID NO: 23357 - RNA, 42 nt, Mus musculus
guugaccacagacuuugcgaaguuguugguaugcgcgugaga

SEQ ID NO: 23358 - RNA, 46 nt, Mus musculus
cacgcgcauaccaacaacuucgcaaagucuguggucaaccuuguag

SEQ ID NO: 23359 - RNA, 46 nt, Mus musculus
auuucuuuauugacugucuucaaagaccauucauuuauuuucuuag

SEQ ID NO: 23360 - RNA, 45 nt, Mus musculus
guugcuuaauucugugaguuauugauuugguccaaaguauugaga

SEQ ID NO: 23361 - RNA, 46 nt, Mus musculus
aaaaaaaaucacacaacucuguauucucuacucuccuuaaagagau

SEQ ID NO: 23362 - RNA, 46 nt, Mus musculus
aggcaaacacugggucaaacaugcacaaucagugagucagucagcg

SEQ ID NO: 23363 - RNA, 46 nt, Mus musculus
guccaagcacagagcagcuauccuuaaggucaaagcacaacccaag

SEQ ID NO: 23364 - RNA, 45 nt, Mus musculus
guuucuugaaagcuuguguguguuuccuucgaacauguuggcuag

SEQ ID NO: 23365 - RNA, 33 nt, Mus musculus
gucacuaaggaagagauucauccucucuuccca

SEQ ID NO: 23366 - RNA, 46 nt, Mus musculus
ccaccuccucuuucagcuuuuaucaauuuauaauaaucagcaauag

SEQ ID NO: 23367 - RNA, 46 nt, Mus musculus
cuuauccuccgucagcucuaucuuacauagagaacguugggacgag

SEQ ID NO: 23368 - RNA, 46 nt, Mus musculus
ugugagauaaugcacuuuucuuuucuucucugggaaggccugggug

SEQ ID NO: 23369 - RNA, 24 nt, Mus musculus
guggagaaguggaaggacacccgc

SEQ ID NO: 23370 - RNA, 45 nt, Mus musculus
cuugaaaugcagucuaaccuugaaaugcuugccuuuuccggccau

SEQ ID NO: 23371 - RNA, 41 nt, Mus musculus
uucagggugucccacucucgaaaguucucaaagugcagcau

SEQ ID NO: 23372 - RNA, 64 nt, Mus musculus
aaaguggucuuggucuaacauuugcaaguucuauaaauaccucaaguauuucuacuacauaguu

SEQ ID NO: 23373 - RNA, 79 nt, Mus musculus
cccuuccucuggaagcccacgcuggcaauggcguuucauaagaguauguauaaacaaaauugcaauuccucaagcacaa

SEQ ID NO: 23374 - RNA, 45 nt, Mus musculus
uuugacaguaaaauuaaauuuugaaaaucuucuuuuggcccucau

SEQ ID NO: 23375 - RNA, 45 nt, Mus musculus
cacacuuuccuaaaguucagcaaaggcagcauucuccagcugaca

SEQ ID NO: 23376 - RNA, 46 nt, Mus musculus
gaagcaggccagcaguugaaaagacagaacuggcauuauuagcaga

SEQ ID NO: 23377 - RNA, 46 nt, Mus musculus
gaaaucucaguaaagccaaagcgcuguaaaucucaagagaacugag

SEQ ID NO: 23378 - RNA, 27 nt, Mus musculus
ugcuaugagugcagcaaugacugagag

SEQ ID NO: 23379 - RNA, 46 nt, Mus musculus
cauguggggugugugugugucugugugugugugugugugugugugu

SEQ ID NO: 23380 - RNA, 42 nt, Mus musculus
ccaaaaagaaaaaagaaaaggaaaaaaaaaaaaaagaaauga

SEQ ID NO: 23381 - RNA, 46 nt, Mus musculus
auuuauauucaauucauaaaauuuuucuccuuagguccccacaucu

SEQ ID NO: 23382 - RNA, 46 nt, Mus musculus
uaagguacuguggaaagaaaaaugugguagaauauuagguugggau

SEQ ID NO: 23383 - RNA, 46 nt, Mus musculus
agagugcuuggcauugcacggaacugcuggaagagaacaugagaag

SEQ ID NO: 23384 - RNA, 46 nt, Mus musculus
agccagauguaguggcuggcacgugccuguaaugcaggcaugggag

SEQ ID NO: 23385 - RNA, 45 nt, Mus musculus
gguguucagauaccacagaccaucacuuuacacggagagggccca

SEQ ID NO: 23386 - RNA, 45 nt, Mus musculus
gcuuacugucaauuguugcaucccuggaagacacaggaccaggua

SEQ ID NO: 23387 - RNA, 49 nt, Mus musculus
gggaaauauauggguugucagguggugguaagugcaguggagaagggga

SEQ ID NO: 23388 - RNA, 49 nt, Mus musculus
uagagaagcuuugagagggugagaguugagcaaaaucccuaaagagaag

SEQ ID NO: 23389 - RNA, 69 nt, Mus musculus
agcagccauugagagaguuggaaauggggccagcuaggugaugggguguggaugggagaagcaguucac

SEQ ID NO: 23390 - RNA, 50 nt, Mus musculus
gaucuugugugugagacaaaaagacaaaugaaacacagaugaagaagaac

SEQ ID NO: 23391 - RNA, 45 nt, Mus musculus
uaaauguguuuuuccgaauguuccuaauuguacauuuacucucuc

SEQ ID NO: 23392 - RNA, 46 nt, Mus musculus
ugcagcuauagccaucuuguuuauggagguucggugggcacugaaa

SEQ ID NO: 23393 - RNA, 44 nt, Mus musculus
caccgaaccuccauaaacaagauggcuauagcugcaaucaaaau

SEQ ID NO: 23394 - RNA, 50 nt, Mus musculus
aauggcgagugcaagacaagggacaaucaaugccaguacaucugggggac

SEQ ID NO: 23395 - RNA, 45 nt, Mus musculus
ucaaaauaaauaaaugaaaauauaagcaaaaguagaaagggagga

SEQ ID NO: 23396 - RNA, 46 nt, Mus musculus
aauugcccuucucggugccuuccguguucagcuuuucauagcagaa

SEQ ID NO: 23397 - RNA, 64 nt, Mus musculus
acaaguucugcuaugaaaagcugaacacggaaggcaccgagaagggcaauuguggaaaggaugg

SEQ ID NO: 23398 - RNA, 46 nt, Mus musculus
auaaugcucuacuaaaaauaaaaauagguaaauguuaaaaggagag

SEQ ID NO: 23399 - RNA, 25 nt, Mus musculus
uccuguaauguacacugucuucacc

SEQ ID NO: 23400 - RNA, 44 nt, Mus musculus
ccaggcaaucagucuacaauagagccuuaucuccagcccucaga

SEQ ID NO: 23401 - RNA, 66 nt, Mus musculus
cacguaucggucaacuucaaggagagaucaucccgacuuccuucuaucaucaaggccgagugauug

SEQ ID NO: 23402 - RNA, 46 nt, Mus musculus
uuuccugacuucuaucuguuaccugcagucaaucacucggccuuga

SEQ ID NO: 23403 - RNA, 52 nt, Mus musculus
gaaacccaggaaagaacgaugaucgcaggucucaaacaagaaaaagcugaaa

SEQ ID NO: 23404 - RNA, 46 nt, Mus musculus
ugcaaacuucacuugccuaaaaucauagugguuaucaguaguuaag

SEQ ID NO: 23405 - RNA, 46 nt, Mus musculus
uuaauuacguccaaccaucccuccauacccugcuucacagucccaa

SEQ ID NO: 23406 - RNA, 46 nt, Mus musculus
uauaauucaguaaggcuauuaaagacaggugagguaacacacgcug

SEQ ID NO: 23407 - RNA, 46 nt, Mus musculus
auaaggcuauauuacaaacuaccauauugguaaaacauucagcaag

SEQ ID NO: 23408 - RNA, 45 nt, Mus musculus
uuauauccaguuucuaauuauuauccaaauucuaauuaccccuaa

SEQ ID NO: 23409 - RNA, 47 nt, Mus musculus
cagcauuauuucccucccauacuaucuuuuccccaccaggccuugga

SEQ ID NO: 23410 - RNA, 46 nt, Mus musculus
uggguguucucaauauuaaggauaagugaaagguguuuguguagac

SEQ ID NO: 23411 - RNA, 41 nt, Mus musculus
auaggugggagggaagaaaagucucgaauaaacccuggcuc

SEQ ID NO: 23412 - RNA, 93 nt, Mus musculus
gcauuacaauacauagcaaaagaccacaccucaacagugacccacauaaacauaagcaccacacuauccaacaacacagagccagcccgcaca

SEQ ID NO: 23413 - RNA, 47 nt, Mus musculus
ucaaucagggcuaacuugcggggcaagguaaggacaaccagagccag

SEQ ID NO: 23414 - RNA, 54 nt, Mus musculus
ugggcuugggauccgaggcaggagaccacgggagauaaggaagaagguggagag

SEQ ID NO: 23415 - RNA, 45 nt, Mus musculus
ucucuccaccuucuuccuuaucucccguggucuccugccucggau

SEQ ID NO: 23416 - RNA, 45 nt, Mus musculus
gguaagucauggaaaaaaauggccaugaagguuggccagcuggag

SEQ ID NO: 23417 - RNA, 46 nt, Mus musculus
uacguugaagaugggacuccguguggccccuccaugaugugcuuag

SEQ ID NO: 23418 - RNA, 45 nt, Mus musculus
uaaauaccugaaggacaugaguaaggcacaccuuugggguggggg

SEQ ID NO: 23419 - RNA, 41 nt, Mus musculus
uacuuacccucucucagcccuuagcugaugauggagugcga

SEQ ID NO: 23420 - RNA, 45 nt, Mus musculus
gauaacuuacuguauuaaacauguauauuuucauagcuguuccua

SEQ ID NO: 23421 - RNA, 98 nt, Mus musculus
caacgaagccaccugcaucugugauuucacuugggcaggcacagacugcagcauccgggauccaguucggaaccccaaccccccuaaggaugaaggcc

SEQ ID NO: 23422 - RNA, 45 nt, Mus musculus
gugugccuccuucugaagcuguggaaguggauuacugcugcagug

SEQ ID NO: 23423 - RNA, 45 nt, Mus musculus
cagcuucagaaggaggcacacaggaauauauccuuuugccacaga

SEQ ID NO: 23424 - RNA, 42 nt, Mus musculus
cacauucucuccagaggaaaguuguagucuuuuaugccccgu

SEQ ID NO: 23425 - RNA, 45 nt, Mus musculus
auagucaccaugugauauugaaaaugagaaugcucaggccccgag

SEQ ID NO: 23426 - RNA, 45 nt, Mus musculus
cagugcuguaaaaugaugcaacagaaacugagcgugcucccaguu

SEQ ID NO: 23427 - RNA, 49 nt, Mus musculus
ucauuuucucauuauucuccccucucucacccccucauuucauucccaa

SEQ ID NO: 23428 - RNA, 45 nt, Mus musculus
cugacagcuuuucacgaucuuugggaaugaaaugagggggugaga

SEQ ID NO: 23429 - RNA, 46 nt, Mus musculus
ugaacuuuaguguggucuguaugggauagcaugauucucacagcag

SEQ ID NO: 23430 - RNA, 91 nt, Mus musculus
cucuugccagggccuaacucuccaaaucuaacuucugaagguggauccgagaauguuuuguucuaguuuuaaaguaacaaaagacugagug

SEQ ID NO: 23431 - RNA, 42 nt, Mus musculus
gauccaccuucagaaguuagauuuggagaguuaggcccuggc

SEQ ID NO: 23432 - RNA, 45 nt, Mus musculus
ucuuggagacagggggaggagaaaugguauaagaaacugucagag

SEQ ID NO: 23433 - RNA, 45 nt, Mus musculus
auucauaaaguguuccauauuuuugacagacuugaggccccaggg

SEQ ID NO: 23434 - RNA, 46 nt, Mus musculus
uugcuaaucucuguaccauuccaguuuuuaguauaugugcugcuga

SEQ ID NO: 23435 - RNA, 49 nt, Mus musculus
cccagccacaggcaguugagaaaaaagaucuuuaaauguacaaacacua

SEQ ID NO: 23436 - RNA, 41 nt, Mus musculus
aaggguuaggaagaagaaaggagagaaaagagaggggcaga

SEQ ID NO: 23437 - RNA, 48 nt, Mus musculus
cucacacacccauauauacauguacagacaaacacagacagacagaca

SEQ ID NO: 23438 - RNA, 45 nt, Mus musculus
gcauauuguggacugugauggaguuuucucauuugguugcuauca

SEQ ID NO: 23439 - RNA, 46 nt, Mus musculus
gacuugugugggcagagacagugugccuaggaagguuggaccagac

SEQ ID NO: 23440 - RNA, 46 nt, Mus musculus
ccagaucugcugcuuuacaaacaggaaaaccaauuaucaguguuaa

SEQ ID NO: 23441 - RNA, 42 nt, Mus musculus
uuaacacugauaauugguuuuccuguuuguaaagcagcagau

SEQ ID NO: 23442 - RNA, 47 nt, Mus musculus
uuuagagcuuugaaaacaguaacuuuaaauauuuauaauauaccaga

SEQ ID NO: 23443 - RNA, 46 nt, Mus musculus
guguuaaaccagaaauacuggaggggagugugugcuggcugcaggg

SEQ ID NO: 23444 - RNA, 42 nt, Mus musculus
cccaccccccuccccacacccgcacacccgcgccaaggagcc

SEQ ID NO: 23445 - RNA, 27 nt, Mus musculus
gagaagggguaggacagacccuauagg

SEQ ID NO: 23446 - RNA, 43 nt, Mus musculus
uuugggacccaaaauaagacaaagcauuagaaccaacccccaa

SEQ ID NO: 23447 - RNA, 46 nt, Mus musculus
gguuccuuucuuaguuuccaaaacaggaggaggcaguguuucaccu

SEQ ID NO: 23448 - RNA, 46 nt, Mus musculus
ccacuuucaaaaagagcaaaacagagacuuuuuuuuuuuaugccau

SEQ ID NO: 23449 - RNA, 53 nt, Mus musculus
uuuuuugaccaguaaaccuagagaacaggaagcaagauugaaaauaauaaaca

SEQ ID NO: 23450 - RNA, 49 nt, Mus musculus
gcccuucuuuacaccacgcccauagaucacggucauuaccucaguaccu

SEQ ID NO: 23451 - RNA, 55 nt, Mus musculus
augaccgugaucuaugggcgugguguaaagaagggcaagugugucagacagcgaa

SEQ ID NO: 23452 - RNA, 45 nt, Mus musculus
ucagagaaaauuaacucaugucauuguacauacagcguagagccu

SEQ ID NO: 23453 - RNA, 75 nt, Mus musculus
auaaugaacaaaggcaguuccguaauaaaucaauggcuguggagguaaagcuacaccacaaacuuccaaaggccc

SEQ ID NO: 23454 - RNA, 67 nt, Mus musculus
cucuuucaaauuuuucaucauggcugcauucacaaauguguccccuguaaaaugcugcccacccaag

SEQ ID NO: 23455 - RNA, 45 nt, Mus musculus
guuauaauuuuuaaaaucaacgaauauuaaauuaacaucacauua

SEQ ID NO: 23456 - RNA, 45 nt, Mus musculus
ggagacacaacauuacacagagaagucuagugaaguacgggagga

SEQ ID NO: 23457 - RNA, 45 nt, Mus musculus
aguuucugagugaagcuauccauacuuagccaacuuucacagcau

SEQ ID NO: 23458 - RNA, 41 nt, Mus musculus
gccccacccugugccuccaaaaaucacccccagggccagaa

SEQ ID NO: 23459 - RNA, 47 nt, Mus musculus
acuugugauguuucuugugcaccauagaaccuucuccugucuggaac

SEQ ID NO: 23460 - RNA, 46 nt, Mus musculus
guauaauaauaauaauaaggucuguacuuugaaagccuugccagca

SEQ ID NO: 23461 - RNA, 88 nt, Mus musculus
aaaaaaaggaaagaaauugacuuccuugauguuauucucagacagauggagcugaagccugccaugucagucuaaauccauaggaaag

SEQ ID NO: 23462 - RNA, 46 nt, Mus musculus
auguuccuugcuccgauguguacgaacacuucaaagcugaacccug

SEQ ID NO: 23463 - RNA, 47 nt, Mus musculus
gcaacagcugcagcucaucuggcaguuuugucuuuaaagucccuagu

SEQ ID NO: 23464 - RNA, 46 nt, Mus musculus
cucccgaugcucuggugagcuugcucugcacuuaauccuugcccuc

SEQ ID NO: 23465 - RNA, 45 nt, Mus musculus
uacuuagagggcaaggauuaagugcagagcaagcucaccagagca

SEQ ID NO: 23466 - RNA, 46 nt, Mus musculus
gcacagacuagcuuaucaggaagcccuuuuuucuucagcacccaga

SEQ ID NO: 23467 - RNA, 46 nt, Mus musculus
auauuacacaugacacuauucuaccauaguugccaggccuggccag

SEQ ID NO: 23468 - RNA, 42 nt, Mus musculus
uaugucuucuaucuuccuuaguggccauaguuucagugccuu

SEQ ID NO: 23469 - RNA, 46 nt, Mus musculus
gaguuucaucaaggcaguuauucacaaacuuccuauaaagggcgag

SEQ ID NO: 23470 - RNA, 45 nt, Mus musculus
acagcgauaacuuuuugcagauauacugauagcacuguugagaaa

SEQ ID NO: 23471 - RNA, 46 nt, Mus musculus
cugugcuauaguaaaaugucuuuacccagauagauagugaggccag

SEQ ID NO: 23472 - RNA, 42 nt, Mus musculus
uuuuuuuccucagauauuucuucaguguuaaggccccaaagu

SEQ ID NO: 23473 - RNA, 46 nt, Mus musculus
gaacacuaucauuggcuccuccuucaucuuauguauucagcagcag

SEQ ID NO: 23474 - RNA, 53 nt, Mus musculus
uuauuucaaguuuggaggaagauuaaccuaacugaguuuaagauuagugggaa

SEQ ID NO: 23475 - RNA, 25 nt, Mus musculus
aaaagagaggugcccgagccacaga

SEQ ID NO: 23476 - RNA, 46 nt, Mus musculus
cauuaaagccaguuaaaauguuaucauuaaaagcugacugugaaag

SEQ ID NO: 23477 - RNA, 46 nt, Mus musculus
gcuggacaacaccuuauucaaaugaggggaaauccaaauaccaggc

SEQ ID NO: 23478 - RNA, 72 nt, Mus musculus
guguuuuuguuuggguuuuccucaaucuggaaaacuuuucuuagugucccacuacugugaaaaagucacccu

SEQ ID NO: 23479 - RNA, 45 nt, Mus musculus
gagggguggauacagagguucaaacccagcucugcugacugugug

SEQ ID NO: 23480 - RNA, 46 nt, Mus musculus
cacugaauucaguguaaauaaaaccaguuucccuuagaagcagcaa

SEQ ID NO: 23481 - RNA, 47 nt, Mus musculus
gucuuugguaguuacuguugcugugauaaaacaccaugaccaaagca

SEQ ID NO: 23482 - RNA, 46 nt, Mus musculus
ggcaagaagaugaaauaaaggugccaaucagguaguuuucugacag

SEQ ID NO: 23483 - RNA, 46 nt, Mus musculus
accucucauggcaguucuugauagaauguucucuaauagccugcag

SEQ ID NO: 23484 - RNA, 46 nt, Mus musculus
uugggcuagacacuuucuucuccauacaucaucaugaugccaggcu

SEQ ID NO: 23485 - RNA, 41 nt, Mus musculus
uucagauugcuuucuucacugcugggacuuuaguggaagag

SEQ ID NO: 23486 - RNA, 46 nt, Mus musculus
uugcugcauugaauuaagucacuaggccaagccaccacauguccag

SEQ ID NO: 23487 - RNA, 45 nt, Mus musculus
auguugaagauauucaugcuugguauuuaaaaaaaaagaaaggaa

SEQ ID NO: 23488 - RNA, 42 nt, Mus musculus
gcauuagucugcauacuggcgggcacaacuccacagccacca

SEQ ID NO: 23489 - RNA, 46 nt, Mus musculus
cuguguugugucuugcuauucuuuuuuucuuucucuucaagcccag

SEQ ID NO: 23490 - RNA, 46 nt, Mus musculus
cuuggagacugccucugugugaguggauuacucugcucugggacac

SEQ ID NO: 23491 - RNA, 41 nt, Mus musculus
cgucaagaagaggagauucgaucccacucagcaaggcccca

SEQ ID NO: 23492 - RNA, 46 nt, Mus musculus
uuuccaaaagggaccuuugucuuguaccccaucccaauucucagau

SEQ ID NO: 23493 - RNA, 46 nt, Mus musculus
gccucagaucugagaauugggaugggguacaagacaaaggucccuu

SEQ ID NO: 23494 - RNA, 68 nt, Mus musculus
caacaacuucagaauccuuuuuuuucuuuuuaacuaaaggagaagggaguagcaacaagugcaauaaa

SEQ ID NO: 23495 - RNA, 68 nt, Mus musculus
agaacaaauagcaaaugacccugccccccagccugcuggcacuuaauauuuucuaaaugauuuggcau

SEQ ID NO: 23496 - RNA, 46 nt, Mus musculus
agggggggggggacacagaaaauaacccauaacaagaacacaaaag

SEQ ID NO: 23497 - RNA, 46 nt, Mus musculus
gccccuacuucuccacuggcccauuuuuaccaagaagacauccaga

SEQ ID NO: 23498 - RNA, 45 nt, Mus musculus
aaucguacuguacgaaaugggucagaaucauuuucagugguguua

SEQ ID NO: 23499 - RNA, 51 nt, Mus musculus
uuuacuaugcaaagaugggaaaugcacaaacuuccaagacaugucugaaga

SEQ ID NO: 23500 - RNA, 47 nt, Mus musculus
ccgcgaacgaaagcagugacggaggagcuuguaccaccgguaagagg

SEQ ID NO: 23501 - RNA, 41 nt, Mus musculus
uggugcuugaaaacaguuucgguuuuaacccuuuccacuaa

SEQ ID NO: 23502 - RNA, 60 nt, Mus musculus
uuacuguaccauugaauugugauugguccauacaaggcuuuugguuaggaauaaauauug

SEQ ID NO: 23503 - RNA, 46 nt, Mus musculus
augucauaauuucuccaaacuuacuguguuuaauacaguuggccag

SEQ ID NO: 23504 - RNA, 35 nt, Mus musculus
auuugucauuugaaaacaaucaaaggaaagagaac

SEQ ID NO: 23505 - RNA, 45 nt, Mus musculus
guuuuguauuucuugcucaaauagaaaacaaguagguuggcacac

SEQ ID NO: 23506 - RNA, 42 nt, Mus musculus
gcagcuuaaagcuauaguagguuuuaaguauacaugcuacag

SEQ ID NO: 23507 - RNA, 45 nt, Mus musculus
aggacuacacaaagcauguguauagauuugguaaaaaugggguag

SEQ ID NO: 23508 - RNA, 46 nt, Mus musculus
cauaaucuguaauuucugcacacauuagauaguccagccaugaaaa

SEQ ID NO: 23509 - RNA, 46 nt, Mus musculus
aguuuuauguaaguagugugugugugugugugugugugugugugug

SEQ ID NO: 23510 - RNA, 42 nt, Mus musculus
uuguuagccaguugugcaucuacugccacagucagcccuggg

SEQ ID NO: 23511 - RNA, 46 nt, Mus musculus
uuaccagguacauauauaauuuauauuuuucccucccauuguauag

SEQ ID NO: 23512 - RNA, 46 nt, Mus musculus
aagcauagugcugagauuguguugcucagaauaacuucucgagaag

SEQ ID NO: 23513 - RNA, 46 nt, Mus musculus
ucgaugaaggggugcuauauugaccaccgggagacuauucgcagag

SEQ ID NO: 23514 - RNA, 45 nt, Mus musculus
ggaacaguauacacugaugaaccauauccagccuccugaagauag

SEQ ID NO: 23515 - RNA, 47 nt, Mus musculus
gcuuuaauuuucaguuucaugacaauuuguguuaacuugguguagau

SEQ ID NO: 23516 - RNA, 47 nt, Mus musculus
ugcuguaacagaagcugaaaaucaacaaaugacaguucaagcccagc

SEQ ID NO: 23517 - RNA, 46 nt, Mus musculus
ggacagccagggcuacacagagaaacccugucucagaaagaguccu

SEQ ID NO: 23518 - RNA, 46 nt, Mus musculus
guuguuggugguuuuguuuuucauugucagaauccuugugacccag

SEQ ID NO: 23519 - RNA, 46 nt, Mus musculus
uuucauccaaaauuaaaacacuucuuaaaauuccaccuguuaccag

SEQ ID NO: 23520 - RNA, 42 nt, Mus musculus
acuguaaccuuagugcagcugcccaaugggcagacaguccag

SEQ ID NO: 23521 - RNA, 42 nt, Mus musculus
gauguaaccuuagugcagcugcccaaugggcagacaguccag

SEQ ID NO: 23522 - RNA, 46 nt, Mus musculus
uuaucaaacaggguggaaguaucccucaaacuucuagaugguagaa

SEQ ID NO: 23523 - RNA, 46 nt, Mus musculus
auccauuucuucaacaaauguuuauugaugacaugcuaugugccag

SEQ ID NO: 23524 - RNA, 46 nt, Mus musculus
ucuguuugaaaagacaaaaucuuuuagauuagagaaaggccacaaa

SEQ ID NO: 23525 - RNA, 55 nt, Mus musculus
uacguauguaugugcauauauguauacacauagacacauggcuugugaaggcugg

SEQ ID NO: 23526 - RNA, 46 nt, Mus musculus
aaaaauaaaauaaacauauguaguuuuauuuuuuauacugccccac

SEQ ID NO: 23527 - RNA, 46 nt, Mus musculus
agccagcuuauucuuugaguagaaaaaggcuacugauuuguuugag

SEQ ID NO: 23528 - RNA, 45 nt, Mus musculus
ugugacuggggaauugguuuuggaggagagaaaauauaggugaag

SEQ ID NO: 23529 - RNA, 45 nt, Mus musculus
gauacauuuuuuaccuagugcguguacacaugcaugggagcagau

SEQ ID NO: 23530 - RNA, 27 nt, Mus musculus
cugcccucaagaaaugugcagcgccag

SEQ ID NO: 23531 - RNA, 44 nt, Mus musculus
ccagccugcugagcugacguaaugugugggccacacaggaaagu

SEQ ID NO: 23532 - RNA, 46 nt, Mus musculus
ugcauuuacacugugcagccaacaggagcguuuucaagauguccag

SEQ ID NO: 23533 - RNA, 46 nt, Mus musculus
caagcuuugauaguguuuaacugaaaaaugguuuagaaagggcuag

SEQ ID NO: 23534 - RNA, 42 nt, Mus musculus
aaauuucauccuccaacuuuaguucuauguagagcaugccaa

SEQ ID NO: 23535 - RNA, 43 nt, Mus musculus
auuuauuuuuuaaaaaaaagaaaaauuaaaaaaaaaauaagag

SEQ ID NO: 23536 - RNA, 42 nt, Mus musculus
ggugggucccagcuggggaaauguuacauuguuaccagcaag

SEQ ID NO: 23537 - RNA, 47 nt, Mus musculus
uucuaagcuucuaagggcaucucaaaagauaagaguaaguccgagau

SEQ ID NO: 23538 - RNA, 45 nt, Mus musculus
auauuaaaagugggaaauuuugugaacauuuuucuguguguguag

SEQ ID NO: 23539 - RNA, 46 nt, Mus musculus
cccauuaaaauuucaguucaguauuuucucuaaauuucauuuuuag

SEQ ID NO: 23540 - RNA, 44 nt, Mus musculus
gacaggugggaauagacugaaucaucaagaaugugcugagcugg

SEQ ID NO: 23541 - RNA, 46 nt, Mus musculus
uuaagugauaugugaacugaccuaaaaggaaaggaagcaguggggg

SEQ ID NO: 23542 - RNA, 46 nt, Mus musculus
cuguguuggaagccauaaaacuaguacuguaucauguuaaggaaug

SEQ ID NO: 23543 - RNA, 91 nt, Mus musculus
aauuccugaauauauucaugugauagucuaaguuuguuauuuggaauaaggaaaggagaucuaaguacauguauuggugacaugcugaguu

SEQ ID NO: 23544 - RNA, 46 nt, Mus musculus
uuauuguuugcguauaugaacaagugcagguaccugaggaugacag

SEQ ID NO: 23545 - RNA, 30 nt, Mus musculus
agcacaauuuuccugagcaaaucucaaacg

SEQ ID NO: 23546 - RNA, 45 nt, Mus musculus
guaucagaauugaucaauuaauuuuuuuuuauucuuagugcguga

SEQ ID NO: 23547 - RNA, 46 nt, Mus musculus
aggcaugcaugaauuuuuguccauuuuuacucuaauauuuuugaag

SEQ ID NO: 23548 - RNA, 46 nt, Mus musculus
gaaaccugcaauuaaaaccuuagccaagugcccugggucauaucuc

SEQ ID NO: 23549 - RNA, 44 nt, Mus musculus
gauauaguuuguuauggaccuuuaaauuuuauugagagccagua

SEQ ID NO: 23550 - RNA, 45 nt, Mus musculus
cugucuccucuuuacuuucuaguuuaucuuuuucuucuugacgau

SEQ ID NO: 23551 - RNA, 46 nt, Mus musculus
uucugaaauuuuagcauucucauuaauucccuuuugcugucgccuu

SEQ ID NO: 23552 - RNA, 46 nt, Mus musculus
aggauuuggaggccaaaccuacuuggccucaguaucuuuuucuggg

SEQ ID NO: 23553 - RNA, 46 nt, Mus musculus
cggcucuaauggguuaguacuuuacuccugauccuccugccccacc

SEQ ID NO: 23554 - RNA, 71 nt, Mus musculus
aaaggaaggcacaucugaauuagugguuuucuuuaagaaugcuaaguuauugguauuuuguucuaaagagu

SEQ ID NO: 23555 - RNA, 69 nt, Mus musculus
ggcagagauaugcuggaagguagauggagucaggggauagagggaguaaggcucccguggagagcacaa

SEQ ID NO: 23556 - RNA, 45 nt, Mus musculus
auguacacaaucauucuacccaauugaaauuaucuuaaggaacag

SEQ ID NO: 23557 - RNA, 58 nt, Mus musculus
uggguaagucugugaugaaagaacauuccauguacucaaggaaaguaggauggccaug

SEQ ID NO: 23558 - RNA, 46 nt, Mus musculus
guaaacgguuacagaaaccacuccacagcaacagcgcugaccacag

SEQ ID NO: 23559 - RNA, 46 nt, Mus musculus
uaaccguaaaccaaaaauauuccaaaugugggaaauuaaguugaag

SEQ ID NO: 23560 - RNA, 45 nt, Mus musculus
ugcaggucucucucaagccgcauccuugcaggccuaugcaccggc

SEQ ID NO: 23561 - RNA, 45 nt, Mus musculus
ccaugauguuuucuccuggcagccggugucaagauuagugcugcc

SEQ ID NO: 23562 - RNA, 45 nt, Mus musculus
uacaaggucuuguggaagccacugaaauucuaauucugacuccag

SEQ ID NO: 23563 - RNA, 50 nt, Mus musculus
cuugccagccuuguuuaggccugggcccaggauacgugggaucugcuuaa

SEQ ID NO: 23564 - RNA, 48 nt, Mus musculus
caccgagaacuuggggcgugggguggacuugagccugacggugcccga

SEQ ID NO: 23565 - RNA, 45 nt, Mus musculus
aagcagcucagauuacaagagagucucacaaacaagacaagaagc

SEQ ID NO: 23566 - RNA, 46 nt, Mus musculus
ugagcuggagcagauugaauuacacaacagcaucaaggacaggcag

SEQ ID NO: 23567 - RNA, 44 nt, Mus musculus
uucccaccgaaaguuuacauaaaauuauaaaagaccuugggagu

SEQ ID NO: 23568 - RNA, 45 nt, Mus musculus
uggagagauuuuauauaaauacugaauuucugacuuuugcuggag

SEQ ID NO: 23569 - RNA, 46 nt, Mus musculus
caaggcaagcaucuguaaccaguuucucauuguguccugggcccua

SEQ ID NO: 23570 - RNA, 45 nt, Mus musculus
agacguagauuccucuguuacagcagcuauggauuauccccagca

SEQ ID NO: 23571 - RNA, 46 nt, Mus musculus
guguuaguuuuaaauacaaaagacauuuaagaaguaacguaacaag

SEQ ID NO: 23572 - RNA, 46 nt, Mus musculus
uuuuuaccauuuauuaaagaucaguauaaaauagcaugcuaacaag

SEQ ID NO: 23573 - RNA, 46 nt, Mus musculus
cacccucccugcuccccaacccacccauucccacuuccuagcccag

SEQ ID NO: 23574 - RNA, 42 nt, Mus musculus
cugccaguuuccuugacaucaugcccuccuaguauggcccaa

SEQ ID NO: 23575 - RNA, 48 nt, Mus musculus
auuugaucuuauuuugcauacuaucucacuaagaaugaccccaaaggc

SEQ ID NO: 23576 - RNA, 79 nt, Mus musculus
auuucuaggaccuagagcauccauuacuguagcaguucaauaagaucauaugaagaagcauauggaaaggauuacaugg

SEQ ID NO: 23577 - RNA, 46 nt, Mus musculus
acuuagaucucaguuuucugauuucauuucuuuuuacauauagcag

SEQ ID NO: 23578 - RNA, 46 nt, Mus musculus
gauaaagacuauaacaaaguauagcuaaacacuuuuuuaaugccag

SEQ ID NO: 23579 - RNA, 46 nt, Mus musculus
uauaggcugacuucaucccaugagcuggguauauuccucucaguaa

SEQ ID NO: 23580 - RNA, 44 nt, Mus musculus
uagaaaauauaaagcugggcggcuagggaggaccuggaaggagu

SEQ ID NO: 23581 - RNA, 46 nt, Mus musculus
uauaguugucuauucaguagacauaacugcaauauaugucauugag

SEQ ID NO: 23582 - RNA, 46 nt, Mus musculus
ggccuaauaaugcugucuuuagaauuuaaaauuuauuagcuaccug

SEQ ID NO: 23583 - RNA, 42 nt, Mus musculus
gcagagauacugugugcagcuuaggguuaguuaacccaacag

SEQ ID NO: 23584 - RNA, 46 nt, Mus musculus
acaugauugugucuggcagugccauuaugaggagugaugaccccag

SEQ ID NO: 23585 - RNA, 46 nt, Mus musculus
ucgaagcagugcugcauuccagugauuaaaaucaauugugcaggau

SEQ ID NO: 23586 - RNA, 46 nt, Mus musculus
aaguuuuuacuuuucuuauuuucaguguaacugaauccucuggcag

SEQ ID NO: 23587 - RNA, 64 nt, Mus musculus
aggugauagaaucuccauugccuaacaguuaaguacauagauagaugaaaguuuuuacugauau

SEQ ID NO: 23588 - RNA, 46 nt, Mus musculus
cuuucuauagaauuccauuauuuaccuaaagauagaaucagcuguu

SEQ ID NO: 23589 - RNA, 46 nt, Mus musculus
gauauuauauucauuaggacaaugagcaggaaccaaauguacacag

SEQ ID NO: 23590 - RNA, 46 nt, Mus musculus
ucuccaacaaaucaaguuaaguuauuagaacagcucuacuuucaag

SEQ ID NO: 23591 - RNA, 45 nt, Mus musculus
cacaggcuaacaacaguuauugggaauccaaugauaagauaguag

SEQ ID NO: 23592 - RNA, 35 nt, Mus musculus
ugaacucagcagcagguuauauauaugagguucua

SEQ ID NO: 23593 - RNA, 42 nt, Mus musculus
uccaggugauauagccuauccuauuggguaaauuucuugcag

SEQ ID NO: 23594 - RNA, 46 nt, Mus musculus
ccauccuuacccauugugggccuuauguuccuuuagaagccuuaag

SEQ ID NO: 23595 - RNA, 46 nt, Mus musculus
guuaaccuggucugucccucauuagaaaagaacaggcuucuuagag

SEQ ID NO: 23596 - RNA, 45 nt, Mus musculus
cuuaauuuuuuguaugcauugauuuuuuuuuucaaaagaaugaga

SEQ ID NO: 23597 - RNA, 107 nt, Mus musculus
uaugggcaccugcacucaugugcacauaucuauacacagacacauagcgacacacacacacacaaaagaaagcaaucaucuggagaacacauggaaaagccccaaga

SEQ ID NO: 23598 - RNA, 48 nt, Mus musculus
aucacuacucagguaaugaaaucaggcucagacucaugaaagcuaaua

SEQ ID NO: 23599 - RNA, 46 nt, Mus musculus
aucauaauaccaaaucaucauagugcucuuuucuagccagccugac

SEQ ID NO: 23600 - RNA, 50 nt, Mus musculus
uaguauacucgcauacaucuugagagagaggagagagaaaagaggagaga

SEQ ID NO: 23601 - RNA, 46 nt, Mus musculus
aauaaugccaaagcuacuacuaaaaauaaguugaaaaauuggugag

SEQ ID NO: 23602 - RNA, 41 nt, Mus musculus
uuucugauugucaaaaauaaaauuauaaaccucugacaaca

SEQ ID NO: 23603 - RNA, 45 nt, Mus musculus
auagccagggcuacacagagacccugucuugaaaacugaaacggg

SEQ ID NO: 23604 - RNA, 46 nt, Mus musculus
aguauaucuuaauuuacuuggacuugagcuuuauacacuggaucga

SEQ ID NO: 23605 - RNA, 46 nt, Mus musculus
caaguaaggaugccucaaucccucuugggaggaagaagaaagcaau

SEQ ID NO: 23606 - RNA, 41 nt, Mus musculus
uuugaaacuuuggaaacacacacaaaaagaaaguggggagg

SEQ ID NO: 23607 - RNA, 36 nt, Mus musculus
aaacuguuaaugaucucagucaacugugcacucuac

SEQ ID NO: 23608 - RNA, 46 nt, Mus musculus
uuuacacauacugaagaauucuuacaucacuaaaaugacgccuauu

SEQ ID NO: 23609 - RNA, 42 nt, Mus musculus
aaaacaguaaagugaucacauccuacuauccucauaggaaac

SEQ ID NO: 23610 - RNA, 42 nt, Mus musculus
ccaugggcagucuccaacuccacaccuccagcuccagggcau

SEQ ID NO: 23611 - RNA, 55 nt, Mus musculus
gauaguagacuagaaacugccucuaugugucuaugccauaguuacagaaaagugc

SEQ ID NO: 23612 - RNA, 50 nt, Mus musculus
agugauagagcaucugaaaauaacagcagagaaacaagugauagacugaa

SEQ ID NO: 23613 - RNA, 46 nt, Mus musculus
auaacaaaaaugauacccccaaacuagaaaagauccaaaccaacag

SEQ ID NO: 23614 - RNA, 44 nt, Mus musculus
auaaauaauuguaauaacacaugguauggcaggagguaguggga

SEQ ID NO: 23615 - RNA, 46 nt, Mus musculus
auacucacacauguaagacuuuaucucacuguaguuuuacuuuggg

SEQ ID NO: 23616 - RNA, 46 nt, Mus musculus
caucuucauguuuaggucuuuaauccaucuugaacuaaauauggac

SEQ ID NO: 23617 - RNA, 46 nt, Mus musculus
uuucuuaucuuaaaaggaaggcuuucaaguuugcuauuacuaagag

SEQ ID NO: 23618 - RNA, 46 nt, Mus musculus
gaaccaaauagaaucuaguguuguaaagggacaaaagggaagccaa

SEQ ID NO: 23619 - RNA, 46 nt, Mus musculus
auuuuuucuaaugguauauucauccaacucgucaucugagcugcua

SEQ ID NO: 23620 - RNA, 46 nt, Mus musculus
ucaagugugaagguacuaggacuagauaguauuuaaaggccgagau

SEQ ID NO: 23621 - RNA, 46 nt, Mus musculus
uuaacuccugagccaacucuucagccuaguucuaguucugugagau

SEQ ID NO: 23622 - RNA, 46 nt, Mus musculus
cuuuaaaacauuuuaaaagauggugugacuaucugagugugugggu

SEQ ID NO: 23623 - RNA, 47 nt, Mus musculus
uucuucucgccacccuucuuugcgggagccauucugccgggcccaag

SEQ ID NO: 23624 - RNA, 45 nt, Mus musculus
uauccaugccugcgccucggggaaucucuguggaacggcugcuga

SEQ ID NO: 23625 - RNA, 45 nt, Mus musculus
cauauccgacacaaacccuguagcaggaaaucaggcagugggagu

SEQ ID NO: 23626 - RNA, 42 nt, Mus musculus
cgcccucaaggccugagggcggggcuuuaguaaugcggucca

SEQ ID NO: 23627 - RNA, 46 nt, Mus musculus
ucaucagugcugugcccaagggugguggcaguccuuagccccauac

SEQ ID NO: 23628 - RNA, 46 nt, Mus musculus
gcuauuugggagcuaugauccacagaaacagcucaucauugaagau

SEQ ID NO: 23629 - RNA, 41 nt, Mus musculus
agcagcgccguuuccgacuggaacgugggccggcccccaga

SEQ ID NO: 23630 - RNA, 51 nt, Mus musculus
ugauuauuuuuauaagcacaugccaacgcuuuacuacuguggaaagacaag

SEQ ID NO: 23631 - RNA, 48 nt, Mus musculus
caccccucccacaggacucacuuugucccaacaauucagauugccuag

SEQ ID NO: 23632 - RNA, 46 nt, Mus musculus
gguguuugaacacacagccacaggccauguccugacagugcugcag

SEQ ID NO: 23633 - RNA, 85 nt, Mus musculus
gaaauguacugaaugcuaguacccaagaccuugagcaggaaagucacccagacaccucugcuuucuuuugccaucugaccugcag

SEQ ID NO: 23634 - RNA, 28 nt, Mus musculus
cauuuccuccuaguuggcuaccuguguu

SEQ ID NO: 23635 - RNA, 45 nt, Mus musculus
guuguuuaagagaaucaaaaguucuuaugguuuggucugggauca

SEQ ID NO: 23636 - RNA, 27 nt, Mus musculus
agaacagggugaccaacugucaccauu

SEQ ID NO: 23637 - RNA, 60 nt, Mus musculus
auggcuccagagcaaaaggcuuaagggugaaaggaccacucaaagauggagggucugcua

SEQ ID NO: 23638 - RNA, 107 nt, Mus musculus
ugccccauugagugcuucaugccgcuagaugugcaagcugacagagacgauucucgagaguaaucuuuccagccccacccuacaagugucucucuaccaaggucaau

SEQ ID NO: 23639 - RNA, 42 nt, Mus musculus
cgagaaucgucucugucagcuugcacaucuagcggcaugaag

SEQ ID NO: 23640 - RNA, 52 nt, Mus musculus
ccagucccgauggcaccaccggccacaccuacaaccaguauacacagagaua

SEQ ID NO: 23641 - RNA, 64 nt, Mus musculus
guguggccgguggugccaucgggacuggguucagcagccccaggucuacggcaguugucacagc

SEQ ID NO: 23642 - RNA, 42 nt, Mus musculus
ccuagagcagaaagccuaccaaggaggaagguaggaccaaag

SEQ ID NO: 23643 - RNA, 41 nt, Mus musculus
ugcuggcacacauuugcuuucucaucacuccugagcuggga

SEQ ID NO: 23644 - RNA, 46 nt, Mus musculus
auaaggccaggcuggagagugguggcacacacccagaggcagguag

SEQ ID NO: 23645 - RNA, 46 nt, Mus musculus
cccagaaaucuggggcacaaggaauaaugccccucacccccacagu

SEQ ID NO: 23646 - RNA, 45 nt, Mus musculus
gucccacaaguuucccuuugaccuccacacauuuugggcacaugu

SEQ ID NO: 23647 - RNA, 45 nt, Mus musculus
agggggcuggagaugguggcacaucccuuuaaucccagcacucag

SEQ ID NO: 23648 - RNA, 46 nt, Mus musculus
cugcuuccuucccuccccacuuaaugauagcuauccuaaaccccag

SEQ ID NO: 23649 - RNA, 45 nt, Mus musculus
cuaugacgaugggaagaccuaccauguaggagaacaguggcagaa

SEQ ID NO: 23650 - RNA, 51 nt, Mus musculus
aucacacuugaauucucccuuuccauucccgaggcaugugcagcucauccg

SEQ ID NO: 23651 - RNA, 49 nt, Mus musculus
agggagaaaauggccagcggaugagcugcacaugccucgggaauggaaa

SEQ ID NO: 23652 - RNA, 41 nt, Mus musculus
cuccgaucuuguaguugacaccguugucauggcaccauucu

SEQ ID NO: 23653 - RNA, 46 nt, Mus musculus
agucuuugcuggauaugucauaacugccuuauacauuugcucaucg

SEQ ID NO: 23654 - RNA, 45 nt, Mus musculus
uuugugaguauaaauguucaccucuguccuuacucaauacuaaag

SEQ ID NO: 23655 - RNA, 46 nt, Mus musculus
aaaauguuacuuggagucaaacagucuacuucuguuugcaucaugu

SEQ ID NO: 23656 - RNA, 60 nt, Mus musculus
cuuuaagcucacaugccagugcuugggcuuuggcaguggucauuucagaugcgauucauc

SEQ ID NO: 23657 - RNA, 59 nt, Mus musculus
cugccaaagcccaagcacuggcaugugagcuuaaagccagcgucagacaaccgcuccca

SEQ ID NO: 23658 - RNA, 51 nt, Mus musculus
ugcuuugacccuuacacgguuucccauuacgccauuggagaggagugggag

SEQ ID NO: 23659 - RNA, 24 nt, Mus musculus
ucuguuucucaugacaugaagcag

SEQ ID NO: 23660 - RNA, 46 nt, Mus musculus
ccucugguucugcagugccuccacuaugauguuguaggugaccccu

SEQ ID NO: 23661 - RNA, 53 nt, Mus musculus
cuacaacaucauaguggaggcacugcagaaccagaggaggcacaagguucggg

SEQ ID NO: 23662 - RNA, 45 nt, Mus musculus
gugcuagaaucaauuuuuauuguguuauuuuuagaaaguggcaga

SEQ ID NO: 23663 - RNA, 45 nt, Mus musculus
gggcagaggcuacgacucugacuggagguuguuugacucagagag

SEQ ID NO: 23664 - RNA, 54 nt, Mus musculus
cgccguuccaggagaguucugaguacaucauuucaugccaaccaguuggcaccg

SEQ ID NO: 23665 - RNA, 47 nt, Mus musculus
uggauugaggcccggaacaugaggauagaggugguagucuacgucuc

SEQ ID NO: 23666 - RNA, 97 nt, Mus musculus
uagaugaggagguccaaaucggucauguucccaggggagacguagacuaccaccucuauccucauguuccgggccucaauccaaaugccucuacagg

SEQ ID NO: 23667 - RNA, 46 nt, Mus musculus
uucggcagguauggucuuggccuaagccugacggggguggccgcag

SEQ ID NO: 23668 - RNA, 67 nt, Mus musculus
guauucagcuuccuggcacaacccaccagcaacccaguguugggcaacaaaugaucuuugaggaaca

SEQ ID NO: 23669 - RNA, 52 nt, Mus musculus
ugaagggggucuuuugaacuguggagggaacauccaagaucucugguccaug

SEQ ID NO: 23670 - RNA, 76 nt, Mus musculus
ccccaacugguuacccuuccacaccccaaucuucauggaccagagaucuuggauguucccuccacaguucaaaaga

SEQ ID NO: 23671 - RNA, 42 nt, Mus musculus
ucaaacacuucaguucguugcaaagccuuaauuggagcagag

SEQ ID NO: 23672 - RNA, 47 nt, Mus musculus
gagccaggaaccgaguacaccaucuacgucauugcccugaagaacaa

SEQ ID NO: 23673 - RNA, 47 nt, Mus musculus
ugauuguucuucagggcaaugacguagaugguguacucgguuccugg

SEQ ID NO: 23674 - RNA, 71 nt, Mus musculus
acuccuugcuggugucauggcaggcgccccgugccaggauuacuggcuacauuaucaaguaugagaagccu

SEQ ID NO: 23675 - RNA, 43 nt, Mus musculus
caugacaccagcaaggaguugggugugguggucaggaaccgca

SEQ ID NO: 23676 - RNA, 74 nt, Mus musculus
ugacuacaagauccaccuguacacucugaacgacaaugcccggagcucgcccgugaucaucgaugccuccaccg

SEQ ID NO: 23677 - RNA, 43 nt, Mus musculus
uucuaacauccgggcugaugcuccucugaacuggggucuggcc

SEQ ID NO: 23678 - RNA, 50 nt, Mus musculus
uggcuuccaagucgaugccaucccagccaauggccagaccccaguucaga

SEQ ID NO: 23679 - RNA, 61 nt, Mus musculus
gugauugucucugucuuuguucuccagcuaauagugaugguggucucuguagcguccguca

SEQ ID NO: 23680 - RNA, 49 nt, Mus musculus
ccgugugacggacgcuacagagaccaccaucacuauuagcuggagaaca

SEQ ID NO: 23681 - RNA, 34 nt, Mus musculus
gaccagcccagggagucaucacuacucuggagag

SEQ ID NO: 23682 - RNA, 35 nt, Mus musculus
uugucaguguguccuugagagcauagacacugacu

SEQ ID NO: 23683 - RNA, 62 nt, Mus musculus
uuaccaugaguccugacacaaucaccgaugagcugucuggagaaagguugauuucuuucauu

SEQ ID NO: 23684 - RNA, 49 nt, Mus musculus
acuggcuaccgggugcgggugaacccgaaagagaagacaggaccaauga

SEQ ID NO: 23685 - RNA, 51 nt, Mus musculus
gguccugucuucucuuucggguucacccgcacccgguagccagugagcuga

SEQ ID NO: 23686 - RNA, 45 nt, Mus musculus
ucugaaguucagucaggugacacccaccagcuuuacugcccagug

SEQ ID NO: 23687 - RNA, 46 nt, Mus musculus
gggccauugcucaucuuuuucauacaaauggaaaaaaaaucaauuc

SEQ ID NO: 23688 - RNA, 46 nt, Mus musculus
cgccgcagagaauacuucaaauuuagcagugcuaucugccgugggg

SEQ ID NO: 23689 - RNA, 52 nt, Mus musculus
gucugaguacacagucagugugguugccuugcacgaugauauggagagccag

SEQ ID NO: 23690 - RNA, 51 nt, Mus musculus
uccauaucaucgugcaaggcaaccacacugacuguguacucagaccccggc

SEQ ID NO: 23691 - RNA, 46 nt, Mus musculus
ggcaaguuuccagguacagggugaccuacucgagcccugaggaugg

SEQ ID NO: 23692 - RNA, 46 nt, Mus musculus
cccagggucagccuuuuuaaauauaaagacuuaagagaggggaaaa

SEQ ID NO: 23693 - RNA, 74 nt, Mus musculus
cagaaaugaccauugaagguuugcaacccacuguggaguacgugguuaguguuuaugcucagaaccggaacgga

SEQ ID NO: 23694 - RNA, 43 nt, Mus musculus
uaccuggacuggcaguuuuaguuuuugaugguccuaggccauu

SEQ ID NO: 23695 - RNA, 47 nt, Mus musculus
ucccaaaaauggccuaggaccaucaaaaacuaaaacugccaguccag

SEQ ID NO: 23696 - RNA, 45 nt, Mus musculus
cgucccagaugcaggugacagauguccaggacaacagcaucagug

SEQ ID NO: 23697 - RNA, 45 nt, Mus musculus
uacacagagaaacccugucucggaaaaaaaaaaagaaaaauaaau

SEQ ID NO: 23698 - RNA, 35 nt, Mus musculus
cuugcuggacuguccccacggccagugacagcaua

SEQ ID NO: 23699 - RNA, 79 nt, Mus musculus
aggaaauagcccuguccaggaguucacugugcccggaagcaaguccacagccaccaucaacaacauuaaaccaggagca

SEQ ID NO: 23700 - RNA, 45 nt, Mus musculus
gaugguggcuguggacuugcuuccgggcacagugaacuccuggac

SEQ ID NO: 23701 - RNA, 46 nt, Mus musculus
uuucuuucuuucuuucuuucuuucuuucuuucuuuuucuguccaaa

SEQ ID NO: 23702 - RNA, 44 nt, Mus musculus
cagaccugucucuccguaggugauucuguaauagcgcacagaga

SEQ ID NO: 23703 - RNA, 47 nt, Mus musculus
uccgagagaucuggaggucauugccuccacccccaccagccugcuca

SEQ ID NO: 23704 - RNA, 45 nt, Mus musculus
auuuaacucugcuaauucaguguugcauuuagauuuuuguuugaa

SEQ ID NO: 23705 - RNA, 42 nt, Mus musculus
cucaucucaaaguaaauaaaaguuuuuuaaaggggugcagug

SEQ ID NO: 23706 - RNA, 95 nt, Mus musculus
gaucgagugccgcccucgcggaauuccaucacccucaccaaccuuaauccgggcaccgaguacguugucagcaucauugcuguuaauggcagaga

SEQ ID NO: 23707 - RNA, 50 nt, Mus musculus
acucggugcccggauuaagguuggugagggugauggaauuccgcgagggc

SEQ ID NO: 23708 - RNA, 55 nt, Mus musculus
ggguggcuccucgggcccccaucaccggcuacaucauccgccaucacgccgagca

SEQ ID NO: 23709 - RNA, 54 nt, Mus musculus
ggugaugggggcccgaggagccacccaguggacagugaaugaguuggcggugau

SEQ ID NO: 23710 - RNA, 42 nt, Mus musculus
gcagagcaaagguccugaaacuagaaaaaggaauguggggag

SEQ ID NO: 23711 - RNA, 46 nt, Mus musculus
uuccguuccucuccuugcccccugucauccuuccugguccccuuuc

SEQ ID NO: 23712 - RNA, 52 nt, Mus musculus
ugccugggacagaauacuuagucagugucuccagugucuacgaacaacauga

SEQ ID NO: 23713 - RNA, 42 nt, Mus musculus
gguucuacaggagaggaaaguaguuacauucaggcccauuuc

SEQ ID NO: 23714 - RNA, 88 nt, Mus musculus
gagcugaccaaccucuuggugcgcuacucacccgugaagaaugaagaggacguugcagagcuauccauuucaccuucagacaaugccg

SEQ ID NO: 23715 - RNA, 53 nt, Mus musculus
agcugucccuccucccacggaucugcgauucaccaauaucgguccagacacga

SEQ ID NO: 23716 - RNA, 41 nt, Mus musculus
guucucuauaguguuuuguuuauuuuuuuaacaguagcgug

SEQ ID NO: 23717 - RNA, 44 nt, Mus musculus
uaccaaaaaugaguguggaacagaaggggagaucucaggguagg

SEQ ID NO: 23718 - RNA, 47 nt, Mus musculus
ucuagaucucugauuuaugaaaugcaaaggagauuacauuugcagau

SEQ ID NO: 23719 - RNA, 45 nt, Mus musculus
acacaguuacagggcuggagccuggcauugacuaugacaucagcg

SEQ ID NO: 23720 - RNA, 43 nt, Mus musculus
uccaccauuaucggguaccgaaucacaguaguugcggcaggag

SEQ ID NO: 23721 - RNA, 45 nt, Mus musculus
auguaauuuaauuaguauucauaaaugcauagcaaaauacugcag

SEQ ID NO: 23722 - RNA, 96 nt, Mus musculus
ugaucagaguuccugcacuuuugagaaccugaauccuggccuggaguacaacgucaguguuuacacugucaaagaugacaaggaaagugccccuau

SEQ ID NO: 23723 - RNA, 50 nt, Mus musculus
ccaggauucagguucucaaaagugcaggaacucugaucagcauggaccac

SEQ ID NO: 23724 - RNA, 48 nt, Mus musculus
gauaucacuggcuacagaauaacuacuacccccacgaacgggcagcag

SEQ ID NO: 23725 - RNA, 46 nt, Mus musculus
gggguaguaguuauucuguagccagugauaucuggaguaaaugcag

SEQ ID NO: 23726 - RNA, 45 nt, Mus musculus
auuuauugauaucuccuuuccuuuaaugccuucacugcccaauuu

SEQ ID NO: 23727 - RNA, 42 nt, Mus musculus
aaggugaacauuaacguguuaugugcuaggaaacccaguggg

SEQ ID NO: 23728 - RNA, 46 nt, Mus musculus
aucuggaaacacuguagcugucacauuauacaauacauugccacag

SEQ ID NO: 23729 - RNA, 46 nt, Mus musculus
agccagggcuauacagagaaacccugucucaaaaaaaaaaaugauc

SEQ ID NO: 23730 - RNA, 46 nt, Mus musculus
ugggggcgggggagacuaacguuuauacuacagggaauuuugagag

SEQ ID NO: 23731 - RNA, 43 nt, Mus musculus
ggagugcuuacugucuccugggagaggagcacuaccccaggua

SEQ ID NO: 23732 - RNA, 47 nt, Mus musculus
ucccaggagacaguaagcacuccagugucaggguuugccuccagaug

SEQ ID NO: 23733 - RNA, 45 nt, Mus musculus
uuaacgcuauuguaauucacuacugaaauuguuucaucuugccag

SEQ ID NO: 23734 - RNA, 47 nt, Mus musculus
acuacucuguugacaaucggugcaucucucuccuggccaucucgcag

SEQ ID NO: 23735 - RNA, 46 nt, Mus musculus
guccugcgagauggccaggagagagaugcaccgauugucaacagag

SEQ ID NO: 23736 - RNA, 46 nt, Mus musculus
acgaccgagccagggaggugaggcaccccgagaagugacuucagac

SEQ ID NO: 23737 - RNA, 46 nt, Mus musculus
aacaccgaggugacagagaccacaauugugaucaccuggacccccg

SEQ ID NO: 23738 - RNA, 43 nt, Mus musculus
uugagacaauauucucuugccuagacaagaccauuacaggaaa

SEQ ID NO: 23739 - RNA, 45 nt, Mus musculus
uugcugaucaguagcuccagguucuccaaaaauccaccgccgagg

SEQ ID NO: 23740 - RNA, 83 nt, Mus musculus
uuggccuccaaguauccccugagaaaucugcagccugggucugaguacaccgugaccuugguggcugugaaagggaaccagca

SEQ ID NO: 23741 - RNA, 41 nt, Mus musculus
uuucacagccaccaaggucacgguguacucagacccaggcu

SEQ ID NO: 23742 - RNA, 57 nt, Mus musculus
ucaggcccgcggucagucgguagccugcuauacgggcucgagguggaguccacguua

SEQ ID NO: 23743 - RNA, 96 nt, Mus musculus
cuaaccuccaguuugucaaugaaacugacagaacaguucugguaacguggacuccaccucgagcccguauagcaggcuaccgacugaccgcgggcc

SEQ ID NO: 23744 - RNA, 45 nt, Mus musculus
gggauguuguauagugguagagcauuuuuugauucacagcuuaaa

SEQ ID NO: 23745 - RNA, 32 nt, Mus musculus
aaaaagagggaaggaggagggaagaagggagg

SEQ ID NO: 23746 - RNA, 54 nt, Mus musculus
cugggcuguccccuggggucacguaccucuucaaagucuuugcugugcaccagg

SEQ ID NO: 23747 - RNA, 56 nt, Mus musculus
gcccggggaacaugggcagaggcugccugucaacagaaauaccuuugcugaaauca

SEQ ID NO: 23748 - RNA, 42 nt, Mus musculus
uggugacuuucacaucagucaguuccacaaacuguagguccg

SEQ ID NO: 23749 - RNA, 47 nt, Mus musculus
agagcacacccguuuucauccaacaagagaccacuggcaccccaaga

SEQ ID NO: 23750 - RNA, 53 nt, Mus musculus
ccuccacagcauagauagugauguuguacugaacaccgggcugcaggucgcug

SEQ ID NO: 23751 - RNA, 24 nt, Mus musculus
ucaaccucccugaaacggccaacu

SEQ ID NO: 23752 - RNA, 44 nt, Mus musculus
uugaugauacuuccauuguuguucgguggaguagaccccaggca

SEQ ID NO: 23753 - RNA, 45 nt, Mus musculus
uccaccgaacaacaauggaaguaucaucaaccugguccacgguag

SEQ ID NO: 23754 - RNA, 85 nt, Mus musculus
cacuuccgugaacauuccugaccugcucccgggcagaaaguacauugucaaugucuaucagauaucugaggagggaaaacagagc

SEQ ID NO: 23755 - RNA, 67 nt, Mus musculus
gauaucugauagacauugacaauguacuuucugcccgggagcaggucaggaauguucacggaagugg

SEQ ID NO: 23756 - RNA, 45 nt, Mus musculus
gcaccagaggccacaaaggugcccagggaaucccagccuggccag

SEQ ID NO: 23757 - RNA, 117 nt, Mus musculus
ggccacuucugaaucuguaacugaaaucacagccagcagcuuuguggucucaugggucucagccuccgacaccgugucaggcuuccggguggaguaugagcugagcgaggagggaga

SEQ ID NO: 23758 - RNA, 46 nt, Mus musculus
gagacccaugagaccacaaagcugcuggcugugauuucaguuacag

SEQ ID NO: 23759 - RNA, 42 nt, Mus musculus
ucucuggggaacccacgucugagcagugcaggcacagcccca

SEQ ID NO: 23760 - RNA, 53 nt, Mus musculus
ggccugaccccaggugugaucuaugagggacagcucaucagcauccagcagua

SEQ ID NO: 23761 - RNA, 41 nt, Mus musculus
gaugagcugucccucauagaucacaccuggggucaggccuu

SEQ ID NO: 23762 - RNA, 61 nt, Mus musculus
cucuacgggucgcuggaaggaagcuaccauuccuggccaccuuaacuccuauaccaucaaa

SEQ ID NO: 23763 - RNA, 45 nt, Mus musculus
aucuucaaagaagaauggaggauagauaggauucucgaggcucug

SEQ ID NO: 23764 - RNA, 46 nt, Mus musculus
guccucuugaguuguguagacagaagggaaugagguauugagagaa

SEQ ID NO: 23765 - RNA, 46 nt, Mus musculus
ggauguguugcccucuggguuuguuacugcuuuugagucgacagau

SEQ ID NO: 23766 - RNA, 105 nt, Mus musculus
gcacaacuggaccuguccaaguaauuaucacggagacccccagccagcccaauucccaccccauccaguggaaugccccggagccuucacacaucaccaaguaca

SEQ ID NO: 23767 - RNA, 42 nt, Mus musculus
gcuggcugggggucuccgugauaauuacuuggacagguccag

SEQ ID NO: 23768 - RNA, 46 nt, Mus musculus
ucacaaguuuuccagccucaaauucaguaaauaagaugcaugagac

SEQ ID NO: 23769 - RNA, 68 nt, Mus musculus
ccgauaccaguguuacugcuacggccguggcaucggggaguggcacugucaaccucugcagaccuacc

SEQ ID NO: 23770 - RNA, 45 nt, Mus musculus
aacacugguaucggacaccaugcacaaacuucucccaggagucac

SEQ ID NO: 23771 - RNA, 46 nt, Mus musculus
gauucagagacccggacauuuuaccagauuggugacuccugggaga

SEQ ID NO: 23772 - RNA, 46 nt, Mus musculus
caauggggucacacuuccaucugccccggcccugaccaaagcaggu

SEQ ID NO: 23773 - RNA, 90 nt, Mus musculus
auuacuuacaaugugaacgacacguuccacaagcgucacgaggagggacauaugcugaacuguaccugcuuuggucagggccggggcaga

SEQ ID NO: 23774 - RNA, 46 nt, Mus musculus
acgugucguucacauuguaaguaaugucaucaacgaugcacugguc

SEQ ID NO: 23775 - RNA, 46 nt, Mus musculus
agagaaucucgauugagaaaacugucugcacaacacuggccugcag

SEQ ID NO: 23776 - RNA, 42 nt, Mus musculus
ugugcagacaguuuucucaaucgagauucucucaucucagau

SEQ ID NO: 23777 - RNA, 57 nt, Mus musculus
accugggccacaugaugaggugcacguguguggggaacggucguggagaaugggccu

SEQ ID NO: 23778 - RNA, 74 nt, Mus musculus
gagcugggaguaggggaugcaggcccauucuccacgaccguuccccacacacgugcaccucaucauguggccca

SEQ ID NO: 23779 - RNA, 59 nt, Mus musculus
cugcacaaccaaugaaggggucauguaucgcauuggggaucagugggauaagcagcaug

SEQ ID NO: 23780 - RNA, 49 nt, Mus musculus
cccacugauccccaaugcgauacaugaccccuucauugguugugcagau

SEQ ID NO: 23781 - RNA, 47 nt, Mus musculus
ggacaacaugaaauggugcggcaccacccagaacuacgaugccgauc

SEQ ID NO: 23782 - RNA, 45 nt, Mus musculus
uucuggguggugccgcaccauuucauguugucccugcgacccuca

SEQ ID NO: 23783 - RNA, 46 nt, Mus musculus
aauuccaauggugcucugugccacuuccccuuccuguacaacaacc

SEQ ID NO: 23784 - RNA, 51 nt, Mus musculus
uguacaggaaggggaaguggcacagagcaccauuggaauuuccgccucgag

SEQ ID NO: 23785 - RNA, 28 nt, Mus musculus
gaaggaauacuucuggucuuguucguaa

SEQ ID NO: 23786 - RNA, 101 nt, Mus musculus
cguucaccuacaacgguaggaccuucuauuccugcaccaccgaagggcggcaagacggacaucugugguguagcacaacuuccaauuacgaacaagaccag

SEQ ID NO: 23787 - RNA, 44 nt, Mus musculus
agccgugacccagacuuaugguggcaauucaaacggggagcccu

SEQ ID NO: 23788 - RNA, 109 nt, Mus musculus
gucaccgacagugguguggucuacucugugggaaugcaguggcugaagucgcaaggaaacaagcaaaugcugugcacgugccugggcaauggcgucagcugccaggaga

SEQ ID NO: 23789 - RNA, 46 nt, Mus musculus
gcuccuucacugauguccgaacagcuauuuaccaaccgcagacuca

SEQ ID NO: 23790 - RNA, 46 nt, Mus musculus
gucugcgguugguaaauagcuguucggacaucagugaaggagccag

SEQ ID NO: 23791 - RNA, 62 nt, Mus musculus
ggaagacaggcaaggcagaccauuucagaugaguggggagccauagggagaaggcaggagca

SEQ ID NO: 23792 - RNA, 68 nt, Mus musculus
cccugugggucuucaggggucucucaggaagaggaaaggccacacacagagcauaugagagcuaugag

SEQ ID NO: 23793 - RNA, 46 nt, Mus musculus
cuuuggcuuaugagcaugagacucagaguucagucuagaaccaaag

SEQ ID NO: 23794 - RNA, 46 nt, Mus musculus
aguggaaugaaguugagacgugccuuuagcacagagggcuggguug

SEQ ID NO: 23795 - RNA, 46 nt, Mus musculus
ggcugaagcacuuuguagagcaugucgcucacacuuccacuccccu

SEQ ID NO: 23796 - RNA, 48 nt, Mus musculus
accgaggaaaccugcuucagugugucugcacaggcaauggcagagggg

SEQ ID NO: 23797 - RNA, 45 nt, Mus musculus
cuugcuccacgugucuccaauccuauaggauguccggguguccug

SEQ ID NO: 23798 - RNA, 53 nt, Mus musculus
ucaggacacccggacauccuauaggauuggagacacguggagcaagaaggaca

SEQ ID NO: 23799 - RNA, 46 nt, Mus musculus
gacacugaauaguauuuuuucuuuuuuuccuuuggcaaauggagag

SEQ ID NO: 23800 - RNA, 42 nt, Mus musculus
ggugugguuaacuuuuuagcuucccuggggcagucggaagag

SEQ ID NO: 23801 - RNA, 45 nt, Mus musculus
acaauuacaaagucacccacgugguuaaccccagcgucugggagg

SEQ ID NO: 23802 - RNA, 45 nt, Mus musculus
auuuuguguguggaggugggaggcacacacgccacagugugcaug

SEQ ID NO: 23803 - RNA, 45 nt, Mus musculus
ucaucuuugaccuacuaaguguucucugaaggcugaugcccaguu

SEQ ID NO: 23804 - RNA, 46 nt, Mus musculus
ucaguaucuuugaaucaguaucucuugaaacuccuaaugcugagcu

SEQ ID NO: 23805 - RNA, 100 nt, Mus musculus
aaaguggaaugaauuucuguguguuguuuguucaucgauugggcagagagacuguuaaauuauaacccauccuugcucuuacgcuacaaugugggcagua

SEQ ID NO: 23806 - RNA, 46 nt, Mus musculus
gaaguuuaaauaagguuuacugacucuaaacaagaaccuaguggaa

SEQ ID NO: 23807 - RNA, 84 nt, Mus musculus
ggacaauuaaaucccuaaaguagcauguaaaugaauccuuugaccugggggagcgauuggaaauaaaaggcucuaccccauguu

SEQ ID NO: 23808 - RNA, 42 nt, Mus musculus
ggcaguucucaguucaacccugccuuaggcagucagcuagua

SEQ ID NO: 23809 - RNA, 54 nt, Mus musculus
ggacuguacuugucuaggcgaaggcaauggacgcaucaccuguaccuccagaag

SEQ ID NO: 23810 - RNA, 46 nt, Mus musculus
acaguccaccaucauccagccuugguagggcuuuucccaggucucc

SEQ ID NO: 23811 - RNA, 78 nt, Mus musculus
guguuuugaucaugcugcugggacguccuacgucgugggggagaccugggaaaagcccuaccaaggcuggaugauggu

SEQ ID NO: 23812 - RNA, 42 nt, Mus musculus
caauuuccuuaaaaacaaacauuaaagguugugggggauuuu

SEQ ID NO: 23813 - RNA, 42 nt, Mus musculus
uccccuuggugaagaagacauguuauuuaaaggaggaaaaau

SEQ ID NO: 23814 - RNA, 49 nt, Mus musculus
gagugucugugucugggaaauggaaaaggggaauggaccugcaaaccua

SEQ ID NO: 23815 - RNA, 28 nt, Mus musculus
uccccuuuuccauuucccagacacagac

SEQ ID NO: 23816 - RNA, 72 nt, Mus musculus
caugaagggggucaguccuacaagauuggcgacaaguggaggaggccacaugagacugguggcuacauguua

SEQ ID NO: 23817 - RNA, 45 nt, Mus musculus
gauugcauuuuggccaacauacauacuuauuuaucucaggcagaa

SEQ ID NO: 23818 - RNA, 41 nt, Mus musculus
acacacacacacacacacacacauacagagagagagacaga

SEQ ID NO: 23819 - RNA, 46 nt, Mus musculus
uucacuauucagucagggauaacaggaaaaggcaaggacaggccag

SEQ ID NO: 23820 - RNA, 46 nt, Mus musculus
cucuggccuguccuugccuuuuccuguuaucccugacugaauagug

SEQ ID NO: 23821 - RNA, 49 nt, Mus musculus
uaaagauuccaugaucugggacuguaccugcaucggggcugggagaggc

SEQ ID NO: 23822 - RNA, 50 nt, Mus musculus
gauccugccucucccagccccgaugcagguacagucccagaucauggaau

SEQ ID NO: 23823 - RNA, 58 nt, Mus musculus
cuguuuugacaaugggaagcacuaucagauaaaucagcagugggaacggaccuaccua

SEQ ID NO: 23824 - RNA, 45 nt, Mus musculus
cuugucuuuuuguuguuguuguuaagaguauugaagcccucagga

SEQ ID NO: 23825 - RNA, 43 nt, Mus musculus
ccugugccuggggaccucggugcgcugcaccgaagccgggaag

SEQ ID NO: 23826 - RNA, 46 nt, Mus musculus
aguggaugggaggagagucgcccuccccaggaggcaaguggccacg

SEQ ID NO: 23827 - RNA, 51 nt, Mus musculus
gggcuccuuuucucccccugugcagcgcagcgggugcgagcgguugagccc

SEQ ID NO: 23828 - RNA, 42 nt, Mus musculus
gggcucaaccgcucgcacccgcugcgcugcacagggggagaa

SEQ ID NO: 23829 - RNA, 45 nt, Mus musculus
aagagcagagacagcuuccugaagcgggugaaggagaaugaucag

SEQ ID NO: 23830 - RNA, 45 nt, Mus musculus
gaccagugucugaaaagguaaagaagcgagcugcucugccuaaaa

SEQ ID NO: 23831 - RNA, 45 nt, Mus musculus
ggcugugagccaccauguuguugcugggauuugaacucuggaccu

SEQ ID NO: 23832 - RNA, 46 nt, Mus musculus
auugggccaggcauguggugcaugccuuuaaucccagcacucggga

SEQ ID NO: 23833 - RNA, 41 nt, Mus musculus
uguacucauuuauaauaauaaauaaaacuuugggccagagu

SEQ ID NO: 23834 - RNA, 46 nt, Mus musculus
gguaccagugaugguuugaauaagaauggcccccacagacucauau

SEQ ID NO: 23835 - RNA, 42 nt, Mus musculus
caaaccuguucauagcagcuuuguuguguccggccagcagau

SEQ ID NO: 23836 - RNA, 45 nt, Mus musculus
guguacuuacauauaauaaauaaaucuuuaaaaaaaaaagucuug

SEQ ID NO: 23837 - RNA, 46 nt, Mus musculus
aucccagcaaccacaugguggcucacaacuaucuguaacgagagcu

SEQ ID NO: 23838 - RNA, 46 nt, Mus musculus
acacuucacugcuuacuaaacagaucaugacaacuggccuguagga

SEQ ID NO: 23839 - RNA, 46 nt, Mus musculus
cucaaaacaaaaacaacaaaauaucaaacaauaaaaucagauaguc

SEQ ID NO: 23840 - RNA, 45 nt, Mus musculus
gguuacagacucgcuuccucuucccccucucugagugccgcacag

SEQ ID NO: 23841 - RNA, 46 nt, Mus musculus
cggcuuccuauaucacuggacaguugaucaauguggauggaggcca

SEQ ID NO: 23842 - RNA, 32 nt, Mus musculus
aucaacuuaaaaauuauauaaaaucauuaucg

SEQ ID NO: 23843 - RNA, 41 nt, Mus musculus
gcuacccagggcuaccuaaagucaaauuccaaaguuguagg

SEQ ID NO: 23844 - RNA, 46 nt, Mus musculus
guuaaaaaucaauagcuuuucaaaugacugaggaguaaacuuagau

SEQ ID NO: 23845 - RNA, 46 nt, Mus musculus
aaaaaaaaaaaaaaagguucaucaacauauucucccgggcacaugg

SEQ ID NO: 23846 - RNA, 45 nt, Mus musculus
accuguuguucucuuuuguaauaaaagguucauggggcuggugag

SEQ ID NO: 23847 - RNA, 58 nt, Mus musculus
uucuaggauauuuaaauuagcuauccaauaauaugcuccagauaagguaaggaucagg

SEQ ID NO: 23848 - RNA, 46 nt, Mus musculus
cggaccagucuuguaugcuucuggguuuuuucauauugcugagaac

SEQ ID NO: 23849 - RNA, 48 nt, Mus musculus
caggcaacuuagcacaccacgagaaugaaaucuggggagaccaagcua

SEQ ID NO: 23850 - RNA, 46 nt, Mus musculus
gaguaucgguuacucuuugucucucuaaccacaauuccuggcagag

SEQ ID NO: 23851 - RNA, 46 nt, Mus musculus
cugaaauucauauuaccuggaggcccuguaucuuuucugccaagua

SEQ ID NO: 23852 - RNA, 60 nt, Mus musculus
aacaaacaaacaaacaaacaaacaaaaaaaccagcauggcuucaguaagagaucacaggg

SEQ ID NO: 23853 - RNA, 51 nt, Mus musculus
uucauggcuccuguggaagacaucacugcgaagggauggcaugcugugaua

SEQ ID NO: 23854 - RNA, 44 nt, Mus musculus
gugugguacagugguaaauucacacugugggaucuggggguuua

SEQ ID NO: 23855 - RNA, 42 nt, Mus musculus
ccagggcuacacagagaaacccugucgggaggugggggucgg

SEQ ID NO: 23856 - RNA, 46 nt, Mus musculus
ccagcuccgcugaagucuccgccauacagugcaacaucaggaaaga

SEQ ID NO: 23857 - RNA, 45 nt, Mus musculus
cuaaugccgcuucacugccaaagcuacgcugcaccuggugaaaga

SEQ ID NO: 23858 - RNA, 46 nt, Mus musculus
agguccaggguugaguuugcugguugcugacugaguugagccuugu

SEQ ID NO: 23859 - RNA, 51 nt, Mus musculus
uguauauaugugggggaugugccugugagugcgaguacccuuagaucuagg

SEQ ID NO: 23860 - RNA, 46 nt, Mus musculus
gugcaugaucagcaaaguucuuuaccaccuggauacguccccagac

SEQ ID NO: 23861 - RNA, 46 nt, Mus musculus
aaggugccugcggccaagccugauggccuaaguucaauccucagaa

SEQ ID NO: 23862 - RNA, 46 nt, Mus musculus
gucgagguuucacaaagaaacccugccucgaagauguggguaagaa

SEQ ID NO: 23863 - RNA, 46 nt, Mus musculus
aaaaguuauuaaacuuagaaugaucacguaaacacacgcacaagga

SEQ ID NO: 23864 - RNA, 55 nt, Mus musculus
ccggucugcagagcugagcaaugagggaaaacgaaauaacagagguuuuauuccg

SEQ ID NO: 23865 - RNA, 44 nt, Mus musculus
ucggguaaacuggguucagagacagaggggagugcuggcggacc

SEQ ID NO: 23866 - RNA, 42 nt, Mus musculus
aaugucggugacauuggggggaaacgacagaggaaugaaaag

SEQ ID NO: 23867 - RNA, 47 nt, Mus musculus
gcaacagacaucuggcugucugggcuucagcagcugugugcagaggg

SEQ ID NO: 23868 - RNA, 46 nt, Mus musculus
uaauucuuuuguguguguguguguguguguguguguguguguggug

SEQ ID NO: 23869 - RNA, 46 nt, Mus musculus
accucauaguggucaguugugaucagcagauuuuggccagccccag

SEQ ID NO: 23870 - RNA, 45 nt, Mus musculus
agcaagguugagagccacuguccuagaaaaucaauauuagcccaa

SEQ ID NO: 23871 - RNA, 36 nt, Mus musculus
acuccucuguaaaguaagcucagcuagcucucaggc

SEQ ID NO: 23872 - RNA, 46 nt, Mus musculus
cucccgcccggaauccaucaucaucuaccggucagauaaugagaag

SEQ ID NO: 23873 - RNA, 46 nt, Mus musculus
ggugaaaggucagcaaggaagccaggcuagauccuggugcaucuug

SEQ ID NO: 23874 - RNA, 44 nt, Mus musculus
aauaagguaccgagagcagggccuuuugccuuuccuaagccggg

SEQ ID NO: 23875 - RNA, 49 nt, Mus musculus
cuggguucuaaaaaucuuuguaaguuaucgaggauagauccccuacaug

SEQ ID NO: 23876 - RNA, 55 nt, Mus musculus
gcacaacuaagcccuuuauuccuauuuaauuaaaucuucacaccaaaccgugaga

SEQ ID NO: 23877 - RNA, 46 nt, Mus musculus
aauuacuguaaacuuuagagagguuguuuuugaucacuagagagag

SEQ ID NO: 23878 - RNA, 46 nt, Mus musculus
cgugaaggacuuacuguggcagauguacuugauaaaauucuagcag

SEQ ID NO: 23879 - RNA, 48 nt, Mus musculus
caauugaacaagcaaagaaagugaugacuauguuuguccaacgacagg

SEQ ID NO: 23880 - RNA, 46 nt, Mus musculus
aguugcaucugaauccuugcuuuaccugucauuuacuaaccccaag

SEQ ID NO: 23881 - RNA, 49 nt, Mus musculus
gcuucuagugucuugcucuuucuuugcgcugugauauugagagguuggg

SEQ ID NO: 23882 - RNA, 48 nt, Mus musculus
ggagaguagcugagaguucuacaucucaauccacaggcggcagugaga

SEQ ID NO: 23883 - RNA, 49 nt, Mus musculus
agagagagagagagagagacagauaccccagugacacaugagagagaga

SEQ ID NO: 23884 - RNA, 46 nt, Mus musculus
uuugagaauguaaccacacuuaauuauaucagauucacgccaucuc

SEQ ID NO: 23885 - RNA, 45 nt, Mus musculus
gagaaugacuucuuaauguguucauucugucuuuuagagggaaga

SEQ ID NO: 23886 - RNA, 44 nt, Mus musculus
cgucagcugcuucuaaucucuuuaucuuucuaugugcguccaca

SEQ ID NO: 23887 - RNA, 46 nt, Mus musculus
ggaccaccucaaacccuccuucccucaaaaaggacuuacugagcag

SEQ ID NO: 23888 - RNA, 46 nt, Mus musculus
gugucuuaguacuuuaaacugcuuugguuucgggucuucuauguag

SEQ ID NO: 23889 - RNA, 42 nt, Mus musculus
acugugauggauuaguuugucuuugugugucauaguggggau

SEQ ID NO: 23890 - RNA, 46 nt, Mus musculus
acuauucaagguaugaagcaagugucugcacuuucacccaagagag

SEQ ID NO: 23891 - RNA, 41 nt, Mus musculus
uuuauccagaggacuuggaaacuagcugagaauaucugaau

SEQ ID NO: 23892 - RNA, 45 nt, Mus musculus
aggaauacuuugaaauaucuacuaguuugauugaguucaguagca

SEQ ID NO: 23893 - RNA, 46 nt, Mus musculus
ugguucaggggauuugcauaugucuacgguguuuaggagugguccg

SEQ ID NO: 23894 - RNA, 41 nt, Mus musculus
cucuguuagcugggacaaacggauucuuagggcaggcaacu

SEQ ID NO: 23895 - RNA, 45 nt, Mus musculus
acaugauugaugauaagaaaaaguuagaccaauacuugguguagg

SEQ ID NO: 23896 - RNA, 46 nt, Mus musculus
cacccauagacugaaucugugugccuagcacacaagccuuauguag

SEQ ID NO: 23897 - RNA, 46 nt, Mus musculus
ugagagcuuccaguagaaaaugcacgcagcggacuuguguggguag

SEQ ID NO: 23898 - RNA, 45 nt, Mus musculus
aacugugauacaggccagcuagcugugacaccggaaaggccauag

SEQ ID NO: 23899 - RNA, 68 nt, Mus musculus
aggcugagggaugaggaaggucaaggacuuugaggccauaguuugguugaguuggaggugcuggcagu

SEQ ID NO: 23900 - RNA, 46 nt, Mus musculus
cguuaggcuacaagucuaauauuaccuguggcaauguaggguuagg

SEQ ID NO: 23901 - RNA, 41 nt, Mus musculus
ggaaguuuaugacacuggugugaucuagcaaaagagcagcu

SEQ ID NO: 23902 - RNA, 23 nt, Mus musculus
cuggaaaagaaucaagagggcag

SEQ ID NO: 23903 - RNA, 42 nt, Mus musculus
uuuuuucccuuugcuuugcuaucauugucuuaagaggcccag

SEQ ID NO: 23904 - RNA, 46 nt, Mus musculus
aagcaauugaugagacaauuguaaguaaaugcuugaaaaacacaaa

SEQ ID NO: 23905 - RNA, 46 nt, Mus musculus
acuagacaacagcuugcaagcgaagaggcugcuucguacacagugu

SEQ ID NO: 23906 - RNA, 46 nt, Mus musculus
aggagcggcugcccccgauucagcagcacauuuugaauaugcugga

SEQ ID NO: 23907 - RNA, 45 nt, Mus musculus
ggcuacaaauccaucuucaacauguuggauaccuaauacauguag

SEQ ID NO: 23908 - RNA, 50 nt, Mus musculus
acuuaagcuuccagauuuuuuccuugucuuugaaaacucccugccagacu

SEQ ID NO: 23909 - RNA, 53 nt, Mus musculus
gucugacaagacugaggacuggagaaaaggaacaacuugccugagaucuuaac

SEQ ID NO: 23910 - RNA, 85 nt, Mus musculus
agaguagagaaguagagacuggcuauggccacguggagggggaggggaagggaagguagagagaggggaagcaagagggcaagag

SEQ ID NO: 23911 - RNA, 96 nt, Mus musculus
cuuauggacuguguggaagcaucaccugucaauaaaaagcugguggcguauuaacugaggcaggaacuagaaggcagacacuugguagagagagaa

SEQ ID NO: 23912 - RNA, 46 nt, Mus musculus
caguaacaggagguuucuuucuccuggacugaagggagaugagcgg

SEQ ID NO: 23913 - RNA, 46 nt, Mus musculus
aaaggucuuuuuugucuuuaagagcacacuuacuauuuuaacccau

SEQ ID NO: 23914 - RNA, 45 nt, Mus musculus
guauagcuggcacagcaguccugcagucacguugagaaaauggag

SEQ ID NO: 23915 - RNA, 45 nt, Mus musculus
auagcugcuuagaaaguagaaauccuguggcuagaguggguucag

SEQ ID NO: 23916 - RNA, 46 nt, Mus musculus
ggaaaacaugguuccuuugagccacagcaauagggguuugaaucag

SEQ ID NO: 23917 - RNA, 41 nt, Mus musculus
uaugcguucaugcaugcgugugugugugugugugugugugu

SEQ ID NO: 23918 - RNA, 46 nt, Mus musculus
uuucuaucauaaugcuaauaauaaauuaaaaaaauaagguggaaaa

SEQ ID NO: 23919 - RNA, 45 nt, Mus musculus
uuuuuauguauauguacauuuugcauacaugcauaucugugcauc

SEQ ID NO: 23920 - RNA, 42 nt, Mus musculus
cuguucugucauuuccuguagucuuuuguauacaucggggcu

SEQ ID NO: 23921 - RNA, 46 nt, Mus musculus
gggucagauccuggagcuggaguuuuagacaguugugagcugccau

SEQ ID NO: 23922 - RNA, 61 nt, Mus musculus
aggaagaagggugacucccaguauuuuugccucgagcaucuagaaggaauugccauggaug

SEQ ID NO: 23923 - RNA, 80 nt, Mus musculus
gagccaugagacuggaugugauccuucagcagggaaggugugcagggaagauguuauguaguagagggaagacaggugag

SEQ ID NO: 23924 - RNA, 48 nt, Mus musculus
uuucuaucugaaaaacaaaaacccauuaucuuuucucuuucccagacg

SEQ ID NO: 23925 - RNA, 46 nt, Mus musculus
cuuuucucacugcaauggcacaauucuugacaacagcaucuugcag

SEQ ID NO: 23926 - RNA, 79 nt, Mus musculus
ccuucaauaucuuccuuucuuguagcuacagaaguaggacucacaguuaacacaaauaaaaacaaaaauaaaacaagag

SEQ ID NO: 23927 - RNA, 118 nt, Mus musculus
agcucucauaguccuuaggaauagaaucugacaauaaagacuugcauuuacucugcucccugcgccugcgguuuuaauuuaacacaucaaugaaaagacagcauuuaaaaagggaggg

SEQ ID NO: 23928 - RNA, 49 nt, Mus musculus
cugcauuuaaugagaaaaucguuaagcaugaaaaaaacgggcugagaug

SEQ ID NO: 23929 - RNA, 45 nt, Mus musculus
uacgguaugugaccaaggggggagccuaccacucucuuugcuguu

SEQ ID NO: 23930 - RNA, 45 nt, Mus musculus
agucucagaguugggggaggaacuggaggauucauuucugaugaa

SEQ ID NO: 23931 - RNA, 51 nt, Mus musculus
aaaacaacaacaacaacaacaacaacaaaacaucaccaccaccaccaaacc

SEQ ID NO: 23932 - RNA, 46 nt, Mus musculus
cuguguaaguguauaugcaugugacugcagugcccacaggagccag

SEQ ID NO: 23933 - RNA, 46 nt, Mus musculus
uuccuuuuccuuuuccuuuuccuuuuucuccuugccucgccucucu

SEQ ID NO: 23934 - RNA, 46 nt, Mus musculus
caaguggaaaugaccaaacgugccugucaucgucaucucucgggag

SEQ ID NO: 23935 - RNA, 64 nt, Mus musculus
aaagguauauaugagugugagugcugagagggauuuauagagaugggauagguguaugaaugcc

SEQ ID NO: 23936 - RNA, 46 nt, Mus musculus
cagauuauuugugggccuuuuucccucuaagcaagaagugagccag

SEQ ID NO: 23937 - RNA, 45 nt, Mus musculus
ggacgggcccugugcuucaucugcaucacauaacaaagaagagag

SEQ ID NO: 23938 - RNA, 45 nt, Mus musculus
aaggcccaggaagcucuaucacagcugaggaagccacaaagguau

SEQ ID NO: 23939 - RNA, 49 nt, Mus musculus
cuucaguaacuacagaacuguuaaacgucauagcccauuuccuuuguag

SEQ ID NO: 23940 - RNA, 45 nt, Mus musculus
ugguucaugacgcaugcaugaaugucugaaacaagugcgggcauu

SEQ ID NO: 23941 - RNA, 41 nt, Mus musculus
ucucucuuaaauacugguuaaacagcaaaggcugcgcggcg

SEQ ID NO: 23942 - RNA, 69 nt, Mus musculus
gcucagguggucaguucugggugcauagggcugugcugaagacucagagguaagcacaguggggaagga

SEQ ID NO: 23943 - RNA, 95 nt, Mus musculus
gaacuuggccuggggcuggagagccagaguagcuguaaggaauggcaggggcaagacugggaauggucauuauucaucuaccuucaggccaaaug

SEQ ID NO: 23944 - RNA, 65 nt, Mus musculus
gaaaaugccaggaauuuucaacucagaaaaggcauuagacaggaaccaaaguaguauucaggaga

SEQ ID NO: 23945 - RNA, 46 nt, Mus musculus
aucuccgacauguggaaaauugucuguguugguuaaugguaaugag

SEQ ID NO: 23946 - RNA, 46 nt, Mus musculus
uuauaguacaguaaucaggacaacuaugaagauuaagaauuaaggg

SEQ ID NO: 23947 - RNA, 45 nt, Mus musculus
agaaggauuuccacgaaagaccaaacagccucccaagcucgccau

SEQ ID NO: 23948 - RNA, 46 nt, Mus musculus
ucugugguuucaauuauaguguucauucagacuaauccuccccucu

SEQ ID NO: 23949 - RNA, 44 nt, Mus musculus
ucuacagagugaccauaaggacauauauuacaagaaauaacuua

SEQ ID NO: 23950 - RNA, 45 nt, Mus musculus
caagagaguagcgaaccaucuuggcaggugaccucuggcugcuua

SEQ ID NO: 23951 - RNA, 86 nt, Mus musculus
caccgacccuguguccagccccacuguuuggccugggcacaacuaccaacuccaccauuauaccgccggaauggcacacauugcuu

SEQ ID NO: 23952 - RNA, 42 nt, Mus musculus
cgcggccggaggcggcucggcggggcuuggcccagcgcggua

SEQ ID NO: 23953 - RNA, 42 nt, Mus musculus
ccaucaaggaaggcgcccacagagcgccaaaaggcuccagau

SEQ ID NO: 23954 - RNA, 67 nt, Mus musculus
cggcaaguacgggacccgcuauggugccucccuccggaaaauggugaagaaaauugaaaucagccag

SEQ ID NO: 23955 - RNA, 46 nt, Mus musculus
cuggcugauuucaauuuucuucaccauuuuccggagggaggcacca

SEQ ID NO: 23956 - RNA, 46 nt, Mus musculus
gagcauucguuguuuacuugcaacuagugaggaacuuaagggugaa

SEQ ID NO: 23957 - RNA, 45 nt, Mus musculus
gggguugguacagaugcgcugacaucgcuaucaauuucccaagau

SEQ ID NO: 23958 - RNA, 46 nt, Mus musculus
gaaaggcuauggacugcacagcccguguuccaggucuggugcauau

SEQ ID NO: 23959 - RNA, 45 nt, Mus musculus
gcuauacagugaaacccugucucaaaaacaaaguuaugguuauag

SEQ ID NO: 23960 - RNA, 50 nt, Mus musculus
ugaaggaacugaaagaccaguagaagcccugcugucugagacuugccuag

SEQ ID NO: 23961 - RNA, 46 nt, Mus musculus
aguaaaccucagaauaagaaagucagaagugacugcuguguaagau

SEQ ID NO: 23962 - RNA, 47 nt, Mus musculus
uuuagcauuuuguacuuaaggaaauaaaaaagaaaaaccuggaagau

SEQ ID NO: 23963 - RNA, 46 nt, Mus musculus
uacuauccgugugacaggcuacugugugacagugauggugucggag

SEQ ID NO: 23964 - RNA, 47 nt, Mus musculus
ccagagaagugggggugaauggaugcggggugacgagggaccccuuc

SEQ ID NO: 23965 - RNA, 46 nt, Mus musculus
ugacuuaucuccaugguaacauccucaccaucauucucccacuacc

SEQ ID NO: 23966 - RNA, 46 nt, Mus musculus
uagugggagaaugauggugaggauguuaccauggagauaagucaug

SEQ ID NO: 23967 - RNA, 46 nt, Mus musculus
agcacagcugaccuccuccguauccuguggggcagauguucccaag

SEQ ID NO: 23968 - RNA, 46 nt, Mus musculus
gguggagaauagguccugguuaggucucuuuguuaccuggcaguag

SEQ ID NO: 23969 - RNA, 49 nt, Mus musculus
cucgagcaguggaaagauagcucucuucccccucuacugccagguaaca

SEQ ID NO: 23970 - RNA, 45 nt, Mus musculus
acagagaccauggacauggauggggucaucaagagaagagggaug

SEQ ID NO: 23971 - RNA, 44 nt, Mus musculus
aagacagcaagucuucuagaggaagcuugccuuuaacagacaga

SEQ ID NO: 23972 - RNA, 42 nt, Mus musculus
gauggaggucauuguauagacaguuagccuuccccaggucag

SEQ ID NO: 23973 - RNA, 42 nt, Mus musculus
caguauacccaucaccccgcacaacauccccaacccccaacu

SEQ ID NO: 23974 - RNA, 45 nt, Mus musculus
cuugauggcauggcauaguagaggcccccuccaacccggaacaug

SEQ ID NO: 23975 - RNA, 46 nt, Mus musculus
acucaaacauccuucccugugauggaggaugguagaaagcccagga

SEQ ID NO: 23976 - RNA, 53 nt, Mus musculus
cucccaucuaaucaacucucugagauuugagaggaaaaagaaggcaggggaag

SEQ ID NO: 23977 - RNA, 47 nt, Mus musculus
cagaugccaggcugacagaucagagagaaacuaacaugagagaugac

SEQ ID NO: 23978 - RNA, 46 nt, Mus musculus
ucuggcagguuuaugugguguggugugagacaguuacuuucugcgg

SEQ ID NO: 23979 - RNA, 105 nt, Mus musculus
acugccagcacccaagggugcaucaagugcauagcccaggucaccccauuucagccuuccaacccgcagaaaguaacugucucacaccacaccacauaaaccugc

SEQ ID NO: 23980 - RNA, 45 nt, Mus musculus
uuuugcauuaccucuuuaaaguaguuuuuuuuaggacacugaaga

SEQ ID NO: 23981 - RNA, 46 nt, Mus musculus
ucacccugcacuuggguaagaggagaggagggugaggggucuagcc

SEQ ID NO: 23982 - RNA, 41 nt, Mus musculus
ugcuuucagcucuagccuggggucagaaaaaguguggcauu

SEQ ID NO: 23983 - RNA, 50 nt, Mus musculus
agcaaguugaacggacagagaagggaaggagagaagaagcaagagggagc

SEQ ID NO: 23984 - RNA, 41 nt, Mus musculus
uggugccccgugcuguguaccugcccaacugugaccgcaaa

SEQ ID NO: 23985 - RNA, 42 nt, Mus musculus
agcaugcaccaggaaugugaccccuagagcuauggccagucc

SEQ ID NO: 23986 - RNA, 44 nt, Mus musculus
ggggguguauucuugacuacaccucacuaguacacaugggcagg

SEQ ID NO: 23987 - RNA, 46 nt, Mus musculus
gacaggaugcaggaggaggcaugucuaguuuggggguucugugcag

SEQ ID NO: 23988 - RNA, 32 nt, Mus musculus
ucauauguugguaaagagccagacgucuacag

SEQ ID NO: 23989 - RNA, 42 nt, Mus musculus
aucaaaacaguuuugccucgagcuagguuucuugggggaguu

SEQ ID NO: 23990 - RNA, 46 nt, Mus musculus
acgcugaucaccauuuucucggagucuggcuuuaccucggggcggg

SEQ ID NO: 23991 - RNA, 61 nt, Mus musculus
acuccgcucggucucagcggccagcugcgcugcugccgcagaacagguaagaggcgucggc

SEQ ID NO: 23992 - RNA, 46 nt, Mus musculus
uuuguucaucagaaacuuaaaaagaaacaaaaccugagucccauug

SEQ ID NO: 23993 - RNA, 31 nt, Mus musculus
agggaaaggaaacaaaaguugggggucaagu

SEQ ID NO: 23994 - RNA, 45 nt, Mus musculus
gggaggagguggcuuugaggaggcaucuaggaauugagaccaagg

SEQ ID NO: 23995 - RNA, 42 nt, Mus musculus
ugagacagucgccucccagcccagccugggagagggggagga

SEQ ID NO: 23996 - RNA, 26 nt, Mus musculus
agagcugugguaggguaugaagaugg

SEQ ID NO: 23997 - RNA, 42 nt, Mus musculus
ccaaagauaauacaaggaaugggguaaggguuaaagaaugaa

SEQ ID NO: 23998 - RNA, 41 nt, Mus musculus
uguuggccagcgaccgugugggaagagaggacagagggcau

SEQ ID NO: 23999 - RNA, 77 nt, Mus musculus
gcucuaccaccucaaugaucucuucaucuccgugaaagcucagagucuccagaggcggggugucagcggccgcuccg

SEQ ID NO: 24000 - RNA, 30 nt, Mus musculus
aaacgccucccagagucagcucugcgcgac

SEQ ID NO: 24001 - RNA, 45 nt, Mus musculus
gcuacgcggacuucugggaaauguaguuuuugcucuguaggcagg

SEQ ID NO: 24002 - RNA, 46 nt, Mus musculus
cccccccaaacaaaagaaaccaaaaaucaaauguagcauucaggau

SEQ ID NO: 24003 - RNA, 46 nt, Mus musculus
agggacacaacuagaaauguaauaaaguuuuauguuuggcaggaag

SEQ ID NO: 24004 - RNA, 45 nt, Mus musculus
gguuuaucaggugggguagaaaccuuacuagcccaaggacauagu

SEQ ID NO: 24005 - RNA, 46 nt, Mus musculus
acucugguacacaaguucaaucuguucuguauucccauugggagau

SEQ ID NO: 24006 - RNA, 44 nt, Mus musculus
gauugugggauucuggguguggcugggaagcagucugggugaga

SEQ ID NO: 24007 - RNA, 42 nt, Mus musculus
cccuuuacccaugacgaguaugcaccaaacucugugugugug

SEQ ID NO: 24008 - RNA, 30 nt, Mus musculus
uaggaaguagagacugagagaaagagagau

SEQ ID NO: 24009 - RNA, 53 nt, Mus musculus
ggggaaccggaagcacaccaucagcccggaggacuacaucacaggcgcccuac

SEQ ID NO: 24010 - RNA, 46 nt, Mus musculus
uuucgugaaggacuaaguugggccuggauggaaguggccccgagau

SEQ ID NO: 24011 - RNA, 46 nt, Mus musculus
caacacuggucgccaugacccugcaggagcuggggguaacuguauu

SEQ ID NO: 24012 - RNA, 42 nt, Mus musculus
augauguuccaugggaaucggcgccuggagacagagggagag

SEQ ID NO: 24013 - RNA, 46 nt, Mus musculus
ggaaucauuuucuuuccaacaugugggucucgggccucaaacucag

SEQ ID NO: 24014 - RNA, 45 nt, Mus musculus
gggaaggugagacaggaagagaaaaugguaucaaaggggauggua

SEQ ID NO: 24015 - RNA, 42 nt, Mus musculus
caccccuacucuccuguggccagggcaggggaggccccagau

SEQ ID NO: 24016 - RNA, 45 nt, Mus musculus
uauggcuuuuaucucaguaaucuaggucuauaugaaauccuccau

SEQ ID NO: 24017 - RNA, 41 nt, Mus musculus
augccacaggagaguuagagccagaguucgaccucggcaga

SEQ ID NO: 24018 - RNA, 46 nt, Mus musculus
cagagaaacccuaucuugaaaaagccauuaaacaaaagaagaagaa

SEQ ID NO: 24019 - RNA, 46 nt, Mus musculus
cuagaggcauccagucaguguguagauucccagguaugugggggug

SEQ ID NO: 24020 - RNA, 44 nt, Mus musculus
gaaccggcguugcuuccaguaaaugugaaccacucacaccuggg

SEQ ID NO: 24021 - RNA, 66 nt, Mus musculus
aguucuaagcagcugaguuacacagcaaaaccuugugguaguaggagagggguggagaaagaaaga

SEQ ID NO: 24022 - RNA, 46 nt, Mus musculus
auccauggccaaaauguuugagaauccccugaccuguuaccuguag

SEQ ID NO: 24023 - RNA, 46 nt, Mus musculus
cagaugguguugaagaacuugugcagguuuggcucccagcuaccca

SEQ ID NO: 24024 - RNA, 45 nt, Mus musculus
cccucuucuggagugucugaagacagcuacaguguacucucauaa

SEQ ID NO: 24025 - RNA, 41 nt, Mus musculus
aggccccauaggcucauauaucugaauguuugguuaccauu

SEQ ID NO: 24026 - RNA, 39 nt, Mus musculus
cucugggcagguuugugaggaaguuucuauacgggguua

SEQ ID NO: 24027 - RNA, 46 nt, Mus musculus
aaugagaucuggcgcccucuucuggagugucugaagacagcugcag

SEQ ID NO: 24028 - RNA, 41 nt, Mus musculus
ccgagugccuggggcucucagguuaaagcaagaauugggug

SEQ ID NO: 24029 - RNA, 59 nt, Mus musculus
gcacacuaggagaaaggacgcagaaaggauaccggggugugugugugugugugugugug

SEQ ID NO: 24030 - RNA, 59 nt, Mus musculus
agaaacaagcugaguucguucugaguuaagaaagcaaagaguugaaggaccgaagaauu

SEQ ID NO: 24031 - RNA, 46 nt, Mus musculus
ggccaaguaagaugcuggagcccagggagugcgggaacugguucag

SEQ ID NO: 24032 - RNA, 56 nt, Mus musculus
auuccuucugagccuggcucauuggcacuugcagaaugggggaugguguuaguguc

SEQ ID NO: 24033 - RNA, 52 nt, Mus musculus
ugcuuucagggcuccugugaagguuucaugaacccacauguaagugauccag

SEQ ID NO: 24034 - RNA, 45 nt, Mus musculus
aagcaacuuuaggaucuuaugucccuugacacagcccccacccau

SEQ ID NO: 24035 - RNA, 42 nt, Mus musculus
ccaccauuucacucuggggagcacaggguugucaaugggaag

SEQ ID NO: 24036 - RNA, 42 nt, Mus musculus
aagcugagagaaagagagcgaagucagagaaggccccuggag

SEQ ID NO: 24037 - RNA, 42 nt, Mus musculus
cggaaucgcuaucccaaaggccacuccaaaacucagccccgc

SEQ ID NO: 24038 - RNA, 45 nt, Mus musculus
ucaucgacacccaggcugggcuggcaguggcuguggaccccucag

SEQ ID NO: 24039 - RNA, 41 nt, Mus musculus
ccccuuagagcaugggggacgaguggguguccuaggccugc

SEQ ID NO: 24040 - RNA, 28 nt, Mus musculus
cacgaauuuccacugggugggaccuguu

SEQ ID NO: 24041 - RNA, 46 nt, Mus musculus
auugccuggaacuacaggaggcucuggggccagggccaggccccac

SEQ ID NO: 24042 - RNA, 45 nt, Mus musculus
aaggacaugcauaaaagcaagugaauaauaacccucgcccacccc

SEQ ID NO: 24043 - RNA, 45 nt, Mus musculus
ccagacuggccagggagggcagagcccaggcaaugggaccuagag

SEQ ID NO: 24044 - RNA, 41 nt, Mus musculus
cugccucaguuuccccucucauuuggcuucggcugcccucu

SEQ ID NO: 24045 - RNA, 47 nt, Mus musculus
cucacucuagcaauaccaccggacuaguuagccuucccggccccaag

SEQ ID NO: 24046 - RNA, 42 nt, Mus musculus
caucaagguauuuacucccagccucccccagccuugccccug

SEQ ID NO: 24047 - RNA, 45 nt, Mus musculus
accuacgugaguacugucucugggcaaaggaaucaaccuggggag

SEQ ID NO: 24048 - RNA, 42 nt, Mus musculus
aguaaagacagccugagugcaucaggcugccucagggcccag

SEQ ID NO: 24049 - RNA, 27 nt, Mus musculus
cucucugguuguuuucagugccccagg

SEQ ID NO: 24050 - RNA, 45 nt, Mus musculus
ccccugguguggggggaagacuuggagcuuuacucgaaauuccug

SEQ ID NO: 24051 - RNA, 42 nt, Mus musculus
gcaguacuguugggggacagggaauuggggugggagggaggc

SEQ ID NO: 24052 - RNA, 46 nt, Mus musculus
gaggcacccaaaaggaggggagugcugcaccccaaaagguaccagu

SEQ ID NO: 24053 - RNA, 77 nt, Mus musculus
aaucaacagaggccgggugagacccagaaauccgugcuagauccuccacgacauggucguggcuccuggcgacagua

SEQ ID NO: 24054 - RNA, 43 nt, Mus musculus
aggguccuucccucugaaguugaaguauuagagucuaucuauc

SEQ ID NO: 24055 - RNA, 45 nt, Mus musculus
gcaacagcuucggaccguccgaaccacgggcauaaaggguggauc

SEQ ID NO: 24056 - RNA, 46 nt, Mus musculus
cacuuagcuuuugguguccuggaaggaccugaaacagggccaggag

SEQ ID NO: 24057 - RNA, 42 nt, Mus musculus
caagugagccagaagaggcucugaaccgagagcugggggagg

SEQ ID NO: 24058 - RNA, 42 nt, Mus musculus
gcacccucucaccccaacuuugccuugcugaaagugguccag

SEQ ID NO: 24059 - RNA, 46 nt, Mus musculus
ccugucacucuggggagaggcacuauguggaaaagcuggcugucag

SEQ ID NO: 24060 - RNA, 44 nt, Mus musculus
acuuuuccaucugaguuaguggaugugaugaaggcuaggggcau

SEQ ID NO: 24061 - RNA, 45 nt, Mus musculus
cccugccucaucccuugucauucuacuguguccuaagcccuggug

SEQ ID NO: 24062 - RNA, 42 nt, Mus musculus
aguaagaucuguguagguguuaacuggaaaaauaaacuguug

SEQ ID NO: 24063 - RNA, 45 nt, Mus musculus
ugcuuguagaagccagaccuugugcucuagaaauagcagcaagcc

SEQ ID NO: 24064 - RNA, 46 nt, Mus musculus
aagacauuaaaacaggcuguggucagaagugugaagggguuaaaau

SEQ ID NO: 24065 - RNA, 44 nt, Mus musculus
cacuaucuuuugacacuaagauggaagguuacuaaguugcagga

SEQ ID NO: 24066 - RNA, 42 nt, Mus musculus
gaccgguaguacagauagucuucagcuaucgucuugccccag

SEQ ID NO: 24067 - RNA, 42 nt, Mus musculus
uguuuuaaaaagccaagguggguggggaagaaagggagggag

SEQ ID NO: 24068 - RNA, 45 nt, Mus musculus
cauucucggggagcaggccacccugggccaggccagcagcugcuc

SEQ ID NO: 24069 - RNA, 46 nt, Mus musculus
uguucaucuuggaggaguugcugagucccaucgucacaccccucau

SEQ ID NO: 24070 - RNA, 88 nt, Mus musculus
uagguccuucaucccagaccagcacaugguguucugccccgagcagcugcuccgagugauucuugcacacauccacuacaugccugac

SEQ ID NO: 24071 - RNA, 48 nt, Mus musculus
gaagauguguuagcuguggaacacguccucaccacggucacccuccug

SEQ ID NO: 24072 - RNA, 47 nt, Mus musculus
cugcagucccgccucaaccgaggcuacaagcccgccuccaaguacau

SEQ ID NO: 24073 - RNA, 44 nt, Mus musculus
aucgccaacuuccugcuguguccccucauccucaucuggcagau

SEQ ID NO: 24074 - RNA, 47 nt, Mus musculus
cccggcucucuguuucucaaugaguggagccucaaggccgaguacaa

SEQ ID NO: 24075 - RNA, 45 nt, Mus musculus
gccuugaggcuccacucauugagaaacagagagccggguccccag

SEQ ID NO: 24076 - RNA, 46 nt, Mus musculus
uauacaucuccuauacuugucucuuguccacccuauccuggcaguc

SEQ ID NO: 24077 - RNA, 46 nt, Mus musculus
agcauacaacaaaggaagucuguucacuucauggccaccaggaagu

SEQ ID NO: 24078 - RNA, 45 nt, Mus musculus
cuugggcuguguugcuaaugguucaacuucuggucuuaccauugg

SEQ ID NO: 24079 - RNA, 46 nt, Mus musculus
cucugccagaugccuuuuugccugcccaagucuguagugccaggua

SEQ ID NO: 24080 - RNA, 46 nt, Mus musculus
cccuguuucccaucagagaccucccucgcucagagacaggcuaaaa

SEQ ID NO: 24081 - RNA, 46 nt, Mus musculus
aaacuuucucuucauuggacagaaaaugaaacaacucaccccauac

SEQ ID NO: 24082 - RNA, 23 nt, Mus musculus
gccugacaccuuuuccuccagca

SEQ ID NO: 24083 - RNA, 23 nt, Mus musculus
guggaucuugguccgaccugguc

SEQ ID NO: 24084 - RNA, 45 nt, Mus musculus
agacccaggcccaagcuggccagggaugcccacugagccccaagu

SEQ ID NO: 24085 - RNA, 47 nt, Mus musculus
gcugcuaguggcuuuggcaguggccuuguguaugcgccaucauucga

SEQ ID NO: 24086 - RNA, 46 nt, Mus musculus
cagagggaggaagcagcugaaguccuuccccgacaagcccauggca

SEQ ID NO: 24087 - RNA, 42 nt, Mus musculus
ugccccccacacccucgcuuccuggguaccucacugccagcc

SEQ ID NO: 24088 - RNA, 46 nt, Mus musculus
ggagcaagaggguaagcaggggaggugaagcauuagaccaggaaag

SEQ ID NO: 24089 - RNA, 45 nt, Mus musculus
ucauggcgagagcuugugcuagaggaaucugcugccgggagaggc

SEQ ID NO: 24090 - RNA, 46 nt, Mus musculus
ggguccugugaucaaggugaacagcaagcagcgcuacgccucuaau

SEQ ID NO: 24091 - RNA, 45 nt, Mus musculus
ucauggcuagaaucugccugaaucguuuguucugaugcccuugag

SEQ ID NO: 24092 - RNA, 46 nt, Mus musculus
ucaugaucagugcagacauggcccaugcugugcacccaaacuacuc

SEQ ID NO: 24093 - RNA, 42 nt, Mus musculus
gcccauccugcgcaucccacaucuggccauccaucugcagcg

SEQ ID NO: 24094 - RNA, 46 nt, Mus musculus
ggaggcuaggagugggagugacuugaccaacuuccaucgcugagag

SEQ ID NO: 24095 - RNA, 46 nt, Mus musculus
uuauuuauuuauuuaauguguaugaauacaccgcagcugucuucag

SEQ ID NO: 24096 - RNA, 71 nt, Mus musculus
uucccugugauggugaggcacaauguuauuuaaaugguuuugcgugaugagcuuugugugugugugugugu

SEQ ID NO: 24097 - RNA, 45 nt, Mus musculus
ugcaaagccucugucaccuugauucuuucccugccuuucccuguu

SEQ ID NO: 24098 - RNA, 42 nt, Mus musculus
ucuccaaccagccuagugagacuagggcgcuggggcccgaag

SEQ ID NO: 24099 - RNA, 45 nt, Mus musculus
ugcauggcuguaggaugcagggcuuccagcuacugccaggaguua

SEQ ID NO: 24100 - RNA, 46 nt, Mus musculus
gacgucuauuggacugacucaguugugggguccaggucagcaauca

SEQ ID NO: 24101 - RNA, 46 nt, Mus musculus
uuugugguuccauauucaccgcugggauucggaguugaacagcuag

SEQ ID NO: 24102 - RNA, 45 nt, Mus musculus
uugcaaggcacugggacuagagguuucaggguuuugagaucuggg

SEQ ID NO: 24103 - RNA, 45 nt, Mus musculus
caaaccucuguuuccuguggcaggcguucccaugauccagcacca

SEQ ID NO: 24104 - RNA, 41 nt, Mus musculus
agugucagcgcugcaugccaggugcuaacggugaagggaag

SEQ ID NO: 24105 - RNA, 46 nt, Mus musculus
gccccaucagcugugguaaguaagcuguggccccaacuucagggag

SEQ ID NO: 24106 - RNA, 46 nt, Mus musculus
ggccagggacaccuggcuucccucccuacugccaaauaaaccccua

SEQ ID NO: 24107 - RNA, 42 nt, Mus musculus
uggaaggagaagugauaagacacaggagaugagcacacagag

SEQ ID NO: 24108 - RNA, 51 nt, Mus musculus
agggagaagucauuuuacuuccucugaguaagaggcagggguagggaguug

SEQ ID NO: 24109 - RNA, 45 nt, Mus musculus
ugccggguacuauggaaacucugcgguuucagcugcugcccccgg

SEQ ID NO: 24110 - RNA, 41 nt, Mus musculus
guucuggagacgcagcugagugcuggggcaagcgcgggcau

SEQ ID NO: 24111 - RNA, 47 nt, Mus musculus
gacaugggaaggagggguggacggagaugggugguuagugagaaggg

SEQ ID NO: 24112 - RNA, 42 nt, Mus musculus
ugggcaagggacuguggaagccuaaagccucugaggggaagg

SEQ ID NO: 24113 - RNA, 46 nt, Mus musculus
auaaucacuuguaccgaaagccaaguauaagcaccuuagacaccag

SEQ ID NO: 24114 - RNA, 84 nt, Mus musculus
gugucagaggaaggcaggguggagccagagccccaggaagaagagagggaagaacaggauaaagaagagggaucgagagaggac

SEQ ID NO: 24115 - RNA, 44 nt, Mus musculus
ggaaggugucucugagaggaguguggagagggagcccaggggaa

SEQ ID NO: 24116 - RNA, 44 nt, Mus musculus
ccaaggcuaugggaggggaccagagcaggaccuggaaguuagaa

SEQ ID NO: 24117 - RNA, 45 nt, Mus musculus
cugaucuucuaugaugaggugugugugugugugugugugugugug

SEQ ID NO: 24118 - RNA, 46 nt, Mus musculus
uugaguuagccauagauuuuucuauuuuguuuuuauuugucaaggu

SEQ ID NO: 24119 - RNA, 45 nt, Mus musculus
aaaaaaaaagaugaaccucugagugcaucaucuuucccagagguc

SEQ ID NO: 24120 - RNA, 61 nt, Mus musculus
ggggauggaauccaauuugugaccccagauggaguauaagucgccuuuguuucccugcaua

SEQ ID NO: 24121 - RNA, 46 nt, Mus musculus
gacuaaaauaugaccugaauaucucuuuugauguguguacauagag

SEQ ID NO: 24122 - RNA, 46 nt, Mus musculus
uuuauuuauacguauuuccauauuucauuccuguacggccccgcug

SEQ ID NO: 24123 - RNA, 42 nt, Mus musculus
cucagccucacagcccuuccuguugauuacauaagcgcuugg

SEQ ID NO: 24124 - RNA, 42 nt, Mus musculus
aagcgugauguguagcugauugguugacuauuggcugguaau

SEQ ID NO: 24125 - RNA, 46 nt, Mus musculus
cucucuuauccugguaaccccuagaccagaccaguuuagcccugga

SEQ ID NO: 24126 - RNA, 46 nt, Mus musculus
uucaauggccaggacaccugguggauuuuuaugacauagggggggu

SEQ ID NO: 24127 - RNA, 74 nt, Mus musculus
uuugagcagcguccaggcgaugcgaacccagaugcagcagaugcauggcaggaugguuccugucugagccagua

SEQ ID NO: 24128 - RNA, 45 nt, Mus musculus
aaaaaaaaaaaaaaagaaaaaaaaaaagaaaaaaagaaaagaaaa

SEQ ID NO: 24129 - RNA, 46 nt, Mus musculus
uucccuacuuucuugccuucaucuguguccuuuuguggggagaagc

SEQ ID NO: 24130 - RNA, 53 nt, Mus musculus
aagaauaggauuuccugucaacagauucaggacaacaccuagacacaagacuc

SEQ ID NO: 24131 - RNA, 45 nt, Mus musculus
ucaacaugcuggacaaacucauccgcaaucccaacagccugaaga

SEQ ID NO: 24132 - RNA, 45 nt, Mus musculus
uuguuagauccuaucucagaaaacaagagggauguggguggagac

SEQ ID NO: 24133 - RNA, 45 nt, Mus musculus
guuguuugucauuaaccuuccuuuauuucaauugagagucccaga

SEQ ID NO: 24134 - RNA, 23 nt, Mus musculus
acacaguuaaagggccaaaugac

SEQ ID NO: 24135 - RNA, 46 nt, Mus musculus
aauaagauuccaggcuaauagaauuuaauuacagacaucuccagug

SEQ ID NO: 24136 - RNA, 42 nt, Mus musculus
uuuaaaacugcuauaguuguaauuagaccuuggcccucaagg

SEQ ID NO: 24137 - RNA, 67 nt, Mus musculus
cuaauaaccucacuccacauuauaacccaucagugacuugguuucaagaccaaaauuaaauuauuuc

SEQ ID NO: 24138 - RNA, 68 nt, Mus musculus
augguuaaguaagcauuggguuugaaauaauacauuaaagucaauguuuuaaauauaaguaaauauac

SEQ ID NO: 24139 - RNA, 46 nt, Mus musculus
aaccacagaacaggaaaguaauuccaagugacuuauaaggcaaauc

SEQ ID NO: 24140 - RNA, 45 nt, Mus musculus
augugugaugugagaaaguacgggaaaucacagagcccaggacaa

SEQ ID NO: 24141 - RNA, 27 nt, Mus musculus
agguuauuuccgaagguuccacagaag

SEQ ID NO: 24142 - RNA, 45 nt, Mus musculus
acacacacacacacacagagagagagagagagagagagucagcca

SEQ ID NO: 24143 - RNA, 63 nt, Mus musculus
uuuuguuuuacuguucucaucuauaaaaauggagauaaauaaagcuugccuugcaaagauauu

SEQ ID NO: 24144 - RNA, 50 nt, Mus musculus
aagaaaucgaugcauccugcauuaaaauugaaaaggucauaggaguuggu

SEQ ID NO: 24145 - RNA, 38 nt, Mus musculus
cgacccuuuagguuuauucauguugccuuuauccaguc

SEQ ID NO: 24146 - RNA, 45 nt, Mus musculus
uuuaaacucuuauccuugaagugugaggacauuccaggaagucag

SEQ ID NO: 24147 - RNA, 54 nt, Mus musculus
ucuuuuuaaauuuuaauagacggaguaaguacagcaaagcgaaacaagaagcag

SEQ ID NO: 24148 - RNA, 45 nt, Mus musculus
auaugcuauagaguauguccucccacccaaccucuagcccccaga

SEQ ID NO: 24149 - RNA, 46 nt, Mus musculus
ggguuuccauuugcacaaggauuauaacauggcccuuuccccagau

SEQ ID NO: 24150 - RNA, 44 nt, Mus musculus
uuguucaaacaugggaaacaauguuaagaacaugacuaaaauau

SEQ ID NO: 24151 - RNA, 46 nt, Mus musculus
aggacuguuaauaguuauauaauuaaacgcaacuugaaacccagga

SEQ ID NO: 24152 - RNA, 46 nt, Mus musculus
uuauuuauuuuauuguauuuguuuaauuuguaaugagaugccagaa

SEQ ID NO: 24153 - RNA, 46 nt, Mus musculus
gguccucguggucauucucauugcagcuuuugugaucagccgaagg

SEQ ID NO: 24154 - RNA, 46 nt, Mus musculus
agacgcuucauuuauagguucagccccacucuagugaaacccaaag

SEQ ID NO: 24155 - RNA, 46 nt, Mus musculus
agaaguuacaagauauagcguagcucuggcuuggcuggaaccagau

SEQ ID NO: 24156 - RNA, 42 nt, Mus musculus
guguguguguguguguguuaauacaucuaacgagcacauuuc

SEQ ID NO: 24157 - RNA, 45 nt, Mus musculus
ccugcauuuuuaggacgucucagacaagauccacucugcccauuu

SEQ ID NO: 24158 - RNA, 46 nt, Mus musculus
ugcuauucagaacauugccacaaaaccuugaaaauuaugggcauaa

SEQ ID NO: 24159 - RNA, 45 nt, Mus musculus
gguuggcaucaaccuccagcuggcagauuacagaugagagagaau

SEQ ID NO: 24160 - RNA, 46 nt, Mus musculus
uuacgcuuuuuuugcaguuaccagauuuaacuaccuacguccuuau

SEQ ID NO: 24161 - RNA, 46 nt, Mus musculus
accauuuaugaaaauugguacuuuuguuuaaaguuuuuaaccagau

SEQ ID NO: 24162 - RNA, 45 nt, Mus musculus
ucacaaacacgguguucaucuguugcucugucugccucuccuuuc

SEQ ID NO: 24163 - RNA, 23 nt, Mus musculus
uaaucuaauccaaaagccccugu

SEQ ID NO: 24164 - RNA, 46 nt, Mus musculus
cucagaaaauggacguugguuuuuauuuauucacccaagcccagag

SEQ ID NO: 24165 - RNA, 46 nt, Mus musculus
ucugugccuccuuccucgugggcgaauaacauuugggggugcagaa

SEQ ID NO: 24166 - RNA, 48 nt, Mus musculus
uagccagugguuaggugugaggcucaaaggccuuacuggaguuagcca

SEQ ID NO: 24167 - RNA, 45 nt, Mus musculus
ggggucugaagcuuagauggguuuugugugauuuaagggguggaa

SEQ ID NO: 24168 - RNA, 45 nt, Mus musculus
cugccaucuuuuaauuagacacauuauguuauuugagugggauaa

SEQ ID NO: 24169 - RNA, 46 nt, Mus musculus
aguuauucaauauguuuguugacuuaauuuuuauuuacaguaaaaa

SEQ ID NO: 24170 - RNA, 41 nt, Mus musculus
aaaguauuuuguuuauguaugagagaggguaugcauguagg

SEQ ID NO: 24171 - RNA, 46 nt, Mus musculus
ggacucaagccaaaagauuaugucagccuauacuaugccaaaaggu

SEQ ID NO: 24172 - RNA, 46 nt, Mus musculus
ccauccaucuucaccuccuuguuuguuauaagaaucggccaccaau

SEQ ID NO: 24173 - RNA, 46 nt, Mus musculus
ucuuaaccacugaaccaucuccccaccccucgucuuugccacuuaa

SEQ ID NO: 24174 - RNA, 46 nt, Mus musculus
gcguauucagguacaagagcccaugagcaccaaagcacuaagaguc

SEQ ID NO: 24175 - RNA, 46 nt, Mus musculus
uuauuauaaauguagaagcugcguuaaaauauaaaaaggugcuagu

SEQ ID NO: 24176 - RNA, 42 nt, Mus musculus
agacgaccagagucuccaucacugaccuccuagcacacacca

SEQ ID NO: 24177 - RNA, 46 nt, Mus musculus
uaaugucaacgagacaucggugaacuuggaauggagcagcccucag

SEQ ID NO: 24178 - RNA, 46 nt, Mus musculus
ugggaacuggaauccacuuguaaagccgacucucagaaaguaagau

SEQ ID NO: 24179 - RNA, 46 nt, Mus musculus
aucauuuaauuugcuaucgguaauggguucuacugagcaaccagaa

SEQ ID NO: 24180 - RNA, 42 nt, Mus musculus
gcuguuuguuuuguuuuuuuuccucucuccccuccagcagaa

SEQ ID NO: 24181 - RNA, 85 nt, Mus musculus
uugacaaagcuuuaauuggacaaggcccuuuuuuaaacucccaggugcagugccuagucacuuagugcauaagaacagggcaggg

SEQ ID NO: 24182 - RNA, 42 nt, Mus musculus
ugguuuauggaaagaaaagaugauuuauuguugcucggaguu

SEQ ID NO: 24183 - RNA, 46 nt, Mus musculus
uuuaucgggugacaguugcgcuuaaagaaauugaucauguuaagag

SEQ ID NO: 24184 - RNA, 45 nt, Mus musculus
cagcuauacucuagucauuucauauacagaaacaaaacaucaggu

SEQ ID NO: 24185 - RNA, 46 nt, Mus musculus
acagagacagagacagagacagagacagagagaagaggccaaagau

SEQ ID NO: 24186 - RNA, 46 nt, Mus musculus
gucagguagcccaggcuggccuuuaauucucucuauuggcugagaa

SEQ ID NO: 24187 - RNA, 46 nt, Mus musculus
agucugaguauuuaaaaaugaaguaguccauaucuguucaagagaa

SEQ ID NO: 24188 - RNA, 46 nt, Mus musculus
uuagaccagguaaauacaagucguaccaacuaauuuugaaggagac

SEQ ID NO: 24189 - RNA, 46 nt, Mus musculus
ugacuuuccugucccauccuuugccccucccuucacccccaacccc

SEQ ID NO: 24190 - RNA, 41 nt, Mus musculus
uuaugcugggcuguuugcaacugcaccauagcuaugugaga

SEQ ID NO: 24191 - RNA, 46 nt, Mus musculus
aguauauauuccugggcuguuguuucucuugccuggugucccagau

SEQ ID NO: 24192 - RNA, 46 nt, Mus musculus
ggcaaauuagauaucaagcacgcauccccuucuaucauagcaggcg

SEQ ID NO: 24193 - RNA, 45 nt, Mus musculus
uccguccucaacacagguuuugguaguaucgacacauucucagac

SEQ ID NO: 24194 - RNA, 42 nt, Mus musculus
gcuuacaaagucauucgcuuacaaaaguacagagcagcaguu

SEQ ID NO: 24195 - RNA, 46 nt, Mus musculus
uccuaauugggaaaaugaggauaagauuagaguaggagugagagau

SEQ ID NO: 24196 - RNA, 46 nt, Mus musculus
gaacacauauccuuuagauuuacauaauggcccacaaagagaaaaa

SEQ ID NO: 24197 - RNA, 45 nt, Mus musculus
agggucaugagcuuaaaggauagcuugggcuacacagugaggagc

SEQ ID NO: 24198 - RNA, 45 nt, Mus musculus
cuuuauccuccucccaucaccaucccucggguaaauaagacaaua

SEQ ID NO: 24199 - RNA, 45 nt, Mus musculus
uuuucuuaccuagacaaugccaugggaaaaagccaagccuaauuu

SEQ ID NO: 24200 - RNA, 46 nt, Mus musculus
aagauacaagucacuuuaagggaggacuugauagugaaacagaaga

SEQ ID NO: 24201 - RNA, 46 nt, Mus musculus
uugcccauugcuucuaaugcuuuccagugacagacugggcaaagag

SEQ ID NO: 24202 - RNA, 39 nt, Mus musculus
agggaugagggaugagcucuuagggaugagcucuuaggg

SEQ ID NO: 24203 - RNA, 50 nt, Mus musculus
gagggaugagcuaggagggaugagggaugagcuaggagggcugagggaug

SEQ ID NO: 24204 - RNA, 61 nt, Mus musculus
ugagcuaggagggaugagggaugagcuaggaggacugagggaugagcuaggagggaugagg

SEQ ID NO: 24205 - RNA, 46 nt, Mus musculus
aagaacagauaagguucaccugcuauaagugcagggggcgggggag

SEQ ID NO: 24206 - RNA, 88 nt, Mus musculus
cuggccucuuccuggauucaaagggagccaggauaaguuaagcaagggguggcugggaguccuaugugggugagcaagagggggcucg

SEQ ID NO: 24207 - RNA, 46 nt, Mus musculus
uccuaauucccagaucacacauacacaaagccuguagcccccaguu

SEQ ID NO: 24208 - RNA, 46 nt, Mus musculus
ugguucaagacucuuugcuuuaaaagaaaaucaaaggccuuuagau

SEQ ID NO: 24209 - RNA, 46 nt, Mus musculus
uucacacaguacuaaaaggccggagaggcuguggggaagacaagau

SEQ ID NO: 24210 - RNA, 47 nt, Mus musculus
ggcugcucaguuugauuauagauauaaaauuaaauuaucaaguaaau

SEQ ID NO: 24211 - RNA, 48 nt, Mus musculus
gguaugcuuaagaucuugaguucauacgcuagcauggaguagaaaaga

SEQ ID NO: 24212 - RNA, 46 nt, Mus musculus
ucccugucccaagaagcugacuuggacaaucucuucgaagacagaa

SEQ ID NO: 24213 - RNA, 93 nt, Mus musculus
ucugaaaaagagcaugguaccugguguuucuuuuauccuguuaguaauagaaaagucugugaacccaggggccaugaaaaaaagaacagcauu

SEQ ID NO: 24214 - RNA, 42 nt, Mus musculus
agcacugauuacauggucacuucaacacagaaagccccaugc

SEQ ID NO: 24215 - RNA, 42 nt, Mus musculus
gcuuccagacuuuacauacacuuuguauuugaacgcacauac

SEQ ID NO: 24216 - RNA, 45 nt, Mus musculus
gccaggcagacucuucuaggaggcuugcagaaaggggcagcccag

SEQ ID NO: 24217 - RNA, 46 nt, Mus musculus
uucauguauguuuucuugagacaaagccacacuuuauagcccagac

SEQ ID NO: 24218 - RNA, 46 nt, Mus musculus
auugacagcuccagaaagcccuugcaguuuauguaauuauggagag

SEQ ID NO: 24219 - RNA, 45 nt, Mus musculus
caguccuuuucuuauuuuccccaaaucuucaaauaggcccaaguu

SEQ ID NO: 24220 - RNA, 36 nt, Mus musculus
aauuucugaaggaaaagauaaaaauucuuuguaaga

SEQ ID NO: 24221 - RNA, 46 nt, Mus musculus
uuguccuuagugacagcuccaguguggaaucuugcuguuccuucug

SEQ ID NO: 24222 - RNA, 45 nt, Mus musculus
gcauguuggaauggcuuucuacuccccuuggagacacccggcguu

SEQ ID NO: 24223 - RNA, 45 nt, Mus musculus
guuacugauuuaaauggauuugggaaggucuggcauggcuagggg

SEQ ID NO: 24224 - RNA, 46 nt, Mus musculus
gggccagaagaggguguugggccccucaaacuugaguuagggagag

SEQ ID NO: 24225 - RNA, 46 nt, Mus musculus
uugguguguauguaugacauaagcuagcuaaaauaacacagcagag

SEQ ID NO: 24226 - RNA, 41 nt, Mus musculus
uacagguaguuauaaacuguccaccauggguguagggaacc

SEQ ID NO: 24227 - RNA, 46 nt, Mus musculus
uacacaacuaccaccaaccaccaucauuucuacagaugcccagguu

SEQ ID NO: 24228 - RNA, 46 nt, Mus musculus
guacaggauucuggccugugucguauuaaacauuuaucugggagaa

SEQ ID NO: 24229 - RNA, 46 nt, Mus musculus
agcauucaucaagaaugaaugguauagaaaugacauggcggcuaug

SEQ ID NO: 24230 - RNA, 72 nt, Mus musculus
aaaaauuaguaaaaaagaaaagauucuuuaagaggcaaagaauuauagaagugacaaaauuaaguuaggcag

SEQ ID NO: 24231 - RNA, 46 nt, Mus musculus
aaaucaagauauaauguggucucuuucugugucuggggagcaaaga

SEQ ID NO: 24232 - RNA, 46 nt, Mus musculus
accagcccuaaauccuucaugaaacccccuuuucacaucucagauc

SEQ ID NO: 24233 - RNA, 42 nt, Mus musculus
acuccagagccuccugucuuccauuuccaaaugcuaggccua

SEQ ID NO: 24234 - RNA, 46 nt, Mus musculus
cucucgagugcuucauucgguguuuugagacaaaucgugcugagau

SEQ ID NO: 24235 - RNA, 46 nt, Mus musculus
uacaaagguaguuuaaaaauuaaugaaaggggcuggcuggugugug

SEQ ID NO: 24236 - RNA, 45 nt, Mus musculus
uguguguucauucugugauauauggaagggacagaaccaggagcu

SEQ ID NO: 24237 - RNA, 46 nt, Mus musculus
ggacagaguagaaagccugcaguauauccugguauuugcaugagaa

SEQ ID NO: 24238 - RNA, 48 nt, Mus musculus
aauggcugguacccauuggcaacugccuaugcaacgcugggcacgagg

SEQ ID NO: 24239 - RNA, 63 nt, Mus musculus
uucccugguggaaguucgaggcuccugugucaacaacucagaagagaaggaugugccaaaaau

SEQ ID NO: 24240 - RNA, 54 nt, Mus musculus
uucacgcagguggacauuggugaccgaaucaugaaacucaacacugagauccgg

SEQ ID NO: 24241 - RNA, 68 nt, Mus musculus
acgacaaggagcgcuucaucagagagagccaguuuggcaagaucgacaccaucgcagcugaugagagc

SEQ ID NO: 24242 - RNA, 46 nt, Mus musculus
acaaaacccuuaauuuaaaaguuguuuaaagauagagccaccauug

SEQ ID NO: 24243 - RNA, 42 nt, Mus musculus
gaauuggucauucuggaggaacaagagagggggugaugagaa

SEQ ID NO: 24244 - RNA, 75 nt, Mus musculus
gaagccuccuuucucuuucucccugccccaagcaugaagagaggagacagcuaagaccauuuucaaucuagccug

SEQ ID NO: 24245 - RNA, 75 nt, Mus musculus
caagccaucugacccugacaugugagauaguuuaugacugagucaacugaucaaaaacaaugaagaagcaaagau

SEQ ID NO: 24246 - RNA, 79 nt, Mus musculus
gaaagaagucaggacagcuuguaucacugacgaugggccccgcauugaaauaacucacauccuuuaagaaaauauuaag

SEQ ID NO: 24247 - RNA, 23 nt, Mus musculus
gaguuccgugcuuggcugccaca

SEQ ID NO: 24248 - RNA, 45 nt, Mus musculus
auuuaugccuauuacucugguggucauggaguccuggcgggguua

SEQ ID NO: 24249 - RNA, 48 nt, Mus musculus
uauagacuuagaugccuauuuaaaacuaaaauaccgacaagaaauacg

SEQ ID NO: 24250 - RNA, 42 nt, Mus musculus
ucuaauggcuugauucuuggugauguggugagggggucagau

SEQ ID NO: 24251 - RNA, 46 nt, Mus musculus
uguucagggagagcuuggguggauagcaagcccucuggaaggaggg

SEQ ID NO: 24252 - RNA, 46 nt, Mus musculus
aagcaaguuaaauaaauaagaaccugcagacuuaaagaggggagag

SEQ ID NO: 24253 - RNA, 45 nt, Mus musculus
acagggugucuuuuagaugggccuuucgacccccaagccugaaga

SEQ ID NO: 24254 - RNA, 46 nt, Mus musculus
uuagcuuccuggauuugagggauagaaugagaggaggugggcagaa

SEQ ID NO: 24255 - RNA, 42 nt, Mus musculus
guguccccagagaccucucucgccccagaccuagagguaguu

SEQ ID NO: 24256 - RNA, 46 nt, Mus musculus
cacccaccaggugcuaggagguagcuccguaagcuacacuugacag

SEQ ID NO: 24257 - RNA, 42 nt, Mus musculus
cucaaggacugcagcugagccuugucucucccugccccauuu

SEQ ID NO: 24258 - RNA, 46 nt, Mus musculus
gggacucaucucugaaaaagucccagagacauacagcaugaccauu

SEQ ID NO: 24259 - RNA, 46 nt, Mus musculus
ucgaaugccacaggcacacauuaaagauacuuacagcccaucagau

SEQ ID NO: 24260 - RNA, 24 nt, Mus musculus
gaucaacuccaaagggggccguuu

SEQ ID NO: 24261 - RNA, 58 nt, Mus musculus
augaagaugugaguauucuugggaucugggagcauucccuuugcagugucauagauac

SEQ ID NO: 24262 - RNA, 65 nt, Mus musculus
caaaguaggcagcuccguagaugauaaugcccuguacugacacauuaaagccuugguacaggccc

SEQ ID NO: 24263 - RNA, 44 nt, Mus musculus
gguaugggcaaaaucaagaggguacacaaagcacaaggauguag

SEQ ID NO: 24264 - RNA, 42 nt, Mus musculus
agucaucgaguuucuguuggacaaaucugcugagaaggcccu

SEQ ID NO: 24265 - RNA, 46 nt, Mus musculus
ugugugugugguauauguguuuagugugagugauauguauguagua

SEQ ID NO: 24266 - RNA, 39 nt, Mus musculus
aauugcuggccgcuucacaccugggaccuucacuaacca

SEQ ID NO: 24267 - RNA, 45 nt, Mus musculus
guuaugccugaucuuuaccucuacagagacccagaggagauugag

SEQ ID NO: 24268 - RNA, 42 nt, Mus musculus
auauuuuagaauccacccucagcccacuaugaacggccagug

SEQ ID NO: 24269 - RNA, 45 nt, Mus musculus
uguggcuauuugucauugaauugucuuucaacuuuaaaacauagu

SEQ ID NO: 24270 - RNA, 50 nt, Mus musculus
ucaaguucaagguuacuauguagacuggagaauguugagugauuugaaga

SEQ ID NO: 24271 - RNA, 45 nt, Mus musculus
gacccaauggauuucauuaggguuguuuacaagguguggccagga

SEQ ID NO: 24272 - RNA, 45 nt, Mus musculus
gugaaagaggaauucagaaauacguauacaaacgacagcacuaag

SEQ ID NO: 24273 - RNA, 46 nt, Mus musculus
gaaugcucagcuuugugugggugcuagagauaugaauucgguccuc

SEQ ID NO: 24274 - RNA, 43 nt, Mus musculus
aacccaaacugaguucauguuccuuuagcacuacacaaaggca

SEQ ID NO: 24275 - RNA, 46 nt, Mus musculus
guacuguggaugaauauauagaauacaaagaguuguuucagcaaga

SEQ ID NO: 24276 - RNA, 46 nt, Mus musculus
aguagcaaauccauagcaguugaaugcauggggaugaccucuggac

SEQ ID NO: 24277 - RNA, 42 nt, Mus musculus
uggcggcuguggcuguggugguugugguggcuguggcugcgg

SEQ ID NO: 24278 - RNA, 46 nt, Mus musculus
aagugaugcugcuaguagaaccaggugcucugcuccuaccuaggag

SEQ ID NO: 24279 - RNA, 45 nt, Mus musculus
gccacagcaacccaugguguuaguagagaggauucaggugcagug

SEQ ID NO: 24280 - RNA, 42 nt, Mus musculus
ccacagcaacccaugguguuaguagagaggacucaggugcag

SEQ ID NO: 24281 - RNA, 42 nt, Mus musculus
acagcaacccauggugucaguaaagaggauucaggugcagug

SEQ ID NO: 24282 - RNA, 86 nt, Mus musculus
ccuuuagcuuuggcuuucuugauugcaaaauggcgaacugguacugcuggguaggcugaguacugccuauggucauguugucuucc

SEQ ID NO: 24283 - RNA, 42 nt, Mus musculus
aguaaaaguccucugccaacagagacauucacaaggggagau

SEQ ID NO: 24284 - RNA, 46 nt, Mus musculus
aguguucuuugcuuucucagaugccucugugugacacuggcugcag

SEQ ID NO: 24285 - RNA, 42 nt, Mus musculus
uuaccuugccaacagagauccuuucugauccaaccaccagug

SEQ ID NO: 24286 - RNA, 46 nt, Mus musculus
aguuggcauuggcgauuucauuggucucauugggauccaaccagac

SEQ ID NO: 24287 - RNA, 46 nt, Mus musculus
augccugcccuuccgucgggccaggguguuuuuccggcaacgagcc

SEQ ID NO: 24288 - RNA, 45 nt, Mus musculus
gcggucaaucuucuuggauucccgguaucuccugagaagccggcg

SEQ ID NO: 24289 - RNA, 46 nt, Mus musculus
cuugugaucuauagcagcugugaauuuaaacugacagacaagggag

SEQ ID NO: 24290 - RNA, 79 nt, Mus musculus
uugacauggcuaccauugcauguugacauguuugacaaaugucugagaggguagugccaucccaccaucauuacaguug

SEQ ID NO: 24291 - RNA, 46 nt, Mus musculus
aacaaucaguaaugagaucugaugcccucuucugguaugucuggag

SEQ ID NO: 24292 - RNA, 46 nt, Mus musculus
gggaguaacauugucauuguggugaaguccuaugagcugucugggg

SEQ ID NO: 24293 - RNA, 45 nt, Mus musculus
guuuuccuguucacuuaucuauguugcauuuguacaugaaaggga

SEQ ID NO: 24294 - RNA, 46 nt, Mus musculus
augguugugagccaccaugugguugcugcgauuugaacuccggacc

SEQ ID NO: 24295 - RNA, 45 nt, Mus musculus
cacucugugugauugcuggaggccuuagccggguguggauuccua

SEQ ID NO: 24296 - RNA, 41 nt, Mus musculus
guacuacuaggcuuuggaaaaaaugcagucaagucggugua

SEQ ID NO: 24297 - RNA, 45 nt, Mus musculus
aaauggcauucaguucaccauccaggaugauggcugcugauggga

SEQ ID NO: 24298 - RNA, 45 nt, Mus musculus
aaugucauccaauuuaccauugggguggauggauguugaugagag

SEQ ID NO: 24299 - RNA, 46 nt, Mus musculus
guuuuguuuuuaauuuugugugugugugugugugugugugugugug

SEQ ID NO: 24300 - RNA, 48 nt, Mus musculus
ggcagauuuuccuguuugacuguauugugcuaucaacacaucaggagu

SEQ ID NO: 24301 - RNA, 46 nt, Mus musculus
ucucaacuuuugccuuccuuuccacuccauacuuucuuacccacag

SEQ ID NO: 24302 - RNA, 46 nt, Mus musculus
uaccuaucuuuauaaucuacuucaaaucaugaucucaucuuuuuag

SEQ ID NO: 24303 - RNA, 37 nt, Mus musculus
ucuuuucucaaccuaagaccaagccuucauaagccag

SEQ ID NO: 24304 - RNA, 46 nt, Mus musculus
aaaugguaaauccauauuaauuuuaaaaguuagagaaagcagucag

SEQ ID NO: 24305 - RNA, 42 nt, Mus musculus
aaugaguguaacugaagccuagaguaaggggggugagcccag

SEQ ID NO: 24306 - RNA, 45 nt, Mus musculus
gugugugugugugugugugugugagagagagagagagagacaaag

SEQ ID NO: 24307 - RNA, 41 nt, Mus musculus
agggagggagagagagagagagagggagggagaaagagaga

SEQ ID NO: 24308 - RNA, 43 nt, Mus musculus
cauucuggugacaaccuccagccucuuggugcacguguugaga

SEQ ID NO: 24309 - RNA, 68 nt, Mus musculus
gcagcuuaugaauuuucguaucauguccuacaaguacuaccccuggcuuauauagagaaugcugagug

SEQ ID NO: 24310 - RNA, 46 nt, Mus musculus
gaggcuaucagcaaauaaaaggcaagagagauaguaacccuggagc

SEQ ID NO: 24311 - RNA, 46 nt, Mus musculus
uuauaucagaguacauuggauucguuuuuauguuccuguuggguag

SEQ ID NO: 24312 - RNA, 46 nt, Mus musculus
acuggggagaguagaaaguccaugauauaacucucuuaaaggagau

SEQ ID NO: 24313 - RNA, 46 nt, Mus musculus
uagcagaaccacaacaccaccugcaguucacaggaucuggcaucag

SEQ ID NO: 24314 - RNA, 42 nt, Mus musculus
uaaguccuguaacguuacagagaaaacguaagaagguggcuu

SEQ ID NO: 24315 - RNA, 45 nt, Mus musculus
uagaguacaguuggaaugccaggaucauuuuuggugguagcacua

SEQ ID NO: 24316 - RNA, 42 nt, Mus musculus
aaaagaugauaggaaaaguuaggacugcuccaugaguggcac

SEQ ID NO: 24317 - RNA, 45 nt, Mus musculus
agacuugucuaaguguuuguagaaguuucauguaaaauagcccaa

SEQ ID NO: 24318 - RNA, 46 nt, Mus musculus
ccagcauggaugcuaguguucugggagaaguauagguaggugccag

SEQ ID NO: 24319 - RNA, 47 nt, Mus musculus
aguuucugagggcaacuguacugcuaccugaucuguguguaaggaca

SEQ ID NO: 24320 - RNA, 106 nt, Mus musculus
ugggcaacaacgcgaacucucuuuuagauagauuggguuugagguagguaccauacuauagacaucuaaauacauuuuguguagacugcugaaagacaaagccugg

SEQ ID NO: 24321 - RNA, 70 nt, Mus musculus
gguaucugccuuuaggaguuaauuaaagcagugggcauggaugagaucacuuaaagagaagcugcagaaa

SEQ ID NO: 24322 - RNA, 46 nt, Mus musculus
caucuggccuuguggguuuaguuaaggaggaccaacugaaaaggag

SEQ ID NO: 24323 - RNA, 50 nt, Mus musculus
ugucagcuagccaaaagcaauaaaguauuaggugcaggagcugugugaga

SEQ ID NO: 24324 - RNA, 42 nt, Mus musculus
auugguacaagaacuccuacuguugaauacaucugcacccaa

SEQ ID NO: 24325 - RNA, 55 nt, Mus musculus
aaugccuugaauuugaucaacccuaccaaaacaaaaaggcauagauagacaagaa

SEQ ID NO: 24326 - RNA, 47 nt, Mus musculus
auuucacuagaguauugggaaauguuugacuaccaaaaaacacaaca

SEQ ID NO: 24327 - RNA, 46 nt, Mus musculus
uaaguagcaacugugugcuaauaguuaacaacaguuuauuaggcag

SEQ ID NO: 24328 - RNA, 41 nt, Mus musculus
cuacagguguuuguggccaaccccaacaagacgcagcccau

SEQ ID NO: 24329 - RNA, 46 nt, Mus musculus
ugcuacaggaguucugaacauggcuggguucaugaaagcaaaugag

SEQ ID NO: 24330 - RNA, 45 nt, Mus musculus
aacuguauccagugugagcuuuggggaggauaaaguuggugugca

SEQ ID NO: 24331 - RNA, 46 nt, Mus musculus
uuuuaauuuuacuuuugaagguguuuuaaaacaguagagcuagcag

SEQ ID NO: 24332 - RNA, 46 nt, Mus musculus
cugggagagauggauggguuuaauguccuuuuccuuaaugcugcag

SEQ ID NO: 24333 - RNA, 46 nt, Mus musculus
cagcugugcuaagugacccaguccuugccaccgcguugugagucag

SEQ ID NO: 24334 - RNA, 42 nt, Mus musculus
uugggcuaacacagagagcggugcuagagucuugcuguggaa

SEQ ID NO: 24335 - RNA, 45 nt, Mus musculus
uauuugaaaaccagaguagagauugcguuuguuugaagccaucag

SEQ ID NO: 24336 - RNA, 46 nt, Mus musculus
accuaccucguuauuucugcuguucuucuccguucugaucaucuac

SEQ ID NO: 24337 - RNA, 45 nt, Mus musculus
acaugaucgcauggaaauaggguuaaacaucuauucuauggggag

SEQ ID NO: 24338 - RNA, 48 nt, Mus musculus
gugguggcucacaaccauccguaacgaaaucugaugcccucuucugaa

SEQ ID NO: 24339 - RNA, 42 nt, Mus musculus
uugaaauacuguaaaauaaucugugugaaguauucgaaacag

SEQ ID NO: 24340 - RNA, 46 nt, Mus musculus
aggcagaggcaggccugaucuacaaagugagauucaagacagccag

SEQ ID NO: 24341 - RNA, 46 nt, Mus musculus
guuuauuuaauguaugugaguacacuguaauugucuucagacucac

SEQ ID NO: 24342 - RNA, 46 nt, Mus musculus
guagcaaagcuuuauuuuauuaguuguuaaguauuugcagauugag

SEQ ID NO: 24343 - RNA, 46 nt, Mus musculus
guccauucuuuugcuagcguguucgcaugugcuuuuaaucccaguu

SEQ ID NO: 24344 - RNA, 42 nt, Mus musculus
ccccaguuuccccgggcagcgaggguggcgggagaugcggag

SEQ ID NO: 24345 - RNA, 46 nt, Mus musculus
gcagccuguaugcaacgucucucuagccuugggguuucacuagcag

SEQ ID NO: 24346 - RNA, 42 nt, Mus musculus
gccagggcccugaggcugguucuuacccggacuccggagcua

SEQ ID NO: 24347 - RNA, 42 nt, Mus musculus
gacucaacagaagcgagccuuucuugcucuaauugggaaguc

SEQ ID NO: 24348 - RNA, 48 nt, Mus musculus
uugaccaggggucacacugcgcuggaaaacggugacagccacaaggag

SEQ ID NO: 24349 - RNA, 46 nt, Mus musculus
ccacgccggggccagccaaaacuggaaaucuggucaaccccaacag

SEQ ID NO: 24350 - RNA, 46 nt, Mus musculus
cuggugguugucaagucggucaucacacagcaugaccgccgagagg

SEQ ID NO: 24351 - RNA, 45 nt, Mus musculus
aaaggugaugaugaugucuuugucaaccccaccaaccugcucgag

SEQ ID NO: 24352 - RNA, 46 nt, Mus musculus
caggcaugguggaguugccgagcuaagcugccagacaugaggaaac

SEQ ID NO: 24353 - RNA, 46 nt, Mus musculus
ucagguaccugagcuagaccuggccccaaugggucuguggcugcuu

SEQ ID NO: 24354 - RNA, 46 nt, Mus musculus
agguccagcaaugugggccaggggacaccuguggaccugcacaggc

SEQ ID NO: 24355 - RNA, 88 nt, Mus musculus
ggagcacugcuauuuugcucugugucaggggcauaagguggggcacuagcccacacugagguuuagaggagugcugagguagucagag

SEQ ID NO: 24356 - RNA, 46 nt, Mus musculus
uccucuaaaccucagugugggcuagugccccaccuuaugccccuga

SEQ ID NO: 24357 - RNA, 42 nt, Mus musculus
aauacugacucccuggccagaaacuggccggaugggcccuag

SEQ ID NO: 24358 - RNA, 45 nt, Mus musculus
aguccuuucuuuaaaaugaagagggaaagaaugggauggaaggaa

SEQ ID NO: 24359 - RNA, 42 nt, Mus musculus
uuccgucaauuucuccaucuuccauggccuccuuggcagcuu

SEQ ID NO: 24360 - RNA, 46 nt, Mus musculus
cucucuugccuuugaccuuucucuccaguauaguagagugaaacag

SEQ ID NO: 24361 - RNA, 46 nt, Mus musculus
agugauguugaaagagagguuuuuggcuagaaguguucuugcagcu

SEQ ID NO: 24362 - RNA, 46 nt, Mus musculus
uagaucacccuuaucuuccauaaaaccaaguccaaaggcuggagag

SEQ ID NO: 24363 - RNA, 41 nt, Mus musculus
aucccagcaaccacaugguggcucaccaccacccauaauga

SEQ ID NO: 24364 - RNA, 41 nt, Mus musculus
ucuuccucaucauccucauccucgucaucuucauccucuuc

SEQ ID NO: 24365 - RNA, 47 nt, Mus musculus
cuucauccucaucaucuuccucauccucugaggcaggagcagcagga

SEQ ID NO: 24366 - RNA, 49 nt, Mus musculus
uuccuucuuggcauucuuaccguucuuagcccccuuagcuggaguggca

SEQ ID NO: 24367 - RNA, 46 nt, Mus musculus
aauguuuuucuuagcugguguggcuacugccuuuuugccugggguc

SEQ ID NO: 24368 - RNA, 66 nt, Mus musculus
uuucuucaucuucacuauccucuuccaccuccuuuggaggaggagccauuuucuuggccucaccgu

SEQ ID NO: 24369 - RNA, 45 nt, Mus musculus
agggguccaccacguguccaucccggucaccggcagagacagcag

SEQ ID NO: 24370 - RNA, 47 nt, Mus musculus
uucaccaugguggcggauuacggcggcggcgcguguggagagcgagc

SEQ ID NO: 24371 - RNA, 44 nt, Mus musculus
ccacuggcauugaguuaacuuggccaguuacagagcuaauagga

SEQ ID NO: 24372 - RNA, 45 nt, Mus musculus
ccuucaaagaacuggaauuauuggcuugaaccaccauacccccac

SEQ ID NO: 24373 - RNA, 46 nt, Mus musculus
agucucccugaggcagccaaagaguccucaccugauaauggagcag

SEQ ID NO: 24374 - RNA, 45 nt, Mus musculus
acgugugcagauggacucuaggcuacucuuguggaaaacaggcag

SEQ ID NO: 24375 - RNA, 45 nt, Mus musculus
ccucggagaaggcucguuguauaacagccugaguuugauucuugg

SEQ ID NO: 24376 - RNA, 42 nt, Mus musculus
ggugcagggagccaaggcggggcgcuccacgggggcgcagac

SEQ ID NO: 24377 - RNA, 42 nt, Mus musculus
agguguaccaaguacgcgguaaacugaggcagauagcaucag

SEQ ID NO: 24378 - RNA, 46 nt, Mus musculus
gucuaugucauacagcagcuacuggcuguugaaaagcagccaagau

SEQ ID NO: 24379 - RNA, 46 nt, Mus musculus
cagcgagcgcggagcacgacccaggaacaaugcaaagauggcuuuu

SEQ ID NO: 24380 - RNA, 54 nt, Mus musculus
guauccacugccgcgucugacaugguggggcacgccggugguccgaugccgcga

SEQ ID NO: 24381 - RNA, 45 nt, Mus musculus
cggggccugcuucucuacucgaaggugaccacguuuaaauucuga

SEQ ID NO: 24382 - RNA, 43 nt, Mus musculus
ccucccauguugccaauucauguuguaguuuuggagggguggu

SEQ ID NO: 24383 - RNA, 46 nt, Mus musculus
agaccuguaugcagagcacucugcaaagacaucagugcgccaagac

SEQ ID NO: 24384 - RNA, 44 nt, Mus musculus
ucucucacuucccaaauccaccuuagcucuggaccauccccaga

SEQ ID NO: 24385 - RNA, 41 nt, Mus musculus
aggacaucuacugggcaucuguucugcacuuccaccgugag

SEQ ID NO: 24386 - RNA, 42 nt, Mus musculus
auccugucacccauguagcugugcuaugcaggggccccagcu

SEQ ID NO: 24387 - RNA, 46 nt, Mus musculus
ccccagaacaauagauuaguuaacugauuugaaauguagagcagag

SEQ ID NO: 24388 - RNA, 47 nt, Mus musculus
uuggggggaaacaugugacuaccacagcuuacaugugacagccagag

SEQ ID NO: 24389 - RNA, 46 nt, Mus musculus
gaucucauuacggaugguugcugggauuugaacuucggaccuucag

SEQ ID NO: 24390 - RNA, 46 nt, Mus musculus
uggcuuccucacaugcagcauaacacucacauauaaacgcacagaa

SEQ ID NO: 24391 - RNA, 42 nt, Mus musculus
acucauguuaaaccaaaaaauauuuaaaugaccgggcguggu

SEQ ID NO: 24392 - RNA, 46 nt, Mus musculus
cacaaacaucacuuauuaagugaaguuuccuuucuuguccccaaga

SEQ ID NO: 24393 - RNA, 33 nt, Mus musculus
agagagagagagaaagaggggaggaaggaagaa

SEQ ID NO: 24394 - RNA, 46 nt, Mus musculus
aagccgggcggugguggcacaccuuugaucccagcacuugggaggc

SEQ ID NO: 24395 - RNA, 123 nt, Mus musculus
guaaaguuuuaauaucucaaaacuuaguuuucucauccagaauguaaagguagagguaauaagacccagcagaguucuguuuuuguaauucagcuaaugcaacauuugagacagcaucuguua

SEQ ID NO: 24396 - RNA, 69 nt, Mus musculus
gccuauuaggauugucugaugcugauucauagaaacccuaggacacuuucaaucuuaaaaauaaaucag

SEQ ID NO: 24397 - RNA, 42 nt, Mus musculus
guaucuguacauuguaguauaguacauugucugcacccagcu

SEQ ID NO: 24398 - RNA, 46 nt, Mus musculus
ggacauacagggcuacacaaagaaacccugucuuaaaaagccagga

SEQ ID NO: 24399 - RNA, 42 nt, Mus musculus
cuagugguuuaugcccguaauccaagcacuugggagguagag

SEQ ID NO: 24400 - RNA, 42 nt, Mus musculus
aggaacucugaaaguuuuucauaaguggggcuggggccugga

SEQ ID NO: 24401 - RNA, 45 nt, Mus musculus
ucuucuaucuggaagugcugggauacaagcaaggcaaagcuaguc

SEQ ID NO: 24402 - RNA, 44 nt, Mus musculus
uagaauuuacguucaccuuaguuucuaaccauagccaagcaauu

SEQ ID NO: 24403 - RNA, 46 nt, Mus musculus
cgguggacuugguguugaaugccugugaucccaguacuugggagau

SEQ ID NO: 24404 - RNA, 46 nt, Mus musculus
guuuugaaccgacucccggcaaaauuaucuuuggcauugcugaggu

SEQ ID NO: 24405 - RNA, 45 nt, Mus musculus
gggaccgcgaacgggaggcaggcacaggggcacccugagggagaa

SEQ ID NO: 24406 - RNA, 45 nt, Mus musculus
gguaagacugcaaaccaccaacaaaaccacauauuaagccacgag

SEQ ID NO: 24407 - RNA, 46 nt, Mus musculus
aaauagagacccggugaggcagagacuggccagagagcacagcaaa

SEQ ID NO: 24408 - RNA, 42 nt, Mus musculus
aaauggguggagugggaacaagaacaggaaagaaggccagag

SEQ ID NO: 24409 - RNA, 59 nt, Mus musculus
caaccaucuguaaugaaauccaaugcccucuucugguaugucugaagacauugacagug

SEQ ID NO: 24410 - RNA, 46 nt, Mus musculus
gcucagugguuaagagcacugacuauucuuccaaagguccugaguu

SEQ ID NO: 24411 - RNA, 96 nt, Mus musculus
aggagagaagauuaaguuagaaaaggaggaacaaagccggguccccaccccaagcagacacaacuaaaaagaauagaugugacucucagucaagau

SEQ ID NO: 24412 - RNA, 49 nt, Mus musculus
gcugaagaauggaagaaggagggagaggaagagaaggaagagaaggagg

SEQ ID NO: 24413 - RNA, 46 nt, Mus musculus
agcaguucauuuuauuagccaaagguaccaguggcucagcccucac

SEQ ID NO: 24414 - RNA, 42 nt, Mus musculus
ggcugugugcuucaccacugucuacugaucuaggcccaggua

SEQ ID NO: 24415 - RNA, 46 nt, Mus musculus
uacuccagcuaacucuguaguuaucugugugaaaaguaggggcugg

SEQ ID NO: 24416 - RNA, 52 nt, Mus musculus
caguuugcucagaugugauugauaguaggugccaauauauauuaaguuuggg

SEQ ID NO: 24417 - RNA, 51 nt, Mus musculus
gaguacagcuaugguagcacauaacuauaagacgagaaacuggaaggcaga

SEQ ID NO: 24418 - RNA, 45 nt, Mus musculus
uuuuccacuuccggguacccgaguacgugacguuucuuugcccug

SEQ ID NO: 24419 - RNA, 24 nt, Mus musculus
auaggcaauaguugaaguuaaaca

SEQ ID NO: 24420 - RNA, 87 nt, Mus musculus
ugugcgugcgugugugugcgugcgugugugugugugugcgugcgcuugugugugugugugugcgcgcgugcgugugcgugugugugc

SEQ ID NO: 24421 - RNA, 62 nt, Mus musculus
ggcagaggcagaggcagagaggcagagagaggcagagaggcggagagagagaggcagaggca

SEQ ID NO: 24422 - RNA, 46 nt, Mus musculus
ucugccucucugccucuuucucugccucugccucucugccucucug

SEQ ID NO: 24423 - RNA, 45 nt, Mus musculus
agagaggcagagaggcagaggcagagaaagaggcagagaggcaga

SEQ ID NO: 24424 - RNA, 46 nt, Mus musculus
agcacaugcuaagcuauuucucuuuccuguggaagggggguucugc

SEQ ID NO: 24425 - RNA, 46 nt, Mus musculus
cuauccacaguguauccccuacucugugcugcugaaagaccuggag

SEQ ID NO: 24426 - RNA, 45 nt, Mus musculus
cagcuccuggaaguggauuucugcauuggccgugacauccggaag

SEQ ID NO: 24427 - RNA, 45 nt, Mus musculus
uaagugauuuggagauuaugaaaccagagcauuuuugggaagugu

SEQ ID NO: 24428 - RNA, 46 nt, Mus musculus
caaugguaccaauggauggggagguacuggugaggggugggcagau

SEQ ID NO: 24429 - RNA, 42 nt, Mus musculus
agcuacccacugggauugucugccaacaauugcucucccaag

SEQ ID NO: 24430 - RNA, 45 nt, Mus musculus
gcaccaccacuccuaccccaggggcagccaggaggcaugaaagau

SEQ ID NO: 24431 - RNA, 26 nt, Mus musculus
agcagagagagaaaaggcaggcaagu

SEQ ID NO: 24432 - RNA, 41 nt, Mus musculus
gagccgggcgugguggcacacaccuuuagucccagcacuca

SEQ ID NO: 24433 - RNA, 42 nt, Mus musculus
ccgcuggcuauguuguugcugcugcugcugcuacugucccca

SEQ ID NO: 24434 - RNA, 25 nt, Mus musculus
ugccaaacuugagacacagcaggga

SEQ ID NO: 24435 - RNA, 47 nt, Mus musculus
aagccuggggucuacacccgugugaccguguucaaagacuggcugca

SEQ ID NO: 24436 - RNA, 49 nt, Mus musculus
gagugggggugagggugagcuggaauaacagguggcuaugaagauggga

SEQ ID NO: 24437 - RNA, 46 nt, Mus musculus
uaugagaggagggugguauuaggaggaaaggcugaagggaggagag

SEQ ID NO: 24438 - RNA, 45 nt, Mus musculus
cugugaagcuggugaugugcuucacacagauagugugguuuucag

SEQ ID NO: 24439 - RNA, 46 nt, Mus musculus
cgcaggcuguguuucucugaaacaagagggaaguguuagcccguag

SEQ ID NO: 24440 - RNA, 46 nt, Mus musculus
gauuugagcuagagccaauugaauacuggauaguucuucaauuuag

SEQ ID NO: 24441 - RNA, 44 nt, Mus musculus
gucaucuggugaagccaggaacuauaggccagugugccaggagg

SEQ ID NO: 24442 - RNA, 44 nt, Mus musculus
auacagugcugggguuacugucccaguuugaagccacauucugg

SEQ ID NO: 24443 - RNA, 46 nt, Mus musculus
cuucuucauuaggacacaauauacaugcagucagcucuguacagau

SEQ ID NO: 24444 - RNA, 45 nt, Mus musculus
cccggcucagccucggguucacugucggacgacuccucaggcggc

SEQ ID NO: 24445 - RNA, 41 nt, Mus musculus
cucggcaagaaaccauacgcaguuuucaagaggaaccagaa

SEQ ID NO: 24446 - RNA, 42 nt, Mus musculus
cuuucuucuuucuccaugucuugcggcgguggggcggcaggc

SEQ ID NO: 24447 - RNA, 46 nt, Mus musculus
gugacagcuacuuugguggaacuuggacggacugccuuuaaucaag

SEQ ID NO: 24448 - RNA, 42 nt, Mus musculus
uccggagaagaaagccauggaaauugcugaggcuuugggcag

SEQ ID NO: 24449 - RNA, 46 nt, Mus musculus
aucgaaucuugcaaagaacacaauucuugucaaauggcuaccccaa

SEQ ID NO: 24450 - RNA, 46 nt, Mus musculus
aaaaaaaaaagaaaaaaagaaaaagaaaaagaaaaaagaaaaaaaa

SEQ ID NO: 24451 - RNA, 57 nt, Mus musculus
uguugacaguggucuucauugucuuuaaauguugugccuauggcugccggaaaugcu

SEQ ID NO: 24452 - RNA, 46 nt, Mus musculus
acacaaauccaagacccauugagaaguggggggaagugaaggagaa

SEQ ID NO: 24453 - RNA, 33 nt, Mus musculus
ggaguagcugggccuagagagaacaauugaaug

SEQ ID NO: 24454 - RNA, 41 nt, Mus musculus
guagcaagauuucguuggcucuggagcugaaggcaggccca

SEQ ID NO: 24455 - RNA, 65 nt, Mus musculus
auucccguagucucuuaauauuccggccucuuucccgggcucugagcaggacgcaggccccuucc

SEQ ID NO: 24456 - RNA, 45 nt, Mus musculus
ugguugauguaggucuugguggagaugaugcaggauggcuuugag

SEQ ID NO: 24457 - RNA, 48 nt, Mus musculus
uagccacaauggccauaucagcugggcaaggguaugagggacccuggc

SEQ ID NO: 24458 - RNA, 43 nt, Mus musculus
cuggaaucugacugcaaaggacugaauggaagaagccggggag

SEQ ID NO: 24459 - RNA, 42 nt, Mus musculus
cucccucuaggacauucccugagaguccccaagcugguccag

SEQ ID NO: 24460 - RNA, 42 nt, Mus musculus
aacacuucucaguuuaucuucacacaggagggguaagggcag

SEQ ID NO: 24461 - RNA, 42 nt, Mus musculus
agcguucagagcaauccaggcauuggcagcgccgucagucag

SEQ ID NO: 24462 - RNA, 46 nt, Mus musculus
acguggcucucugcccggcacugcacccgcccaagcccguccacag

SEQ ID NO: 24463 - RNA, 46 nt, Mus musculus
uuuucgguccuuucucuaacuccucuauuggggaccccgcgcucag

SEQ ID NO: 24464 - RNA, 46 nt, Mus musculus
uagacuugagaugggauuccaaccaaaggaauguaacuggguaaug

SEQ ID NO: 24465 - RNA, 45 nt, Mus musculus
caugcaggcaaauacacauacacacaaaauagauaaguccaauga

SEQ ID NO: 24466 - RNA, 46 nt, Mus musculus
augcucacaguucuucuccccaggugguauaguuccacucagaagu

SEQ ID NO: 24467 - RNA, 42 nt, Mus musculus
cauagucuaggauaaaaugaaguuuauuuaggggcaugggaa

SEQ ID NO: 24468 - RNA, 45 nt, Mus musculus
guguaaagucuauccccacaaaaugugaaaaccuagggccacaaa

SEQ ID NO: 24469 - RNA, 43 nt, Mus musculus
aaucacagguucaccaaacaauaaggagcauggaaagggcccu

SEQ ID NO: 24470 - RNA, 46 nt, Mus musculus
uguaaaauuagacccauagaacacuuuguauuuaaaaggaauugag

SEQ ID NO: 24471 - RNA, 42 nt, Mus musculus
aacaaaccacauggguuuaagaaguuguuaaacuggccaguc

SEQ ID NO: 24472 - RNA, 41 nt, Mus musculus
gcuguacuaaucuaaggguauaaagauuaauucagggggca

SEQ ID NO: 24473 - RNA, 53 nt, Mus musculus
agaacauguguuuuuggcuuaguuagcaacaccagacauagagugcgucuugu

SEQ ID NO: 24474 - RNA, 46 nt, Mus musculus
uaaacaaucucagucuugugaauaauaaaaaaaaaggcaaggaaaa

SEQ ID NO: 24475 - RNA, 46 nt, Mus musculus
cacuuuccagaugaaacaaaaccaccacuguacucugucgccuuca

SEQ ID NO: 24476 - RNA, 42 nt, Mus musculus
gagagcuucucucuggagagcgauguggauuacagcucagau

SEQ ID NO: 24477 - RNA, 45 nt, Mus musculus
gcuuucagucggggcuguccgagggcaagggaaagacgagucaaa

SEQ ID NO: 24478 - RNA, 45 nt, Mus musculus
aauaaucacagcgugugugugugugugugugugugugugugugug

SEQ ID NO: 24479 - RNA, 45 nt, Mus musculus
cggcagcaccaccggccgguagggcaugaacaugggguagccggu

SEQ ID NO: 24480 - RNA, 57 nt, Mus musculus
gacggcgggaacgcugcgcucauagacgcguucgggagaagccagggagagacgaaa

SEQ ID NO: 24481 - RNA, 42 nt, Mus musculus
cagacggacggacgcacgcacugcugguagcugggccgagac

SEQ ID NO: 24482 - RNA, 46 nt, Mus musculus
cccuguucucgacaaugguaaaaagccgggaauuuggggguuagga

SEQ ID NO: 24483 - RNA, 46 nt, Mus musculus
agcaaaggagggcauuguuauauaggucauuaaaaaaucaguucac

SEQ ID NO: 24484 - RNA, 46 nt, Mus musculus
ucuuuaucucccaauuaaaugugcuugugauacauaacacacgucc

SEQ ID NO: 24485 - RNA, 46 nt, Mus musculus
ucauguuggacguguguuauguaucacaagcacauuuaauugggag

SEQ ID NO: 24486 - RNA, 24 nt, Mus musculus
gggaggggaggggacacugguggg

SEQ ID NO: 24487 - RNA, 46 nt, Mus musculus
gccucacgguucugcaaaggugacagucagacucuccugcuucagu

SEQ ID NO: 24488 - RNA, 46 nt, Mus musculus
uggguguuauccaggacauuuuaugaagaguagcgaaccuuagaag

SEQ ID NO: 24489 - RNA, 45 nt, Mus musculus
gugcugucugugugcagauaauugacaaagucauugacagacaag

SEQ ID NO: 24490 - RNA, 87 nt, Mus musculus
uugugugagugguguguguguguggugugugugucucugugugugugucucugugugugucuguguauuugugugugugugugugug

SEQ ID NO: 24491 - RNA, 41 nt, Mus musculus
cucaggggaagcagaggauccggagaggauccagguuggca

SEQ ID NO: 24492 - RNA, 45 nt, Mus musculus
gcucacaugcaagaucacacaccucauuuucuccaucaaccucuu

SEQ ID NO: 24493 - RNA, 25 nt, Mus musculus
agcuggcagcaggcagggcugugcu

SEQ ID NO: 24494 - RNA, 45 nt, Mus musculus
gggugaguaucuugggaaagagagacauuuccuugucucuuggga

SEQ ID NO: 24495 - RNA, 46 nt, Mus musculus
uguuugggcaguguguuuccacauuuuuaguauuuuuuuucaagau

SEQ ID NO: 24496 - RNA, 46 nt, Mus musculus
uagucuucugucuuaagcuuacuuaagcuuuuaagauaacggccag

SEQ ID NO: 24497 - RNA, 45 nt, Mus musculus
uaagucauguugcguucaggcuguccuuggagcguguacugauaa

SEQ ID NO: 24498 - RNA, 42 nt, Mus musculus
uaaguuagugggcugguccuucucagcaugguaaggacaugg

SEQ ID NO: 24499 - RNA, 46 nt, Mus musculus
cgcgccuuugcccuggucucucaagcuuauaccuccaucaucgcag

SEQ ID NO: 24500 - RNA, 42 nt, Mus musculus
aggccgacuccaccacaagaaugguucuucccaggaagccag

SEQ ID NO: 24501 - RNA, 42 nt, Mus musculus
aguuccgccaauccccaaugagcagcagcucgcccggcucac

SEQ ID NO: 24502 - RNA, 46 nt, Mus musculus
cgcauuguacaguuuucuccucaggcacuuuugaauguccuuggag

SEQ ID NO: 24503 - RNA, 46 nt, Mus musculus
uugaagauuugaggugguuaauguaucuucagguuaaaacggcccu

SEQ ID NO: 24504 - RNA, 46 nt, Mus musculus
ucaaagaaagucauaaucgagaaucucuuuggugguccucuaaggc

SEQ ID NO: 24505 - RNA, 53 nt, Mus musculus
ugguucauuccucuguaguugcacggcuuagauggagaaacaagagucuaacc

SEQ ID NO: 24506 - RNA, 45 nt, Mus musculus
gguguuuaugugaacauuccuauaaauucaauuucccucuggagu

SEQ ID NO: 24507 - RNA, 44 nt, Mus musculus
uagcuauaacccaaggguccaaguauacgguagaacugccugga

SEQ ID NO: 24508 - RNA, 41 nt, Mus musculus
uaaaugugucuauggacccugcucuccgucuccaggcaguu

SEQ ID NO: 24509 - RNA, 86 nt, Mus musculus
agccuaagcauggccuucaggcaacacguaccucugggagaaggaggaggcagccauuucuaacucguuucuauagaagcccuggg

SEQ ID NO: 24510 - RNA, 45 nt, Mus musculus
uugucaaacuguuaacucuggguauggagagcauugaguguggag

SEQ ID NO: 24511 - RNA, 82 nt, Mus musculus
aaguuacuauggcacuaugaccuagagagcaaaaguugcaagagauucugguauggagguuguggaggcaacgagaacagau

SEQ ID NO: 24512 - RNA, 24 nt, Mus musculus
aaggcaagguguggaugcuguugg

SEQ ID NO: 24513 - RNA, 45 nt, Mus musculus
aaacuggaaaagugaaguaggugggugaagugagaguugguuggg

SEQ ID NO: 24514 - RNA, 96 nt, Mus musculus
uucugcuaaguuggugccuccucagccaguccauguucagccagccccugcccagacagcuucuguaagaccagcccccgcuaagccagccccucc

SEQ ID NO: 24515 - RNA, 43 nt, Mus musculus
acuggcugagcaggggcuggccucgcuggggcuggcuuagcag

SEQ ID NO: 24516 - RNA, 66 nt, Mus musculus
agccagugacaacgaccaaaccaacagcaauuguaaaccugccaccugcuaagccagccccagcga

SEQ ID NO: 24517 - RNA, 50 nt, Mus musculus
gguuuggucguugucacuggcuucauuguggucacaacuuuggauguaag

SEQ ID NO: 24518 - RNA, 45 nt, Mus musculus
cugggagacagacagacagacagacagacagacagacagaccacc

SEQ ID NO: 24519 - RNA, 84 nt, Mus musculus
ugaaaaugcauuuuaccugccuccagaucucaggaaacagugugauugguuccaaggggaccaaccagugaagaauggcgugaa

SEQ ID NO: 24520 - RNA, 46 nt, Mus musculus
ucuucacugguugguccccuuggaaccaaucacacuguuuccugag

SEQ ID NO: 24521 - RNA, 41 nt, Mus musculus
auaacuacuuggaugauucauuuaaagguaacauguccuca

SEQ ID NO: 24522 - RNA, 42 nt, Mus musculus
augcgcuuugggaggcugcucccauccuuugucagcaguaag

SEQ ID NO: 24523 - RNA, 46 nt, Mus musculus
caaagcuguagaccuccuugauauucaccuuccugccaaugcccag

SEQ ID NO: 24524 - RNA, 46 nt, Mus musculus
uuugugguucugggcauuggcaggaaggugaauaucaaggaggucu

SEQ ID NO: 24525 - RNA, 42 nt, Mus musculus
acaucagcaccauaauuuugaggucccguggguuuggagcac

SEQ ID NO: 24526 - RNA, 81 nt, Mus musculus
aauacacuauagagaacaucuuugaaagugcuccaaacccacgggaccucaaaauuauggugcugauguugacuggugaca

SEQ ID NO: 24527 - RNA, 88 nt, Mus musculus
gacuauggugccaaggaaaagcuguuggauuuccuuagccggaggaugacccaacuucagggaaccaugggccugggcaaugccauug

SEQ ID NO: 24528 - RNA, 55 nt, Mus musculus
ggcuuucaucuuggacagcucagaggcuaccacacuguuccaguucaaugagaug

SEQ ID NO: 24529 - RNA, 75 nt, Mus musculus
auccuguggcuucggcagcuggaggccuuccuucagggaccggagggcagcaggcagugauguggacauagaccu

SEQ ID NO: 24530 - RNA, 83 nt, Mus musculus
acacagcagugggacaugcccugguucugccugcaaggagggaucucacagacuuccugaagaauguccuuaccugccauguu

SEQ ID NO: 24531 - RNA, 45 nt, Mus musculus
uccuuacaagccaggaggaccgacagcucaucaacgcuuugcagg

SEQ ID NO: 24532 - RNA, 46 nt, Mus musculus
cacguuugaauguauuccuggccacgaaugacauugcggucuccag

SEQ ID NO: 24533 - RNA, 68 nt, Mus musculus
cagaaccuccaaguggccuugaccucuaagcagcagagccuggagaccgcaaugucauucguggccag

SEQ ID NO: 24534 - RNA, 46 nt, Mus musculus
cagccacgcgggcaccccgcggacaguugcucucugcaauggucag

SEQ ID NO: 24535 - RNA, 94 nt, Mus musculus
gagggggugacucaggacaccuucagccggaugcgagaggugcuucugggcauugugggcgaucugaccauugcagagagcaacuguccgcggg

SEQ ID NO: 24536 - RNA, 46 nt, Mus musculus
cggccuguacaaugaguguguguucagaauuauaauaaggggcugg

SEQ ID NO: 24537 - RNA, 41 nt, Mus musculus
aaauucaggaccuccaggggcaacuggacaaaagggagacc

SEQ ID NO: 24538 - RNA, 30 nt, Mus musculus
auuauuguuauuaacuauauuucuggcuga

SEQ ID NO: 24539 - RNA, 47 nt, Mus musculus
ccuggugagccaggggcagauggaccaccaggacccaaaggcaucag

SEQ ID NO: 24540 - RNA, 47 nt, Mus musculus
agaugacgggagagaugggguuggcagugaaggacgcagaggcaaaa

SEQ ID NO: 24541 - RNA, 45 nt, Mus musculus
gccgaagggaagcaucgggaaccguggaccccgaggagagacggu

SEQ ID NO: 24542 - RNA, 42 nt, Mus musculus
accaggcuggccucaaacuuaaaguaauccuccugccccaag

SEQ ID NO: 24543 - RNA, 45 nt, Mus musculus
gcggagguacggcuggggcuccuggagaacguggcagaacugguc

SEQ ID NO: 24544 - RNA, 43 nt, Mus musculus
gucccccaggccugauuggggaacaaggaauucccggaccucg

SEQ ID NO: 24545 - RNA, 46 nt, Mus musculus
ccgggaauuccuuguuccccaaucaggccugggggaccaaugggac

SEQ ID NO: 24546 - RNA, 24 nt, Mus musculus
cagcugggguggggcaauaggaau

SEQ ID NO: 24547 - RNA, 73 nt, Mus musculus
uuucagggugacucaggacgggacagccagcagagaggacccaaaggagagacgggagacaucggccccaugg

SEQ ID NO: 24548 - RNA, 44 nt, Mus musculus
ggugacaaaggacccaaaggagacaaaggcgagagaggagaugu

SEQ ID NO: 24549 - RNA, 49 nt, Mus musculus
aaggggcugccugguucuucuggagaaaaggggaguccuggaagaaggg

SEQ ID NO: 24550 - RNA, 44 nt, Mus musculus
ccuucuuccaggacuccccuuuucuccagaagaaccaggcagcc

SEQ ID NO: 24551 - RNA, 45 nt, Mus musculus
ggugaauugggagaaaucggcuuggauggucuggauggugaagag

SEQ ID NO: 24552 - RNA, 46 nt, Mus musculus
guucaccucuaggcaaauucacuuaauaacacaccagcuggcagug

SEQ ID NO: 24553 - RNA, 44 nt, Mus musculus
gaauggcacacaagguuuccagggcuguccaggccagaggggag

SEQ ID NO: 24554 - RNA, 45 nt, Mus musculus
uggaaaccuugugugccauucacaccagguggaccucgcucaccc

SEQ ID NO: 24555 - RNA, 44 nt, Mus musculus
aggguaucuccggggaagauggcuaccgaggcuacccgggagac

SEQ ID NO: 24556 - RNA, 46 nt, Mus musculus
uccgccuucgucucccggguagccucgguagccaucuuccccggag

SEQ ID NO: 24557 - RNA, 44 nt, Mus musculus
ugggcccucugucuccccucucuccagagcacuugcauggaacc

SEQ ID NO: 24558 - RNA, 47 nt, Mus musculus
cugagaaagcuugcugugggguuccaugcaagugcucuggagagagg

SEQ ID NO: 24559 - RNA, 43 nt, Mus musculus
acacacacacacagagagagagagagagagagagaguuugaaa

SEQ ID NO: 24560 - RNA, 27 nt, Mus musculus
ugacuuagacuaugaacuggcagagca

SEQ ID NO: 24561 - RNA, 35 nt, Mus musculus
gcagguugagccucaggggccugucauacaugaag

SEQ ID NO: 24562 - RNA, 29 nt, Mus musculus
augccccagguuccguuccaagcacccac

SEQ ID NO: 24563 - RNA, 45 nt, Mus musculus
auguauuugugcuauaugaugaguguauauguuucguggggggca

SEQ ID NO: 24564 - RNA, 45 nt, Mus musculus
uugccgaguaucagccggagcuguuugagaaguuucgcaacaugc

SEQ ID NO: 24565 - RNA, 85 nt, Mus musculus
auucugggguuugauggaucucgagaucagaauguguuugugagucagaagggccuugaguccaagguggacaucaucuugaaca

SEQ ID NO: 24566 - RNA, 45 nt, Mus musculus
gauccaucaaaccccagaaugacuuccagauugcaggcuagugaa

SEQ ID NO: 24567 - RNA, 46 nt, Mus musculus
ccuuccgggugggcagcgugcaggaacuguccgaacugagugagac

SEQ ID NO: 24568 - RNA, 89 nt, Mus musculus
cuggaugagcggguuccucagaucgccuucgugaucaccggagggaagucaguggaggaugcucaggaugugagccuggcucucaccca

SEQ ID NO: 24569 - RNA, 113 nt, Mus musculus
ugggacugguccaguacaacucagaccccacggaugaauucuuccugagggacuuuucuaccaaaaggcagauuaucgaugccaucaacaaagucgucuauaaaggagggagg

SEQ ID NO: 24570 - RNA, 113 nt, Mus musculus
uguguuccugcuggaugguuccaucaauuuuaggagggacaguuuccaggaagugcuccguuuugcaucugaaaucguggacacggucuaugaagacggagauuccaucagag

SEQ ID NO: 24571 - RNA, 45 nt, Mus musculus
uccuuuggacccucuggggcuacuccucagccuccugggguagau

SEQ ID NO: 24572 - RNA, 44 nt, Mus musculus
caagucauaagcucaucggggauugugagcuuaggaauaggaga

SEQ ID NO: 24573 - RNA, 45 nt, Mus musculus
ccuauuccuaagcucacaauccccgaugagcuuaugacuugggca

SEQ ID NO: 24574 - RNA, 46 nt, Mus musculus
augaugucuucccugaguucuaccugaagacccacaagucccagag

SEQ ID NO: 24575 - RNA, 45 nt, Mus musculus
acuuugucagcaggaucguucgcagacucaacauuggucccagua

SEQ ID NO: 24576 - RNA, 45 nt, Mus musculus
ugaagggggauaucggguacuggccaggaucugauggaucugcug

SEQ ID NO: 24577 - RNA, 50 nt, Mus musculus
gaagcugcugacgcccaucaccacucuaaccucacagcagauccaucaga

SEQ ID NO: 24578 - RNA, 45 nt, Mus musculus
ccagcuccucuuggucugugugucuggcuauggugagaggggcca

SEQ ID NO: 24579 - RNA, 47 nt, Mus musculus
aagcaguucgguguggccccucucaccauagccagacacacagacca

SEQ ID NO: 24580 - RNA, 46 nt, Mus musculus
guacgugcugaagaacaucuuccagaggccacuggggagccggaua

SEQ ID NO: 24581 - RNA, 42 nt, Mus musculus
guggucuuucucaucgauggaucccgaaaugcuggcccugag

SEQ ID NO: 24582 - RNA, 42 nt, Mus musculus
caaggcacggggagaugaggguggagggagcuugaugggaag

SEQ ID NO: 24583 - RNA, 46 nt, Mus musculus
acgauacagcaggucaucucugagagggugauccagcuuaaucgug

SEQ ID NO: 24584 - RNA, 49 nt, Mus musculus
gcccauuggcauuggcauugggaaugcugacaucucugaaaugcagacc

SEQ ID NO: 24585 - RNA, 46 nt, Mus musculus
agcagaagguguuccucagcuccugauuguccucacagcagagcca

SEQ ID NO: 24586 - RNA, 46 nt, Mus musculus
aaggaugugguguuucucauugauggcucugaggguguccgcagug

SEQ ID NO: 24587 - RNA, 46 nt, Mus musculus
ugcugucgccugcauucauccuggcugcagagucacucccuaagau

SEQ ID NO: 24588 - RNA, 85 nt, Mus musculus
agaugaaagguaccacuccucucugcuucagggagcuugcaggcccggccacagcaucugacgaccuuccagcaaccagcagcac

SEQ ID NO: 24589 - RNA, 90 nt, Mus musculus
ugguugcuggaaggucgucagaugcuguggccgggccugcaagcucccugaagcagagaggagugguaccuuucaucuuucaagccaaga

SEQ ID NO: 24590 - RNA, 91 nt, Mus musculus
ggcuacgcccuggacuacgcgcuuaggaacaucuuugugaggucggcuggcagccgcaucgaggauaacgugcagcaguuccuggugcugc

SEQ ID NO: 24591 - RNA, 46 nt, Mus musculus
gauuaaggauuucagcuuucgucuggugcucacugaagcgggacuc

SEQ ID NO: 24592 - RNA, 45 nt, Mus musculus
agugaugacgucaggcuggagucccgcuucagugagcaccagacg

SEQ ID NO: 24593 - RNA, 46 nt, Mus musculus
gcacuauuuggaaguguguucuuguugauguagguguggccuuguu

SEQ ID NO: 24594 - RNA, 45 nt, Mus musculus
augugguuaggggcugaaucagcuguugaggcaaagauggcaggg

SEQ ID NO: 24595 - RNA, 45 nt, Mus musculus
cggcuugaacgcaggcucugccuugagcuauauccaugccaauca

SEQ ID NO: 24596 - RNA, 46 nt, Mus musculus
uuaugugcgugacuuuguaaccaaccuaguuaacagccucgauguu

SEQ ID NO: 24597 - RNA, 45 nt, Mus musculus
auggagaugccaucuuucugugagcugggguccuuccugggcgag

SEQ ID NO: 24598 - RNA, 41 nt, Mus musculus
gcccagccugauggcaccucucaggacucucacuggaacca

SEQ ID NO: 24599 - RNA, 46 nt, Mus musculus
agggcggaacucagcgggaaugaagaccagggaggagucgaaagcg

SEQ ID NO: 24600 - RNA, 68 nt, Mus musculus
uccuauaccaacaaaagggaugccauaacugcuguacggaagaugagggcccugaauggcucagcccu

SEQ ID NO: 24601 - RNA, 46 nt, Mus musculus
cauggcguguucuaaaacacagcucauuccuagucucagggaccag

SEQ ID NO: 24602 - RNA, 45 nt, Mus musculus
ucaucccuuugucuagaaugcccuucucucaacucuucuuucccu

SEQ ID NO: 24603 - RNA, 45 nt, Mus musculus
ucaagugugacaagcuacaaggccaccaaagaggggcugggauag

SEQ ID NO: 24604 - RNA, 46 nt, Mus musculus
cccaaaggcacauugucuugcaaccaccagcuauugucacacaagg

SEQ ID NO: 24605 - RNA, 42 nt, Mus musculus
uucucguuuggccucggagcccaggcagccuccagggcagag

SEQ ID NO: 24606 - RNA, 42 nt, Mus musculus
guccucauaagugcugggccuucuagugaugagauucgagau

SEQ ID NO: 24607 - RNA, 46 nt, Mus musculus
acacauccuaucuagacauuuuaaaagaaguuuauuuacauucaag

SEQ ID NO: 24608 - RNA, 46 nt, Mus musculus
uucuugugugcagcaaggcgcaccaacggccaacaccaauuccaag

SEQ ID NO: 24609 - RNA, 46 nt, Mus musculus
uccuguauacacuccucugugaauccagaaagggcuggggacaagg

SEQ ID NO: 24610 - RNA, 46 nt, Mus musculus
accaaacuggaaaaggauuagaauacguaauucacagccaccucac

SEQ ID NO: 24611 - RNA, 42 nt, Mus musculus
gaguuucugucugauguuguagagucuuuagcugugggagac

SEQ ID NO: 24612 - RNA, 42 nt, Mus musculus
ggagagggagggagagagagagagaaagagagagagggaggg

SEQ ID NO: 24613 - RNA, 46 nt, Mus musculus
agaggauacuguggccaacuauuugguggcagagcuuugcugugag

SEQ ID NO: 24614 - RNA, 44 nt, Mus musculus
cuaugcauccuggugaagcgugauugaguuuagaagcccaggga

SEQ ID NO: 24615 - RNA, 46 nt, Mus musculus
ccuuuucuuccugcaacccuucuccaccaaggaacagaggauccag

SEQ ID NO: 24616 - RNA, 32 nt, Mus musculus
ugauccuggauccucuguuccuugguggagaa

SEQ ID NO: 24617 - RNA, 42 nt, Mus musculus
aucuuuguggggucccuuaagacuuuggaggaugacagucag

SEQ ID NO: 24618 - RNA, 45 nt, Mus musculus
aacaaggccaguacuguacacaccagcaugcuugauaacacaguc

SEQ ID NO: 24619 - RNA, 46 nt, Mus musculus
ucaucacagaaacaagccuuacagcggagacaugaaugcuggccaa

SEQ ID NO: 24620 - RNA, 46 nt, Mus musculus
ccagucugccugccaaauuucaaggagcguguugacauguuaagau

SEQ ID NO: 24621 - RNA, 45 nt, Mus musculus
cagccugcucuucccacaagugccaacaaggggcagcuccuagcu

SEQ ID NO: 24622 - RNA, 41 nt, Mus musculus
ucaaggagcccgcagggccuagggacaccugggggaccuca

SEQ ID NO: 24623 - RNA, 90 nt, Mus musculus
cacaccucuagagcccgaagucauccaggcugugacagaggccaugaaggaagccuggggaaaccccagcagcuccuaugugucagguaa

SEQ ID NO: 24624 - RNA, 51 nt, Mus musculus
ggcuuucggccauccauaauggaauacccucuucuggugugucugaagaca

SEQ ID NO: 24625 - RNA, 46 nt, Mus musculus
caguaacagauaaacuuugcauuaucggagaauacuucaaggaaag

SEQ ID NO: 24626 - RNA, 41 nt, Mus musculus
ggaucuagcaguugcucagucccacaaggcaagcaggcaga

SEQ ID NO: 24627 - RNA, 44 nt, Mus musculus
uggugaaggaacccaggaucccaagcaugcuaggaaagcccucc

SEQ ID NO: 24628 - RNA, 46 nt, Mus musculus
cagaagugaggagcuggaggcaggaaaauuacaaguuuaaggccag

SEQ ID NO: 24629 - RNA, 69 nt, Mus musculus
cugaguuggguugugcucuuugcugaggcuuaaggcugcgugcuucugacuuuccucauuauaucgaca

SEQ ID NO: 24630 - RNA, 46 nt, Mus musculus
acuggaacacuccuugcagaaaccccacuagaagggaaggcccaac

SEQ ID NO: 24631 - RNA, 26 nt, Mus musculus
uguccaucaaacacagcaaaguauga

SEQ ID NO: 24632 - RNA, 47 nt, Mus musculus
gccagacagaaacagcucuagacgcagaguugccagcagacccagcu

SEQ ID NO: 24633 - RNA, 46 nt, Mus musculus
cacagaagaacccagagugaguccacgaugacaaaccaggccucgg

SEQ ID NO: 24634 - RNA, 42 nt, Mus musculus
guaucugcuaagucccaaguugaguuuaagguuuuaggucau

SEQ ID NO: 24635 - RNA, 67 nt, Mus musculus
cggcagauggccgcggcgcgcgcucgggcuccggcagguccccgaagagguccauggcggcggggca

SEQ ID NO: 24636 - RNA, 72 nt, Mus musculus
agcgcuucggccggaagcggcgcuacagcaagaaaucgagcgaagauggcagcccgaccccggguaagcgcg

SEQ ID NO: 24637 - RNA, 42 nt, Mus musculus
cagcgcauccuggccaacgugcgcgagcgccagcgcacccag

SEQ ID NO: 24638 - RNA, 46 nt, Mus musculus
ucagaacauaacuggggaagucuugauuucacagccaugugguagc

SEQ ID NO: 24639 - RNA, 48 nt, Mus musculus
accucagccaugccaguucacaugucuaggacuucacucagccaccuc

SEQ ID NO: 24640 - RNA, 42 nt, Mus musculus
agacagggaaagacagagacagacagacagacagaggaaggg

SEQ ID NO: 24641 - RNA, 45 nt, Mus musculus
gacccgcuccuguguguguguguguguguguguguguguguguga

SEQ ID NO: 24642 - RNA, 46 nt, Mus musculus
ccugaaacuggcagggaagcacccugugaacaacagucaagcagag

SEQ ID NO: 24643 - RNA, 46 nt, Mus musculus
gguugagaaccacugccuuagagacaugaauuaaguuagugauguc

SEQ ID NO: 24644 - RNA, 24 nt, Mus musculus
auagaggcuccaaaaccuggcugu

SEQ ID NO: 24645 - RNA, 45 nt, Mus musculus
gaaacccccaaguucacggccuccauaccccaucugcccucuagc

SEQ ID NO: 24646 - RNA, 45 nt, Mus musculus
gaagcuaaaauaugggcaagggaaaaugguacuaccacccuggga

SEQ ID NO: 24647 - RNA, 46 nt, Mus musculus
aacuaacucagauaucugaacucacaggaaugcucaaguggagaaa

SEQ ID NO: 24648 - RNA, 45 nt, Mus musculus
auuuccaggucaucacuggaggaaggcaggacaggaaccuggagg

SEQ ID NO: 24649 - RNA, 48 nt, Mus musculus
ccaaauauugaaggaugugcccuguugaccuugggauauagaugacga

SEQ ID NO: 24650 - RNA, 78 nt, Mus musculus
gcuuccuguuccuccucaaagcucagcgaguagggcgaugcgggaacguauccccggaccugagagaugucaguugug

SEQ ID NO: 24651 - RNA, 46 nt, Mus musculus
cucuggauaccuaggauauagauugagucuucuaggguccccagga

SEQ ID NO: 24652 - RNA, 45 nt, Mus musculus
acugcuaaccagugaaacaucucugugguaugucacagagccagg

SEQ ID NO: 24653 - RNA, 46 nt, Mus musculus
gcaaaaagggacagaggacuaaggcaucagaagccagcacuggaaa

SEQ ID NO: 24654 - RNA, 41 nt, Mus musculus
agagaagagucuagucacaggguuaaggcuagaugugggua

SEQ ID NO: 24655 - RNA, 45 nt, Mus musculus
gcucgggaaucaugaaggcauccaggaggguggaaaaguauuggg

SEQ ID NO: 24656 - RNA, 41 nt, Mus musculus
cugcggaucugcccccagggcuacacuugcuguacuaguga

SEQ ID NO: 24657 - RNA, 42 nt, Mus musculus
cuagcuaggugcgguaagucaccucccaacccaugggccucg

SEQ ID NO: 24658 - RNA, 42 nt, Mus musculus
cuguggaaaccccaaggucaauccccacggcucugggcccga

SEQ ID NO: 24659 - RNA, 45 nt, Mus musculus
cauucaggacuucuggaucagccucccagggacacugugcaguga

SEQ ID NO: 24660 - RNA, 48 nt, Mus musculus
cuaccagaggugaugggugacgggcuggccaaccagaucaacaacccu

SEQ ID NO: 24661 - RNA, 42 nt, Mus musculus
acccaugcccuccccggccugucagaacaggagggacagaag

SEQ ID NO: 24662 - RNA, 47 nt, Mus musculus
guccuugcggcagccaggcccagguggcgguaacugcccccuauccc

SEQ ID NO: 24663 - RNA, 46 nt, Mus musculus
caccucuggcugcacacuccuccccuacccuccugcaccaccccca

SEQ ID NO: 24664 - RNA, 39 nt, Mus musculus
agaagaagcucugcagccaggauccccacacacagcaga

SEQ ID NO: 24665 - RNA, 74 nt, Mus musculus
cuguggagcucagugaaucugguucucaaaaaaagacccacugugggauucucuaguaugacguaggugaggug

SEQ ID NO: 24666 - RNA, 86 nt, Mus musculus
gaggagccucacuucaggggaacagccagcuacaucuagccccuaccccacuuagaaaggucaccuggccauggggaugcugggug

SEQ ID NO: 24667 - RNA, 46 nt, Mus musculus
ggggcagcauugacagucaagggcuuuuacagacaugcacauucag

SEQ ID NO: 24668 - RNA, 61 nt, Mus musculus
agucacuggguuagagaggcuauugccagcacagcaccaaggccugcccaguagucagguc

SEQ ID NO: 24669 - RNA, 46 nt, Mus musculus
aagggcuggugcgccugcaccucgggaggcagugugacggucagag

SEQ ID NO: 24670 - RNA, 46 nt, Mus musculus
aggacccugcagcuuucccuguccagagcaaccacagcccccauac

SEQ ID NO: 24671 - RNA, 46 nt, Mus musculus
gcagcugaugggcugguggauaagcaauggguuaacugacuucaga

SEQ ID NO: 24672 - RNA, 46 nt, Mus musculus
uugccucacagaccugggggugugccuacuccacagagcccagauc

SEQ ID NO: 24673 - RNA, 46 nt, Mus musculus
auguuuggagcuggcccacccauaauaucgugcugccuggggaaau

SEQ ID NO: 24674 - RNA, 45 nt, Mus musculus
ggaggagaugaugaaggugaggcagggguucuccauggccacgau

SEQ ID NO: 24675 - RNA, 45 nt, Mus musculus
ugucuucaggugugggcucccuggaggguggcccuggggccagag

SEQ ID NO: 24676 - RNA, 23 nt, Mus musculus
agggucaagccuugccugugacu

SEQ ID NO: 24677 - RNA, 42 nt, Mus musculus
uugcagagcagguaauaguagggacuucacccuaaugggaag

SEQ ID NO: 24678 - RNA, 45 nt, Mus musculus
uaagauagaggugcaucuguucgccaguagacccaggcuuuggag

SEQ ID NO: 24679 - RNA, 45 nt, Mus musculus
gggucgaaagggagagguuccucaggauuagguggggguucugag

SEQ ID NO: 24680 - RNA, 83 nt, Mus musculus
gagguaagcucagucuacuaagaagauggugagaucuaguggccagugggaagcagucaauggugggcaaaauaugaccuagg

SEQ ID NO: 24681 - RNA, 41 nt, Mus musculus
aaggccuagagccagcaaagaugcugauguagccaggccau

SEQ ID NO: 24682 - RNA, 46 nt, Mus musculus
cagucacaucaaaaacucacuacuguaucuuagauacccacuagag

SEQ ID NO: 24683 - RNA, 46 nt, Mus musculus
uucuauuccguucugaugaguccaaggccaaacacccuacauucag

SEQ ID NO: 24684 - RNA, 42 nt, Mus musculus
uacaacacacauuagcuguagucacaguacuuuugugggcca

SEQ ID NO: 24685 - RNA, 66 nt, Mus musculus
uggaucaagaggaggaggaggagucugagagccaugcaucugaggaggaagaggaagaggaggaag

SEQ ID NO: 24686 - RNA, 42 nt, Mus musculus
cagugcccgguagaggaagcuuucaagaguuuuccagcauua

SEQ ID NO: 24687 - RNA, 45 nt, Mus musculus
gggccuguuugguuaggcagaccccucaucucagagaacagaaac

SEQ ID NO: 24688 - RNA, 42 nt, Mus musculus
augauccucacugagagggaacagaucauucuaaagccagaa

SEQ ID NO: 24689 - RNA, 67 nt, Mus musculus
aaaguuuuggaguuuguuguguuggacauugaggaauggaguaaggauuugcaguagaggugggagc

SEQ ID NO: 24690 - RNA, 45 nt, Mus musculus
ugacaccucaacuuucagauaguuuccuauucagcagccccaucc

SEQ ID NO: 24691 - RNA, 45 nt, Mus musculus
uccauguuccuugauguaugaaaaacaaaauauugcagaccagug

SEQ ID NO: 24692 - RNA, 45 nt, Mus musculus
gaucuccuggccuuaagaguuggucagcguggaacaaugaacagg

SEQ ID NO: 24693 - RNA, 49 nt, Mus musculus
gugaguucucagacagccuagacuacacaaagaaacccugagauuuggc

SEQ ID NO: 24694 - RNA, 45 nt, Mus musculus
uaagcacuggggcagcucucagccccagccucagaagcuuuggug

SEQ ID NO: 24695 - RNA, 46 nt, Mus musculus
gcgucugucuaaugucuggacaucaguuacucaggacugcugaagg

SEQ ID NO: 24696 - RNA, 42 nt, Mus musculus
ggcuguguguguguguguguguguguguguguguuggcugau

SEQ ID NO: 24697 - RNA, 45 nt, Mus musculus
caacgccagacacaaguuaggggcugcagaggacacuggggauca

SEQ ID NO: 24698 - RNA, 45 nt, Mus musculus
acagcaacuuccagaauaaagaguuuauuugagcuuaugauuucc

SEQ ID NO: 24699 - RNA, 46 nt, Mus musculus
cuuucccucuucugguucugauaauucuguccugccaaccccagau

SEQ ID NO: 24700 - RNA, 50 nt, Mus musculus
acuuagggauggguaagcuuguuuucauguuuaggccacuuauuacagaa

SEQ ID NO: 24701 - RNA, 46 nt, Mus musculus
cuuccacauucuucugaggcuuagucuuuuauaguagacuacaauu

SEQ ID NO: 24702 - RNA, 41 nt, Mus musculus
aaauaaggaagagagauaagcgggagacaggcuagcggaga

SEQ ID NO: 24703 - RNA, 46 nt, Mus musculus
uuacuggcuaaauauuuagaauaucuaauuuaaauuaccuggaggu

SEQ ID NO: 24704 - RNA, 44 nt, Mus musculus
agcuucaaguguucuuaaccacugagccaacuguccagcccaga

SEQ ID NO: 24705 - RNA, 46 nt, Mus musculus
ggggggggggggguuagacuugguuuuuuauguugagagagagaga

SEQ ID NO: 24706 - RNA, 69 nt, Mus musculus
gugaggaaaagugacuguguccuguugucaucgggugggggguggaacccaguggaggguaguguagua

SEQ ID NO: 24707 - RNA, 45 nt, Mus musculus
cauggggcuuugaaaaggacccauccuaaaacugggguaugagau

SEQ ID NO: 24708 - RNA, 60 nt, Mus musculus
cugaagauggcuaaaguguacucaucauauauauaaaauaaauaaauaaaaucuuggggg

SEQ ID NO: 24709 - RNA, 46 nt, Mus musculus
gugguucacaaccaucuguaaugggaucugacacccucuucuggug

SEQ ID NO: 24710 - RNA, 46 nt, Mus musculus
uauuugaauuguggugaugggcucugaagggaauagguuaguagag

SEQ ID NO: 24711 - RNA, 42 nt, Mus musculus
uaucugaauccgcguuugucagugcggguauggcggacagac

SEQ ID NO: 24712 - RNA, 75 nt, Mus musculus
cacuccuacugcuucuccgcucggcagaacaagagccagguaugcugccugcgggagcagguugagaagaagaau

SEQ ID NO: 24713 - RNA, 51 nt, Mus musculus
aaggcuucccagagccccuccgccccuccaacugauguaaccccuaagcca

SEQ ID NO: 24714 - RNA, 71 nt, Mus musculus
cccucgugagcccauggaccgaaagaggcugaagagagagauggagccaaggugcagugggaauagugugg

SEQ ID NO: 24715 - RNA, 46 nt, Mus musculus
gcgagcuucuccacaagaugaugcagcccccaaggucaccccaggu

SEQ ID NO: 24716 - RNA, 42 nt, Mus musculus
gagauaucugagaggcccagcuaaaaaccaaccacagcugag

SEQ ID NO: 24717 - RNA, 46 nt, Mus musculus
cugucuggcagaguucagugucaucguucaauacacauaaggccag

SEQ ID NO: 24718 - RNA, 46 nt, Mus musculus
aacacugauaaagguuauaagaucacauugcuuacaacguccagau

SEQ ID NO: 24719 - RNA, 45 nt, Mus musculus
ucggugccagugccugggccgcaggaccccauaggaaggcgauga

SEQ ID NO: 24720 - RNA, 46 nt, Mus musculus
ugcuaaacaagaccugaacaaggucaacaccaacaggcaugcuaac

SEQ ID NO: 24721 - RNA, 45 nt, Mus musculus
uucuaggaacuuuuuagaggguauauaaaugcuagggccccagag

SEQ ID NO: 24722 - RNA, 42 nt, Mus musculus
ucuggggcccuagcauuuauauacccucuaaaaaguuccuag

SEQ ID NO: 24723 - RNA, 52 nt, Mus musculus
aggcaaaucauagcuacuaugaacagucuaaagcagccucauauuccacacc

SEQ ID NO: 24724 - RNA, 26 nt, Mus musculus
aauuguccagggucugcauguaaaua

SEQ ID NO: 24725 - RNA, 42 nt, Mus musculus
auaaauaugauacaacaagcuagucucuuuuuugggggagag

SEQ ID NO: 24726 - RNA, 42 nt, Mus musculus
ugaugcugcuaugaagucagaugcuaaccacuggccccaaag

SEQ ID NO: 24727 - RNA, 41 nt, Mus musculus
uugugagccaccaugugguugcugggacuugaacucgaguu

SEQ ID NO: 24728 - RNA, 45 nt, Mus musculus
ugucuugaaacaaacaaacaaacaaacaaacaaacaaacaaaugg

SEQ ID NO: 24729 - RNA, 46 nt, Mus musculus
acagagcuuguggugccauuucuuaaguggggugacugaagcuuag

SEQ ID NO: 24730 - RNA, 42 nt, Mus musculus
agaggagaggagccuuuuguuguugcaggcaucccacugguu

SEQ ID NO: 24731 - RNA, 46 nt, Mus musculus
gugguguguguguguguguguguguguguaugugugagauguguga

SEQ ID NO: 24732 - RNA, 46 nt, Mus musculus
caggugguuagaagaauccuagaaggcaccuucucuuggggggugu

SEQ ID NO: 24733 - RNA, 42 nt, Mus musculus
cucugauaaaaguuagggauggaaguuugacagcugacagga

SEQ ID NO: 24734 - RNA, 46 nt, Mus musculus
aaaucccagcaaucacaugguggcucacaaccauccauaacaagau

SEQ ID NO: 24735 - RNA, 65 nt, Mus musculus
ugcgggggagaggagaaacagaaucaccaugggaguggagacggaucagauuuauagcugcagag

SEQ ID NO: 24736 - RNA, 45 nt, Mus musculus
gcuguauuuucugcccagaauccaaacaggcucugaggucucagg

SEQ ID NO: 24737 - RNA, 45 nt, Mus musculus
aaucuugucugauguugcauccagacuuugguuuacauacaggag

SEQ ID NO: 24738 - RNA, 44 nt, Mus musculus
ugauacuagaaaaccagcuugaggggcuggugagauggcuuagu

SEQ ID NO: 24739 - RNA, 46 nt, Mus musculus
ccuagcaugggcuuuggaaacuuauacaccuucaacauggccacac

SEQ ID NO: 24740 - RNA, 24 nt, Mus musculus
ucacaucugaucaaaaaauagagg

SEQ ID NO: 24741 - RNA, 45 nt, Mus musculus
aaagacuguuuauagccuauguauguaguaauaagaggcagagau

SEQ ID NO: 24742 - RNA, 42 nt, Mus musculus
uugaaagacugacaagaauuguggagucacuuuuaacaugag

SEQ ID NO: 24743 - RNA, 45 nt, Mus musculus
caccgaagcaugcaaccccagccugugucugaaguagggccaguu

SEQ ID NO: 24744 - RNA, 46 nt, Mus musculus
cugaagccggcagugguggcgcacuccuuuaaucccagcacuuggg

SEQ ID NO: 24745 - RNA, 46 nt, Mus musculus
uaugaguguuuuucugcacauaugucuguucacaucauacaugcaa

SEQ ID NO: 24746 - RNA, 41 nt, Mus musculus
gguuguuagcugcucugugggugcugggaacugaaccccgg

SEQ ID NO: 24747 - RNA, 46 nt, Mus musculus
guacaacuguuuggaaaggacuaggauaggagguccggccucgcug

SEQ ID NO: 24748 - RNA, 45 nt, Mus musculus
agcuguauuaaaggguugcagcauuaggaaggcugagaacugcug

SEQ ID NO: 24749 - RNA, 46 nt, Mus musculus
gccuacacauaugugcaucacauucaugucuggugccccugcagau

SEQ ID NO: 24750 - RNA, 45 nt, Mus musculus
uucagcuccagcagggaacccauuacagugccucucugaaucagu

SEQ ID NO: 24751 - RNA, 46 nt, Mus musculus
gagccaucucaccagccccaacccuuaguucuuauucaucuccaag

SEQ ID NO: 24752 - RNA, 46 nt, Mus musculus
ugccaagccucaacuccuuugcaugaccccuucaguucugggacau

SEQ ID NO: 24753 - RNA, 46 nt, Mus musculus
ccagcaccaccuggguaauucuuacacauuaccagguccagccaca

SEQ ID NO: 24754 - RNA, 63 nt, Mus musculus
ccugaaaagagucuuuaauuuucgcucuaaaauuucauaagccaggccuccaucuucugcacu

SEQ ID NO: 24755 - RNA, 55 nt, Mus musculus
guacucuacauuaucuuccaagcuccuacaaaacaucccacagugcucuuaacac

SEQ ID NO: 24756 - RNA, 45 nt, Mus musculus
uggcucacaaccauccguaaugagaucugacacccuuuucuggag

SEQ ID NO: 24757 - RNA, 46 nt, Mus musculus
uggcccaaugggacaggggcaaggacaacagaagucagauaaauau

SEQ ID NO: 24758 - RNA, 46 nt, Mus musculus
ccugccgaguggcugucacaaccccaguauauucgaguguugacug

SEQ ID NO: 24759 - RNA, 46 nt, Mus musculus
uugcacaaaccaucagaaaacccuacuauaucaucaagacagagau

SEQ ID NO: 24760 - RNA, 45 nt, Mus musculus
agcacucaccuagggacagguucaggacauccuggcaggccagau

SEQ ID NO: 24761 - RNA, 44 nt, Mus musculus
uuccuuuauguagucugugccugccugccacaagcccacccuca

SEQ ID NO: 24762 - RNA, 45 nt, Mus musculus
cuacuccagaugcagcagcucuaaguagcccacaagguagcaaga

SEQ ID NO: 24763 - RNA, 42 nt, Mus musculus
ugcugucgcccagggucucgcuguaacuccuguuguugguag

SEQ ID NO: 24764 - RNA, 42 nt, Mus musculus
ccccacaguccccaugaucaguccccauccuccuccgcaucc

SEQ ID NO: 24765 - RNA, 41 nt, Mus musculus
cccuccagucgcccucucuacucucagauagagagaccuuu

SEQ ID NO: 24766 - RNA, 25 nt, Mus musculus
gcgauuccagugcacuuacuggaga

SEQ ID NO: 24767 - RNA, 45 nt, Mus musculus
gagauccaccaaagacagaaaggaaggaaugaaggaaugaaggaa

SEQ ID NO: 24768 - RNA, 45 nt, Mus musculus
uucggauccacaggcauguccagcacaucagaggggugcacagau

SEQ ID NO: 24769 - RNA, 49 nt, Mus musculus
uaucuaaucugacccugagagggguccccaagaagaaugccagccccau

SEQ ID NO: 24770 - RNA, 42 nt, Mus musculus
cagcuacauugugaguucaaagccugccuaggauacaugaga

SEQ ID NO: 24771 - RNA, 45 nt, Mus musculus
aguucagccuagucauauacacaguggguuccaggacagccagag

SEQ ID NO: 24772 - RNA, 42 nt, Mus musculus
cauauguaucagaagaugaccuagucggccaucacugggaag

SEQ ID NO: 24773 - RNA, 61 nt, Mus musculus
acuucuggggaucaugguugagcagccuugucugaugaugguugucuugaugguagaucgu

SEQ ID NO: 24774 - RNA, 44 nt, Mus musculus
uaaggugaaagggcuuuuuguucagcuuaaggcauucuauaaac

SEQ ID NO: 24775 - RNA, 26 nt, Mus musculus
agagcugcagcaucucacucaucucu

SEQ ID NO: 24776 - RNA, 89 nt, Mus musculus
ggaauaggauaagcuaaugcaauccuaagaagcuuagcgauagaaccgugaaauaagaacaagaaaggaaauaagaagucugcacaggu

SEQ ID NO: 24777 - RNA, 45 nt, Mus musculus
uaguacauagcuguuuucuuagaacacaggaagcugagcccagau

SEQ ID NO: 24778 - RNA, 46 nt, Mus musculus
uaagagaacaagaagggcagcaaucucuuugacauucugcugaguc

SEQ ID NO: 24779 - RNA, 42 nt, Mus musculus
acaauguacuguaaguucauucauguucuacaauggugagac

SEQ ID NO: 24780 - RNA, 45 nt, Mus musculus
cagacaucuuuacccacugaaccuucuuaccagcuugcccucuau

SEQ ID NO: 24781 - RNA, 41 nt, Mus musculus
auuuuccuguaguuggagugugugccaugugugugccugag

SEQ ID NO: 24782 - RNA, 46 nt, Mus musculus
gggaaguuuaagccagcacagcugaguugaaucaaccagccaaaga

SEQ ID NO: 24783 - RNA, 46 nt, Mus musculus
ugguccuugaagaaaaggacuuuaggaaaugacaggagcccccaga

SEQ ID NO: 24784 - RNA, 46 nt, Mus musculus
ugaaaaugagccauuugcuggugugucugaaucauauaauggguaa

SEQ ID NO: 24785 - RNA, 46 nt, Mus musculus
cuauuaaauuaaaauugauugacuacacauuaauguuuagacagau

SEQ ID NO: 24786 - RNA, 46 nt, Mus musculus
caauguacauggacuuguaaguacauguuuauuuuagcccuuauca

SEQ ID NO: 24787 - RNA, 45 nt, Mus musculus
gcucagcaaaugaucugucaauaagacaaaauugcaaccaacaga

SEQ ID NO: 24788 - RNA, 46 nt, Mus musculus
acugguaagaggauaagcaagaggaauguggagugagcuagaagau

SEQ ID NO: 24789 - RNA, 45 nt, Mus musculus
ccuccuuacaaagcaaugaaaucuacacauuuacauuccugguga

SEQ ID NO: 24790 - RNA, 46 nt, Mus musculus
ugccgucuggauaaacuugcuuacacauuagcaucaacucucagau

SEQ ID NO: 24791 - RNA, 34 nt, Mus musculus
uuugucuucuagguuuuagcuccaaaggauggaa

SEQ ID NO: 24792 - RNA, 46 nt, Mus musculus
aaaugucuacaggugugagaaaugacaccaaaggagggugagagag

SEQ ID NO: 24793 - RNA, 60 nt, Mus musculus
agagcauaaacugggcauggugccacaccugccaucugagaucugggaggaacagcuagc

SEQ ID NO: 24794 - RNA, 61 nt, Mus musculus
agaaaaaaacuggggauguaaguggcaaagagaaacaaauguguugaaagcaccaguaagu

SEQ ID NO: 24795 - RNA, 61 nt, Mus musculus
aaauauagaaacauggaacaaaaaucugaauuauuuguuuagcugcgagaaauauagaaaa

SEQ ID NO: 24796 - RNA, 46 nt, Mus musculus
aaagacuuggcucacggcugaaccugagauauuacugaagcgagag

SEQ ID NO: 24797 - RNA, 46 nt, Mus musculus
uaccuuuucuacaaaaccuuggccucugucccggugguccucagag

SEQ ID NO: 24798 - RNA, 45 nt, Mus musculus
uugcugcagugggccaggugccugucuucuucauugggcuguuag

SEQ ID NO: 24799 - RNA, 45 nt, Mus musculus
cuaaagucauuccugaugcuuuguguaaauuguuaagguuggaga

SEQ ID NO: 24800 - RNA, 41 nt, Mus musculus
ucacagccauccauuggacugagcacaagguccccagugga

SEQ ID NO: 24801 - RNA, 42 nt, Mus musculus
cugcaacaccccccaaggcuuuuugcuucacuacugucucuu

SEQ ID NO: 24802 - RNA, 45 nt, Mus musculus
aaaugaaaugaacaccugcgaccccaucaugaauggugcagucgg

SEQ ID NO: 24803 - RNA, 46 nt, Mus musculus
accucaauauacgggugucccaugcuuucccugucuuuuuucagag

SEQ ID NO: 24804 - RNA, 48 nt, Mus musculus
uucccuaaagcuuucucagcuaacucuugugaggcaaacugaacgaag

SEQ ID NO: 24805 - RNA, 45 nt, Mus musculus
uguauucuucauagcccccauagccugcacuauaggcaccagacc

SEQ ID NO: 24806 - RNA, 46 nt, Mus musculus
cggaagaaaauagcuuuaguuuacucaauauuacaugcuagaagaa

SEQ ID NO: 24807 - RNA, 42 nt, Mus musculus
cccguguauauagagacaggucucugggagaugggaggagaa

SEQ ID NO: 24808 - RNA, 45 nt, Mus musculus
auuuuuuauugugaauuauuuaaaauauuacaaaugcagguggga

SEQ ID NO: 24809 - RNA, 46 nt, Mus musculus
cuuccugucagauguaguugucaucuguuucuuuauacuaguaaga

SEQ ID NO: 24810 - RNA, 32 nt, Mus musculus
ugcccggcucugaugcaguuucugccuguucc

SEQ ID NO: 24811 - RNA, 46 nt, Mus musculus
aaccucaauuuuaaagauguaaacgcagugauauuugugaauagaa

SEQ ID NO: 24812 - RNA, 44 nt, Mus musculus
ggcaucagcuuguucaucuguuaaauaacucuaacauuaaaaga

SEQ ID NO: 24813 - RNA, 46 nt, Mus musculus
aaacaaacggucugucaugcuuugguuugcaccuggaaauccagca

SEQ ID NO: 24814 - RNA, 41 nt, Mus musculus
gcuugugagauggccgcacuaacccuucauuguccgcugug

SEQ ID NO: 24815 - RNA, 42 nt, Mus musculus
cuuuugcuuucacuuauaaugaacauacuuuuauuccuagaa

SEQ ID NO: 24816 - RNA, 46 nt, Mus musculus
guuuuuguguauguguuagggaugcuuuuguuuugcuugagauagg

SEQ ID NO: 24817 - RNA, 49 nt, Mus musculus
cagagugaggcuggauaggaguguuuguuacagaugaagucguggcagu

SEQ ID NO: 24818 - RNA, 45 nt, Mus musculus
uggguaaaugacucucuguaguuaacuucccgcuuugucuugaga

SEQ ID NO: 24819 - RNA, 46 nt, Mus musculus
acgaauuuagcaaaaggugauaccuucaaaugcagauaaaaaagaa

SEQ ID NO: 24820 - RNA, 46 nt, Mus musculus
ggcuuuuguuuguuugcucguuugcuucuuccauccuuucuucuga

SEQ ID NO: 24821 - RNA, 46 nt, Mus musculus
uuaugcuuuagacuaaaauuuccaaccaaaaauuugcacaaaaucu

SEQ ID NO: 24822 - RNA, 92 nt, Mus musculus
uauuaaguuuuucagaauuucucaguuaaacccuuuccugugcccucuacaggaucugucugugugugugugugugugugugugugugugug

SEQ ID NO: 24823 - RNA, 46 nt, Mus musculus
gucauucaaaggaaaagaaaauacagcuuaaauuguacggcuagga

SEQ ID NO: 24824 - RNA, 45 nt, Mus musculus
uauucuagagguguucugucuccugagcggcacguccgcaccaga

SEQ ID NO: 24825 - RNA, 46 nt, Mus musculus
agaaggauuuuaaaacaaagaauggaagauaugauauuagcaagau

SEQ ID NO: 24826 - RNA, 46 nt, Mus musculus
caaaguguauuccuugauucaaaguuugacuucccaaauuagauau

SEQ ID NO: 24827 - RNA, 45 nt, Mus musculus
uauauacaagcuauuuaccauuuuuuaccuuggugaaucccagau

SEQ ID NO: 24828 - RNA, 46 nt, Mus musculus
uguuagcucagauuuuuaauugugucuaccauaccugugggcaggu

SEQ ID NO: 24829 - RNA, 41 nt, Mus musculus
cuuggcuugccaguauuuuacauuuauuuauggcagcacag

SEQ ID NO: 24830 - RNA, 46 nt, Mus musculus
uaaauaagaaauacuauuaaauaaugaguacuacuaagccccgugg

SEQ ID NO: 24831 - RNA, 59 nt, Mus musculus
uaaguuaaugucaugaaaaugcuuugcuccuagaauaacgucaacuuuuuuuauacggu

SEQ ID NO: 24832 - RNA, 42 nt, Mus musculus
aauagcacuuguuuuucuggucacauuuucccagaggaagau

SEQ ID NO: 24833 - RNA, 46 nt, Mus musculus
gaaaaucaguuuuuaucuuuaacucuauguacauuuagcacuagcu

SEQ ID NO: 24834 - RNA, 44 nt, Mus musculus
uguuuguuuacauggaauuuacauggaguuacaugcaugauagg

SEQ ID NO: 24835 - RNA, 46 nt, Mus musculus
ugguuguagauucuccuuuaauagcccggacuucacuagcacagaa

SEQ ID NO: 24836 - RNA, 23 nt, Mus musculus
ugcagucaccaagcucugcucaa

SEQ ID NO: 24837 - RNA, 45 nt, Mus musculus
gguauugguuugcugugcuuuagaccuacguugagugauaucagg

SEQ ID NO: 24838 - RNA, 46 nt, Mus musculus
guuuauaccguggguccagacuaugcacaugcugaagcucgaaaau

SEQ ID NO: 24839 - RNA, 24 nt, Mus musculus
gcaggcaggcaggcuuucuuugaa

SEQ ID NO: 24840 - RNA, 45 nt, Mus musculus
gagcaguuugauauuugaaauauuuagaaaaacaaaaaggguagu

SEQ ID NO: 24841 - RNA, 44 nt, Mus musculus
cauuuguaaucaaugacuugaauaugcaguaucucauacaagau

SEQ ID NO: 24842 - RNA, 42 nt, Mus musculus
aauuuuaguagguuaguuuuuauauccuaagguggcccagca

SEQ ID NO: 24843 - RNA, 45 nt, Mus musculus
augugguugauagaacucugaagcucaggaaugaaaaggccaaga

SEQ ID NO: 24844 - RNA, 46 nt, Mus musculus
gcugcucacugugugucugucuuagucuucauucuccuugcccuca

SEQ ID NO: 24845 - RNA, 45 nt, Mus musculus
gggcuacacagagaaacccugucucaaaaaaccaaaaaaauuaag

SEQ ID NO: 24846 - RNA, 46 nt, Mus musculus
uauguuuguguugucauuguuguuccuuguauuugugaccuuagau

SEQ ID NO: 24847 - RNA, 46 nt, Mus musculus
aaccucauucugucugcugccuagagcugcuaaggaauuuuggggu

SEQ ID NO: 24848 - RNA, 46 nt, Mus musculus
gaaugaguaaacauaugagagagaggacuguuuguccagggcagua

SEQ ID NO: 24849 - RNA, 45 nt, Mus musculus
gggaacucuagauacuauacaggacugauggcuuauucggggugu

SEQ ID NO: 24850 - RNA, 46 nt, Mus musculus
aaacaaaacccugagcacucacaucauugucaggugugaaacagau

SEQ ID NO: 24851 - RNA, 45 nt, Mus musculus
gggugaacuggaaaccccaacuccuacccaaagagaggaggcaga

SEQ ID NO: 24852 - RNA, 45 nt, Mus musculus
gaccccaagaauuuaaaaguagugaaggacaccuuccgcugcuca

SEQ ID NO: 24853 - RNA, 45 nt, Mus musculus
gauagacagacaugcccagagaaggagaaacuauuuuuaaaagaa

SEQ ID NO: 24854 - RNA, 45 nt, Mus musculus
aagcagggaagcacccacauuccugacagaauaagauggcggcga

SEQ ID NO: 24855 - RNA, 45 nt, Mus musculus
aacaggaaaugucagcccucuguacugaaguucaauccacugaag

SEQ ID NO: 24856 - RNA, 57 nt, Mus musculus
aagacuuuuuauauuuuuuauauuuuaucauuuaaguggcagaucuaauauuugaac

SEQ ID NO: 24857 - RNA, 45 nt, Mus musculus
uguggauguauauauguauguauauauguauauaugugugugugu

SEQ ID NO: 24858 - RNA, 44 nt, Mus musculus
ggcauguguuaaguguuaucuuuggcggucggcccuuaccauca

SEQ ID NO: 24859 - RNA, 54 nt, Mus musculus
agcauuaguacucuugacucauuagacuuugcaagauauucagaugaugguaac

SEQ ID NO: 24860 - RNA, 46 nt, Mus musculus
acaguagggccauacagauagagcugugaaggcagaaugugccuag

SEQ ID NO: 24861 - RNA, 46 nt, Mus musculus
ucuaacuuaugggagauaaccauuuuuuuauuacuguacugugcug

SEQ ID NO: 24862 - RNA, 46 nt, Mus musculus
cuauuagcagaaccuuugauuuuauuucuuauauugaacuugguag

SEQ ID NO: 24863 - RNA, 46 nt, Mus musculus
aaggagaccauucaggcccuccgagccaaccuaacaaaggcugcag

SEQ ID NO: 24864 - RNA, 46 nt, Mus musculus
uuuccagguaacuuuuuauagccugauaguaacuguauagccccuu

SEQ ID NO: 24865 - RNA, 46 nt, Mus musculus
ugacuaggaauguuguauuuaccucugauuuucuccaaaccccuga

SEQ ID NO: 24866 - RNA, 46 nt, Mus musculus
auuaguuacauuugugugugugugugugugugugugugugugugug

SEQ ID NO: 24867 - RNA, 46 nt, Mus musculus
uuugaaaacugaaauuguucuccgggcguuuucuuucuucagugag

SEQ ID NO: 24868 - RNA, 46 nt, Mus musculus
uggucuucccaaaaggauucugaagacaauagacaaagcccagcug

SEQ ID NO: 24869 - RNA, 45 nt, Mus musculus
gugcgcugugcuuugaccugugucuuuucuuauugugcauuggca

SEQ ID NO: 24870 - RNA, 46 nt, Mus musculus
cuaaucuaaggguuaaaggcuaaguaauaguucacuaggcaaagaa

SEQ ID NO: 24871 - RNA, 46 nt, Mus musculus
agagaccagcuccuccauauccucuucaaccugaucaagaggccag

SEQ ID NO: 24872 - RNA, 45 nt, Mus musculus
uuacagaaguuuuucaguuucaugaggucccauuuaucauuguug

SEQ ID NO: 24873 - RNA, 46 nt, Mus musculus
uucucaagauuauugagaacagaagccauuuuguugucagaguccc

SEQ ID NO: 24874 - RNA, 42 nt, Mus musculus
caauggcagaugauucagagaucugccugccuuuguaagcac

SEQ ID NO: 24875 - RNA, 46 nt, Mus musculus
gaggaaaauaaauuuaugcacaucauuuuacaagaacaagccauac

SEQ ID NO: 24876 - RNA, 46 nt, Mus musculus
gaucaggaaucuaccuagccaccuaccuuuaguuuguugcccagua

SEQ ID NO: 24877 - RNA, 46 nt, Mus musculus
gguucuuucaauguugcaacagauguuaauggaagauaaggcugau

SEQ ID NO: 24878 - RNA, 46 nt, Mus musculus
aaaaaaagaaaaagacagcugcuuucagugcagcagcugucaagaa

SEQ ID NO: 24879 - RNA, 46 nt, Mus musculus
acuuggaaacuuacagucucaucuuauaccuacacuacugaacaag

SEQ ID NO: 24880 - RNA, 42 nt, Mus musculus
ccaguauacacuucauaaagagaacuucauuguacucagaag

SEQ ID NO: 24881 - RNA, 46 nt, Mus musculus
gaggcuagcagcugauauuucauagaugccuauauaaacugauaag

SEQ ID NO: 24882 - RNA, 48 nt, Mus musculus
uuaaaacuuucuaaauuucacagugggcacuugaagccugaaguggcu

SEQ ID NO: 24883 - RNA, 46 nt, Mus musculus
uaauccuuugguuuuaguuacuguugcuguaccucuuuggcuugug

SEQ ID NO: 24884 - RNA, 46 nt, Mus musculus
aauuguaucagauaugauuugaugugauguagaaguuuaaacacag

SEQ ID NO: 24885 - RNA, 46 nt, Mus musculus
gcuacuacaacuuuaugauuaccaacuggaacaugaaggcacaaca

SEQ ID NO: 24886 - RNA, 46 nt, Mus musculus
ccuguaucaguaauaaguauauauuuuaucacuaauuaauccauag

SEQ ID NO: 24887 - RNA, 46 nt, Mus musculus
caauguacucauauacauaaaauaaauaaaucuuuuaaaaaaauaa

SEQ ID NO: 24888 - RNA, 46 nt, Mus musculus
cucugucugucuuccauuaccugaccuggugagucaaaaacaugag

SEQ ID NO: 24889 - RNA, 46 nt, Mus musculus
uaaauauaaauaaucauagcuacuggcuacucuauuguacagcaag

SEQ ID NO: 24890 - RNA, 37 nt, Mus musculus
caaguacagauuuuuuaaaauggcuuccuagaaugaa

SEQ ID NO: 24891 - RNA, 46 nt, Mus musculus
aaaaccaaccuuaaacucaaauaugcucuuaaaaaagaaaagaaaa

SEQ ID NO: 24892 - RNA, 46 nt, Mus musculus
cuauauuugcugauauaacccacuauaaaccaguguaaacccacag

SEQ ID NO: 24893 - RNA, 42 nt, Mus musculus
uaacaggugcuuuuaauacugagccaucucacuggcccuguc

SEQ ID NO: 24894 - RNA, 47 nt, Mus musculus
cugcuuucugauucuuuugaaucaacuaaaacucaaagauggccagg

SEQ ID NO: 24895 - RNA, 46 nt, Mus musculus
gccuaucacuuguuucuaacucuccgauucuauuucuccccagcau

SEQ ID NO: 24896 - RNA, 42 nt, Mus musculus
uguccugugugugucuaugucugugugugucugugugugugu

SEQ ID NO: 24897 - RNA, 42 nt, Mus musculus
gaaagaauaaugcagacuuuuuauuauuucuuaacugacuag

SEQ ID NO: 24898 - RNA, 42 nt, Mus musculus
uuugucugcaucaugcuaaacgaaauaaaucagaccacuugu

SEQ ID NO: 24899 - RNA, 45 nt, Mus musculus
gaauacagcagcuagggcgggagagggaugacuccaacccgcaga

SEQ ID NO: 24900 - RNA, 46 nt, Mus musculus
gcuuaaauaaaaauucuuacccaccuguuaaaugaaaggggcagua

SEQ ID NO: 24901 - RNA, 46 nt, Mus musculus
acacugaaaagcauccuuugccacugcugugagauaagagaaagga

SEQ ID NO: 24902 - RNA, 31 nt, Mus musculus
agcuuugggagccauucuuauucagacaugu

SEQ ID NO: 24903 - RNA, 67 nt, Mus musculus
gccagguacaaaugagauuaccggauucuuauacaaaacagaggaaugcaaacauggaaggacuggc

SEQ ID NO: 24904 - RNA, 54 nt, Mus musculus
agauucuguagaaucugaaugcaauuugacaaaucaagcaucagacuuuuuaua

SEQ ID NO: 24905 - RNA, 46 nt, Mus musculus
cuuguuagagagaaaugugguucaggauuaaauauaugccauagcc

SEQ ID NO: 24906 - RNA, 45 nt, Mus musculus
uccagacauagaaacagccaaaaaggacucaaaaguugugugaga

SEQ ID NO: 24907 - RNA, 94 nt, Mus musculus
ugaacucauacuaagagcauuuuguguaauguuuauuuugaaagauuuuaaguaguuuuacuauuuugaauuuagagaauuaugguaacccuua

SEQ ID NO: 24908 - RNA, 42 nt, Mus musculus
aggaaaaacguuuacaaaugucacugccccacugccccgggg

SEQ ID NO: 24909 - RNA, 46 nt, Mus musculus
uugaguacuuggcacuuuuauccccuucacuuagacagcaccugau

SEQ ID NO: 24910 - RNA, 46 nt, Mus musculus
aagaagucaagguuauccucagguuuguagcaaguuccagaccagc

SEQ ID NO: 24911 - RNA, 46 nt, Mus musculus
ucuguaccucagggauguacccugacucagagcauccccccuacuu

SEQ ID NO: 24912 - RNA, 39 nt, Mus musculus
uugcauuuauuuaauuuacauguacauauaugagugaga

SEQ ID NO: 24913 - RNA, 46 nt, Mus musculus
aacuagaaaggauucccauuuuauauacucaguuugguuacuagau

SEQ ID NO: 24914 - RNA, 47 nt, Mus musculus
caaguucuccaaccucucagaaucugaguccccauccugaaagugga

SEQ ID NO: 24915 - RNA, 34 nt, Mus musculus
aaucugaugauccugaaaaaaagaaacugcagaa

SEQ ID NO: 24916 - RNA, 46 nt, Mus musculus
cauuguuuucaaaagcuguaguguauuuugugauaagccauuauug

SEQ ID NO: 24917 - RNA, 46 nt, Mus musculus
caucacuaagagaaauaaauacccaggauuccauuuggggacagag

SEQ ID NO: 24918 - RNA, 46 nt, Mus musculus
gaguuuuauauucucuguugaaauacugagaauuuagguuagguua

SEQ ID NO: 24919 - RNA, 41 nt, Mus musculus
aaguaauugggaaaacaccacagucaugacgccagcacacc

SEQ ID NO: 24920 - RNA, 66 nt, Mus musculus
agcaaaguaucagggccaaguguacagaauaucucgauagagcagaaaaacuaaaggaauaucuga

SEQ ID NO: 24921 - RNA, 45 nt, Mus musculus
auuaugauauaauauaacuuaaaauaucuacuauuuugcugugag

SEQ ID NO: 24922 - RNA, 47 nt, Mus musculus
uuuaauauaaaaaaaauuacaauguugguaguccacauaauguagac

SEQ ID NO: 24923 - RNA, 42 nt, Mus musculus
cugugauccagcucauugucaaguugaaguucaugcccagaa

SEQ ID NO: 24924 - RNA, 46 nt, Mus musculus
uuccuugucuaaucucgucaaugagaacacccugaagaccauagaa

SEQ ID NO: 24925 - RNA, 81 nt, Mus musculus
caccccagaaacucacgacuuuagccaacggagaagcagcaccaacaccaccuccuaauucagaaguaaaaaagaaaaaga

SEQ ID NO: 24926 - RNA, 45 nt, Mus musculus
ugaggagaccuuggaaaaugccaaaguuaaaaagucaccccuaua

SEQ ID NO: 24927 - RNA, 45 nt, Mus musculus
cucaaacugcgagucuuccugcggguucaaugccagacucggcuu

SEQ ID NO: 24928 - RNA, 45 nt, Mus musculus
aacguguggcugugcccuguaagcacauccagcccucggccuguc

SEQ ID NO: 24929 - RNA, 46 nt, Mus musculus
guaguuauccauuguuucugcaacuaucuuggcaacauccucagac

SEQ ID NO: 24930 - RNA, 52 nt, Mus musculus
ccuuccuucuuuucuuuuuuaaacacagggacucacauagccuaagcuggcc

SEQ ID NO: 24931 - RNA, 47 nt, Mus musculus
aaucucuaugagcgacagcaauguucuuuggcuuagguaggaccugc

SEQ ID NO: 24932 - RNA, 45 nt, Mus musculus
ccucuccaaaaacgucgguguacaaacuggugugggacccugaaa

SEQ ID NO: 24933 - RNA, 41 nt, Mus musculus
auguuggggucuuuugugugucuucuuucacugggggcaca

SEQ ID NO: 24934 - RNA, 45 nt, Mus musculus
agggcaacaguacacacgcggcuacuuuaaucuuuaaauguuuag

SEQ ID NO: 24935 - RNA, 46 nt, Mus musculus
auguaaguuaauaacccaggcacaguuacuuuuaaauuagagagag

SEQ ID NO: 24936 - RNA, 46 nt, Mus musculus
ugggaagaugcgacaggaugaccccccugaggcucacuggcuaggc

SEQ ID NO: 24937 - RNA, 45 nt, Mus musculus
gugcucuuacccgcugagccaucucaccagcccccugguucaguu

SEQ ID NO: 24938 - RNA, 46 nt, Mus musculus
auuucuucccucucaauauuaagcaagaaucgggaaggggcuaggg

SEQ ID NO: 24939 - RNA, 46 nt, Mus musculus
cacagcggaggggcauggcaaacacaaccaaagaaagccuuaagau

SEQ ID NO: 24940 - RNA, 48 nt, Mus musculus
cuuugucucaaaauaucaaaaaacaagaaugcauaaccaaaaauaucu

SEQ ID NO: 24941 - RNA, 46 nt, Mus musculus
aaguuaauaaagguagguccugguuagugguuggguagagguaggc

SEQ ID NO: 24942 - RNA, 46 nt, Mus musculus
uguaagauugucuccaaaaagaaagagaaagaaagaaagaaagaaa

SEQ ID NO: 24943 - RNA, 42 nt, Mus musculus
cccagcaaccacauggcggcucacaaccauccguaaugagau

SEQ ID NO: 24944 - RNA, 25 nt, Mus musculus
ccagugagcuggagggauucacuug

SEQ ID NO: 24945 - RNA, 47 nt, Mus musculus
ugugugcugcauauguguauagguuacugggaaggucggugugaggg

SEQ ID NO: 24946 - RNA, 42 nt, Mus musculus
agaaaaagaaaaagaaaaagaaaaaagaaaaaaaaaggagag

SEQ ID NO: 24947 - RNA, 42 nt, Mus musculus
ugcuggacagaagguacaguuggaacuuccagguccccagag

SEQ ID NO: 24948 - RNA, 29 nt, Mus musculus
aauuaauaauuccuuaguagacuaggaga

SEQ ID NO: 24949 - RNA, 46 nt, Mus musculus
aaccuuccucucaaacauacaugccuaggacgaucuccagccaccc

SEQ ID NO: 24950 - RNA, 26 nt, Mus musculus
caaaaacaaacaaaaauggggaagaa

SEQ ID NO: 24951 - RNA, 41 nt, Mus musculus
acaacacaugucuuccauacugguccugaggaggcagagac

SEQ ID NO: 24952 - RNA, 46 nt, Mus musculus
guugaugugagaagacaggagccaugcccaaaaugagccacuagau

SEQ ID NO: 24953 - RNA, 40 nt, Mus musculus
aguuuauuuuuuauuauaugaguauauaugguguguguau

SEQ ID NO: 24954 - RNA, 45 nt, Mus musculus
cacagacuaucuccuuuaauugagagcugaaauaaguccucccuu

SEQ ID NO: 24955 - RNA, 46 nt, Mus musculus
aaaugucuguuauuguagggcuuguugcuaguuccuuauuauagag

SEQ ID NO: 24956 - RNA, 45 nt, Mus musculus
ugaguaauucagagcugaagguuuccaaauugauucggguugagu

SEQ ID NO: 24957 - RNA, 48 nt, Mus musculus
cacaaccauccguaaaaagaucugacucccucuucuggagugucugaa

SEQ ID NO: 24958 - RNA, 42 nt, Mus musculus
ggugcaccuuucacagccagggauccauggggcaggggacag

SEQ ID NO: 24959 - RNA, 45 nt, Mus musculus
ccagugacucaagaaaaagaagcaggaaucagggugacauaagag

SEQ ID NO: 24960 - RNA, 45 nt, Mus musculus
gaagucaguauuaggaggagaacuguguguggagcccuugugaga

SEQ ID NO: 24961 - RNA, 45 nt, Mus musculus
aucuaccaugucaaugcagagacucugggcuugaauguagcagau

SEQ ID NO: 24962 - RNA, 46 nt, Mus musculus
gucccaguuggugauguagucugcugagguuauggggcuuuuagag

SEQ ID NO: 24963 - RNA, 46 nt, Mus musculus
aagagaucagcaauggucccgccgugcucacaaagauccaggaauc

SEQ ID NO: 24964 - RNA, 46 nt, Mus musculus
aagcugcccagaaaucacaaccacacaggaagggucuagcauauau

SEQ ID NO: 24965 - RNA, 42 nt, Mus musculus
caggagccagucuuuucuuucuuccuucuuucccucucguug

SEQ ID NO: 24966 - RNA, 24 nt, Mus musculus
agugcccugguccagcagcggcag

SEQ ID NO: 24967 - RNA, 84 nt, Mus musculus
uuccaucuggcugcagcagcuucaauggagucuccgggauuaaaaaaaaaagagaaaaaaaagaaaaagaaaaagaaaaagaaa

SEQ ID NO: 24968 - RNA, 42 nt, Mus musculus
auuucauguuuaggugccgaaugugaaucuggguggggagag

SEQ ID NO: 24969 - RNA, 46 nt, Mus musculus
uccccauucgcucuccacaacugcauucacuaucacuucuugagau

SEQ ID NO: 24970 - RNA, 80 nt, Mus musculus
cacuucuagguauucuuugaucugaugagagaaauccgggcaaaaaagaugucagaaaacaaggacaagaacggcaggaa

SEQ ID NO: 24971 - RNA, 43 nt, Mus musculus
ggaggcaggugccuguggacgaggcccgaggcaaagcggagga

SEQ ID NO: 24972 - RNA, 48 nt, Mus musculus
ccuggacaccgcuggccaggaggacuaugcggccauccgugacaacua

SEQ ID NO: 24973 - RNA, 46 nt, Mus musculus
uuuguagaagacuaugagcccaccaaagcugacaguuacagaaaga

SEQ ID NO: 24974 - RNA, 24 nt, Mus musculus
cuagauguggggagagucagagga

SEQ ID NO: 24975 - RNA, 46 nt, Mus musculus
caccuguccagcccugaaagcauuaaguuuuacugaaguccgguuu

SEQ ID NO: 24976 - RNA, 42 nt, Mus musculus
ucaugguuggcaguggaggggucggcaaaucagcccugacgc

SEQ ID NO: 24977 - RNA, 39 nt, Mus musculus
cgggagugucagaggagaucagaaaaaaugugcugagau

SEQ ID NO: 24978 - RNA, 86 nt, Mus musculus
aggggucuggcagcuguggcugguuguucuaaccugguuguggcagagaaaauggaagauggguagagggaaaagguccauuagag

SEQ ID NO: 24979 - RNA, 45 nt, Mus musculus
aggaacuuguacuuugggugaccugggagcuggguucaagaaguu

SEQ ID NO: 24980 - RNA, 73 nt, Mus musculus
uaaccaagaugacaucuucuuaugggcagaggagaaauuacuaaccauagacacaccaaaaauagcucaagau

SEQ ID NO: 24981 - RNA, 42 nt, Mus musculus
agcuugugucauguuaaccacaacagaaucugaccggcagca

SEQ ID NO: 24982 - RNA, 46 nt, Mus musculus
acccaaaaaaaaaaaaagauaauguuaaaguaguacccacccauca

SEQ ID NO: 24983 - RNA, 46 nt, Mus musculus
gcuuacagcuuccaagcuaaaaggaaaagaaaaauacuuggcagaa

SEQ ID NO: 24984 - RNA, 41 nt, Mus musculus
gagggcugcugcuccccaccuguaacuggauugccccacac

SEQ ID NO: 24985 - RNA, 46 nt, Mus musculus
cccacuaugacuguagugguguuucucuuaugaacuugggugcccu

SEQ ID NO: 24986 - RNA, 46 nt, Mus musculus
acgauauuuaacaucuaccauuuucuguugaguuuaucuggcugac

SEQ ID NO: 24987 - RNA, 45 nt, Mus musculus
aaacaugggaaucuuaaucuucuaaugucauccucaauggucuca

SEQ ID NO: 24988 - RNA, 46 nt, Mus musculus
ugacccccccuguggaccacagcuucuguauaauaaaccuaaggaa

SEQ ID NO: 24989 - RNA, 45 nt, Mus musculus
caugcacagaaaauaaaaauaaaucacagggaaaaaauaucaggu

SEQ ID NO: 24990 - RNA, 46 nt, Mus musculus
uauuuaaauagccauuaacagacucuccaagaagacuucucaagaa

SEQ ID NO: 24991 - RNA, 44 nt, Mus musculus
cugaaccuaacuaaccgccaugauaggccuagggcaguguccag

SEQ ID NO: 24992 - RNA, 28 nt, Mus musculus
cggcuagugagggccuuuuguuuuaaga

SEQ ID NO: 24993 - RNA, 41 nt, Mus musculus
acagcuugccccuaagcguugauuugcucaacagcccagac

SEQ ID NO: 24994 - RNA, 44 nt, Mus musculus
guaaguggugugguaaaucuccucccaaauaugcccuggcaaug

SEQ ID NO: 24995 - RNA, 42 nt, Mus musculus
aacucuuugggcuauuugacauaaauuacgugaaucacaggu

SEQ ID NO: 24996 - RNA, 41 nt, Mus musculus
aacaucagcggacuguacaugcagauaacauuuaacuuagg

SEQ ID NO: 24997 - RNA, 46 nt, Mus musculus
cacucagaccuuaaagcucauagaguccauuccagcagcaccaggc

SEQ ID NO: 24998 - RNA, 46 nt, Mus musculus
uacugaguagucggagggguggugagccuaagauucugcagggacg

SEQ ID NO: 24999 - RNA, 46 nt, Mus musculus
uagacuuugaucuuaauuagcagaguuuucccacauuugaccgcau

SEQ ID NO: 25000 - RNA, 46 nt, Mus musculus
gggguguccacacagcaggcggaaggggaaggcacagcccagagag

SEQ ID NO: 25001 - RNA, 46 nt, Mus musculus
ucccauuuuccugcauaccuagaugccacuggcuuagugcugggag

SEQ ID NO: 25002 - RNA, 45 nt, Mus musculus
ugagccacugggugagauuauauagacuucuaaaaacuucagaga

SEQ ID NO: 25003 - RNA, 45 nt, Mus musculus
uuacauauagacuaggaagucacuuuaaucaggauacuguagucu

SEQ ID NO: 25004 - RNA, 46 nt, Mus musculus
uccugagugaggagacugagcaagugccuuuguaccuggguuagag

SEQ ID NO: 25005 - RNA, 46 nt, Mus musculus
uucuguaagguguucugaaguacuaacuuuuaauuacagcacagug

SEQ ID NO: 25006 - RNA, 42 nt, Mus musculus
aaacagccugggacauggcauuugaccuuaaagaguagcaga

SEQ ID NO: 25007 - RNA, 46 nt, Mus musculus
ggaaaaacagaauaucagaccacaaaaacuaauaaagcaagaagau

SEQ ID NO: 25008 - RNA, 46 nt, Mus musculus
cagauuggauuuuaagaagaauaaguuaacucuagugguuguggaa

SEQ ID NO: 25009 - RNA, 67 nt, Mus musculus
ggucucugaguucagguuugugcccauccagacugaagagauggaacuggcuauuuuugagaaaugg

SEQ ID NO: 25010 - RNA, 45 nt, Mus musculus
cuuaaaaguugacauuuuaaaggaaaacuauaauuugagucuagg

SEQ ID NO: 25011 - RNA, 46 nt, Mus musculus
cuaccuuaccuggcuagaguccagcacaugcacacagccccccccc

SEQ ID NO: 25012 - RNA, 45 nt, Mus musculus
uaauaauuuucucccuuugucuuuccggagacucaugauacagau

SEQ ID NO: 25013 - RNA, 46 nt, Mus musculus
ccauuuauuuauuuuuauguaugugaguacacuguagcugucuuca

SEQ ID NO: 25014 - RNA, 46 nt, Mus musculus
caggcaugguggcacauaucuuuaaucucagaaggaaaaggcagaa

SEQ ID NO: 25015 - RNA, 46 nt, Mus musculus
acucagggucucugaaagagaagcaagugcucacaacugcugagau

SEQ ID NO: 25016 - RNA, 45 nt, Mus musculus
agaucuuggccgucauggcagugcuggcaauuaaauaugggaccu

SEQ ID NO: 25017 - RNA, 47 nt, Mus musculus
cuugaauucagagagagcugucugccuuugccuccaauauaccaaga

SEQ ID NO: 25018 - RNA, 45 nt, Mus musculus
auuguauaggauuauuuagaguaagauagacugaagucagaagag

SEQ ID NO: 25019 - RNA, 46 nt, Mus musculus
aauauuuauucuuuaauaauuggaauuggaucuuuugcaagcagau

SEQ ID NO: 25020 - RNA, 46 nt, Mus musculus
aaucccagcaaccacaugguggcucacaaccaucugucaugugauu

SEQ ID NO: 25021 - RNA, 46 nt, Mus musculus
ggaagguuagcaaugugaaauaaguugguuugaaaagggcccaaau

SEQ ID NO: 25022 - RNA, 45 nt, Mus musculus
uuugaaacauaaagccccugaagcuauugguacuuugaggcagau

SEQ ID NO: 25023 - RNA, 42 nt, Mus musculus
aagagaaaaucauuuuuuccagugguuugccucugggcauag

SEQ ID NO: 25024 - RNA, 45 nt, Mus musculus
uagguagaaauuaacagagagaaccacaacuggacacugugcaga

SEQ ID NO: 25025 - RNA, 58 nt, Mus musculus
gaauuguuccuugggaauuggcuuuguauaugcagacagaggaaaaauauacuggcag

SEQ ID NO: 25026 - RNA, 105 nt, Mus musculus
agagucagcugucacagagcgggggaacagugcgaguggagaaaaggacugugguaggcaaguguguuugcuagucagguuuuagaaaguaaaaggaauuaucag

SEQ ID NO: 25027 - RNA, 138 nt, Mus musculus
uaaagcauugcagguaggaggagauguggcauugcagagaaaggaauguuuauuuagcacacgaagaugcugagggaaggaaggaggaugagcacuguuggaccaggucauaaucaugguguggaaaguccugagaga

SEQ ID NO: 25028 - RNA, 86 nt, Mus musculus
agccauggaauaugcaugaaaugacauuuuauuguaaguauagaugggagacuugauuuagaacagggggagaagcuagaaacuac

SEQ ID NO: 25029 - RNA, 42 nt, Mus musculus
gguugcuuggggcagguaccugggaacuagcagagaggugau

SEQ ID NO: 25030 - RNA, 46 nt, Mus musculus
uugcaaaccaauaaaagacaacccaauuuaaaaauaagcaaaagau

SEQ ID NO: 25031 - RNA, 46 nt, Mus musculus
cuuggguuguugaaggguaggcugugcuaagagaaccuguagagaa

SEQ ID NO: 25032 - RNA, 46 nt, Mus musculus
uaaauauuuaguggaaagccugagauugcuguaugagagccuggaa

SEQ ID NO: 25033 - RNA, 45 nt, Mus musculus
cuuuauguguacuuaguuaguguuuacuuuucucagccucuuagu

SEQ ID NO: 25034 - RNA, 45 nt, Mus musculus
uucuggaauuagacauuugagcugagcaaagcacuggagcugaga

SEQ ID NO: 25035 - RNA, 46 nt, Mus musculus
acuugguuccugucugugggaguggaagggaugauagucaguaaaa

SEQ ID NO: 25036 - RNA, 45 nt, Mus musculus
uugugagucucuuuuauuaucgucuuuuagaauuugugcauagau

SEQ ID NO: 25037 - RNA, 45 nt, Mus musculus
gccagcuagcucccggucgagugaaacuugggaagcguacgaggc

SEQ ID NO: 25038 - RNA, 46 nt, Mus musculus
auggccucucacacaaaaagugaagaacucaaaaagacgucaagaa

SEQ ID NO: 25039 - RNA, 45 nt, Mus musculus
uucucuucaaggcuaaaccauauuccauucuuuucuauaguagau

SEQ ID NO: 25040 - RNA, 45 nt, Mus musculus
ugugcauuucaguaguauugaguauaugaagguuguuggagaagu

SEQ ID NO: 25041 - RNA, 46 nt, Mus musculus
ugagagcaucgguuugaucuggcuuggguacuguguaugguucaag

SEQ ID NO: 25042 - RNA, 46 nt, Mus musculus
agcuguuauugugaucgauuuuucuuuuaugugugacuugugagau

SEQ ID NO: 25043 - RNA, 46 nt, Mus musculus
gcucacaaccauccauaaugagaucugaugcccucuucgguguguc

SEQ ID NO: 25044 - RNA, 46 nt, Mus musculus
aaaagaaaaauaucaacaaacaaauauagguagcuuucauauagau

SEQ ID NO: 25045 - RNA, 47 nt, Mus musculus
agcaaaaagcaaauauuaaccaaccaaaacaacaaccagcaaaauua

SEQ ID NO: 25046 - RNA, 45 nt, Mus musculus
auacagagaaacccugucucaaaaaaaccaaaauaaauaaauaaa

SEQ ID NO: 25047 - RNA, 45 nt, Mus musculus
acccugccuauaucuucaggaagaugacacuguuuaaccaagagg

SEQ ID NO: 25048 - RNA, 46 nt, Mus musculus
auaaacucuuaucaggauguagccaaacagauuguuuagagaaggu

SEQ ID NO: 25049 - RNA, 43 nt, Mus musculus
uaacagcuacuaaggaauauaugggguuuuuauggcacaguga

SEQ ID NO: 25050 - RNA, 64 nt, Mus musculus
agaaaguagauuaguagauaccuaaguccagguuugggaaagaggauggaaugggucagaaagc

SEQ ID NO: 25051 - RNA, 46 nt, Mus musculus
uacuuaagcugcuguguauguuuguacuuaaucuucagagccacca

SEQ ID NO: 25052 - RNA, 45 nt, Mus musculus
aggcucuagaaacugagcccuuaccaaauuauaagaaucaggaga

SEQ ID NO: 25053 - RNA, 44 nt, Mus musculus
aaaaauaguuggaaccaaauucauuuuucaaacucucagcaaga

SEQ ID NO: 25054 - RNA, 46 nt, Mus musculus
gaauguccuuguuuacauccuguguaggucgccauguuggugagau

SEQ ID NO: 25055 - RNA, 41 nt, Mus musculus
ccuauugacugucucccaagaucauuuucacggaugccagc

SEQ ID NO: 25056 - RNA, 45 nt, Mus musculus
aaagaaagaagaaagaaaagaaagaaagaaagaaagaaagaaaga

SEQ ID NO: 25057 - RNA, 46 nt, Mus musculus
aagaaguucuugucucuacugcuaagggaaagaauauaucaaaggu

SEQ ID NO: 25058 - RNA, 46 nt, Mus musculus
acacuaauuaguguuuuucguuucuuuuguauaacuguggccagau

SEQ ID NO: 25059 - RNA, 45 nt, Mus musculus
aucuuuaagaaagaacaugucuuagauuaagggguaaaagagaga

SEQ ID NO: 25060 - RNA, 45 nt, Mus musculus
aucacuaguaagccucagcccucacauucuuauucauccccaagg

SEQ ID NO: 25061 - RNA, 42 nt, Mus musculus
aucuccaucaucaacgcaagcuaauagcauaguucuggaguc

SEQ ID NO: 25062 - RNA, 46 nt, Mus musculus
cggaauucuucauucacacaagaggcaacccggguucggccgucuu

SEQ ID NO: 25063 - RNA, 46 nt, Mus musculus
gaaacacaaagccucccaucccggucuccaccuggaacucccaacc

SEQ ID NO: 25064 - RNA, 46 nt, Mus musculus
ucccaacaugaaaauuauucccuguuucuaccaauuagugauagau

SEQ ID NO: 25065 - RNA, 46 nt, Mus musculus
uucuuggcaccuacaugguaguacacaacugcauauaacuccagau

SEQ ID NO: 25066 - RNA, 63 nt, Mus musculus
gaacugaaguccagucaguucaauauggcaaagaaaaggcaaauaaagacaggguauuugcaa

SEQ ID NO: 25067 - RNA, 45 nt, Mus musculus
caaaacugucuguaaauccagucccaggggaucugaugcccucac

SEQ ID NO: 25068 - RNA, 50 nt, Mus musculus
uguuuuguuuuguuuuguuuuguuuucguuaccuuuagauuagaggucua

SEQ ID NO: 25069 - RNA, 46 nt, Mus musculus
accauuuuucguuugucuuuuggcuuaaaacaucuuggccaguuug

SEQ ID NO: 25070 - RNA, 45 nt, Mus musculus
ccuugagugcuuacagacuucuucagccugucaaccagaccugac

SEQ ID NO: 25071 - RNA, 45 nt, Mus musculus
cuuugggucccuuugucugcgugaacagggucucuagucgcaggu

SEQ ID NO: 25072 - RNA, 46 nt, Mus musculus
ggaaagcaaccuaaagagguguaauuccaccagagaacuccuagac

SEQ ID NO: 25073 - RNA, 45 nt, Mus musculus
cccaacuauucucaacaguacacaguacaaaacuuaugcaaagau

SEQ ID NO: 25074 - RNA, 50 nt, Mus musculus
uuaugggucauugugauguaaguuuugaaggccagaaugcagagaagugg

SEQ ID NO: 25075 - RNA, 45 nt, Mus musculus
acugugugguucuuaggccuguggaaauaguuugugggguuaagu

SEQ ID NO: 25076 - RNA, 46 nt, Mus musculus
uagaaggaauauaugccuaaugcuuccuuauuuucaucaccgggac

SEQ ID NO: 25077 - RNA, 46 nt, Mus musculus
auugggcaggcaaaaugcaugucuuaauuaaaaauaaagcagaggu

SEQ ID NO: 25078 - RNA, 46 nt, Mus musculus
aacaagcaagaguauuuucucagugucuuuuaaagguaagcaagau

SEQ ID NO: 25079 - RNA, 42 nt, Mus musculus
cauaaugaguacaggagccagcaggaaccaugacugggagag

SEQ ID NO: 25080 - RNA, 46 nt, Mus musculus
acguaccuuagaacucuauggaguugaauuucacuaugcaagggua

SEQ ID NO: 25081 - RNA, 46 nt, Mus musculus
uaacucauauuacuaaggauguuagcaguauauuugaaauagagua

SEQ ID NO: 25082 - RNA, 46 nt, Mus musculus
guagaauacccaagauacaauuugcaaaauacaggaaaagaagaag

SEQ ID NO: 25083 - RNA, 44 nt, Mus musculus
cagcccagggauggucccacccauaaagggccuuuccccuuuga

SEQ ID NO: 25084 - RNA, 45 nt, Mus musculus
aaucaggaacuauagaugugagcaucaacaacagaauacaagaga

SEQ ID NO: 25085 - RNA, 45 nt, Mus musculus
gauuuccuuuuuggugacccaagagaauuagaaaaauggcuaagu

SEQ ID NO: 25086 - RNA, 46 nt, Mus musculus
uccucaaaacuguggaacaucuaucuuuagcuuucuggcccagaau

SEQ ID NO: 25087 - RNA, 42 nt, Mus musculus
auggcccccauacauucauguguuugaaugcuuggcccauag

SEQ ID NO: 25088 - RNA, 42 nt, Mus musculus
cugaugaaagagcuuucuuaacuccaguggaaguggguaguu

SEQ ID NO: 25089 - RNA, 46 nt, Mus musculus
guggaugcucacagucagcuauuggauggaacaugggccccccaau

SEQ ID NO: 25090 - RNA, 46 nt, Mus musculus
guaacaaaaaguaagcaguugagaauugugcuugagcugucaggau

SEQ ID NO: 25091 - RNA, 42 nt, Mus musculus
uuaggauugauuacaggccaucaugacaggauaggcaaggca

SEQ ID NO: 25092 - RNA, 46 nt, Mus musculus
uugaugauaagaggacccuggaguacaggugccauguuugacagau

SEQ ID NO: 25093 - RNA, 46 nt, Mus musculus
uaagcuguauaagugcagauuacuauauuuggugaaaugcagaauu

SEQ ID NO: 25094 - RNA, 51 nt, Mus musculus
uauacaagguugguuuauggaacuauuucuuuugaaaacauuaucggagau

SEQ ID NO: 25095 - RNA, 42 nt, Mus musculus
gaagaaagagaagugguaauugggaaugaagaaaagugagug

SEQ ID NO: 25096 - RNA, 45 nt, Mus musculus
gaacuguuauuuauaccacacaacuuuauauuuaaauguuuagaa

SEQ ID NO: 25097 - RNA, 45 nt, Mus musculus
aauuaaauaaauuacaaguuccauuuauaaggcuguuuuaauaga

SEQ ID NO: 25098 - RNA, 46 nt, Mus musculus
ucuguuggauauagucuucaagcaucuugauuugacugagcgagac

SEQ ID NO: 25099 - RNA, 46 nt, Mus musculus
aacuuucuagucgaauuuuaacaaagaauaaaaggcaucgagagau

SEQ ID NO: 25100 - RNA, 44 nt, Mus musculus
ggaacuggaguuauaggugguugugagccaucaugugugugggg

SEQ ID NO: 25101 - RNA, 83 nt, Mus musculus
cacaacugccucugaguuuccuguuccaucuuucuuccaucacccaaggcuuuucuucuacucucaucucuacaccaccuucu

SEQ ID NO: 25102 - RNA, 46 nt, Mus musculus
uaggaugcaacucugagaauaacaaccacucacacagucgucaguu

SEQ ID NO: 25103 - RNA, 46 nt, Mus musculus
aacuuuuuuacugaugcuuugugaauuucacaucaugcacccuggu

SEQ ID NO: 25104 - RNA, 23 nt, Mus musculus
gaagcaguaaaacaacugccgac

SEQ ID NO: 25105 - RNA, 46 nt, Mus musculus
gacaaguaugggagggccacuggugaguuccaggcagcagcgagug

SEQ ID NO: 25106 - RNA, 46 nt, Mus musculus
ucuggagccagugggcagaggggagcugguguuguuggcggugggg

SEQ ID NO: 25107 - RNA, 44 nt, Mus musculus
ucaagacccuauagucuaaaguuagcuuuucuuucccguaagua

SEQ ID NO: 25108 - RNA, 65 nt, Mus musculus
guucugcugcacuagcuuggaaugagacuggggaauuuggauuuggaggggcugagggagaagug

SEQ ID NO: 25109 - RNA, 48 nt, Mus musculus
gagucgccucuggagucccacagaaugccugcuggaauugggucugau

SEQ ID NO: 25110 - RNA, 50 nt, Mus musculus
agaggucaccccaagaaggucggcuauggaugagauugguauauuggauu

SEQ ID NO: 25111 - RNA, 49 nt, Mus musculus
acacuuaggaauggggagaggcuaggggucugaaggaauuuggagagag

SEQ ID NO: 25112 - RNA, 45 nt, Mus musculus
gcacuauuaggagguguggccuuauuggaguaggugugucacugu

SEQ ID NO: 25113 - RNA, 46 nt, Mus musculus
uauguauguauguauguauguauguauguaugugucuuaguuaagg

SEQ ID NO: 25114 - RNA, 46 nt, Mus musculus
guuuguauguggauggguugggcaucaggguaacaguggcugagua

SEQ ID NO: 25115 - RNA, 46 nt, Mus musculus
gccaucuuuacuauguuaauccuacugaccaaugaacaugggagau

SEQ ID NO: 25116 - RNA, 61 nt, Mus musculus
guugcaaugucucucacucucuguuauugucuagcugugaguuuguuuguuuguuaaucau

SEQ ID NO: 25117 - RNA, 46 nt, Mus musculus
cagaucuguacaggcccuaagcaugcugccuuugucucugugaguu

SEQ ID NO: 25118 - RNA, 46 nt, Mus musculus
ucuacaauauaauauaugcuuacugggcuaggaauacuggggaguc

SEQ ID NO: 25119 - RNA, 46 nt, Mus musculus
gcccccuguaauucccucccccaacuuccaacacauaggagcagug

SEQ ID NO: 25120 - RNA, 46 nt, Mus musculus
gcuacuugguucagauuucaaauaauauaaaaaggucuguguagag

SEQ ID NO: 25121 - RNA, 55 nt, Mus musculus
uauuacuagacaaauuucuuuaagaaauugagaaggccuagaucagauuaggaga

SEQ ID NO: 25122 - RNA, 42 nt, Mus musculus
uaagaaagucugcuuauugaguaaaagguaaaguagagaguu

SEQ ID NO: 25123 - RNA, 46 nt, Mus musculus
aaccauguggucuuaaucaucauugaaagauuaagaguucuuagau

SEQ ID NO: 25124 - RNA, 42 nt, Mus musculus
cucuauacuauauguauacacaagauuagccuggggcauuug

SEQ ID NO: 25125 - RNA, 46 nt, Mus musculus
uaguugacacauaugggggaaguauuuuuucccuucucugguagau

SEQ ID NO: 25126 - RNA, 46 nt, Mus musculus
ccuuugaaugagaauuagguguagucauaaaauauaagggauguuu

SEQ ID NO: 25127 - RNA, 46 nt, Mus musculus
aauuuacuggcucaguagaagccuuaaagauuaauuucuggaaguu

SEQ ID NO: 25128 - RNA, 45 nt, Mus musculus
acaagaaaagcuaauguaucugacuuguaaagucagacuagaaga

SEQ ID NO: 25129 - RNA, 46 nt, Mus musculus
cauuuuuguuucggugucaauguuuguuuuauaguuacuuacagga

SEQ ID NO: 25130 - RNA, 42 nt, Mus musculus
augauguuuagauucagcgugaguauguagucaagaacagau

SEQ ID NO: 25131 - RNA, 41 nt, Mus musculus
cuggugacaccuugaagaaggugucauggaagaggguacaa

SEQ ID NO: 25132 - RNA, 46 nt, Mus musculus
ccucaacuaugaaguggggaggacugauuguaggguuguaugagau

SEQ ID NO: 25133 - RNA, 46 nt, Mus musculus
gaacuugagaugaaucucuuagugugguugcacccacagcccaggg

SEQ ID NO: 25134 - RNA, 46 nt, Mus musculus
ucugggaagaggugaaaugagauuugaaccccaaacaggccugcac

SEQ ID NO: 25135 - RNA, 24 nt, Mus musculus
ccucuguggagggcugcagccuuu

SEQ ID NO: 25136 - RNA, 44 nt, Mus musculus
gaggaccagccaugaguacugccucugcugauagacuggccaag

SEQ ID NO: 25137 - RNA, 45 nt, Mus musculus
cgacaccucaggcuucacagaaucagcuuucccauuggcagccag

SEQ ID NO: 25138 - RNA, 44 nt, Mus musculus
uuuguuuacaguaguacauugcuaaucaaacgcuucgcggagau

SEQ ID NO: 25139 - RNA, 47 nt, Mus musculus
cuuccaaggaaagugccaugaagaccuauguggaaaagguagacgag

SEQ ID NO: 25140 - RNA, 91 nt, Mus musculus
aagggcacaugaaaaggggggaugagguaaugcaggccagugaauggaacuauuauuugcaaaagcacaaucauccaagaaguguccagga

SEQ ID NO: 25141 - RNA, 46 nt, Mus musculus
guccacaccuuucucuccccaacaaggccaggcagugaccccuuag

SEQ ID NO: 25142 - RNA, 42 nt, Mus musculus
ggccgcugagaaacagacuggggagugauaccgucgccaugg

SEQ ID NO: 25143 - RNA, 42 nt, Mus musculus
gggcaaagccaagugggacucguggaacaagcugaaagguaa

SEQ ID NO: 25144 - RNA, 46 nt, Mus musculus
accacguuuccccuuacugcccagucaaucuccgcugaucauaggu

SEQ ID NO: 25145 - RNA, 42 nt, Mus musculus
gucggggaagguauuuagucuugugccuggccugccccugua

SEQ ID NO: 25146 - RNA, 43 nt, Mus musculus
gggugaagcaggaacaggguccucgaaagaaagauggggcgua

SEQ ID NO: 25147 - RNA, 44 nt, Mus musculus
ggcacaguguccuaguaagaggaaacuugucaagguccuguagu

SEQ ID NO: 25148 - RNA, 46 nt, Mus musculus
agaagucagacauggugacauauggcucugauuguagcacucaggu

SEQ ID NO: 25149 - RNA, 42 nt, Mus musculus
ggugacaguccccugccucuguaagacccuucucugggagag

SEQ ID NO: 25150 - RNA, 42 nt, Mus musculus
ccggaguuugagcaguccaaaaggaagaauccagccauguac

SEQ ID NO: 25151 - RNA, 24 nt, Mus musculus
caccacagcgcugagccagcuucc

SEQ ID NO: 25152 - RNA, 42 nt, Mus musculus
gagaggcggugguggcggauucggcuaccagaaaacaaagaa

SEQ ID NO: 25153 - RNA, 45 nt, Mus musculus
acaucuacagguaaguguuaaggaggccaagcaacagagagcacc

SEQ ID NO: 25154 - RNA, 47 nt, Mus musculus
aaaacugaucgaaaagaacuacuuucuccacaagucugcccaggaag

SEQ ID NO: 25155 - RNA, 46 nt, Mus musculus
gagguggucaucccaggcauggaaguacauacuuauaaccccagca

SEQ ID NO: 25156 - RNA, 46 nt, Mus musculus
cuuuacacagcugggaaaacagauagaaccuguguuugugcuacag

SEQ ID NO: 25157 - RNA, 46 nt, Mus musculus
cggcaggaggcugaggccgaagcagagcuucauagggagacuugag

SEQ ID NO: 25158 - RNA, 79 nt, Mus musculus
ggaauacauucaucguguugguagaacagccaggggccugaauggaagagggcacgcccugcucauccugcgcccugaa

SEQ ID NO: 25159 - RNA, 46 nt, Mus musculus
uggacuggauuguucaguacgacccucccgaugaccccaagguaac

SEQ ID NO: 25160 - RNA, 45 nt, Mus musculus
ucacuccugguuuuguucacuucuugaaucacacaaagacaugaa

SEQ ID NO: 25161 - RNA, 45 nt, Mus musculus
cccagaugaugaguggggcuacauggaucugaagauaccagagau

SEQ ID NO: 25162 - RNA, 45 nt, Mus musculus
uugagaaacugugugugugugugugugugugugugugugugugug

SEQ ID NO: 25163 - RNA, 42 nt, Mus musculus
agaauuucucugaaaaaggagccuuuguacguggguguugau

SEQ ID NO: 25164 - RNA, 46 nt, Mus musculus
auuuuacuauggccacaugaggaaugugggccuguugacuucagaa

SEQ ID NO: 25165 - RNA, 42 nt, Mus musculus
cugugaucgagcucauugucaaguugaaguucaugcccagga

SEQ ID NO: 25166 - RNA, 46 nt, Mus musculus
uuccuugucuaaucucgucaaugagaacacccugaaggccauagaa

SEQ ID NO: 25167 - RNA, 45 nt, Mus musculus
gcagcaagugcucuuaaucucuaggccaucucuccagccccagug

SEQ ID NO: 25168 - RNA, 46 nt, Mus musculus
agcgaaaacugaagaaagugcugaggcuugugaggaaccagaagau

SEQ ID NO: 25169 - RNA, 46 nt, Mus musculus
uuuauacccccaaaguuuaaauauuaaacaagccucucccugaaaa

SEQ ID NO: 25170 - RNA, 58 nt, Mus musculus
uagccaacggagaagcagcaccaacaccaccuccugauucagaaguaaaaaagaaaaa

SEQ ID NO: 25171 - RNA, 57 nt, Mus musculus
cugaggagaccuuggaaaauggcaaaguuaaaaagucaccccagaaacucacaacuu

SEQ ID NO: 25172 - RNA, 46 nt, Mus musculus
aggguucugccuaacauaugaagaggaucgcugcaggaaugaaaag

SEQ ID NO: 25173 - RNA, 46 nt, Mus musculus
agaaaguuggggaagaaaguccgaggccucccgcuuucacccugag

SEQ ID NO: 25174 - RNA, 45 nt, Mus musculus
ccugcgcaggaguuucaucuguaacugcgacaucuugccaggccg

SEQ ID NO: 25175 - RNA, 45 nt, Mus musculus
uggcaagaugucgcaguuacagaugaaacuccugcgcaggaagau

SEQ ID NO: 25176 - RNA, 45 nt, Mus musculus
gaccccaguccauccucaggggucugacuugagauucaaauuuga

SEQ ID NO: 25177 - RNA, 24 nt, Mus musculus
accacaccggaguugagaggcucc

SEQ ID NO: 25178 - RNA, 48 nt, Mus musculus
ggggagggagagggagagagggagagagagagaggagagagagagaga

SEQ ID NO: 25179 - RNA, 45 nt, Mus musculus
cuucagccuggcaucuacaguucucuucaaaucucuuugcaaacg

SEQ ID NO: 25180 - RNA, 46 nt, Mus musculus
ugggguuucacaccuuuaaucuagcgcacuggggaggcagagggag

SEQ ID NO: 25181 - RNA, 77 nt, Mus musculus
ucucgcagcaguugcugaauaaaauauguuauaucucuuccugcgauuggaauguguuuaauacagcugccgauaac

SEQ ID NO: 25182 - RNA, 41 nt, Mus musculus
cuguugaugcucuuaagaucuucgagauccucaugcaguca

SEQ ID NO: 25183 - RNA, 70 nt, Mus musculus
gucuauuacuguacccgucagcguccgcucuccuacuugucuugagguccaggaugcagcuaaggcaaga

SEQ ID NO: 25184 - RNA, 68 nt, Mus musculus
gccuggaacauugaaggauucaaacauuauuucagcaguauauucccuguuuucuggaguauucagug

SEQ ID NO: 25185 - RNA, 41 nt, Mus musculus
ugaggaaaauaccuaauuuaaaaaaaaggaaaaaaaaaaga

SEQ ID NO: 25186 - RNA, 58 nt, Mus musculus
uuuaaaaaucacuugcuccauaaaccuuuccauuaagucccagucuucaacuauacca

SEQ ID NO: 25187 - RNA, 44 nt, Mus musculus
gccuuucaucacccuccucugggcuuggucacccacuuuugcag

SEQ ID NO: 25188 - RNA, 24 nt, Mus musculus
aaaacaaaaaagagggggcugaag

SEQ ID NO: 25189 - RNA, 45 nt, Mus musculus
cuuucuuauagaacccaggaccaccagcccuggggacagcaccau

SEQ ID NO: 25190 - RNA, 49 nt, Mus musculus
cugccguccguuccgugcugcugagaggccggggagcuagagaugggag

SEQ ID NO: 25191 - RNA, 62 nt, Mus musculus
cuggcugaccaugcaccggcccgggccgcccucggucgggagggagggaggaagggagggag

SEQ ID NO: 25192 - RNA, 45 nt, Mus musculus
ucuucccccucgcacugccuuuccgcggggagccaagauggccgc

SEQ ID NO: 25193 - RNA, 44 nt, Mus musculus
gagucacauuuuguugggaucagaucugagugaucucggcucca

SEQ ID NO: 25194 - RNA, 46 nt, Mus musculus
aaggaauuaagaccagccugagcaaucuaagagguacugccuuaag

SEQ ID NO: 25195 - RNA, 46 nt, Mus musculus
cuuccagaagacccagauucaauucucagcacccacauggcagcuc

SEQ ID NO: 25196 - RNA, 46 nt, Mus musculus
cacuaucuuguacaagagucuccugauaaagaaagaaaggaugaag

SEQ ID NO: 25197 - RNA, 45 nt, Mus musculus
uuagaguuaggcugcuagagcugagaauguuucagauccguguaa

SEQ ID NO: 25198 - RNA, 46 nt, Mus musculus
ugcuauguaugaauaacgacuuuccuccaagagcacauugccuggu

SEQ ID NO: 25199 - RNA, 46 nt, Mus musculus
ucuuucauuuaaaaagcaauauuucaaaacacuuaaagugagccag

SEQ ID NO: 25200 - RNA, 45 nt, Mus musculus
acuuacauauaauaaauaaauaaaucuuuaaaaaaaaaaaguuug

SEQ ID NO: 25201 - RNA, 45 nt, Mus musculus
ugccuccacagggugacuccugauuucaugugucagagaguggag

SEQ ID NO: 25202 - RNA, 46 nt, Mus musculus
gacuuggcaacuaaaugagaaaauauuguuguagauaccauagcaa

SEQ ID NO: 25203 - RNA, 68 nt, Mus musculus
gugaguuuguggugauugcuccugcugcacacagugaugcaguucucagugaauccaaguguaaccuc

SEQ ID NO: 25204 - RNA, 46 nt, Mus musculus
acaagucaugugaguguugauuauauucauuuuccaacuuugcaag

SEQ ID NO: 25205 - RNA, 46 nt, Mus musculus
cuuggagaccacucugcaguccuuacuguagacaccaugcacucag

SEQ ID NO: 25206 - RNA, 42 nt, Mus musculus
guaaauaacuaaaagacccccucccccucucucugaagcgag

SEQ ID NO: 25207 - RNA, 43 nt, Mus musculus
ugauucuggggcuuggccuguguauaugaagggaaggcuggag

SEQ ID NO: 25208 - RNA, 46 nt, Mus musculus
acauuggaguucauuguguuaaggcuguacuucagugucccucaaa

SEQ ID NO: 25209 - RNA, 46 nt, Mus musculus
gagacaucuuugcaugacaugagguauauauuaaauagguaugcag

SEQ ID NO: 25210 - RNA, 45 nt, Mus musculus
augguucuuugguguguguguaugcauguuuuuauuauagcugag

SEQ ID NO: 25211 - RNA, 45 nt, Mus musculus
uccacauucagaagccuuuuacuauuugcguauuuguagugucag

SEQ ID NO: 25212 - RNA, 46 nt, Mus musculus
auuauauauaugaguacacugcuguagcugucuucagacacaccag

SEQ ID NO: 25213 - RNA, 42 nt, Mus musculus
ccaaaccacccuccaacaacuuuauuucuuuucucuggccuu

SEQ ID NO: 25214 - RNA, 46 nt, Mus musculus
aauucauaaauuaucaguuucaaauaugguacacacugcaaagaag

SEQ ID NO: 25215 - RNA, 101 nt, Mus musculus
uuuaaaauggucuuaugacaauagccuacaaaaaucuguacaguaagaaccagagaggacaaagaagaggguuaaggugggucccagguauaguguaauug

SEQ ID NO: 25216 - RNA, 42 nt, Mus musculus
gaggcagaggcagaggcacagagaggcagagagagagaggca

SEQ ID NO: 25217 - RNA, 45 nt, Mus musculus
gcagagaggcagagagagaggcagagaggcagagagagagaggca

SEQ ID NO: 25218 - RNA, 46 nt, Mus musculus
gcacagaaugcuuucaauuaugcugauauguagguauagaaaaaag

SEQ ID NO: 25219 - RNA, 54 nt, Mus musculus
gaaaacuggaggccagcugggccuggaccaucucagagauacagagaaggaaaa

SEQ ID NO: 25220 - RNA, 57 nt, Mus musculus
ggacuguuuuuauuucuucaaacauguuuuaaagccauuuuauaccauuagaacagc

SEQ ID NO: 25221 - RNA, 46 nt, Mus musculus
gugccacacacuaugaguaggugggggagauacaguauuuauuuag

SEQ ID NO: 25222 - RNA, 34 nt, Mus musculus
agaagccugggagacugcuaagccugugccagca

SEQ ID NO: 25223 - RNA, 46 nt, Mus musculus
agaaagucuggaaaacauuccuucuguuaagaagauuauaaagcag

SEQ ID NO: 25224 - RNA, 45 nt, Mus musculus
ccggucccugaaggccaaauuuggaacugagaagugugagcacga

SEQ ID NO: 25225 - RNA, 44 nt, Mus musculus
uuugucagcugccugcuggagcagccugagguaucagucacugg

SEQ ID NO: 25226 - RNA, 45 nt, Mus musculus
aagcugguagggacuuuuagcaauggccagagcuaugguauggaa

SEQ ID NO: 25227 - RNA, 97 nt, Mus musculus
gcuccugccgugggcaccugagacgcccuuguggaaccagcagcaggagucacaccagcauccagaagcauguccaguaccaagcuugagccagaug

SEQ ID NO: 25228 - RNA, 80 nt, Mus musculus
aagguagaguauccguuaacucacauucuggacacuugcugguagagccuuuagucccaggaucuguguuuuuaaacugc

SEQ ID NO: 25229 - RNA, 46 nt, Mus musculus
aguuagugagcuguggugugugugccgaggcugugagugggcugaa

SEQ ID NO: 25230 - RNA, 73 nt, Mus musculus
cgggaccucuccuuggugauuguaaauuauuuugggaccuaaaauucccacuugaauccaaaguaaaaaaugg

SEQ ID NO: 25231 - RNA, 64 nt, Mus musculus
uuauggugaaguguaaauuccgccugugugauuuuuaaaaauuaauagaccuacacaagcccug

SEQ ID NO: 25232 - RNA, 49 nt, Mus musculus
ugcagaugcgcggacauggcggcggcuccucucccuauggcggccggag

SEQ ID NO: 25233 - RNA, 46 nt, Mus musculus
ccggcuccacuccgacggucuugcggugaauuagcccguuguagcg

SEQ ID NO: 25234 - RNA, 46 nt, Mus musculus
gguacggggcgcagcacagaaguaccaugauacauuuuaggagggu

SEQ ID NO: 25235 - RNA, 44 nt, Mus musculus
uggaguacuggaauuaaagaccuacuuacacaucuacugcccag

SEQ ID NO: 25236 - RNA, 42 nt, Mus musculus
uuucaaaaguuugggagugguuguaggggggcuaugagggau

SEQ ID NO: 25237 - RNA, 46 nt, Mus musculus
cacacacacacacacacacacuaugacgucaggaagaaauuguuaa

SEQ ID NO: 25238 - RNA, 41 nt, Mus musculus
uuguuguuguuguuuuauaauuuuuuauuuauauggguggg

SEQ ID NO: 25239 - RNA, 46 nt, Mus musculus
ccaaguaggaaaccagucuggggcuauauagcaagagccugucuaa

SEQ ID NO: 25240 - RNA, 46 nt, Mus musculus
ccuuuaauuccagcauuuggaaggcagaggcagguagaucucugag

SEQ ID NO: 25241 - RNA, 45 nt, Mus musculus
gcucuuucgaagguccgaaguucaaaucccagcaaccacauggug

SEQ ID NO: 25242 - RNA, 46 nt, Mus musculus
cauauaauaaauaaauaaaucuuuaaaaaaaaaaagaaagaaaaau

SEQ ID NO: 25243 - RNA, 46 nt, Mus musculus
uguuacgauuaauuuauaauaugaugacauuauuaggagaugguaa

SEQ ID NO: 25244 - RNA, 45 nt, Mus musculus
aaguacacugucacugucuucagacacaccagaaguuggcaucag

SEQ ID NO: 25245 - RNA, 46 nt, Mus musculus
aagaauguugugaggaggacaguagauuaugaaaccgaaagacuag

SEQ ID NO: 25246 - RNA, 46 nt, Mus musculus
ugggcugggcuugggccaguguccccauauguacagaauugaauaa

SEQ ID NO: 25247 - RNA, 46 nt, Mus musculus
cagaauuguguuaguccugugcugguccugguuuggaauguaggga

SEQ ID NO: 25248 - RNA, 46 nt, Mus musculus
guauaguuuaauugccaaguuucauuaguuagauuccuguacugag

SEQ ID NO: 25249 - RNA, 45 nt, Mus musculus
cacagucccuccucccauaccucccuccuaagccuaguccugcag

SEQ ID NO: 25250 - RNA, 46 nt, Mus musculus
ccugccucugccucucaagugcuaagauuaaagaugugugccacug

SEQ ID NO: 25251 - RNA, 47 nt, Mus musculus
acaaaagaaauuuacuaaguauugacaacaaaaugagugagacaugg

SEQ ID NO: 25252 - RNA, 46 nt, Mus musculus
auguaaaugaaugccaguaagcauuuacuaaauauuaacagagcag

SEQ ID NO: 25253 - RNA, 46 nt, Mus musculus
acacaauugccuggcaugauuauaucuggguaagcacaaaagcaag

SEQ ID NO: 25254 - RNA, 47 nt, Mus musculus
ugaauguaaauguuugucacaggaagcacaaaauuauguccaagaac

SEQ ID NO: 25255 - RNA, 46 nt, Mus musculus
accuuggguuauuuuauuuuauuuuuguggaacaccacaaucucag

SEQ ID NO: 25256 - RNA, 85 nt, Mus musculus
aaaaucuuaucaaaucagaaaacuaugggaagauuucggcagagaagaaugaacauuguauugacaacaauauugauuugcaggu

SEQ ID NO: 25257 - RNA, 50 nt, Mus musculus
aguacauauuuacuagcuuacuuuuucguuaccaggacagcuugccgagc

SEQ ID NO: 25258 - RNA, 52 nt, Mus musculus
aauuaucagugcuguaauuauuaaaaccucuuagaggagagagaaaaagggu

SEQ ID NO: 25259 - RNA, 50 nt, Mus musculus
cuggcagaacuagcccucuagagguuuaucaguccaucagccauuucuga

SEQ ID NO: 25260 - RNA, 46 nt, Mus musculus
auauuuuauaaccaaccauuuagaagucuuuuaaucccaagcaaag

SEQ ID NO: 25261 - RNA, 93 nt, Mus musculus
ggaccugaguucaugucuccagcaccauuauaaaagccaaauguggaagcaugugucuguauaucggguguuuaggcaguguggaaguagaga

SEQ ID NO: 25262 - RNA, 46 nt, Mus musculus
acucccuagaagcccgaauaaaucaaccaucacuacagacuggaaa

SEQ ID NO: 25263 - RNA, 46 nt, Mus musculus
cuuugggucauauccagauaugguauuaacauuuauaagcauggag

SEQ ID NO: 25264 - RNA, 45 nt, Mus musculus
cuuagaugugacuuacagagaguaaaauguccacuuggcuauggu

SEQ ID NO: 25265 - RNA, 45 nt, Mus musculus
gucuggccccugccuugugaggaggagcuugauuugaaaugacag

SEQ ID NO: 25266 - RNA, 46 nt, Mus musculus
ccacaaagcaaaacaaaaauuauuccaagacuugguggaacuggag

SEQ ID NO: 25267 - RNA, 46 nt, Mus musculus
ugucuuggaacucguucuguugaccaggcuggccucauacuccaag

SEQ ID NO: 25268 - RNA, 45 nt, Mus musculus
auucugccacugagcaauauccacagccccugaaauuucaacuca

SEQ ID NO: 25269 - RNA, 45 nt, Mus musculus
ugugugugguggggaguuguuuaguagcacuggugcuggcagcaa

SEQ ID NO: 25270 - RNA, 46 nt, Mus musculus
caaaagaugaaacagauaaagaaaaagccagugauaaguuacccag

SEQ ID NO: 25271 - RNA, 23 nt, Mus musculus
guauuaugaggauaaaggcaaua

SEQ ID NO: 25272 - RNA, 46 nt, Mus musculus
caaucccagguaaaaaauaaauuuauaagguuuacauugugucuag

SEQ ID NO: 25273 - RNA, 54 nt, Mus musculus
gucucuuuuacuacauauuagaaagaaaacaaggagggguauaugagaagguuu

SEQ ID NO: 25274 - RNA, 34 nt, Mus musculus
gggagaaagagggagagaagggguggggggagag

SEQ ID NO: 25275 - RNA, 46 nt, Mus musculus
ugguaggcaacccgaaggaccauuuuuuuguuuucuguuugcugaa

SEQ ID NO: 25276 - RNA, 46 nt, Mus musculus
gaaauauuauagugaauagaaaguagaaugaguaaauuaagaccuu

SEQ ID NO: 25277 - RNA, 46 nt, Mus musculus
uauaaaaggauguucuagguaaacaacuuaaauaauaacagaacaa

SEQ ID NO: 25278 - RNA, 46 nt, Mus musculus
acuuaacgcuuaggacuucauauauucuauauauucuagccccaag

SEQ ID NO: 25279 - RNA, 45 nt, Mus musculus
gucauaacaaaaggaaaauaaauauugugaggaagucauuuagag

SEQ ID NO: 25280 - RNA, 46 nt, Mus musculus
aaaaaaacauuuuaaaaacuuagggccacucauauuacucagccaa

SEQ ID NO: 25281 - RNA, 46 nt, Mus musculus
uuaacauaauuauuugaaauauuuuucauacuauuccugucacuag

SEQ ID NO: 25282 - RNA, 46 nt, Mus musculus
ucauuuauuuauauuuuaaacguguucuucauuugucuggggguuu

SEQ ID NO: 25283 - RNA, 46 nt, Mus musculus
uaaauguuuuugcuugcauauacauucaugcuccauaugacugcag

SEQ ID NO: 25284 - RNA, 76 nt, Mus musculus
gaaguccaguuguguacaauccuccuaugacucaacagccaguucgaacccaagugccugguccuccacagccacc

SEQ ID NO: 25285 - RNA, 46 nt, Mus musculus
gucuuaggaauaauuuugccuaucgauucucaggccugugguuaag

SEQ ID NO: 25286 - RNA, 46 nt, Mus musculus
uuaacuuaaacauuuaaaaacaaaaaaacaaaaacauugcagcuag

SEQ ID NO: 25287 - RNA, 32 nt, Mus musculus
ggauucauuggugaauauacaguuuaaccaaa

SEQ ID NO: 25288 - RNA, 97 nt, Mus musculus
uuguauauguagauaugugaugauguguguuuguauauguagauaugugaugauguguguuuguauauguagauaugugaugauguguguuuguaua

SEQ ID NO: 25289 - RNA, 41 nt, Mus musculus
cacacacacacacaccaugugauuaugugaugccuguggag

SEQ ID NO: 25290 - RNA, 46 nt, Mus musculus
uuauaauuuaguaguauagagcaacuuaaacauaggacggccccau

SEQ ID NO: 25291 - RNA, 46 nt, Mus musculus
cucugcaguccucuucucagccuguucagugcucuccagcccccua

SEQ ID NO: 25292 - RNA, 92 nt, Mus musculus
cuacguguaauggcacauuacuuuaaugucaacacucaagaggcagaugcagguggaucucgagucaguagucagccuaaacagaauuccag

SEQ ID NO: 25293 - RNA, 42 nt, Mus musculus
uagguuuccuguuaccuuuaucuucaaauguuaaugguggug

SEQ ID NO: 25294 - RNA, 46 nt, Mus musculus
guaagguuauuaguuuguuuguuuguuuuuggucuugauuuuaaag

SEQ ID NO: 25295 - RNA, 41 nt, Mus musculus
uuuuaagccaccaugugguugcugggaauugaaccaggacc

SEQ ID NO: 25296 - RNA, 46 nt, Mus musculus
uaaggugggcacaccuguguugagaucaaggggaccucaugaugag

SEQ ID NO: 25297 - RNA, 35 nt, Mus musculus
ucacuaaaaaaauaaaacuuuaaaaaaaaaaaaaa

SEQ ID NO: 25298 - RNA, 41 nt, Mus musculus
cacauacuacaauuaugauuguuggguauauuccaggccca

SEQ ID NO: 25299 - RNA, 45 nt, Mus musculus
uuaugaaaucaaguucuccucuguuuggugcauaaauguuuagaa

SEQ ID NO: 25300 - RNA, 28 nt, Mus musculus
cuuuaaucccaguacucuggagggcagg

SEQ ID NO: 25301 - RNA, 46 nt, Mus musculus
ucucgaaaaaacuaaaauuaauaaauaauugaguaaauaaagacag

SEQ ID NO: 25302 - RNA, 42 nt, Mus musculus
cccagaacccacaugguagaaggagaaauaaaauguccacag

SEQ ID NO: 25303 - RNA, 46 nt, Mus musculus
ugauuggcuuguuaaguggagcguauguaauauagagacuccuggg

SEQ ID NO: 25304 - RNA, 45 nt, Mus musculus
acucagacuuugagagaaaaagaaugcaggaguggaauaaccaag

SEQ ID NO: 25305 - RNA, 46 nt, Mus musculus
cuccccaacaggguccuucuucuucauuuagguaguguggccguua

SEQ ID NO: 25306 - RNA, 26 nt, Mus musculus
cuugaguuacugaaggcaggcugggu

SEQ ID NO: 25307 - RNA, 44 nt, Mus musculus
cucucuuauuuauuauaaaaggugaggaauaggaaggggugaca

SEQ ID NO: 25308 - RNA, 46 nt, Mus musculus
ccuaaccgguuaggauaugacaaaaucaccacuuuugcaagcuguu

SEQ ID NO: 25309 - RNA, 46 nt, Mus musculus
uauaucugugaaaucagcuguggagaguaaagaaaaucccaaagua

SEQ ID NO: 25310 - RNA, 47 nt, Mus musculus
ccugaugguuacucuccguucuccucuccauagcacagagcgccaca

SEQ ID NO: 25311 - RNA, 90 nt, Mus musculus
aaguuuauaucuaaaagcuguauuuacuuuuaaagaaguguuacccaaagcauacacuguuguucauuuuauaacagcguuaagcguagu

SEQ ID NO: 25312 - RNA, 48 nt, Mus musculus
auuagcaucauaaaagaugaccuagaagacauaaaacugguagaacau

SEQ ID NO: 25313 - RNA, 53 nt, Mus musculus
ugucccagaucaggaugcagaaucauuuuggagccgugaaaucugaagaaaag

SEQ ID NO: 25314 - RNA, 45 nt, Mus musculus
caggaccuuacagguccuaaucaaacaggaaauccagaggaagag

SEQ ID NO: 25315 - RNA, 46 nt, Mus musculus
ucccuggagcauaaaugcugccgacgcgaagcucgccucaccggag

SEQ ID NO: 25316 - RNA, 63 nt, Mus musculus
ggauuauauuauaaaccagcaccuaguggcuuuagcuuauagaagaaaacaucauauuuuagg

SEQ ID NO: 25317 - RNA, 46 nt, Mus musculus
aaagccuuguggagggccacuggacauauaccacaaugucuccagu

SEQ ID NO: 25318 - RNA, 42 nt, Mus musculus
aguccucggaguuuccgagcccuacccaccgccacccaacag

SEQ ID NO: 25319 - RNA, 45 nt, Mus musculus
agccugggauacauugagacuuggauucaaagaagcaggaggagg

SEQ ID NO: 25320 - RNA, 45 nt, Mus musculus
ugcgcgugucugugucugugugugugugugugugugugugucugu

SEQ ID NO: 25321 - RNA, 44 nt, Mus musculus
cugugugugucugugucugugugugucugugugugucuguguua

SEQ ID NO: 25322 - RNA, 44 nt, Mus musculus
agagcaggagaccagaccaggcugugaaggagacaaguguguca

SEQ ID NO: 25323 - RNA, 46 nt, Mus musculus
aagagcaggagacaagaccagguugugaaggagacaagugugucag

SEQ ID NO: 25324 - RNA, 44 nt, Mus musculus; identical to SEQ ID NO: 25322

SEQ ID NO: 25325 - RNA, 44 nt, Mus musculus; identical to SEQ ID NO: 25322

SEQ ID NO: 25326 - RNA, 44 nt, Mus musculus; identical to SEQ ID NO: 25322

SEQ ID NO: 25327 - RNA, 47 nt, Mus musculus
gaagagcaggagacaagaccagguugugaaggagacaagugugucag

SEQ ID NO: 25328 - RNA, 44 nt, Mus musculus; identical to SEQ ID NO: 25322

SEQ ID NO: 25329 - RNA, 45 nt, Mus musculus
guggagguguguguggcagccguugagaugccugucccuuuaaga

SEQ ID NO: 25330 - RNA, 28 nt, Mus musculus
guaaaaaugaaacaagauacuggguuug

SEQ ID NO: 25331 - RNA, 46 nt, Mus musculus
cucugcuccaugcuguagaagugcauccuagucuuaucucggagcu

SEQ ID NO: 25332 - RNA, 46 nt, Mus musculus
aucuuguuuuucaguacugauuuaaaaaaucauauauagcccaguu

SEQ ID NO: 25333 - RNA, 45 nt, Mus musculus
acccagaccucgagaaugaagcccuuguuacugcuuuccccguuc

SEQ ID NO: 25334 - RNA, 42 nt, Mus musculus
ucugucaagauggcugcuccagucaaaccaccagccacacgg

SEQ ID NO: 25335 - RNA, 61 nt, Mus musculus
gaaccacucaagaccuccccggugguagcccccacaucugagcccuccagcccucugcaca

SEQ ID NO: 25336 - RNA, 46 nt, Mus musculus
ggauauugaagcaacaaugaacucugcccugaaugagcuucaagag

SEQ ID NO: 25337 - RNA, 59 nt, Mus musculus
aacauccagcuacuggggccacuccaagcaguucucucagacgucucucccagcuauau

SEQ ID NO: 25338 - RNA, 97 nt, Mus musculus
uacgugauaagcuuacacugguuacuuccccucagcagccccggagaacccacagaacuuaaagcagaccaaugcucuguacauucuauagagagua

SEQ ID NO: 25339 - RNA, 46 nt, Mus musculus
ggcaggaaggucaaaaaguuucaauaaccaucggcccauggacccu

SEQ ID NO: 25340 - RNA, 45 nt, Mus musculus
cauccucccagcccaucaugagccagaaucuccccaaggaagggc

SEQ ID NO: 25341 - RNA, 45 nt, Mus musculus
auuuggcccccagucuucagaguccuacccuuaccauccagagac

SEQ ID NO: 25342 - RNA, 45 nt, Mus musculus
gggucauguagcugauauuuaucuugcaaacaucaacaaguaagc

SEQ ID NO: 25343 - RNA, 46 nt, Mus musculus
agguaucagcccuaauucugccagguuacuggaaaccaaagcaaag

SEQ ID NO: 25344 - RNA, 42 nt, Mus musculus
gaaucuguauaugaggcacacugaguuuauaagguggcaugu

SEQ ID NO: 25345 - RNA, 46 nt, Mus musculus
gauuuuaaaauuaaaugucuaauaaugaaugucuaaaugucuauga

SEQ ID NO: 25346 - RNA, 50 nt, Mus musculus
uucaaaccugccaguuauuuuguggagaaguuacugcagagggucaaaaa

SEQ ID NO: 25347 - RNA, 46 nt, Mus musculus
gacuaaagauggggacagaguucaggggucauaauggacaaaagau

SEQ ID NO: 25348 - RNA, 46 nt, Mus musculus
aaaguccuucugguccugcccaagcccacucugauuaucaugagau

SEQ ID NO: 25349 - RNA, 46 nt, Mus musculus
uuccugugaguuucuccucuuuaucuccacuguuuuaucccuagua

SEQ ID NO: 25350 - RNA, 60 nt, Mus musculus
cauggacucuauagcugguguccucaagcuuuacuuccggggccuggaacacccgcucuu

SEQ ID NO: 25351 - RNA, 46 nt, Mus musculus
guucuaugaggaccaaauacuuucuaggaaagcauuacuggcaguc

SEQ ID NO: 25352 - RNA, 46 nt, Mus musculus
ugagcugacccucucaaaaaguuguguaguacuuucccagcuaaaa

SEQ ID NO: 25353 - RNA, 42 nt, Mus musculus
gaagugcaggaacuguugacauauguaagaaagcgcacaggc

SEQ ID NO: 25354 - RNA, 45 nt, Mus musculus
gcaaaacacucagcacacaaaacaauagaauaaaugcagcuuaaa

SEQ ID NO: 25355 - RNA, 42 nt, Mus musculus
ugaguacucuugcagaggacccucauucaauucacgggagac

SEQ ID NO: 25356 - RNA, 46 nt, Mus musculus
cugcauguauguguauacauuauaugcaugccuggugccuguguga

SEQ ID NO: 25357 - RNA, 77 nt, Mus musculus
cagcaaccacaugguggcucacaaccaucuguaaugccauccaauuuccucuucuggugugucugaagacagcaaca

SEQ ID NO: 25358 - RNA, 45 nt, Mus musculus
caauacucacuggggcucuaaguguuucacauaauugcugcagau

SEQ ID NO: 25359 - RNA, 46 nt, Mus musculus
uaauuuugaaaaggcauauuuuauccuugaugaguuuauaauaggu

SEQ ID NO: 25360 - RNA, 24 nt, Mus musculus
gaaagucgaguguuacagaaacca

SEQ ID NO: 25361 - RNA, 46 nt, Mus musculus
auguccagcaccaugccagcugccacagucccaaagccugccagua

SEQ ID NO: 25362 - RNA, 46 nt, Mus musculus
ugaaaaggaguguucuaucauugguauccuugaaaccucuggagaa

SEQ ID NO: 25363 - RNA, 45 nt, Mus musculus
agcuagauucucuggccugcuggagcccugagugacacagaagcc

SEQ ID NO: 25364 - RNA, 45 nt, Mus musculus
acagcugaugguguagaggaacacuagguguccugggaccacaag

SEQ ID NO: 25365 - RNA, 45 nt, Mus musculus
uagggaaacaaaaggaaaauaaaaauccaaauagaaagugcagag

SEQ ID NO: 25366 - RNA, 48 nt, Mus musculus
cauugaaaauaaugagaauuugguaucaaagugaaaucccagaaaggc

SEQ ID NO: 25367 - RNA, 46 nt, Mus musculus
auuuggcacauucccuuguccuauccccaaucuuagaagcccaucu

SEQ ID NO: 25368 - RNA, 45 nt, Mus musculus
ugccugugcaagagucuuguguuuugagauggaguuaggccagag

SEQ ID NO: 25369 - RNA, 42 nt, Mus musculus
uugucacuagacacacugggaagggaguaggggucaggcuag

SEQ ID NO: 25370 - RNA, 71 nt, Mus musculus
ccccggagggcgcgaggcuuuggaggugguuugugcggccagggagcaagcgggagaggggcgggggcgag

SEQ ID NO: 25371 - RNA, 46 nt, Mus musculus
auggcagaacccucuaccccuccccugugcccuccacacccaagcc

SEQ ID NO: 25372 - RNA, 46 nt, Mus musculus
ggacuccucacuuuuccuggaguuggaaggaaagaauaguuaagag

SEQ ID NO: 25373 - RNA, 45 nt, Mus musculus
gucacccugcuaggggucucauauugggggguacaacucccagcc

SEQ ID NO: 25374 - RNA, 45 nt, Mus musculus
aaggacucugggcaggagcaggcaucaaaggggaaggagugugaa

SEQ ID NO: 25375 - RNA, 42 nt, Mus musculus
caggucuagucucccaggcucuuagacacagggcaccaagau

SEQ ID NO: 25376 - RNA, 46 nt, Mus musculus
aaaccagcaacggacacauacaacaaaggacacgaggcugccuaag

SEQ ID NO: 25377 - RNA, 41 nt, Mus musculus
guuccucaggacagauacucaccacauggaucgugccgggu

SEQ ID NO: 25378 - RNA, 46 nt, Mus musculus
uggugugaaugauuccucugucuaggaaaaacauggggggaaagug

SEQ ID NO: 25379 - RNA, 42 nt, Mus musculus
ggaguuagaaaggaccagucccuuuauggagaaagugaagca

SEQ ID NO: 25380 - RNA, 45 nt, Mus musculus
ccaugagaugacauagccgauaacagaggacaacacaugccagua

SEQ ID NO: 25381 - RNA, 45 nt, Mus musculus
ugaaagccuccugucuggacagcaguagguauccuaggcucagaa

SEQ ID NO: 25382 - RNA, 89 nt, Mus musculus
uucacaguaaauuauucaagauauucgaauuaacauccuagcccaaccuugccucaccccuuuuguaagacugguuuuguaucugauca

SEQ ID NO: 25383 - RNA, 45 nt, Mus musculus
uggcaaaggaaagugacaucggccuugggcauaggaauuguggcu

SEQ ID NO: 25384 - RNA, 46 nt, Mus musculus
ccuagaugcucaggagauccacugcaggcuuagguucugucccuag

SEQ ID NO: 25385 - RNA, 45 nt, Mus musculus
uccccauuggucaauuuagaugagcuuuguuguauguguaugugu

SEQ ID NO: 25386 - RNA, 46 nt, Mus musculus
cgcugccaacacgaagauuggcccucgccgcauacacacaguccaa

SEQ ID NO: 25387 - RNA, 45 nt, Mus musculus
ccacuaugcacugccccugggccgcaagaagggggccaagcugac

SEQ ID NO: 25388 - RNA, 92 nt, Mus musculus
gugcucgaaggcaaggagcuggaguucuaucugcggaagaucaaagcccggaaaggcaaaugagccucaugcguaguguaauaaaggugucu

SEQ ID NO: 25389 - RNA, 41 nt, Mus musculus
uaccagauggcuagauuuugccgcaaguuacagcgcccuga

SEQ ID NO: 25390 - RNA, 46 nt, Mus musculus
aagagcuuuagacucugcagcgcccacuuuccuccuggagcagcag

SEQ ID NO: 25391 - RNA, 47 nt, Mus musculus
agcgcugcucugacagcgcagcccuaacuggggaagguaguccaggu

SEQ ID NO: 25392 - RNA, 46 nt, Mus musculus
agcgcuggagguggccaguuuguggguuuccgaacacuaaccccag

SEQ ID NO: 25393 - RNA, 47 nt, Mus musculus
gaauuccuccaggcuaacaaagggcaagaguuacccaccccugacca

SEQ ID NO: 25394 - RNA, 45 nt, Mus musculus
uguggguccauccggagaagguuauguuccuccuccaggcuauga

SEQ ID NO: 25395 - RNA, 45 nt, Mus musculus
aggaggaacauaaccuucuccggauggacccacaacauugcacag

SEQ ID NO: 25396 - RNA, 72 nt, Mus musculus
aaaccagaauuggugauucaagaaguuucacagagcccccagggaagcagucuguuuugugaauuacccgug

SEQ ID NO: 25397 - RNA, 42 nt, Mus musculus
auauaaucuaucaguuuguugcuacaaacuggucugguagaa

SEQ ID NO: 25398 - RNA, 32 nt, Mus musculus
ugcuaguguuauuccucuggauuccaauggau

SEQ ID NO: 25399 - RNA, 46 nt, Mus musculus
ccaucuugccagcccucuuuaauucugucuuagggggaggcuuggg

SEQ ID NO: 25400 - RNA, 46 nt, Mus musculus
cacuagacgggauggaucgcugugcccacuacagaagaaguuagau

SEQ ID NO: 25401 - RNA, 48 nt, Mus musculus
ccuuccuggaagaaguuacugaguauuauauaaguggugaugaggauc

SEQ ID NO: 25402 - RNA, 45 nt, Mus musculus
ggccuuugagcacagagaaaaaauguuuaauagacugaggaucga

SEQ ID NO: 25403 - RNA, 46 nt, Mus musculus
aagggaaacucucaaguaagagacagagugggcacggguugcaggc

SEQ ID NO: 25404 - RNA, 46 nt, Mus musculus
cagcuguccuuggacauguuuuuaaagaaacaacuuguaucuagag

SEQ ID NO: 25405 - RNA, 42 nt, Mus musculus
uugguauuuccuugccucuguuuccugugccaccaugcccag

SEQ ID NO: 25406 - RNA, 65 nt, Mus musculus
gugagaccuagucuuagaggacaaacagaacaaaacagucagguuacuguggaaacugaggcagg

SEQ ID NO: 25407 - RNA, 74 nt, Mus musculus
ccuggaacucagugaacucugaacucaaggccagcauggggaguuuagcaagaccuuuuuacacucagaaugga

SEQ ID NO: 25408 - RNA, 35 nt, Mus musculus
uuuuaaagacauggucuuauauagucuaggcuggc

SEQ ID NO: 25409 - RNA, 46 nt, Mus musculus
aaauaaccagggagauuauaaacugagguaguuuacccugccaggu

SEQ ID NO: 25410 - RNA, 137 nt, Mus musculus
cucaguuuauaaucucccugguuauuuccguuugaugugaucuaaggucugccucaguggugaugauguucauccacacacaagguuaguaagagugcacgaccagaaacguuggucuuauuuuugagaacccccau

SEQ ID NO: 25411 - RNA, 76 nt, Mus musculus
uuagugccgugggaaugggcuaguuuagaagcuauguuuggaaagcaggcaaguugacuuuaggaagaaaagcugu

SEQ ID NO: 25412 - RNA, 82 nt, Mus musculus
gcuuaacaacacuugauuucagaugauuagguuuuuguuucugagacccagcaccuguauauuuaaaaauuguuccagauua

SEQ ID NO: 25413 - RNA, 99 nt, Mus musculus
aaugaguaaaugacucaugccugcagacauguccugaugguggcaagaacagaaggaucuuugacugaaggagaaaaacugucauugucaucccagccc

SEQ ID NO: 25414 - RNA, 46 nt, Mus musculus
cugaaauguggcaacccuuuaucuaacuugaaaucaaaaccgucaa

SEQ ID NO: 25415 - RNA, 44 nt, Mus musculus
uuugaguuggccuuuucagcucagucauuuuacguguaacgugg

SEQ ID NO: 25416 - RNA, 45 nt, Mus musculus
cugggugggagucauguggccgugguggacaaagcuugcugaggg

SEQ ID NO: 25417 - RNA, 33 nt, Mus musculus
gcgaggacgaggacucagagggugacgagaaga

SEQ ID NO: 25418 - RNA, 45 nt, Mus musculus
uggucaaugacacuaaaacaaaauaauauucacgugccaccgucc

SEQ ID NO: 25419 - RNA, 41 nt, Mus musculus
aacaacucguaaucuacccucccuguuccacgugaccgaga

SEQ ID NO: 25420 - RNA, 46 nt, Mus musculus
gaaggcucucugaggagguggcgcuugaugguuggguccuggagaa

SEQ ID NO: 25421 - RNA, 42 nt, Mus musculus
caaaccuagcaguguguuuccaugguaauccagucccaugau

SEQ ID NO: 25422 - RNA, 41 nt, Mus musculus
gauggccaggaacuugaggccucuggccacggugcgucugu

SEQ ID NO: 25423 - RNA, 42 nt, Mus musculus
auguguguaaguguucuacgugcgugccuggugccacagagg

SEQ ID NO: 25424 - RNA, 63 nt, Mus musculus
gguuggcagagagugggaguuggaguggggaaaccggcuuguggggagaaugggggggcaaaa

SEQ ID NO: 25425 - RNA, 43 nt, Mus musculus
aucuugugcggagggaacgggaacugugcaucuggagggagga

SEQ ID NO: 25426 - RNA, 45 nt, Mus musculus
aaagggcuagggggugcuuugaccagaacaggauuaaacagagag

SEQ ID NO: 25427 - RNA, 42 nt, Mus musculus
auuuccagaagagggguuggaaagauuguaaaagccagaaga

SEQ ID NO: 25428 - RNA, 44 nt, Mus musculus
agauagguguuccuuuaucaaggaaacuucucuuugcaacagau

SEQ ID NO: 25429 - RNA, 46 nt, Mus musculus
uuuuuucugucauggauuuugaaaggagaaccuccaacuaccaguc

SEQ ID NO: 25430 - RNA, 45 nt, Mus musculus
gacagguaagcugugacucucagcagcugcucaggggaggagaau

SEQ ID NO: 25431 - RNA, 42 nt, Mus musculus
uggucaagauggcuuuguaggaacucuggacaagcaagagaa

SEQ ID NO: 25432 - RNA, 46 nt, Mus musculus
caggagacagagggaagggcucuauguuguaucuuaguguguagua

SEQ ID NO: 25433 - RNA, 45 nt, Mus musculus
cuccagggagacccugaggauaucagagcaauauccucaagggaa

SEQ ID NO: 25434 - RNA, 41 nt, Mus musculus
aucagaaugaaaggauuuaagauauauugcaauuugccggu

SEQ ID NO: 25435 - RNA, 45 nt, Mus musculus
ccacagcuaaagcuauguaguguguggccugguaccagaccaguu

SEQ ID NO: 25436 - RNA, 46 nt, Mus musculus
cccuuugcuaguccccuuccuaaaaugcccuggguugcugucagaa

SEQ ID NO: 25437 - RNA, 34 nt, Mus musculus
acuuuacauauguccacauggagacauacuugua

SEQ ID NO: 25438 - RNA, 46 nt, Mus musculus
ccaacccccaaaauacuuuuaacagaacaccuuaaaaccuggagaa

SEQ ID NO: 25439 - RNA, 41 nt, Mus musculus
agugaucccgauugccccagggcaggaaaugauggcugagg

SEQ ID NO: 25440 - RNA, 82 nt, Mus musculus
uaucacuuauggggaggaagugaccucacucuccuuccuaccucuucuggauucugaucuacccaaacuuaccuucuuguua

SEQ ID NO: 25441 - RNA, 97 nt, Mus musculus
cggagcaguaucuccaaccugggccauuauaauuuaaaggaccguguauagagcccacaaucuuugugauuguguccguuugaucgauuuuaguaau

SEQ ID NO: 25442 - RNA, 46 nt, Mus musculus
gccucugucuccugagugcugggauuaaaggcacagacaccaugcc

SEQ ID NO: 25443 - RNA, 46 nt, Mus musculus
aaugcucggcaacuguuagcuuuuguugucgggauguaacuuagug

SEQ ID NO: 25444 - RNA, 42 nt, Mus musculus
gagguuaaauucugacaguggccaccucguggggguggucuu

SEQ ID NO: 25445 - RNA, 45 nt, Mus musculus
ggcagauuaagaauucugccugcacagguaagcugcuaagguugg

SEQ ID NO: 25446 - RNA, 52 nt, Mus musculus
gcauuuacucaacuuguuuuacuugcacauuauuauuaggugacaauaaaug

SEQ ID NO: 25447 - RNA, 77 nt, Mus musculus
gauaauauuacucugcuccaaaguguuuccaacuagcagugaauggugaagucuguaggauguugagaagaccccuu

SEQ ID NO: 25448 - RNA, 45 nt, Mus musculus
acaaacacucauuucuaaacccucaugaacuuaguauugggagau

SEQ ID NO: 25449 - RNA, 45 nt, Mus musculus
gaagagauucauucuaaaacaaagucaagaaaacaacuggguaag

SEQ ID NO: 25450 - RNA, 39 nt, Mus musculus
cuucguuugugaggagagggaacaaaaacaaaaugagag

SEQ ID NO: 25451 - RNA, 45 nt, Mus musculus
aagggagagguuaggcggugguggcgcacgccuuuagucccagca

SEQ ID NO: 25452 - RNA, 48 nt, Mus musculus
ucgaauucagguguggcuguaugaacaagugaauaugcggauagaagg

SEQ ID NO: 25453 - RNA, 42 nt, Mus musculus
gcuugcggauguagcccggccggaccuuggggcgcuggagag

SEQ ID NO: 25454 - RNA, 41 nt, Mus musculus
aggcccuggggcgaacggggaggcaggaaagcgcgcggagu

SEQ ID NO: 25455 - RNA, 46 nt, Mus musculus
cucacaaccacccguaaugagaucugaugcccucuucugggugcau

SEQ ID NO: 25456 - RNA, 46 nt, Mus musculus
aaagggggugacuuuuuggaaccaauaaagcuuuuugcugaugaac

SEQ ID NO: 25457 - RNA, 41 nt, Mus musculus
auggugccacugguagcuucaacuguaaggcgaggggagug

SEQ ID NO: 25458 - RNA, 46 nt, Mus musculus
gaaaagaucaaugcaacaacaauggcuacuuguagcuccggcugac

SEQ ID NO: 25459 - RNA, 47 nt, Mus musculus
uuuuauauguuuuuuuuuucuauucaguuucaguaauccagguggca

SEQ ID NO: 25460 - RNA, 46 nt, Mus musculus
uuguuuaaagaauuucaaauaaagugccaccaugucacaccgugga

SEQ ID NO: 25461 - RNA, 46 nt, Mus musculus
gaaaaaguagacacaagcccucaggaguuaaccugucaggcaccac

SEQ ID NO: 25462 - RNA, 52 nt, Mus musculus
aaguuuugaaggccauuuuaccauccuugcucccaaacaauucuguggugcc

SEQ ID NO: 25463 - RNA, 60 nt, Mus musculus
uguuguuguucaacuauauauauuuaaguacauuagaagauuggauucugucaacucuuu

SEQ ID NO: 25464 - RNA, 26 nt, Mus musculus
gaauccccuucccacagcagcugagg

SEQ ID NO: 25465 - RNA, 44 nt, Mus musculus
ggggccacggucucggcugucuguggggcccgagggucucugga

SEQ ID NO: 25466 - RNA, 48 nt, Mus musculus
uuccccaucaccuuucucgcauugaaaauagagcccacuucacacaac

SEQ ID NO: 25467 - RNA, 42 nt, Mus musculus
ucucuggaggcuuuuuccucuccccaagauggugucacacaa

SEQ ID NO: 25468 - RNA, 46 nt, Mus musculus
gcuacccuccuuuccuagcccaggugagcagcuuggcggguuucca

SEQ ID NO: 25469 - RNA, 46 nt, Mus musculus
ccuagcgcaggacaaguggcaucacccauucucccucugcaguuaa

SEQ ID NO: 25470 - RNA, 45 nt, Mus musculus
aggcuggggguucauuccuaucaggagugauugugaaugagaagu

SEQ ID NO: 25471 - RNA, 45 nt, Mus musculus
aagucccccaagccauccaccagcucuaccuggauagcaacaaga

SEQ ID NO: 25472 - RNA, 42 nt, Mus musculus
aguguucagcaagcuggagaaccugcugcuccuggaucugca

SEQ ID NO: 25473 - RNA, 51 nt, Mus musculus
agccgaaaccugcgaaggguccccgucaucccaccccgaauccauuaccuu

SEQ ID NO: 25474 - RNA, 98 nt, Mus musculus
ccccgagccagcagagccgacagaccugccuccaccucuuccucccggcccuccaucugucuucccugacuguccacgggaaugcuacugccccccug

SEQ ID NO: 25475 - RNA, 48 nt, Mus musculus
cuccucccacuucuccucaucuuggccucaguggcccaaggccaaccg

SEQ ID NO: 25476 - RNA, 45 nt, Mus musculus
ucaugcuggcaaagacaggcagucccugggccaagugcaggggag

SEQ ID NO: 25477 - RNA, 44 nt, Mus musculus
gagugccccagaguccagaggagaggcaggugugugcagguaag

SEQ ID NO: 25478 - RNA, 45 nt, Mus musculus
ugugugugagugugagugagugugugugugugugugagugugugu

SEQ ID NO: 25479 - RNA, 46 nt, Mus musculus
accucugagcugcucaaggcauauuaaaauguaaggcuguguaagu

SEQ ID NO: 25480 - RNA, 44 nt, Mus musculus
gugcauuaaugcauguaugcaugagugggugaacugauggauag

SEQ ID NO: 25481 - RNA, 41 nt, Mus musculus
auggaacaaucuuugcuuuggaaauuuagcugacuggccuc

SEQ ID NO: 25482 - RNA, 46 nt, Mus musculus
ccuacuauuuauuggauagagcauuauccuggaagcacuaagagau

SEQ ID NO: 25483 - RNA, 45 nt, Mus musculus
caacaggccaccguauaccucaaccuggggaacuguauuuuuaaa

SEQ ID NO: 25484 - RNA, 46 nt, Mus musculus
ccccgguggcugccuccuaugggcuccucaccugcaagaaccagau

SEQ ID NO: 25485 - RNA, 45 nt, Mus musculus
gauacuguguagucuuaggugcuggggcagaaaggagaaggagaa

SEQ ID NO: 25486 - RNA, 46 nt, Mus musculus
acaaacaggauuucucagggugggaucucucuauaaggcacugaga

SEQ ID NO: 25487 - RNA, 44 nt, Mus musculus
ccgagccuugugcucagcagagggaaguuuggcuaaugggcuga

SEQ ID NO: 25488 - RNA, 72 nt, Mus musculus
ccccucucuugucuccauuauuuuaauugcuuuuucuggcagcacgguggggacagggcagauuuaugagaa

SEQ ID NO: 25489 - RNA, 46 nt, Mus musculus
ggcucugggagcccacugcagaggugauuuuggagguuggcauuga

SEQ ID NO: 25490 - RNA, 42 nt, Mus musculus
ggguggggauggcccaugcggggacuucugggagaugcagug

SEQ ID NO: 25491 - RNA, 46 nt, Mus musculus
ggugccuuugacuaaccuagguuaguuaccaaggugacugucaaaa

SEQ ID NO: 25492 - RNA, 42 nt, Mus musculus
gaggcagcuggucacuuugcaugcccucacuaguagucagga

SEQ ID NO: 25493 - RNA, 45 nt, Mus musculus
gcuggccgaguccagugugugcauguccuugucacacgcggagcc

SEQ ID NO: 25494 - RNA, 42 nt, Mus musculus
uggcuccugcuaggacagugaggagggcagcugggcccaggu

SEQ ID NO: 25495 - RNA, 42 nt, Mus musculus
aacguguuucccucaccacaauuaugcauguauacaccagcu

SEQ ID NO: 25496 - RNA, 46 nt, Mus musculus
gcgccaucauguccgccuugucggacacggagauccagcgggagau

SEQ ID NO: 25497 - RNA, 41 nt, Mus musculus
ccuggcuggaggugagccugggcgauggagaugcucuggga

SEQ ID NO: 25498 - RNA, 27 nt, Mus musculus
gaauucaaggguggggaucggggggaa

SEQ ID NO: 25499 - RNA, 58 nt, Mus musculus
ggggacccgucagcuuugcuuggguugcucugugugugugugugugugugugugugug

SEQ ID NO: 25500 - RNA, 46 nt, Mus musculus
gaggcuggugugcaagaggacacccagagauggugcgugcauacau

SEQ ID NO: 25501 - RNA, 42 nt, Mus musculus
uuaaugaaucucucagggcaagaacuugaucagccggaagaa

SEQ ID NO: 25502 - RNA, 56 nt, Mus musculus
gaaaaacaaugaaauuaucccaaaacacuauguuguagagauggcccagguguugc

SEQ ID NO: 25503 - RNA, 45 nt, Mus musculus
gccuuuuuuugcuggagaagaugguugggcaggaguggcccuucu

SEQ ID NO: 25504 - RNA, 45 nt, Mus musculus
ccacugggcaauaucccuaggccucuguuuaagauuggguuucau

SEQ ID NO: 25505 - RNA, 52 nt, Mus musculus
ugaggcaacaugacuagaacccauugaaagaaguggggaggaggaaggagug

SEQ ID NO: 25506 - RNA, 84 nt, Mus musculus
uguuagcguacuugguguguagguguguuagcguacuugguguguagguguguuagcguacuugguguguagguguguuagcgc

SEQ ID NO: 25507 - RNA, 24 nt, Mus musculus
gguuaucaggaaaccugcagagag

SEQ ID NO: 25508 - RNA, 47 nt, Mus musculus
cauggcaacauugaggaacaucugcggcagcuggaagggcagcugga

SEQ ID NO: 25509 - RNA, 46 nt, Mus musculus
ccuaggugcgugcacuuccuccucucucagagucuauuggucaggu

SEQ ID NO: 25510 - RNA, 50 nt, Mus musculus
aaacuggagaaugagcuggccaacaaggaaucccugcaccgccagguaac

SEQ ID NO: 25511 - RNA, 102 nt, Mus musculus
gcucuggcucagaaggaggacauggaagagagaaucaccacacuggagaagcgcuacuuggcugcucagcgagaagccacauccauccaugaccucaaugac

SEQ ID NO: 25512 - RNA, 45 nt, Mus musculus
gugagcggcuggucacccugagugccaccgugacugagcuggagg

SEQ ID NO: 25513 - RNA, 46 nt, Mus musculus
uuaacucgggagcuaagcaugugucgggagcagcuucuggagcggg

SEQ ID NO: 25514 - RNA, 45 nt, Mus musculus
gucuuucaaccuauuuguuguauuagcuaucugcagcuugcaaag

SEQ ID NO: 25515 - RNA, 50 nt, Mus musculus
guguguguguguguguguguguguauguguguauauguguguguguuugu

SEQ ID NO: 25516 - RNA, 41 nt, Mus musculus
ccuugagucagagaaaagugugggcuggaguccaggucagu

SEQ ID NO: 25517 - RNA, 41 nt, Mus musculus
gagggggcgagagagagagagagagagagagagagaacuau

SEQ ID NO: 25518 - RNA, 46 nt, Mus musculus
acaguucuagcacagggcagcugcaugccugagagaguuagggacu

SEQ ID NO: 25519 - RNA, 50 nt, Mus musculus
ugcauaugugugcuugugcaaaugugugcacugggagugaggacugagaa

SEQ ID NO: 25520 - RNA, 46 nt, Mus musculus
uuuaugauugguaggaagggagguuggccuggaggacuuggaaaua

SEQ ID NO: 25521 - RNA, 47 nt, Mus musculus
aggccgagcagaguaagcagccccacccccagagaggcuagcaagac

SEQ ID NO: 25522 - RNA, 45 nt, Mus musculus
cuggugacagggguguaaggccugaugaccagacugccaucaauu

SEQ ID NO: 25523 - RNA, 42 nt, Mus musculus
cauaacugagcaacccgcucggcccccggaacuccaccauau

SEQ ID NO: 25524 - RNA, 25 nt, Mus musculus
acaaacagaacagaaagcaugcccu

SEQ ID NO: 25525 - RNA, 42 nt, Mus musculus
agggccugagauacacacacacacacacacacacacacacac

SEQ ID NO: 25526 - RNA, 42 nt, Mus musculus
cgcaggucaaacgugacggggcucccuccuggauagggucgg

SEQ ID NO: 25527 - RNA, 42 nt, Mus musculus
augaaaaaaucucuccuccuccuccuccuuucuguggagcug

SEQ ID NO: 25528 - RNA, 46 nt, Mus musculus
auuugacucuuugagcugugugugugugugugugugugugugugug

SEQ ID NO: 25529 - RNA, 45 nt, Mus musculus
acuuggggagccuccuugucuuuuaaacuuccugcuuccggguag

SEQ ID NO: 25530 - RNA, 45 nt, Mus musculus
ucugcccucuggggcugagagaccccaaccuuucuucaagcugaa

SEQ ID NO: 25531 - RNA, 45 nt, Mus musculus
ccgucuagccugaugagcugagguugaucccuggaaccuacagag

SEQ ID NO: 25532 - RNA, 50 nt, Mus musculus
aaauuguaaaaaauguuuuaagagaacaggcacauaacaucuaaggcaac

SEQ ID NO: 25533 - RNA, 61 nt, Mus musculus
guguucuuccaaugauagucucagucugcgucuugugugccaaaccaaacuuucacccagu

SEQ ID NO: 25534 - RNA, 91 nt, Mus musculus
ggaucuccccagaaacgugcaguuuaggaguugaugucuagacuguuguuguguuccuuuaggcugaggaagaucaagcaugcccggugcc

SEQ ID NO: 25535 - RNA, 46 nt, Mus musculus
gugcgggugcugacgcuuccucugcaagcccaccaugccauggaga

SEQ ID NO: 25536 - RNA, 66 nt, Mus musculus
ggagagucaucccguaugaugugcuuccugacuggcugaaagacaacgacuaccugcuacauggcc

SEQ ID NO: 25537 - RNA, 62 nt, Mus musculus
auuucucuuucugggaaucuugacgaugcugagaccaaauauguacuucauggcuccccugc

SEQ ID NO: 25538 - RNA, 44 nt, Mus musculus
cccuggcucuauuacuccuucuacugcuccccacagccgcggcu

SEQ ID NO: 25539 - RNA, 43 nt, Mus musculus
uguggcacagugggaccgguuugccacucccaagcaccggcag

SEQ ID NO: 25540 - RNA, 45 nt, Mus musculus
gaccuugucucaaaggaaugauaaaagggcuggacauaacaguua

SEQ ID NO: 25541 - RNA, 86 nt, Mus musculus
ccagguguagugauccuuaucccagugcuugggagggugaagcaggaagauugcguguguuccaaggcagcgagggagauguacag

SEQ ID NO: 25542 - RNA, 45 nt, Mus musculus
uaguucaugagaaagcaguugcuuuucguaaguacaucaguucca

SEQ ID NO: 25543 - RNA, 46 nt, Mus musculus
acuugggaagucccuccuccaccccucagguggggaggcucagaga

SEQ ID NO: 25544 - RNA, 44 nt, Mus musculus
uuuguuuuuucuugaagaaaauaucccccccuuacccccguccu

SEQ ID NO: 25545 - RNA, 48 nt, Mus musculus
caaauaacuugaguuuaaauccuuuuuuuuuuuuuucuuggcagagua

SEQ ID NO: 25546 - RNA, 46 nt, Mus musculus
uucacuccaaggaaaaggaacuuguggauugacugagccaccagaa

SEQ ID NO: 25547 - RNA, 32 nt, Mus musculus
cgcuacugggggaggggaggagccgcugggcc

SEQ ID NO: 25548 - RNA, 46 nt, Mus musculus
aagaggaguuaggauccugugaguugcccuccauguuggcauugug

SEQ ID NO: 25549 - RNA, 42 nt, Mus musculus
uuuugcuuuuucccauucugaauugucacacaugauggccac

SEQ ID NO: 25550 - RNA, 46 nt, Mus musculus
cauuacauauaagacuguuggaaugaaguuggcaucuuggagugag

SEQ ID NO: 25551 - RNA, 90 nt, Mus musculus
gacugucauuuggguucuguaaucaaauucaugaacuugcuuauuuaauuuggagggcaguaaaagucaaggauguuuggaguacaggag

SEQ ID NO: 25552 - RNA, 36 nt, Mus musculus
cggacggaccccauggaauugaguuagagaggggag

SEQ ID NO: 25553 - RNA, 46 nt, Mus musculus
aggguagaaaugaaguuuaaguguuuauuguuuguuugugccucug

SEQ ID NO: 25554 - RNA, 46 nt, Mus musculus
gagucagggucuuucuguguaauagcucuggcuauccuggaacucu

SEQ ID NO: 25555 - RNA, 83 nt, Mus musculus
aaaauaauugcuguagcuauuuuucuagauaaaagcaaagggcaguauuccuggaaugaggaccaagcugauugauuguagag

SEQ ID NO: 25556 - RNA, 46 nt, Mus musculus
cuuuaaugcgugacggucacgugccuaggugagcgugggguuauag

SEQ ID NO: 25557 - RNA, 47 nt, Mus musculus
ugucugccuuguuccuuugcuggaauuggccauauuuuauaucaacu

SEQ ID NO: 25558 - RNA, 46 nt, Mus musculus
aauuucugugaguagaauugcuaguuaacauuuuauaugguguuag

SEQ ID NO: 25559 - RNA, 45 nt, Mus musculus
uugugagccaccaugugguugcugggauuugaacucgggaccuac

SEQ ID NO: 25560 - RNA, 45 nt, Mus musculus
gauauaccuggaugugauagguuauucccagcauccaguaggcag

SEQ ID NO: 25561 - RNA, 45 nt, Mus musculus
uguguaaauguuuugcuugugugugugugugugugugugugugug

SEQ ID NO: 25562 - RNA, 45 nt, Mus musculus
gucacugaaauauaaagacauggcaauaguaagguacagauacag

SEQ ID NO: 25563 - RNA, 45 nt, Mus musculus
ggaaauguagcaguggauggaagaaguaaacaacugaaaguugga

SEQ ID NO: 25564 - RNA, 46 nt, Mus musculus
aauccuacacuugacaggcugagucaggaggauugugagccccuga

SEQ ID NO: 25565 - RNA, 42 nt, Mus musculus
gugcuucucaaguccuuaugguaauuugugucaccccagcug

SEQ ID NO: 25566 - RNA, 46 nt, Mus musculus
ucugaugaugaaaaugagauuaauauauaaguaaguaaaugcaaag

SEQ ID NO: 25567 - RNA, 46 nt, Mus musculus
uaucauauguucugauuauauucuuucccuccuuaacuuuucucag

SEQ ID NO: 25568 - RNA, 45 nt, Mus musculus
auugaugaaaaauggucuuaagcuauuuuauaagaacaccugcua

SEQ ID NO: 25569 - RNA, 45 nt, Mus musculus
gaaacuuuaucgugugugugugugugugugugugugugugugugu

SEQ ID NO: 25570 - RNA, 46 nt, Mus musculus
gugugugugagagagagagagagagagagagagagagaugguuggu

SEQ ID NO: 25571 - RNA, 84 nt, Mus musculus
aaaucaaguaaagaagaaaaauuaccagucuuucuuucccugucaauaaaagucuaucuuacacuguuugucuuuccuugccag

SEQ ID NO: 25572 - RNA, 46 nt, Mus musculus
aaagugaaguccgaaaacagcauuuuauccuuucaggugcacccuu

SEQ ID NO: 25573 - RNA, 45 nt, Mus musculus
uuaguauuuauaugugggugugguugcaugcaggccaccguucau

SEQ ID NO: 25574 - RNA, 44 nt, Mus musculus
gccaccauucgcuugugaugucgauaaacuucauuucaccccgc

SEQ ID NO: 25575 - RNA, 41 nt, Mus musculus
gugguggcacacacuuuuaauuccagcgcuugaaaggcaga

SEQ ID NO: 25576 - RNA, 62 nt, Mus musculus
uuuaggcccaaacacguguaaaauugaauuuccuggaccagauugcaaaguauugggagcua

SEQ ID NO: 25577 - RNA, 69 nt, Mus musculus
caaggaaguacucugaagauuccccacguggagagaaagaucuuagacuuguuccagcuaaauaaggca

SEQ ID NO: 25578 - RNA, 48 nt, Mus musculus
guuugcaguuguuugcaaggauagaaaauggaccaaaauugccaccaa

SEQ ID NO: 25579 - RNA, 46 nt, Mus musculus
cccugguugucacaugaaaguguaaccugggaauuaacuggcccaa

SEQ ID NO: 25580 - RNA, 46 nt, Mus musculus
ccucucccagcuguuccuaucugcaagccucuuuguuugcaggcag

SEQ ID NO: 25581 - RNA, 46 nt, Mus musculus
ccuuuuagaaauguguacucauagaaguuuauugagcuacaucccu

SEQ ID NO: 25582 - RNA, 41 nt, Mus musculus
uugcuuuuuauguuugagacagcuucucacuauauaagcca

SEQ ID NO: 25583 - RNA, 67 nt, Mus musculus
aaggacaaggaguacaaaccccaugauauuccccagaggcagucugugcagcccgcagaaaccuguc

SEQ ID NO: 25584 - RNA, 24 nt, Mus musculus
auaacaguaacgaagcuagagagg

SEQ ID NO: 25585 - RNA, 66 nt, Mus musculus
uguauuuuaaagaaaaaagucauugaagauuguggaagccagauuuacacaaguacugcuagaccu

SEQ ID NO: 25586 - RNA, 46 nt, Mus musculus
cuaugaauauuaaaauugagccagaagaggcaacagaagccaggac

SEQ ID NO: 25587 - RNA, 46 nt, Mus musculus
gaaauaaaauacauccgucuuuauucucgcaauuaacaggugguag

SEQ ID NO: 25588 - RNA, 45 nt, Mus musculus
aaguacacuguagcugucuucagauguaccagaagagggagucag

SEQ ID NO: 25589 - RNA, 50 nt, Mus musculus
ugaaaagcaccaucaagcaagagcccacugagaagaaagacugcgaguua

SEQ ID NO: 25590 - RNA, 46 nt, Mus musculus
uuuuauuuuuuauuauuuauuuuauuuuuuauuucagguuugggag

SEQ ID NO: 25591 - RNA, 46 nt, Mus musculus
cauaccacucauucaccuaaagugggggguaugucaaagauggcua

SEQ ID NO: 25592 - RNA, 46 nt, Mus musculus
ccagccggaccugcuccaccagcuggugaccaucaugaaccccaac

SEQ ID NO: 25593 - RNA, 45 nt, Mus musculus
uauaagguguguguguguguguguguguguguguguguguagucc

SEQ ID NO: 25594 - RNA, 48 nt, Mus musculus
gugguagcgucaacuguucagaaggacauggccaucaugaucgaggac

SEQ ID NO: 25595 - RNA, 45 nt, Mus musculus
gauucuccuuggacaaguagaauaaugugcuauuauuauuuuuag

SEQ ID NO: 25596 - RNA, 42 nt, Mus musculus
gaguaauugauucugaaagaauggauuuugagcuguugccag

SEQ ID NO: 25597 - RNA, 55 nt, Mus musculus
ccuacaucaugugaaagaauuguguucuugccccccguauaaguauaaccugcgg

SEQ ID NO: 25598 - RNA, 46 nt, Mus musculus
gugugaucauauuuaugugugaaugugguuauauauccaaaggcag

SEQ ID NO: 25599 - RNA, 44 nt, Mus musculus
acaaugaaugggccuuaaaugugaaugaagccuuggaagcaaag

SEQ ID NO: 25600 - RNA, 45 nt, Mus musculus
gcguguguaucugagccuacucuguugugugccugauaaacccug

SEQ ID NO: 25601 - RNA, 45 nt, Mus musculus
uaaaccacaguagaucucuauuacuuuucuuucacaaaucagcag

SEQ ID NO: 25602 - RNA, 46 nt, Mus musculus
uuugcgucaccuucgacuagucacgcaggaugcagaaaagugugcc

SEQ ID NO: 25603 - RNA, 46 nt, Mus musculus
uuagacaguuugugacucagcuguaugcucugccgugcguccuuag

SEQ ID NO: 25604 - RNA, 46 nt, Mus musculus
uuuggugguuaauuuguuauuguguguguguguguuucugcagaag

SEQ ID NO: 25605 - RNA, 46 nt, Mus musculus
uuuguggaauagugggugguuauaaggagauucuauuaaaaggaag

SEQ ID NO: 25606 - RNA, 46 nt, Mus musculus
acucauagacuuagggguggggcuggcuccauauucugcuguggag

SEQ ID NO: 25607 - RNA, 46 nt, Mus musculus
cagaauauuuuaaguagaaauuacuauuuuuccucuugcuugguag

SEQ ID NO: 25608 - RNA, 42 nt, Mus musculus
ucuuugaguagccuugcuacagcagucaaagagauggaggag

SEQ ID NO: 25609 - RNA, 42 nt, Mus musculus
uuaugugugucugugugucauauggaugccugguuccugagg

SEQ ID NO: 25610 - RNA, 46 nt, Mus musculus
guucaugcauggaaagaaugugcugcuaaaacauucuugccugaga

SEQ ID NO: 25611 - RNA, 45 nt, Mus musculus
guugaugcucuuaagcacugagccaucucuagcccuacugcccgc

SEQ ID NO: 25612 - RNA, 47 nt, Mus musculus
aguugaaggagcccuugccgaguggaaagaagagaagcaccaaguua

SEQ ID NO: 25613 - RNA, 45 nt, Mus musculus
aaagaauuuuugaaaauugugaaguuuaaggauagaguuggugag

SEQ ID NO: 25614 - RNA, 71 nt, Mus musculus
cuacgagagauggaagcuuugcagucucucagauuugccaaugaagagaaauugcugucaccuguccaaga

SEQ ID NO: 25615 - RNA, 90 nt, Mus musculus
cacuccgauacaugauugaaagaaccgugaacuggcaacauagagcccagcagcugcuuucuucagggaaucuaaaacuugugcaagacc

SEQ ID NO: 25616 - RNA, 41 nt, Mus musculus
accuuucucucuuuaucugcugagccauuuugauggccccc

SEQ ID NO: 25617 - RNA, 42 nt, Mus musculus
gaccaggcugucccugcaucucucuaaacagcuugaggacag

SEQ ID NO: 25618 - RNA, 83 nt, Mus musculus
uuguuuccaugagaguggguuuggcuggguuuuaggugcuagaggagacuuacugaaaaaaagaaaaaaagaaaaaaaaaacc

SEQ ID NO: 25619 - RNA, 57 nt, Mus musculus
auccuuuucauugcccgaugacugggacaacagaaccucauauuuacacucucccuu

SEQ ID NO: 25620 - RNA, 68 nt, Mus musculus
gauacaaggccaucuggccuaggguuuuauaauagaugaucuggcauccuaaagagcaaguaugguuu

SEQ ID NO: 25621 - RNA, 56 nt, Mus musculus
uacauguguguaccaugagcauuguggaggcagaggcgggauuugggcuacaaagc

SEQ ID NO: 25622 - RNA, 45 nt, Mus musculus
cucuguucagcaagcugaccgaaguucaccaguuagauccagcag

SEQ ID NO: 25623 - RNA, 53 nt, Mus musculus
gguauccccagcucgccaacagugcugagcgaagggaguuaagcuggcugugg

SEQ ID NO: 25624 - RNA, 41 nt, Mus musculus
guaaugggcaaauuucuuuaguucaguuuugguaacgggca

SEQ ID NO: 25625 - RNA, 50 nt, Mus musculus
uagcgagcggugggaucgaguuaaacacaugcggaccccccaaaagaaga

SEQ ID NO: 25626 - RNA, 46 nt, Mus musculus
uuauuuaucucagcaauaacuucuauguugguuucaguggcuggaa

SEQ ID NO: 25627 - RNA, 46 nt, Mus musculus
acagggaaguuugguugagaugugguccaucaucuuagaggcucag

SEQ ID NO: 25628 - RNA, 55 nt, Mus musculus
augcguggcacuguccaaggaaguaaauaugugucaaagaagaugggaugcugcu

SEQ ID NO: 25629 - RNA, 46 nt, Mus musculus
agagugaccuugaacuucugaauucguucugaauucuucugacgau

SEQ ID NO: 25630 - RNA, 32 nt, Mus musculus
gacuauauaugcgcccucaccagcuuuucuuu

SEQ ID NO: 25631 - RNA, 46 nt, Mus musculus
cugacauaagcuagucagcauauauuaaaauguucuguugagcugg

SEQ ID NO: 25632 - RNA, 37 nt, Mus musculus
ucccguuucuacccgagcggcccugggaggaacacgg

SEQ ID NO: 25633 - RNA, 46 nt, Mus musculus
uacgaagagucagugcaguuguaaaaagcuuacguuugcggggagu

SEQ ID NO: 25634 - RNA, 48 nt, Mus musculus
gacuucuaccuaggcgccuccagugucuaugcccccaagccccggcuc

SEQ ID NO: 25635 - RNA, 46 nt, Mus musculus
cuggugcccucggaggcacaggacgguguuaguuaugagaugucag

SEQ ID NO: 25636 - RNA, 41 nt, Mus musculus
auccugauggcaucaucaugcaggcagacuuagugcuggaa

SEQ ID NO: 25637 - RNA, 45 nt, Mus musculus
gcugaggcaagagaaagaggauuacuucaaguuugaaaccagcua

SEQ ID NO: 25638 - RNA, 42 nt, Mus musculus
uuggagccuguuugaagaacacagcuguaaaaauauuuggag

SEQ ID NO: 25639 - RNA, 51 nt, Mus musculus
gcucugugaguuccaggacagccagaggaacccugucucaacaaggaaagg

SEQ ID NO: 25640 - RNA, 45 nt, Mus musculus
uauugagccagggauuaguuaaaaaauaaugagaagguaggccua

SEQ ID NO: 25641 - RNA, 45 nt, Mus musculus
gaccgagcgcacaguggaugucuucaguguggcccugaagcagac

SEQ ID NO: 25642 - RNA, 41 nt, Mus musculus
aggcagcuucacgagagcgggaaaaguugcucaugggagca

SEQ ID NO: 25643 - RNA, 45 nt, Mus musculus
agacacagcgaaggcuaaaggcugagccaagaucacacugaugga

SEQ ID NO: 25644 - RNA, 45 nt, Mus musculus
acaugaaagcacagauaggaucuuguaacugggaguggggguagg

SEQ ID NO: 25645 - RNA, 46 nt, Mus musculus
ccagcugugacuccaguucccucccgucccaacauggacugcaaau

SEQ ID NO: 25646 - RNA, 46 nt, Mus musculus
cugauggcccccuuaacauggauguguucccuguguugcuguagag

SEQ ID NO: 25647 - RNA, 45 nt, Mus musculus
uagaagagaaaggaaucuccuuucguuugaggucuaccugggggu

SEQ ID NO: 25648 - RNA, 103 nt, Mus musculus
cgccacugcuucccagcuccacagcaacgucgucaacuauguccagcagauccuggcgcccaaggacaguuagaggcuucgccuggguggucccugccucaga

SEQ ID NO: 25649 - RNA, 48 nt, Mus musculus
cucuguaccacgccaugauggguggcagugagauggcccggacccugg

SEQ ID NO: 25650 - RNA, 59 nt, Mus musculus
ucauccuuaagaaugacuaccaagaggaauuccagaaagugaaggacuuccugcagagc

SEQ ID NO: 25651 - RNA, 53 nt, Mus musculus
cccaaagauuuccaaugcucagaaugcugaguuacggcuaagauggggccaaa

SEQ ID NO: 25652 - RNA, 45 nt, Mus musculus
gcuucaugucagaggucagagguagauucacauuccggccucuaa

SEQ ID NO: 25653 - RNA, 66 nt, Mus musculus
augcaagccauugaagccguggccaucucuaccuggaagaccuaccagcuugucuacuuccuagau

SEQ ID NO: 25654 - RNA, 46 nt, Mus musculus
cagaaggcuccucugucuuccugucucccugacccucaccccagua

SEQ ID NO: 25655 - RNA, 46 nt, Mus musculus
gugacacacacacacacacacacacacacacacacacgucagugca

SEQ ID NO: 25656 - RNA, 46 nt, Mus musculus
gguguaagcgugguggagcaugcucacagccaauuugggagaagaa

SEQ ID NO: 25657 - RNA, 46 nt, Mus musculus
uuauuaucauuguguguguguguguguguguguguguguguuacaa

SEQ ID NO: 25658 - RNA, 46 nt, Mus musculus
acugagcacaggaaccccaauggaggaguuaggggaaggacugaag

SEQ ID NO: 25659 - RNA, 50 nt, Mus musculus
ccacaugguggcucacagccaucugaugcccuuuccuagugugucugaag

SEQ ID NO: 25660 - RNA, 23 nt, Mus musculus
cggucucaggguagcacaggaac

SEQ ID NO: 25661 - RNA, 46 nt, Mus musculus
uacaauucauucaagaugucacacauguccuaaugacuggccuagu

SEQ ID NO: 25662 - RNA, 46 nt, Mus musculus
ccauuuaaagaauguauaugagcuuagaagauaaaggaccaaaggc

SEQ ID NO: 25663 - RNA, 46 nt, Mus musculus
auaaagagacauuuagcacauuuuucuauuuaaaagagacucagag

SEQ ID NO: 25664 - RNA, 45 nt, Mus musculus
uuacaguuucagagccugcccaccucaaaugaccuccaagcagau

SEQ ID NO: 25665 - RNA, 44 nt, Mus musculus
cggugccuuaacaggagccauccuggcagcaagaaguaagugag

SEQ ID NO: 25666 - RNA, 25 nt, Mus musculus
aagcaagcugaggaagcagggguuu

SEQ ID NO: 25667 - RNA, 45 nt, Mus musculus
ggaaguuugacagcuauuaaaaccagggcuccacaguugggaggu

SEQ ID NO: 25668 - RNA, 45 nt, Mus musculus
gguggcaucuuccaggccuucaaagguuuucgaaauucuccagug

SEQ ID NO: 25669 - RNA, 67 nt, Mus musculus
uucugugugagccuucguucauuuguaaaauacagaggagauagucccagucuuuuuaucaaguuag

SEQ ID NO: 25670 - RNA, 94 nt, Mus musculus
uuuccuauguggaauucccgaagaaaaaagauauaucaguauguggaaaauaggaagagaugagcugcguguguucucugaaaagccaugaaua

SEQ ID NO: 25671 - RNA, 42 nt, Mus musculus
ugaguagaccacaaauuucacccaacauccaagggggcugga

SEQ ID NO: 25672 - RNA, 45 nt, Mus musculus
ucgcccccgccuucggucacuagcgugaaguagauguggcgcccg

SEQ ID NO: 25673 - RNA, 43 nt, Mus musculus
cuaaacaugcagcuuccgggcccccuugauuauuagaccucag

SEQ ID NO: 25674 - RNA, 41 nt, Mus musculus
ugugccuuuuuagugugugugugugugugugugugugugug

SEQ ID NO: 25675 - RNA, 41 nt, Mus musculus
gaaggggaagguggaaugggagggggacuuucacugggagu

SEQ ID NO: 25676 - RNA, 46 nt, Mus musculus
auguuauguauuuacuuauuuaaaaagaagaauggaaugggaaguc

SEQ ID NO: 25677 - RNA, 50 nt, Mus musculus
ugugacaacuguguacacuaguggggaagacauuguuuauaagugagaga

SEQ ID NO: 25678 - RNA, 63 nt, Mus musculus
ggguuauucuaagcugccuuuguguuuguuuuauguggagaucaugaaaguagaaaguuccug

SEQ ID NO: 25679 - RNA, 43 nt, Mus musculus
gucuuuccugccuauagaaaaaccuuucuaauugccaacaaga

SEQ ID NO: 25680 - RNA, 45 nt, Mus musculus
cggagucuguagaaggcuucuuaucuccaagucguuguggcaguc

SEQ ID NO: 25681 - RNA, 46 nt, Mus musculus
ccgcggacaccagguauacaggcaguacauauacauacaugcaggc

SEQ ID NO: 25682 - RNA, 48 nt, Mus musculus
auggcaaugaagcgagcagcuuugcuggagaaacggcuaagaagagag

SEQ ID NO: 25683 - RNA, 44 nt, Mus musculus
auuguagguuguuuguuaggauggaaacaugugggggccagugc

SEQ ID NO: 25684 - RNA, 46 nt, Mus musculus
aggccugggugauuucaccuccgcaacccucuccacagaagcagau

SEQ ID NO: 25685 - RNA, 42 nt, Mus musculus
acagaaaauggacggacagaggagcaaguccuuggcagacau

SEQ ID NO: 25686 - RNA, 47 nt, Mus musculus
gaagaagaagauggaagccgcuuuuaccaaacagaggcagaaaaugg

SEQ ID NO: 25687 - RNA, 43 nt, Mus musculus
agcuguuggcuucugagauggugcaccuuaggaugaggcugga

SEQ ID NO: 25688 - RNA, 58 nt, Mus musculus
ggaagcugaaucacacugaugggaaaaguagcgggagcaguucacagaaaaccacacc

SEQ ID NO: 25689 - RNA, 46 nt, Mus musculus
ucuaagcuucuucaggacuaugaccuaagagccagcaaccccaggg

SEQ ID NO: 25690 - RNA, 58 nt, Mus musculus
cagauaauccacgauacugaaagaccuccucauacgccacggccagaucagaucgcua

SEQ ID NO: 25691 - RNA, 59 nt, Mus musculus
gagugcuucuagacgaguucgggaaucagauagaaacgccaagcauugaagaagcguua

SEQ ID NO: 25692 - RNA, 48 nt, Mus musculus
ccaagcacauuaggaaaaaucuguccuucaagccagugaacggagaag

SEQ ID NO: 25693 - RNA, 49 nt, Mus musculus
aaaaauuuucauuguuuauucaaagguauguguugugugggggguguaa

SEQ ID NO: 25694 - RNA, 46 nt, Mus musculus
agcagacuugucaguuuccuuggacugaguacaguagggcagagug

SEQ ID NO: 25695 - RNA, 91 nt, Mus musculus
uaaccagcuuacugguauucaggauuacccucucuggccauagagcuaaggaagaguauaagcuauggaguguaucucggaaagcgggcua

SEQ ID NO: 25696 - RNA, 47 nt, Mus musculus
cgagucacugagagaaggucuuauuuuucaguggaagaaaguugaaa

SEQ ID NO: 25697 - RNA, 70 nt, Mus musculus
agugugagacuggaaugguucagcaaaaggaggggagaagugugggguuaguaugagucugaucuuaagg

SEQ ID NO: 25698 - RNA, 45 nt, Mus musculus
ugccaagaauacuuaaaccauugcugccauuucagcuuggaagau

SEQ ID NO: 25699 - RNA, 46 nt, Mus musculus
uucuuccuuuccuucucuccucucucuuuugaauggugucacagca

SEQ ID NO: 25700 - RNA, 46 nt, Mus musculus
uuaaccauugauuuaaaauaugguuaaaucccuuugaaugccagau

SEQ ID NO: 25701 - RNA, 23 nt, Mus musculus
uuaagugugagcaguuaaaguau

SEQ ID NO: 25702 - RNA, 46 nt, Mus musculus
aauggaacaagaacaaaaaucuaaagagcaccacccagcugaagcu

SEQ ID NO: 25703 - RNA, 46 nt, Mus musculus
aauugcaugugcucaacaguauucagcuuuuuuucaagccacagau

SEQ ID NO: 25704 - RNA, 46 nt, Mus musculus
uacuaguugaagguaauaaaaauccacuccuuguaaugcagcuaca

SEQ ID NO: 25705 - RNA, 45 nt, Mus musculus
ugaguaccagaggaugcguuuacauguggaggccugagguggaua

SEQ ID NO: 25706 - RNA, 46 nt, Mus musculus
ccuugagccagguuuugaaaugugugaaggaauuuacuagauaggg

SEQ ID NO: 25707 - RNA, 78 nt, Mus musculus
uguuugugugcacacacacaugugugcuugugugcguguauaugacagagauaggaagaaaaggauaugagauugaau

SEQ ID NO: 25708 - RNA, 48 nt, Mus musculus
gugugaccacauaugggucauacauagaguacacaguuagauugaaga

SEQ ID NO: 25709 - RNA, 46 nt, Mus musculus
cugucguugauaaguaaggcaucaaauguucucuucuggggggcug

SEQ ID NO: 25710 - RNA, 44 nt, Mus musculus
uaggcaagcauucucccaucugagcuacauucccagccccuaga

SEQ ID NO: 25711 - RNA, 46 nt, Mus musculus
ccaauugcauuacuuagguuucuuucaucccguaaagccugcugau

SEQ ID NO: 25712 - RNA, 45 nt, Mus musculus
ggucugacuuagaguuucagagguucaguccuuuaucaucguggc

SEQ ID NO: 25713 - RNA, 45 nt, Mus musculus
aggcagccuguggauguaaacagguaucaugaaagcagcacggga

SEQ ID NO: 25714 - RNA, 24 nt, Mus musculus
acuuuccucaggcuagcuggcaug

SEQ ID NO: 25715 - RNA, 46 nt, Mus musculus
auuuauugguuuauaaaacuacaaggguccuaaagugggagggauu

SEQ ID NO: 25716 - RNA, 45 nt, Mus musculus
gaggagacguaacuguggaggacaagggaaaagucgaggacaguu

SEQ ID NO: 25717 - RNA, 44 nt, Mus musculus
uggagacuucuugacuaggaagguaaauugugauaccaguuaau

SEQ ID NO: 25718 - RNA, 46 nt, Mus musculus
aaacagucuuuaaaauggcugugugugugugugugugugugugugc

SEQ ID NO: 25719 - RNA, 45 nt, Mus musculus
ugcuagucaggcuauguaggaugaaagguggucaguguugaagug

SEQ ID NO: 25720 - RNA, 39 nt, Mus musculus
gcagauaugaacucggugaccccagaaaugugucugauc

SEQ ID NO: 25721 - RNA, 46 nt, Mus musculus
uccccgcuuuugucaaaccuugccauggucccuugcaagaugugag

SEQ ID NO: 25722 - RNA, 41 nt, Mus musculus
cccggaggaggccuggcugcggagaggagggagaggaggga

SEQ ID NO: 25723 - RNA, 34 nt, Mus musculus
ugaugcucaccaaggacugcaagaauccccagga

SEQ ID NO: 25724 - RNA, 60 nt, Mus musculus
uuacuuaaaugaugaaauguauauucuauuagcccagaaagagcaaucugaaauguuuaa

SEQ ID NO: 25725 - RNA, 45 nt, Mus musculus
aaauauagguagccaacaaucucagaauuuuggaucagcccagac

SEQ ID NO: 25726 - RNA, 45 nt, Mus musculus
acacaauaaaaguuaaagaaauucaaaaccuguauaaaacaaaag

SEQ ID NO: 25727 - RNA, 45 nt, Mus musculus
ccagaggggaagguagaggaguugccucauuuccagcugcugcag

SEQ ID NO: 25728 - RNA, 46 nt, Mus musculus
gugcacucagauacauaaaauaaauaaaaugaaccuuuaaaaaaag

SEQ ID NO: 25729 - RNA, 46 nt, Mus musculus
uugggacucagucuaucaagacagggguggaaguggagcuggccag

SEQ ID NO: 25730 - RNA, 46 nt, Mus musculus
aaaaaaaaaaaaaaaaagcuuucuguggcuccccuuucccucugua

SEQ ID NO: 25731 - RNA, 27 nt, Mus musculus
aagagguccuuggaacuggaauuacag

SEQ ID NO: 25732 - RNA, 42 nt, Mus musculus
gcaagcuccguuaggaaaagaugugaagguuagugaaacaag

SEQ ID NO: 25733 - RNA, 43 nt, Mus musculus
cuguauguguguguguaggugacacugcaguauaaauagggag

SEQ ID NO: 25734 - RNA, 46 nt, Mus musculus
ccuuuggauaagcccucagcagugagggucagacuugugcauggag

SEQ ID NO: 25735 - RNA, 61 nt, Mus musculus
guugcucaauuggagucccguuuccguugcuagaugagguggcgaucucuccuggcccagc

SEQ ID NO: 25736 - RNA, 45 nt, Mus musculus
uuucucacuuauuuauagcagauugugugcuguugauucugcaga

SEQ ID NO: 25737 - RNA, 46 nt, Mus musculus
aguccuagcuuggcucagaacaguuuagcuuaccaacaaagggaau

SEQ ID NO: 25738 - RNA, 46 nt, Mus musculus
uuuuuucuuuuuuuuugguacucguuuucuuaaaaccacuuugcag

SEQ ID NO: 25739 - RNA, 44 nt, Mus musculus
cuccacuaaggccuuaaagcauuccugucuccaucuuuccccag

SEQ ID NO: 25740 - RNA, 46 nt, Mus musculus
ccucugcuuccucuucuuuuaaaagcacacucacccucagacccuu

SEQ ID NO: 25741 - RNA, 98 nt, Mus musculus
uucauuuuuaaaacacuuacuuucuuuuauuuauuuagagagauggucuuacuuuguagcccagguuaaccuuaaacgcucguuucuccugccucagu

SEQ ID NO: 25742 - RNA, 45 nt, Mus musculus
uuaaacauguggcuguguguguauguauggcugugugugugugug

SEQ ID NO: 25743 - RNA, 45 nt, Mus musculus
uauaaacuacuagguaagcauucucccagugugucaugcccccau

SEQ ID NO: 25744 - RNA, 46 nt, Mus musculus
ggggacaaagggagguuauagauacgguaucaaaaaugaggggaag

SEQ ID NO: 25745 - RNA, 42 nt, Mus musculus
accccaccugcacgcaccuguucacagauguuuuccgugaug

SEQ ID NO: 25746 - RNA, 42 nt, Mus musculus
aaaauuuuauucagucuuggacagauggcucaucagguaaag

SEQ ID NO: 25747 - RNA, 42 nt, Mus musculus
ggcucugaaggucagcaguggccuuccgcauggagguggcau

SEQ ID NO: 25748 - RNA, 37 nt, Mus musculus
uuugacucaaugcgccuuccuguaacuaagcaacacu

SEQ ID NO: 25749 - RNA, 46 nt, Mus musculus
caagagaccagggaccugauuuucuggugagagacuuggcacccag

SEQ ID NO: 25750 - RNA, 44 nt, Mus musculus
gcuguauuucuaaacucacccuucuggaaugguuugaaucugaa

SEQ ID NO: 25751 - RNA, 41 nt, Mus musculus
ugauggguaccccugggacagcaggguacucagagccccau

SEQ ID NO: 25752 - RNA, 42 nt, Mus musculus
aacuagaauagggguuagaaagagauaguguuggcucagcag

SEQ ID NO: 25753 - RNA, 45 nt, Mus musculus
aauaaauaaauaaauaaaucuuaaaaaaaaaaaaaaaaacaggac

SEQ ID NO: 25754 - RNA, 44 nt, Mus musculus
cucaauucaugaauaucuuaguaauuacucauauaauucuaaua

SEQ ID NO: 25755 - RNA, 42 nt, Mus musculus
cuucuuacuacagugaaaaggauggauuugauaugggcccaa

SEQ ID NO: 25756 - RNA, 45 nt, Mus musculus
aaccaucucagcagcuggcuccuguggucagugcuugccuagugc

SEQ ID NO: 25757 - RNA, 43 nt, Mus musculus
uuuguuuuguuuuucuuuuuuucuuucaguaguuaaccaccag

SEQ ID NO: 25758 - RNA, 45 nt, Mus musculus
gugggcuggaacgguuccaccuucgcuugaguccuggccccugca

SEQ ID NO: 25759 - RNA, 57 nt, Mus musculus
uggcgcaggccaccggcaagcccgcacaguacaucgcagugcacgugcucccggacc

SEQ ID NO: 25760 - RNA, 54 nt, Mus musculus
ugcacugcgauguacugugcgggcuugccgguggccugcgccagcugcugggug

SEQ ID NO: 25761 - RNA, 39 nt, Mus musculus
uucacgaugaacauaggcauggugguggagagacugcga

SEQ ID NO: 25762 - RNA, 44 nt, Mus musculus
uguaccguccuccgguccacgcucgcagucucuccaccaccaug

SEQ ID NO: 25763 - RNA, 45 nt, Mus musculus
uccuccuccucuucuuccuccucuuccuccucccccuccccuucc

SEQ ID NO: 25764 - RNA, 45 nt, Mus musculus
gggauuaggagguguggccuuguuagagugggugugaccuuguug

SEQ ID NO: 25765 - RNA, 45 nt, Mus musculus
ugauuaaaacacuugguuaucgagugggccagauuuugcacccag

SEQ ID NO: 25766 - RNA, 46 nt, Mus musculus
aaaaaugggacucucauuuugucuuuauuuguuaagauuaccagca

SEQ ID NO: 25767 - RNA, 46 nt, Mus musculus
cuggaagcuugcucuaggaacacagacuggaaggagaagaggagga

SEQ ID NO: 25768 - RNA, 46 nt, Mus musculus
uacuuuucaucagugaauuuuguucauauaaguuuccugaccaacc

SEQ ID NO: 25769 - RNA, 45 nt, Mus musculus
cacaggaagaauugccagaauguuuucuagacaaaggcccacagu

SEQ ID NO: 25770 - RNA, 46 nt, Mus musculus
cauaugauagcguugguuuauucauaguccugacucgccaccugaa

SEQ ID NO: 25771 - RNA, 35 nt, Mus musculus
gcugugcuuaugguuucuuuaaguagucacauaag

SEQ ID NO: 25772 - RNA, 46 nt, Mus musculus
cacacacacacacaugaaguaggguuagcaaguuuuaaacacagau

SEQ ID NO: 25773 - RNA, 46 nt, Mus musculus
uaacaaacaugcuuuuaauaugcaccuccuaacuacagucagagag

SEQ ID NO: 25774 - RNA, 46 nt, Mus musculus
gcgacuuucaucagucaugguuaccauccaauuuugaaccccaguu

SEQ ID NO: 25775 - RNA, 32 nt, Mus musculus
ggggcuggcaaaggcccuagcguucuccagag

SEQ ID NO: 25776 - RNA, 46 nt, Mus musculus
agcagaagggucaguggucagagucugggaucaaaaacuugaagaa

SEQ ID NO: 25777 - RNA, 46 nt, Mus musculus
aucucucccuccgcuucuguguugcuucuuugacagugcuccauuu

SEQ ID NO: 25778 - RNA, 46 nt, Mus musculus
uuugucuuuugcccuauauuguuuauauguagaagcaucaguagau

SEQ ID NO: 25779 - RNA, 45 nt, Mus musculus
acucaggaugggcagcgaacuccacuguggggaacaugcacagaa

SEQ ID NO: 25780 - RNA, 46 nt, Mus musculus
gaacuccuuucuacuugucuggggguacuugugguuaagccaggau

SEQ ID NO: 25781 - RNA, 46 nt, Mus musculus
acacaggcacacacaccucucagaugcagaugaauagagcccuuug

SEQ ID NO: 25782 - RNA, 42 nt, Mus musculus
gaaccuuguguacuguagaguggcuugcuuuuagccccaggu

SEQ ID NO: 25783 - RNA, 42 nt, Mus musculus
aguguaggugcuaauagccucaccaucguguugggcccagug

SEQ ID NO: 25784 - RNA, 45 nt, Mus musculus
ucugcuaguuguaauguguuccuuaaauucugcuaaacugaggau

SEQ ID NO: 25785 - RNA, 46 nt, Mus musculus
ugaauauuggucuaucuggucaagaaaagaaguaaaacccccaagu

SEQ ID NO: 25786 - RNA, 44 nt, Mus musculus
ucugccauauggcaagaucucgguguuuucaacuggugggaagu

SEQ ID NO: 25787 - RNA, 42 nt, Mus musculus
uggugggcagccuuugacuaacaaugugugaagcaccaggcu

SEQ ID NO: 25788 - RNA, 42 nt, Mus musculus
augauacauuguagcaaggucaugcugaugucccggggaaga

SEQ ID NO: 25789 - RNA, 44 nt, Mus musculus
uaaaauaauaaaaucuuuaaaaaacaaacaaacaaacaacaaaa

SEQ ID NO: 25790 - RNA, 42 nt, Mus musculus
cccagcaucgacauggugguucacaaucaucuguaaugggau

SEQ ID NO: 25791 - RNA, 42 nt, Mus musculus
ugccagucugcaggaugaggagucuuguacaagggucagauc

SEQ ID NO: 25792 - RNA, 45 nt, Mus musculus
ggggaacucaaggaaaaugcuccuaggaaucuuugugcccagaga

SEQ ID NO: 25793 - RNA, 46 nt, Mus musculus
aaauuguuuuggcuuaccuagaaauaacuuuucugcaccuugagau

SEQ ID NO: 25794 - RNA, 46 nt, Mus musculus
caguaagacccagucaguagguuaggucagcuccuuagguagagau

SEQ ID NO: 25795 - RNA, 45 nt, Mus musculus
gcuauaccagccuucucugagauaaugcuuauuuuuauggcuagc

SEQ ID NO: 25796 - RNA, 46 nt, Mus musculus
uaaauuacccuauauugagaauuacugcucccguuuugacugaggc

SEQ ID NO: 25797 - RNA, 41 nt, Mus musculus
uuaauguucucugauuuguaaaucaaaugcaucagacagau

SEQ ID NO: 25798 - RNA, 46 nt, Mus musculus
cccagcuacuuaguguaacuacacugaaucaaaacucugcucagaa

SEQ ID NO: 25799 - RNA, 46 nt, Mus musculus
uauuuucugauuuguuuuuuuauuuguuuguuuguuugcuuggguu

SEQ ID NO: 25800 - RNA, 46 nt, Mus musculus
aauauuauugcucagguggaaagugggcucaacagaugcaggagag

SEQ ID NO: 25801 - RNA, 44 nt, Mus musculus
auguaaaccaggagagccuugaacuccagaaaucaagugcuaga

SEQ ID NO: 25802 - RNA, 45 nt, Mus musculus
aguggacucauggagagagagagagagagggagagagagagagag

SEQ ID NO: 25803 - RNA, 35 nt, Mus musculus
gguagucuccugagguugacagaggacaugaaaga

SEQ ID NO: 25804 - RNA, 41 nt, Mus musculus
ugguacuugagagggacccuucucuaaguugacgccaggau

SEQ ID NO: 25805 - RNA, 46 nt, Mus musculus
uaaaauugacacggcuaacugaaucagcuaggagauuccaggagaa

SEQ ID NO: 25806 - RNA, 45 nt, Mus musculus
ucaagcaaguagcucagguuggcuucaaccuugaacaguaguagc

SEQ ID NO: 25807 - RNA, 90 nt, Mus musculus
gguccggugaaagagcacugguuuuuuuauugggucccacuauagaccuuuucccacaguggaauaaguauaacacaccuuaccugccuu

SEQ ID NO: 25808 - RNA, 45 nt, Mus musculus
caaucaacaaauuucccaucuuagucuauauguaauacuugagua

SEQ ID NO: 25809 - RNA, 77 nt, Mus musculus
ccaaaaaccaugggcacacagacuuccaggaaagccagcauuucucuaugaaaagaguccuuguucugaagucagca

SEQ ID NO: 25810 - RNA, 42 nt, Mus musculus
aggcuggugcacaucuauaaucccagcacuaaggagucugag

SEQ ID NO: 25811 - RNA, 42 nt, Mus musculus
aaguuggauagggauauuuucuucaucuuuguaaagccagag

SEQ ID NO: 25812 - RNA, 46 nt, Mus musculus
uucaauuuuccuaaccaauacacuuguauuggagcugccccaguuu

SEQ ID NO: 25813 - RNA, 46 nt, Mus musculus
agaaagagaaaagaauuagaaucuagcucacaugucagccguagac

SEQ ID NO: 25814 - RNA, 83 nt, Mus musculus
uggcuugcgaagacucaguaagcacucaacuccacagcacucagacccugugaauccacguguccaagccuaggcagauggcc

SEQ ID NO: 25815 - RNA, 96 nt, Mus musculus
gcacagaccuuugccaguaaagcuacaucggaucucuaaaguucucagaaguccaucaccacugccauuaaaucacuaauaaucagcaagacaggu

SEQ ID NO: 25816 - RNA, 96 nt, Mus musculus
augcaugcacccacaccaugcagagagacugacagacacacagagagacagacaacugacacaugcacacaggcaccaugaccuuugacucccaga

SEQ ID NO: 25817 - RNA, 45 nt, Mus musculus
aaccaacagcaucuaaauagaaaaauuaauauucugccaccuguc

SEQ ID NO: 25818 - RNA, 47 nt, Mus musculus
cuagaagggccugugggcaguuuugauguugcuucauaucugugaaa

SEQ ID NO: 25819 - RNA, 63 nt, Mus musculus
aucacaccaagggacaaguuacacuuccucccaccucaaaaggagagaagacacauuuucuuu

SEQ ID NO: 25820 - RNA, 42 nt, Mus musculus
accugaccucugcaauucagaacauucauuccgccuccaaag

SEQ ID NO: 25821 - RNA, 45 nt, Mus musculus
ucagugucucaauuuaaaauggugaauuacuccuaugaugaagau

SEQ ID NO: 25822 - RNA, 46 nt, Mus musculus
caggauaccauggucugauuuuuguuccucccgcaaucucggaggu

SEQ ID NO: 25823 - RNA, 46 nt, Mus musculus
uucagaacuccacacuugugauauuaggagagagggagcugaagga

SEQ ID NO: 25824 - RNA, 45 nt, Mus musculus
ugaaagaaacugauuucucaaguuugcaugaaauccaaggcaaag

SEQ ID NO: 25825 - RNA, 48 nt, Mus musculus
gguaggaagaugauaaacaagagaccacuaugaguccuuagaauugca

SEQ ID NO: 25826 - RNA, 44 nt, Mus musculus
ggaagggcaaacccgggagacuacccuugcuggaaaggaggagg

SEQ ID NO: 25827 - RNA, 46 nt, Mus musculus
auguauagcaagcuaaggacauucacagcauccaugcuccuuaguu

SEQ ID NO: 25828 - RNA, 42 nt, Mus musculus
ccugucucgaaaaacaaacaaacaaacaaacaaaaucuugug

SEQ ID NO: 25829 - RNA, 46 nt, Mus musculus
aguauuuaggcguauuuauuucuccugguuuaauaucccucuagau

SEQ ID NO: 25830 - RNA, 45 nt, Mus musculus
ucaguucucccaaagggguaagaagagaguggagagaaaaaagga

SEQ ID NO: 25831 - RNA, 45 nt, Mus musculus
ggcccauaaccaccccuaacuucccucacaagaaacuuuugagga

SEQ ID NO: 25832 - RNA, 46 nt, Mus musculus
aaaagaaaccaaaugaaaaaaaaaaaagaaaagaaaagaaaaagaa

SEQ ID NO: 25833 - RNA, 46 nt, Mus musculus
ggccaggcaaggucauauaguuagagcaucagcgagagaaagagca

SEQ ID NO: 25834 - RNA, 45 nt, Mus musculus
uugauuugcugguacucugagaugggcagggugcauuauagguga

SEQ ID NO: 25835 - RNA, 42 nt, Mus musculus
uuucuuuagagccagaaauuuucuuugcuaaaauccgucaga

SEQ ID NO: 25836 - RNA, 78 nt, Mus musculus
acaccagguagacgagguucuuaagucuuacagaaaucuuaugguauaggaaguguuacucucuugaagaaauuaaaa

SEQ ID NO: 25837 - RNA, 67 nt, Mus musculus
gccuagggaaaugaagaaauuugucuauaguacuguccccaugcucugaguuuaaucacugucccag

SEQ ID NO: 25838 - RNA, 45 nt, Mus musculus
auuaccacacuuuuccugguacaauucucuuuauagacugagaag

SEQ ID NO: 25839 - RNA, 45 nt, Mus musculus
ugcgaucccucgguuaaucugcaucacagccaaagcaugacagga

SEQ ID NO: 25840 - RNA, 46 nt, Mus musculus
auauccgauauuuacauuaugauucacaacagcagcaagauuacag

SEQ ID NO: 25841 - RNA, 41 nt, Mus musculus
ugugagcuaccacgugguugcugggauuuuuacuccggacc

SEQ ID NO: 25842 - RNA, 73 nt, Mus musculus
acacguuuuaaacaggaauuuucauuauaauuuaagcaggcacauucuuuuuaauauucccuuucugcacugu

SEQ ID NO: 25843 - RNA, 83 nt, Mus musculus
augcguagauacauuuuuaauauauauugagguaaugacacaguauaccagugagggcuuuugauuuuaaaucuuguacaggg

SEQ ID NO: 25844 - RNA, 46 nt, Mus musculus
caaaacauucuguuucucagucauguagcugcuuucuucgggauaa

SEQ ID NO: 25845 - RNA, 45 nt, Mus musculus
gucugauaccauuggugacaaguuuucugguuuuccuagaugucu

SEQ ID NO: 25846 - RNA, 46 nt, Mus musculus
gugcuugcugaauacugccacuucuuguuugaagauuaccgagagg

SEQ ID NO: 25847 - RNA, 46 nt, Mus musculus
agccuuuugucuuuguguuuuacuacauagcuuuuggggucuccag

SEQ ID NO: 25848 - RNA, 46 nt, Mus musculus
cuggcugauuggcuccauggaagucccaguucugcauugcauuuau

SEQ ID NO: 25849 - RNA, 46 nt, Mus musculus
cacacucucuguuaccgcaugacacacacaguaguuucucggccug

SEQ ID NO: 25850 - RNA, 45 nt, Mus musculus
gaggaagcuguuuucagaaugaguaacgcagcaaaaauaugguag

SEQ ID NO: 25851 - RNA, 42 nt, Mus musculus
ccaaucugcugggaauggaaauccuccaaacagaagccugag

SEQ ID NO: 25852 - RNA, 42 nt, Mus musculus
aagaaguguucuuaacuagagaacuagcucucuggccuugag

SEQ ID NO: 25853 - RNA, 46 nt, Mus musculus
uccuuagguccuucccuugucaagaguugagaacacuacaucccau

SEQ ID NO: 25854 - RNA, 46 nt, Mus musculus
ugauaaauauggauccaauuuuauuuuucagcauauagacacccag

SEQ ID NO: 25855 - RNA, 83 nt, Mus musculus
uuuggcaucuuuaucauauaaaaucgcuacaguuauggauacucaguuuggauauuuuuauuuuguuccuuuggucuaugucu

SEQ ID NO: 25856 - RNA, 46 nt, Mus musculus
cuauuccuuucaguucugaaaguguauuuuagcuacauuccuguaa

SEQ ID NO: 25857 - RNA, 42 nt, Mus musculus
gcuaccauauugcugagguuucuccuuaaucuuaaaccccag

SEQ ID NO: 25858 - RNA, 105 nt, Mus musculus
uguuuuauuuugaauuguuaaaauuaaaauuuuuauugacaacugugggaagcuaauuuggaaagaaaaugauauuuucuauguuugguuuuacggauuagguau

SEQ ID NO: 25859 - RNA, 45 nt, Mus musculus
cuacuuuaaaagcgagucuuaagaaacgcuuuaggcuuagguuga

SEQ ID NO: 25860 - RNA, 42 nt, Mus musculus
aaaggaaugcccagguaugugucagacaucagugagccccag

SEQ ID NO: 25861 - RNA, 41 nt, Mus musculus
uaaaauuguaguuaaaauuguaaauacauagaauggagaaa

SEQ ID NO: 25862 - RNA, 46 nt, Mus musculus
uuccagaucuuuaaagaaucucguaacggagacuaccagccccccc

SEQ ID NO: 25863 - RNA, 46 nt, Mus musculus
ccacagagccacgcaacaaaaacagugguacuaucagaaaacacag

SEQ ID NO: 25864 - RNA, 46 nt, Mus musculus
cagaacuuugugcaaaggacuccaguugaucugaaauuaagggcag

SEQ ID NO: 25865 - RNA, 45 nt, Mus musculus
aauugaugugaaauaugcggcuaauauacauauauuuagaggcag

SEQ ID NO: 25866 - RNA, 44 nt, Mus musculus
acccacagagaaaauguaagcagcugguuuuacugagggucgga

SEQ ID NO: 25867 - RNA, 45 nt, Mus musculus
auagucugaagagguguuugaagaauaacuaaaugaaaagaucga

SEQ ID NO: 25868 - RNA, 45 nt, Mus musculus
cagaaauggcgaugacuacaaggaaacaaugcugucaaggcacaa

SEQ ID NO: 25869 - RNA, 28 nt, Mus musculus
aaagaaggaaagaaagaaagagaccaca

SEQ ID NO: 25870 - RNA, 39 nt, Mus musculus
auacacuagucagggcagugcuguagaauuaagggcaga

SEQ ID NO: 25871 - RNA, 46 nt, Mus musculus
acauuuugugucaauuuucuaguggacaaacagcuguagcccccag

SEQ ID NO: 25872 - RNA, 46 nt, Mus musculus
ugaaccuagaguuagcaaggauuaccaaauuguuagacaaaagaau

SEQ ID NO: 25873 - RNA, 46 nt, Mus musculus
cauccaugacuaccuauucuguuuuuguuuuucugcccccuacgga

SEQ ID NO: 25874 - RNA, 45 nt, Mus musculus
aacaugagcugucauuugguuuauugaucuuacccauucugacag

SEQ ID NO: 25875 - RNA, 42 nt, Mus musculus
gcaaauagcaguacugucguaaucuauuccugaagcccccac

SEQ ID NO: 25876 - RNA, 46 nt, Mus musculus
ucauauauaauuaaggcauuaaaaucauuuagcauaauaugaacag

SEQ ID NO: 25877 - RNA, 46 nt, Mus musculus
auaggccguccaagcucucaggucuaauaaugaauccuugcccuuu

SEQ ID NO: 25878 - RNA, 45 nt, Mus musculus
acuuucccacuguccuauuuaaggaaacagaauauaaaauucaca

SEQ ID NO: 25879 - RNA, 45 nt, Mus musculus
cagucuuugugaugauaacaaaugcaguucuguuguagguugcaa

SEQ ID NO: 25880 - RNA, 42 nt, Mus musculus
cccccccuccuccaccuccuguaauuuuguuuccccuucuaa

SEQ ID NO: 25881 - RNA, 41 nt, Mus musculus
gaugcccuagcauaggggaaugcuagggcggugagguggca

SEQ ID NO: 25882 - RNA, 46 nt, Mus musculus
ugcauaugcagucugaauaaaugcaagugcuauaaacuacgugcag

SEQ ID NO: 25883 - RNA, 45 nt, Mus musculus
cccuggguuuaagaugguagcagagaagcacgguguaaacuuugg

SEQ ID NO: 25884 - RNA, 46 nt, Mus musculus
caugucugugugccacagugugugugugugugugugugugugugug

SEQ ID NO: 25885 - RNA, 46 nt, Mus musculus
gaaauagaggagggggcauggcacacuaaauucacuucaguggcag

SEQ ID NO: 25886 - RNA, 46 nt, Mus musculus
uuauauugugaaguguaacacacacaaaucuuaaguagaaagccag

SEQ ID NO: 25887 - RNA, 42 nt, Mus musculus
aagcaggauuuguguuagugcaaaaggcuaaagaucagagau

SEQ ID NO: 25888 - RNA, 45 nt, Mus musculus
uguguuguuuuaaauugcaccccacaaaagauauaaaacuaugag

SEQ ID NO: 25889 - RNA, 42 nt, Mus musculus
aaccuauuugguuauuuuuauguguacguuucuagggaugau

SEQ ID NO: 25890 - RNA, 25 nt, Mus musculus
acuuuuuuuauguuuuugggaaccu

SEQ ID NO: 25891 - RNA, 46 nt, Mus musculus
ugcagaaagggccaguauuguguaggcccagucugggaaaccaggg

SEQ ID NO: 25892 - RNA, 46 nt, Mus musculus
guguuuucccauuuuguuaagaguauauugaucauuuguuuugugu

SEQ ID NO: 25893 - RNA, 43 nt, Mus musculus
aucuccucuuccaucuggauaccuuucuuggggggagggcggg

SEQ ID NO: 25894 - RNA, 46 nt, Mus musculus
aacuucagauguugguccucaaaaaccaguuucuuuugaugguggc

SEQ ID NO: 25895 - RNA, 23 nt, Mus musculus
uguccauugcugucauuuuuguu

SEQ ID NO: 25896 - RNA, 42 nt, Mus musculus
cuucugcugauaaaauuacauguauggugugugugugugugu

SEQ ID NO: 25897 - RNA, 41 nt, Mus musculus
ugcaugcauacauuuauuuuuguuuucuuuuucauggcauu

SEQ ID NO: 25898 - RNA, 46 nt, Mus musculus
ugucugcuuuuaccuggaguacucugaguaaaaaucuccggugcag

SEQ ID NO: 25899 - RNA, 24 nt, Mus musculus
ccagacugggacuaaaggagguga

SEQ ID NO: 25900 - RNA, 46 nt, Mus musculus
gugccuuuacugcaaacauaaaaugcgugacccagacauucaguac

SEQ ID NO: 25901 - RNA, 46 nt, Mus musculus
cauuuagcauaccaccagaagucccuauagucuuuaguagugccag

SEQ ID NO: 25902 - RNA, 45 nt, Mus musculus
uaccuaauaaaaaauggaaagaaaaaaaaaaaagaaugucacaag

SEQ ID NO: 25903 - RNA, 46 nt, Mus musculus
ucaauuuaacuuugcagaacaaugcuuaguauauuacaaagcauaa

SEQ ID NO: 25904 - RNA, 46 nt, Mus musculus
cucuguuuucuguccuuuaacuuuuuaugguuuuuuuuccccccuu

SEQ ID NO: 25905 - RNA, 59 nt, Mus musculus
cugaucaaauuaacaacaauucucuauuccaaaaauacccaauuucuguauaaaaauac

SEQ ID NO: 25906 - RNA, 46 nt, Mus musculus
gaaagaaagaaagaaagaaagaaagaaagaaagaaaacuagaauag

SEQ ID NO: 25907 - RNA, 41 nt, Mus musculus
guguuuuauucaguuauggccaugucuuuugaccugucuca

SEQ ID NO: 25908 - RNA, 41 nt, Mus musculus
aauggaaagaaccuaaccuuguguguaugugagaggccucu

SEQ ID NO: 25909 - RNA, 51 nt, Mus musculus
gacuagcuuucauaauacuguaagaaacuauaaaaacuucucagagaugga

SEQ ID NO: 25910 - RNA, 48 nt, Mus musculus
aguggaugguggagccuguccuucugaggaugggcucacuauagaagg

SEQ ID NO: 25911 - RNA, 62 nt, Mus musculus
guugugagauugugccuguauguguuguucauuagucccaguuuacugaaacaacaggagag

SEQ ID NO: 25912 - RNA, 46 nt, Mus musculus
gguagucacacugcugggcagggguucccaccagauuccucaacag

SEQ ID NO: 25913 - RNA, 44 nt, Mus musculus
ugacuuuucaggagcaagguauaaaaauuaaggauguaagggua

SEQ ID NO: 25914 - RNA, 46 nt, Mus musculus
uguauuugcuuagaugguacucgcucaagaaucaacaccgagagau

SEQ ID NO: 25915 - RNA, 45 nt, Mus musculus
uccacacgaccugacauugucccuuugcaguacugauggccguuu

SEQ ID NO: 25916 - RNA, 45 nt, Mus musculus
uuuaagaggaagaaguacaguuuaauaguagugagcuagcaagag

SEQ ID NO: 25917 - RNA, 46 nt, Mus musculus
acgccuuuaaucccagcacuuaggaggcagaggcaggcggcccucu

SEQ ID NO: 25918 - RNA, 46 nt, Mus musculus
uaugcuuuucuguuaugaugguauguccuguugagggaguguacag

SEQ ID NO: 25919 - RNA, 45 nt, Mus musculus
acccucuuccuuaacuguacacucccucaacaggacauaccauca

SEQ ID NO: 25920 - RNA, 46 nt, Mus musculus
aagagaaacugguauccuuaauugcugagccaucucgccagcccac

SEQ ID NO: 25921 - RNA, 46 nt, Mus musculus
ccucugcugggagcccguuggcucuuuucaguuguugucccccagg

SEQ ID NO: 25922 - RNA, 45 nt, Mus musculus
uuucauuccucagugcagguauggaggcgggaggucucauaguac

SEQ ID NO: 25923 - RNA, 44 nt, Mus musculus
aaauuuuuauugauauuuuggagauuuuaaaaauaggucuagau

SEQ ID NO: 25924 - RNA, 47 nt, Mus musculus
ggaggccacugggcuuagugaggcagcaggaauggaaaugggagagc

SEQ ID NO: 25925 - RNA, 45 nt, Mus musculus
aguuggaaccaguagacaaaggaaaguauaccaaaaaggagaaac

SEQ ID NO: 25926 - RNA, 44 nt, Mus musculus
gaucuuggcggggcggcguggcgcggcuggagcugcgggcucgg

SEQ ID NO: 25927 - RNA, 46 nt, Mus musculus
guaaaugccacauagguuuaaggaggugguaaaugcuagauuagag

SEQ ID NO: 25928 - RNA, 45 nt, Mus musculus
aaaagcacagauaguugcaaugauuccugucucuaacucaucuuu

SEQ ID NO: 25929 - RNA, 46 nt, Mus musculus
acaucgucguuuugggggaagucuacaacuacuccugugaaccaga

SEQ ID NO: 25930 - RNA, 46 nt, Mus musculus
gaagaagaaauagcucacacgguuaauguacuucuuuuguggccag

SEQ ID NO: 25931 - RNA, 46 nt, Mus musculus
agaauguaaaauauuuugagaaaguaggagaaagaacauagaauag

SEQ ID NO: 25932 - RNA, 46 nt, Mus musculus
aauugauggaucuuucagguauccagaauuaugucugcguaaaaua

SEQ ID NO: 25933 - RNA, 46 nt, Mus musculus
ggauauguuugccuuucuacuuuaucccugccuuuaaucaucagaa

SEQ ID NO: 25934 - RNA, 46 nt, Mus musculus
cguauuaaaacuguuacuuaguaacuguuuucaggguguguuagga

SEQ ID NO: 25935 - RNA, 46 nt, Mus musculus
aaacuaaauuaugaaugaauuuuacaaauucagaguuuucuaagau

SEQ ID NO: 25936 - RNA, 45 nt, Mus musculus
ucauuggaaaacgacaguuuuaauaauguccaaauacucugaggu

SEQ ID NO: 25937 - RNA, 50 nt, Mus musculus
ucaucaguaugugcaugauagaaaugcacuuuggcaagaacaggagaaga

SEQ ID NO: 25938 - RNA, 46 nt, Mus musculus
auucggaauuucacauuggaugucauuuaacccugaguaccagaau

SEQ ID NO: 25939 - RNA, 88 nt, Mus musculus
aaauugauuguuugugggaugacaucaaauggcuuuaccauugcagacccagacgauagaggcauguuggauaugugcggcuuugaua

SEQ ID NO: 25940 - RNA, 46 nt, Mus musculus
caaacaugauuuuccuaccaacuauagcaucauuugguggucagau

SEQ ID NO: 25941 - RNA, 42 nt, Mus musculus
acuugaaacagaaaguagggacuauacguacagcauccaguu

SEQ ID NO: 25942 - RNA, 45 nt, Mus musculus
cauuccucauuuguaagaugaacaguguguguguguguauuugcc

SEQ ID NO: 25943 - RNA, 46 nt, Mus musculus
gagaaagugaagcgcacgaaagacgaccuggaagucauucaucuga

SEQ ID NO: 25944 - RNA, 46 nt, Mus musculus
gcaauggaugaaaaaauugagggguuaacagaugaauuugugaacu

SEQ ID NO: 25945 - RNA, 42 nt, Mus musculus
ugcuuggcugugaggucacuaaccggagugauuaccgagaaa

SEQ ID NO: 25946 - RNA, 46 nt, Mus musculus
cagaugacaaaggagaagaugauuaagacccgaaacaaccugcaag

SEQ ID NO: 25947 - RNA, 46 nt, Mus musculus
uacccuuggucaggcauaucccaaggacaaacaaagcuguccagag

SEQ ID NO: 25948 - RNA, 44 nt, Mus musculus
aggcaucaaagaagacagcaauggcugcugccaaggccccacaa

SEQ ID NO: 25949 - RNA, 54 nt, Mus musculus
gccaucacuggugcuucucuugcugauauaauggccaagaggaaucagaaaccg

SEQ ID NO: 25950 - RNA, 41 nt, Mus musculus
uuugaccuuuggacuuuuaacauuuuugagacugguauaga

SEQ ID NO: 25951 - RNA, 41 nt, Mus musculus
ugcagaagaucauguguggauccaagacauuggaacaagaa

SEQ ID NO: 25952 - RNA, 42 nt, Mus musculus
caugaggagcagcugaggcuuggaccuaugaagggagcauaa

SEQ ID NO: 25953 - RNA, 45 nt, Mus musculus
gcaaguuccaggacagccaagcugaggaaguaaaggaguuggaga

SEQ ID NO: 25954 - RNA, 42 nt, Mus musculus
gaauauugucaaaguucuagaagacaugaaaggcaugaaaga

SEQ ID NO: 25955 - RNA, 46 nt, Mus musculus
aacauggaugcagugacuuaugaugaugugcgugugaacuucacug

SEQ ID NO: 25956 - RNA, 46 nt, Mus musculus
cuauuuagguuuuaagaagauauuaaaauuguauuauaguggggag

SEQ ID NO: 25957 - RNA, 51 nt, Mus musculus
agaucauauuugauugacaguccaccuacuuacaaugugcacuaugguuac

SEQ ID NO: 25958 - RNA, 48 nt, Mus musculus
uuccugauucaaaagaagugcuggaaaagguucuucuacggagagagu

SEQ ID NO: 25959 - RNA, 45 nt, Mus musculus
uaaacugcgccuuuucaaggauggaaaauugaaauaucagguauu

SEQ ID NO: 25960 - RNA, 48 nt, Mus musculus
uacgugcaacaccugagcgguuaccacuucaaacucaaguuugaccca

SEQ ID NO: 25961 - RNA, 35 nt, Mus musculus
gcaguggcaaaggccuccauugaccagagcagaga

SEQ ID NO: 25962 - RNA, 88 nt, Mus musculus
gucauggaacuguacccugcccugcugguggaaaaaccucguccagaugcuaucuuuggggagaccaugguagagcuuggagcaccau

SEQ ID NO: 25963 - RNA, 46 nt, Mus musculus
accuuuggaggcgaaguggguuuuaagaucaucaauacugccucaa

SEQ ID NO: 25964 - RNA, 47 nt, Mus musculus
caauaaugugaaggggugucccuucacuucuuucaaugugcaagauc

SEQ ID NO: 25965 - RNA, 57 nt, Mus musculus
augaauuuugauaucuuuauacuugaauuucagaucaugauuagcuuaacaagaacc

SEQ ID NO: 25966 - RNA, 46 nt, Mus musculus
uucuuaaaucuugcauaucuuuaucucaucaaacaaagggguccaa

SEQ ID NO: 25967 - RNA, 46 nt, Mus musculus
agcaaagccuagagcaacaaaagcuucuacaaaggaacuaaccaag

SEQ ID NO: 25968 - RNA, 46 nt, Mus musculus
uggccucgugagcuucuucacaauauugauaugucuuccagcccau

SEQ ID NO: 25969 - RNA, 41 nt, Mus musculus
aaacaaagacaguuugugaguaguucugggcaauagggaua

SEQ ID NO: 25970 - RNA, 46 nt, Mus musculus
cauuuucuacaucucauuaucagcugagguacuguauauuacugaa

SEQ ID NO: 25971 - RNA, 46 nt, Mus musculus
auuaccucucugaacuauggugugaacaaucaaacaaaaugaugag

SEQ ID NO: 25972 - RNA, 47 nt, Mus musculus
uuuacgcauaaagcagacugcauagauccaauauugacugacccaag

SEQ ID NO: 25973 - RNA, 47 nt, Mus musculus
cugauugaaccugggaauucagguuaaguaugugacugcuacagugc

SEQ ID NO: 25974 - RNA, 51 nt, Mus musculus
ucucugggccauaccuaauaggcauguugaucgcaaugaagggggagagga

SEQ ID NO: 25975 - RNA, 44 nt, Mus musculus
gccuucccacccuuuuugucuuuuuugucuuucuccacagugag

SEQ ID NO: 25976 - RNA, 70 nt, Mus musculus
gcccaggagugauggcauccaaauuuaaacaagucauacuggaucucacuguggagaaagacaaaaaaga

SEQ ID NO: 25977 - RNA, 42 nt, Mus musculus
agagcacgcgggccugggcggcgcggaaagcagcaggaggag

SEQ ID NO: 25978 - RNA, 45 nt, Mus musculus
cugcuuuccgcgccgcccaggcccgcgugcucugcgccaccagga

SEQ ID NO: 25979 - RNA, 45 nt, Mus musculus
guaggggagugggggggaggguaugggggacuuuugggaauagca

SEQ ID NO: 25980 - RNA, 45 nt, Mus musculus
auaaagaugcccagcuaaggcaacucagucacaugcauaguagac

SEQ ID NO: 25981 - RNA, 49 nt, Mus musculus
ggcuguuuagugggaguggacuuggcugaagagaccagagaauggaagg

SEQ ID NO: 25982 - RNA, 46 nt, Mus musculus
guuucugacuuacaugaaaccaccagcugccuuguuuagcccugcu

SEQ ID NO: 25983 - RNA, 107 nt, Mus musculus
cuugguccuguggagguuugaugacccaggauaggggaaugauagggcacugaggcaggaguagguggguggguggggagcacccucauagaggcagggggagggag

SEQ ID NO: 25984 - RNA, 45 nt, Mus musculus
cuuauauccauagcaacagacccaagguuaaagaugcugugcagg

SEQ ID NO: 25985 - RNA, 44 nt, Mus musculus
aauacacaugggaggaguuacagagacaaaguucggagcugaga

SEQ ID NO: 25986 - RNA, 42 nt, Mus musculus
gccauaagucccaggagcuacaauacugacuugccugcaaga

SEQ ID NO: 25987 - RNA, 45 nt, Mus musculus
uguuuuuccaccucuccugauaaagaguucagcaagacccgcaga

SEQ ID NO: 25988 - RNA, 46 nt, Mus musculus
uacuucuguuucccugaagucagggaauuuggucaacaguucagga

SEQ ID NO: 25989 - RNA, 41 nt, Mus musculus
aaaaucucagucuaagggaaaagauuuauuuugcagacagu

SEQ ID NO: 25990 - RNA, 75 nt, Mus musculus
gauuacuauaugcauauguaagauuguaugauucuacagggcaguccuaugggaggugaaugaacagaaccaggg

SEQ ID NO: 25991 - RNA, 57 nt, Mus musculus
acauguaguuuuaaaacuagucacaaucauguaaagggaaaaaguaaauagagggca

SEQ ID NO: 25992 - RNA, 46 nt, Mus musculus
caauccaucaagggcaauacaaugagaguaagugacacagacaaca

SEQ ID NO: 25993 - RNA, 42 nt, Mus musculus
augugugcacccgggcaccaccagcuuccuuuucggggagaa

SEQ ID NO: 25994 - RNA, 42 nt, Mus musculus
ucuccuucagccgcugcggcuguugccgcgaucccggccgac

SEQ ID NO: 25995 - RNA, 45 nt, Mus musculus
uuccuggccgagcagcaguccgagaucgacugccugaaggggcgg

SEQ ID NO: 25996 - RNA, 45 nt, Mus musculus
gggcccaccgacagaaacuggagaauuuggcccaguuugcaccag

SEQ ID NO: 25997 - RNA, 69 nt, Mus musculus
cacguguguuuacguagcuuuacacaucaaagguacuauugagagugauugaaguagcuuaaaugugua

SEQ ID NO: 25998 - RNA, 46 nt, Mus musculus
ugccucccaaaugcugggauuaaaggcgggcgccaccacagcccac

SEQ ID NO: 25999 - RNA, 53 nt, Mus musculus
uaacugaaaaaaccaaagaacuggaaacugcucaagaccguaaucugggcauu

SEQ ID NO: 26000 - RNA, 42 nt, Mus musculus
uuugauauacuugggagcugggucacucuacauugcugccug

SEQ ID NO: 26001 - RNA, 46 nt, Mus musculus
ccauauaggacuguacuuuuaaaauuacauuugauuuaagacucag

SEQ ID NO: 26002 - RNA, 46 nt, Mus musculus
gggagcaaguguaguuaaauucacuggacagugaaaagaagccacg

SEQ ID NO: 26003 - RNA, 46 nt, Mus musculus
agacauagacucucuaugaagaaggcuauuugcagaaaaaggaagg

SEQ ID NO: 26004 - RNA, 46 nt, Mus musculus
uagaggauguuaaacgucuaaaugaaaaacuuaaagaaagcaauac

SEQ ID NO: 26005 - RNA, 45 nt, Mus musculus
auggcugaacacagaguugaaaaccaaaacugaugagcuguuggc

SEQ ID NO: 26006 - RNA, 31 nt, Mus musculus
gcuccacuuuaaccuaggggaauguuuggag

SEQ ID NO: 26007 - RNA, 46 nt, Mus musculus
cugggacaaaauuucauggagagaagaaaaagccuaggcuaagaag

SEQ ID NO: 26008 - RNA, 47 nt, Mus musculus
aaagaucagauggaaaaagaaaugcuugagaaaauaggaaaauugga

SEQ ID NO: 26009 - RNA, 45 nt, Mus musculus
gauaguaaaagaaguggaagccaaagcaccgauuuugaaacgcca

SEQ ID NO: 26010 - RNA, 44 nt, Mus musculus
acaaucagagaauggaaauacaaauaaaagaccuuucgcaacag

SEQ ID NO: 26011 - RNA, 54 nt, Mus musculus
gucugucugagcauuacucaagcacaguacagagguuuuauaaagacagugugu

SEQ ID NO: 26012 - RNA, 46 nt, Mus musculus
cagaugcuacuaaugaguacaaguacuuaagucuucuaugguggga

SEQ ID NO: 26013 - RNA, 46 nt, Mus musculus
gcaggauugcugaacuucagcauaaacuugagaacucucucgcuga

SEQ ID NO: 26014 - RNA, 50 nt, Mus musculus
aauagacagugagaaacuucaaaaugagcagcuagagaaacuucaagagc

SEQ ID NO: 26015 - RNA, 85 nt, Mus musculus
agagaaaucagaaacucacugcaacuacucagaagcaggaacagaucaucaacacaaugacgcaagacuugagaggagccaauga

SEQ ID NO: 26016 - RNA, 28 nt, Mus musculus
aagguaagagcagaaaauuuaaagaagg

SEQ ID NO: 26017 - RNA, 59 nt, Mus musculus
acugaaaccaaacaaaggcugaauagccagauagaaaaacuggagcaugagaucucuca

SEQ ID NO: 26018 - RNA, 53 nt, Mus musculus
cuugaagaagaaauuggaaaacgagguggaacaaagacauacgcuuacgagga

SEQ ID NO: 26019 - RNA, 106 nt, Mus musculus
cuccaucuuaacacaaaagaacuguuaaaaaaugcucagaaggacauugcuacacugaaacagcaccuuaauaauauggaagcccagcucgcuucacaguccacac

SEQ ID NO: 26020 - RNA, 45 nt, Mus musculus
gcuaaggcaggcugaagaacaggucaaugacuugaaggagagacu

SEQ ID NO: 26021 - RNA, 67 nt, Mus musculus
auugaaguucgcuugaaagaaucagcagaguuucagacacaguuggagaagaaauugauggaaguag

SEQ ID NO: 26022 - RNA, 44 nt, Mus musculus
auugaugcuacaugcugcugaugucgaagcucugcaagcugcca

SEQ ID NO: 26023 - RNA, 45 nt, Mus musculus
aaagcagaaucccaguuguuggaauguaaagcaucuugggaagag

SEQ ID NO: 26024 - RNA, 44 nt, Mus musculus
uagagaaacaaaaccgacuacuucaugaucaaaucgaaaaauua

SEQ ID NO: 26025 - RNA, 54 nt, Mus musculus
agguggcucagguugagaguuugcgguaucgacaaagaguugaacuucuagaac

SEQ ID NO: 26026 - RNA, 57 nt, Mus musculus
cugaugaagaaaacugaaacaaugaacguuguuauggagaccaacaagaugcuacgg

SEQ ID NO: 26027 - RNA, 45 nt, Mus musculus
auaauugccgagucacucccauacacaggaauuuacaauggccua

SEQ ID NO: 26028 - RNA, 48 nt, Mus musculus
ugagcugagugagaaaagcgguaugcuccaggcagaaaagaagcuacu

SEQ ID NO: 26029 - RNA, 46 nt, Mus musculus
uuuucuucauuugcagggcgugguggcgcacgccuuuagucccagc

SEQ ID NO: 26030 - RNA, 46 nt, Mus musculus
ucaacagaaagauccagacacagaagaauaucgaaaguugcuuucu

SEQ ID NO: 26031 - RNA, 46 nt, Mus musculus
aggaaggcauucagaaagauuuagaugccaaaauaauugauauaca

SEQ ID NO: 26032 - RNA, 42 nt, Mus musculus
aaacuuugaggaacaacaauaugaacuaaccagugcccccag

SEQ ID NO: 26033 - RNA, 46 nt, Mus musculus
gaugagcuugauguccgaaugacugcucuuaagucccaguaugaag

SEQ ID NO: 26034 - RNA, 46 nt, Mus musculus
guauccgcccaaugguuacaccugcaacggucacaaauccgaccac

SEQ ID NO: 26035 - RNA, 46 nt, Mus musculus
cagaagggccuguggaacauguuccaguauuuggaaacgcaagugg

SEQ ID NO: 26036 - RNA, 46 nt, Mus musculus
acaagcuacagcuuuuguacaacccacucaacagagccacccgcag

SEQ ID NO: 26037 - RNA, 46 nt, Mus musculus
cucaguaagaaauaaccuauuaugauuuaggaagaaguuauggcag

SEQ ID NO: 26038 - RNA, 60 nt, Mus musculus
ucagaucaacagacuacuuccucucaagauggucaaggcaaaggagaugauguaauugua

SEQ ID NO: 26039 - RNA, 52 nt, Mus musculus
auugacagugaugaugaagaugaugaugaagaaaaugauggcgaacaugaag

SEQ ID NO: 26040 - RNA, 78 nt, Mus musculus
acgaagaugaugaugaugaugaagaagaugacacggggaugggagaugagggugaagauaguaaugaaggaacuggua

SEQ ID NO: 26041 - RNA, 47 nt, Mus musculus
aggguggugaugggacugauccagguacagaaacagaagaaaguaug

SEQ ID NO: 26042 - RNA, 42 nt, Mus musculus
augugucuuuagauacuaccacugaagguuuuuucgcaaaag

SEQ ID NO: 26043 - RNA, 45 nt, Mus musculus
guuaaccauccagagugagacagagguaaucccaguauucggcag

SEQ ID NO: 26044 - RNA, 46 nt, Mus musculus
guagaguccuacccuacuuguccaugaaucuauauauguaauagga

SEQ ID NO: 26045 - RNA, 46 nt, Mus musculus
guuguugugcuuccuguugcaguguaucuguuucaaacaaguugaa

SEQ ID NO: 26046 - RNA, 42 nt, Mus musculus
cuuaguauuaguucagaggcaggccuagaaauugauagccag

SEQ ID NO: 26047 - RNA, 46 nt, Mus musculus
cauaagccaauaggaugugcuugagacauucagagucagcacggag

SEQ ID NO: 26048 - RNA, 45 nt, Mus musculus
uuucuguagauaccaguaguagucaaccgaagccuuucagacgag

SEQ ID NO: 26049 - RNA, 42 nt, Mus musculus
aaagcugauucugauuuggauuaccuucaauauaggcuggaa

SEQ ID NO: 26050 - RNA, 41 nt, Mus musculus
agugcuccccacaccuagcaaacugauguauuucuugaggc

SEQ ID NO: 26051 - RNA, 45 nt, Mus musculus
ccauaacaaagucacgcauccacuggacccugucuggcccaaagu

SEQ ID NO: 26052 - RNA, 45 nt, Mus musculus
uacaaaugggguuuuagauuuaaaggcucgguuugaguagugugu

SEQ ID NO: 26053 - RNA, 46 nt, Mus musculus
cccagugccuuugaggaaaggagcugauguuacuaauacuguggca

SEQ ID NO: 26054 - RNA, 42 nt, Mus musculus
cacacacacacacacacacugcgaagcagacagcacucaggu

SEQ ID NO: 26055 - RNA, 44 nt, Mus musculus
ugcucauagaaauuguaucuucccgcuuuccugacgguauggug

SEQ ID NO: 26056 - RNA, 46 nt, Mus musculus
acagguaucagugagugguacggagaaaacgcuacagcaagaaaac

SEQ ID NO: 26057 - RNA, 46 nt, Mus musculus
gagagagagaaugagagagagagagagagagagagagagaaagaau

SEQ ID NO: 26058 - RNA, 45 nt, Mus musculus
caccaucggggcagcaggaucuccaggagaagcagccugguaagg

SEQ ID NO: 26059 - RNA, 46 nt, Mus musculus
ggaaggcaaaauaggaggauguuuugguuuggggagaggauaagaa

SEQ ID NO: 26060 - RNA, 45 nt, Mus musculus
uaggaauaccagaacuacaacucaucugccuccuuggcacugaga

SEQ ID NO: 26061 - RNA, 46 nt, Mus musculus
aaauaacucccacucaagagcaggagguguucagaauuuagcagau

SEQ ID NO: 26062 - RNA, 114 nt, Mus musculus
uccaggaacaacaaauuagaccuuguagccuaacacaaagugaugucucaguaccacugucaagcacuuuuugagaucuggggcacguaaaguccuucuuuugaaccugcacau

SEQ ID NO: 26063 - RNA, 54 nt, Mus musculus
cccauugaaacuccaucuagguuugauguugccucuagacaguuuucuuacuug

SEQ ID NO: 26064 - RNA, 46 nt, Mus musculus
guuucaaaguugguaaacuuugacuuguuugacuucaucgcaguuc

SEQ ID NO: 26065 - RNA, 43 nt, Mus musculus
uugauuucccaucaucgacuccauaaacaauagcgugggaaug

SEQ ID NO: 26066 - RNA, 41 nt, Mus musculus
cccagaagcuugcaagccgcggcugccggcgacgccccaga

SEQ ID NO: 26067 - RNA, 48 nt, Mus musculus
ggcccgcuuccggaagguggacguggacgaauaugacgagaacaaguu

SEQ ID NO: 26068 - RNA, 86 nt, Mus musculus
aggccgggcccgacgagggcgagguggacucgugccuacggcaauauccuuacgcucgcggcggccggggguuguggggacgcggg

SEQ ID NO: 26069 - RNA, 24 nt, Mus musculus
aggacaggagcucccggggccagc

SEQ ID NO: 26070 - RNA, 45 nt, Mus musculus
cuuuuugucaauccauuuuaaaauauaaagauauugucucugguu

SEQ ID NO: 26071 - RNA, 47 nt, Mus musculus
gcucuccaggcugcucugaaaaaccccccuauuaacacaaagagcca

SEQ ID NO: 26072 - RNA, 46 nt, Mus musculus
cucuuuggcacaaacaucccauuuccuucugguaauaaggcugccu

SEQ ID NO: 26073 - RNA, 45 nt, Mus musculus
gauuugggguuguuuuuccccccugucugucugucugugcaagau

SEQ ID NO: 26074 - RNA, 45 nt, Mus musculus
caguucccucccugcaguacccacuucccagcuauagccccaguc

SEQ ID NO: 26075 - RNA, 46 nt, Mus musculus
ccagucccucccuguguccaucuuuguccucucccugucccuuccc

SEQ ID NO: 26076 - RNA, 45 nt, Mus musculus
uguuuuuuggguuuugguuuuuguuuuguuuuguuuuugaaaggu

SEQ ID NO: 26077 - RNA, 48 nt, Mus musculus
ugggaaauuauggaaacaaucuaaauguccaauugcugugcuagggua

SEQ ID NO: 26078 - RNA, 47 nt, Mus musculus
gcaagagaaaggaauaaacucuauuugauaauuuauauuaggaggaa

SEQ ID NO: 26079 - RNA, 56 nt, Mus musculus
ccacgaaacagcagcauggggccagcacuuggggcccaaaagccugaagucugaag

SEQ ID NO: 26080 - RNA, 43 nt, Mus musculus
agcaggaaaugcccuucacucuguaggugcucgagccccaaua

SEQ ID NO: 26081 - RNA, 46 nt, Mus musculus
ccccaacacgugggaaguggaagcugagaagggaaggcagauggga

SEQ ID NO: 26082 - RNA, 46 nt, Mus musculus
cucucguucccccggggcuuuccggagggagagaggagcugcuguu

SEQ ID NO: 26083 - RNA, 44 nt, Mus musculus
gcggggacaaggugccaugaacccuccacacugaggccacagga

SEQ ID NO: 26084 - RNA, 46 nt, Mus musculus
guuccaugaugcauccugggcccuccgcucuggagcaguuguuaau

SEQ ID NO: 26085 - RNA, 46 nt, Mus musculus
uuaaaacauaguugauuugacuuaaaacauaguuugggcuggacau

SEQ ID NO: 26086 - RNA, 45 nt, Mus musculus
uuucuuagagcuugguugacuuuuuuuuuuuuaauggccucagau

SEQ ID NO: 26087 - RNA, 46 nt, Mus musculus
agcugccacuccuaguacuugaguuugccugggcgaguuagcagua

SEQ ID NO: 26088 - RNA, 65 nt, Mus musculus
caaaauggauaaaaauggagaaacuguucggaaaaggguuuaagauuuuaaaugaauggcuauga

SEQ ID NO: 26089 - RNA, 73 nt, Mus musculus
ugauuaauugaauugauugguucacuggacccuaaaagagcccuggucuaaauucagaauuggaauuauaaaa

SEQ ID NO: 26090 - RNA, 61 nt, Mus musculus
cccgcacucuaggugaugcuggcacauuaacccccucuucaggcaguacacaccuagccuc

SEQ ID NO: 26091 - RNA, 46 nt, Mus musculus
uccucuguauagaaauauaaaguauguuucuguauugcuuaaaauu

SEQ ID NO: 26092 - RNA, 46 nt, Mus musculus
gacagaacucaguugcuuuaucauucuuuucaccccugcaccauaa

SEQ ID NO: 26093 - RNA, 42 nt, Mus musculus
aaagcuguguucuucuguuuuaaaggauucccgcccccaaca

SEQ ID NO: 26094 - RNA, 46 nt, Mus musculus
uaaacaaaugauuucuauguuccuuuuccuuauuuuucugugauaa

SEQ ID NO: 26095 - RNA, 46 nt, Mus musculus
agaaaccaguggucaccuuuaaagagaacauuaagccacgagaagu

SEQ ID NO: 26096 - RNA, 46 nt, Mus musculus
uuauuuaucacagaaaucccagaauuaauacuagaagaccccagug

SEQ ID NO: 26097 - RNA, 44 nt, Mus musculus
caacaacgacgaauacgacagcagcguuugaucuccauagggaa

SEQ ID NO: 26098 - RNA, 45 nt, Mus musculus
cugugucaucuuucuuuaacaguuguuuguuuguuuguuuguuua

SEQ ID NO: 26099 - RNA, 45 nt, Mus musculus
cccuggcuaauuucucuucuaaauaguuuccauccccgugaagau

SEQ ID NO: 26100 - RNA, 46 nt, Mus musculus
ugcuuucaaucauuuguccuuuuuuaacauuuuauucaguauauau

SEQ ID NO: 26101 - RNA, 33 nt, Mus musculus
aaaauagaaaucucagaauacagugaaggugau

SEQ ID NO: 26102 - RNA, 46 nt, Mus musculus
gacaggagacagaacagaguggaauaacaggccuacgcagucagag

SEQ ID NO: 26103 - RNA, 64 nt, Mus musculus
auugaugcuuuaguuagccaguggugaauugggguagaagauaguugaauggaaaucaggugua

SEQ ID NO: 26104 - RNA, 45 nt, Mus musculus
ugagaagaaaauggaaagaaaaagacuuucaagugcuuggcaaga

SEQ ID NO: 26105 - RNA, 41 nt, Mus musculus
uccuucacacagagugaggagcugaggaaaaagggggcagu

SEQ ID NO: 26106 - RNA, 43 nt, Mus musculus
agaagguagugucucccucuguaagagaaagaaaaagagggga

SEQ ID NO: 26107 - RNA, 46 nt, Mus musculus
uuaaguuugaggucuugggcuuaaacaccaguauugccagagagag

SEQ ID NO: 26108 - RNA, 46 nt, Mus musculus
uuaaaaacaaaacauuuaaccauuaguauuuuuuucagcuguaguc

SEQ ID NO: 26109 - RNA, 46 nt, Mus musculus
cuuguaccagaaaaugcuaguuacugaucuggaauacgcuuuagac

SEQ ID NO: 26110 - RNA, 46 nt, Mus musculus
acaaaaauguuuuaaaucaaauuuaguuauuaagcgaaaggcagaa

SEQ ID NO: 26111 - RNA, 79 nt, Mus musculus
guucauaaaaauaauucucaucguuucaguagggcggcauauaggaaugauccagguauuagcuagauggugaccagau

SEQ ID NO: 26112 - RNA, 34 nt, Mus musculus
aguuauaucacuuuguuaagugaacuguugcuac

SEQ ID NO: 26113 - RNA, 45 nt, Mus musculus
cuguaguuugccagugggaaaagggacgggaacagcagcuugaaa

SEQ ID NO: 26114 - RNA, 74 nt, Mus musculus
aacguuugaaggccaguagcaagggaacuuuaaagacuguuaaaaagaggaaagaauaaucaaguccugaggaa

SEQ ID NO: 26115 - RNA, 99 nt, Mus musculus
accucaccaauaacagacaauucuugaauuucagagggugaauuaaaaaaauuuggaaaacuugaaaauguuugaaggccaaagagaaaaaaacuugaa

SEQ ID NO: 26116 - RNA, 55 nt, Mus musculus
uuccacaccugggaagccaugauaaaacggccaagaggagaaaaaacacguaaga

SEQ ID NO: 26117 - RNA, 46 nt, Mus musculus
gaaaaaucaauaaauguuugaaguucagguggauaguugguaagau

SEQ ID NO: 26118 - RNA, 42 nt, Mus musculus
uuaguaucauucauuugauuugauaguucuuuugugcuagau

SEQ ID NO: 26119 - RNA, 41 nt, Mus musculus
uaauaaacuaaaagccaaccuuggcucuuguauggugggga

SEQ ID NO: 26120 - RNA, 46 nt, Mus musculus
augcgccaccacugccuggugcagagauuuuuauauacacugagag

SEQ ID NO: 26121 - RNA, 46 nt, Mus musculus
cuuuaauacagcuccucauguuguggugacaccccccccccccaua

SEQ ID NO: 26122 - RNA, 41 nt, Mus musculus
cauugcagcuuucugaacuaucuccuguccaagcuaacuau

SEQ ID NO: 26123 - RNA, 41 nt, Mus musculus
guagaggaaggaacaccugauuuacaguuaggaagcagauc

SEQ ID NO: 26124 - RNA, 61 nt, Mus musculus
aacauccguucuggguucucuaugucuguagagauggaauuaaaugucucaaaggccccug

SEQ ID NO: 26125 - RNA, 46 nt, Mus musculus
gaggaaagaaugugcgacuucuugaagggggaaauaugcuaaagau

SEQ ID NO: 26126 - RNA, 44 nt, Mus musculus
uuacaaauaauaaaugaauaaauaaguauuaaauaaaagagaaa

SEQ ID NO: 26127 - RNA, 45 nt, Mus musculus
agacagacagacagacagacacacacacacacacacagcuaaaua

SEQ ID NO: 26128 - RNA, 46 nt, Mus musculus
ugugcauguuuguguagauaaaaauuuucauuuuguuuguguagau

SEQ ID NO: 26129 - RNA, 81 nt, Mus musculus
uaguaauuucagaucuuaucauuaucaaaaauaauagcagauguuuuuaauuuaccugugaaguauuguugacccccaaug

SEQ ID NO: 26130 - RNA, 61 nt, Mus musculus
uuuucaagagucagcauuuguuaauauuuuuguacuggagauuaaguuucagcaugcauuu

SEQ ID NO: 26131 - RNA, 46 nt, Mus musculus
auucuagaccacagauuuauaguaagcuguuaagcaaaacuaagau

SEQ ID NO: 26132 - RNA, 45 nt, Mus musculus
cugacaagguaaccuuaaccucuguaguuuucauuuuacugccag

SEQ ID NO: 26133 - RNA, 46 nt, Mus musculus
uauaugucuguguaccacauacaugcagugcuuauagaggccagaa

SEQ ID NO: 26134 - RNA, 46 nt, Mus musculus
ccuuucauaaaaaaaaucuuaccuaauuuagucauuggugucagga

SEQ ID NO: 26135 - RNA, 46 nt, Mus musculus
gggcaucuugguggagaugagauuucacguaaauauugaaagauga

SEQ ID NO: 26136 - RNA, 25 nt, Mus musculus
gaagcaaagguaauguguggaugua

SEQ ID NO: 26137 - RNA, 45 nt, Mus musculus
uguucauuuguucauucauuaauguuacaguggcuaggaagcaga

SEQ ID NO: 26138 - RNA, 46 nt, Mus musculus
uguuucuguugaguuuuguccucuggugagguagcaggugugugug

SEQ ID NO: 26139 - RNA, 45 nt, Mus musculus
gcguaaucauagacuggugaaagaagccaggagaauaggccauua

SEQ ID NO: 26140 - RNA, 90 nt, Mus musculus
uugaaaguucuaaccugugucacuuugacaaaaaucuagccaggacacacagaaaacugugugugugugugugugugugugugugugugu

SEQ ID NO: 26141 - RNA, 46 nt, Mus musculus
guccaucaucacucagggaguucagggcagugacuggcgcacaagu

SEQ ID NO: 26142 - RNA, 46 nt, Mus musculus
aagguggcacuuucgaacagugagacauaugauuaugaugguaaga

SEQ ID NO: 26143 - RNA, 45 nt, Mus musculus
uuuauuuuaauagaaauuaggggaugugaccugugaccuugacuu

SEQ ID NO: 26144 - RNA, 46 nt, Mus musculus
auaaacuauguggaccuuuagugcuugaaauaaggucuuggcaguu

SEQ ID NO: 26145 - RNA, 46 nt, Mus musculus
uuuauagauaaaauaaguagacaucagaaauauuaugaugagggau

SEQ ID NO: 26146 - RNA, 46 nt, Mus musculus
aggacuccacccucuuacagaacuuacuaguuuguuagguuuuaga

SEQ ID NO: 26147 - RNA, 46 nt, Mus musculus
auguagcuaucaccacaaaaagguaccauguuuuugaguccuagau

SEQ ID NO: 26148 - RNA, 91 nt, Mus musculus
ggccuuuuugucuuucaggaacaguguuuuucuuuuaaauagcaggucuuauuugggaagauacuuuuaaaaagugaguugaaaccuugag

SEQ ID NO: 26149 - RNA, 96 nt, Mus musculus
cucacaugcauuaacaccgacgucgagaacauuuugaauggaaagacagcagcuggugugcagucagaauaguuugacggauuuugagugagagcu

SEQ ID NO: 26150 - RNA, 50 nt, Mus musculus
gugugugugugugugugugugugugugugagugucugggguaagggaggg

SEQ ID NO: 26151 - RNA, 73 nt, Mus musculus
aaggauggggagacgagggaagagggaggugcuacgaacaaggugauguucucgaaagaaacuguaguuggaa

SEQ ID NO: 26152 - RNA, 107 nt, Mus musculus
gagcccgcaggaaacgcgagcuuguucuuuagucgcgggcuggaaggaggagaaauaaugccuucuguccagaguuagaggggucggagagcccggaaagggggaaa

SEQ ID NO: 26153 - RNA, 104 nt, Mus musculus
gaaacguggugugcuggccggggcgaugcaggagagaggaggauggaagucggcacaccuggggguugggagggcgcauucuggagggcaaaugagaggaaggg

SEQ ID NO: 26154 - RNA, 49 nt, Mus musculus
ccgggcgaggagcggagggagguuggggaagcgggagacgagaacgugu

SEQ ID NO: 26155 - RNA, 41 nt, Mus musculus
ggugggggagucgcggcguccuucuguccccagggcgggga

SEQ ID NO: 26156 - RNA, 44 nt, Mus musculus
gcggcgagacgcggcggcggaggaugagccugcagagcgcgcag

SEQ ID NO: 26157 - RNA, 45 nt, Mus musculus
accgugcuacugaugacagaggggaggcucuguucagccugucuc

SEQ ID NO: 26158 - RNA, 45 nt, Mus musculus
uguaaauauccccgguccuccuagaacggcacugucugcucacgu

SEQ ID NO: 26159 - RNA, 61 nt, Mus musculus
ccacacauccccuuccuccuaccuaccugccucugagauucauauuuagccuuuaacacua

SEQ ID NO: 26160 - RNA, 46 nt, Mus musculus
cacgcaccacuacgugagguagcuuuugauauuuuuauaagcagga

SEQ ID NO: 26161 - RNA, 42 nt, Mus musculus
ggccuacccacaucaugugaaccuuuuaaugccagggcagac

SEQ ID NO: 26162 - RNA, 46 nt, Mus musculus
guuuugccuaauaaagucucuccuccacuucugucagcacccuacc

SEQ ID NO: 26163 - RNA, 42 nt, Mus musculus
acuucucugcugcucuccaucacuguccuuuugacccaagaa

SEQ ID NO: 26164 - RNA, 45 nt, Mus musculus
gcaggaggcagccaucauggacuauaaccgggacauagcagagau

SEQ ID NO: 26165 - RNA, 47 nt, Mus musculus
ccugaacaagcucaaugagaucgaaggcucccugaacaaagccaaag

SEQ ID NO: 26166 - RNA, 45 nt, Mus musculus
cagccuacaguuaaacagccauuuccucuuaguucugccugcugg

SEQ ID NO: 26167 - RNA, 46 nt, Mus musculus
guaugcugaggcagcuggaggaggcagagaaugagcugaagaagaa

SEQ ID NO: 26168 - RNA, 45 nt, Mus musculus
accgaagaaagagaaccaggaagaggacuuucuacugucugggug

SEQ ID NO: 26169 - RNA, 46 nt, Mus musculus
ccgcugacgccacggaggccaagaacaaggcccaugaggcagagag

SEQ ID NO: 26170 - RNA, 48 nt, Mus musculus
cucuaaggagaauucccgccaucaaccggaccauagcugaagccaaug

SEQ ID NO: 26171 - RNA, 54 nt, Mus musculus
gaagggacgcaguaccuuacaagaagccaaugacauucucaacaaccugaaagg

SEQ ID NO: 26172 - RNA, 61 nt, Mus musculus
ccgccgaccaacuccuagcucgagccgaugcugccaaggcccuugcugaagaagcugcuaa

SEQ ID NO: 26173 - RNA, 59 nt, Mus musculus
cugcagaccuggaccgucugauugaccagaagcuaaaggauuacgaggaccucagggaa

SEQ ID NO: 26174 - RNA, 56 nt, Mus musculus
agaucuaugccaguguggcccagcugaccccuguggacucugaggcccuggaggua

SEQ ID NO: 26175 - RNA, 73 nt, Mus musculus
aucucucaggaccuggagaagcaggcugcccgaguccaugaggaagccaagcgugcaggugacaaagccguag

SEQ ID NO: 26176 - RNA, 52 nt, Mus musculus
ugaggacccuggcaggagaaaaucaaacugcgcuggagauugaagaacuuaa

SEQ ID NO: 26177 - RNA, 49 nt, Mus musculus
ucagccagagucuacaggggagccaaacaacaugacccucuuggcagaa

SEQ ID NO: 26178 - RNA, 54 nt, Mus musculus
ggcugagcgagcacggucccgaguggagaguacagagcagcugauugagaucgc

SEQ ID NO: 26179 - RNA, 56 nt, Mus musculus
agaguaaauagcagccugcauagccaaauuagccgacugcagaauauccggaauac

SEQ ID NO: 26180 - RNA, 41 nt, Mus musculus
cacauagacacacacacacacacacacacacacaccguuuu

SEQ ID NO: 26181 - RNA, 47 nt, Mus musculus
gacauggugacagaucaagccuuugaggacagacuuaaggaagcaga

SEQ ID NO: 26182 - RNA, 47 nt, Mus musculus
ugaaugcagggaaggcuuugugggcaaucgcugugaccagugugaag

SEQ ID NO: 26183 - RNA, 46 nt, Mus musculus
ccucaugugucuggccgcgacugcgguacuugugacccuggcuacu

SEQ ID NO: 26184 - RNA, 46 nt, Mus musculus
uagaccccaacgcgguuggcaacugcaaccgccugacgggcgagug

SEQ ID NO: 26185 - RNA, 46 nt, Mus musculus
aaucuacggcaggaaugccucaggccuuucuucuuuaaccucagau

SEQ ID NO: 26186 - RNA, 46 nt, Mus musculus
gguacagaagagaaacuccaagccuuggaccuuauagcccgugugu

SEQ ID NO: 26187 - RNA, 72 nt, Mus musculus
gaaaaaguaaaauaaagaauauucucuucaagaacuuugaaggagacgaaagagaugaauuaucauugggga

SEQ ID NO: 26188 - RNA, 45 nt, Mus musculus
agaaacagaguugaggucugugcccugaagcccaaggaggggaac

SEQ ID NO: 26189 - RNA, 93 nt, Mus musculus
aggcuccaugaagcaacggauuacccuuggaggcccgcucucuccccguuugaauuucagaagcuccugaacaacuugaccucuaucaagauc

SEQ ID NO: 26190 - RNA, 45 nt, Mus musculus
auccgugcccuugaucgcucagggcaacuccuaccccagcgagac

SEQ ID NO: 26191 - RNA, 44 nt, Mus musculus
gugaaguuccugggcaaccagguccugaguuaugggcagaaucu

SEQ ID NO: 26192 - RNA, 72 nt, Mus musculus
uggagugguccucagacaggcaagauauugccguaaucucagacaguuacuuuccuagauacuucaucgccc

SEQ ID NO: 26193 - RNA, 46 nt, Mus musculus
ugcuguuggcuacaguguuuaugacaucuccuccaccuuucagauu

SEQ ID NO: 26194 - RNA, 47 nt, Mus musculus
gcuccugcgauccuucgggcagcacagacgaguguaauguugaaaca

SEQ ID NO: 26195 - RNA, 46 nt, Mus musculus
aaaacggguugacuuucagaguggggcuucuuuccugccuguucuu

SEQ ID NO: 26196 - RNA, 45 nt, Mus musculus
uaguuuuaagcuagcauguacaguauuagguuucaucacggggga

SEQ ID NO: 26197 - RNA, 78 nt, Mus musculus
cacacagugugacaguuacggcagaugcagcuguaagccaggagugaugggugacaagugugaccguugucagccugg

SEQ ID NO: 26198 - RNA, 46 nt, Mus musculus
gagcaguucuguaaauaauuggcagcugggccauagaccauuugaa

SEQ ID NO: 26199 - RNA, 48 nt, Mus musculus
ucccagugaguggaguaagcuaaaagagaagucuccugaacccugagg

SEQ ID NO: 26200 - RNA, 62 nt, Mus musculus
gccuggggaacacugaagccugcucuccgugccacugcagcccuguuggugagugacaucca

SEQ ID NO: 26201 - RNA, 45 nt, Mus musculus
uaaauuaguaccuuguuuuugcuguuagugcuagaaguagaagau

SEQ ID NO: 26202 - RNA, 46 nt, Mus musculus
acggaguugacugugaaaagugccugccuuucuucaaugaccggcc

SEQ ID NO: 26203 - RNA, 41 nt, Mus musculus
ugucuaguuaaugucccaucuugggauuuuuggugugugug

SEQ ID NO: 26204 - RNA, 46 nt, Mus musculus
uagaggguccucccagauuccccacacuuaggccaagcugauagag

SEQ ID NO: 26205 - RNA, 42 nt, Mus musculus
gucuuacuauuacgcaaucucagacuuugcugugggcggcag

SEQ ID NO: 26206 - RNA, 36 nt, Mus musculus
cuugggugaggauuaaauagcuguguguugucugag

SEQ ID NO: 26207 - RNA, 46 nt, Mus musculus
cguuuauguuccccggcagucaguguuugcauccaacucugagaca

SEQ ID NO: 26208 - RNA, 24 nt, Mus musculus
agugacagagccuuucccccaguu

SEQ ID NO: 26209 - RNA, 24 nt, Mus musculus
aggcuggaauucaccaucagauac

SEQ ID NO: 26210 - RNA, 69 nt, Mus musculus
aacuccauacagcagggagcuccuaggagaaaauuucuagguggcguuuggauaccaagucucuggcau

SEQ ID NO: 26211 - RNA, 51 nt, Mus musculus
auuaaucagacuuugggauguuugcaguaacuugcauggagaguuagcguu

SEQ ID NO: 26212 - RNA, 55 nt, Mus musculus
gacaggugguauuugaagagagugguuuauggguaauaacaaaggggagacugca

SEQ ID NO: 26213 - RNA, 46 nt, Mus musculus
aaccuguguuuucucucaccagguagaauuucuuuagugcggagac

SEQ ID NO: 26214 - RNA, 46 nt, Mus musculus
gccaaguaguagugggaguccaguucaacgccacugugcuguagau

SEQ ID NO: 26215 - RNA, 39 nt, Mus musculus
uggcagggagggagggaggaagggagggaggugagagag

SEQ ID NO: 26216 - RNA, 41 nt, Mus musculus
uagaaaggucgaguacagcacuaaguuuaagugggccaaga

SEQ ID NO: 26217 - RNA, 45 nt, Mus musculus
aggcugguuauaguuuguggcaauggcuuggcuuuuuguuugggu

SEQ ID NO: 26218 - RNA, 41 nt, Mus musculus
cucugagucgguuugguugacuuugguuuauacgcggagau

SEQ ID NO: 26219 - RNA, 46 nt, Mus musculus
uggaguuccguaacuccauuuugguacuaggaaucaaaccccaguc

SEQ ID NO: 26220 - RNA, 57 nt, Mus musculus
auugaacauuaaaaaaaaaagaagaauugaacauuucuuuggaagaguauauuaggu

SEQ ID NO: 26221 - RNA, 42 nt, Mus musculus
ucuguuacgcuucguccuucguuucuucauuuggcuguugug

SEQ ID NO: 26222 - RNA, 45 nt, Mus musculus
aaggaacgauugguucugaauucuucaacucguuguugggcugua

SEQ ID NO: 26223 - RNA, 46 nt, Mus musculus
gagauuugggauggggguggaaggggaaagagagagagagagagaa

SEQ ID NO: 26224 - RNA, 45 nt, Mus musculus
auuuuauuucugauuuuugaugaaauauaucaucuuggcggaggu

SEQ ID NO: 26225 - RNA, 42 nt, Mus musculus
auuaaguauagguauuagaguucuccagggcaacaggagcga

SEQ ID NO: 26226 - RNA, 71 nt, Mus musculus
gccaugcuugaugcaggugcccccucccaugcccccacucuaccacaauauagaaaucuacuuugaaugac

SEQ ID NO: 26227 - RNA, 46 nt, Mus musculus
cuacagugugcucagauauaauaauaaguaaaucuuuaggccagag

SEQ ID NO: 26228 - RNA, 42 nt, Mus musculus
gaaauucauuucuuacugugccacccuggcagaggcgaggaa

SEQ ID NO: 26229 - RNA, 46 nt, Mus musculus
auucccaacaaccacaugguggcucacaaccaucuguaacaggauc

SEQ ID NO: 26230 - RNA, 42 nt, Mus musculus
auaaaaacaauaaaauauauuggggccuggugagauggcuca

SEQ ID NO: 26231 - RNA, 46 nt, Mus musculus
ugcguccuuucauuugaagauuuaucuuucaaugaccgccugguuc

SEQ ID NO: 26232 - RNA, 45 nt, Mus musculus
ucacgugggcugggacuuggaguuagagagacaagaggagacaca

SEQ ID NO: 26233 - RNA, 46 nt, Mus musculus
aaggaaauggaaugaggucauuaugguaugaaaagagauguguuua

SEQ ID NO: 26234 - RNA, 46 nt, Mus musculus
caguugugaacugccauguacguggugggaaucgaacccagguccu

SEQ ID NO: 26235 - RNA, 46 nt, Mus musculus
aguuugucugugccuuuccagucuccuagcaacaaucccuagagau

SEQ ID NO: 26236 - RNA, 42 nt, Mus musculus
gagggcugccgaaaccuacucggccugcuggacaacgacgag

SEQ ID NO: 26237 - RNA, 45 nt, Mus musculus
gguucuuugaacuucuuaauucucagaauccuuuucugggcccac

SEQ ID NO: 26238 - RNA, 45 nt, Mus musculus
cagggcuauuacacaaagugauuacguuauaaaaggccuccagau

SEQ ID NO: 26239 - RNA, 46 nt, Mus musculus
gaacuuauugagguccaccaaauaaaucccacuugagauauuguaa

SEQ ID NO: 26240 - RNA, 42 nt, Mus musculus
uuccuugucuuuagauauaacaugugauuuccgguugcuuag

SEQ ID NO: 26241 - RNA, 42 nt, Mus musculus
cucagugcugagauuauugguauggucauuaugcugugugug

SEQ ID NO: 26242 - RNA, 46 nt, Mus musculus
gagcuugguguguuaaagcugcuucauuugagauaccuucugaguc

SEQ ID NO: 26243 - RNA, 45 nt, Mus musculus
caaccaugaacaaacagaaaagccaauaacaacaaaaagaaagaa

SEQ ID NO: 26244 - RNA, 46 nt, Mus musculus
cuuguuuacgguugauuuugagggaugagcacuucucgccuccuaa

SEQ ID NO: 26245 - RNA, 62 nt, Mus musculus
gugaccacuguguacagaugaccucaagaagcagcagcgguuuguuuauguuuucccaagau

SEQ ID NO: 26246 - RNA, 43 nt, Mus musculus
acacacagccugguauccucugucuggcagucuguacucagaa

SEQ ID NO: 26247 - RNA, 46 nt, Mus musculus
aacucuccuucaucguauuuguauuugucuuuauguuaugccagau

SEQ ID NO: 26248 - RNA, 45 nt, Mus musculus
ggcagccugggcugcauagcuagucuauaaccaaagaaccaaaga

SEQ ID NO: 26249 - RNA, 56 nt, Mus musculus
uucuuaugcauuggaaauauuaagccuuaauaaauuagauagaagugaaggugaaa

SEQ ID NO: 26250 - RNA, 42 nt, Mus musculus
caugccccagauugacuuuguagaucacuucuaugcagaguu

SEQ ID NO: 26251 - RNA, 24 nt, Mus musculus
acacuguaauugaaggcaggaaaa

SEQ ID NO: 26252 - RNA, 45 nt, Mus musculus
ccugguugaucuccaguucuagucuguuucuccucugcucccagu

SEQ ID NO: 26253 - RNA, 46 nt, Mus musculus
agccgggaaaagcugauuggcuuuugaaaacagcuaauggacauga

SEQ ID NO: 26254 - RNA, 45 nt, Mus musculus
auguguuguaauauagucggguuccgggcauagcgcaucugugga

SEQ ID NO: 26255 - RNA, 46 nt, Mus musculus
acaaauagucaauuugccuuuaguugcuaagcuccacacccaagag

SEQ ID NO: 26256 - RNA, 46 nt, Mus musculus
ggaaaugaaguccuggaggaaaugugugguggcguagcuggggagg

SEQ ID NO: 26257 - RNA, 46 nt, Mus musculus
acacaugcuuuacacuuuuuagacaauuuaugaaaacuaggacugg

SEQ ID NO: 26258 - RNA, 99 nt, Mus musculus
uauauuaauuagcuuugggccauguuaaugacgaggccaaagaacucuuccaucucauuaggacggcaacaugauauuuucuauacgcuuggacuugau

SEQ ID NO: 26259 - RNA, 45 nt, Mus musculus
uguuuuacuuuuuuuuuguacucaauucugaauccccuugaaguc

SEQ ID NO: 26260 - RNA, 42 nt, Mus musculus
ugcaggcugcgcaccgggagguagcggaggcagcgcgaucuu

SEQ ID NO: 26261 - RNA, 45 nt, Mus musculus
gcugaggacacagugggauucuggucuuaagugaccagucucuaa

SEQ ID NO: 26262 - RNA, 44 nt, Mus musculus
auccagaacuuucuuuugaaugguaaaaauaauaaacucauaag

SEQ ID NO: 26263 - RNA, 46 nt, Mus musculus
uagggguuuuggucauuggggucacacuugaucauaacuuucagcc

SEQ ID NO: 26264 - RNA, 46 nt, Mus musculus
ugaaaguuaugaucaagugugaccccaaugaccaaaaccccuagau

SEQ ID NO: 26265 - RNA, 45 nt, Mus musculus
aauugaccaucucggcgcccauucccacaaucaccaaggucccac

SEQ ID NO: 26266 - RNA, 46 nt, Mus musculus
ugggaagcaagccggagguuaccauugagugcacaggagccgaguc

SEQ ID NO: 26267 - RNA, 45 nt, Mus musculus
gcucaucuacuucucggggaacgccaggcucgauggcaacccgau

SEQ ID NO: 26268 - RNA, 46 nt, Mus musculus
cgaggagaaccuggaguucuggcuggccugcgaggaguucaagaag

SEQ ID NO: 26269 - RNA, 42 nt, Mus musculus
acacacacacacacacgcacacacacacacacacaccccacu

SEQ ID NO: 26270 - RNA, 45 nt, Mus musculus
gcuauuuaucacagguuuguucacuuguuuaguggggugugugug

SEQ ID NO: 26271 - RNA, 46 nt, Mus musculus
cauuuaccagggucugucuguauugggcaucuauugaccuugguag

SEQ ID NO: 26272 - RNA, 46 nt, Mus musculus
agggcgaagagggaaaagcgaguagcaaguaccaggcugcgcagaa

SEQ ID NO: 26273 - RNA, 42 nt, Mus musculus
ggugcggcacaugguugcggacgcaggacagcacgucgugga

SEQ ID NO: 26274 - RNA, 39 nt, Mus musculus
cuccgauacuggggguauuagcaaauucgagugggccag

SEQ ID NO: 26275 - RNA, 49 nt, Mus musculus
auucagugaggagaaccuggaguucugguuggccugcgaggaguucaag

SEQ ID NO: 26276 - RNA, 58 nt, Mus musculus
accaaacuggcguccagggcucaccacaucuuugacgaguacauccgcagcgaagccc

SEQ ID NO: 26277 - RNA, 45 nt, Mus musculus
uucaguauaagccagggaugugaacagagcacacagugagaauua

SEQ ID NO: 26278 - RNA, 46 nt, Mus musculus
cugugggggaagcagggcaaaccacaaaggugagugguguggagug

SEQ ID NO: 26279 - RNA, 47 nt, Mus musculus
acaggugaacauagaucacgagacccgagaacugaccaagacaaacc

SEQ ID NO: 26280 - RNA, 42 nt, Mus musculus
gucaccagcuuaucgcgaccuggcugcccaagccucggccac

SEQ ID NO: 26281 - RNA, 46 nt, Mus musculus
agaggauaguggaaggacagacggacauccauccccgcagcuugag

SEQ ID NO: 26282 - RNA, 45 nt, Mus musculus
ccagagcacccggcgcagccuugucgucagcccucagucacaggu

SEQ ID NO: 26283 - RNA, 42 nt, Mus musculus
augagauuucuauaccucaaaaaaccggccugugagccccuu

SEQ ID NO: 26284 - RNA, 46 nt, Mus musculus
ggaaggagacuuccggcacaggggccagcacucauguccagcaggu

SEQ ID NO: 26285 - RNA, 45 nt, Mus musculus
accgaacaaacuuuccaaguugggacuuccagcaccagccaccga

SEQ ID NO: 26286 - RNA, 46 nt, Mus musculus
gauugucucgcugcuauuguuauuuauugugguuuguuugccugua

SEQ ID NO: 26287 - RNA, 45 nt, Mus musculus
gacccuggaucccugaacagucucuuuaacuaagaccuuccagau

SEQ ID NO: 26288 - RNA, 42 nt, Mus musculus
gauggcuacucuaauuguugccgauuuccaugggguuguuug

SEQ ID NO: 26289 - RNA, 44 nt, Mus musculus
ccgcaugugacacggacguaggagaggcgcuacggggacccaga

SEQ ID NO: 26290 - RNA, 46 nt, Mus musculus
acagcuacaguguacuuaauuauaaucaauaaauaaauuauuaaaa

SEQ ID NO: 26291 - RNA, 46 nt, Mus musculus
auagaaaauuaaauuaacuuuaaacguguuauuugagccugcagga

SEQ ID NO: 26292 - RNA, 43 nt, Mus musculus
uuucguggaauccagucagacgccgggcguuguccaggccccc

SEQ ID NO: 26293 - RNA, 42 nt, Mus musculus
guauuccauccuuuugaguuacaguggggacaacugggaaag

SEQ ID NO: 26294 - RNA, 48 nt, Mus musculus
gugacacuaggagacaaguguuuuaacucuaggccuguccuuaauucc

SEQ ID NO: 26295 - RNA, 46 nt, Mus musculus
guacucuuaccugcccugcccuccuuucugagaaacuugcuugcag

SEQ ID NO: 26296 - RNA, 45 nt, Mus musculus
auugugaagauuccuuauguuggguuucuagguuagcacggaagc

SEQ ID NO: 26297 - RNA, 46 nt, Mus musculus
uuaaagcucccagccugccuauuucaaguuuauacaaugccagaac

SEQ ID NO: 26298 - RNA, 64 nt, Mus musculus
gcacacugacagggagucagaguguaguugauggagaggacuggguggggcuguggcagcagga

SEQ ID NO: 26299 - RNA, 66 nt, Mus musculus
uccaccaugcuucccuguugucugagcaggugaaccuaaggcaaggcaagagcagagcugagggag

SEQ ID NO: 26300 - RNA, 46 nt, Mus musculus
ucuguugcuuuuuguguuuugccaagcaugucccuugccccaaaac

SEQ ID NO: 26301 - RNA, 46 nt, Mus musculus
auugagauuuuuaacaacaccuugcccccaucccccaccccaaaaa

SEQ ID NO: 26302 - RNA, 46 nt, Mus musculus
ccaggcaggcaucccccuugcaucccagugguggaaauccagagaa

SEQ ID NO: 26303 - RNA, 45 nt, Mus musculus
cuacuccugugaagggaggcaggaggaacuaaggcucacuggcac

SEQ ID NO: 26304 - RNA, 46 nt, Mus musculus
acgucuucuuacaggacugaugguuauuaugagcacaugcuaguaa

SEQ ID NO: 26305 - RNA, 45 nt, Mus musculus
ggacuccuuuuguuuuuucauuauuuaaucucauuuagugugugu

SEQ ID NO: 26306 - RNA, 46 nt, Mus musculus
guugcccucaucccucaccucguaaaaaacuuuguguaugaguggg

SEQ ID NO: 26307 - RNA, 45 nt, Mus musculus
gagcaaaaaagggugucacauccccuggagcuguugauggucaga

SEQ ID NO: 26308 - RNA, 46 nt, Mus musculus
uaaaaagggagaaaugguuaagcaguagugaacauagcuagagaaa

SEQ ID NO: 26309 - RNA, 46 nt, Mus musculus
aaacacaacaaaaacuguuguggguggaguuauuuacugcacugaa

SEQ ID NO: 26310 - RNA, 101 nt, Mus musculus
gauacgauuuccaggugauacaagcuuauguauuauguaggagugagguguuauuauauguguaaguaacuaucaagagggccaguaaaacauuuagaaaa

SEQ ID NO: 26311 - RNA, 46 nt, Mus musculus
accaggcucucuuuauaauagauggaggauagagaaaccugguuag

SEQ ID NO: 26312 - RNA, 49 nt, Mus musculus
uggucuguaaaugauacagucucaguagggguaaugcuagacuuaggga

SEQ ID NO: 26313 - RNA, 56 nt, Mus musculus
auauuucaaaauuuaccagguauaucugucuucuaaaaugucaugagagagggcaa

SEQ ID NO: 26314 - RNA, 74 nt, Mus musculus
uggagugcuucuccucugcacaguuaucuuuauguccuuagaucaaugaaauauauguaaaauaauaauaggag

SEQ ID NO: 26315 - RNA, 47 nt, Mus musculus
uuuaagagauaugcuguuugugcucuuugcaucauuaaugaaggccu

SEQ ID NO: 26316 - RNA, 45 nt, Mus musculus
ucgugugccugcagcuguguguuguaugcgcuucaguccuggcuu

SEQ ID NO: 26317 - RNA, 45 nt, Mus musculus
ucaaaucccagcaaccacaugguggcucccaaccaucuguaguga

SEQ ID NO: 26318 - RNA, 49 nt, Mus musculus
cacccaucagucccuuaaaaagagaagugugugaaaggucugagauuuu

SEQ ID NO: 26319 - RNA, 45 nt, Mus musculus
gguaggguuaguuggauuucugcauaugcuguggguugugcauau

SEQ ID NO: 26320 - RNA, 46 nt, Mus musculus
ucguaccuggugugcuuuacacacugcagggcuaaauguggggggg

SEQ ID NO: 26321 - RNA, 57 nt, Mus musculus
cuguuuuuguugugguuuuguuuuuauuugcccccaaauuaauuuggagcauagccc

SEQ ID NO: 26322 - RNA, 46 nt, Mus musculus
uagauauguuucagccuucaagacucagccuagcccuuccgccugc

SEQ ID NO: 26323 - RNA, 57 nt, Mus musculus
aaaucuauucggggaagauuugaggugaauuccuuuccuguaccugucuccugucag

SEQ ID NO: 26324 - RNA, 45 nt, Mus musculus
gcuuggauaguaucugaagucuuuuuauuuguuauccugugccca

SEQ ID NO: 26325 - RNA, 46 nt, Mus musculus
uuaaaugucugauuuauaggcagccguaaguaauuuuaggaaguag

SEQ ID NO: 26326 - RNA, 45 nt, Mus musculus
uuuuuuuguuguuguuguacuuuuuacccccauauaauugcugua

SEQ ID NO: 26327 - RNA, 55 nt, Mus musculus
ugcuaaggcacauaguuuuccauuuuuaaaagugugugugugugugagagagaga

SEQ ID NO: 26328 - RNA, 45 nt, Mus musculus
ucacacugaguuuauauuguugaccuuugguccugcuuugguuug

SEQ ID NO: 26329 - RNA, 46 nt, Mus musculus
aagaaagaauuuaacuuuuuuaaaaauaggaagcuacacuuaugag

SEQ ID NO: 26330 - RNA, 42 nt, Mus musculus
caguuggauccuuucucuccacauacaaacaacuggcaccug

SEQ ID NO: 26331 - RNA, 44 nt, Mus musculus
cggugguccgguuguuaguucucuauaucaugaagaaacaauca

SEQ ID NO: 26332 - RNA, 46 nt, Mus musculus
ccuuccugcucucuaccucccuuucuuaugaaaaugaucccaguug

SEQ ID NO: 26333 - RNA, 41 nt, Mus musculus
ccacaagucccaccauguguuuucuuugguuggugguauag

SEQ ID NO: 26334 - RNA, 46 nt, Mus musculus
acaaagcagguauaugaauuuuucuggugaauuuuuccagggguag

SEQ ID NO: 26335 - RNA, 46 nt, Mus musculus
ugcaaacuuuauaugccccaguacaggggaaugccagggccacgaa

SEQ ID NO: 26336 - RNA, 33 nt, Mus musculus
gaagagcacagugggagggguuugcuuaggaga

SEQ ID NO: 26337 - RNA, 46 nt, Mus musculus
cugagcuacauagugagauccuguuuacaggcaucaaagugauuag

SEQ ID NO: 26338 - RNA, 64 nt, Mus musculus
ggaaaacaacauugaccauauagccaaagccaucaaaucgaaagcugcggaugugaauaugaca

SEQ ID NO: 26339 - RNA, 45 nt, Mus musculus
uccuaaauaguuguaaaggucauauccacgugugcucucugcaaa

SEQ ID NO: 26340 - RNA, 42 nt, Mus musculus
ccgagaccccagccugccagaacauuguguucccaugaacag

SEQ ID NO: 26341 - RNA, 45 nt, Mus musculus
gcaaauguugcucaauuccuguugagcugcaucuuguuggcuuau

SEQ ID NO: 26342 - RNA, 58 nt, Mus musculus
ugggcaugugaccgaggacauaaggaacuggugaaagucuugcuacaguaugaagcug

SEQ ID NO: 26343 - RNA, 42 nt, Mus musculus
guugugagccaccaugugauugcugggaauugaacuccaggu

SEQ ID NO: 26344 - RNA, 45 nt, Mus musculus
gaccuguaaaucacuuuauauauaaacauacaguuguagauugag

SEQ ID NO: 26345 - RNA, 46 nt, Mus musculus
ggcuggauguguguuacaggucucccaccuggugcacacuuugaag

SEQ ID NO: 26346 - RNA, 45 nt, Mus musculus
ccugcguguaugucuguaccacaugcaugcuuggaggcugcagag

SEQ ID NO: 26347 - RNA, 46 nt, Mus musculus
cagucuuguaaucagugagccaucuuuccaguaucccugccaccuu

SEQ ID NO: 26348 - RNA, 47 nt, Mus musculus
agauuuaaauaaaaagaagaagaaggagaaggagaaggagaaggaga

SEQ ID NO: 26349 - RNA, 45 nt, Mus musculus
auuaucugacacuggccagaggucuugguucuguuaagggcaaag

SEQ ID NO: 26350 - RNA, 42 nt, Mus musculus
ugcucugucucuuuuuaguuucuguuuccaugaacuguccau

SEQ ID NO: 26351 - RNA, 45 nt, Mus musculus
ggucacaggacaaccugaaugucagugcucuccuuccccuuuaag

SEQ ID NO: 26352 - RNA, 45 nt, Mus musculus
uccauggcaagcauuuuacccacuaaaccaacuucucagugccag

SEQ ID NO: 26353 - RNA, 61 nt, Mus musculus
caaacuguauccaguagguuauuuuuaaaaaagaagaagaagauaagguuaagucagguag

SEQ ID NO: 26354 - RNA, 46 nt, Mus musculus
uguauucauccagaaugucugcucuaccucccagcacuuguuuuag

SEQ ID NO: 26355 - RNA, 45 nt, Mus musculus
uccccucucucucuuuugcucugugugugugugugugugugugug

SEQ ID NO: 26356 - RNA, 31 nt, Mus musculus
uuuuaauuuaguuugugggguauguguguga

SEQ ID NO: 26357 - RNA, 46 nt, Mus musculus
uauagcauguuuaacagucuucaucugcuguuuucucuguacccag

SEQ ID NO: 26358 - RNA, 45 nt, Mus musculus
guugaccuacaaucacaaaaaaaauacaagaaaaagauggaggag

SEQ ID NO: 26359 - RNA, 46 nt, Mus musculus
ucaauuuucuaaauugucagauugauuuaaucauuuucuguuacag

SEQ ID NO: 26360 - RNA, 24 nt, Mus musculus
aguagacucaagauugcaguagau

SEQ ID NO: 26361 - RNA, 46 nt, Mus musculus
gaccagugcugcucuuuccaguugcccuuagcuauacccugaccag

SEQ ID NO: 26362 - RNA, 46 nt, Mus musculus
gcgucugaagacagcaacaguguacucacauacauaaaaaagaaaa

SEQ ID NO: 26363 - RNA, 41 nt, Mus musculus
uggaaaugugugugugugugugugugugguguguguguugc

SEQ ID NO: 26364 - RNA, 91 nt, Mus musculus
cuugcacguguggucaugugauugcagagugggccggcuuuguauccuccugagcccucaggcuuccacggaaagcgccaucuguucugcu

SEQ ID NO: 26365 - RNA, 92 nt, Mus musculus
ccuuccguacuguuccagggcagugggaggaggaauuagagagaaaauaaauaaaauaaaaaaaagaaagaaauucaucaucagaaccccga

SEQ ID NO: 26366 - RNA, 45 nt, Mus musculus
uguuuugagaguaugagauugcacguucucgcuugugaccuguga

SEQ ID NO: 26367 - RNA, 46 nt, Mus musculus
uauggcucugugguagaaaacaugcuuagaacacauaaggccccag

SEQ ID NO: 26368 - RNA, 46 nt, Mus musculus
uauugcuucuccucucuuccuuuucuccuauucuucaucuguccau

SEQ ID NO: 26369 - RNA, 44 nt, Mus musculus
acaucaucaccccugaaagcugauugaggacuguaaccaccuca

SEQ ID NO: 26370 - RNA, 46 nt, Mus musculus
aggaauaagcagcagucgucuccggggugggagcuuaggagggaag

SEQ ID NO: 26371 - RNA, 45 nt, Mus musculus
auuauaccauagcagucaacacaaagcauuaaaaaaucugcuaua

SEQ ID NO: 26372 - RNA, 42 nt, Mus musculus
cuaaauucaauugugugugugugugugugugugugugugugu

SEQ ID NO: 26373 - RNA, 44 nt, Mus musculus
ggaacugcugcuccagucuggcgcugaccccacccuccgagacc

SEQ ID NO: 26374 - RNA, 83 nt, Mus musculus
cuugucucuuacuuuggucucuaaaaucaaugcuaacuuugggguguggaaggugcuggguuuagggcagugggcagagcccu

SEQ ID NO: 26375 - RNA, 31 nt, Mus musculus
uugugaaguccugccccauuccugcugaagu

SEQ ID NO: 26376 - RNA, 46 nt, Mus musculus
acuggcccccuugcuuccuuucuaccccuuguucuguugucuagcu

SEQ ID NO: 26377 - RNA, 46 nt, Mus musculus
gagcucaggcgagggggccgcagccccaagcaacuagcccccauac

SEQ ID NO: 26378 - RNA, 52 nt, Mus musculus
ccagggcagggcccuccugagcgcauggaagaccaccagagggauaugcagg

SEQ ID NO: 26379 - RNA, 47 nt, Mus musculus
cuagauguaccagcugagaagccugaagcaaguggcccccaagaacu

SEQ ID NO: 26380 - RNA, 42 nt, Mus musculus
gacacacaggccggagagggaguccagaagcuacccccgagc

SEQ ID NO: 26381 - RNA, 41 nt, Mus musculus
agauggcugcagcguccaugcaccaagugagaagucccagu

SEQ ID NO: 26382 - RNA, 46 nt, Mus musculus
gagccuuucuguggugucuccuuuucccugcagcugauggccagga

SEQ ID NO: 26383 - RNA, 45 nt, Mus musculus
gccagagagcaaguugagugggagcugaagcaggcagguggagga

SEQ ID NO: 26384 - RNA, 41 nt, Mus musculus
aauguguagaagcaacaggaagugagccccaagguaucuga

SEQ ID NO: 26385 - RNA, 44 nt, Mus musculus
gaacuucuugcauuccauaaacgacuggcuucagaagcagcaga

SEQ ID NO: 26386 - RNA, 42 nt, Mus musculus
aguccuggggagugguguggugcuuggaacuuucucugagug

SEQ ID NO: 26387 - RNA, 46 nt, Mus musculus
cagcgccugguggcccugaaaaaguuuguggcaguauuggccaagg

SEQ ID NO: 26388 - RNA, 46 nt, Mus musculus
ucgggggcuaccuggacugaccagggaugcucccccaaccacagcc

SEQ ID NO: 26389 - RNA, 33 nt, Mus musculus
gcccacuggguaagccccauccacacccuacug

SEQ ID NO: 26390 - RNA, 46 nt, Mus musculus
acuaaucccuguacauuuauuagccaggcucugccugaccccuggu

SEQ ID NO: 26391 - RNA, 45 nt, Mus musculus
aggcugaaugauaucgacggauucuuuacaagaaauaaagcagau

SEQ ID NO: 26392 - RNA, 46 nt, Mus musculus
guaaauguguuggacaaagugaaugacuugguaacagagagcagua

SEQ ID NO: 26393 - RNA, 24 nt, Mus musculus
agacucccauaguuaugccuuggg

SEQ ID NO: 26394 - RNA, 46 nt, Mus musculus
uguguggaaugguggcaggucaguuuggguucagaucuugaaagga

SEQ ID NO: 26395 - RNA, 46 nt, Mus musculus
ggagucugacuaggacagaggagcaugggcaggaaggugagagcua

SEQ ID NO: 26396 - RNA, 45 nt, Mus musculus
gcugucugcagagaguucaacaucgcuggcuucccgacugugagg

SEQ ID NO: 26397 - RNA, 45 nt, Mus musculus
gcgaacagaacagggugccugcagaaagguccucguguuugggga

SEQ ID NO: 26398 - RNA, 45 nt, Mus musculus
ugucacuucucugaugaguguguuuccuaguuuguggugccaggc

SEQ ID NO: 26399 - RNA, 45 nt, Mus musculus
uucuucgccuccugguguggccacugcaucgccuucgccccgacg

SEQ ID NO: 26400 - RNA, 23 nt, Mus musculus
gcugacgcugcuggaugcugauu

SEQ ID NO: 26401 - RNA, 42 nt, Mus musculus
cgccucgccccggcucccgggauccgccgggcggcaggcaag

SEQ ID NO: 26402 - RNA, 41 nt, Mus musculus
ggcagcggcggcccagucgccauuacagcucaacaacugac

SEQ ID NO: 26403 - RNA, 45 nt, Mus musculus
uuuauaagggagaaaugcagagagauggaaagcauauuagugguu

SEQ ID NO: 26404 - RNA, 45 nt, Mus musculus
gaaguuuucuaacuugaaaacacacauguccaaagaaaugaccaa

SEQ ID NO: 26405 - RNA, 42 nt, Mus musculus
uuucggcguuguucacggcugaagcagccuaguucgagaccu

SEQ ID NO: 26406 - RNA, 44 nt, Mus musculus
cugucacuuuggcgacccgaagcugggacaauuccaccuucaga

SEQ ID NO: 26407 - RNA, 41 nt, Mus musculus
guguuuugaaguuugaaagaacaagaacccaggaccugaug

SEQ ID NO: 26408 - RNA, 45 nt, Mus musculus
aaacaaauggaucucaguaacuccaguguagugugguacagaaga

SEQ ID NO: 26409 - RNA, 45 nt, Mus musculus
guuguuaagucaaugaaucaguccuuuaguuuuaaguccaaggaa

SEQ ID NO: 26410 - RNA, 46 nt, Mus musculus
agaaagcgcucuccaccgaaagcauccagcgucuuuuguuuaagau

SEQ ID NO: 26411 - RNA, 26 nt, Mus musculus
uaaacaccgggcucggggaggcgaug

SEQ ID NO: 26412 - RNA, 42 nt, Mus musculus
aagaaagcgaaauccaccuuaaaaaaaaacaaaacccaagau

SEQ ID NO: 26413 - RNA, 46 nt, Mus musculus
uuuaaaaaaaauguuaaucuacuuuguaaaccaguaacucccagac

SEQ ID NO: 26414 - RNA, 45 nt, Mus musculus
gugugugugugugugugugugugugugugugugaaggcagcuccu

SEQ ID NO: 26415 - RNA, 42 nt, Mus musculus
uguuagaaaagagaagugucuguacugccuaggcccugggau

SEQ ID NO: 26416 - RNA, 46 nt, Mus musculus
uucugacccuuguuugugagucccuguagcaucgcuaugccuuaag

SEQ ID NO: 26417 - RNA, 42 nt, Mus musculus
cggguuauaaggagccgagugugaguggagaagagaggggag

SEQ ID NO: 26418 - RNA, 37 nt, Mus musculus
agaauuaguuaaaggaagggccgagaauuggcuguag

SEQ ID NO: 26419 - RNA, 46 nt, Mus musculus
ucauacacagacuauaucaccucuugccugcaaaaaaaaggcagau

SEQ ID NO: 26420 - RNA, 46 nt, Mus musculus
ccgagggggcacagguaugguagugggaguuuggaaauucucucca

SEQ ID NO: 26421 - RNA, 93 nt, Mus musculus
cuccaucagcgucaggucaaguucgagguuacuauguagacuggagaauguugcgugauuugaagagacggaaaauggcuuaugaauaugcag

SEQ ID NO: 26422 - RNA, 46 nt, Mus musculus
auguauggagcagcacuauucacaauaacucaaaagagaaccuacu

SEQ ID NO: 26423 - RNA, 46 nt, Mus musculus
cuaguuucacugcguauguuggaauuccuucauguauucuguagcu

SEQ ID NO: 26424 - RNA, 52 nt, Mus musculus
aaccugcccagcugggcagucaauccuggcaggagacuuaagaucaaacccu

SEQ ID NO: 26425 - RNA, 46 nt, Mus musculus
guggcuauuugucauugaauugucuuucaacuuuaaagcauaguac

SEQ ID NO: 26426 - RNA, 46 nt, Mus musculus
caagggacuuccacugguaauaggacaaugaucauggguaagaaug

SEQ ID NO: 26427 - RNA, 44 nt, Mus musculus
caaaucccagcaaccacauggugacucacaaccauccgaaacaa

SEQ ID NO: 26428 - RNA, 46 nt, Mus musculus
gcuauuaaauuuucaugcuuagguuaggaaaaguagaugcauagaa

SEQ ID NO: 26429 - RNA, 46 nt, Mus musculus
uauuuaucugucaaaacuacauacccacaugaacaaauaugugcag

SEQ ID NO: 26430 - RNA, 48 nt, Mus musculus
cauucauuaaucccucacuagggucugccuccgugucguaggaaggcu

SEQ ID NO: 26431 - RNA, 44 nt, Mus musculus
caaaugugcagaacucuggccuacaaauuguaugcggcuaccaa

SEQ ID NO: 26432 - RNA, 46 nt, Mus musculus
ucacaaucauggaguaauucuugccauugagguuuuuuaccagaag

SEQ ID NO: 26433 - RNA, 46 nt, Mus musculus
gugaagugcaccugcacguucucagugggcaccugauggacgccag

SEQ ID NO: 26434 - RNA, 46 nt, Mus musculus
cauaauuacugauuuucacgguguauccuguuguaagaggagcaac

SEQ ID NO: 26435 - RNA, 46 nt, Mus musculus
aagaaauaaaaaauaauuuuaaaauauuuuaaaugcuagauauuag

SEQ ID NO: 26436 - RNA, 42 nt, Mus musculus
aacuguuaagccacccucuccacucucccagugagcacgugg

SEQ ID NO: 26437 - RNA, 45 nt, Mus musculus
ccuaauuuuuauguguuuaaagcccaugauuucuaagugagggag

SEQ ID NO: 26438 - RNA, 39 nt, Mus musculus
acaugauuuuauguaucuagauauguaaacuguguaaga

SEQ ID NO: 26439 - RNA, 46 nt, Mus musculus
caaccuagacagaaaaccaucaaagagaacucuaaaaaauugugau

SEQ ID NO: 26440 - RNA, 68 nt, Mus musculus
aaugggaucugaugucuucuucuggugucugaagacagcuacaguguacuuauauacauaaaauaaau

SEQ ID NO: 26441 - RNA, 42 nt, Mus musculus
ccuuccggcggcccaagacccugcgguuccggaggcagccaa

SEQ ID NO: 26442 - RNA, 49 nt, Mus musculus
gauguggccaaagucaauacccugauaaggcccgacggagagaagaagg

SEQ ID NO: 26443 - RNA, 45 nt, Mus musculus
gucugaggaagaggaaggggacgaggacaacgagcgacgggcggc

SEQ ID NO: 26444 - RNA, 41 nt, Mus musculus
gaccaacaagauggccccugcugcaggagcagccucagcag

SEQ ID NO: 26445 - RNA, 46 nt, Mus musculus
aaauguaauuuuucuaggcauuuaccacauacauuuucaaauggag

SEQ ID NO: 26446 - RNA, 45 nt, Mus musculus
uuguguaguucuaaaguagaaaaaaguuguaaauuaaaugugaga

SEQ ID NO: 26447 - RNA, 41 nt, Mus musculus
cauacuacucuugcaaaggacaugaguucucuagcacccau

SEQ ID NO: 26448 - RNA, 42 nt, Mus musculus
gaguaauuucuaauauugccauugucuuuuuuucccccauuu

SEQ ID NO: 26449 - RNA, 45 nt, Mus musculus
agaacuacuugcuuaguguccuuggaggcuauugagagaauguca

SEQ ID NO: 26450 - RNA, 46 nt, Mus musculus
guaugugaugucugugaugcguguaccguacagaauguguggccag

SEQ ID NO: 26451 - RNA, 46 nt, Mus musculus
auaaaguaucuccugccuaacaaggagaaaauguuuuaagugauag

SEQ ID NO: 26452 - RNA, 46 nt, Mus musculus
ggaaaauauauacccuguuaucucagcgcuugggagguggagacag

SEQ ID NO: 26453 - RNA, 46 nt, Mus musculus
guuggcaauagaaagcauaaaaauagaccaaaccacuguagaaaac

SEQ ID NO: 26454 - RNA, 46 nt, Mus musculus
aaugguucaguacagcuauugcugugcucauagaaaaacugaccag

SEQ ID NO: 26455 - RNA, 31 nt, Mus musculus
gucugggagaugagucaucccuuuguccgag

SEQ ID NO: 26456 - RNA, 71 nt, Mus musculus
aaugggaaaugagguguuuuauagauuuagagugauaaugagaauuggaaagauaaguaauaagguaagag

SEQ ID NO: 26457 - RNA, 46 nt, Mus musculus
uuccaguggaaucuuugcuuuagauuuuuugugugugugugugcgu

SEQ ID NO: 26458 - RNA, 45 nt, Mus musculus
ugccugaauaaacuccaccguaaggcuugcccauuugaccagacc

SEQ ID NO: 26459 - RNA, 31 nt, Mus musculus
gcucccgguggccagagcuagaaggguuuga

SEQ ID NO: 26460 - RNA, 42 nt, Mus musculus
caccauuuugauauaacuacaacuguuaucuaaagcagagau

SEQ ID NO: 26461 - RNA, 47 nt, Mus musculus
uugaaaaaaaaaggggaggaagcaggaaauaaaacaugguaagagau

SEQ ID NO: 26462 - RNA, 45 nt, Mus musculus
acauaaaguugaaaaugcugagccuuugguucuuuagaaucauag

SEQ ID NO: 26463 - RNA, 46 nt, Mus musculus
ucacaaccuucuguaacuuacaugugugguacacagacaugugcag

SEQ ID NO: 26464 - RNA, 47 nt, Mus musculus
ccauuacuuuguguagugggguugaagauacaaagcauuaugaggaa

SEQ ID NO: 26465 - RNA, 46 nt, Mus musculus
ggccuugaacucagagaucuagcuacccuugccucucaagugcuag

SEQ ID NO: 26466 - RNA, 46 nt, Mus musculus
uguuuuugaaacaggguuuuguuguguagcccuggcuauccuggaa

SEQ ID NO: 26467 - RNA, 41 nt, Mus musculus
auuucaaauugcuauggaagcuggcuuaaggauugcaccag

SEQ ID NO: 26468 - RNA, 43 nt, Mus musculus
uuuaggacuuacgaagcucugaggagagaacaugacucccaga

SEQ ID NO: 26469 - RNA, 42 nt, Mus musculus
gaugcuccuccuccaacaugggaacagcuagaaaaugggcug

SEQ ID NO: 26470 - RNA, 46 nt, Mus musculus
auccagaaccacagcaaaaaaggagcagaucaacaacaggugaggg

SEQ ID NO: 26471 - RNA, 46 nt, Mus musculus
ccuuagccuccacagcauagcaaauacaaaacauacaugugucgag

SEQ ID NO: 26472 - RNA, 46 nt, Mus musculus
cuguguuuuaauguuuuaaaaggaaaaaaaaagcuuauauagaaaa

SEQ ID NO: 26473 - RNA, 45 nt, Mus musculus
uccgaccuccaccaucugcuccugaaccugguccuccauacuugg

SEQ ID NO: 26474 - RNA, 56 nt, Mus musculus
uagaggguuacuacccgguggcuccucauccagcucagaucagaccuucauacccc

SEQ ID NO: 26475 - RNA, 46 nt, Mus musculus
uuccuccuccccaaccccauccuagucuggaugagcuacaucgaag

SEQ ID NO: 26476 - RNA, 42 nt, Mus musculus
ucuagacuagguuuaccuugaauucacucaagcuggccucag

SEQ ID NO: 26477 - RNA, 45 nt, Mus musculus
agcuuccauucugauuauaagcagccuauauauauaguugcccua

SEQ ID NO: 26478 - RNA, 46 nt, Mus musculus
agacuugaagguagccggaaaauacaaagcaaaugauuauagccag

SEQ ID NO: 26479 - RNA, 45 nt, Mus musculus
ggcacaugccaguaauccuaguacuggagagauggagguagggag

SEQ ID NO: 26480 - RNA, 46 nt, Mus musculus
auaaucugacaccaacccucaccccuacauucaaacacucgugcac

SEQ ID NO: 26481 - RNA, 46 nt, Mus musculus
auuacggcuagaauugcagcagcugaaccaucagaucagccagcag

SEQ ID NO: 26482 - RNA, 46 nt, Mus musculus
cuggaauuauagcaguuguuguaggccuccugacauguaugcugag

SEQ ID NO: 26483 - RNA, 44 nt, Mus musculus
gaaugaucucaagugagcagcucagcuuggaacugcaucaggug

SEQ ID NO: 26484 - RNA, 46 nt, Mus musculus
gguggaaugaacucugugacucuagagcugauuccagguaccuuga

SEQ ID NO: 26485 - RNA, 47 nt, Mus musculus
gguaaagaaaggaacaggaacacuucuauagacuuuaaccagagaga

SEQ ID NO: 26486 - RNA, 48 nt, Mus musculus
auauauucauuggguuuuuuucaagacaggauuucucuauucagcccu

SEQ ID NO: 26487 - RNA, 54 nt, Mus musculus
uuaaaauuuuacuuuaggaguuagaguaggauauagcuacgggcacuggagagg

SEQ ID NO: 26488 - RNA, 46 nt, Mus musculus
auuuaaucauuuuuuaaaaaugauuaaaagccaaccuacugcccau

SEQ ID NO: 26489 - RNA, 46 nt, Mus musculus
ucuugauuaccuagaacaagaauuuauaauauaaccugacauggug

SEQ ID NO: 26490 - RNA, 55 nt, Mus musculus
accaaauggaucagccuugacacaagagaaucucagccuccuaucaaacaagacc

SEQ ID NO: 26491 - RNA, 47 nt, Mus musculus
auggauaacuucuaaacuuuuucucugaguggucagugaaguccagg

SEQ ID NO: 26492 - RNA, 42 nt, Mus musculus
uaaaacuuaacacucgauaggagcuucaguaaacaaggacau

SEQ ID NO: 26493 - RNA, 46 nt, Mus musculus
gaccuggcuuucugacauuaaaaauguuuaugaaaaaguugaagag

SEQ ID NO: 26494 - RNA, 82 nt, Mus musculus
acaggacaauguacuuucacuauggucaaguccugggucugggaauucuucuugaacuugacgcuugugagaaacaguuaac

SEQ ID NO: 26495 - RNA, 41 nt, Mus musculus
gaugguagaaugaaauuucaauauauuuuucauuugggcuu

SEQ ID NO: 26496 - RNA, 48 nt, Mus musculus
aaaaaccauccguaacgauuuauuacauccuaauuuguucucaagagg

SEQ ID NO: 26497 - RNA, 65 nt, Mus musculus
gcuuauaguguugcaaagggaugucaucccugaagauagagcucagauacagcgucacugagaca

SEQ ID NO: 26498 - RNA, 46 nt, Mus musculus
ggucccagcuccagugaacacaggaaaagucaaggaaaggaugcaa

SEQ ID NO: 26499 - RNA, 46 nt, Mus musculus
cuuuauggggagugugaagucccuucucagaaucagugcuacggaa

SEQ ID NO: 26500 - RNA, 46 nt, Mus musculus
aucuguuuaauauuuccguuuuuaaacagcuuucaaaacaaaugag

SEQ ID NO: 26501 - RNA, 46 nt, Mus musculus
auuucaguccuguuuuacaguauuucaaaucacauaucugccacaa

SEQ ID NO: 26502 - RNA, 44 nt, Mus musculus
guggaacuggauguugacauagaggcuuugaacuuccggggaga

SEQ ID NO: 26503 - RNA, 47 nt, Mus musculus
aaauugguaaaucaacgagauacauauauauauacacauacagagag

SEQ ID NO: 26504 - RNA, 41 nt, Mus musculus
augauaaagaccccaaaaugccuuuuuuuuaaaguggggag

SEQ ID NO: 26505 - RNA, 45 nt, Mus musculus
ugaggcugaggguagauggguucaguucagugucuccugcccaga

SEQ ID NO: 26506 - RNA, 42 nt, Mus musculus
accguuuccauggggcucugggcguucaucacagccggaggc

SEQ ID NO: 26507 - RNA, 46 nt, Mus musculus
ucaucuugguccaugugacagaccgaucagaugcacggcuccagua

SEQ ID NO: 26508 - RNA, 45 nt, Mus musculus
ggcccuugagaaguccagaugugagccgagcuagaguggggaguc

SEQ ID NO: 26509 - RNA, 59 nt, Mus musculus
guuuugguuuuuuccuuaaguaauuggcagugucugaguaaauugauuucuugaugugu

SEQ ID NO: 26510 - RNA, 45 nt, Mus musculus
gugagcacgucaggccugauucagucuaauugguaaagucuaaug

SEQ ID NO: 26511 - RNA, 46 nt, Mus musculus
cauuugauuuguuuuguaacuuuauuagguuuuugaagcugcaaac

SEQ ID NO: 26512 - RNA, 58 nt, Mus musculus
cuucccauauuuaugugccuuuugucuauuuauaaugccacuggaagaggagggagaa

SEQ ID NO: 26513 - RNA, 46 nt, Mus musculus
cuuuuuuguucuuugaagaacagccugugguauuugaaggguucag

SEQ ID NO: 26514 - RNA, 45 nt, Mus musculus
ucauugccgagccugcaugacauaaucaaaggaaacaaggagauc

SEQ ID NO: 26515 - RNA, 46 nt, Mus musculus
uagcaaauggagauauaaaaggaagaaagcccuuuacgaaccagag

SEQ ID NO: 26516 - RNA, 46 nt, Mus musculus
cagcagaaugugugugugugugugugugagagagagagagagggag

SEQ ID NO: 26517 - RNA, 46 nt, Mus musculus
agaacaagccuuggaugagauccagcaagucguccccagcugcagu

SEQ ID NO: 26518 - RNA, 46 nt, Mus musculus
cucucuucuccucccucccucccucccuccuucccgcucucucucu

SEQ ID NO: 26519 - RNA, 46 nt, Mus musculus
caaaggguggggagggggucuuaguguuaauuagcaaugaguaguu

SEQ ID NO: 26520 - RNA, 65 nt, Mus musculus
acaugaauuugaaaagaagaacaucauuuccccucaucagauccaaaucucugcaguuuacuggc

SEQ ID NO: 26521 - RNA, 45 nt, Mus musculus
uacuaaaaauaucauuguagcaagaugguaacuguacauggagau

SEQ ID NO: 26522 - RNA, 45 nt, Mus musculus
uuacauuucaaaacuucccaaaaguaaucaguauccaagcccuaa

SEQ ID NO: 26523 - RNA, 46 nt, Mus musculus
ucuuuaaaguaguuuauaauuauguuuaucuuuucagguuucagau

SEQ ID NO: 26524 - RNA, 47 nt, Mus musculus
caugacacagcuuguuucaaaccuaucagcaacuguagcagaauuaa

SEQ ID NO: 26525 - RNA, 42 nt, Mus musculus
uuuccagagugauuguaccaguuugcaguccuaccagcaaug

SEQ ID NO: 26526 - RNA, 45 nt, Mus musculus
caauaagacaauaguuaagcuucagaauacuucacggauagcaga

SEQ ID NO: 26527 - RNA, 47 nt, Mus musculus
ucguauuaaagccuuagaaguuaacaugucucucaguggucgcuauc

SEQ ID NO: 26528 - RNA, 70 nt, Mus musculus
auuucuaguuuuucggaguacauauauaaauggugcucaguuagaauugcucuuuaucgacaacgcagca

SEQ ID NO: 26529 - RNA, 46 nt, Mus musculus
uaaugaguuaguaaauguuauagaaacaaagguacaauguacauau

SEQ ID NO: 26530 - RNA, 46 nt, Mus musculus
caaagucugugagacacuuuuaucuggagacuaagacagggguaac

SEQ ID NO: 26531 - RNA, 45 nt, Mus musculus
uauauuuuuauauaauauauacaaaggauuacucuggucccaaua

SEQ ID NO: 26532 - RNA, 41 nt, Mus musculus
aguuuucuuucauaugucaggaaagcacuguagcacucagc

SEQ ID NO: 26533 - RNA, 46 nt, Mus musculus
uguaaugaacuguuguuaggguuuuugguacuagcaugguggaaga

SEQ ID NO: 26534 - RNA, 46 nt, Mus musculus
ucuguuauuagacguaccucaggaaaugugaauuuuuauuccagau

SEQ ID NO: 26535 - RNA, 41 nt, Mus musculus
caggagaaacugacccuacaucugucacaagucccaaagau

SEQ ID NO: 26536 - RNA, 46 nt, Mus musculus
gucuucauuuuauuuuuacauuuuguauaacaagugcaccccaguu

SEQ ID NO: 26537 - RNA, 42 nt, Mus musculus
gaauccccaugaugcauuagauauguaacacuuugcccagac

SEQ ID NO: 26538 - RNA, 45 nt, Mus musculus
auagaacccagugcccucuucuggugugucugaagacagcugcaa

SEQ ID NO: 26539 - RNA, 46 nt, Mus musculus
agcguaacaccagaaacuguaauauauaugcagcagaccuguaagg

SEQ ID NO: 26540 - RNA, 42 nt, Mus musculus
aaaaccaaaaggugguuuucaggucuuccuuacacaucagua

SEQ ID NO: 26541 - RNA, 45 nt, Mus musculus
aagauggaaagcuguuuaagauuacuuugucaacaguguagaguc

SEQ ID NO: 26542 - RNA, 42 nt, Mus musculus
uaaaaaauugaaaaaugaaugaucuucuaguuggagggggau

SEQ ID NO: 26543 - RNA, 46 nt, Mus musculus
agaguuguugcucacauagaauaauauauuaauaugggcucaagaa

SEQ ID NO: 26544 - RNA, 45 nt, Mus musculus
uguggagucagccauaguuuuggggcauguucuuuggcacuagaa

SEQ ID NO: 26545 - RNA, 58 nt, Mus musculus
aacccugcggcguggggcgggcgggaucccugaugaagcccuuuuucgguuagccugg

SEQ ID NO: 26546 - RNA, 56 nt, Mus musculus
gcaggggcgagucaggugugauguguuccggaccugugauuuugaaaacgugaguc

SEQ ID NO: 26547 - RNA, 62 nt, Mus musculus
aucacuuuuugccuuuguacucggguaccccaucaccgcaguuagggcaguuuggguagugu

SEQ ID NO: 26548 - RNA, 62 nt, Mus musculus
gguuuacgaguuguguuuuggaauuugcagaguuccagcagggagagaaggggauauugggg

SEQ ID NO: 26549 - RNA, 45 nt, Mus musculus
acccucugcuguaugaagacaugguguuaagccugugugcuggug

SEQ ID NO: 26550 - RNA, 47 nt, Mus musculus
uccuacucuguaaugauauuguauuaacaacaucaaaaacacauuca

SEQ ID NO: 26551 - RNA, 45 nt, Mus musculus
ugucuauaaaugauuguuuauuuguacuguaacuuuuaagugggg

SEQ ID NO: 26552 - RNA, 42 nt, Mus musculus
ucagaguagacuucaaccucaguggccuuuaaaccagcccag

SEQ ID NO: 26553 - RNA, 41 nt, Mus musculus
guggggucaaucucaacagcaucgaugcgggacuucgggaa

SEQ ID NO: 26554 - RNA, 41 nt, Mus musculus
aagagagagagagagagagagagagagaaagagaaaagaaa

SEQ ID NO: 26555 - RNA, 45 nt, Mus musculus
uggucuuggugcugcacaguccggaccccaauguccccacccaca

SEQ ID NO: 26556 - RNA, 46 nt, Mus musculus
gcacugguguauugcuggcauaugucugugugaggguauagggucc

SEQ ID NO: 26557 - RNA, 46 nt, Mus musculus
ggaagggcagccagugcucauaaccacugagccaucucgccagccu

SEQ ID NO: 26558 - RNA, 44 nt, Mus musculus
uccauccugucugcuaccuccauacugccuccuuaagucugcag

SEQ ID NO: 26559 - RNA, 45 nt, Mus musculus
cgcgaugguuucacagcgggguuguccaccacguggaggguguag

SEQ ID NO: 26560 - RNA, 45 nt, Mus musculus
uuaccuucuaacagaugaacuaaguugaggguggagggcauaagg

SEQ ID NO: 26561 - RNA, 46 nt, Mus musculus
gggaggcccagcccagaccauacgcugcaaagcugugugaccagca

SEQ ID NO: 26562 - RNA, 48 nt, Mus musculus
uuaagaaauaaacauaaaagacaucaggauaagaggggaggaaaggag

SEQ ID NO: 26563 - RNA, 46 nt, Mus musculus
caaccaucuguaaugggaucuucuggcaugcaggcauauaugcaga

SEQ ID NO: 26564 - RNA, 46 nt, Mus musculus
ugagucuuugguauagaagaaaaacguauucagcgaaauaguagca

SEQ ID NO: 26565 - RNA, 41 nt, Mus musculus
gagacaguacauuuguaaagggaaaaagaaaaggcaaaaau

SEQ ID NO: 26566 - RNA, 46 nt, Mus musculus
guucaaggaugcugacaucaauauucaaucaucugcucacucaucc

SEQ ID NO: 26567 - RNA, 47 nt, Mus musculus
uaaaaaaaaaaaaaaaagaaaaaaggaaaaaaaaaaaaaaaaagaaa

SEQ ID NO: 26568 - RNA, 42 nt, Mus musculus
cagcagggauuaauccucggaaaggcuggcuuacuugggcag

SEQ ID NO: 26569 - RNA, 57 nt, Mus musculus
cacugggggauugggcaguguuauaaaaauuugucugaccaggcugcuguacuuguc

SEQ ID NO: 26570 - RNA, 46 nt, Mus musculus
aguuccuggugcuggacagcugggaaguuguggauagcuguaccag

SEQ ID NO: 26571 - RNA, 46 nt, Mus musculus
ugggguuuuacuuuacaaauauucggaggguccgaagugguuguag

SEQ ID NO: 26572 - RNA, 45 nt, Mus musculus
uauaauuugaugucauuaaagagagagagagagagagagagagag

SEQ ID NO: 26573 - RNA, 45 nt, Mus musculus
uauccuccaucuuugcauuauuaguagccacaguguuaggcagag

SEQ ID NO: 26574 - RNA, 46 nt, Mus musculus
cuuaccucugaugaaguugcugauccaaaugauguuaagggcuuau

SEQ ID NO: 26575 - RNA, 46 nt, Mus musculus
gucgaggccgggggugggacaguggaugcagcugaggcuggggcaa

SEQ ID NO: 26576 - RNA, 73 nt, Mus musculus
uagcugagaccacugggguuggagaagaaacaguagcuggugcuagggcugaagcaaggauaggaauggaagc

SEQ ID NO: 26577 - RNA, 46 nt, Mus musculus
ggcugaggccaagacaggagucggagcuggaacugaugguugggau

SEQ ID NO: 26578 - RNA, 117 nt, Mus musculus
aguuagaaccggagcugggguugacacuggaacuagagcgguggcugaugccaaaaugggaacuggagcugggguggaggcaggagcugcagcugcuggggcuguuaggccuggagc

SEQ ID NO: 26579 - RNA, 42 nt, Mus musculus
gcuuuugcuguuuuuuagauacaacuucaguaaagccaucau

SEQ ID NO: 26580 - RNA, 44 nt, Mus musculus
ucaagauggcaucuauggcuccuuggggguggggguagggguga

SEQ ID NO: 26581 - RNA, 45 nt, Mus musculus
gggucagcaccagcugugccugaggccuggucaucaaauggccua

SEQ ID NO: 26582 - RNA, 46 nt, Mus musculus
guguuuugccugcauuuaugucuguacucguguguacacugcccag

SEQ ID NO: 26583 - RNA, 46 nt, Mus musculus
ugacuagaaaaacuucucuucgcuauuucccuuuuuggaggcaaaa

SEQ ID NO: 26584 - RNA, 45 nt, Mus musculus
ugugaacucuuaucagcauuuuucuucucgucccucucucgccuc

SEQ ID NO: 26585 - RNA, 46 nt, Mus musculus
gguucuugaacaacauuauuagcugugccauuugaggguaccaaca

SEQ ID NO: 26586 - RNA, 44 nt, Mus musculus
cgucuaaaucgagguggcuuaucuugccuugguggucggguagg

SEQ ID NO: 26587 - RNA, 41 nt, Mus musculus
uaagcaggucuucuuaagguggcaggacgugauggccggcc

SEQ ID NO: 26588 - RNA, 46 nt, Mus musculus
gguaaagaugagucuuucuuaacugcuagucuagaaucugggcgag

SEQ ID NO: 26589 - RNA, 43 nt, Mus musculus
aaccaauggcuguggcugagguugagcuggugcuggagggggg

SEQ ID NO: 26590 - RNA, 46 nt, Mus musculus
augagaaacacuucuuuuucgggcagguugacuuucuagcgcugag

SEQ ID NO: 26591 - RNA, 29 nt, Mus musculus
agcuuuuguuauuaucaaccaucugugga

SEQ ID NO: 26592 - RNA, 42 nt, Mus musculus
agacuugggaguagcugccugcugaggcucagcaugauaggg

SEQ ID NO: 26593 - RNA, 45 nt, Mus musculus
uucucucucucccuuucucuaaguuccucuggagauggcugcuuu

SEQ ID NO: 26594 - RNA, 50 nt, Mus musculus
cagacuguuguuuucgucuuugcuuccauauuucaucguuaucagguacu

SEQ ID NO: 26595 - RNA, 45 nt, Mus musculus
auuagagugaacucagguugucaagcuuggcagcaagcaccccua

SEQ ID NO: 26596 - RNA, 45 nt, Mus musculus
ugaucacuuucugggacugauauugugugccauaaauauggagag

SEQ ID NO: 26597 - RNA, 44 nt, Mus musculus
uaccuguugugcaagcaacuugggaggugguggcaagugugaag

SEQ ID NO: 26598 - RNA, 73 nt, Mus musculus
aucugcuucagcaucuagguuaucaaauuuaucgagcuccuucaguucggaugcacuaaggauggaugggcgu

SEQ ID NO: 26599 - RNA, 46 nt, Mus musculus
ggaucauugccuuuguucucugcuuugagacuuggaagguuagcag

SEQ ID NO: 26600 - RNA, 46 nt, Mus musculus
auauagccacaauuuaaaaacacaauuucuucucauguggcaggag

SEQ ID NO: 26601 - RNA, 59 nt, Mus musculus
uuccuuuuccccugacuuucuucauugugugucugugggggugaggggugggggguauc

SEQ ID NO: 26602 - RNA, 46 nt, Mus musculus
acagaaccacaacagcaguccuguacuuacacauuaccagcuggaa

SEQ ID NO: 26603 - RNA, 42 nt, Mus musculus
gaaagacagacugguggaaugcuaauuugaaguggcccacag

SEQ ID NO: 26604 - RNA, 46 nt, Mus musculus
acacccaccauauaagcuaagugagagaaccaugggaaaggcccag

SEQ ID NO: 26605 - RNA, 46 nt, Mus musculus
auauaaaggucuugagagcauacaguuagagguuaaguaaugagag

SEQ ID NO: 26606 - RNA, 46 nt, Mus musculus
cuugaacacacuucaaacaaauauacauccccuuuaaagagaucag

SEQ ID NO: 26607 - RNA, 45 nt, Mus musculus
ggguugagaaccaagucugcgcgcuuccaaggggcucgccccgga

SEQ ID NO: 26608 - RNA, 45 nt, Mus musculus
agccaccgccguacaaaccgccaaagcacuuucgcuaccuccuga

SEQ ID NO: 26609 - RNA, 42 nt, Mus musculus
gguucccgcagcaaggaauuugaggacauccuccuccuucau

SEQ ID NO: 26610 - RNA, 45 nt, Mus musculus
cugagugagcucccuuguuguugcaugggauggcaauguccacau

SEQ ID NO: 26611 - RNA, 44 nt, Mus musculus
gcucacgggagauaguaccucgcaugcggaguacuucccuggcc

SEQ ID NO: 26612 - RNA, 46 nt, Mus musculus
gauaguaacguguaugcaucuauacacacuuuaaacucagugauag

SEQ ID NO: 26613 - RNA, 45 nt, Mus musculus
gauuugaggaggagcugcagaacugccucacggcaacagggaugg

SEQ ID NO: 26614 - RNA, 45 nt, Mus musculus
aaaaacaaacaaacaaaaaaagccacagaaaacauaugaccccau

SEQ ID NO: 26615 - RNA, 29 nt, Mus musculus
cuucgggagccgagauauuuugguguaag

SEQ ID NO: 26616 - RNA, 47 nt, Mus musculus
agugugugugugugugugugugugcauauauauauauagagagagug

SEQ ID NO: 26617 - RNA, 46 nt, Mus musculus
gauuucuucaggugagggcaucaugugacacacuacagagagggaa

SEQ ID NO: 26618 - RNA, 46 nt, Mus musculus
aacacgaauuuuuauguggaggaaaucauggaagauagggccuuaa

SEQ ID NO: 26619 - RNA, 41 nt, Mus musculus
uaggacgguaugauaggauaugcuaggaugauaagguaggg

SEQ ID NO: 26620 - RNA, 46 nt, Mus musculus
auaugcuaggacgguaugguagggauaugcuaggacaguaugguag

SEQ ID NO: 26621 - RNA, 25 nt, Mus musculus
uguagccagagaggagcugauguaa

SEQ ID NO: 26622 - RNA, 46 nt, Mus musculus
aaaggaacacuuggaguuacaguaaggcuggagacugagccaggag

SEQ ID NO: 26623 - RNA, 45 nt, Mus musculus
uuuacuuggaccagaagugguugugggaggagaacgaaccaagau

SEQ ID NO: 26624 - RNA, 46 nt, Mus musculus
gccaauuaaggaaaacuaaggcuccagacaucuugcauagaagggg

SEQ ID NO: 26625 - RNA, 46 nt, Mus musculus
gggaguagagucauuccuggccucagcccaggucacccuugaaacu

SEQ ID NO: 26626 - RNA, 44 nt, Mus musculus
accaaaauaaugugcuuugcuggccagaagcacccggccacucc

SEQ ID NO: 26627 - RNA, 42 nt, Mus musculus
cgagguguucucagaggcagguguuaaguaaaggucugagau

SEQ ID NO: 26628 - RNA, 46 nt, Mus musculus
ggguuugggcaucagcugguucuccaugcccuacuuauuuucuaca

SEQ ID NO: 26629 - RNA, 42 nt, Mus musculus
ugaagaaacacacucagugcaaugguggcuuuguguggagau

SEQ ID NO: 26630 - RNA, 45 nt, Mus musculus
guggagacaauagaauuuauccuuggauuuccauucccgcccaga

SEQ ID NO: 26631 - RNA, 72 nt, Mus musculus
uuccauguuucauaucaaugagguuguuuacaccucugcugcugagacuuucacagaaaccuccagauggua

SEQ ID NO: 26632 - RNA, 80 nt, Mus musculus
cuaggggacacagaagaucuggaacagagccaagacgucacaucugacugcagacuuucccuccaccaaagcacccaaag

SEQ ID NO: 26633 - RNA, 42 nt, Mus musculus
uacagaugucaaaaguauuucuaaagacauaguuggccccag

SEQ ID NO: 26634 - RNA, 45 nt, Mus musculus
uaauguuuuaguauaaaugaauaaucagccuuugaguuugcuguu

SEQ ID NO: 26635 - RNA, 44 nt, Mus musculus
gagagggccauaaagccugcuuucugcagcaguagugggcugag

SEQ ID NO: 26636 - RNA, 45 nt, Mus musculus
uaagaaccaugcaacuuguaaguaaaugagaacagauucgccagg

SEQ ID NO: 26637 - RNA, 42 nt, Mus musculus
ccucuaugucuucaugugucucugucucugugugucugugug

SEQ ID NO: 26638 - RNA, 44 nt, Mus musculus
uacccugagcagaccuugggcgcaaacucugcagccagccccac

SEQ ID NO: 26639 - RNA, 25 nt, Mus musculus
aagaagcaaaaagggaaauggcuac

SEQ ID NO: 26640 - RNA, 41 nt, Mus musculus
uuggauguugaccaccaugaauuccaauccaaaacgcagaa

SEQ ID NO: 26641 - RNA, 100 nt, Mus musculus
ccuccccagaccugggccaggugccccuuucuccagaugacaaccagaagaccuccuccccagaccugggucaggugucccuuucuccagaugauaacca

SEQ ID NO: 26642 - RNA, 101 nt, Mus musculus
gaagaccuccuccccagaccugggucaggugccccuuucucuagaugacaaccagaagacgaccuccccagaccugggucaggugccccuuucuccagaug

SEQ ID NO: 26643 - RNA, 83 nt, Mus musculus
cccagaucugggucaggugccucuuuuuccugaagacaaccagaauuacuuccuagaccugagucagguaccucucuccucag

SEQ ID NO: 26644 - RNA, 45 nt, Mus musculus
cugacucucucuccugauuuuggucagacaguccuuuccccagac

SEQ ID NO: 26645 - RNA, 48 nt, Mus musculus
agccucuugacccucucaccagauuuuaaugagauaauccuagcccca

SEQ ID NO: 26646 - RNA, 41 nt, Mus musculus
agaucucacucacauaccaccuccuucaccaucucccacac

SEQ ID NO: 26647 - RNA, 45 nt, Mus musculus
guaaugagaccugacgcccucuucuggugcgucugaagacagcua

SEQ ID NO: 26648 - RNA, 46 nt, Mus musculus
cacggacuuuccuaugaaaaauccucagaggggaagacuuaugaag

SEQ ID NO: 26649 - RNA, 24 nt, Mus musculus
acgggagggcgcccgagccgcgag

SEQ ID NO: 26650 - RNA, 45 nt, Mus musculus
ugacagggaggcuuaaaugggagucauauucuacagccaccuggg

SEQ ID NO: 26651 - RNA, 41 nt, Mus musculus
ggcuacagcaauaaacaaucguaaucccagacaggcugagg

SEQ ID NO: 26652 - RNA, 45 nt, Mus musculus
uguaaugagacuucucugauguuaagcuuugcucuuuguggggug

SEQ ID NO: 26653 - RNA, 42 nt, Mus musculus
aagaguacguccacaccggauaaauuucauuguagaccuggu

SEQ ID NO: 26654 - RNA, 44 nt, Mus musculus
accgugaacuuuuaaaauaaaaucagacacaacacuccucagag

SEQ ID NO: 26655 - RNA, 42 nt, Mus musculus
ucucucaagaugaucuaacuguaggaacgaaggcgggcaggu

SEQ ID NO: 26656 - RNA, 46 nt, Mus musculus
auagcugucugcuggcucagcgucuaguucauuucauacuuuccag

SEQ ID NO: 26657 - RNA, 42 nt, Mus musculus
caugggagagagagagagagagagagagagagagaggggggg

SEQ ID NO: 26658 - RNA, 46 nt, Mus musculus
aaggggaagugacccgagguugagaggggcugggagcugggggucg

SEQ ID NO: 26659 - RNA, 50 nt, Mus musculus
aauugaaauauauuuuaaaagaacacuuuugguuuggggggauagggcag

SEQ ID NO: 26660 - RNA, 46 nt, Mus musculus
ccguuuaaauggauuaauugugauuauuugcuucuguggcuuguag

SEQ ID NO: 26661 - RNA, 46 nt, Mus musculus
ugucuacuuguuuuguuauagacaaguauucagaggcguuucagaa

SEQ ID NO: 26662 - RNA, 92 nt, Mus musculus
gcagguuguguguguaugcguaaggacacacacacguaacaguaauuaaaagacgucaugaauuggaaagagaacaagggagugcuaugcag

SEQ ID NO: 26663 - RNA, 26 nt, Mus musculus
cucggaauguaaacaucucaccccag

SEQ ID NO: 26664 - RNA, 46 nt, Mus musculus
uguuuuugcucaaguggaggauuaaggggacaggguaugauugcca

SEQ ID NO: 26665 - RNA, 45 nt, Mus musculus
aaggucugggagugugugugugugugugugugugugugugugugu

SEQ ID NO: 26666 - RNA, 42 nt, Mus musculus
uuuaccccacagacggaucuguugaaaugguaacugaggacu

SEQ ID NO: 26667 - RNA, 82 nt, Mus musculus
aucuuugaucugguauuccagaggcagagaggcagaggcagagaggcagagagaggcagagaggcagagagagagaggcaga

SEQ ID NO: 26668 - RNA, 54 nt, Mus musculus
aggcagagagagaggcagagagaggcagagagggaggcagagaggcagagagag

SEQ ID NO: 26669 - RNA, 62 nt, Mus musculus
gaggcagagagagaggcagagagaggcagagagggaggcagagaggcagagagagaggcaga

SEQ ID NO: 26670 - RNA, 43 nt, Mus musculus
ggcagagagagaggcagagagaggcagaaagaggcagagagag

SEQ ID NO: 26671 - RNA, 41 nt, Mus musculus
ucccuucccuucccuucccuucccuucccuucccuucagua

SEQ ID NO: 26672 - RNA, 46 nt, Mus musculus
cuuuaaauaaacgaaagcaaaaaccaaaugaacaaaaagcccauag

SEQ ID NO: 26673 - RNA, 45 nt, Mus musculus
gaacugauccaguuuaucacaagugggccuguuauugccauggag

SEQ ID NO: 26674 - RNA, 45 nt, Mus musculus
agaaaugcagcucacggcccugauacuuuugcaucugcugccaga

SEQ ID NO: 26675 - RNA, 45 nt, Mus musculus
ucaaaucccagcagccccaugguggcucacaaccauccguaaaga

SEQ ID NO: 26676 - RNA, 45 nt, Mus musculus
aauuuauaacgugguagaugacaaguccuugaauagucccagcug

SEQ ID NO: 26677 - RNA, 41 nt, Mus musculus
aacaccguggaaagaauaaugcuaaaagcuuagggcagcau

SEQ ID NO: 26678 - RNA, 45 nt, Mus musculus
uaaauuuaccaauugcaccuguugcaucauuaagccucaugcuau

SEQ ID NO: 26679 - RNA, 42 nt, Mus musculus
guaagccaccaugugguugcugggauuugaacuccggaacuu

SEQ ID NO: 26680 - RNA, 89 nt, Mus musculus
uuucaggaaguccuucccuuccccacaccauucacguaggcacugccuguaucuucuggcacuuucaaaguuuuaaguuucacacugag

SEQ ID NO: 26681 - RNA, 46 nt, Mus musculus
cugaagcucaggauggagcagcuugccugugugcacaaagccccac

SEQ ID NO: 26682 - RNA, 46 nt, Mus musculus
ucuguucucaucugaaugagaagaaacuuaggagucuaguaagcag

SEQ ID NO: 26683 - RNA, 46 nt, Mus musculus
auuccuuuucuuuagcuugucuuuucuucuuguucuuucccgucuu

SEQ ID NO: 26684 - RNA, 45 nt, Mus musculus
auggagucuacccuuacuguuuucuacgcccacaguuacaguugg

SEQ ID NO: 26685 - RNA, 46 nt, Mus musculus
ugaguaauccuuauuagacaguugguaagggaaaugcucauuuuag

SEQ ID NO: 26686 - RNA, 45 nt, Mus musculus
auuuuaugguuggguaauggaucaauaugaggcccuaagugccuu

SEQ ID NO: 26687 - RNA, 46 nt, Mus musculus
aaaaauccaaauuaucuucuagguaacuuagagugauugcagccac

SEQ ID NO: 26688 - RNA, 41 nt, Mus musculus
uucugggcaagggacuggugggaguggcaguggugauaggg

SEQ ID NO: 26689 - RNA, 44 nt, Mus musculus
aguucuaagccaacgaaagcuacauagccugucucaaaaagcca

SEQ ID NO: 26690 - RNA, 42 nt, Mus musculus
aggaaggaaggaaggaaggaaggaaggaagggaggacaguag

SEQ ID NO: 26691 - RNA, 49 nt, Mus musculus
uaggaauguugggaaagauuuuaauagcuauucgggaugcaugcuuugg

SEQ ID NO: 26692 - RNA, 46 nt, Mus musculus
agccaaaaccaccaccaacaacaaaacaaacugaaauuacagcaac

SEQ ID NO: 26693 - RNA, 45 nt, Mus musculus
ugauuggcuuaccauuuuguuuuguuuuuacuguaguucaauuug

SEQ ID NO: 26694 - RNA, 46 nt, Mus musculus
uaguguccuaggagcggaggggagggaugagaggaaauauuuggag

SEQ ID NO: 26695 - RNA, 46 nt, Mus musculus
ggauauggugacagagcugugcuccggcccuugcguagcaauagag

SEQ ID NO: 26696 - RNA, 46 nt, Mus musculus
ccuugguaguugaggcaaacucacauguugaagaaucauuugguaa

SEQ ID NO: 26697 - RNA, 46 nt, Mus musculus
gaagaauaucaaaagcugcauuauagggacagggagagcagugaag

SEQ ID NO: 26698 - RNA, 45 nt, Mus musculus
gaguggugcugaugcuguggauuuacccaaugucaaucaugagag

SEQ ID NO: 26699 - RNA, 31 nt, Mus musculus
cuuuuguuaauuuuuuugagaaaauuaaaau

SEQ ID NO: 26700 - RNA, 46 nt, Mus musculus
ccagcuuagccucacauguuuuucaugggcaauuucuggcuucuuu

SEQ ID NO: 26701 - RNA, 42 nt, Mus musculus
aaucacaguuucuaaauccugugggcagagagaagucaggag

SEQ ID NO: 26702 - RNA, 45 nt, Mus musculus
acaaauaaggucucacuucaaagucgagaguuaugcauccgccgu

SEQ ID NO: 26703 - RNA, 45 nt, Mus musculus
gccauuaggauauucagaaacaaagauuuucaaaagacauuuagg

SEQ ID NO: 26704 - RNA, 41 nt, Mus musculus
ucugcuuguugugaucacuuggcucgggcaacuccauguaa

SEQ ID NO: 26705 - RNA, 45 nt, Mus musculus
acaucucuucagaccuuugugacugcuuuuaaaaauucagccuga

SEQ ID NO: 26706 - RNA, 46 nt, Mus musculus
uugcuuuuaacuuuuuuacaauuuugauuaucauguuuaauuguac

SEQ ID NO: 26707 - RNA, 118 nt, Mus musculus
ucauggcucucugugcagucucuugagcacgugacggagcagagaaccacaguagaagggcuaacugugagggaggacauuaccaaggagcuagaauucucggucuccuaagagagaa

SEQ ID NO: 26708 - RNA, 46 nt, Mus musculus
gagaagcauggcccacccuuguuuacuuucauuuuuaaggccucgu

SEQ ID NO: 26709 - RNA, 45 nt, Mus musculus
ggugguuggugugcuaccgugugggugcugggaaccaaacccaau

SEQ ID NO: 26710 - RNA, 42 nt, Mus musculus
agcugggcggugguggcacacaucuuuaaucccagcacucgg

SEQ ID NO: 26711 - RNA, 45 nt, Mus musculus
acaugaacacacacaugcauguacauaccuaacaugcauauggag

SEQ ID NO: 26712 - RNA, 46 nt, Mus musculus
uuauauucaaaaucaauauuaaacauuuaaauauuuagagccaaga

SEQ ID NO: 26713 - RNA, 45 nt, Mus musculus
gacaguagcugucgugaacaauuccauuuggaaaaacaaaaugca

SEQ ID NO: 26714 - RNA, 46 nt, Mus musculus
guugcuguuuaguuuuguuuucuuacugugauauagcaucugugag

SEQ ID NO: 26715 - RNA, 45 nt, Mus musculus
guucaagggcacugucccugaagguagaggagccauaguggcgga

SEQ ID NO: 26716 - RNA, 46 nt, Mus musculus
uaccuccguuaaccuaaucuugauuaucccucacagacaugcccag

SEQ ID NO: 26717 - RNA, 46 nt, Mus musculus
agagaaggagauuguguguuaagcuuccuuuucacguguggucaac

SEQ ID NO: 26718 - RNA, 46 nt, Mus musculus
aucagaguggccucuggucaagccugugguucauuuuauugaucag

SEQ ID NO: 26719 - RNA, 46 nt, Mus musculus
cagugacauccaugggcugaugguccugaguucuguaagaaagagg

SEQ ID NO: 26720 - RNA, 42 nt, Mus musculus
aaucaauaaauaaaucuuuaaaaaaaaaaaagaaagaggcug

SEQ ID NO: 26721 - RNA, 46 nt, Mus musculus
aagccaugacugagggaagaaaucagggaagagaguccagcacaga

SEQ ID NO: 26722 - RNA, 46 nt, Mus musculus
guguucauucuuuuauuguccguuguguuaaccugacugacacaag

SEQ ID NO: 26723 - RNA, 46 nt, Mus musculus
ccauuugcuuacucagguuagcccugcaucugagccuugaccuaag

SEQ ID NO: 26724 - RNA, 26 nt, Mus musculus
ucuuggggucauuaggacggaaggag

SEQ ID NO: 26725 - RNA, 42 nt, Mus musculus
cuguuuuaugaacgagaaugucacuugcagugaaaggcacag

SEQ ID NO: 26726 - RNA, 24 nt, Mus musculus
agggccacucagcuuccagggccc

SEQ ID NO: 26727 - RNA, 46 nt, Mus musculus
aucaggaguccucucagaagcugcauauccaacuucagauguugag

SEQ ID NO: 26728 - RNA, 45 nt, Mus musculus
gcuucuccucuggacagaagcucagaugcuagcuggcaggugcag

SEQ ID NO: 26729 - RNA, 45 nt, Mus musculus
cugagguuugguguggucaguggugaacguggugggggaugggau

SEQ ID NO: 26730 - RNA, 41 nt, Mus musculus
gaacucucucuuuacucaagacaaaaauguaggcuuggaga

SEQ ID NO: 26731 - RNA, 46 nt, Mus musculus
cacugaugguuagcagcauuacuuggauggucccgaugaagaugcc

SEQ ID NO: 26732 - RNA, 103 nt, Mus musculus
cgggccauggugucugcucagcaguggcggccgaggccgagggagggcgagugcggcgcgcgcccugggcguccucgcggcggcugcucgguguccccgcggc

SEQ ID NO: 26733 - RNA, 42 nt, Mus musculus
ggaggagggcgcgcgcgggcugggcggcuccgagccccgcac

SEQ ID NO: 26734 - RNA, 45 nt, Mus musculus
accucuggcgagauggaccagggacaaggagggaaagucaccggg

SEQ ID NO: 26735 - RNA, 66 nt, Mus musculus
cuuaaccgccaaggcuucagcuaccaguguccccacgggcaaguggugguagcugugaggagcauc

SEQ ID NO: 26736 - RNA, 97 nt, Mus musculus
uuuagcaagaaggaaggcucugacagacaauggaacuaugccugcaugccuacaccccaaagccugggggagcccacugagugcuggugggaggaga

SEQ ID NO: 26737 - RNA, 46 nt, Mus musculus
ggauugguggcgggguuccagagccgcuacuucgaaucagugcugg

SEQ ID NO: 26738 - RNA, 57 nt, Mus musculus
acaugauuuccuaugacuacgauuuuuauaugcgaggagcaacaaccacuuucucug

SEQ ID NO: 26739 - RNA, 64 nt, Mus musculus
ggugucggcugccuaggccuuucucaccacgaucacacauauaaauaaacucacaauuaagcca

SEQ ID NO: 26740 - RNA, 46 nt, Mus musculus
uuggaggugaaagggggaggugggaggguuugaggacugagcugaa

SEQ ID NO: 26741 - RNA, 44 nt, Mus musculus
cccugcuagaccuuccugcugccaccugggaaucaguugcuccu

SEQ ID NO: 26742 - RNA, 45 nt, Mus musculus
agagguuaauggucacaagaagaguugucuacacaagccacagag

SEQ ID NO: 26743 - RNA, 45 nt, Mus musculus
auucccacaggcaacccucaaaaauguccaaauugcaagccacac

SEQ ID NO: 26744 - RNA, 46 nt, Mus musculus
uuugagcaucucccaggggacagugcugcugaggggaaacagggag

SEQ ID NO: 26745 - RNA, 42 nt, Mus musculus
agaauuauaucagccaggcgugguggcacacuugggaggcag

SEQ ID NO: 26746 - RNA, 46 nt, Mus musculus
uggugaagcuaagaccaccuggguauggugacacacaaacgggcag

SEQ ID NO: 26747 - RNA, 41 nt, Mus musculus
aacaugaaaaucacuaauuugaauuuuaacgaucaugcaga

SEQ ID NO: 26748 - RNA, 45 nt, Mus musculus
aaagaagcaggugagugcaggacaggcauuacugaacagaccaag

SEQ ID NO: 26749 - RNA, 44 nt, Mus musculus
uagcuguucagucaaugauaagaaagguacaaucaauacagcca

SEQ ID NO: 26750 - RNA, 44 nt, Mus musculus
cguggcucucaggaguuaaguaagguucaagucuggaggagagg

SEQ ID NO: 26751 - RNA, 46 nt, Mus musculus
aauaaaaaagaaaucccaacgugugugugugugugugugugugugu

SEQ ID NO: 26752 - RNA, 46 nt, Mus musculus
acugcucuggaugcuggcugagaaggugaauuuuaugcuggcggug

SEQ ID NO: 26753 - RNA, 45 nt, Mus musculus
ugacuacacuguggcugucuucagacacaccagaagagagcaucg

SEQ ID NO: 26754 - RNA, 46 nt, Mus musculus
cgucuuuauuuuugauuauguguguguguguggcuaucucugugua

SEQ ID NO: 26755 - RNA, 44 nt, Mus musculus
aagaggacuaugcaagggauucgcuguuuguucgacacccugag

SEQ ID NO: 26756 - RNA, 42 nt, Mus musculus
ugcagagguaauggaguugauuccaaaggggcuacuggagag

SEQ ID NO: 26757 - RNA, 45 nt, Mus musculus
aucuagucuggaaguagaaaagaacaguaucuaaagauggccugg

SEQ ID NO: 26758 - RNA, 45 nt, Mus musculus
cugggaaagcagggaaggauuuccaggguuagacgagaacaagag

SEQ ID NO: 26759 - RNA, 46 nt, Mus musculus
uggacugagucacaccagagaagugucuucggaggcucaugcacac

SEQ ID NO: 26760 - RNA, 45 nt, Mus musculus
uuugaagccauuuucagagaaaaaugccauucauuauaaccaagg

SEQ ID NO: 26761 - RNA, 45 nt, Mus musculus
uuuccucaguggugcccacagaagggcaacauagaccagcuguag

SEQ ID NO: 26762 - RNA, 46 nt, Mus musculus
gcauagaaacaaacuacaacaacaacacaacaugcuucuggccuag

SEQ ID NO: 26763 - RNA, 52 nt, Mus musculus
ggagagaagaaaaaauuacacauaccagaaaaaggaaagaauggagacagga

SEQ ID NO: 26764 - RNA, 47 nt, Mus musculus
gcaacccaguaagcuugguuucugccgcugcagccuccacagggaac

SEQ ID NO: 26765 - RNA, 46 nt, Mus musculus
ucuugcuucuaguggcucucuuccaauaacgucucuggaugcaacu

SEQ ID NO: 26766 - RNA, 45 nt, Mus musculus
cccucacugcugucucugcuuaaaccuuuaaauauccccguuauu

SEQ ID NO: 26767 - RNA, 46 nt, Mus musculus
aggugccuguauagcaccucuggcacugggaaaguuagccgcaguu

SEQ ID NO: 26768 - RNA, 45 nt, Mus musculus
uuacaguaccaggcaggaacuuccugcuaugaauaggccucagau

SEQ ID NO: 26769 - RNA, 55 nt, Mus musculus
uuagagagcaguucgccauaaccauuuaacaaaacaauagucaguaucugccccu

SEQ ID NO: 26770 - RNA, 46 nt, Mus musculus
ggaagagggaaggaaaaacaugauaagcauuuacugacaacuagaa

SEQ ID NO: 26771 - RNA, 45 nt, Mus musculus
uguuuuuauuuuuguuuuuguuuuguaaugcagcauugucguagg

SEQ ID NO: 26772 - RNA, 46 nt, Mus musculus
acugcaaccuucacagcaggguucuccauauuagugcagcagaggu

SEQ ID NO: 26773 - RNA, 46 nt, Mus musculus
uacacguaaaauuagguuucaugaaaugaaaacuuugucgggagau

SEQ ID NO: 26774 - RNA, 46 nt, Mus musculus
uuaacacuuacaugugugugugugugugugugugugugugugugug

SEQ ID NO: 26775 - RNA, 45 nt, Mus musculus
gcccagaacauuuaaguagauacucuacugaagaagguacacaag

SEQ ID NO: 26776 - RNA, 50 nt, Mus musculus
uagauuuuaucaaaagugaagucuuuugugcuguagaagagaucuugagg

SEQ ID NO: 26777 - RNA, 46 nt, Mus musculus
agaugccugaauuuauucauagaauuucuagaaaauaguaggagac

SEQ ID NO: 26778 - RNA, 46 nt, Mus musculus
auuaugaaagggauguauuuaaaauuuuauaugaaaaggacuugaa

SEQ ID NO: 26779 - RNA, 46 nt, Mus musculus
ccuguuuucccuccaaccugaaauuaaauucuaaaaggcaucuuau

SEQ ID NO: 26780 - RNA, 46 nt, Mus musculus
ccuaggaacauaguaagacucugucuugaaggaagggaaggacaga

SEQ ID NO: 26781 - RNA, 44 nt, Mus musculus
aacuucugggaguguaggaagugggggauugcaaaacauagcaa

SEQ ID NO: 26782 - RNA, 45 nt, Mus musculus
uuuaacucauuuuuauuuuaugugcauugcuauuuugcccacaga

SEQ ID NO: 26783 - RNA, 68 nt, Mus musculus
aggaagugugugugugugugugugugugugugugugugagagagagagagagagagagauacauguua

SEQ ID NO: 26784 - RNA, 42 nt, Mus musculus
gcuauggggaaauuauauggaaaugacuucagccaaaccacc

SEQ ID NO: 26785 - RNA, 46 nt, Mus musculus
guucuuggcaugacugcuauguauucuucaaaauggccagacagau

SEQ ID NO: 26786 - RNA, 27 nt, Mus musculus
cuuuuuaaaaaaaagaaagggggcugg

SEQ ID NO: 26787 - RNA, 66 nt, Mus musculus
auaaaugauuuuguuuuaagauuuauuuuuaauugauguggggaaggggaauauuugugcagguac

SEQ ID NO: 26788 - RNA, 46 nt, Mus musculus
aacaaugaacuucaggaaaauuuaaagcucauuuuaauaggaagaa

SEQ ID NO: 26789 - RNA, 47 nt, Mus musculus
agcaaaaggggaugcagaacacccguauuucauacuuuacacaaaga

SEQ ID NO: 26790 - RNA, 41 nt, Mus musculus
ccaaacuauaauaaugaauaugugguauugucauauagaga

SEQ ID NO: 26791 - RNA, 46 nt, Mus musculus
cuaccucagcaaagccaagccaaccuccuacagccacagccaagca

SEQ ID NO: 26792 - RNA, 42 nt, Mus musculus
caauuaacaauauuaaauuuuaggaaaagaaacuagacaauu

SEQ ID NO: 26793 - RNA, 42 nt, Mus musculus
cucacuauguuguccagccugaccucuaacuuuggggcucga

SEQ ID NO: 26794 - RNA, 46 nt, Mus musculus
caugacgcagaucccccugucucagcccauacagauugcacaggug

SEQ ID NO: 26795 - RNA, 47 nt, Mus musculus
uguuuacaguccugcacuguaauuaucuuucagugacuggcagaauu

SEQ ID NO: 26796 - RNA, 46 nt, Mus musculus
aaaucuuguggaauauggaccuaguaacacauggaaacaaggagag

SEQ ID NO: 26797 - RNA, 46 nt, Mus musculus
aguccuccaaagcacuaggcgugugacauugcugcccagcucagaa

SEQ ID NO: 26798 - RNA, 46 nt, Mus musculus
aaaaugaucucuuccuaaaaaccaccauaaaugccaugccaguuuu

SEQ ID NO: 26799 - RNA, 45 nt, Mus musculus
gucagguuaugguaucaaaguuaugcugacuuuacuuaaugagau

SEQ ID NO: 26800 - RNA, 36 nt, Mus musculus
agcugcacugcaccuguagcaccuuuaguccugaga

SEQ ID NO: 26801 - RNA, 46 nt, Mus musculus
cucuauuaaauaaagauuaauauagcauuuuagguggccuccaauu

SEQ ID NO: 26802 - RNA, 46 nt, Mus musculus
gaaaacuguuuacccagcagugaaagaaaccauaaagaaaauauua

SEQ ID NO: 26803 - RNA, 46 nt, Mus musculus
cagaugagacucacagucuucuuaacaaucuaccaaaagccaagac

SEQ ID NO: 26804 - RNA, 42 nt, Mus musculus
ggguuguuuguuuguuuuuguaguucaugaaaaaguccagau

SEQ ID NO: 26805 - RNA, 41 nt, Mus musculus
ggcgcggugacaauucagauagauacuuauuacgaccagua

SEQ ID NO: 26806 - RNA, 46 nt, Mus musculus
uuacuuuuaauacuacaauuucucuacuauuuauugggugccuaca

SEQ ID NO: 26807 - RNA, 46 nt, Mus musculus
cauaguugacaaauacagagaaauuuguguaucugcuuaugaagua

SEQ ID NO: 26808 - RNA, 35 nt, Mus musculus
gguaauagucuuauuuuauaacaaacauuaagucu

SEQ ID NO: 26809 - RNA, 56 nt, Mus musculus
ugggauugacuaugcauaaacgcucaaucauauaugcgaccaacaugggggagggg

SEQ ID NO: 26810 - RNA, 46 nt, Mus musculus
ugccccucccuucuccccugguacuaucucaaguuagguccaagau

SEQ ID NO: 26811 - RNA, 44 nt, Mus musculus
gcugguauaaaagggaaaacaaaauuucuaugaaugccgaagag

SEQ ID NO: 26812 - RNA, 46 nt, Mus musculus
aaauaaauaguauuuuuaaauaaugugacauaucuaaaauacagau

SEQ ID NO: 26813 - RNA, 41 nt, Mus musculus
ugcugauauauucagugagucaguuucauaaacaggacagu

SEQ ID NO: 26814 - RNA, 46 nt, Mus musculus
agacaccuacacacgggaggcaaugcuaagaucaaugccaacugca

SEQ ID NO: 26815 - RNA, 26 nt, Mus musculus
aaccacugccccagaggcugucacuc

SEQ ID NO: 26816 - RNA, 45 nt, Mus musculus
cauguacaacaaacauugcuuuuuugcuaugguuaaagccuaguu

SEQ ID NO: 26817 - RNA, 37 nt, Mus musculus
uggagaaaauauuauuucaguauuaaaacguggagaa

SEQ ID NO: 26818 - RNA, 32 nt, Mus musculus
acaauuguguuuuuuuuuuuuuuuuuuuuuuu

SEQ ID NO: 26819 - RNA, 41 nt, Mus musculus
caagugggaaggaggcuacuggagguggagggggcagaaga

SEQ ID NO: 26820 - RNA, 45 nt, Mus musculus
gccacggggcauauuugacugaauguggcauccuuuuccauauga

SEQ ID NO: 26821 - RNA, 45 nt, Mus musculus
ucuugggaaauuaaucagauuacuacuaguguucuagagguagau

SEQ ID NO: 26822 - RNA, 45 nt, Mus musculus
auuggaacacaggcacagaacaaguugcaaaaaugacuaggcaga

SEQ ID NO: 26823 - RNA, 45 nt, Mus musculus
guaauuuaguauuuaaaucaacuuaaaaauacuuuaaaaguggau

SEQ ID NO: 26824 - RNA, 45 nt, Mus musculus
cuucugaguugaauaagguucuucagucuagugccugugagaaau

SEQ ID NO: 26825 - RNA, 45 nt, Mus musculus
uuguugggcuuuguugaaaguuuuuuuguguguugcagggauaaa

SEQ ID NO: 26826 - RNA, 46 nt, Mus musculus
gugcuauuuuaguuuuguauaguuuucuuucuucaccgugcauucu

SEQ ID NO: 26827 - RNA, 45 nt, Mus musculus
acaccuugugaagauuauacaucaauaauaauagggucaucuaau

SEQ ID NO: 26828 - RNA, 46 nt, Mus musculus
ccaguggaauccagaaggacuuccucuuuuggaaaugggguuagga

SEQ ID NO: 26829 - RNA, 47 nt, Mus musculus
cuuccaucccauguaggugaucugcauauaguucaaugccccauaug

SEQ ID NO: 26830 - RNA, 46 nt, Mus musculus
aaguagccccucuuaugguaugcuguuaucuuuauuguugcuaggu

SEQ ID NO: 26831 - RNA, 52 nt, Mus musculus
agagagagagagagagagagaccccagccauggcuaagaggagagaaggggg

SEQ ID NO: 26832 - RNA, 74 nt, Mus musculus
ccacgcaggugagaguaagcgcagugggccuugauggacagagacagacagacagacagacacacagagagaga

SEQ ID NO: 26833 - RNA, 49 nt, Mus musculus
ugaaaccagggggccccagagcgacacccuguagcccugggguuauggg

SEQ ID NO: 26834 - RNA, 61 nt, Mus musculus
uuagaguagauaauaauuuuuuuuuaauaacucugacagugugggaacuaauagggucagg

SEQ ID NO: 26835 - RNA, 46 nt, Mus musculus
gguuuguuugcuuguuuguuuuucuuuuuuuaaugacuagucagac

SEQ ID NO: 26836 - RNA, 45 nt, Mus musculus
ugcuuggugcaguaauuccacagauguggaaggcacuccaggagu

SEQ ID NO: 26837 - RNA, 46 nt, Mus musculus
aaacauaugcugccaacacuggcuuaucuuucucuuguucucgggu

SEQ ID NO: 26838 - RNA, 46 nt, Mus musculus
ugauuguaauuguguguguguguguguguguguguguuugagagag

SEQ ID NO: 26839 - RNA, 46 nt, Mus musculus
gaaagaaauuugacaguuuuuugguauuguuaaggagaaaagagau

SEQ ID NO: 26840 - RNA, 48 nt, Mus musculus
uuccuauuguuguccacaugcccugcacauacgguaaauacaguagau

SEQ ID NO: 26841 - RNA, 57 nt, Mus musculus
uggaaauuuuuauuuuaauucugaauuuuacuagccaacuccucaaaauuccccaag

SEQ ID NO: 26842 - RNA, 46 nt, Mus musculus
cuugaaaaaucaguauuuacuauuuaaagaaauauuuguagcagaa

SEQ ID NO: 26843 - RNA, 46 nt, Mus musculus
agaaauaauucaauagagcauaauauguuguuuuaacacaccagaa

SEQ ID NO: 26844 - RNA, 46 nt, Mus musculus
aaaaugaggauugaaaugggagagcauguagacaaggugccuuauc

SEQ ID NO: 26845 - RNA, 46 nt, Mus musculus
cugggguacucugagcaaguauaaugaggagaaggggugaagcuga

SEQ ID NO: 26846 - RNA, 45 nt, Mus musculus
aggaaauaggggugggacauugggaggagaaagaauucugggaga

SEQ ID NO: 26847 - RNA, 58 nt, Mus musculus
gcagauaggaugucgacagguagauuaugauucuggagaguaagacugcacuuccaaa

SEQ ID NO: 26848 - RNA, 45 nt, Mus musculus
aaacaauaaaucacugcauuuacuagcaaguauuaaguaccaagu

SEQ ID NO: 26849 - RNA, 46 nt, Mus musculus
aauuagcaaaguguuaaguaagacuuugugaucuaagccuugagaa

SEQ ID NO: 26850 - RNA, 42 nt, Mus musculus
uucuucacagcuaguauuuauuauuuaaaaaagcaaacagau

SEQ ID NO: 26851 - RNA, 42 nt, Mus musculus
agggugcuuuuggugauaagauuuuuauuaaguuggguaggu

SEQ ID NO: 26852 - RNA, 44 nt, Mus musculus
uuuuaaagaaaccaaaauucucacuauggaaccaguuguggaua

SEQ ID NO: 26853 - RNA, 46 nt, Mus musculus
gacuugcauuaaugugagaagcagcaccggagaccagcucucagau

SEQ ID NO: 26854 - RNA, 49 nt, Mus musculus
ucuaucuccaaguuugcuccaaaccaagugggcaaugcagcucagauuu

SEQ ID NO: 26855 - RNA, 103 nt, Mus musculus
ugccaaggcuugggcuugggggugacaagacccagauuaagagaguccuaguuggagggugggaaagaggguuuggggaaggaagguagaauaauaucaaggg

SEQ ID NO: 26856 - RNA, 46 nt, Mus musculus
acaaaaccagcuaguacaccaugugagugauacagagucaggguag

SEQ ID NO: 26857 - RNA, 46 nt, Mus musculus
caucuucagaauaauccaugugucuuaggguuucuauugcugagac

SEQ ID NO: 26858 - RNA, 45 nt, Mus musculus
cccagauacagacuagugauacuggcaccugggauaugccugaga

SEQ ID NO: 26859 - RNA, 42 nt, Mus musculus
caguacacgugucuuagcuccaguuuaggaccccggguuagu

SEQ ID NO: 26860 - RNA, 45 nt, Mus musculus
gugcuggguucuagaguugcauuacuaauccacuuugcguuggau

SEQ ID NO: 26861 - RNA, 46 nt, Mus musculus
uugauuuuugcuguuuuaaucauguauaguuaaguuauagguacuu

SEQ ID NO: 26862 - RNA, 49 nt, Mus musculus
gauguaauuaaaagggaagugaagugaggaguaaguugucugcacagga

SEQ ID NO: 26863 - RNA, 45 nt, Mus musculus
uuauuuuuccugggaggcaaagguguagaaagaacagugaagaag

SEQ ID NO: 26864 - RNA, 45 nt, Mus musculus
cugcaaugcuuuggcccaaacuauagucuuaucugaagguucaga

SEQ ID NO: 26865 - RNA, 46 nt, Mus musculus
gcucaugugauaauguguacauauuuacuauuuucucuggggaguu

SEQ ID NO: 26866 - RNA, 46 nt, Mus musculus
guggacaaauuaaacuauuaagggaaagaauagugcuggagggcau

SEQ ID NO: 26867 - RNA, 48 nt, Mus musculus
gugugccacagcacaggcacaccucuccaguucacaugcacgaguaau

SEQ ID NO: 26868 - RNA, 77 nt, Mus musculus
ucacuuagaaugauaacugaaccucagcaccucuaucaagacccucuguagugaagaccaaaaccuuuaggacagau

SEQ ID NO: 26869 - RNA, 42 nt, Mus musculus
uccuuuuauaagaguugccuuggucucgucacagcaauaaaa

SEQ ID NO: 26870 - RNA, 46 nt, Mus musculus
uugaggauuaauuuauguuaauauacaaguacuguuuaacauugau

SEQ ID NO: 26871 - RNA, 46 nt, Mus musculus
guugugaagggauuaaaauuuaaauguucaaaggguaacaacagag

SEQ ID NO: 26872 - RNA, 46 nt, Mus musculus
aggagcccagaauaauugaaauuggcauuaggugaaggaccaggug

SEQ ID NO: 26873 - RNA, 46 nt, Mus musculus
aagaguacugcaguacacacaagacuuagugugaccuguuucaauc

SEQ ID NO: 26874 - RNA, 45 nt, Mus musculus
agcauaguuaauuauuaguuuucugaauuuuuucuuggaugauag

SEQ ID NO: 26875 - RNA, 42 nt, Mus musculus
ugaaauggcaccccuggacuugaggugacaaacaggccaaug

SEQ ID NO: 26876 - RNA, 44 nt, Mus musculus
guagggcgugaucagcucaaggguuguuaguaggaggcugaaaa

SEQ ID NO: 26877 - RNA, 46 nt, Mus musculus
uaugugggguggugguaccaugggaauauaugguagaugccguagu

SEQ ID NO: 26878 - RNA, 45 nt, Mus musculus
augaacagggcauaaguauucaguuugagugugaacagggagaua

SEQ ID NO: 26879 - RNA, 46 nt, Mus musculus
gacucaucugucuuaaaaacaaacuaugaaagcaggaaccguaggc

SEQ ID NO: 26880 - RNA, 45 nt, Mus musculus
uuaucugaaggagauuagaaucaugaacagagagauguaaggagg

SEQ ID NO: 26881 - RNA, 42 nt, Mus musculus
gguaaguccgguugugcgacacagaagagauucuggcccuau

SEQ ID NO: 26882 - RNA, 57 nt, Mus musculus
acugaggacuggcuaugagcagcugacggugugcaggugauuugaaaagggagaaau

SEQ ID NO: 26883 - RNA, 55 nt, Mus musculus
uuuagugaguaagugagagacaccuguccucuccugggaggcaggcggaggacug

SEQ ID NO: 26884 - RNA, 46 nt, Mus musculus
aauagaaaucuugucucaaaaagcaaagagagcuacuuccaaagau

SEQ ID NO: 26885 - RNA, 45 nt, Mus musculus
uccucaguuuuuagugacuuguuuaccagccacucagccguugac

SEQ ID NO: 26886 - RNA, 42 nt, Mus musculus
ugaaauguugucuagaaaauugaauauuuacuuagggaggau

SEQ ID NO: 26887 - RNA, 46 nt, Mus musculus
uaagaaugaaauauuugaauuguuucuugaaucuguguugcuugau

SEQ ID NO: 26888 - RNA, 46 nt, Mus musculus
gacauuaauuuuuguaagcauuucuucuguuucuuaaugggcaucu

SEQ ID NO: 26889 - RNA, 47 nt, Mus musculus
guuaaaauuauaguauuuaaaauaauguaaaacacuuauggggaggc

SEQ ID NO: 26890 - RNA, 50 nt, Mus musculus
cuuguggaguguucuggagccuauuuuaaugacuaaaacggaguugaaga

SEQ ID NO: 26891 - RNA, 45 nt, Mus musculus
ccuuggucaugguuaaaugagugaaaauagaagauaaacagaggc

SEQ ID NO: 26892 - RNA, 46 nt, Mus musculus
auuuauuuacuaauaaccaaaaugacucccccaucaacugccacuc

SEQ ID NO: 26893 - RNA, 41 nt, Mus musculus
auuuauuaguacucaggauuauuauaauuaacggcgaggag

SEQ ID NO: 26894 - RNA, 45 nt, Mus musculus
guuuaucgaccgggcgauuuugguuaaaauauucaaaauggcgga

SEQ ID NO: 26895 - RNA, 42 nt, Mus musculus
gguggggugggcaugugguucugagcagagcuggcaggggag

SEQ ID NO: 26896 - RNA, 46 nt, Mus musculus
agugugucuguguuguguguuugucuguguguguucaugugugugu

SEQ ID NO: 26897 - RNA, 46 nt, Mus musculus
ccuuaaggauuguacccagggcccugaguagggggaggacaggauu

SEQ ID NO: 26898 - RNA, 29 nt, Mus musculus
cugggugucgggagcccugacaacagaag

SEQ ID NO: 26899 - RNA, 46 nt, Mus musculus
aacuaauauuagcaucguaauuuugaguaagcgguaaauuugagau

SEQ ID NO: 26900 - RNA, 45 nt, Mus musculus
accacgagaagaaguuuuccacccucagcaaagccaccccagcua

SEQ ID NO: 26901 - RNA, 42 nt, Mus musculus
ucuugggaaggggcaggaacacgggaauggaucgcgucauag

SEQ ID NO: 26902 - RNA, 46 nt, Mus musculus
gaguauuaggaguaagggugagaagagagagauaggaggaggggaa

SEQ ID NO: 26903 - RNA, 46 nt, Mus musculus
aauuguuguguguuaauggauuuauaaggaaagagacagaaaugac

SEQ ID NO: 26904 - RNA, 45 nt, Mus musculus
uaacuuggcacuguaccccuuccuuuguugcuuuuugucaggaua

SEQ ID NO: 26905 - RNA, 45 nt, Mus musculus
ccucgagcagcccgaagaauguccuguguaguuuccacgguaaga

SEQ ID NO: 26906 - RNA, 50 nt, Mus musculus
ggaugggugaucucagagaagggaaggagagaggagagagagagagagag

SEQ ID NO: 26907 - RNA, 89 nt, Mus musculus
aauaccgguguguaaaugaggcuggcucggaucccagcacucacauuugugaccagccucucucuccuugguucccucucagcccaugg

SEQ ID NO: 26908 - RNA, 46 nt, Mus musculus
caggaagaauccaugagacuccaggaagcaucguuaggggcgagga

SEQ ID NO: 26909 - RNA, 41 nt, Mus musculus
ccagaugacugagaggcaacgugauaauccacucggcuuug

SEQ ID NO: 26910 - RNA, 42 nt, Mus musculus
ucugucucucucuggcucugugugugucugucugucugucug

SEQ ID NO: 26911 - RNA, 42 nt, Mus musculus
caccaacgccggucaguaagcucuggcugccacgucucaccc

SEQ ID NO: 26912 - RNA, 42 nt, Mus musculus
gcuggcgcuugccuguauggcgagcuuggaacagaagcagcc

SEQ ID NO: 26913 - RNA, 43 nt, Mus musculus
cacugcggugaacuucaaugauucaggcuauguugggccaaga

SEQ ID NO: 26914 - RNA, 24 nt, Mus musculus
aguaacacaaauaccaccugugau

SEQ ID NO: 26915 - RNA, 51 nt, Mus musculus
acaauuauuccuggucuccugggaccagagcuguguguugcuguuugcugu

SEQ ID NO: 26916 - RNA, 46 nt, Mus musculus
gaguugcuguggaaggacaggucacgcccacgguaggacgggcccc

SEQ ID NO: 26917 - RNA, 46 nt, Mus musculus
aggccucgaugguaccaugugccgaggccucagacacagcguaguc

SEQ ID NO: 26918 - RNA, 44 nt, Mus musculus
gacugggugccuuacaucaacggcaaguuuaagaaggacgauua

SEQ ID NO: 26919 - RNA, 26 nt, Mus musculus
acaauggaacaugaacucauuaacag

SEQ ID NO: 26920 - RNA, 44 nt, Mus musculus
uccugauuuugcaaccccaucucacucuccaugaagucaguuua

SEQ ID NO: 26921 - RNA, 46 nt, Mus musculus
auuggcacugcacccguuugaagagucccggggcuuucugucugcu

SEQ ID NO: 26922 - RNA, 42 nt, Mus musculus
gcccaggcacggccaccgauucuguauucaggcggaggguga

SEQ ID NO: 26923 - RNA, 46 nt, Mus musculus
aucgaaugauaaauuguucucaaagagaguaaaaaagacuccaaaa

SEQ ID NO: 26924 - RNA, 44 nt, Mus musculus
cuggaggcagcgaugaauggcagauccaggaacacugguaagga

SEQ ID NO: 26925 - RNA, 48 nt, Mus musculus
aaaaucagggaagcuggacuucguaggaagaguacugaccauggagua

SEQ ID NO: 26926 - RNA, 45 nt, Mus musculus
acaaggaaauagccuuccacacacgucagaaagacauggggaaag

SEQ ID NO: 26927 - RNA, 93 nt, Mus musculus
uuaauacaccaugugguaauuuaaugguuaauauuuguaggcguuaccaucccacuguccacagugcccacaaucauuuuauacccgucacuu

SEQ ID NO: 26928 - RNA, 46 nt, Mus musculus
uuaccacaugguguauuaauuccacauuaggauaugugcccccaga

SEQ ID NO: 26929 - RNA, 46 nt, Mus musculus
agccaggugccagaugaauuugaagcuggcauaaaggacuacagag

SEQ ID NO: 26930 - RNA, 45 nt, Mus musculus
auguauguguaccguguauguaccucauaccugugaaggccugaa

SEQ ID NO: 26931 - RNA, 75 nt, Mus musculus
gccuagaaccugggggucacuaggguguccgugugucccugugugugugugugugugugugugugugugugugug

SEQ ID NO: 26932 - RNA, 40 nt, Mus musculus
uuaaucuuuucugauuaacauuugaauaaacagcuuauug

SEQ ID NO: 26933 - RNA, 46 nt, Mus musculus
ggcauaaccuggguccugguuuacaggacagacaaauacaagagau

SEQ ID NO: 26934 - RNA, 53 nt, Mus musculus
agaaggaaacuauaacagagucagcuggucgacaacagaagaagaagauaggu

SEQ ID NO: 26935 - RNA, 46 nt, Mus musculus
aacaagaccugacucccucuucuggugugucugaagacagcuacag

SEQ ID NO: 26936 - RNA, 42 nt, Mus musculus
ugagccaccaugugguugcugggaauugaacucagguccccu

SEQ ID NO: 26937 - RNA, 44 nt, Mus musculus
uccagaguucacuuagcugaucauucucggaaccauaggccucu

SEQ ID NO: 26938 - RNA, 46 nt, Mus musculus
cuaggggaagggaaggcaggaugauuguuggggcugaagcagagag

SEQ ID NO: 26939 - RNA, 46 nt, Mus musculus
uuauuauaaaagaaauacaaacucagauacuucucuagccugaccu

SEQ ID NO: 26940 - RNA, 50 nt, Mus musculus
cagaauucugaauuuccugucauacuuuuuagacauucacaucagacuua

SEQ ID NO: 26941 - RNA, 46 nt, Mus musculus
gugccauauacacagaagcagacuguccaugaacauuaggagaaaa

SEQ ID NO: 26942 - RNA, 24 nt, Mus musculus
ugacucuggguuccauaaagguga

SEQ ID NO: 26943 - RNA, 41 nt, Mus musculus
gaaguuuaugccuguaauaccagcacuuaggauuggcagca

SEQ ID NO: 26944 - RNA, 23 nt, Mus musculus
accuggugguagaagauuccauu

SEQ ID NO: 26945 - RNA, 41 nt, Mus musculus
ggauauuucugaacuucgaugagaguugggaaaggagagaa

SEQ ID NO: 26946 - RNA, 46 nt, Mus musculus
acuccgauccuaggcuuuucuguuauuaauaacaccuuuggugaau

SEQ ID NO: 26947 - RNA, 45 nt, Mus musculus
aagccuucucccuucacgccugugucugcucugcuccuggcugag

SEQ ID NO: 26948 - RNA, 46 nt, Mus musculus
aguaauugaaaauaauuuucauuuuuuuuucugggagaagauccag

SEQ ID NO: 26949 - RNA, 45 nt, Mus musculus
cuuagguuuuuuuccccccacaguauauugaaucaccugguccca

SEQ ID NO: 26950 - RNA, 53 nt, Mus musculus
gcccacucaucaacgccccacaucuggaacgaguccucggguuugucaaguug

SEQ ID NO: 26951 - RNA, 49 nt, Mus musculus
guagccagguaaccuguugucccagccccugagaaauauguagacccca

SEQ ID NO: 26952 - RNA, 46 nt, Mus musculus
ggaugucugaguuuagagccagccuggucuacagagugaauuccag

SEQ ID NO: 26953 - RNA, 46 nt, Mus musculus
cauaggaggggaaguacugggucacuugguaacucuauggcuagau

SEQ ID NO: 26954 - RNA, 46 nt, Mus musculus
cucuuuguauacuuccaacugagcaacuuucagacuacagauagau

SEQ ID NO: 26955 - RNA, 45 nt, Mus musculus
acuguccaagggaucgcugaugauuacgauaaaaagaaacuagug

SEQ ID NO: 26956 - RNA, 45 nt, Mus musculus
cgauaguuauuuaaucuaaaauuucaucauaucccucggguucua

SEQ ID NO: 26957 - RNA, 42 nt, Mus musculus
uucucuugugguuuuacccuucuguuucuuuccugugcucag

SEQ ID NO: 26958 - RNA, 42 nt, Mus musculus
agugagggacguuuucguugcuguggcagaacaucaggagag

SEQ ID NO: 26959 - RNA, 45 nt, Mus musculus
cugucucagagugccgggcaucuucuuucugcuaagccucucuca

SEQ ID NO: 26960 - RNA, 45 nt, Mus musculus
cagugucucuucaaaauaugauagcgguuuccaaaggccuuuaga

SEQ ID NO: 26961 - RNA, 46 nt, Mus musculus
agaaggcccaugaagagagauuuaguuugugauaaugaccagaaac

SEQ ID NO: 26962 - RNA, 48 nt, Mus musculus
ggcaaccaguggaggcagggugugauggaggacuagguagauuuuagc

SEQ ID NO: 26963 - RNA, 46 nt, Mus musculus
guuaaguuguuaggaaagcaaauagagcugugaucauggggcagau

SEQ ID NO: 26964 - RNA, 45 nt, Mus musculus
cagcauugggaaggaugagaaccacuguuguaggugaggcugagu

SEQ ID NO: 26965 - RNA, 46 nt, Mus musculus
aagagaaccccggugcaguucuacuucggugcagggcguggaagau

SEQ ID NO: 26966 - RNA, 46 nt, Mus musculus
cacaaaugaguaguuuguguauguuauauuuuuaaugaauaaagag

SEQ ID NO: 26967 - RNA, 46 nt, Mus musculus
ugaaacucucguuucuuggaccauuacuuuggguuuccugcuagac

SEQ ID NO: 26968 - RNA, 47 nt, Mus musculus
aauauaaaccccuaaugugagguuaaaacacugucuuuggaggacca

SEQ ID NO: 26969 - RNA, 73 nt, Mus musculus
aaacaauccaaggacaacuuaagaaaaguaacaauauaaaaggcuucaaaguggaagggaauuguaaacagaa

SEQ ID NO: 26970 - RNA, 47 nt, Mus musculus
agcucaucauugcuggacccagaacggccacagcguuacacgggagu

SEQ ID NO: 26971 - RNA, 46 nt, Mus musculus
auacuuuuagccuuuguugguuuguaaucuggcuuugguggcauac

SEQ ID NO: 26972 - RNA, 88 nt, Mus musculus
gaauuaauuagaauccugagcuaagagggaaggaagcuggguagugacgaaggacuugaguaggcuggcaggaaaggacuggggaggg

SEQ ID NO: 26973 - RNA, 46 nt, Mus musculus
uggucuccuggaaaccuucauauucuuucauauucuagaaacagau

SEQ ID NO: 26974 - RNA, 45 nt, Mus musculus
aaaacagaacggugucuguuuucguccaguacuaaaugaaaagaa

SEQ ID NO: 26975 - RNA, 73 nt, Mus musculus
gugaugugggcguagaccauguguuuuaaguaaagaggaaaucagggggcgugucaggaugaagggaaugugg

SEQ ID NO: 26976 - RNA, 51 nt, Mus musculus
gagccugucuuuaguaaaucgaugucagguacaccguagguaaugcaaggg

SEQ ID NO: 26977 - RNA, 59 nt, Mus musculus
cuggaggccaugaagucaacgcugaugcaugccaagagaucugagagagguuagaaaaa

SEQ ID NO: 26978 - RNA, 64 nt, Mus musculus
aggauggguagaaaauaagaaagaaggcacagugaaaagaggcaaggagagguucuggggaaga

SEQ ID NO: 26979 - RNA, 89 nt, Mus musculus
gagcaugcauuguuggagcuguggaaagauugucugugaacgcucaaaacuguaauacaaaagagggcuguaugcaaguaugugaguag

SEQ ID NO: 26980 - RNA, 47 nt, Mus musculus
guccuuuagacuaucauauuucaauuuauaccuuuauugaugaaugc

SEQ ID NO: 26981 - RNA, 45 nt, Mus musculus
cuaucccagauggcuaucaaauauguaucuucauguacaggcacu

SEQ ID NO: 26982 - RNA, 42 nt, Mus musculus
acaacucuugacuauauacucuucaggauucugcccccaguu

SEQ ID NO: 26983 - RNA, 76 nt, Mus musculus
cucaucuccgaaaaguuucagauacuagcugaagaacucugcagggaagagguuguugacuacuggguauauaugu

SEQ ID NO: 26984 - RNA, 87 nt, Mus musculus
ccaugaaacagggcauauggauagaaagaaaugucuguuguaaggcuugaaguaggacacagaaagggaaagauugcacaagcuucc

SEQ ID NO: 26985 - RNA, 45 nt, Mus musculus
ucuugugucuuggaaugaauguuuucuucaaucauggccagagau

SEQ ID NO: 26986 - RNA, 72 nt, Mus musculus
uacaugaaauaacuaaaagaagaaaaaaaaauauagagcagauauuaguaaaagaaauguuacuugauauac

SEQ ID NO: 26987 - RNA, 75 nt, Mus musculus
gccacuccagcuggacauucaauggacccgagagacagagaauuagucacucugcccucucugucccuugccucc

SEQ ID NO: 26988 - RNA, 45 nt, Mus musculus
uguauagguaaggagaugauaguaaaaauauagaaugcgggagau

SEQ ID NO: 26989 - RNA, 45 nt, Mus musculus
gggagaccuucaccuuuugccaggagcagcccuauucccagcugu

SEQ ID NO: 26990 - RNA, 48 nt, Mus musculus
gguaugaaguaccuuucgucucucaacuuuguccaccgagaucuggcc

SEQ ID NO: 26991 - RNA, 101 nt, Mus musculus
ugcaucacugaggacccgcucugcaugaucacggaauacauggagaauggagaucuuaaucaguuucuuucucgccacgagccucugaguuccuguucuag

SEQ ID NO: 26992 - RNA, 48 nt, Mus musculus
auuuucuuaaggagaucaagaucaugucucggcucaaggacccaaaca

SEQ ID NO: 26993 - RNA, 52 nt, Mus musculus
auuuacuauauacuuacuuaaauccccucacccaguccacauaacagcccaa

SEQ ID NO: 26994 - RNA, 46 nt, Mus musculus
cccacuuuuagguuuuauacuucuuauguggccagaagugcccacc

SEQ ID NO: 26995 - RNA, 70 nt, Mus musculus
ugucagugccaaccagccuguccugguggccgugaaaaugcuccgagcagaugccaacaagaaugccagg

SEQ ID NO: 26996 - RNA, 58 nt, Mus musculus
uucaucucugugaaguggagggaauggaaaaauucaaagacaaagauuuugcacuaga

SEQ ID NO: 26997 - RNA, 59 nt, Mus musculus
uguggcuguggaagaguuccccaggaaacuguuggccuucaaggagaagcugggagaag

SEQ ID NO: 26998 - RNA, 58 nt, Mus musculus
cagguggcaacaccuacugugugccugcuguaaccauggaucugcuaucggggaaaga

SEQ ID NO: 26999 - RNA, 45 nt, Mus musculus
gcuggaugaugaaaugacagucagccuuucccugcccagcgaguc

SEQ ID NO: 27000 - RNA, 45 nt, Mus musculus
uugaucauuucuaucugccuuacuucucccugaacuuguccuaga

SEQ ID NO: 27001 - RNA, 42 nt, Mus musculus
cuggagcccuucccaccucuccuauggcacccaccaccuaug

SEQ ID NO: 27002 - RNA, 24 nt, Mus musculus
uagaaaagauuuauggcaaaagau

SEQ ID NO: 27003 - RNA, 45 nt, Mus musculus
gugccaauaccauuuugccgacacguggaugauguucagcgagau

SEQ ID NO: 27004 - RNA, 46 nt, Mus musculus
uuuucauggggaaaaaaaagugaaaaauuacuuucagggaacuaau

SEQ ID NO: 27005 - RNA, 63 nt, Mus musculus
acguguggccuggcuaugacuacgugggauggcggaacgaaagugcuaccaacgguuucauug

SEQ ID NO: 27006 - RNA, 46 nt, Mus musculus
uucugucuaugauggagcuguuggguacagguaaauacuaggagau

SEQ ID NO: 27007 - RNA, 46 nt, Mus musculus
ggcauugaauuugcacccauguacaagaucaacuacagucgggaug

SEQ ID NO: 27008 - RNA, 46 nt, Mus musculus
cugagauuccagugcaacccgaugaccugaaggaauuucugcagau

SEQ ID NO: 27009 - RNA, 45 nt, Mus musculus
guaccccuccaagucccauccaggaggggcuacuauagccaacuu

SEQ ID NO: 27010 - RNA, 42 nt, Mus musculus
cguccuggacacggacugaauuugucugcauagguguuugug

SEQ ID NO: 27011 - RNA, 42 nt, Mus musculus
gauauaagauacaauuugccaaaugcaugaaacucuaaaagu

SEQ ID NO: 27012 - RNA, 41 nt, Mus musculus
gacagugugucaacuauuugcuauuagcaauggguggagag

SEQ ID NO: 27013 - RNA, 46 nt, Mus musculus
ucaaggguacauccaucuugucuuuguacuagcauaaugguauauu

SEQ ID NO: 27014 - RNA, 34 nt, Mus musculus
ugaaaugaucccgauucccagaaugccccuggug

SEQ ID NO: 27015 - RNA, 46 nt, Mus musculus
uuccuucagcuacuuuacaaauucuaguugucuccauuuuacagau

SEQ ID NO: 27016 - RNA, 93 nt, Mus musculus
uaauuuuaaaaagaaagagagagagagagagagagagagagagagagagagaaagagagagagaaaggaagaaagaaagaaagaaagaaagaa

SEQ ID NO: 27017 - RNA, 45 nt, Mus musculus
ggagcacagggucccuaaugaagaagauagagaaaguacccaagg

SEQ ID NO: 27018 - RNA, 62 nt, Mus musculus
guucaagggugguaugcuuaccuauaacaaagcccugagauuacucagacuaaugcugagga

SEQ ID NO: 27019 - RNA, 46 nt, Mus musculus
uucgguuaaagaucugccucaaaauaaacaagaagaucaggcaaga

SEQ ID NO: 27020 - RNA, 42 nt, Mus musculus
ucccagagauagcugcggagcuauuuacaguugaugguuuca

SEQ ID NO: 27021 - RNA, 41 nt, Mus musculus
gugccaaaaaaaagagagagaaaagaaaagaaaugaaaaga

SEQ ID NO: 27022 - RNA, 46 nt, Mus musculus
ucucccugacuucaccuacuugcugguuuauguucaucuccuaggu

SEQ ID NO: 27023 - RNA, 42 nt, Mus musculus
aaccaucaucaucaucaucaucaucaucuuucagcagcagca

SEQ ID NO: 27024 - RNA, 46 nt, Mus musculus
aaaauacuagaccuuugcucucauguaggugcuaaagacuguagga

SEQ ID NO: 27025 - RNA, 45 nt, Mus musculus
acaaggacccagagagaccuggccgggcacgugagguggagaaga

SEQ ID NO: 27026 - RNA, 41 nt, Mus musculus
agggaggaagagauagagacagagacagacagagucagaga

SEQ ID NO: 27027 - RNA, 45 nt, Mus musculus
aaagguuauugaaugucugaggcauucuugggauuauggacguga

SEQ ID NO: 27028 - RNA, 44 nt, Mus musculus
uuuccaaggacucuguucugcagagaauguucugcacccucuga

SEQ ID NO: 27029 - RNA, 45 nt, Mus musculus
ucuuuucaaaugguagcaaaugcauuaccuuggggcuggggagau

SEQ ID NO: 27030 - RNA, 45 nt, Mus musculus
aagaaagcugggcgugguggcacacgccuuuaaucccagcacucg

SEQ ID NO: 27031 - RNA, 46 nt, Mus musculus
ugugugugugugugugugugugugugugugugugagauugugugua

SEQ ID NO: 27032 - RNA, 49 nt, Mus musculus
ucuaaguggacuucucuuggugugucaggaaaaguucggaaaagcggca

SEQ ID NO: 27033 - RNA, 46 nt, Mus musculus
acaauggcagaggaagcccgggucacuggcaaacagguauguggag

SEQ ID NO: 27034 - RNA, 31 nt, Mus musculus
guagucgaugaggaguauuagcugaaaacag

SEQ ID NO: 27035 - RNA, 44 nt, Mus musculus
guccucuugguaccuuguuccucucuugcucuuucccugcuucc

SEQ ID NO: 27036 - RNA, 46 nt, Mus musculus
cucccugaauaauuauguccguuuacaauaaauaaugguggcagac

SEQ ID NO: 27037 - RNA, 45 nt, Mus musculus
gguaguuuguaucuuaauguuugugcgcuagcacaggcccauugg

SEQ ID NO: 27038 - RNA, 45 nt, Mus musculus
caaauaacuguugugggggucacagagugagccacacacuggaga

SEQ ID NO: 27039 - RNA, 42 nt, Mus musculus
uauacuugagaaaacacauuucaaaaaaccgagcagccaaaa

SEQ ID NO: 27040 - RNA, 42 nt, Mus musculus
guggucagcaccaucccugagucguugcaguagugcccgagc

SEQ ID NO: 27041 - RNA, 67 nt, Mus musculus
aaacuugagggugugaguaucuaaguagugaaaugaggggaugggaaagagaagaggagggaaguag

SEQ ID NO: 27042 - RNA, 46 nt, Mus musculus
ggcauacuuucccuuggauuuaaaauagaagaaauggaccauagac

SEQ ID NO: 27043 - RNA, 41 nt, Mus musculus
uguguauguauuuaaccacauguguaccuggcacccaagga

SEQ ID NO: 27044 - RNA, 35 nt, Mus musculus
cugcuaccugggcccugggaugcacaggcacuuuu

SEQ ID NO: 27045 - RNA, 41 nt, Mus musculus
gacuauacuuugguuguuuaggguucaugaugcccagcugc

SEQ ID NO: 27046 - RNA, 44 nt, Mus musculus
gucuuggagaccuuguagaugcaagcuauaacauggcguuuaga

SEQ ID NO: 27047 - RNA, 42 nt, Mus musculus
ccuccccuugcccucuccuaguuccucuuaccccugucuggu

SEQ ID NO: 27048 - RNA, 41 nt, Mus musculus
cuaaauauauacuuagguguguguaugugugugugugugug

SEQ ID NO: 27049 - RNA, 46 nt, Mus musculus
auuuuuaaaauuuauauguauuaggagagguuuaaacaggccagaa

SEQ ID NO: 27050 - RNA, 41 nt, Mus musculus
cuuaccccugugguaauuguauguguuuguuagggagaguu

SEQ ID NO: 27051 - RNA, 47 nt, Mus musculus
uuccuuugcuuugcugauaacuucauuuaucagcuacaucggaucug

SEQ ID NO: 27052 - RNA, 46 nt, Mus musculus
uuggccaucaaugagaggagaggcccuuggucuugcgaagaucaua

SEQ ID NO: 27053 - RNA, 46 nt, Mus musculus
uaaagaugcacuaucuucaguuuaacuaauccuaaaaugugcuaua

SEQ ID NO: 27054 - RNA, 46 nt, Mus musculus
uuuuaaguuacauuuuuuauuuuuauauuuuauucuugggcguggg

SEQ ID NO: 27055 - RNA, 41 nt, Mus musculus
ccugcacuucuuauaggcaggacaaauuuuggguugaaggu

SEQ ID NO: 27056 - RNA, 45 nt, Mus musculus
agagaaugaaagagauccaauggaggguuugguaaauauggcauu

SEQ ID NO: 27057 - RNA, 46 nt, Mus musculus
uaagggagaaaaacaucaaccuguuuauuuuguuuaaaacuuagag

SEQ ID NO: 27058 - RNA, 46 nt, Mus musculus
cacagagucugugugugugugugugugugugugugugugcgugugc

SEQ ID NO: 27059 - RNA, 46 nt, Mus musculus
cugcuugguacauucauuuaaaagcuagacaugguggcaugcagau

SEQ ID NO: 27060 - RNA, 46 nt, Mus musculus
gaaauacuuuccuaaaaguuucuuugaaaauuauguggcaugaguc

SEQ ID NO: 27061 - RNA, 46 nt, Mus musculus
cucagcugauggcuguccaguacacagaaaccacuagcaucaggua

SEQ ID NO: 27062 - RNA, 46 nt, Mus musculus
guggaacucugccucagguugggguaagagguggggaaagggagag

SEQ ID NO: 27063 - RNA, 46 nt, Mus musculus
aagggcaguguggcucccauccaagccgacaggcuaugggacagug

SEQ ID NO: 27064 - RNA, 47 nt, Mus musculus
auauuuaauuuggggugcuacuucccaaugugaaacugaagaggaga

SEQ ID NO: 27065 - RNA, 28 nt, Mus musculus
augggaggagaucuuugggucuauucuu

SEQ ID NO: 27066 - RNA, 47 nt, Mus musculus
auauuuacagaagcucaagaaguugaguaaagcuggggguugcugug

SEQ ID NO: 27067 - RNA, 48 nt, Mus musculus
guggaaaggaccaaaucuagaagaaugacaaauagccaacagaaagcc

SEQ ID NO: 27068 - RNA, 24 nt, Mus musculus
ucuccuuuguccagaucccaagcu

SEQ ID NO: 27069 - RNA, 45 nt, Mus musculus
auguauuuguuuguuauuagcauauuaccacuagcaaauuucagu

SEQ ID NO: 27070 - RNA, 45 nt, Mus musculus
accuguauuuuuaaaugccucauuuuguuucaguuuaggagaguu

SEQ ID NO: 27071 - RNA, 44 nt, Mus musculus
cccucuuuuggguguguucuugucuggucuugaugucagaacaa

SEQ ID NO: 27072 - RNA, 46 nt, Mus musculus
uugcuuucuauucuguggacacgguguguuacacuuacugauuuau

SEQ ID NO: 27073 - RNA, 54 nt, Mus musculus
uauuugggcuuuuuaucaugccagaaaaggggagccaccuaaaggauuugaguu

SEQ ID NO: 27074 - RNA, 79 nt, Mus musculus
guggguacccuuaagugaacaggacaggaaaacucagaaaauaucauggcggcaaaauguauggaaaggaucagauaga

SEQ ID NO: 27075 - RNA, 46 nt, Mus musculus
uuuaaaguuuugaaauauguuuaaaagcuuacauugaagacaagua

SEQ ID NO: 27076 - RNA, 46 nt, Mus musculus
agauauacuauuacuugacauauuucagaaauuuuaugccuuagga

SEQ ID NO: 27077 - RNA, 46 nt, Mus musculus
uuccagauguguaaagaauaauuggacaggugacacgugcuuucac

SEQ ID NO: 27078 - RNA, 45 nt, Mus musculus
uucagacugaugccggucugcauaccuggcacuguucguggggau

SEQ ID NO: 27079 - RNA, 46 nt, Mus musculus
gcuacccaaagaaauuagacuaaugauguaacaauaggccccguau

SEQ ID NO: 27080 - RNA, 91 nt, Mus musculus
auaaaugugcuggcuaguuuuuaugucaacuugacgcaagcuagguucauuuuggaagagggaaccucaguuaggaaaaauuuccacuaga

SEQ ID NO: 27081 - RNA, 46 nt, Mus musculus
uguuggguauuguuugguuauaguucaccacuguugcuaggagaug

SEQ ID NO: 27082 - RNA, 45 nt, Mus musculus
caaaaacaauucuagacauauauagggcugggaacucuggcagau

SEQ ID NO: 27083 - RNA, 46 nt, Mus musculus
ugccuccccaccucccucccucccucccucccuuccucccuccuuc

SEQ ID NO: 27084 - RNA, 46 nt, Mus musculus
uuauguguuugcucaguguuccguggacuucggcacgcuaguauua

SEQ ID NO: 27085 - RNA, 46 nt, Mus musculus
ugagaaaucaugccacacaacagaccugguauaaggggguuuauuu

SEQ ID NO: 27086 - RNA, 42 nt, Mus musculus
cauuguaacugucuguagacucaccugaagagggcaucagau

SEQ ID NO: 27087 - RNA, 46 nt, Mus musculus
cauggguaucuuucuguugaagggcaguugaauguugccaggugug

SEQ ID NO: 27088 - RNA, 45 nt, Mus musculus
gucugcagaugucuuuucauuuuauuuauuuguggggugugugug

SEQ ID NO: 27089 - RNA, 46 nt, Mus musculus
ggaaaacuuuccgugacuaaaccuguucuacaaagugccaccagaa

SEQ ID NO: 27090 - RNA, 41 nt, Mus musculus
gugaacuugauuggucccauuaaaaacacaacaccagaguc

SEQ ID NO: 27091 - RNA, 46 nt, Mus musculus
acaacccugauuaucuuguguagcugagcuauuuuucugcuguuaa

SEQ ID NO: 27092 - RNA, 46 nt, Mus musculus
uucaaugggaaaggcuucauaaauuugaucucaaccaugggcaaua

SEQ ID NO: 27093 - RNA, 84 nt, Mus musculus
cuucaguucagcccaagccuuuauuacuuccagcagcgcccaagacucaaaccaaugccagugucccagcaaaagccaucauca

SEQ ID NO: 27094 - RNA, 42 nt, Mus musculus
gcagguccuugucagucagugcuugcgugcuuucccggagcu

SEQ ID NO: 27095 - RNA, 45 nt, Mus musculus
ccuaaguccuaggauuaaaguaguaaggaugucaccacuaccaga

SEQ ID NO: 27096 - RNA, 45 nt, Mus musculus
cucaugcaguccugugcuaggcacuuugcagcacuggaaguaggg

SEQ ID NO: 27097 - RNA, 46 nt, Mus musculus
auagaguucaggaacuccuaccauuaucuuucaaauuaacuaagau

SEQ ID NO: 27098 - RNA, 27 nt, Mus musculus
gacagacaugaaggcagagccccagcc

SEQ ID NO: 27099 - RNA, 45 nt, Mus musculus
uuacuuguauguuugugcaccaugugugccuagugcuuuuguagg

SEQ ID NO: 27100 - RNA, 41 nt, Mus musculus
agagagaaggagggcuagagaugagaguaagaaagggugag

SEQ ID NO: 27101 - RNA, 46 nt, Mus musculus
uguguauguguguguauguauacauauacauguguguguauagaga

SEQ ID NO: 27102 - RNA, 45 nt, Mus musculus
gagcuuuauuauagaaaugcaggggaaagagagaagguauaaagg

SEQ ID NO: 27103 - RNA, 46 nt, Mus musculus
gguuaugauauagaaacauacuuuuggaauagaaagcugcuaggau

SEQ ID NO: 27104 - RNA, 44 nt, Mus musculus
auuucaucuuacugaaaauaauaagacucuggucaggccgagau

SEQ ID NO: 27105 - RNA, 44 nt, Mus musculus
ucccucagguguucaguagguaggauagauuuugcaggcauuag

SEQ ID NO: 27106 - RNA, 47 nt, Mus musculus
caaaggcuccaagcuauuuucucagacugugggcguguggcugggga

SEQ ID NO: 27107 - RNA, 45 nt, Mus musculus
cggcgcuggacaaacccgagaccgaccugcucagccaccuggauc

SEQ ID NO: 27108 - RNA, 24 nt, Mus musculus
acccucuccagauaagggaaaaag

SEQ ID NO: 27109 - RNA, 44 nt, Mus musculus
uagucaccagaccagaaaauaggaaaaaguuuuggugaccggug

SEQ ID NO: 27110 - RNA, 46 nt, Mus musculus
ucugggugagucaguaaugagggggcaucagcaggauuuggggagg

SEQ ID NO: 27111 - RNA, 43 nt, Mus musculus
gaauuuguccuccucauauuuuguccacggauccuuaggcaag

SEQ ID NO: 27112 - RNA, 46 nt, Mus musculus
cacuuucgaaaaccauccagccacuugcuugaugcugaaacagcag

SEQ ID NO: 27113 - RNA, 41 nt, Mus musculus
auugcccagcucaguccuaagaaaacauuuguaguggucca

SEQ ID NO: 27114 - RNA, 45 nt, Mus musculus
uucauauauauggguauauauaaaagauuaaugcgugugcgugug

SEQ ID NO: 27115 - RNA, 89 nt, Mus musculus
uaguggagaggugcaaauuuguugugugggggcagagaggcugggccggagugguagugugggaaaggaaugggcagcgugcagacagg

SEQ ID NO: 27116 - RNA, 28 nt, Mus musculus
gacgucuaugggguaucgggucccggag

SEQ ID NO: 27117 - RNA, 67 nt, Mus musculus
gaagagaggcuucccugaccgggaaucgaacccgggccgcggcggugagagcgccgaauccuaacca

SEQ ID NO: 27118 - RNA, 42 nt, Mus musculus
uccgcuugugaugggggcgggugcguagucuugguuccaggg

SEQ ID NO: 27119 - RNA, 56 nt, Mus musculus
gggcagagaggcugggccggagugguagugugggaaaggaaugggcagcgugcaga

SEQ ID NO: 27120 - RNA, 42 nt, Mus musculus
guguccacgcgagggccacggggccacgcgcuaauggucgag

SEQ ID NO: 27121 - RNA, 45 nt, Mus musculus
agagaggcuucccugaccgggaaucgaacccgggccgcggcggug

SEQ ID NO: 27122 - RNA, 42 nt, Mus musculus
augcaagccuccaaaaaagguauagauaagagcaguggcuag

SEQ ID NO: 27123 - RNA, 46 nt, Mus musculus
acaauggaagacugucucaaaagaaagaagggaaggaaggaaggaa

SEQ ID NO: 27124 - RNA, 44 nt, Mus musculus
gagaagagaaggcauccuggcuaaaauuuucacauuuccaauga

SEQ ID NO: 27125 - RNA, 44 nt, Mus musculus
agauuucacaaaucuucgaaggacuccucgaagcgagggcggca

SEQ ID NO: 27126 - RNA, 45 nt, Mus musculus
gaaaugucuucaaaauaaauaaucagaacaggaaacgccagcgag

SEQ ID NO: 27127 - RNA, 42 nt, Mus musculus
ccauagcgggguauagccucuggacuuggugcaacgugggag

SEQ ID NO: 27128 - RNA, 45 nt, Mus musculus
acagaugguugugagccacaaugugguugcugggaugugaacuca

SEQ ID NO: 27129 - RNA, 75 nt, Mus musculus
cugacaaacccacccuucauauaggcucuaaagucaggguggaaagagagagagagagagagagagagagagaga

SEQ ID NO: 27130 - RNA, 46 nt, Mus musculus
acccaugaugcucacaaucuggugugcagauaugcaugaagacaga

SEQ ID NO: 27131 - RNA, 46 nt, Mus musculus
caucauguaugcaugguaaaccuaagauuacuaagagacagggagu

SEQ ID NO: 27132 - RNA, 68 nt, Mus musculus
gggaagacccacagauacacagaaacgagagagacagaagaggagagagacagagacaaagagacagc

SEQ ID NO: 27133 - RNA, 61 nt, Mus musculus
ggaggaggaggcaaagacagggcgagcacugaggcaaagccagacagcugagcagagggag

SEQ ID NO: 27134 - RNA, 46 nt, Mus musculus
cagauuuuggcacaagccccaaagcccuucuggcuuuaacgaggag

SEQ ID NO: 27135 - RNA, 77 nt, Mus musculus
gggcagagccagguaccuaccugacuggcaccaucaauggagauccggagucgguggcaucucugcacugggacggg

SEQ ID NO: 27136 - RNA, 42 nt, Mus musculus
aagaaagaaagaaaagaaggaagagagagagagagagagaga

SEQ ID NO: 27137 - RNA, 41 nt, Mus musculus
cccacacggcucaggugaggggugugaagaugggagcccug

SEQ ID NO: 27138 - RNA, 41 nt, Mus musculus
gaggccaggacuggcaagacauucaguaagcaguaguggga

SEQ ID NO: 27139 - RNA, 82 nt, Mus musculus
ggucacgaucccugcgggggccacccauauccuuguacggcagcagggggggucuggucucaagagcaucuaccuggcccug

SEQ ID NO: 27140 - RNA, 46 nt, Mus musculus
cuaguuguauuuauuugguauuuauucauuuuuauuuagcaccagg

SEQ ID NO: 27141 - RNA, 44 nt, Mus musculus
gaaauccaggguguuggugacaaauaugaguggugugugugugu

SEQ ID NO: 27142 - RNA, 41 nt, Mus musculus
uuucucaugugccaauaauaaucccuuagaaauugguugua

SEQ ID NO: 27143 - RNA, 45 nt, Mus musculus
agaacccaacaacucccuggacacaaacaggagcuuaguuguaag

SEQ ID NO: 27144 - RNA, 46 nt, Mus musculus
gcucugacagcauugcucugugcucaaggauuuucaaacaguaaag

SEQ ID NO: 27145 - RNA, 42 nt, Mus musculus
uaagcccaaccaacaucuaggaauggaauucaaugagaggaa

SEQ ID NO: 27146 - RNA, 45 nt, Mus musculus
aaugcagagcuucuaggauuguggaagggacugaaugcugaggua

SEQ ID NO: 27147 - RNA, 46 nt, Mus musculus
guucuuacuggcacgaagaaauuuucuccuugggagguagaaacag

SEQ ID NO: 27148 - RNA, 67 nt, Mus musculus
ggugugucugaacacagugacuauguacucauauaaauaaauaaaaucuuuaaaaaaaaaaagagga

SEQ ID NO: 27149 - RNA, 42 nt, Mus musculus
cuuucacauugcacaguaggggcaagcgcaagagaccggggu

SEQ ID NO: 27150 - RNA, 45 nt, Mus musculus
uggucgagauccgggcccaacauucgacuauucucauccccacga

SEQ ID NO: 27151 - RNA, 46 nt, Mus musculus
cucuugacggaaggccugggaggaaccagguggguaucggggacca

SEQ ID NO: 27152 - RNA, 46 nt, Mus musculus
aacccuagugcugugcuagggggcagggaccucuucucacugcuag

SEQ ID NO: 27153 - RNA, 45 nt, Mus musculus
cucugugaauauuuauucuauuuaugguuccuaagaagcugucug

SEQ ID NO: 27154 - RNA, 46 nt, Mus musculus
aaucugcaguaccgaggagcuugucugccuguccagguauaagagg

SEQ ID NO: 27155 - RNA, 45 nt, Mus musculus
cuuuuuguccauaaaugucuuccucugggaagagagaaagcugaa

SEQ ID NO: 27156 - RNA, 42 nt, Mus musculus
cagaggaagacauuuauggacaaaaagguaucauugaccuag

SEQ ID NO: 27157 - RNA, 46 nt, Mus musculus
cugaugugugugcagccauggcagcucgcaggcgacagaguauuag

SEQ ID NO: 27158 - RNA, 45 nt, Mus musculus
uucuggccuccgaaggguuugugcuggggagauagcgugggcgug

SEQ ID NO: 27159 - RNA, 42 nt, Mus musculus
gugguuccugcaucaauugguagaacagcacguagcccucac

SEQ ID NO: 27160 - RNA, 46 nt, Mus musculus
guagauucccccuccaucccacaagacucagaguagccagguggag

SEQ ID NO: 27161 - RNA, 41 nt, Mus musculus
agagagaaaucccauucucucaguuuccccaccuguaucca

SEQ ID NO: 27162 - RNA, 45 nt, Mus musculus
agucucgaagaggccuugugcugcucaaacacuguagcacggcau

SEQ ID NO: 27163 - RNA, 42 nt, Mus musculus
ucuugagccuuucaucugggggaccuggccugggaggcaaag

SEQ ID NO: 27164 - RNA, 42 nt, Mus musculus
ccggguccgccccccucgagggcagaaaggccgaggcugcug

SEQ ID NO: 27165 - RNA, 45 nt, Mus musculus
accugucccccggugaggcggcgggggaggccagccgggguccag

SEQ ID NO: 27166 - RNA, 44 nt, Mus musculus
ucaugaacuugcccaucucgacagcaggcagccggcacccagca

SEQ ID NO: 27167 - RNA, 42 nt, Mus musculus
aaauacuagcugagcaacuggggaaaaaauuaagguggaauu

SEQ ID NO: 27168 - RNA, 46 nt, Mus musculus
ccuucaccccucuccccauccucuuuuuauguugcugcugcuguuu

SEQ ID NO: 27169 - RNA, 47 nt, Mus musculus
aacauugaaacaagagauucucagaauaaggauuguaaucagguacg

SEQ ID NO: 27170 - RNA, 26 nt, Mus musculus
aggaggaggagggaugaggagaaaac

SEQ ID NO: 27171 - RNA, 43 nt, Mus musculus
aaaguguucaaauuggaagcggaagggccuaaggggagaauug

SEQ ID NO: 27172 - RNA, 41 nt, Mus musculus
gugccgggguaacguagaaagugagagacccggaggaaagu

SEQ ID NO: 27173 - RNA, 46 nt, Mus musculus
uuucuggagccuuauauaccaagguggaggcucuggaagccugagg

SEQ ID NO: 27174 - RNA, 46 nt, Mus musculus
uggggagagcugccuaucagccugcgugcccgccucuugacauuau

SEQ ID NO: 27175 - RNA, 46 nt, Mus musculus
aacagucacucucccccugucuagugagaggagugauuucucagag

SEQ ID NO: 27176 - RNA, 50 nt, Mus musculus
gacuauaguguuuuccuuuauuuugccucauuuucuagggacagaguaug

SEQ ID NO: 27177 - RNA, 45 nt, Mus musculus
uaugaaaccugcccaucuguucucucugggauccuuauagucagc

SEQ ID NO: 27178 - RNA, 46 nt, Mus musculus
gcauuuuuccucagcaaccccauuugugcugagugacagcagguga

SEQ ID NO: 27179 - RNA, 46 nt, Mus musculus
uuuaggugaaguaccuaaggcuuucaaaacuacaugugggucauau

SEQ ID NO: 27180 - RNA, 45 nt, Mus musculus
aaacccuguauugaaaagcaaaacaaaccaaagaaagaaaggaag

SEQ ID NO: 27181 - RNA, 42 nt, Mus musculus
caaguaucuggaggaaacaucaauucgcuaugugacccccag

SEQ ID NO: 27182 - RNA, 45 nt, Mus musculus
ugaaaacugaaguuaugcugagggcugagcagcacuggcauugaa

SEQ ID NO: 27183 - RNA, 45 nt, Mus musculus
ucugccugaggcauuugacuuuauugcacgaaacccugccgagac

SEQ ID NO: 27184 - RNA, 45 nt, Mus musculus
ucugagauucggguauaaggggaaagauacguguugagucuauaa

SEQ ID NO: 27185 - RNA, 42 nt, Mus musculus
aacagagaaauacgauuaugagaugggauggguugguggcaa

SEQ ID NO: 27186 - RNA, 60 nt, Mus musculus
cugaacgaauuccgggaaaagcacaacauucgucucaugggggaagaugagaagccagca

SEQ ID NO: 27187 - RNA, 46 nt, Mus musculus
uuuuuuacccugauucccacuuguaauuucuuuuuauugucguuau

SEQ ID NO: 27188 - RNA, 42 nt, Mus musculus
ucuagaauauagagaaaacaaacgaacguuugggggcaaagu

SEQ ID NO: 27189 - RNA, 45 nt, Mus musculus
cugggucaggaugcaaaacugcccugcuucuaccgaggggauccg

SEQ ID NO: 27190 - RNA, 46 nt, Mus musculus
uguggaaguugacaaagaaguaguagaaggcaaaaaggagccagga

SEQ ID NO: 27191 - RNA, 45 nt, Mus musculus
cacagccuagaugagaagacacuuguacaaauacugaccgagcca

SEQ ID NO: 27192 - RNA, 42 nt, Mus musculus
agaucugucguuuuuuggcuagccuaagaaucuaaggcagaa

SEQ ID NO: 27193 - RNA, 41 nt, Mus musculus
aaauaggaauggaagaggagggucacuaucaccccagaugu

SEQ ID NO: 27194 - RNA, 46 nt, Mus musculus
gucauccuuaucccaggacuaagguuuuccuuuuucuagccggcac

SEQ ID NO: 27195 - RNA, 42 nt, Mus musculus
gcguaggaucucaaucuuagagagcuucuuguccgggggcag

SEQ ID NO: 27196 - RNA, 45 nt, Mus musculus
ugaaauagagaaagacgaauugagaauuggccgcuaaaggugugg

SEQ ID NO: 27197 - RNA, 42 nt, Mus musculus
gaacuuggcuucauaguuguccaacgcuagagagaccagcag

SEQ ID NO: 27198 - RNA, 41 nt, Mus musculus
ucuguccuuagcacauuuagcccuugccauccccugacccu

SEQ ID NO: 27199 - RNA, 45 nt, Mus musculus
agaagaagaccccgacuuccugggucaggcccagagccgccccua

SEQ ID NO: 27200 - RNA, 44 nt, Mus musculus
cugaccuaggagcccgaggccugaaggaugcuaaccaaauucga

SEQ ID NO: 27201 - RNA, 46 nt, Mus musculus
acugggaauuauuucuugagggaaggaauauaaacaggacggaucu

SEQ ID NO: 27202 - RNA, 45 nt, Mus musculus
uuggacagagaauuuguccaaugggugaugcuguacccaucccag

SEQ ID NO: 27203 - RNA, 45 nt, Mus musculus
agauggacguggcauagcuggauguguuugagaaucuccaguugg

SEQ ID NO: 27204 - RNA, 46 nt, Mus musculus
aaguggaugagacaccauugcuguauuuuccccucggugcugggag

SEQ ID NO: 27205 - RNA, 46 nt, Mus musculus
auccuacuaaagucuauaaaguauauuucuuauaagaauuacuaag

SEQ ID NO: 27206 - RNA, 70 nt, Mus musculus
aucucuguuccaugaaauuugaauuuuaaacauuuaaugucaggaagagacuuccuggagcaggcaaaga

SEQ ID NO: 27207 - RNA, 46 nt, Mus musculus
caagccuggcacccugcgucugacccaugcaaagguggaaggagag

SEQ ID NO: 27208 - RNA, 46 nt, Mus musculus
auuuuuuaagacaggguuucucuguguggccguagcuguccuggag

SEQ ID NO: 27209 - RNA, 46 nt, Mus musculus
aauagugauuuugauauaaggguugaaauuugagugucauacagag

SEQ ID NO: 27210 - RNA, 45 nt, Mus musculus
aauacugagagauaucuguggcguauggaggggguuugugcuggg

SEQ ID NO: 27211 - RNA, 43 nt, Mus musculus
aaaggucuaaggaagaaaaacuugucuccuggugcgguggagu

SEQ ID NO: 27212 - RNA, 48 nt, Mus musculus
uaugccccuuauuguaucuggggcagaugaccggcaagugaagaucug

SEQ ID NO: 27213 - RNA, 46 nt, Mus musculus
gguugacaccugccggggccauuacaacaaugugucuugugcuguu

SEQ ID NO: 27214 - RNA, 47 nt, Mus musculus
ggguucagacuuuccguagggaucaugaucgcuucuggguccuggcu

SEQ ID NO: 27215 - RNA, 41 nt, Mus musculus
cucuaggccaugauggugggaugauuguauuuaagcuggaa

SEQ ID NO: 27216 - RNA, 46 nt, Mus musculus
agcgguucuaaguuuccaguauucaacaugucauacaauccagcag

SEQ ID NO: 27217 - RNA, 46 nt, Mus musculus
aagcaaucuagagaacaguaccuacgaccuauacaccauccccaaa

SEQ ID NO: 27218 - RNA, 46 nt, Mus musculus
cccaguaccugggaagagaaaugcguacauauggacagacagacag

SEQ ID NO: 27219 - RNA, 46 nt, Mus musculus
cacacacacaaacaaacaaauaaauaaauauugauaggcccuggag

SEQ ID NO: 27220 - RNA, 41 nt, Mus musculus
agauaaaggccuaguaagaggaggggauucgaagacagaga

SEQ ID NO: 27221 - RNA, 45 nt, Mus musculus
ggaugcucuguguaacauucaugagaacauucgugucaagagugg

SEQ ID NO: 27222 - RNA, 46 nt, Mus musculus
uaucuauaccacaagcaaccacaucaaauaugcugucaccacuggg

SEQ ID NO: 27223 - RNA, 52 nt, Mus musculus
ucuggauuuacccaucuaugucaccagagugaagggcaauaauguauacugc

SEQ ID NO: 27224 - RNA, 50 nt, Mus musculus
cuagaggcagccaaagcccuggacgacaagaacugcugggagaagcuagg

SEQ ID NO: 27225 - RNA, 58 nt, Mus musculus
cuuuccuuccuguaccuuauuacuggcaaccuggagaaacuucgaaagaugaugaaga

SEQ ID NO: 27226 - RNA, 46 nt, Mus musculus
augaagaagcugagagccugaaggaaaccuuugacccugagaagga

SEQ ID NO: 27227 - RNA, 46 nt, Mus musculus
ccagacauugauccuaaugccaagcugcuccagccaccugcaccua

SEQ ID NO: 27228 - RNA, 52 nt, Mus musculus
aggagcauuggcugcugacauugacaucgacacuguaggcacugaaggcugg

SEQ ID NO: 27229 - RNA, 48 nt, Mus musculus
agguuugggagaggauguucuuggaaagggacaagaagaaggaggugg

SEQ ID NO: 27230 - RNA, 65 nt, Mus musculus
accauuugccgugaauacauuguggguuugugcauggagauagaaaggaagaagcuaccuaagga

SEQ ID NO: 27231 - RNA, 45 nt, Mus musculus
uccauuucuccgcugucguccucacucaugaguucuuguaguuua

SEQ ID NO: 27232 - RNA, 66 nt, Mus musculus
gcagccugugcauaugaucuuggugcugcggacagcccucaaccuuuucuucaagcucaagaacuu

SEQ ID NO: 27233 - RNA, 45 nt, Mus musculus
caguacgagacagaaggauucaauaaacgccacuuuccccagcca

SEQ ID NO: 27234 - RNA, 25 nt, Mus musculus
caugcuccgaccaucucggcucccg

SEQ ID NO: 27235 - RNA, 24 nt, Mus musculus
ggauggggggcccucugggccaga

SEQ ID NO: 27236 - RNA, 44 nt, Mus musculus
cuaugaaacgaggaccugugguuuuacggagggcuaacgaggaa

SEQ ID NO: 27237 - RNA, 45 nt, Mus musculus
aaggagacguuaaguggccuggccaaaaacgccacugagcugcag

SEQ ID NO: 27238 - RNA, 41 nt, Mus musculus
ucgugggccacuuugcugagacgaugcauaguaaaggggua

SEQ ID NO: 27239 - RNA, 27 nt, Mus musculus
agcuauagcuugaccagagaaaugaag

SEQ ID NO: 27240 - RNA, 46 nt, Mus musculus
gacccuuguccuaguuagcugcagcugucaacuuuacaaagcccag

SEQ ID NO: 27241 - RNA, 46 nt, Mus musculus
ucaccaggacuccacuccucccgagcaguuugagaaguaccagcag

SEQ ID NO: 27242 - RNA, 45 nt, Mus musculus
ugaguccuacuccaucaggguuucugcuguuagaaacaggccaau

SEQ ID NO: 27243 - RNA, 44 nt, Mus musculus
uccuuuggaauucucuuaagggaaaggaauuuugcacuuagcca

SEQ ID NO: 27244 - RNA, 45 nt, Mus musculus
agguuuuagcuuauauauaggacaucagauucccuggaauccuug

SEQ ID NO: 27245 - RNA, 46 nt, Mus musculus
cauguauacaauguauccugaucauauccacccucccaccccaccc

SEQ ID NO: 27246 - RNA, 46 nt, Mus musculus
ggaaacacuguaauuaacuacuugcuuggagaauucuaaacuggag

SEQ ID NO: 27247 - RNA, 46 nt, Mus musculus
ugagugccaaugggcccuccuuaugcccuuguuaugggccugggau

SEQ ID NO: 27248 - RNA, 46 nt, Mus musculus
gccacucaaccuccaccugguaagggacaaagaaaagccaggacuc

SEQ ID NO: 27249 - RNA, 46 nt, Mus musculus
aggaccugcauuuuccuacacugaggagcuauggugaagaugaggu

SEQ ID NO: 27250 - RNA, 45 nt, Mus musculus
aggaggagcuggacaccaagcuaacccguauucccagugccaaga

SEQ ID NO: 27251 - RNA, 46 nt, Mus musculus
uccucagagaucuucagcacacggguucuguagucaaccaccauag

SEQ ID NO: 27252 - RNA, 46 nt, Mus musculus
caggaaggugagauuuauggucaaucaaagagauauucugagccag

SEQ ID NO: 27253 - RNA, 41 nt, Mus musculus
gccugguuuagcuuccuggagagccacaacaagcuggacaa

SEQ ID NO: 27254 - RNA, 111 nt, Mus musculus
gggauguccuccuugcaggcugacuugagcuguuccagaucuucaagggugauguuguuggucagguccugaaggagaguuccguacucugccaugacuggaggagaaagg

SEQ ID NO: 27255 - RNA, 42 nt, Mus musculus
aacucuccuucaggaccugaccaacaacaucacccuugaaga

SEQ ID NO: 27256 - RNA, 64 nt, Mus musculus
ggucacuuacuucaaguacuuaccugagacuuaacucccacccccagcaacaugcgcccacacg

SEQ ID NO: 27257 - RNA, 72 nt, Mus musculus
cccugcauaacagaagaaacuuagaaaagcuaggagccgagagugauaagucauaacacacacacacacaca

SEQ ID NO: 27258 - RNA, 53 nt, Mus musculus
aacauucuccagacuuucuuacagucucccaaguacccccuccccaauugccc

SEQ ID NO: 27259 - RNA, 44 nt, Mus musculus
aguuguagguagguggggcaauuggggaggggguacuugggaga

SEQ ID NO: 27260 - RNA, 42 nt, Mus musculus
auuaauguguguaacacacacacccacaaagguugggggcag

SEQ ID NO: 27261 - RNA, 46 nt, Mus musculus
cuugggaaaggcugcacaugaggaauucagugugugugugugugug

SEQ ID NO: 27262 - RNA, 24 nt, Mus musculus
aaagaggcaagggcagaaaaguua

SEQ ID NO: 27263 - RNA, 41 nt, Mus musculus
uacagcugccaaaggcugcggggaggagcgauccuauuaca

SEQ ID NO: 27264 - RNA, 46 nt, Mus musculus
aacccaagucagggggagagagaaugagaggaaugugugagaagac

SEQ ID NO: 27265 - RNA, 47 nt, Mus musculus
ggugcgggcacucccggguccccgguuccuaagcagcgucuggagcc

SEQ ID NO: 27266 - RNA, 42 nt, Mus musculus
gcaggcuccagacgcugcuuaggaaccggggacccgggagug

SEQ ID NO: 27267 - RNA, 46 nt, Mus musculus
uuaaguauggggaguggcgggaagagaaacagauaagguauggggg

SEQ ID NO: 27268 - RNA, 45 nt, Mus musculus
ccuuccuugcauccuucaguggugagaaaaacuaucccggugaag

SEQ ID NO: 27269 - RNA, 46 nt, Mus musculus
guauuuagacugaugaguggguauuucuaguuguggagucacauga

SEQ ID NO: 27270 - RNA, 54 nt, Mus musculus
aaaauggugccaagaucccaucaauuuugguaggguaggcugagggaagcuuaa

SEQ ID NO: 27271 - RNA, 85 nt, Mus musculus
aagcuucucaauggagaguaggggaaaacauaggcuggcagauagagaagagggcuaacuaaaaagagaggugggacucucagag

SEQ ID NO: 27272 - RNA, 41 nt, Mus musculus
gaagcgucgccaauaagggaccggaaaucccgccuucgccg

SEQ ID NO: 27273 - RNA, 83 nt, Mus musculus
gcuccugagcuggcuccucacccccaacgucuaccucagcgaacucuucggcaaguuucucuucaucagcugcgaucuccuca

SEQ ID NO: 27274 - RNA, 45 nt, Mus musculus
acuguucugguucauaggacaggccuuauggcuggcuccugcaua

SEQ ID NO: 27275 - RNA, 45 nt, Mus musculus
ugugaucauguauucuggaagauauauaaguacugaggacagaga

SEQ ID NO: 27276 - RNA, 27 nt, Mus musculus
auuaacuguguaggacagacugacuga

SEQ ID NO: 27277 - RNA, 47 nt, Mus musculus
ucccaagccccagccguuugcuccagcguugaguucucuuugggggg

SEQ ID NO: 27278 - RNA, 45 nt, Mus musculus
uacugccugccuucugugaccccgagaccgcccuuuugccccccu

SEQ ID NO: 27279 - RNA, 42 nt, Mus musculus
ugaacagcccugccagcuguguccagucuccagagcugggag

SEQ ID NO: 27280 - RNA, 27 nt, Mus musculus
gcagggcgagcagggcugaugcugggg

SEQ ID NO: 27281 - RNA, 73 nt, Mus musculus
gcagcaggagcugauaggugcuggugauguuugcaaagagggugagaagguaagcgccaggccgugguucugg

SEQ ID NO: 27282 - RNA, 79 nt, Mus musculus
aguagugaggaaagacuaaacucuggcccuuuaucuggguucaaaggcaggaggcaccuugaggcucaccacaggaaag

SEQ ID NO: 27283 - RNA, 45 nt, Mus musculus
gccccaguaaagaagauccaggccucuucgauggccuucaagcag

SEQ ID NO: 27284 - RNA, 46 nt, Mus musculus
agaaaaaggauagcuggugguuuuccugagggugugugugugugag

SEQ ID NO: 27285 - RNA, 64 nt, Mus musculus
cucagggaagaauuuaacuggauagcuagccccugaccacccccuaacuaguacucccuuucua

SEQ ID NO: 27286 - RNA, 80 nt, Mus musculus
cccaggaaauccaaggagaacccucggaacuucucggacaaccaguugcaagagggcaagaacgugauuggguugcagau

SEQ ID NO: 27287 - RNA, 67 nt, Mus musculus
ccaugaaugguuaauauauauguauauauauguuuuagcagacauucccugagagccccuggauugc

SEQ ID NO: 27288 - RNA, 61 nt, Mus musculus
cucucugggcuuacuaaugcauuccuucccccacaaccaucaaaacuggaccaacaaaaac

SEQ ID NO: 27289 - RNA, 84 nt, Mus musculus
ggccugaugcugcaccgacccuuccuucuacaaggaggccucuccuacagcuguggcugcagggacuuaauuuauagggagggg

SEQ ID NO: 27290 - RNA, 45 nt, Mus musculus
ccuagcagaggcucuuuggcuucuuucuuuccauuccucucucac

SEQ ID NO: 27291 - RNA, 81 nt, Mus musculus
agggguggagcagagguaggacggcugcccaccaugcucuggggcuugacgaacacgaguuugcugauuuuaaauaaaaag

SEQ ID NO: 27292 - RNA, 45 nt, Mus musculus
ccaggcguauugaggacaccaagagaacacuggcccaaguaucag

SEQ ID NO: 27293 - RNA, 42 nt, Mus musculus
agggugggcacggguucauuaaugucuuucucuauggcuugg

SEQ ID NO: 27294 - RNA, 25 nt, Mus musculus
uugagaagcaagccagggaugagcc

SEQ ID NO: 27295 - RNA, 43 nt, Mus musculus
guguaugugugugaaacacccagagucguuagauguuuuauug

SEQ ID NO: 27296 - RNA, 42 nt, Mus musculus
acaugacagugugugugugugugugugugugugugugggugg

SEQ ID NO: 27297 - RNA, 46 nt, Mus musculus
caugagcaauacuuauguuguuuauuuguuuauccauauggcaguc

SEQ ID NO: 27298 - RNA, 46 nt, Mus musculus
cuggcuggggucugaggcugcaaagcggacccucugcugcagaugg

SEQ ID NO: 27299 - RNA, 41 nt, Mus musculus
cccaggcccugggaggcuccguaaggaagcuggggguucug

SEQ ID NO: 27300 - RNA, 76 nt, Mus musculus
ccgcagucguuucuuugccuggaagcccugcgcccagcccacgcugcuucaaaccuuacccacucaucacccccug

SEQ ID NO: 27301 - RNA, 46 nt, Mus musculus
cuucggggggcuugggaucuucuaggagaauuagaaacaggcauca

SEQ ID NO: 27302 - RNA, 43 nt, Mus musculus
uuucacuuuuagcagaaaaucucgagguagagccaaagcagaa

SEQ ID NO: 27303 - RNA, 59 nt, Mus musculus
gaaggggauauuagcuucagaaaugagagugcacagccuggaaucagcagagagaaaca

SEQ ID NO: 27304 - RNA, 93 nt, Mus musculus
augcaaucugacaaaugugaaugagaaaccuuggugggaauccgaaugugcugaaauccuuugguugauaauuucccaguccaugcucuugcc

SEQ ID NO: 27305 - RNA, 49 nt, Mus musculus
uucacugccauuacacuaaguaaaaaaauauuuucuauuaaaagauaug

SEQ ID NO: 27306 - RNA, 40 nt, Mus musculus
gaggagucacuaggaagcuguaaagauuaaaaggcacgug

SEQ ID NO: 27307 - RNA, 46 nt, Mus musculus
gggagaugggacacaucaugauuuuacuuuuaauaugacaucacag

SEQ ID NO: 27308 - RNA, 46 nt, Mus musculus
aggaaaaacugccaggucagcaauucacuccccaacccacccccca

SEQ ID NO: 27309 - RNA, 47 nt, Mus musculus
cucuggacaccaccaccucuuuauuuccuucucauagccccuaucug

SEQ ID NO: 27310 - RNA, 42 nt, Mus musculus
auaggggcuaugagaaggaaauaaagagguggugguguccag

SEQ ID NO: 27311 - RNA, 47 nt, Mus musculus
ccagaacaaaucugguacccacgaggacaagccaaaccaaguggauc

SEQ ID NO: 27312 - RNA, 42 nt, Mus musculus
gaccucuguggugugaacauucuuucuucugaccugggaguu

SEQ ID NO: 27313 - RNA, 47 nt, Mus musculus
ggugaccaacaaaaguuugcgacagaagagucgugcauccuucacca

SEQ ID NO: 27314 - RNA, 47 nt, Mus musculus
uguuggaaaacuccacucccagaaacucgacaagauuuuucaggaga

SEQ ID NO: 27315 - RNA, 90 nt, Mus musculus
acaaguguagccugggguggaucugggacaguugacaaagcuucacuugugguccucauuugugacagggacacuguuggcccuaagaga

SEQ ID NO: 27316 - RNA, 45 nt, Mus musculus
ucacaaaugaggaccacaagugaagcuuugucaacugucccagau

SEQ ID NO: 27317 - RNA, 125 nt, Mus musculus
cacauuugcugcugacugggacaccgggcagagugugagugagcucaacagaaguggcgguggcgcaacccagggguaggagugcucaaggcugagcugcauccugccccaugaguucacugcuu

SEQ ID NO: 27318 - RNA, 46 nt, Mus musculus
gcccgggucucgacccaccuuuccgaaucaagaaaauccagaaggu

SEQ ID NO: 27319 - RNA, 45 nt, Mus musculus
cuacgaugacagaggugacacgcuggggcuugcagaaagcgcagg

SEQ ID NO: 27320 - RNA, 53 nt, Mus musculus
aggacuccuuccaauccugcgcuuucugcaagccccagcgugucaccucuguc

SEQ ID NO: 27321 - RNA, 51 nt, Mus musculus
uugaggauggugcggcugcggcaacccuccucgcucacugucugccgcaga

SEQ ID NO: 27322 - RNA, 49 nt, Mus musculus
ucugaguuguugcugcuaccauccuuguaaggcgaggggauggcgcccg

SEQ ID NO: 27323 - RNA, 45 nt, Mus musculus
ccaccaggagcaaggucagcgagagcuuccagaacauccugcaac

SEQ ID NO: 27324 - RNA, 46 nt, Mus musculus
cagcuccucacugcugucagggagaagggagcuaaaacaugcucag

SEQ ID NO: 27325 - RNA, 42 nt, Mus musculus
ucuacuccuaccaacagaguccaguacagccuugcccugaug

SEQ ID NO: 27326 - RNA, 45 nt, Mus musculus
agucagugcucuuaacucgcugagccaucucuccagccccaaaaa

SEQ ID NO: 27327 - RNA, 46 nt, Mus musculus
gauagcuauggagaaugauguagaauauuuauuuaugugugaugaa

SEQ ID NO: 27328 - RNA, 46 nt, Mus musculus
ucuccaacaccuauuugugcuugugugugugugugugugugugugu

SEQ ID NO: 27329 - RNA, 42 nt, Mus musculus
ugccccuggagucaucaucaucaucauaaucuuuaucacaau

SEQ ID NO: 27330 - RNA, 46 nt, Mus musculus
augucgaaaauaugggagacugagaaaauguugccuauggccucag

SEQ ID NO: 27331 - RNA, 45 nt, Mus musculus
uuuauaaagggucagaaaauauuuuacaggaaagucuuauucuug

SEQ ID NO: 27332 - RNA, 42 nt, Mus musculus
uaaagagucuggaugucaucuuugucaguuagaugugagcag

SEQ ID NO: 27333 - RNA, 37 nt, Mus musculus
aaaaggaaaggggcuggagagauguuucaguuaguag

SEQ ID NO: 27334 - RNA, 46 nt, Mus musculus
gacagaaaugacauacucugccauugucauucuugcuucuccaguc

SEQ ID NO: 27335 - RNA, 42 nt, Mus musculus
guccccucuuuugaggagccuuccucccuucuguguucccag

SEQ ID NO: 27336 - RNA, 49 nt, Mus musculus
uguacucggcuuacuuuacauauuauacuucauuguuuaguagucucgg

SEQ ID NO: 27337 - RNA, 45 nt, Mus musculus
gauggaagccuccuccucgguucccuugugugucucccugucccu

SEQ ID NO: 27338 - RNA, 46 nt, Mus musculus
gugaccuacaaacaaacuaaaauauccacauuucugagccccugug

SEQ ID NO: 27339 - RNA, 25 nt, Mus musculus
acguuuccuuauuuguuagagacau

SEQ ID NO: 27340 - RNA, 46 nt, Mus musculus
cuuucaguucucuaggaagauuagacaauccauugauaaaacagcu

SEQ ID NO: 27341 - RNA, 42 nt, Mus musculus
gaacaucuacuuuauagaagagaccuauuuggcgugcuuauu

SEQ ID NO: 27342 - RNA, 46 nt, Mus musculus
acuaagcauugaagaauacuugaaauauuuguaauugagaaaugua

SEQ ID NO: 27343 - RNA, 45 nt, Mus musculus
accugaaggagagccgugaguggagcucaugcucuugaccuugga

SEQ ID NO: 27344 - RNA, 47 nt, Mus musculus
ggcucagccucgaagaacaagacuuggcucauuaucugcccguagug

SEQ ID NO: 27345 - RNA, 47 nt, Mus musculus
ugcuucugaaguguccacuacaaguuccacaucaaaaccacccacag

SEQ ID NO: 27346 - RNA, 24 nt, Mus musculus
auaggugcaagagcagauggucgc

SEQ ID NO: 27347 - RNA, 44 nt, Mus musculus
uaaacugcgagaagauaauaauaaaacugaugaaggcccagaua

SEQ ID NO: 27348 - RNA, 42 nt, Mus musculus
gacgucagugcuaaggcaguggguacagaugaauucugcuua

SEQ ID NO: 27349 - RNA, 46 nt, Mus musculus
guuggaacugggcuugucuauggugaaacucccuuggcgcacuaac

SEQ ID NO: 27350 - RNA, 42 nt, Mus musculus
ucuacgagcaaaggagacagaguaauacaaaaugaaagcaag

SEQ ID NO: 27351 - RNA, 46 nt, Mus musculus
aaacuucuuugguaaaacaaacauuggcuaaaaugcagcagcaaga

SEQ ID NO: 27352 - RNA, 42 nt, Mus musculus
ucuucuccuugcuagaugagcuuccugagugaaggagggcuu

SEQ ID NO: 27353 - RNA, 85 nt, Mus musculus
agauaggagaaaagcaagacacggaacugcaggaaaaagaagcccagguauaccaaagcgagaagcacgaugcagaccgaggccu

SEQ ID NO: 27354 - RNA, 67 nt, Mus musculus
uggaacgaccuucgcucuggagcucucgaguagcuucucuucauuugggagcuggggaagaguucgc

SEQ ID NO: 27355 - RNA, 42 nt, Mus musculus
agaaguacuaguuguacaacuuccuuggcuagucagggagag

SEQ ID NO: 27356 - RNA, 46 nt, Mus musculus
gcauaaaggucucauaaaagacugggcucucaacucugcugcagua

SEQ ID NO: 27357 - RNA, 46 nt, Mus musculus
caagguacuauccaagucauuuuuacuaggaguauuuugaagagau

SEQ ID NO: 27358 - RNA, 42 nt, Mus musculus
uuuuuauauuagucauuucuacauaugacucucuacccaaag

SEQ ID NO: 27359 - RNA, 46 nt, Mus musculus
uugaccauuguuaaaaaagaaguauggacuuuaaaaggccauagac

SEQ ID NO: 27360 - RNA, 45 nt, Mus musculus
auuaagaaguucagggagucuugggcacagaccaagccaggagau

SEQ ID NO: 27361 - RNA, 46 nt, Mus musculus
gugcaacucuggaggaacauuuacgccgccaucacucagagcagaa

SEQ ID NO: 27362 - RNA, 46 nt, Mus musculus
acaaaugauugugaauuugacaguucuguggcuuuuauggggagau

SEQ ID NO: 27363 - RNA, 46 nt, Mus musculus
cccaaaacaacccuccucaaauggugugggaaagaacagaggagga

SEQ ID NO: 27364 - RNA, 46 nt, Mus musculus
aauuccagcagccaucacaaauagcagagagcacuauucaugagau

SEQ ID NO: 27365 - RNA, 46 nt, Mus musculus
aaaaauaccucaguggcuguggcaucaaauucauauugggcaagua

SEQ ID NO: 27366 - RNA, 42 nt, Mus musculus
ugugaauuuucuccuaagcuuuuaauuucugaggccaaaaaa

SEQ ID NO: 27367 - RNA, 24 nt, Mus musculus
aaaugagccuaacauccugguuuu

SEQ ID NO: 27368 - RNA, 41 nt, Mus musculus
caacccuggcgaucaaugaggugacagaugucacagccaga

SEQ ID NO: 27369 - RNA, 42 nt, Mus musculus
uacaugauacaaaaacaacuaugguagcucaguagcacagau

SEQ ID NO: 27370 - RNA, 42 nt, Mus musculus
uucccagcauucucuacaggauuuaguucccugaggcaagau

SEQ ID NO: 27371 - RNA, 46 nt, Mus musculus
gccaagcccugugugacaagaagauaagcuguaaaagauugcuaaa

SEQ ID NO: 27372 - RNA, 46 nt, Mus musculus
caaaaaauuaaaccccagaauccacauaugacagaaaaggugagau

SEQ ID NO: 27373 - RNA, 46 nt, Mus musculus
ucuuuugguuggugguucagucucugagagccccaaggguccaggu

SEQ ID NO: 27374 - RNA, 46 nt, Mus musculus
ugaauuugagaacaaugaggccacugugacuggagaugagugagag

SEQ ID NO: 27375 - RNA, 80 nt, Mus musculus
aggagcccauaagaggguaacauaauucuuuaagggacaggaaagauaagaacacauaugaguugggaaggagaauacug

SEQ ID NO: 27376 - RNA, 45 nt, Mus musculus
uggguuugggucuaguucacuuccauuuuuauucaagggagagag

SEQ ID NO: 27377 - RNA, 66 nt, Mus musculus
gagguuggcucuugcugcugcuuccugggucggccgcguccucgcuucuguggcaccugggcggca

SEQ ID NO: 27378 - RNA, 44 nt, Mus musculus
gccuuugggucuuccucugggucucuuaggagagggcucacagg

SEQ ID NO: 27379 - RNA, 81 nt, Mus musculus
uaagagacccagaggaagacccaaaggcagcaaaaacaagagucccucuaaagcagcccagaagaaagcagagaccauugg

SEQ ID NO: 27380 - RNA, 62 nt, Mus musculus
accaucgagccaaagaugccuuuuuggggggaggggagggguuugcuuuguguuguucagag

SEQ ID NO: 27381 - RNA, 41 nt, Mus musculus
ucaugucaauuugacuuagacaugaguaauugauggcuaga

SEQ ID NO: 27382 - RNA, 45 nt, Mus musculus
guccuaauuuuucauguuucuaccugggugaguuuacccucagug

SEQ ID NO: 27383 - RNA, 46 nt, Mus musculus
ugaaucaagccaucagggaaaacaacaaaacaaaacaccucuagcu

SEQ ID NO: 27384 - RNA, 42 nt, Mus musculus
ugagggcacugacccucauagguuuuaaauaaacacacagac

SEQ ID NO: 27385 - RNA, 42 nt, Mus musculus
agguuguaaggcaacuaagacacuauaaucacagccugucac

SEQ ID NO: 27386 - RNA, 45 nt, Mus musculus
aaaggaaauauaauacugaaaaucauggaaauaccacauuuaaga

SEQ ID NO: 27387 - RNA, 41 nt, Mus musculus
guguggugugugugugugugugugaguguguguguguggug

SEQ ID NO: 27388 - RNA, 79 nt, Mus musculus
uggugugugugagugugugugugugguguguguauguguguguguguaugugugguguguguaugugugugugugugug

SEQ ID NO: 27389 - RNA, 50 nt, Mus musculus
uucuaugcauuuauugcuugcauguguuuguacugugugugugugugugu

SEQ ID NO: 27390 - RNA, 41 nt, Mus musculus
ucauagaagacugauaaucuuaggacccuuaagccgggaga

SEQ ID NO: 27391 - RNA, 45 nt, Mus musculus
gaaaucaugaggcauaguuuuuuuucuggaguaaacuggcaagau

SEQ ID NO: 27392 - RNA, 44 nt, Mus musculus
gcuaaucauguauuuacugauuacuucaggguucauccugacua

SEQ ID NO: 27393 - RNA, 42 nt, Mus musculus
ugacaucaagcggaagcuagaggcagaaaaauagcaagaaaa

SEQ ID NO: 27394 - RNA, 46 nt, Mus musculus
uauaaaaauuacggauuuugggcuuugcaaagaagggaucacagau

SEQ ID NO: 27395 - RNA, 45 nt, Mus musculus
uuuuuaaaaaauuaagauucauuuagaaagugauugcagggaaag

SEQ ID NO: 27396 - RNA, 46 nt, Mus musculus
auguuaggccaacacugucacucugaacuguucccucugcugagaa

SEQ ID NO: 27397 - RNA, 46 nt, Mus musculus
ccccagcgaagauggauacuagagggcugaggcaggaugggggagc

SEQ ID NO: 27398 - RNA, 42 nt, Mus musculus
aaauuggagaauaacaaggagauccaggaaugcgagggaaga

SEQ ID NO: 27399 - RNA, 46 nt, Mus musculus
ugaaucuacauuguuagaaguauaguugcucuugcuugccccuguu

SEQ ID NO: 27400 - RNA, 65 nt, Mus musculus
gggacuuucaccuguguugcugguuucuauggaccuccugagaggcagacaggcuguaggguaug

SEQ ID NO: 27401 - RNA, 102 nt, Mus musculus
gugucucugauuacugcagaccuccugggagucagaaacauuguagggugugggaggguaucaugcuccugaucuggucuggguggggaaagaccagaaaga

SEQ ID NO: 27402 - RNA, 45 nt, Mus musculus
aggaggcucagggcuucaggggcaggaucuaacccauuuguagau

SEQ ID NO: 27403 - RNA, 44 nt, Mus musculus
ugcugucucugguuaggaggggccuccuguaucucugguuagag

SEQ ID NO: 27404 - RNA, 41 nt, Mus musculus
cuugcugugguggccguacugaguucugauggugcccagug

SEQ ID NO: 27405 - RNA, 45 nt, Mus musculus
ucaaugugucuauguuuaguuuuuguuuccaggaucuguccaaug

SEQ ID NO: 27406 - RNA, 46 nt, Mus musculus
guuuuuccacauggcugcucagccugcuuccuuuuagaccccagca

SEQ ID NO: 27407 - RNA, 46 nt, Mus musculus
aaaauacuaugcuaugaagauucugaagaaagaagucauuauugca

SEQ ID NO: 27408 - RNA, 46 nt, Mus musculus
ucagacgaugaaugauuuugacuauuugaaacuacuagguaaaggc

SEQ ID NO: 27409 - RNA, 41 nt, Mus musculus
aguagauucucuuguaagguucaggaccucaccagccacaa

SEQ ID NO: 27410 - RNA, 41 nt, Mus musculus
guguugccucacuguggucugugacuuucauuugccugagu

SEQ ID NO: 27411 - RNA, 42 nt, Mus musculus
ggugucucaauucaaauccucucuaauguucuggccccgcuc

SEQ ID NO: 27412 - RNA, 47 nt, Mus musculus
ggaccacuguuauagagagaacauuucauguagauacaccagaggaa

SEQ ID NO: 27413 - RNA, 46 nt, Mus musculus
agcaaaucuuuuucuguaggguggugcuguaacauggguagagaga

SEQ ID NO: 27414 - RNA, 46 nt, Mus musculus
gucaucccagauauuuguuuucccaaagucaguauuaggcccuagg

SEQ ID NO: 27415 - RNA, 46 nt, Mus musculus
cucauggcuuguucagcuugcuuucuucuagaacccaggacuaaga

SEQ ID NO: 27416 - RNA, 46 nt, Mus musculus
ggaguaaguuuuacaauuaaaauacaaauuuuaggaaaggggagau

SEQ ID NO: 27417 - RNA, 46 nt, Mus musculus
agaaaaauggguuuaguggccaaaaugaauauuuuauuagauaguu

SEQ ID NO: 27418 - RNA, 45 nt, Mus musculus
uugagaacauuaacaggcuggauguaaagcaguaaugggucaguu

SEQ ID NO: 27419 - RNA, 25 nt, Mus musculus
guuagagcaggaugaggggaaaagc

SEQ ID NO: 27420 - RNA, 42 nt, Mus musculus
uaacagaaaagaaaguccagcuauuuguguuuagguguaggu

SEQ ID NO: 27421 - RNA, 42 nt, Mus musculus
uggaaccuaaaugcuaccucauugauuagauauuggcaccua

SEQ ID NO: 27422 - RNA, 65 nt, Mus musculus
guguguauguaugugcgugugcaugugugugugugagagagaaagacagacagagagagagagag

SEQ ID NO: 27423 - RNA, 46 nt, Mus musculus
aagugugugugcaugcacauggguguguaugcacauguguguaggc

SEQ ID NO: 27424 - RNA, 45 nt, Mus musculus
acuuuaaacccagauguucccugugcugcaagaaagagagagaga

SEQ ID NO: 27425 - RNA, 45 nt, Mus musculus
ugugagccucagaugaaccccuucaauucacagggcuuuguuaag

SEQ ID NO: 27426 - RNA, 41 nt, Mus musculus
ugugugagugagugagugagugagugagugagugagaaaac

SEQ ID NO: 27427 - RNA, 45 nt, Mus musculus
uccuacagauccaaagcugcaguaacuccaugacacagggcaaca

SEQ ID NO: 27428 - RNA, 48 nt, Mus musculus
cccagcccccacccaacuagaccucuaaaagccuuggggccuccaguc

SEQ ID NO: 27429 - RNA, 60 nt, Mus musculus
cucugacaauuccacauccuauaccucuccugcuuccccccacauuuccaugaagauguc

SEQ ID NO: 27430 - RNA, 45 nt, Mus musculus
uuagugauuuuaaguugaaaauugaaauuuauagacugccaaggu

SEQ ID NO: 27431 - RNA, 45 nt, Mus musculus
acauaagaccugaccuuuuaaacuaugaaaauuuaaugacuagaa

SEQ ID NO: 27432 - RNA, 46 nt, Mus musculus
acauugcaaguuccugaaacuauuuaacauuacagguuuugagagg

SEQ ID NO: 27433 - RNA, 46 nt, Mus musculus
uuauauggucccuuuuauuaauauugcuaaaucauauaggucaguu

SEQ ID NO: 27434 - RNA, 49 nt, Mus musculus
auuacgggugguugugagccaccaugugcuugcugagauuugaacuuca

SEQ ID NO: 27435 - RNA, 46 nt, Mus musculus
ccaccacucuagccccaucgcauucauucucuccuuacaccagaug

SEQ ID NO: 27436 - RNA, 46 nt, Mus musculus
ugacuccuaagcacugccuuaugagguauagaucgagcccccauuu

SEQ ID NO: 27437 - RNA, 45 nt, Mus musculus
guauucauuguugcuuucuucuguuuaacuucucugggccuuaga

SEQ ID NO: 27438 - RNA, 46 nt, Mus musculus
aagguaauguaaguaauguuuacuuguaaguauguugagacugguu

SEQ ID NO: 27439 - RNA, 42 nt, Mus musculus
agaaacauguaguuagauaugugauaaaguuaacauuauuga

SEQ ID NO: 27440 - RNA, 46 nt, Mus musculus
gucugcauuuggcugauuaugggauggaccccuggguggggcaguc

SEQ ID NO: 27441 - RNA, 51 nt, Mus musculus
uguugcagaauacguuccaguuccaugaacacuacuagucaguaaggauga

SEQ ID NO: 27442 - RNA, 94 nt, Mus musculus
guuugguuuucuccuagguucucgaccuaucuacucucagguuuagccacccaaacaguguccaguauggauucuaucuuagggaguaggccuu

SEQ ID NO: 27443 - RNA, 39 nt, Mus musculus
ucuugcagugcaagacauugaucucuaaguauagaagaa

SEQ ID NO: 27444 - RNA, 68 nt, Mus musculus
cccguugguucuuacaauuuuucugucucuuuuucagcagaguucccugagggaaggguuuugauaga

SEQ ID NO: 27445 - RNA, 46 nt, Mus musculus
aauuauucuaauaucuuuuuagccuuaaauucaucuugccauguaa

SEQ ID NO: 27446 - RNA, 46 nt, Mus musculus
cacuagaugucacucugacucauaugguuaagugcagccuggacuu

SEQ ID NO: 27447 - RNA, 68 nt, Mus musculus
cagaagaaauauacagaaaauaguuuaugaaauagggcagagaaugauaaaauguguacagugaaaga

SEQ ID NO: 27448 - RNA, 46 nt, Mus musculus
uuuuugagguggaaacauguugaacauguucauagauuauggagca

SEQ ID NO: 27449 - RNA, 68 nt, Mus musculus
aaaauaaggacaguaggcuugcucugcuucugaaauacuaugcguguauaggagaguuuggggaaggu

SEQ ID NO: 27450 - RNA, 45 nt, Mus musculus
ucacucuuggccauguauugcucuugacaguacaaugaaaucaga

SEQ ID NO: 27451 - RNA, 45 nt, Mus musculus
augagcuucaggccaacgagagucccuuucucucauuguguaggu

SEQ ID NO: 27452 - RNA, 46 nt, Mus musculus
aaggcauuaaaauucuggaaacagaagcugaggggguuggguagau

SEQ ID NO: 27453 - RNA, 46 nt, Mus musculus
cugagugauaccuuauccauccacaucugggaauacagggguuauu

SEQ ID NO: 27454 - RNA, 42 nt, Mus musculus
guaaguauuauuuucaugacauugaauuuauagccaccaaua

SEQ ID NO: 27455 - RNA, 46 nt, Mus musculus
cauccaaaugugguguuuaugucagaaguucacuuuuagggcagaa

SEQ ID NO: 27456 - RNA, 46 nt, Mus musculus
aauaccuugccucuauaaaauggcauauauauuagcuugaucagau

SEQ ID NO: 27457 - RNA, 46 nt, Mus musculus
agacacagguuuacauucugcucuacaguuggguuugaaaggagau

SEQ ID NO: 27458 - RNA, 42 nt, Mus musculus
cuagggagaggaugaaaaacucagaaaucaacggugguaauu

SEQ ID NO: 27459 - RNA, 23 nt, Mus musculus
cuugggaaucuauuuuucuuucc

SEQ ID NO: 27460 - RNA, 42 nt, Mus musculus
uuauauugaaggccugugacuuuuucuuuuuaggacucaucu

SEQ ID NO: 27461 - RNA, 46 nt, Mus musculus
cugauuugcuuuauauuuguuuaaguuuguuucguccccuuaagau

SEQ ID NO: 27462 - RNA, 43 nt, Mus musculus
gaagagcacauuugguuguguuuaaucuuucacaggcccuacu

SEQ ID NO: 27463 - RNA, 45 nt, Mus musculus
uguuugucuauacuauaugauuaaauaaauuucauuggggcagau

SEQ ID NO: 27464 - RNA, 46 nt, Mus musculus
guccccccucucucugucucucucccucucccuuucccuucccuuu

SEQ ID NO: 27465 - RNA, 46 nt, Mus musculus
gugcaaaaugauaacuuuuaugcuuugcguaguguuuauugggaaa

SEQ ID NO: 27466 - RNA, 46 nt, Mus musculus
aauauguaaauaucucccuuucacuaagaaaguaaugggugaagau

SEQ ID NO: 27467 - RNA, 46 nt, Mus musculus
uauagaauggucacuauuauuaaaugcaaaagacaggauuggagag

SEQ ID NO: 27468 - RNA, 41 nt, Mus musculus
guaauggaggagaaacaugcaguccuucuguacagagagau

SEQ ID NO: 27469 - RNA, 46 nt, Mus musculus
aaaauugagacuauauaggaagagaucauauaaauuuucaggagau

SEQ ID NO: 27470 - RNA, 46 nt, Mus musculus
gaggcuggaagacacaaauuucuggccuggaucuuaacauggagau

SEQ ID NO: 27471 - RNA, 46 nt, Mus musculus
cacacucaggaugauauuuucucuauccauccauuugucugcagau

SEQ ID NO: 27472 - RNA, 41 nt, Mus musculus
ucuucagucuucccuccucuggagcuucauguggucuguga

SEQ ID NO: 27473 - RNA, 46 nt, Mus musculus
gcuccugucagcaagcacuucuuggcauucacaauagcgucuggau

SEQ ID NO: 27474 - RNA, 46 nt, Mus musculus
uguuuacauuucaaauguuaucaccuuucccaguuuccccucugca

SEQ ID NO: 27475 - RNA, 46 nt, Mus musculus
aacaucacaacggcagguuuuuggagagaagucagaagcagcagaa

SEQ ID NO: 27476 - RNA, 45 nt, Mus musculus
acuuuuggcaaagcuaagaagcaguacuguccuugacccuuagau

SEQ ID NO: 27477 - RNA, 45 nt, Mus musculus
cugugucagccuucugagcgcuguaauucuacgucucaccauauc

SEQ ID NO: 27478 - RNA, 46 nt, Mus musculus
ggaaaucacaaacauaaaaacgaaaguuuaaaucaaccaaaccaga

SEQ ID NO: 27479 - RNA, 45 nt, Mus musculus
cauauauuaguauauggucaccaugcaugugcagugccuguggag

SEQ ID NO: 27480 - RNA, 81 nt, Mus musculus
ugguaucuuuguguuuaaguuuuuacugcuuauauacaggaguuguguagcuggguuguaggguauaucuaauuauauguu

SEQ ID NO: 27481 - RNA, 42 nt, Mus musculus
ugagugacugucuuuacagcuucuauugucuuugcaucagaa

SEQ ID NO: 27482 - RNA, 46 nt, Mus musculus
ggcuuuccccugaacauucugauggccauguuuuccccaugcugau

SEQ ID NO: 27483 - RNA, 46 nt, Mus musculus
uguccuuugcuuuauucucucauguauuuggaaaguauuuucagau

SEQ ID NO: 27484 - RNA, 45 nt, Mus musculus
ugugagugggugcugagaguuggucuuuccucuggcgcuguugaa

SEQ ID NO: 27485 - RNA, 42 nt, Mus musculus
uauuaagaauuuucauuuuguaguuugagagguaccugaggc

SEQ ID NO: 27486 - RNA, 45 nt, Mus musculus
uggcuacuuguuuuguaguagcuguauauuagaauuugaggauag

SEQ ID NO: 27487 - RNA, 46 nt, Mus musculus
agacuuugucucuucuauauuaauuauauuugggugucugggggau

SEQ ID NO: 27488 - RNA, 45 nt, Mus musculus
gagagaggcaaacauguaacaggaaacaaggagacugucucagag

SEQ ID NO: 27489 - RNA, 46 nt, Mus musculus
agcaucaaugauccuugugcgaguacaacacucagagccccaggaa

SEQ ID NO: 27490 - RNA, 51 nt, Mus musculus
ucucuggugaggcaugcgggaaucaaacacccaaccagaaccauaccaagc

SEQ ID NO: 27491 - RNA, 54 nt, Mus musculus
gaacacucuucgggaguggugucgguaucauaacuugaguacggauggcaagaa

SEQ ID NO: 27492 - RNA, 47 nt, Mus musculus
auauucccaauacaucucgggaggccagaaugaagcagggucccaag

SEQ ID NO: 27493 - RNA, 45 nt, Mus musculus
ccuggaaauucuaacuucaccuaaggaguccacauuugcagccug

SEQ ID NO: 27494 - RNA, 46 nt, Mus musculus
accaucuggauccaguggcuuguggcagaaaggccuccacauuaga

SEQ ID NO: 27495 - RNA, 43 nt, Mus musculus
aauuaucuuccacuccugguucugggauaauacaggccgguaa

SEQ ID NO: 27496 - RNA, 47 nt, Mus musculus
gaguggaagauaauuugcuauguccugaauguguucacagcaacaag

SEQ ID NO: 27497 - RNA, 45 nt, Mus musculus
aaaugcagauuaggauucagugggaagucacugucaccuguugug

SEQ ID NO: 27498 - RNA, 42 nt, Mus musculus
ggaaagggaggcuuaaaguaggaagcagguggggacauggca

SEQ ID NO: 27499 - RNA, 45 nt, Mus musculus
ccauugcccuuacugacguguucccaugcauguucccagcuugau

SEQ ID NO: 27500 - RNA, 45 nt, Mus musculus
acugaggaacucuggccuccauuuauuuuccugccuccauggauc

SEQ ID NO: 27501 - RNA, 46 nt, Mus musculus
ugaauuuggcaagagauaaaaagcuaaguaaaugcuccccuccccc

SEQ ID NO: 27502 - RNA, 46 nt, Mus musculus
ggcaagguuuauucuaccuuacagcuuguaaguucaacgccaagaa

SEQ ID NO: 27503 - RNA, 45 nt, Mus musculus
cuccucucauguugaggaucuauuuugccuuuccuggucucagau

SEQ ID NO: 27504 - RNA, 46 nt, Mus musculus
gugugguauuucccucucgagccugaccauaauccugcaugggcau

SEQ ID NO: 27505 - RNA, 46 nt, Mus musculus
uaaagaggcacgguccgccucccguggcacagugcuugcccccagg

SEQ ID NO: 27506 - RNA, 45 nt, Mus musculus
ggcacggugugauagccccuucuuaucaaauaugaaauggcuggu

SEQ ID NO: 27507 - RNA, 23 nt, Mus musculus
aaguguggggauagaagagagga

SEQ ID NO: 27508 - RNA, 46 nt, Mus musculus
aaucaaagacuuugugucccuucucgugugcauugugucccccucu

SEQ ID NO: 27509 - RNA, 45 nt, Mus musculus
agaaagaagaagaagaagaagaagaagaggaggaggaggaggagg

SEQ ID NO: 27510 - RNA, 46 nt, Mus musculus
auuuuauuugguuucuuagaaaccagagaauaacuagcaggcuaug

SEQ ID NO: 27511 - RNA, 44 nt, Mus musculus
uaagucacagcgugugugugugugugugugugugugugugugug

SEQ ID NO: 27512 - RNA, 41 nt, Mus musculus
auuggaaagauauacacccaagggugacagugggccacagg

SEQ ID NO: 27513 - RNA, 42 nt, Mus musculus
gugugugugugaaggagagaaaauaagaaaacaggacaagau

SEQ ID NO: 27514 - RNA, 46 nt, Mus musculus
guguguguguguguguguguguguauguauguauguguguguuugu

SEQ ID NO: 27515 - RNA, 46 nt, Mus musculus
uuauugauacugcuaugugugaugagacaaagcuaagauuuaugau

SEQ ID NO: 27516 - RNA, 46 nt, Mus musculus
accucccuccuuuacgaaguaccucucugggaaccugguaccuguc

SEQ ID NO: 27517 - RNA, 46 nt, Mus musculus
agugaccuuccauauuaaaccuagauccgucccgcauacaacagau

SEQ ID NO: 27518 - RNA, 45 nt, Mus musculus
aauucauccaacugagcaacaacagcagcaucuccaacccucagg

SEQ ID NO: 27519 - RNA, 42 nt, Mus musculus
acacaugauugugggugggguuuguguuuggucacagugagg

SEQ ID NO: 27520 - RNA, 46 nt, Mus musculus
ccuguacuguuugguguuccgccgugucugggagcagugcgugugc

SEQ ID NO: 27521 - RNA, 46 nt, Mus musculus
gaucuuaauauuucauucauuuuucuguugccuuaaagccugacau

SEQ ID NO: 27522 - RNA, 46 nt, Mus musculus
uuagacagguaucuguccuuucucgucagggagaauagggucagca

SEQ ID NO: 27523 - RNA, 46 nt, Mus musculus
cgggagcccagaacacaugcagcacagugaauggauggacccaggc

SEQ ID NO: 27524 - RNA, 42 nt, Mus musculus
ucuuguggguuuucuggaagaaugaaucaaauacagagagau

SEQ ID NO: 27525 - RNA, 43 nt, Mus musculus
cuucaacaagaauguauagaaagucuucuauuuggggcaagaa

SEQ ID NO: 27526 - RNA, 46 nt, Mus musculus
cuguuggaugauguaaggaaguaacaacuuguugagcaugccagag

SEQ ID NO: 27527 - RNA, 46 nt, Mus musculus
uuauguauuuuguguauaugaguacacugugacugucuucagagac

SEQ ID NO: 27528 - RNA, 87 nt, Mus musculus
ccuugaugcugcuuucgugguuucugccacacaaugccucgagccugcgaccuaaaauuguccagugaucaauucagugcuggggau

SEQ ID NO: 27529 - RNA, 57 nt, Mus musculus
cacaugcucaaagucucuacucucugagucuaagaacuguccucaggcaccgcagac

SEQ ID NO: 27530 - RNA, 74 nt, Mus musculus
agaaaacucagcuuaaaauagaaggaagaaggggaagaaagaaggaaggaaggggcuugcaauuugcaggacca

SEQ ID NO: 27531 - RNA, 44 nt, Mus musculus
cagacuccggaaguaugugucugcauacuuauugaaagacaaga

SEQ ID NO: 27532 - RNA, 45 nt, Mus musculus
ugccucccccaacacauaaauaaaagccuaucuuuaaaaaacaga

SEQ ID NO: 27533 - RNA, 44 nt, Mus musculus
ugcaaacccagaggacauggaagaacaauuuuaaaucaaguaga

SEQ ID NO: 27534 - RNA, 34 nt, Mus musculus
uuccacaauccuucccaaagcagcauagucagau

SEQ ID NO: 27535 - RNA, 46 nt, Mus musculus
guguaauucaggugugugacuuaccagguguguguccccccuuccc

SEQ ID NO: 27536 - RNA, 42 nt, Mus musculus
gucaaucaaaguuacacuaauaucaccgcuuuggccccuacc

SEQ ID NO: 27537 - RNA, 46 nt, Mus musculus
ccuucuaccuuauguagaacccuccugugucugugugggcccuggc

SEQ ID NO: 27538 - RNA, 46 nt, Mus musculus
aagcuguuuugcuuccaauuagauaauguguguguaacuugggaga

SEQ ID NO: 27539 - RNA, 43 nt, Mus musculus
cucuuuuugaagccccaggauaauacaggaguagugcugaggu

SEQ ID NO: 27540 - RNA, 45 nt, Mus musculus
cauauuauucauuguaacucauuuuaaaauucuauucguugcaug

SEQ ID NO: 27541 - RNA, 45 nt, Mus musculus
uugacaaauuugaaaaaugaauauuuaaaaacaguaaccauaaca

SEQ ID NO: 27542 - RNA, 44 nt, Mus musculus
ggucagucugucccuccgggcaagaguugacaaugacagucuga

SEQ ID NO: 27543 - RNA, 46 nt, Mus musculus
gcaagcagccccuaaaacgcuccgggucuuugugcuccugccugug

SEQ ID NO: 27544 - RNA, 46 nt, Mus musculus
auuugcuuuccuugauacccucaauugcuaauaccaacucucagau

SEQ ID NO: 27545 - RNA, 46 nt, Mus musculus
guugaguggaugggagauuaacuucuaccuuauccuuggaccagcu

SEQ ID NO: 27546 - RNA, 45 nt, Mus musculus
cgggaaggaacagaauagaagaauuucgagagaagcuugcagaga

SEQ ID NO: 27547 - RNA, 42 nt, Mus musculus
uucuaugcaacuuucagaaauugcucaccucuccuaucuugg

SEQ ID NO: 27548 - RNA, 46 nt, Mus musculus
uacuugaacuaggcuguauagccuuuaguaauuagaggaugcagga

SEQ ID NO: 27549 - RNA, 25 nt, Mus musculus
aagcuggagggaaagaggaucauuc

SEQ ID NO: 27550 - RNA, 45 nt, Mus musculus
aauuaucaagccuaauucuuucuguauguucuguuuuguccagau

SEQ ID NO: 27551 - RNA, 45 nt, Mus musculus
uuucuauugcugugaagagacaccaugaccacaacaacucuuaua

SEQ ID NO: 27552 - RNA, 46 nt, Mus musculus
ugugugugugugugugugugugugugugugucugugccuguguguu

SEQ ID NO: 27553 - RNA, 44 nt, Mus musculus
aggcuuguaacugaaaccaaagccaugugggcuuguccaguuga

SEQ ID NO: 27554 - RNA, 45 nt, Mus musculus
auuuuguuguuguugcagagugaguaucgugcuaugcuggguaga

SEQ ID NO: 27555 - RNA, 45 nt, Mus musculus
uugcuuaaaaagucaggaacaugguggcagguauuuccugggugu

SEQ ID NO: 27556 - RNA, 24 nt, Mus musculus
uuaagguagagaauauauuuggua

SEQ ID NO: 27557 - RNA, 46 nt, Mus musculus
gcagaaguuuccacuuaauuguuaauugcagagcauuaggaagcca

SEQ ID NO: 27558 - RNA, 45 nt, Mus musculus
ucuagaguuguuuugagugaagguaaaaggaagauacagcgugau

SEQ ID NO: 27559 - RNA, 46 nt, Mus musculus
aaagacaaugcggaguuuuguugcugaauuaagaugguagguagau

SEQ ID NO: 27560 - RNA, 44 nt, Mus musculus
aggacagaauagguguacggugaacauccucauaagaaguuggg

SEQ ID NO: 27561 - RNA, 45 nt, Mus musculus
agguagauguuggggugacuuggaugggauuuggggugacuugga

SEQ ID NO: 27562 - RNA, 42 nt, Mus musculus
ucccuaaagccaguguuccuuaguucccuucuuccuucugau

SEQ ID NO: 27563 - RNA, 45 nt, Mus musculus
aggcacguuuguaguacucacuggugccauuuaucugucagaugu

SEQ ID NO: 27564 - RNA, 46 nt, Mus musculus
ggugucuggauaacauauaagagcuguguccucuuaggagccaggu

SEQ ID NO: 27565 - RNA, 45 nt, Mus musculus
uuauccucguuucugucuucaaaccgcagcuuucagggccaggau

SEQ ID NO: 27566 - RNA, 45 nt, Mus musculus
gacgcgaccucugccugacucucauugguaguucaaaagcgggau

SEQ ID NO: 27567 - RNA, 46 nt, Mus musculus
acacaagugugugugugugugugugugugugugugugagggggggg

SEQ ID NO: 27568 - RNA, 46 nt, Mus musculus
agaugaggccuuuacuuucccccaccuucuuuucuugcccccauuu

SEQ ID NO: 27569 - RNA, 46 nt, Mus musculus
gaacucuuaauguccuuaggagcuuuucuuguuggggguaagagau

SEQ ID NO: 27570 - RNA, 42 nt, Mus musculus
cagcugucauaucaacagagauaguuccucggggcuccagag

SEQ ID NO: 27571 - RNA, 45 nt, Mus musculus
gcuguucuuaaugucucuauagcuagucuauagaucauugcauga

SEQ ID NO: 27572 - RNA, 46 nt, Mus musculus
acacacaugcacacacacacauacagauacacacacaugcacacac

SEQ ID NO: 27573 - RNA, 46 nt, Mus musculus
uuuuuuuaaaauauaaacucuuuauauacagauaagaaacuaaggu

SEQ ID NO: 27574 - RNA, 42 nt, Mus musculus
uacccgaggcuccugauggcacuucucacccugcccccuacc

SEQ ID NO: 27575 - RNA, 28 nt, Mus musculus
ugaagcuagcuauuacaugauucaucgu

SEQ ID NO: 27576 - RNA, 46 nt, Mus musculus
aaguguguuuucuugucaaugcaggauguaaaaaaaaccacaagaa

SEQ ID NO: 27577 - RNA, 46 nt, Mus musculus
uucuuagacuguaaagccaggcuaaagccucuagauugccccuguc

SEQ ID NO: 27578 - RNA, 45 nt, Mus musculus
cgugucuaauggagggugaggucagguucgcuuucaccuggaggu

SEQ ID NO: 27579 - RNA, 45 nt, Mus musculus
cuaauuauguaugcaaguuucaaguuaggaaaaaaugggauauua

SEQ ID NO: 27580 - RNA, 42 nt, Mus musculus
auuucaaagcaagaauacuguuuuuucucuuauggcccuauc

SEQ ID NO: 27581 - RNA, 42 nt, Mus musculus
cugugaaguguuuguguguguguguguguuugugugugagug

SEQ ID NO: 27582 - RNA, 46 nt, Mus musculus
uucugcaauacauguuaauuagaucauauuucucuugcgcgcuugu

SEQ ID NO: 27583 - RNA, 41 nt, Mus musculus
cugcauuuugucuuuucgaagggaaucuuccaagugguaga

SEQ ID NO: 27584 - RNA, 46 nt, Mus musculus
gccuuuuaaaggccacagugauguuuagauauaugagcugaguguu

SEQ ID NO: 27585 - RNA, 45 nt, Mus musculus
gaaaguauggccuuaugaaaacagcucacggcagcccaguuggau

SEQ ID NO: 27586 - RNA, 50 nt, Mus musculus
uaaauggguagagaaaccgaugggaaacuucagcagcagcagaaaaaaug

SEQ ID NO: 27587 - RNA, 77 nt, Mus musculus
cugaaccacuccugaguaggaaccccaaggaaucuaauuuagccuccacagagauacuggcacaucuguguuuauug

SEQ ID NO: 27588 - RNA, 46 nt, Mus musculus
acaagaaaaccucaauaaaaacaugauggucuuugaaucaacacua

SEQ ID NO: 27589 - RNA, 45 nt, Mus musculus
aauacaagcccugccuuucaguaguccaguuugaaugacuguuug

SEQ ID NO: 27590 - RNA, 45 nt, Mus musculus
ugagcacaggcuguuugcugacacucccuugugccuugugcaguc

SEQ ID NO: 27591 - RNA, 44 nt, Mus musculus
cgaagagcgcucauuagacaugagugguuucuguauuaguguug

SEQ ID NO: 27592 - RNA, 46 nt, Mus musculus
agagcaugcagggugucuggauaaugaauuuguuuccaagccagaa

SEQ ID NO: 27593 - RNA, 46 nt, Mus musculus
uguugugcgaguagauugguuccuuauugauuucacacgugcccau

SEQ ID NO: 27594 - RNA, 46 nt, Mus musculus
gucucgugggugcacaaagaaaugcaaaccaaacucaugaccaggu

SEQ ID NO: 27595 - RNA, 41 nt, Mus musculus
ccaccuucucuagcuccauacauaaagcgagcggccuuaga

SEQ ID NO: 27596 - RNA, 45 nt, Mus musculus
aauuggagaacaccaugucaggugagagaaggcuauuggccgagu

SEQ ID NO: 27597 - RNA, 46 nt, Mus musculus
gggcaggaaagaugaugcugcugucuccuaguuagacuggucguuc

SEQ ID NO: 27598 - RNA, 42 nt, Mus musculus
cauuaggaucaucuaaucagcuuccucaaaguugcugcagau

SEQ ID NO: 27599 - RNA, 41 nt, Mus musculus
uaggagaugauauacugcuaagggucauuuaaugauuuaau

SEQ ID NO: 27600 - RNA, 46 nt, Mus musculus
augguugugagccaccaugugguugcugggauuugaaccccugacc

SEQ ID NO: 27601 - RNA, 46 nt, Mus musculus
aagaaagaauugucuggguaaagaugaugaccuuaggaguggagau

SEQ ID NO: 27602 - RNA, 46 nt, Mus musculus
ugaaaccaacuuagagaccagguaaucagugggcuagcggcaagug

SEQ ID NO: 27603 - RNA, 42 nt, Mus musculus
ucauucaggucgcccuguggcaggcaagugacugcccccccc

SEQ ID NO: 27604 - RNA, 46 nt, Mus musculus
cagccuggggaaccaggggcuggguacagcucagguagagagagag

SEQ ID NO: 27605 - RNA, 45 nt, Mus musculus
uagcuaggggcugugcuggcuuacaguauuaugaugguuguagau

SEQ ID NO: 27606 - RNA, 45 nt, Mus musculus
aggucauuaggaaucaggaacugugucaaguacaaagggugcaga

SEQ ID NO: 27607 - RNA, 42 nt, Mus musculus
cuuuaaauguuacaguugaccaauguauauuggauggcaguu

SEQ ID NO: 27608 - RNA, 24 nt, Mus musculus
ucccuuuugugcuucaaggugacu

SEQ ID NO: 27609 - RNA, 47 nt, Mus musculus
cgcguagcuauaacuuuuauuugggaaggcauuucuucuugugauua

SEQ ID NO: 27610 - RNA, 46 nt, Mus musculus
cuuacauuuuaaugauuuauuuugugugucugugauucugggagaa

SEQ ID NO: 27611 - RNA, 41 nt, Mus musculus
uggauuuuagcacgagcguuuucagcugucuccgggccauu

SEQ ID NO: 27612 - RNA, 46 nt, Mus musculus
aguuauuuugcguugcuucucuagguuuugagguaagggcuuggau

SEQ ID NO: 27613 - RNA, 42 nt, Mus musculus
gguuucuauucugauggcucucugucacagaggcacugagug

SEQ ID NO: 27614 - RNA, 46 nt, Mus musculus
ugaccacguucaaaugcuuuguguguuucuaugagagucagcaguu

SEQ ID NO: 27615 - RNA, 45 nt, Mus musculus
acacacacacacaaucuugauuccacuaauuccacuaagauagau

SEQ ID NO: 27616 - RNA, 63 nt, Mus musculus
aauugaaucuguuuaucuauauccugauucauaggcagagggagaggaagaaagagagugggg

SEQ ID NO: 27617 - RNA, 48 nt, Mus musculus
caaccagaggaaagagagaaaggaaagagagggagauucagaucagca

SEQ ID NO: 27618 - RNA, 46 nt, Mus musculus
aggccuagaaguuuuguuuuuauauuauacauuuucaagagcaggg

SEQ ID NO: 27619 - RNA, 46 nt, Mus musculus
gggucuuuuguaaugcacuugccaaagacaccaguuccuuauugag

SEQ ID NO: 27620 - RNA, 45 nt, Mus musculus
gacugguuugauauguuguaucaaaaguaugaaauuaagggaggu

SEQ ID NO: 27621 - RNA, 29 nt, Mus musculus
uagccagcaccaaaaggaggcaggcagau

SEQ ID NO: 27622 - RNA, 42 nt, Mus musculus
aggagaccguaauugcuuuuuuccaggucagaauucccaguc

SEQ ID NO: 27623 - RNA, 46 nt, Mus musculus
ucccucuuaaagagcaucuagauuaauaaacaccaagcacagaacc

SEQ ID NO: 27624 - RNA, 45 nt, Mus musculus
uugaugaaaacuaggacaaaauauuaauauuccaauguuagcaag

SEQ ID NO: 27625 - RNA, 45 nt, Mus musculus
ucaagaaggggagagguauagugguagggaugggggcggguagca

SEQ ID NO: 27626 - RNA, 45 nt, Mus musculus
aguggaaggagggagagaugagaacccugugcaaugaacgauaua

SEQ ID NO: 27627 - RNA, 42 nt, Mus musculus
caaacuuguacaaucacucuggaaaucaaucuggcagcuucu

SEQ ID NO: 27628 - RNA, 42 nt, Mus musculus
uuaaagaaaaugccuuuuuccccucuaaaaaugaccccaauu

SEQ ID NO: 27629 - RNA, 45 nt, Mus musculus
gaauuguaggugaagauauguaguaauucuuaaaacaguaagaga

SEQ ID NO: 27630 - RNA, 45 nt, Mus musculus
cuccucaucacgugcccaagcccagaacacacuuagaccccagau

SEQ ID NO: 27631 - RNA, 46 nt, Mus musculus
gugugacuauggggaauuaauagggcaggugugacuauggagaauu

SEQ ID NO: 27632 - RNA, 47 nt, Mus musculus
ggauuuaauagggcaggugugacuauggggauuuaauagggcaggug

SEQ ID NO: 27633 - RNA, 51 nt, Mus musculus
ggggauuuaauagggcaggugugacuauggggauuuaauagggcaggugug

SEQ ID NO: 27634 - RNA, 41 nt, Mus musculus
ggacagaggacgugaggcaugagagaugagaggguggugaa

SEQ ID NO: 27635 - RNA, 46 nt, Mus musculus
ccacuuagccauauccuaacuucuaaaaaugcuuugagacccauuu

SEQ ID NO: 27636 - RNA, 46 nt, Mus musculus
aacuccugaucuucacacauccugggauuacauacaugugccagcg

SEQ ID NO: 27637 - RNA, 71 nt, Mus musculus
gucauucauuuaaaacaccuagccaaagagcagcagacagaucaucaccugcaaagagcagaccaucauau

SEQ ID NO: 27638 - RNA, 46 nt, Mus musculus
acacugcucauugucuuugaacuuuuuauccuuuggugugugggau

SEQ ID NO: 27639 - RNA, 42 nt, Mus musculus
uauuuaagaucaguuccuuagauucccccauuguccccaagg

SEQ ID NO: 27640 - RNA, 45 nt, Mus musculus
gggcugagguucuguguuacaggguagcagcauuaggcaguuuga

SEQ ID NO: 27641 - RNA, 46 nt, Mus musculus
augauuggagugugugugugugugugugugugugugugugagagag

SEQ ID NO: 27642 - RNA, 43 nt, Mus musculus
cccagaggccccugacccuggcugugaucucccacaggucggu

SEQ ID NO: 27643 - RNA, 46 nt, Mus musculus
uguagcaguaauaauuaaagaauaagaggccauuaauuuaggagga

SEQ ID NO: 27644 - RNA, 46 nt, Mus musculus
cugaugucugcugcaaggcuaugucuuuuggauaugauagggagac

SEQ ID NO: 27645 - RNA, 47 nt, Mus musculus
acaagcuacguaaauuuuguagagguuuuuuuuucauaauagagaac

SEQ ID NO: 27646 - RNA, 41 nt, Mus musculus
ccagcaccacacggcagcucacaacaguccuuaacuccagu

SEQ ID NO: 27647 - RNA, 46 nt, Mus musculus
aaaacaaaguaaacagaacacagauguguaggacucgcugucaggg

SEQ ID NO: 27648 - RNA, 46 nt, Mus musculus
guuuuuguuugugugugcuuguauguguguuuguauguguguuugu

SEQ ID NO: 27649 - RNA, 24 nt, Mus musculus
uguuugaauguguugucaccaaag

SEQ ID NO: 27650 - RNA, 42 nt, Mus musculus
gauccgugcuaggugguuuagccuagccauaugcccuagaug

SEQ ID NO: 27651 - RNA, 45 nt, Mus musculus
cuccaccuucuagucuacuaauguaauucuaaugaaagccggaga

SEQ ID NO: 27652 - RNA, 60 nt, Mus musculus
cucuucucaggcaucccguucucucuucccaggcaucccguucucucuucccaggcaucc

SEQ ID NO: 27653 - RNA, 45 nt, Mus musculus
cuuugcagcugcaagcugguaaauccgccucucucucuaacgucc

SEQ ID NO: 27654 - RNA, 46 nt, Mus musculus
uucaaugcccaagaagauguuaaauuaaaacguuuaggaacaaauu

SEQ ID NO: 27655 - RNA, 46 nt, Mus musculus
cauguggaugcugggaaucuaaacuggguccucacugcaaucagaa

SEQ ID NO: 27656 - RNA, 46 nt, Mus musculus
cauucuuggacguuaagaaagggcuguaacaccugaguguucugca

SEQ ID NO: 27657 - RNA, 47 nt, Mus musculus
uaucauuguauaugguuugaccuuuaguugaaucugguaguaaagau

SEQ ID NO: 27658 - RNA, 44 nt, Mus musculus
aauguuuucugaagaaaggccucucgccuucugagcuuucgggg

SEQ ID NO: 27659 - RNA, 46 nt, Mus musculus
caucuuaauuugaaugagaaaaaaauaucaaaagcauuuaggagau

SEQ ID NO: 27660 - RNA, 31 nt, Mus musculus
auuagucaguugucuccagugaaaagcuagg

SEQ ID NO: 27661 - RNA, 84 nt, Mus musculus
uuugguaugauuuuaauuuuauguaaauugagccaguuuaggcccccaucaccauuuuguuucuuuuugacccagcacccugag

SEQ ID NO: 27662 - RNA, 41 nt, Mus musculus
ggcacaacagcagagcagccucuguugugaauggugagaca

SEQ ID NO: 27663 - RNA, 46 nt, Mus musculus
cgcuugaaggaaguaaugacuaguuaagcaaacucauagccaagaa

SEQ ID NO: 27664 - RNA, 46 nt, Mus musculus
ucagaagaaacaaagcuaaaugacccucugaacacauagcccauaa

SEQ ID NO: 27665 - RNA, 42 nt, Mus musculus
agagugauuugaaaauaaaauguuuuaaauccucucacagau

SEQ ID NO: 27666 - RNA, 46 nt, Mus musculus
gagaagaaagcuguaaagucucugccuugugcauucugguagcugu

SEQ ID NO: 27667 - RNA, 42 nt, Mus musculus
cgaaggcaccucuuuuaaaagagcauuuaauugggccccacu

SEQ ID NO: 27668 - RNA, 46 nt, Mus musculus
uucuuuuaauagugauuuuuauuuucaguccagugagccauuucau

SEQ ID NO: 27669 - RNA, 88 nt, Mus musculus
ccauuggcaagauguuagugucucuaacuuuauacuuagggcaggucuauugguaagauguuaguggcucuaacuuuauacuuagggc

SEQ ID NO: 27670 - RNA, 46 nt, Mus musculus
ccauugguaagauguuaguggcucuaacuuuauacuuagggcaggu

SEQ ID NO: 27671 - RNA, 46 nt, Mus musculus
caaagaggguugcgcuuccugaugcuguucccagguguaaggagau

SEQ ID NO: 27672 - RNA, 46 nt, Mus musculus
gcaugcgucacauccuauuuauaagguaacguuuuacaaaccagac

SEQ ID NO: 27673 - RNA, 42 nt, Mus musculus
gguggcggggaaaccguuuugccguuaauaauaccguguuuu

SEQ ID NO: 27674 - RNA, 46 nt, Mus musculus
aggcuucuugguggguuugcucagaagggaaugagacgugugugaa

SEQ ID NO: 27675 - RNA, 46 nt, Mus musculus
acuaaaaaucauauucuggacucauuuguuuuccucagguugagac

SEQ ID NO: 27676 - RNA, 45 nt, Mus musculus
uacauggguuuauuucuuuauauuguuauuaucuguaggugcuag

SEQ ID NO: 27677 - RNA, 46 nt, Mus musculus
augccucauaaguuuaagaaauguagugaaaucuugcaaaugaguc

SEQ ID NO: 27678 - RNA, 41 nt, Mus musculus
ugauuccuagagauuuauuguaacaagaauggagcugaggu

SEQ ID NO: 27679 - RNA, 47 nt, Mus musculus
gucccucagcauggagcaagcuuagaaaccagaguacuauagagcaa

SEQ ID NO: 27680 - RNA, 69 nt, Mus musculus
gcucauuuagacagaagauucuucagccuagaguuugggagaaaaauccaugaucuaauuagcuggacg

SEQ ID NO: 27681 - RNA, 46 nt, Mus musculus
aacuggcccaauaaagaugaggauguccuugucuuauggaggagau

SEQ ID NO: 27682 - RNA, 45 nt, Mus musculus
uguaguaaucuacaacaacauacuuagugauacaaagcagaacau

SEQ ID NO: 27683 - RNA, 47 nt, Mus musculus
ugaggccaauuaauauuauuugacuuaaagagauuuuugcaaggaga

SEQ ID NO: 27684 - RNA, 49 nt, Mus musculus
uuaacaucagacacaugcuuguuggauuuuaaugauccugauguaguau

SEQ ID NO: 27685 - RNA, 42 nt, Mus musculus
cguuugaagucaacuuaaaaacaaaagggaacagggccacuu

SEQ ID NO: 27686 - RNA, 69 nt, Mus musculus
agcagccaacagauacuaauugcuuuaugcacauugacugguauuacauauuuucauaucaucccuaug

SEQ ID NO: 27687 - RNA, 45 nt, Mus musculus
ccuuucagggaguugauuuguaggcaucagacaaaaccagcagaa

SEQ ID NO: 27688 - RNA, 42 nt, Mus musculus
uaacauauguuggaacagacgucuugucugcuaggagcagua

SEQ ID NO: 27689 - RNA, 46 nt, Mus musculus
cccaguagcuagguaaggggguauuuaaaggaagaaaccacaacuc

SEQ ID NO: 27690 - RNA, 46 nt, Mus musculus
ccucaaguugucuuuauagucagugcaaaggugugaguagugagag

SEQ ID NO: 27691 - RNA, 46 nt, Mus musculus
ggaggguuugaaagugugugugugugugugugugugagagagagag

SEQ ID NO: 27692 - RNA, 46 nt, Mus musculus
aggaaugcuuuagauauaaaacugagaaagagaagauagcagagau

SEQ ID NO: 27693 - RNA, 42 nt, Mus musculus
uccgugcgcaugcacccauacugugcccauaccugugcagac

SEQ ID NO: 27694 - RNA, 45 nt, Mus musculus
cuacugaucugcuaaugcuggccucccuuaaagucggugcuuguu

SEQ ID NO: 27695 - RNA, 45 nt, Mus musculus
uuacaggccuguaaccccagcuauucaggaagucaaggagaagga

SEQ ID NO: 27696 - RNA, 46 nt, Mus musculus
uuuaaaaaagauauaucggaucucgcagggaauuaagcagccaaug

SEQ ID NO: 27697 - RNA, 37 nt, Mus musculus
uauuaguguacuuucaucucuauuaaauuauauacuc

SEQ ID NO: 27698 - RNA, 45 nt, Mus musculus
uaccacaaucagcuugugaggucagcugggaaugcugagguauuu

SEQ ID NO: 27699 - RNA, 45 nt, Mus musculus
uuuauguuuauuauuuugcuacaaagaacauuaaaagugauuaua

SEQ ID NO: 27700 - RNA, 45 nt, Mus musculus
gacaggauaaaauauaugcagacaggaauguaagagcaggcauuu

SEQ ID NO: 27701 - RNA, 42 nt, Mus musculus
auaacccuacaaaguacuuaacauauaaagcuacagccaacu

SEQ ID NO: 27702 - RNA, 45 nt, Mus musculus
auuauccucacaauacauuuugauuugucuguaucuauuauaguu

SEQ ID NO: 27703 - RNA, 42 nt, Mus musculus
gaagauucuggcuuguugcgucuuuccuggccggccgcgaac

SEQ ID NO: 27704 - RNA, 41 nt, Mus musculus
ugaagaggcacuguagugugcucagagcagcuccuggaagu

SEQ ID NO: 27705 - RNA, 42 nt, Mus musculus
ccacgacauauaggggcacagauucuuuuucccaguucagau

SEQ ID NO: 27706 - RNA, 45 nt, Mus musculus
uugcuguuuagcaccagcaucgauuuugcuucuaccaccccacau

SEQ ID NO: 27707 - RNA, 46 nt, Mus musculus
ugaggcaacuugcaaugacuuuucaacauuucaugagagaggagau

SEQ ID NO: 27708 - RNA, 46 nt, Mus musculus
aaguacauuguagcugucuuuagacacaccgaagagggcaucagau

SEQ ID NO: 27709 - RNA, 43 nt, Mus musculus
agucagagaaacuuuauucauuuuaugaucuggaguccaguaa

SEQ ID NO: 27710 - RNA, 45 nt, Mus musculus
cgacuccgugagacuucugggcaggguuaucgucaagcuggugag

SEQ ID NO: 27711 - RNA, 46 nt, Mus musculus
acucacgaugcuggcuucucugguuugauuuccccuagccccauga

SEQ ID NO: 27712 - RNA, 46 nt, Mus musculus
ugucaauauguagucuuuauaguuuugaaucuguuagcccaccugg

SEQ ID NO: 27713 - RNA, 46 nt, Mus musculus
auccccauugcacuuuucccuuccuccacaaagagcaugccuacuu

SEQ ID NO: 27714 - RNA, 46 nt, Mus musculus
guucuugguuggcaguggagggagaauauaggaaaguuggccaucc

SEQ ID NO: 27715 - RNA, 45 nt, Mus musculus
gugcacuaccacacccagcucaaauuuguauguucauaaggagaa

SEQ ID NO: 27716 - RNA, 46 nt, Mus musculus
cuugcgaaccuucuccccaccuuaacuuguaaaauaaaggcuagag

SEQ ID NO: 27717 - RNA, 45 nt, Mus musculus
uguauuuugaugcuaauuccauuuucccaggaggggcuguggaug

SEQ ID NO: 27718 - RNA, 41 nt, Mus musculus
aagccuggcagugguggugaacgccuuuaaugucagcacuu

SEQ ID NO: 27719 - RNA, 42 nt, Mus musculus
acuuucuaguuaaguaauuucauaggaaacauagggccgggu

SEQ ID NO: 27720 - RNA, 48 nt, Mus musculus
guuguucucaaugccgaauugccaaauacugcagugccaagugucagg

SEQ ID NO: 27721 - RNA, 46 nt, Mus musculus
uuuguuguagauguagguggcuagugagagugguagucaggccugg

SEQ ID NO: 27722 - RNA, 42 nt, Mus musculus
ucaguagugaguagguuuacgcuucagaaugugaacucagau

SEQ ID NO: 27723 - RNA, 46 nt, Mus musculus
ucaaguuaucuuuuaaaaaaaaaguugaaaaauguuuuggugcaaa

SEQ ID NO: 27724 - RNA, 47 nt, Mus musculus
ggagucagucguuaaccauuuuauguucaauauuuauauuagcacag

SEQ ID NO: 27725 - RNA, 45 nt, Mus musculus
caggcaaaucagcgaguccgggccacauuuugcuuucccccauug

SEQ ID NO: 27726 - RNA, 24 nt, Mus musculus
gauggaauuggagaacaaauuaag

SEQ ID NO: 27727 - RNA, 42 nt, Mus musculus
aagcacaaugauuaacuuucuaauugaugugugcgggcauaa

SEQ ID NO: 27728 - RNA, 46 nt, Mus musculus
cauuggaaauguuaaugagagaggaacacagcaugcuaaaggagau

SEQ ID NO: 27729 - RNA, 52 nt, Mus musculus
uuuuggaauuaagucuguguuguguuuuccuucacucgccggcuuguuuggg

SEQ ID NO: 27730 - RNA, 60 nt, Mus musculus
uuaauaaggcuuucaagacuaggauuuuaguuguugcccccagcguuugaguuacuguug

SEQ ID NO: 27731 - RNA, 49 nt, Mus musculus
auuauaaauaaguacauuguagcugucuucagcggcaccagaagagggc

SEQ ID NO: 27732 - RNA, 46 nt, Mus musculus
ccauuacagaguuaccaugugguugcugggaauugaacucaggacc

SEQ ID NO: 27733 - RNA, 46 nt, Mus musculus
ugcaguccauucagcaaucaccacccacaaaucagcaauggcaguu

SEQ ID NO: 27734 - RNA, 42 nt, Mus musculus
uggaggcaguuugugugggaaagauguacaugagccaggaaa

SEQ ID NO: 27735 - RNA, 42 nt, Mus musculus
aaauggagauuuuguuuuuauccuuguuugggggaaggaaaa

SEQ ID NO: 27736 - RNA, 46 nt, Mus musculus
ucuugacagccugauuccacagcaagguuuccaaucuugccuccag

SEQ ID NO: 27737 - RNA, 45 nt, Mus musculus
uuaccgguucagcuucaguccuuuugaguccugcacgugcuuugg

SEQ ID NO: 27738 - RNA, 46 nt, Mus musculus
aauggcugggcaguuaaauguguucuugguuccaucacaacuagau

SEQ ID NO: 27739 - RNA, 46 nt, Mus musculus
acuuggacuugaccuuaucuuuauugcaaacaaaccagaccaagug

SEQ ID NO: 27740 - RNA, 46 nt, Mus musculus
uugagacauucuccauuaauuauuuuuuccuacccagggccucaga

SEQ ID NO: 27741 - RNA, 45 nt, Mus musculus
ggaugguguggauucagugcuagggacugaacucagggccucaug

SEQ ID NO: 27742 - RNA, 46 nt, Mus musculus
ugugugugugugugugugugugugugagagagagagagcacgugca

SEQ ID NO: 27743 - RNA, 41 nt, Mus musculus
gcucaggaugaaaucugagcagaacaauaaacagcaccaga

SEQ ID NO: 27744 - RNA, 45 nt, Mus musculus
ggaggugauggugcaugguuuuaaucccagcauucaggaggcaga

SEQ ID NO: 27745 - RNA, 27 nt, Mus musculus
ccaggcuggccuagaacugacugugug

SEQ ID NO: 27746 - RNA, 46 nt, Mus musculus
ggaaaauucuugaguuaccauaguuacuuacaacucagcaucacug

SEQ ID NO: 27747 - RNA, 45 nt, Mus musculus
cacuggcuuuuggucucuccuucuguuuauuguuaccuuggagau

SEQ ID NO: 27748 - RNA, 27 nt, Mus musculus
gacagcauacauguuaaugucugaggg

SEQ ID NO: 27749 - RNA, 46 nt, Mus musculus
cagccaucucgcuggccugucuccacccgauuuuauuuacugaguu

SEQ ID NO: 27750 - RNA, 45 nt, Mus musculus
uguggauuggagccacuccggcaaugcuuaggcuacuuauuagau

SEQ ID NO: 27751 - RNA, 45 nt, Mus musculus
cuugaacucaccuucuccccucucucugccuuucugcccugaugc

SEQ ID NO: 27752 - RNA, 41 nt, Mus musculus
uuaccugggccuaagcuuuucauggccacugugccucaaga

SEQ ID NO: 27753 - RNA, 45 nt, Mus musculus
uauucaaauggucacauuguguguguucuguagcgcuuguggagg

SEQ ID NO: 27754 - RNA, 45 nt, Mus musculus
uaaaggaagcaggagacaacagggaaaggaaaagcugggcuuggu

SEQ ID NO: 27755 - RNA, 46 nt, Mus musculus
uucuugugugcuguccuuugacauagccccuuuacaugcuggaaaa

SEQ ID NO: 27756 - RNA, 46 nt, Mus musculus
uaguguacuuacauauaauaaaaaauaaauaaaucuuaaaaaaaaa

SEQ ID NO: 27757 - RNA, 45 nt, Mus musculus
aaucccggcaaccacaugguggcuuacaaccauccguaacgagau

SEQ ID NO: 27758 - RNA, 46 nt, Mus musculus
uacauguuuauggauguauguacacauguguguggaugccagaaga

SEQ ID NO: 27759 - RNA, 46 nt, Mus musculus
ugugagccaccuugugguugcugggauugaauuuaggaccuucgga

SEQ ID NO: 27760 - RNA, 46 nt, Mus musculus
gaaagaaucucccauuuuccagaauaaaguacacaaugagccugac

SEQ ID NO: 27761 - RNA, 46 nt, Mus musculus
ggacuggagcaaaugagaauuaaccguguaacaaaagagcaaaaua

SEQ ID NO: 27762 - RNA, 85 nt, Mus musculus
cgucaggaucagaacugaggccccaccugaccugucuugcgggaggagcgagaagccugguguuuauguuguacuuugcuggucu

SEQ ID NO: 27763 - RNA, 23 nt, Mus musculus
cuucauugguuguggaaaucaga

SEQ ID NO: 27764 - RNA, 61 nt, Mus musculus
cuuggcuuacacugugugcaaggggagucguggcguagucugugaucgcugccuacugggg

SEQ ID NO: 27765 - RNA, 45 nt, Mus musculus
gagguguggaucugaggaaggauggaggcacugaagguggaaaag

SEQ ID NO: 27766 - RNA, 42 nt, Mus musculus
uuauugggagagcuugauagcgaaagcgaaagaccccgagcc

SEQ ID NO: 27767 - RNA, 46 nt, Mus musculus
auuauucaaaguuaaauaaaacgaaaaccugucaguuugaucagau

SEQ ID NO: 27768 - RNA, 45 nt, Mus musculus
gaauguauccucacgacuucaaaaaacuuuuugaaaccauagagc

SEQ ID NO: 27769 - RNA, 41 nt, Mus musculus
ugacaaacagguuacaaaguguuaaccugucaacaagaaga

SEQ ID NO: 27770 - RNA, 56 nt, Mus musculus
gacuauuuggacacuuggggguaggggagagaaagaacucaaacgaggaaggauca

SEQ ID NO: 27771 - RNA, 50 nt, Mus musculus
aggagggaauguguccucacccagagaguaaauauuggcuagccacguag

SEQ ID NO: 27772 - RNA, 45 nt, Mus musculus
uuagucugcuguguuaggagccuggugcaggaacagcaagcagcc

SEQ ID NO: 27773 - RNA, 46 nt, Mus musculus
gcagauaaacaacauggcuucaccuuggugccauggaauguggauc

SEQ ID NO: 27774 - RNA, 46 nt, Mus musculus
cuacaucaacacuucuuucuauaaaaauaggauacaggucccaaug

SEQ ID NO: 27775 - RNA, 46 nt, Mus musculus
uagaacugaauauguuuguuagugaaaaagaauuccgggugcguug

SEQ ID NO: 27776 - RNA, 46 nt, Mus musculus
uuaagauacuagucaagugugugugugcaugaaaaggaaaccagua

SEQ ID NO: 27777 - RNA, 45 nt, Mus musculus
auaccauccaguugauuuauucuguuguuucugagugccccauuu

SEQ ID NO: 27778 - RNA, 44 nt, Mus musculus
acauugaagaaaaagaagaaggaaaaaagcuaguagacuaagau

SEQ ID NO: 27779 - RNA, 45 nt, Mus musculus
auucugauuuggaggagucguccccguggacauccaggaaucgau

SEQ ID NO: 27780 - RNA, 46 nt, Mus musculus
ugcgccauucguaauguuuacuuccgcccggccuagugugguggug

SEQ ID NO: 27781 - RNA, 56 nt, Mus musculus
gauugggcgaaggagcacccggggccugaggggaccggcgagagacugagcgagaa

SEQ ID NO: 27782 - RNA, 58 nt, Mus musculus
aagucgagucgccagcggggaggacgcggcgcgggcggugggacgaguucgaagccgg

SEQ ID NO: 27783 - RNA, 52 nt, Mus musculus
gguuuauuuuuaaaaaccacaucuuuaaacuuuuagguucagauaguaacag

SEQ ID NO: 27784 - RNA, 46 nt, Mus musculus
uuaugauugucauuuaauauccuuuucauuugcaaaacgguaggag

SEQ ID NO: 27785 - RNA, 42 nt, Mus musculus
acacacacacacacacacacagacacacacagacacggagag

SEQ ID NO: 27786 - RNA, 45 nt, Mus musculus
auaauauugguuacuguaacaacuugcaguauugauuacuugguu

SEQ ID NO: 27787 - RNA, 45 nt, Mus musculus
ugaagucuaaccaacauuuaaaaguuaggcuaggaaaucagguuc

SEQ ID NO: 27788 - RNA, 46 nt, Mus musculus
gcagaggagagccuggacuagggagaggaugagaauggagagagag

SEQ ID NO: 27789 - RNA, 62 nt, Mus musculus
aaagaaagaaaagggagggagagaggcagaggagagccuggacuagggagaggaugagaaug

SEQ ID NO: 27790 - RNA, 62 nt, Mus musculus; identical to SEQ ID NO: 27789

SEQ ID NO: 27791 - RNA, 46 nt, Mus musculus
gacaccaagcauagaguagugcaggccucaaacgugggacaucugg

SEQ ID NO: 27792 - RNA, 48 nt, Mus musculus
aaaggaaaguaacuaauuuacaugguuauaauaaugguggcauugagu

SEQ ID NO: 27793 - RNA, 46 nt, Mus musculus
uuaucaagaaccucgauguuugagccuuuugguugagugacucagc

SEQ ID NO: 27794 - RNA, 48 nt, Mus musculus
aaggaagaguaagauguuuuaacaaauuuagaauauggugagauggug

SEQ ID NO: 27795 - RNA, 46 nt, Mus musculus
uuguuuuguuuuuguuuuuuugucagccugccacaguuggguucau

SEQ ID NO: 27796 - RNA, 45 nt, Mus musculus
cagugucagugagaagcacuguaucagaaaacugugggaggguuu

SEQ ID NO: 27797 - RNA, 48 nt, Mus musculus
aaaguaaauuuaauaaagguuguauaugugugugugugugugugagag

SEQ ID NO: 27798 - RNA, 45 nt, Mus musculus
gucuuuauugcaggccagaaacaugccauaggucucaggagagag

SEQ ID NO: 27799 - RNA, 48 nt, Mus musculus
ucugggugaaacagauaaaccggugggaaagaauucgauugauuaaaa

SEQ ID NO: 27800 - RNA, 46 nt, Mus musculus
gaaugaccucugacuuucuguucagugggcauccucuuagguccug

SEQ ID NO: 27801 - RNA, 42 nt, Mus musculus
uuuaagaauuacuuguguugaguuauaguccuuuagaaggag

SEQ ID NO: 27802 - RNA, 45 nt, Mus musculus
aacaggaaugccaggagaaguucuuggcugugucucagugaaaag

SEQ ID NO: 27803 - RNA, 80 nt, Mus musculus
uuuuuauaagugcuuaaucuuguuuuaacacuauauuugacgaucaccaugguauguacuguuuccgacugaagaagcuu

SEQ ID NO: 27804 - RNA, 46 nt, Mus musculus
cugugaaugaaugucccacacaaugacuacuuacacaccacugcag

SEQ ID NO: 27805 - RNA, 47 nt, Mus musculus
ugugcuguucuuucuguacacaaacaugaauacauuauuuuggcuga

SEQ ID NO: 27806 - RNA, 71 nt, Mus musculus
agagagagagagagagagggagagagugagugaguguauguguguagaggacaacuuguuagcgucuguuc

SEQ ID NO: 27807 - RNA, 45 nt, Mus musculus
uaauuguauuuacuguaaaauccaauauugaaauuaacgguccca

SEQ ID NO: 27808 - RNA, 41 nt, Mus musculus
cacacaugcacacacacacacacacacacacacacagggag

SEQ ID NO: 27809 - RNA, 45 nt, Mus musculus
gcaaaugcgauuacauagagaagacuuugaaauauuaaaggugau

SEQ ID NO: 27810 - RNA, 23 nt, Mus musculus
auuuuaaggauuuaaggguuuag

SEQ ID NO: 27811 - RNA, 45 nt, Mus musculus
uucuugaagggaaauggaggaguggaucugggagagaagggugau

SEQ ID NO: 27812 - RNA, 46 nt, Mus musculus
guagcauagggagggguuaggagagauggggcaguguaagcaggag

SEQ ID NO: 27813 - RNA, 46 nt, Mus musculus
ggugaaugguuaaagaaaaugugauacacacauauacaagugggag

SEQ ID NO: 27814 - RNA, 46 nt, Mus musculus
agucacuuguggaagcuaaaaugguuugcauucauagaaugggaaa

SEQ ID NO: 27815 - RNA, 45 nt, Mus musculus
ccuuuguaugugcugguuuuggccaggagcuguacgcagugugag

SEQ ID NO: 27816 - RNA, 46 nt, Mus musculus
augguugccugugaguaucugcaucuguauugguucuugcugguag

SEQ ID NO: 27817 - RNA, 45 nt, Mus musculus
ucuggagguggucucuauggguuguaucuccccuuuguuggguau

SEQ ID NO: 27818 - RNA, 45 nt, Mus musculus
auagcaguaacauuuuuuuguuuuguuuuguuuuuuuguuuuugg

SEQ ID NO: 27819 - RNA, 46 nt, Mus musculus
aaacaaaacaaaacuauacgcacaguauaauuauaaaauaaacaag

SEQ ID NO: 27820 - RNA, 45 nt, Mus musculus
uaauucaaaaguuacuggguccaucuaggacccauuuaggaggua

SEQ ID NO: 27821 - RNA, 45 nt, Mus musculus
cagaugguugugagccaccaugugguugcugggauuugaaucagg

SEQ ID NO: 27822 - RNA, 44 nt, Mus musculus
aaguauucuuuacaauauugucuuucccuugcagacagcgugcu

SEQ ID NO: 27823 - RNA, 46 nt, Mus musculus
aguuccaguggauaucacacccuuuucugaacuucauaggcaccag

SEQ ID NO: 27824 - RNA, 24 nt, Mus musculus
auagcuagcucacuaugaaaugua

SEQ ID NO: 27825 - RNA, 107 nt, Mus musculus
gggaaacccauggcacuggucacauauguggcagaggauggccuuguuggacuucagugggaggagaggcccuugggccugagguguuugaugccccaguguagggg

SEQ ID NO: 27826 - RNA, 85 nt, Mus musculus
uuaagaagcauccauucuucaguggaauugauugggauaacauucggaauugugaagcaccuuacaucccagaaguuaguagccc

SEQ ID NO: 27827 - RNA, 45 nt, Mus musculus
uagcugucauugaccauugcuguguggaaauaaagguuaaugaau

SEQ ID NO: 27828 - RNA, 46 nt, Mus musculus
gaauaguuguuuauccccauugacaguuaaaauuaauaguucauag

SEQ ID NO: 27829 - RNA, 41 nt, Mus musculus
acacagggucuuaacaaccacgcuaacuucaaauugaguga

SEQ ID NO: 27830 - RNA, 46 nt, Mus musculus
guucuuuucucccacugccuucauaaauuuaacacuuaucaggcua

SEQ ID NO: 27831 - RNA, 46 nt, Mus musculus
guccauuucuccaauaccugucuaucuguucgucuauccgucccuc

SEQ ID NO: 27832 - RNA, 46 nt, Mus musculus
uuguuugagcauuguuuagugcuucacugaguagcauuaggcccag

SEQ ID NO: 27833 - RNA, 45 nt, Mus musculus
cacaggcuucguguucuguguuuggcuucuauaacuuggugcagu

SEQ ID NO: 27834 - RNA, 44 nt, Mus musculus
aggcaaaucaaagcuucugaaaaacaaaucaaaacuuugcagca

SEQ ID NO: 27835 - RNA, 41 nt, Mus musculus
cagcacaggcuagaaguuagguagaauuuacucuagcgcaa

SEQ ID NO: 27836 - RNA, 46 nt, Mus musculus
caaauuucuauauauagaaagcuuauuagaauuucucaaacccuuu

SEQ ID NO: 27837 - RNA, 46 nt, Mus musculus
agaugcacacugucagaggaaacuggccaugcaggaauucauggag

SEQ ID NO: 27838 - RNA, 79 nt, Mus musculus
guucacaccgaagcucuaauugcugaagcaucaaaggacaagaagcuccgagagcagagcgaacauuauucuaagcaac

SEQ ID NO: 27839 - RNA, 47 nt, Mus musculus
aguuaaagccucaaaucaguaauauaaugaagcuuuacagaacagag

SEQ ID NO: 27840 - RNA, 46 nt, Mus musculus
uugagaagauuaauacaauugaaaacccuuuaacuagauggaacag

SEQ ID NO: 27841 - RNA, 42 nt, Mus musculus
auuucacaugagaaacaaaagugggcauuuuacuauggccag

SEQ ID NO: 27842 - RNA, 46 nt, Mus musculus
acucuuaugcagugggggcugacagcugcauggguauaaaggcaag

SEQ ID NO: 27843 - RNA, 79 nt, Mus musculus
auauagcaaaaacaaauuaguuacucaccaggaauaugcagcauagaacaucagcaagagauaacuaaacugaaaacug

SEQ ID NO: 27844 - RNA, 72 nt, Mus musculus
ugcaugacucagaaggccagcagcuugcucucaacaaagagauucugguuuuaaaagacaaauuggaaaaaa

SEQ ID NO: 27845 - RNA, 45 nt, Mus musculus
ucagcagggaaaagucaagacugcuaaacaggcaguucuagugca

SEQ ID NO: 27846 - RNA, 46 nt, Mus musculus
uugugaacuguccagcaagaagugugcccuagcugcaccuaaagag

SEQ ID NO: 27847 - RNA, 73 nt, Mus musculus
cggugaaagacaauaaagagaagagggguagagcuacuacaacaugaucuaugccgaaaacaaaacaaaggag

SEQ ID NO: 27848 - RNA, 87 nt, Mus musculus
aauagaguuuaaguuucugcuacuguguaagagcacuguacaccgagaagagcccgcucaucuauucagaaguccugagcacacugu

SEQ ID NO: 27849 - RNA, 45 nt, Mus musculus
augccagggccaggaagggggaguggauaaguuggggagcagggc

SEQ ID NO: 27850 - RNA, 50 nt, Mus musculus
aagggaagaauuugaaaaugaguucaaacaacaauaugaacgggaaaaag

SEQ ID NO: 27851 - RNA, 46 nt, Mus musculus
gcgcaaccagcacuuagaagaagaagucaaagaucuagcagauaag

SEQ ID NO: 27852 - RNA, 46 nt, Mus musculus
uguagaguucuuuugauaacuaaucuuugcugacauaugugcccag

SEQ ID NO: 27853 - RNA, 42 nt, Mus musculus
augacugaagaguuggaagcauuaagaaauuccagcuugggg

SEQ ID NO: 27854 - RNA, 45 nt, Mus musculus
gagccagagaaauacccagggagcugaagggguuugcagccccau

SEQ ID NO: 27855 - RNA, 41 nt, Mus musculus
auuucaugaguggggugugugugugugugugugugugugug

SEQ ID NO: 27856 - RNA, 49 nt, Mus musculus
cccagauuguuuucuccugugcuucaauccauuuccaccccgaccccca

SEQ ID NO: 27857 - RNA, 42 nt, Mus musculus
ucgaugugcucuguguugcuuguugauuuguucuggugcccu

SEQ ID NO: 27858 - RNA, 46 nt, Mus musculus
aaauaauaaaaauauuuacuaccucucaugaacuucugaacggcaa

SEQ ID NO: 27859 - RNA, 45 nt, Mus musculus
uuuuauaaacuggcagagacuaaagggugucagaccauagcugcu

SEQ ID NO: 27860 - RNA, 42 nt, Mus musculus
uuugaaauaaucccaaaucauuaucuucauugucaccccuag

SEQ ID NO: 27861 - RNA, 42 nt, Mus musculus
ccuucuguccuucuguccuucccccagguuacaaugcuccau

SEQ ID NO: 27862 - RNA, 45 nt, Mus musculus
guccuggagauggaauacagauccuaaaagaccugcccaugguaa

SEQ ID NO: 27863 - RNA, 75 nt, Mus musculus
uuuugaguaacugauuacagaauuuaauccucuaaggccugaaagaauuucacuggcacuaguucugagaucugc

SEQ ID NO: 27864 - RNA, 61 nt, Mus musculus
uacaccauuuuuuuucuuucuguuguuuugauagccagguuucccuuauucacccccucau

SEQ ID NO: 27865 - RNA, 50 nt, Mus musculus
guuucucucuccugaguccauaagcccugggucccccccgucccugcgcu

SEQ ID NO: 27866 - RNA, 46 nt, Mus musculus
gugguagugucuggaaggagucagggauggugaggcugugagggcu

SEQ ID NO: 27867 - RNA, 84 nt, Mus musculus
uuucucauuguaauauuauuguacaguuuugcauggccucaguguaaucauuuuuguucagaaaauuaugaccugugugugugu

SEQ ID NO: 27868 - RNA, 46 nt, Mus musculus
cuauaacauggauucuuuugcacagaacuauuuaaggugggguggu

SEQ ID NO: 27869 - RNA, 45 nt, Mus musculus
uuuuaagcuuuggaucaguuuugauauuaaauugacccccagugu

SEQ ID NO: 27870 - RNA, 55 nt, Mus musculus
gaguccucguuaaugccggugauaaggugcagcauggagccguguacaguuugga

SEQ ID NO: 27871 - RNA, 44 nt, Mus musculus
gccaccacugcccggcacacagcauauucuuaaguuuucucaga

SEQ ID NO: 27872 - RNA, 70 nt, Mus musculus
gagaagacaaccaauagagaagccugccgggaucucagugggaggagauuacgagaugucaaucaugaga

SEQ ID NO: 27873 - RNA, 45 nt, Mus musculus
uccugaucaagccacagagggagcauuagagagugcagaugagga

SEQ ID NO: 27874 - RNA, 45 nt, Mus musculus
ugcacacugcuucaccagucccgacuaccagaggcagugccauga

SEQ ID NO: 27875 - RNA, 46 nt, Mus musculus
guaucagcagaaaucacugagacucggaaacggccuaacaagucaa

SEQ ID NO: 27876 - RNA, 101 nt, Mus musculus
ugggcagggcauuuuggagaacacaggaacugagccaggagagaccucugacaaggagugcaacgagaggaagacagucacagacccagaggagacgccag

SEQ ID NO: 27877 - RNA, 49 nt, Mus musculus
aaugucugguggggacagagcugccaugguuuugucuggagaagacagg

SEQ ID NO: 27878 - RNA, 45 nt, Mus musculus
ugcugcgaucaaagauauguauacacacacacacaccgcccccua

SEQ ID NO: 27879 - RNA, 41 nt, Mus musculus
gcccacacaugucacacacaggaaggacauuacguuucagg

SEQ ID NO: 27880 - RNA, 91 nt, Mus musculus
gaugguccuuggacugaaguguggggggacccugcaggagcgcgcagccaggcucuucucugucagaggccucacaaaggaacucauugac

SEQ ID NO: 27881 - RNA, 46 nt, Mus musculus
auugccuuuuuugagauuaaaaauaacuucaucagcguuugcuaag

SEQ ID NO: 27882 - RNA, 46 nt, Mus musculus
caaaggcagcuuugcacugucccagguuccaaccucagagaggcaa

SEQ ID NO: 27883 - RNA, 41 nt, Mus musculus
ccuccucauuugcucaagaugguggaauugggagaagaacc

SEQ ID NO: 27884 - RNA, 42 nt, Mus musculus
agggucccugcccuuaccacuuucauccaguccucagccacc

SEQ ID NO: 27885 - RNA, 45 nt, Mus musculus
augccacuggaaugcucacuugcucccugcucugugguggcugag

SEQ ID NO: 27886 - RNA, 45 nt, Mus musculus
uuggauuaauguuugacuugcaaagaaaguuugaggaaauuauua

SEQ ID NO: 27887 - RNA, 46 nt, Mus musculus
cuuaucauuauuuaaacuuuaccuuuugacuuauuauacuccagag

SEQ ID NO: 27888 - RNA, 93 nt, Mus musculus
guauaauaagucaaaagguaaaguuuaaauaaugauaaguuugcaauaaauauuauuuuggccagaggccugggaauaggggaagcuugaaac

SEQ ID NO: 27889 - RNA, 46 nt, Mus musculus
ugucuuuuuuuccuaucugcauuuggaguaucaauaaaagacuagg

SEQ ID NO: 27890 - RNA, 93 nt, Mus musculus
aucugcaucucacucucucucucucuccacucgaugacccacucucucaccuuuuucuugcccuagucuuuuauugauacuccaaaugcagau

SEQ ID NO: 27891 - RNA, 38 nt, Mus musculus
aagaugagagaaggugaguuauguguaugugagagaga

SEQ ID NO: 27892 - RNA, 42 nt, Mus musculus
ggugauuuuucauuuuuuguuuuuguuuuuaucugggaccag

SEQ ID NO: 27893 - RNA, 45 nt, Mus musculus
agaggcagaggcaggcggaucucugucaguuugaggucaccccgu

SEQ ID NO: 27894 - RNA, 45 nt, Mus musculus
caccgggcagugguggcacacaccuuuaaaucccagcacuuggga

SEQ ID NO: 27895 - RNA, 46 nt, Mus musculus
ugcagguuuaaggacagccugagccacauagugagacccugucaag

SEQ ID NO: 27896 - RNA, 52 nt, Mus musculus
acaggcauaaacgugugugagugugugcauaugagagagagagagaggagag

SEQ ID NO: 27897 - RNA, 45 nt, Mus musculus
ggguagaagucauuauguagcccaaguuggccacaaacucccagu

SEQ ID NO: 27898 - RNA, 45 nt, Mus musculus
accgagcuacugauuaaauaguacuauuuaaagacaaccccaacc

SEQ ID NO: 27899 - RNA, 74 nt, Mus musculus
gugggagccuuuuggggacgugugacauaaaaucaaacagcauagaaaagcaauuaccucccacuucaccuucu

SEQ ID NO: 27900 - RNA, 46 nt, Mus musculus
agcaugggaagggauacaagccuucacaucacucuggggagaaggc

SEQ ID NO: 27901 - RNA, 42 nt, Mus musculus
gagugugcacucuaccacugagcccugccuccggccccagca

SEQ ID NO: 27902 - RNA, 46 nt, Mus musculus
ggcucacgcuuguacccucagcaccugggaaccuaagguuggagaa

SEQ ID NO: 27903 - RNA, 76 nt, Mus musculus
agaucuaugaguuuaaguccagccuggcuacacagagaagaggagaggagaggaggagaggagaggagagagggag

SEQ ID NO: 27904 - RNA, 46 nt, Mus musculus
gcgcucaggcuugugucuugcucauaccacagacuuagagacagaa

SEQ ID NO: 27905 - RNA, 122 nt, Mus musculus
ggcagcgaugaccgaggaacagguccugagcagucuacugcagcagcugcagcucagccaggcccccacccuggacagcgcggauguggaggagauggccaucccuacccacgugagguccc

SEQ ID NO: 27906 - RNA, 46 nt, Mus musculus
agcagggccacauacugggaccucacguggguagggauggccaucu

SEQ ID NO: 27907 - RNA, 43 nt, Mus musculus
aagucacgcugaccgcucccgaggcaagagguucagccagaau

SEQ ID NO: 27908 - RNA, 46 nt, Mus musculus
uauacaucaggcuggagugacugacaagacccagacucagagaaga

SEQ ID NO: 27909 - RNA, 46 nt, Mus musculus
aaauggagccucuccccguuagggcugggaucagaaagaaagccag

SEQ ID NO: 27910 - RNA, 28 nt, Mus musculus
ucuugcuggagauuuuaaaaaggcacag

SEQ ID NO: 27911 - RNA, 78 nt, Mus musculus
uguucggaauggagcagcggcugccgccuaacagcgagcuggugcaggcugugcugcggcuguuccaggagccugugc

SEQ ID NO: 27912 - RNA, 41 nt, Mus musculus
caauggugacccgagcccgggcacuguguggggacagccuc

SEQ ID NO: 27913 - RNA, 24 nt, Mus musculus
uguuagggaggcccugaaggagga

SEQ ID NO: 27914 - RNA, 42 nt, Mus musculus
aaggccuucgacgugaccgaggccgugaacuucuggcagcag

SEQ ID NO: 27915 - RNA, 46 nt, Mus musculus
uccccugcgccgcgaaacggaccaacuugugugcgcuccagguccc

SEQ ID NO: 27916 - RNA, 44 nt, Mus musculus
uggagcgcacacaaguugguccguuucgcggcgcaggggacgcc

SEQ ID NO: 27917 - RNA, 45 nt, Mus musculus
ucacaccuaagcugguacaaaaucucggcgcggcugggggcagag

SEQ ID NO: 27918 - RNA, 110 nt, Mus musculus
ugugugaaguaugugugcauguguauaugugugguauguguggugcauguggaaugugugguguauguguguguggugugcauguguuguguauguguugugugauaugu

SEQ ID NO: 27919 - RNA, 159 nt, Mus musculus
gguguguauauguaugugugguauauguguguguaguguguaugugugugggguguguaugugugguguguguauuuaugugugguauaugugguauaugugguguaugugugugggguguguauguuugugggguguguauguauguguuguauguuu

SEQ ID NO: 27920 - RNA, 143 nt, Mus musculus
augugguuuguguaguaugugugcauguguaugugugguguguguauauguguaguaugugugguguguauauaugugguguguguguguauaugucugguguguguaguauuugugcauguguguaugucugguguguguau

SEQ ID NO: 27921 - RNA, 43 nt, Mus musculus
guguguguauaugugguauguguauguauguguggugugugug

SEQ ID NO: 27922 - RNA, 46 nt, Mus musculus
augugugugugugugcaguguguauguguggugugcauguguguau

SEQ ID NO: 27923 - RNA, 42 nt, Mus musculus
gagguaccagugacugaaggcacccgaugcugucgccaggag

SEQ ID NO: 27924 - RNA, 49 nt, Mus musculus
augggcaaggaggucaucucugaggcaacacacugccgaggccccagaa

SEQ ID NO: 27925 - RNA, 45 nt, Mus musculus
accuguagcugcgccucagauggggcgcucauacccagggggaua

SEQ ID NO: 27926 - RNA, 48 nt, Mus musculus
uuaggacaagcucacugagaauacaucuguggacagggagacuacaga

SEQ ID NO: 27927 - RNA, 75 nt, Mus musculus
agugagcuuguccuaacuuagugcucucgucagaccuuugcucuacagucuugguuuucuuguccaucacccagu

SEQ ID NO: 27928 - RNA, 79 nt, Mus musculus
gagcuuuugauuccccuguucucaccguaggguuuuguuguacauuaagcugaguucuggccagaaaacagacucagau

SEQ ID NO: 27929 - RNA, 85 nt, Mus musculus
cuaugcagugaacagguucgcaucugagucuguuuucuggccagaacucagcuuaauguacaacaaaacccuacggugagaacag

SEQ ID NO: 27930 - RNA, 46 nt, Mus musculus
ccuugugaaaaaccguuguucccauuucuccuaaccuuagcccuag

SEQ ID NO: 27931 - RNA, 45 nt, Mus musculus
uuacaucaaggaacaucuaguuucauagaauucaccagggcagaa

SEQ ID NO: 27932 - RNA, 27 nt, Mus musculus
cugcccuggugaauucuaugaaacuag

SEQ ID NO: 27933 - RNA, 115 nt, Mus musculus
uguuaguucagauuaauguuugacuugcaaagaaaguuugaagaaauuauuagaaagugaaauagagccaacacugggaucccgaaaagaaaaaagcuauugaaguuaugaaaua

SEQ ID NO: 27934 - RNA, 45 nt, Mus musculus
gcagcuuugcccaugucauuuauugucagagcuucacgggaaaau

SEQ ID NO: 27935 - RNA, 46 nt, Mus musculus; identical to SEQ ID NO: 27887

SEQ ID NO: 27936 - RNA, 123 nt, Mus musculus
auaaugauaaguuugcaauaauuauuauuuuggccagaggccugggaauaggggaagcuugaaacucugggggaacaauuauaauucuugauucuuugugugauguggguauuguuuugaauu

SEQ ID NO: 27937 - RNA, 73 nt, Mus musculus
acucucuccacucgaugacucgcucucucccuuucucuugccccagucuuuuauugauacuccaaaugcagau

SEQ ID NO: 27938 - RNA, 116 nt, Mus musculus
uuuccuaucugcauuuggaguaucaauaaaagacuggggcaagagaaagggagagagcgagucaucgaguggagagaguggggugugcaugcagugugcgugaggugaguguggag

SEQ ID NO: 27939 - RNA, 45 nt, Mus musculus
cugguucggauacaggaggccucaaccgcauugaugagcagagag

SEQ ID NO: 27940 - RNA, 45 nt, Mus musculus
gggaagguggggccugcaaagcccaucacacuauuggcagcaggu

SEQ ID NO: 27941 - RNA, 45 nt, Mus musculus
uacaguagaagaugaaagcucagauguggaagugaggucagagaa

SEQ ID NO: 27942 - RNA, 45 nt, Mus musculus
uugagggagagaagcccaaagcccaaagggacaaagaaccaagag

SEQ ID NO: 27943 - RNA, 46 nt, Mus musculus
cacaugaguucuaggccagucagggcuacagaaugagacuguuaaa

SEQ ID NO: 27944 - RNA, 44 nt, Mus musculus
aagccuuuuaaaacaagaaaauaaucagauguagaagcacacuc

SEQ ID NO: 27945 - RNA, 46 nt, Mus musculus
cuugggaggcaaaggcagaugaauuucugugaguuucaagccaguc

SEQ ID NO: 27946 - RNA, 46 nt, Mus musculus
cagggacacacacauccaaggcuccucuucccggacagcaccaugc

SEQ ID NO: 27947 - RNA, 46 nt, Mus musculus
gugcccagagugcccagcagagccacaggaauggcauggugcuguc

SEQ ID NO: 27948 - RNA, 42 nt, Mus musculus
auggucauccccucgcacgugaggacucaguauguggcccug

SEQ ID NO: 27949 - RNA, 45 nt, Mus musculus
gccccgcuuuucccauccugagacuccuucagugcacagccagau

SEQ ID NO: 27950 - RNA, 50 nt, Mus musculus
ggaugggaaaagcggggcugugcuugcugguaaauuaaggagcagagaag

SEQ ID NO: 27951 - RNA, 50 nt, Mus musculus
gaacaguggcuggguagaggcagcccugggugacagaauuugggagagag

SEQ ID NO: 27952 - RNA, 45 nt, Mus musculus
cagccacauccauaaacuuacuguccugugguaccuaggccugga

SEQ ID NO: 27953 - RNA, 42 nt, Mus musculus
cacucugcuaucccagagagugagcacacuggcuggagccau

SEQ ID NO: 27954 - RNA, 78 nt, Mus musculus; identical to SEQ ID NO: 27911

SEQ ID NO: 27955 - RNA, 55 nt, Mus musculus
agccgucgucgcggaagcgcagccauucaauggugacccgagcccgggcacugug

SEQ ID NO: 27956 - RNA, 45 nt, Mus musculus
caacucucgagagagagagagagagagagagagagagagagagag

SEQ ID NO: 27957 - RNA, 42 nt, Mus musculus; identical to SEQ ID NO: 27914

SEQ ID NO: 27958 - RNA, 42 nt, Mus musculus
ucacacaaguugguucguuucgcggcgcaggggacgccggau

SEQ ID NO: 27959 - RNA, 52 nt, Mus musculus
ugcuuacccauaguccuugagguccagcgugugcagcuccagcuguggcucg

SEQ ID NO: 27960 - RNA, 45 nt, Mus musculus
guguagcuuauuaggaauuuucuggccuagauuucaaacccacug

SEQ ID NO: 27961 - RNA, 41 nt, Mus musculus
aggcaccagugacugaaggcacccgaugcugucgccaggag

SEQ ID NO: 27962 - RNA, 46 nt, Mus musculus
ucaucucugaggcgacacacugccgaggccccagaaauggccaccu

SEQ ID NO: 27963 - RNA, 42 nt, Mus musculus
ggaacauauuuucucuccugaagcuuuggcugggucccagag

SEQ ID NO: 27964 - RNA, 46 nt, Mus musculus
uguuugcucugcgguauuugauuucccugauucuagcccacagggg

SEQ ID NO: 27965 - RNA, 50 nt, Mus musculus
cggggagguggcggagagcuuguucuaggaguuuagaugcaaagccaggu

SEQ ID NO: 27966 - RNA, 46 nt, Mus musculus
cugggucuuggcgaacgucccaaugacuccuauugcuacaacucag

SEQ ID NO: 27967 - RNA, 46 nt, Mus musculus
ucagguuguggaaggucaacauugcauuuaggguuuugucaccagg

SEQ ID NO: 27968 - RNA, 45 nt, Mus musculus
uuccugucuggguagggacuacugugcccuuuacuaaaggugaag

SEQ ID NO: 27969 - RNA, 46 nt, Mus musculus
guuagcguggaccugagcacgaguccugccucaggacgcaggagag

SEQ ID NO: 27970 - RNA, 46 nt, Mus musculus
ugcugggaauugaacccagguccuuuggaaaagcagccaguacuca

SEQ ID NO: 27971 - RNA, 45 nt, Mus musculus
ugugucaucuugccugucaaccucucgggagacuugcugggugag

SEQ ID NO: 27972 - RNA, 46 nt, Mus musculus
agggcucuagggaagggacucaguaugguaggguagacccuggggg

SEQ ID NO: 27973 - RNA, 45 nt, Mus musculus
aaagacccuuacagcuuugggaggacaacgauagcuaaccugcag

SEQ ID NO: 27974 - RNA, 46 nt, Mus musculus
aggugagacaaaccuuguucaucacaggacuccccagagaagccag

SEQ ID NO: 27975 - RNA, 72 nt, Mus musculus
uauguguguauguguguauguguguguguguguguguauguauguguguauguguguauguguguauaugug

SEQ ID NO: 27976 - RNA, 45 nt, Mus musculus
ccagcugugcuacagcguggcuaagcugaucuaccugugcaaaga

SEQ ID NO: 27977 - RNA, 42 nt, Mus musculus
uauuacacaaaccugcaggcgaagacaggccgacggacccuc

SEQ ID NO: 27978 - RNA, 42 nt, Mus musculus
agccagugcuuuuaacaacuaagccaucuuuccagcccccag

SEQ ID NO: 27979 - RNA, 41 nt, Mus musculus
ccugugugaccucaggggacaaaugucucaagguuggggcu

SEQ ID NO: 27980 - RNA, 46 nt, Mus musculus
aagugcuugcuauguggucuagacaagagaagagagacagagacag

SEQ ID NO: 27981 - RNA, 45 nt, Mus musculus
ugugguccacagagugguggugccacauacacuggagggguggug

SEQ ID NO: 27982 - RNA, 46 nt, Mus musculus
aguugggugguguggggucgcuaugccuuggugaguucugugagag

SEQ ID NO: 27983 - RNA, 46 nt, Mus musculus
cccagacaggcucuugaggguuuugcugcuuaaaacccccguauug

SEQ ID NO: 27984 - RNA, 45 nt, Mus musculus
gcuuuugccuuuagggagaucauauuuggggacuucugguugaug

SEQ ID NO: 27985 - RNA, 41 nt, Mus musculus
agcaaucauguacuuauuuauaauaauaaaucuuugggcca

SEQ ID NO: 27986 - RNA, 42 nt, Mus musculus
guuugcuacacuauagggucucccauuccuucacgcuggcag

SEQ ID NO: 27987 - RNA, 42 nt, Mus musculus
cucuuuuuuauggcccucuaucccucacaccagcuaccccag

SEQ ID NO: 27988 - RNA, 45 nt, Mus musculus
ugggugguuagguagggccucucugaggggcauccugaaggcuga

SEQ ID NO: 27989 - RNA, 94 nt, Mus musculus
aggcguuuaugcccgagaugaaacggaguucuacuuaggcaagagaugugcuuauguguauaaagcaaaaaacaauacagugacuccuggaggu

SEQ ID NO: 27990 - RNA, 41 nt, Mus musculus
gcuggggccugcugggaacaggacuucuaacagcaaguaug

SEQ ID NO: 27991 - RNA, 46 nt, Mus musculus
uuauucaaagcuacauuguccucagaguaaacauaaggaugcaaua

SEQ ID NO: 27992 - RNA, 41 nt, Mus musculus
ucauagcagugacuccacuucagccuuuaaaagugcauuug

SEQ ID NO: 27993 - RNA, 46 nt, Mus musculus
aacucuuauuaaaguacaucuacguuucauugugcuuagaacagaa

SEQ ID NO: 27994 - RNA, 45 nt, Mus musculus
aauaguacaucuuuuaauguaguuaaauuuauucuuauggcaguu

SEQ ID NO: 27995 - RNA, 46 nt, Mus musculus
gaaacaagggaaaguccaaaugaacuaaugugaugcacugacagga

SEQ ID NO: 27996 - RNA, 46 nt, Mus musculus
acauuaucuacuucaccgccuugcuuauccaucgagaggcccggga

SEQ ID NO: 27997 - RNA, 45 nt, Mus musculus
uaaaaggaagguuuaguuucuccauugguuugauuauucaugucg

SEQ ID NO: 27998 - RNA, 41 nt, Mus musculus
cccacagauacauuuugaaccauuacuuuuugcuaggcacu

SEQ ID NO: 27999 - RNA, 45 nt, Mus musculus
ggaaaugaaaauucaggagcgagcugcuccguccuuggcaaugau

SEQ ID NO: 28000 - RNA, 46 nt, Mus musculus
auuucugugaguuugaggcccuccugauccaaauaaaguuccaggc

SEQ ID NO: 28001 - RNA, 43 nt, Mus musculus
cuagugugacuugucucaaaacccccaaauguagccccaggau

SEQ ID NO: 28002 - RNA, 46 nt, Mus musculus
uugggagcuacuuauuugacuuuggacucugaacguuggaguagug

SEQ ID NO: 28003 - RNA, 46 nt, Mus musculus
uguauguugugugugcaucauguguguguaguggaagcuguuagac

SEQ ID NO: 28004 - RNA, 45 nt, Mus musculus
agaauaguacacuuaguaucuucuguuuuccuuuuacuuugagau

SEQ ID NO: 28005 - RNA, 42 nt, Mus musculus
agucgagagauccucucucuauugucagacuaaggccaagaa

SEQ ID NO: 28006 - RNA, 46 nt, Mus musculus
cauugcuaaguguggucuuucaguuguuauaccuuuccuuagagau

SEQ ID NO: 28007 - RNA, 46 nt, Mus musculus
uuuuugaugguaccuuacaaauugguuucagacagcuaaccagauc

SEQ ID NO: 28008 - RNA, 45 nt, Mus musculus
cuacuuuugucacucacccaaggcugugugcucacuggaagugau

SEQ ID NO: 28009 - RNA, 53 nt, Mus musculus
augcccuuaugugcacaggaaaggucuuugugcagcaggaagagacuaaggag

SEQ ID NO: 28010 - RNA, 86 nt, Mus musculus
accuuucaagugaccacuccacagaggaaggacuuggaguuuggaggaguaccugguagguauuagaagcccauuagggaggagaa

SEQ ID NO: 28011 - RNA, 51 nt, Mus musculus
agaagacagauauauaguuacacaguacagccuucgucccaggagagaaga

SEQ ID NO: 28012 - RNA, 47 nt, Mus musculus
acaacggggagcccgaacacauggagaagaacgcuacgccguauaaa

SEQ ID NO: 28013 - RNA, 32 nt, Mus musculus
cguaugacagugaaaucauugaagcguuucgu

SEQ ID NO: 28014 - RNA, 46 nt, Mus musculus
ggacauguaggaaggaaaaaguaagggcaaauaacauguugcagga

SEQ ID NO: 28015 - RNA, 46 nt, Mus musculus
uaccuguugcuagacugggugagcaugcuuaugucagugucaagac

SEQ ID NO: 28016 - RNA, 65 nt, Mus musculus
uucacuguucuaaacaccuacuuuucugcaguaucuaguuaucuucuuaggcuuagcuuugagga

SEQ ID NO: 28017 - RNA, 65 nt, Mus musculus
acacacacacacacguuaguguuaacguuaguucugcggugcaaccuuguguuuuucucucagug

SEQ ID NO: 28018 - RNA, 48 nt, Mus musculus
cucuuacacacugagccaccucgccaguccucuaauaaugcacuuaga

SEQ ID NO: 28019 - RNA, 42 nt, Mus musculus
aaccauccauaaugagaucugacgcccucuucugaugcauuu

SEQ ID NO: 28020 - RNA, 34 nt, Mus musculus
ugaucacuuucacuguuuaaaaauggcgguuucg

SEQ ID NO: 28021 - RNA, 45 nt, Mus musculus
gucucugcuucccaugagggugacgugaaggagaagaaggagaag

SEQ ID NO: 28022 - RNA, 47 nt, Mus musculus
ccagcucuacacuguaaaauacaaagauggcaccgaacuggaacuga

SEQ ID NO: 28023 - RNA, 46 nt, Mus musculus
uauaacuucaugaauuuuaaagcuuuuauaaaaaugacauguagau

SEQ ID NO: 28024 - RNA, 46 nt, Mus musculus
ugacuucauuccuacagcucccaagcauacuccuuaucccagagau

SEQ ID NO: 28025 - RNA, 45 nt, Mus musculus
ucuguugucaccuuccuuuuuugugccccuccuccuugugcagau

SEQ ID NO: 28026 - RNA, 42 nt, Mus musculus
aggaagcccagcacauuuccuuccucuuugucccgggcaacu

SEQ ID NO: 28027 - RNA, 42 nt, Mus musculus
uuuuccucugccucccaaagaaugggauuaaagccaccaugc

SEQ ID NO: 28028 - RNA, 46 nt, Mus musculus
uucaugguuuguguuguuguuguuguuuguuuuuuugagacaagau

SEQ ID NO: 28029 - RNA, 46 nt, Mus musculus
ccaccauuugagcuuuuucuuucugccacauuaagugaauuuggga

SEQ ID NO: 28030 - RNA, 44 nt, Mus musculus
guugacuggggaguuggggcgggagugaguaaggacuguuaaga

SEQ ID NO: 28031 - RNA, 46 nt, Mus musculus
cuacagagaagcgcgggauggaggaccuaauacggacagagagggu

SEQ ID NO: 28032 - RNA, 42 nt, Mus musculus
uguccuggaguggcuggaguucccgccggagcgcggccaggu

SEQ ID NO: 28033 - RNA, 44 nt, Mus musculus
ggcgaaguagggagcuuuaacgaacugcuuugaacucucaaccc

SEQ ID NO: 28034 - RNA, 38 nt, Mus musculus
uggugaaguugaaaugagaaaauaaaaaaccgaugucg

SEQ ID NO: 28035 - RNA, 45 nt, Mus musculus
ugagguguuugucucaugucuggggauucugugcaggcagcagug

SEQ ID NO: 28036 - RNA, 45 nt, Mus musculus
cauuuuaugguugaggucaccacaacaugaggaacuguguuaaag

SEQ ID NO: 28037 - RNA, 46 nt, Mus musculus
gccaaggguagagaagccccgggccccagggcggucccugcagcga

SEQ ID NO: 28038 - RNA, 42 nt, Mus musculus
gcuggggucgccucgcugggucacugggucuccgggucaguc

SEQ ID NO: 28039 - RNA, 66 nt, Mus musculus
gggggaggagcccacucagcgacacguaaaccaaccagaucccgagcggaaguuaggagcuccccc

SEQ ID NO: 28040 - RNA, 41 nt, Mus musculus
ugccaugccagcugugaaugcuuguaugugcuuggcccagg

SEQ ID NO: 28041 - RNA, 42 nt, Mus musculus
gcagguguagcuguggaagacccuugaauggggggggggggg

SEQ ID NO: 28042 - RNA, 39 nt, Mus musculus
agguuugaccuuugccaaacaggaacuucuggggcugag

SEQ ID NO: 28043 - RNA, 46 nt, Mus musculus
guuuagcugguuaugauagcacaugccuuuaauuacagcacuagag

SEQ ID NO: 28044 - RNA, 45 nt, Mus musculus
auacaguuggaugcuuaguugcucuuuggaaggacugcaaagauc

SEQ ID NO: 28045 - RNA, 44 nt, Mus musculus
agacacacccagccagggucacagggugacuaagugugcauuug

SEQ ID NO: 28046 - RNA, 44 nt, Mus musculus
uauaaauaaauauaagucucugugucauuacuuggcagcuggcg

SEQ ID NO: 28047 - RNA, 44 nt, Mus musculus
aauccuaaagcaauagagcuuuuuauaccucccuacccccucag

SEQ ID NO: 28048 - RNA, 45 nt, Mus musculus
uucaucacaguucaucugggcuuuuccacuccuuugaauuccagg

SEQ ID NO: 28049 - RNA, 45 nt, Mus musculus
cauaccccgaccaguagugaccccucugauggacaaaguucgggg

SEQ ID NO: 28050 - RNA, 42 nt, Mus musculus
ggacugcgggcuccaaaacaucgcacagggggagguggccgc

SEQ ID NO: 28051 - RNA, 42 nt, Mus musculus
gucacggaaguaggggaacaagagcacggcgcgcagccgccg

SEQ ID NO: 28052 - RNA, 42 nt, Mus musculus
ggaaaguuggauggacacuccaccuggagucaaaaggcggaa

SEQ ID NO: 28053 - RNA, 50 nt, Mus musculus
uuuugauugguugccaaugacaucaccacccgcgcguucuaacacaccaa

SEQ ID NO: 28054 - RNA, 41 nt, Mus musculus
gagggaggccggcucggacccgcuaguggguuugguguguu

SEQ ID NO: 28055 - RNA, 47 nt, Mus musculus
agagagagagagagacagagagagagacagagacacagagagagaca

SEQ ID NO: 28056 - RNA, 45 nt, Mus musculus
aauucgaucgauaccaaauuugaggucuuugcuggagggggcagg

SEQ ID NO: 28057 - RNA, 42 nt, Mus musculus
gcgccaccaccggggugggacggagcggggaucuggcggcag

SEQ ID NO: 28058 - RNA, 41 nt, Mus musculus
ggcugcgaacauccuggcaggaucccggcgggguccugggu

SEQ ID NO: 28059 - RNA, 76 nt, Mus musculus
gggagaagugugagaagggagagccggguagggagaagugugagaagggagagccagguagggagaaguguggccc

SEQ ID NO: 28060 - RNA, 45 nt, Mus musculus
gaggggaagggagagacagagacagacagagagacagacagagac

SEQ ID NO: 28061 - RNA, 45 nt, Mus musculus
cuacauggaugucaaagucacuaagaaugacaacagaguuuggag

SEQ ID NO: 28062 - RNA, 41 nt, Mus musculus
ggugguacaggcuaagagaugggcugacagagaggaggaga

SEQ ID NO: 28063 - RNA, 56 nt, Mus musculus
gagagcggagagaguuuaggaggagcaccccgagagguaggagagaacggggagaa

SEQ ID NO: 28064 - RNA, 52 nt, Mus musculus
gauugaggaacaaaaaccucagugauucagacucugcaagauaaaaucaucg

SEQ ID NO: 28065 - RNA, 46 nt, Mus musculus
aucccagaacuuugggagaggaggcaagaaaaucagagcccaagau

SEQ ID NO: 28066 - RNA, 28 nt, Mus musculus
ggcucuugugugcaaauugggguggugc

SEQ ID NO: 28067 - RNA, 46 nt, Mus musculus
ugagcggccugucuaggaggugugcucuaccugugcaccgugauug

SEQ ID NO: 28068 - RNA, 46 nt, Mus musculus
cuuuccccccuuugucuuucucucuuuccccucuuuguccccagua

SEQ ID NO: 28069 - RNA, 42 nt, Mus musculus
agggcaaagguggcagugaaaagagaaggaggucggggagag

SEQ ID NO: 28070 - RNA, 42 nt, Mus musculus
aguccaugaaguaaguacuacagauugcaucugggcccuggg

SEQ ID NO: 28071 - RNA, 46 nt, Mus musculus
ucuucagagacagacacugaauaugguuacuuucaauguggcagaa

SEQ ID NO: 28072 - RNA, 47 nt, Mus musculus
uuacacagaaaguagaggggcagauagaugguagcagaugggguaag

SEQ ID NO: 28073 - RNA, 46 nt, Mus musculus
auauaaagucauugugguaccgacugccagagagaagugcccucga

SEQ ID NO: 28074 - RNA, 43 nt, Mus musculus
gaaugagcugaugauggcuucccagacgacauugcuggcucag

SEQ ID NO: 28075 - RNA, 46 nt, Mus musculus
uugugagccaccaugugguuacugggauuugaacucaggaucucug

SEQ ID NO: 28076 - RNA, 46 nt, Mus musculus
gggacuccuuucuuggcagcaucccuggcaaaaaugcugcugagua

SEQ ID NO: 28077 - RNA, 42 nt, Mus musculus
ggaucccaagcgccgcucgugucagacagcauuggcagaaau

SEQ ID NO: 28078 - RNA, 45 nt, Mus musculus
cuacaccagagaacuguccagcuuuuacuucagcauagucaagga

SEQ ID NO: 28079 - RNA, 42 nt, Mus musculus
uugcugggaucacauacgucuccuuucugacaaguacuaggc

SEQ ID NO: 28080 - RNA, 44 nt, Mus musculus
agaccaguauaugcugcacuuaauucaggauuuugcgacaaagg

SEQ ID NO: 28081 - RNA, 41 nt, Mus musculus
ccgcuuucucuugggaaauuugaccgguuuuaaccccgaga

SEQ ID NO: 28082 - RNA, 45 nt, Mus musculus
acagugaugguucauggauuuacacuuggagaaaaaggagaaaag

SEQ ID NO: 28083 - RNA, 46 nt, Mus musculus
gggggcugguuccagucuuccuuacuaacaaguguggccaccaggu

SEQ ID NO: 28084 - RNA, 42 nt, Mus musculus
uauaggggaaugccaggacaaggaaguaggaguggguggguu

SEQ ID NO: 28085 - RNA, 46 nt, Mus musculus
cacuagggauuuuaagaagucuuuuucaggcuaagcauguacaggc

SEQ ID NO: 28086 - RNA, 45 nt, Mus musculus
gcugugcguaggagccaugggauuccagggcugugagagggauag

SEQ ID NO: 28087 - RNA, 48 nt, Mus musculus
ggcccugugcauuccugaccacugacuuguauucuaagcugagggcag

SEQ ID NO: 28088 - RNA, 45 nt, Mus musculus
acuguugcugugauuguauguguuaauaguaucauucugagugua

SEQ ID NO: 28089 - RNA, 46 nt, Mus musculus
aggaugcuguuggaguuugcaguuucuacguuguugcuguuaaggu

SEQ ID NO: 28090 - RNA, 73 nt, Mus musculus
gccguacuggugcauaucccggcagagagucugggggguucccauuccuguguuucaucauaagacaaaagau

SEQ ID NO: 28091 - RNA, 45 nt, Mus musculus
gugguuuguaaauaucacggacaucaaggcugcagcuaagguagg

SEQ ID NO: 28092 - RNA, 46 nt, Mus musculus
guguugaaagaagagaacauugugcacagcuaucccugugacugga

SEQ ID NO: 28093 - RNA, 46 nt, Mus musculus
ggcccugaacuucagaacaaggcuguacuuaaagaaggaacagaug

SEQ ID NO: 28094 - RNA, 46 nt, Mus musculus
uuuggugguuucaauauauagaauuuaggaauuuuuauugacagag

SEQ ID NO: 28095 - RNA, 63 nt, Mus musculus
ugcuacccacgugacuauggccaaaggaacaggguugguucacacagccccagcucacgguau

SEQ ID NO: 28096 - RNA, 65 nt, Mus musculus
guggaucuggaagguggcacuuguagucacccuuuaacucccgauaaagugucuccucuuuuacc

SEQ ID NO: 28097 - RNA, 45 nt, Mus musculus
uaaauuauuuauagugaggcagaauuaugccuaacugcuccaaga

SEQ ID NO: 28098 - RNA, 46 nt, Mus musculus
gcuaaagaagcaagcccucuuccacucaucaguugagguauaagac

SEQ ID NO: 28099 - RNA, 45 nt, Mus musculus
gugaaauguucugccucugggcaccucuacauccuggcugaagau

SEQ ID NO: 28100 - RNA, 46 nt, Mus musculus
ucauuuaguggcauugcugugacugucacugcacucuagagaagau

SEQ ID NO: 28101 - RNA, 86 nt, Mus musculus
ugccucauccccuguuagcguuuuaguuuggaccacccagccuuggacaauucccgccaaccaggcaauuugcuauaugccagagg

SEQ ID NO: 28102 - RNA, 75 nt, Mus musculus
cuaggacugcguuggcugaagcagagcuugaauacaacccugagcaugucagucggucgauauacguaagauucc

SEQ ID NO: 28103 - RNA, 46 nt, Mus musculus
gggcuugguuuaucgaucuuacaaaccaguauauuggucucccuca

SEQ ID NO: 28104 - RNA, 53 nt, Mus musculus
acccaaaguacgaagccaagcagcugagaguauucuaccaaauguaugagaag

SEQ ID NO: 28105 - RNA, 87 nt, Mus musculus
uugcucaggcagccauugaaaagcagaaaucggcguuuguccgcuggggagugauggcagacuggaauaacugcuauuacacauuug

SEQ ID NO: 28106 - RNA, 36 nt, Mus musculus
cgguguagaugcccagagucuuucagccauggagau

SEQ ID NO: 28107 - RNA, 45 nt, Mus musculus
cuuuucagagcuuuauuccuggcaaagagaaagaaaaguaaagac

SEQ ID NO: 28108 - RNA, 46 nt, Mus musculus
gaggaggcucgugguacgauccguggccggggcggacagcccccag

SEQ ID NO: 28109 - RNA, 42 nt, Mus musculus
acuuggaggcagccgguucccggacagcgagccaccaggccg

SEQ ID NO: 28110 - RNA, 42 nt, Mus musculus
uugauuccagagucugugucuuuaaugucuaagcuuugaaag

SEQ ID NO: 28111 - RNA, 45 nt, Mus musculus
aagugaauuaauccugccugcagcccgcccgcccgacaaggcuca

SEQ ID NO: 28112 - RNA, 48 nt, Mus musculus
accagugagagacucuuugacucuuaaggggcuggggaguaggaaaaa

SEQ ID NO: 28113 - RNA, 46 nt, Mus musculus
caaaugcucuaugaaauauggauuuacaaaacaauuuauucccaag

SEQ ID NO: 28114 - RNA, 46 nt, Mus musculus
gcucuucccuggcccggaaguucccgaagcugaccaucauagggga

SEQ ID NO: 28115 - RNA, 42 nt, Mus musculus
ugaagacgggcagugggaggagauccugaagcagccgugccc

SEQ ID NO: 28116 - RNA, 46 nt, Mus musculus
gagggugcaugugugcaacaugcauauguacugugaagauguguga

SEQ ID NO: 28117 - RNA, 85 nt, Mus musculus
gacaauguaacaguucucauugggauugcuuaugaaggaaaggccaucgcaggcaucaucaaccagccguauuacaacuaccagg

SEQ ID NO: 28118 - RNA, 46 nt, Mus musculus
uucugcugugcuucagagacacugucuccuuuagaaacaagagagg

SEQ ID NO: 28119 - RNA, 46 nt, Mus musculus
uuccuggaggaaagagaggaagcacacugacauuccgagcagcuaa

SEQ ID NO: 28120 - RNA, 46 nt, Mus musculus
ggguuugggugcuuuuggguuucagcugaaggaagccccugccggg

SEQ ID NO: 28121 - RNA, 46 nt, Mus musculus
ucacagacugcauuuccgccaugaaccccgacaccgugcugcgagu

SEQ ID NO: 28122 - RNA, 45 nt, Mus musculus
uuuguggcagguuugagucccugaguuuaagcuccagcacacaca

SEQ ID NO: 28123 - RNA, 45 nt, Mus musculus
aaagaaaccaaauaauagcagucaguaguaaugacucauaaguga

SEQ ID NO: 28124 - RNA, 24 nt, Mus musculus
gcuuauguguuugcaaguccuggg

SEQ ID NO: 28125 - RNA, 46 nt, Mus musculus
ugagcgucauuuucaacuaacauaauuuccuuuacuuuauauuguu

SEQ ID NO: 28126 - RNA, 42 nt, Mus musculus
uacaugcaaaggaggcggggggagaaagggagggagagagag

SEQ ID NO: 28127 - RNA, 42 nt, Mus musculus
uuuuuugucauaaacaguaguaacccugacuaggacagacag

SEQ ID NO: 28128 - RNA, 50 nt, Mus musculus
uaugaacucugccgguguccuggcugcacugaggaacuacgaguacuaug

SEQ ID NO: 28129 - RNA, 54 nt, Mus musculus
agugcagggauuaagggcuugccccaccacaccuggcucaaauguuacuauuuc

SEQ ID NO: 28130 - RNA, 57 nt, Mus musculus
uugugcagucaacauuccugcugauaaaccagauuucuucagggcacagagucuuaa

SEQ ID NO: 28131 - RNA, 46 nt, Mus musculus
cuguaugcuaaccucacaacaaauccaugagcccugaaagaaguag

SEQ ID NO: 28132 - RNA, 50 nt, Mus musculus
uuuauuuuuucauugauuuauuuauuuguucacuuuacaguccaaucgaa

SEQ ID NO: 28133 - RNA, 46 nt, Mus musculus
aaggaggcaauagagucagagacagcccugcuccaguuguuaggag

SEQ ID NO: 28134 - RNA, 24 nt, Mus musculus
gacagggugauuuguaauggacag

SEQ ID NO: 28135 - RNA, 42 nt, Mus musculus
agaagcucugcuggcgguggaacaugugaaaggugaugucag

SEQ ID NO: 28136 - RNA, 41 nt, Mus musculus
uuggaguuuagugcuacaaaguugucuucgugugauaggcu

SEQ ID NO: 28137 - RNA, 41 nt, Mus musculus
gggaacuccuugaccuuagcagaucuauguguuugggccac

SEQ ID NO: 28138 - RNA, 35 nt, Mus musculus
cuuuguagcuucuaucugguuggugguuauaugaa

SEQ ID NO: 28139 - RNA, 46 nt, Mus musculus
acaaaaaacaagauguugggaaauucguggagcuuccaggugcaga

SEQ ID NO: 28140 - RNA, 44 nt, Mus musculus
uuuugaacuaaaugccagauagaagaaaaugaaaggacccggag

SEQ ID NO: 28141 - RNA, 46 nt, Mus musculus
aacaaacaguauuuucuuagauucuguuuguggaguuuggugcuag

SEQ ID NO: 28142 - RNA, 58 nt, Mus musculus
uaacuuuaaagggaaacugaucaugagauuugaugacacaaacccagaaaaggaaaag

SEQ ID NO: 28143 - RNA, 45 nt, Mus musculus
ugauggugcucauuacaugugcccaaaauaaguaucauugguuga

SEQ ID NO: 28144 - RNA, 58 nt, Mus musculus
ucagaucauuuugaaacuauaaugaaguaugcagagaaauuaauucaagaagggaagg

SEQ ID NO: 28145 - RNA, 57 nt, Mus musculus
cuuauguggaugacacuccugcagaacagaugaaggcggaacgugaacagaggacag

SEQ ID NO: 28146 - RNA, 90 nt, Mus musculus
cagcuguugagaagaaucuacagaugugggaagaaaugaaaaaaggaagccaguuuggucaguccuguugccugcgagcaaaaauugaca

SEQ ID NO: 28147 - RNA, 46 nt, Mus musculus
uuuuaacuuuccauuuuccugaaauuuuuauuauuguuuucuuuag

SEQ ID NO: 28148 - RNA, 46 nt, Mus musculus
gaagguguuacucaugccuugaggacaacagaguaccacgaccgag

SEQ ID NO: 28149 - RNA, 46 nt, Mus musculus
uguccaaaagaaagcucacgugguuugucaaugaaggacugguaga

SEQ ID NO: 28150 - RNA, 42 nt, Mus musculus
cucccuugacuuaaaugcuguaaacacguguuccugccagag

SEQ ID NO: 28151 - RNA, 41 nt, Mus musculus
cagggaugacccacgguuuccuacaguucguggaguucuga

SEQ ID NO: 28152 - RNA, 46 nt, Mus musculus
aauagauuucugaagggaguaaauuaacguuuuauaauaauaaaag

SEQ ID NO: 28153 - RNA, 25 nt, Mus musculus
ccccgauggggagcagaugcuugga

SEQ ID NO: 28154 - RNA, 46 nt, Mus musculus
ggugguguccguuguuuugugcuuuaggguagagcuguacacccag

SEQ ID NO: 28155 - RNA, 46 nt, Mus musculus
aagagcaggggcugagcuuuucuguaggaugaacugacugggccag

SEQ ID NO: 28156 - RNA, 45 nt, Mus musculus
cagacagcuacucugggugauuagcuaucuauggaaaugcccccc

SEQ ID NO: 28157 - RNA, 48 nt, Mus musculus
gcugaagaaggaagucgucccagugaauguccuggaugcgcaggagga

SEQ ID NO: 28158 - RNA, 42 nt, Mus musculus
uuucucagagggugagauggucacauuuauaaacuggggcaa

SEQ ID NO: 28159 - RNA, 42 nt, Mus musculus
cuugacacuggugcuccugacuaauaguaaauuugcccaagu

SEQ ID NO: 28160 - RNA, 46 nt, Mus musculus
uauguaauauuuauauauuuuauucuuagucaaacauuuaaaguag

SEQ ID NO: 28161 - RNA, 46 nt, Mus musculus
uuucuuuucucguuuuaauacuuuucaaucuuuuguagaaaugcag

SEQ ID NO: 28162 - RNA, 46 nt, Mus musculus
cugggaaaagaugaggacuucaagcaguacaucaacaaagacagua

SEQ ID NO: 28163 - RNA, 45 nt, Mus musculus
gaacuucuguacugaaacaaaauaaauggaaacaaacaaacacaa

SEQ ID NO: 28164 - RNA, 51 nt, Mus musculus
cuaaugcuaggagauccuugccuuaaagaucugaaaaaaggagacaucaua

SEQ ID NO: 28165 - RNA, 44 nt, Mus musculus
acaaaggaaaugccaacauccggaucaaaggaaaagaccaaagu

SEQ ID NO: 28166 - RNA, 46 nt, Mus musculus
auuuuuuaaaaguaauuuuguuauaccaaaaacuaagauagccuag

SEQ ID NO: 28167 - RNA, 28 nt, Mus musculus
cuucauguuggccuggaagaucucagag

SEQ ID NO: 28168 - RNA, 50 nt, Mus musculus
ggcggugcagggggaugugguucgugaauugaaagccaagaaagcgccaa

SEQ ID NO: 28169 - RNA, 46 nt, Mus musculus
ccaccaugucuggcucuggguuuggucuuguuuguuuguauggcag

SEQ ID NO: 28170 - RNA, 48 nt, Mus musculus
gacucuuccaaaagccaaggcaguggccugucaucagguggagcagga

SEQ ID NO: 28171 - RNA, 41 nt, Mus musculus
ugguuucagagcauucgaguucaugaccaucuuggcaggga

SEQ ID NO: 28172 - RNA, 46 nt, Mus musculus
gcagcagcuuagagacacguugcuuuguguguuuuuucuucucaag

SEQ ID NO: 28173 - RNA, 46 nt, Mus musculus
ugcccaacuaagguugaggcuuugcggaaagaaguacugucuggaa

SEQ ID NO: 28174 - RNA, 76 nt, Mus musculus
gagaucaagaagcucgguguugagaacugcuacuuccccauauuugugucucaggcugcguuagagaaagagaaga

SEQ ID NO: 28175 - RNA, 46 nt, Mus musculus
ugcuucauuggauggaucuaacuaaaauucugauucugauacauag

SEQ ID NO: 28176 - RNA, 46 nt, Mus musculus
aaugggugcagucccacagagaccugcccgucaggcucaaccagug

SEQ ID NO: 28177 - RNA, 42 nt, Mus musculus
ugggaguucaaacacccacagccuuuccuccgaacucgggag

SEQ ID NO: 28178 - RNA, 51 nt, Mus musculus
agccauuccuguugugagaggaaggaagacugaaaaggagaaguuugcagg

SEQ ID NO: 28179 - RNA, 45 nt, Mus musculus
gacaacaugggccuagugcuuccaccccgaguagcaucuguccag

SEQ ID NO: 28180 - RNA, 42 nt, Mus musculus
ucaaaggaagguggaaauuuggagauguagccaaaaugacag

SEQ ID NO: 28181 - RNA, 43 nt, Mus musculus
gucugaagaagacagagaggcacugauggcaaaaugcaacgag

SEQ ID NO: 28182 - RNA, 48 nt, Mus musculus
guagcagucagacgagauacuggagagaaacugacaauugcugagaag

SEQ ID NO: 28183 - RNA, 46 nt, Mus musculus
uacguuuagugucucugcacugcgagcggguaguguugugggugag

SEQ ID NO: 28184 - RNA, 47 nt, Mus musculus
gcauugaggauuggauuuaaggcuuuggcgugguaaugcugggcagg

SEQ ID NO: 28185 - RNA, 46 nt, Mus musculus
cugcuucugucuccugagagcuuggacagcaggcuuaugccaacag

SEQ ID NO: 28186 - RNA, 45 nt, Mus musculus
acaaccaucuguaaugggaucagaugcccucuucugguguaucug

SEQ ID NO: 28187 - RNA, 45 nt, Mus musculus
uaugccuaaauuaacaguggaaaauacuuuucuguaaacagccag

SEQ ID NO: 28188 - RNA, 46 nt, Mus musculus
cauguuaugggguguaaucacaccaugggcuuguugcagguaggag

SEQ ID NO: 28189 - RNA, 41 nt, Mus musculus
aguggacccaggaggaguuaacauuauuuaauuuggugaca

SEQ ID NO: 28190 - RNA, 41 nt, Mus musculus
aagcucuaugcugggacagggcagggcgacuccgggacagg

SEQ ID NO: 28191 - RNA, 44 nt, Mus musculus
uguuuuauaaaaagauaaagagaaggaauauguuugguggaggu

SEQ ID NO: 28192 - RNA, 46 nt, Mus musculus
gcaugcggaggggaguugagaggguaguagagacagagaaaggcag

SEQ ID NO: 28193 - RNA, 45 nt, Mus musculus
gaaggagaaggagaaggagaaggagaaggagaagaagaaggccau

SEQ ID NO: 28194 - RNA, 45 nt, Mus musculus
cuucuaccuaauaguuuagggcagguaacucuccuuucacuuggu

SEQ ID NO: 28195 - RNA, 72 nt, Mus musculus
gaaucuaguaaguaagcagagcuucacucuggguaaccgggaggguuaggaaagcgggcaguugaugaggug

SEQ ID NO: 28196 - RNA, 81 nt, Mus musculus
gaaggucgugaggguuugucguugauuagcauguaaaaggagauagaccggucugugugggucuugaaguguuaguguaga

SEQ ID NO: 28197 - RNA, 45 nt, Mus musculus
acugcacgugggguaaggcugcucggugguucagaaagaccccag

SEQ ID NO: 28198 - RNA, 45 nt, Mus musculus
aucuguuuguagauuaucuuugugaaaauuauucacugccaagau

SEQ ID NO: 28199 - RNA, 46 nt, Mus musculus
ucugauggguuucagaucucacuuuauuaugugaaguagggcagua

SEQ ID NO: 28200 - RNA, 46 nt, Mus musculus
aagucagaggccaaagagaagccagauugaguagaccagcuuagag

SEQ ID NO: 28201 - RNA, 118 nt, Mus musculus
ucacaagacaagaaaggaaagggaagcuacucuacuuaagggauaauacagagaggggaagaggcaguuuuacuaagagaguuguagagaccaguagagagagaacaaacuagacaca

SEQ ID NO: 28202 - RNA, 76 nt, Mus musculus
aaagugaugucuaauuguguggcagacaaagugacgaaccagagaaagauuugacagaauaggauaugcccaacuc

SEQ ID NO: 28203 - RNA, 46 nt, Mus musculus
aagucuuuauaccuaaaauuaaggacauaccuuuaagcaggcaacc

SEQ ID NO: 28204 - RNA, 46 nt, Mus musculus
cuugcaaucugcuagccuaauuaauagcaguugccuuucccagagg

SEQ ID NO: 28205 - RNA, 108 nt, Mus musculus
uuaaggggucucuuguccacauuggucuagucacuaaaccucuagauuguagugcuaccagugagccccugucauuuuucucuggagaaauaaaauuauaggcauaau

SEQ ID NO: 28206 - RNA, 60 nt, Mus musculus
agauaugcacauucccucuuccugcacuaagcuguuccagaaacuuccuuuguugucuug

SEQ ID NO: 28207 - RNA, 45 nt, Mus musculus
ucucucucucucucucucucucucuuucucucucugucugucucu

SEQ ID NO: 28208 - RNA, 46 nt, Mus musculus
gccuuuaaaggcuugguugggacuguuguccuagcacuugucugug

SEQ ID NO: 28209 - RNA, 46 nt, Mus musculus
agcccucccuggggcaaacauauugaaugauaauauuguucaugcu

SEQ ID NO: 28210 - RNA, 42 nt, Mus musculus
ucuauaaguguaugaucaaaauuuuacaguaugguggagaau

SEQ ID NO: 28211 - RNA, 44 nt, Mus musculus
caggggaggagaugcuacccaaccugcaaucuuaggaaacagca

SEQ ID NO: 28212 - RNA, 25 nt, Mus musculus
cugagcuguucaguuaguuaccagc

SEQ ID NO: 28213 - RNA, 90 nt, Mus musculus
cauguauacuuuaauuuacagcauuuaaauuguaucagggcaauauaagaugacugauaguauuaacuuacauuuuauauauggucaaua

SEQ ID NO: 28214 - RNA, 45 nt, Mus musculus
uucauuccauugccaucagauaaaauauccuauauaaccccacuc

SEQ ID NO: 28215 - RNA, 45 nt, Mus musculus
ccaggaagccaucagaugucuguuggugacuuuaugcaucgaggg

SEQ ID NO: 28216 - RNA, 59 nt, Mus musculus
uaguagcauggaaguuuguucccagaguagauauccucagagaacaaggaaguuaacag

SEQ ID NO: 28217 - RNA, 46 nt, Mus musculus
cuccacuucacacaccccgaaagcaaacuuaauaacuucagccaag

SEQ ID NO: 28218 - RNA, 45 nt, Mus musculus
uaauucuuucuagcuauaaacuauuuaacguucuucaauaaaaga

SEQ ID NO: 28219 - RNA, 45 nt, Mus musculus
auuaguguguggggggguguucauccauagugugugugugugugu

SEQ ID NO: 28220 - RNA, 45 nt, Mus musculus
caccaguggaugcagggaugauguucugggcagccccacagccau

SEQ ID NO: 28221 - RNA, 46 nt, Mus musculus
augagcuuaacaaaguugucauugagagcaaugccagccccggcau

SEQ ID NO: 28222 - RNA, 42 nt, Mus musculus
gcgggugugugcgcggugcgugcgggagacugugcggggccg

SEQ ID NO: 28223 - RNA, 41 nt, Mus musculus
ucacugguuggucuuaaucauagccccucgaaucaccacug

SEQ ID NO: 28224 - RNA, 45 nt, Mus musculus
ucuguacggacuuaucuaggccuagaauguuuucagccucugaga

SEQ ID NO: 28225 - RNA, 46 nt, Mus musculus
cgugcaccucggcaucuucuucauggggauuuuugugaggaacagg

SEQ ID NO: 28226 - RNA, 46 nt, Mus musculus
cucuuguauacaucacagaguuaagucauauuuuuaaugcacucag

SEQ ID NO: 28227 - RNA, 46 nt, Mus musculus
cuuuucuguuugagucuggaacgcaguuucaguacuauaauuggag

SEQ ID NO: 28228 - RNA, 42 nt, Mus musculus
acggcaucaggaggugcugggggaaaccaggaccucguggau

SEQ ID NO: 28229 - RNA, 46 nt, Mus musculus
auuguagcccugaacuuagugcuaugcaccuauaauauccgaacau

SEQ ID NO: 28230 - RNA, 46 nt, Mus musculus
cucuuuucugaugguuguccacagagccuuuugagugggguuagcu

SEQ ID NO: 28231 - RNA, 45 nt, Mus musculus
aggagguucgagggagggguggaagauacuggggacucuggggau

SEQ ID NO: 28232 - RNA, 45 nt, Mus musculus
ugguccaguggcaaaagugucaccucaaaaacagcaugggcagug

SEQ ID NO: 28233 - RNA, 46 nt, Mus musculus
ggauggggacagguaguguccccuaaggcaggaaggguggucuuca

SEQ ID NO: 28234 - RNA, 41 nt, Mus musculus
agcucuggggaggccagagaaagcagagaccaacuaggaga

SEQ ID NO: 28235 - RNA, 46 nt, Mus musculus
cacuucuggaugaggagacccgaacacaaaaagaguuuguugucuu

SEQ ID NO: 28236 - RNA, 46 nt, Mus musculus
aagauuccuauaagaaauaccugcacacgguuaagaaggucaagau

SEQ ID NO: 28237 - RNA, 45 nt, Mus musculus
caugucgugcuggggauuuacugcaacgguuacuacgguucacug

SEQ ID NO: 28238 - RNA, 45 nt, Mus musculus
aggggcagaucuaugccagaaauacaaacugagugacgugaaugu

SEQ ID NO: 28239 - RNA, 45 nt, Mus musculus
ccagggaucagguccuuaggucuugggagccaucaucaguggagg

SEQ ID NO: 28240 - RNA, 45 nt, Mus musculus
agagaauucagugugugaguuugugcgugugaaacuguuuaugug

SEQ ID NO: 28241 - RNA, 45 nt, Mus musculus
ugaaugccacuguuuugagcaggcuuucugaauccugcaccucac

SEQ ID NO: 28242 - RNA, 42 nt, Mus musculus
cagcuccuguaauaucuucaucaaaagcuaaugucaccaggu

SEQ ID NO: 28243 - RNA, 45 nt, Mus musculus
aggacccaggccuucugguggacgguaccaucgcugcgaugguag

SEQ ID NO: 28244 - RNA, 45 nt, Mus musculus
aggaaaacauuucacuggggcuggcuuacagguucagagguuuag

SEQ ID NO: 28245 - RNA, 46 nt, Mus musculus
uguuguugguagugcuagggauugaauguagccuuuugccccuguu

SEQ ID NO: 28246 - RNA, 35 nt, Mus musculus
acaagaaaaaggagaagacagagugccugcagaaa

SEQ ID NO: 28247 - RNA, 42 nt, Mus musculus
uuuccauaagagcagcaaaugcucuuaaccacugagcuaugu

SEQ ID NO: 28248 - RNA, 45 nt, Mus musculus
gcguggauauaugugcauugugugcaugccugcugcccacagagg

SEQ ID NO: 28249 - RNA, 46 nt, Mus musculus
ucugcaggcaacugcauaaacaugucacaaauacauaaaugcaggu

SEQ ID NO: 28250 - RNA, 45 nt, Mus musculus
ugugugugugugugugugauaucaagaaacugaaacaggaagauc

SEQ ID NO: 28251 - RNA, 45 nt, Mus musculus
uccaguuaagugagggaaguuucauuuucuugaaaauggcgagau

SEQ ID NO: 28252 - RNA, 42 nt, Mus musculus
cccuaguacuacaggacaguuugcagacagcuugguggaagg

SEQ ID NO: 28253 - RNA, 45 nt, Mus musculus
auuugguugaucuauugaacuaacugauggguccuccugguagug

SEQ ID NO: 28254 - RNA, 42 nt, Mus musculus
cccucuggugaccagucccgggacccuugcgccaccggagac

SEQ ID NO: 28255 - RNA, 45 nt, Mus musculus
ugcugggauuaaaggcgugcgccaccacugcccggcuugcccugc

SEQ ID NO: 28256 - RNA, 42 nt, Mus musculus
cugcucccacccuccaagugagcuccgccugccagcccaaug

SEQ ID NO: 28257 - RNA, 45 nt, Mus musculus
ugacaggauagggagguugguaggauggacagggccagccagagg

SEQ ID NO: 28258 - RNA, 42 nt, Mus musculus
ucucuggccaguugaccagcuggcccuguauccucaucccaa

SEQ ID NO: 28259 - RNA, 43 nt, Mus musculus
guuugggaugaggauacagggccagcuggucaacuggccagag

SEQ ID NO: 28260 - RNA, 46 nt, Mus musculus
cauucugggcucugccuccugccuacaccaccauagccagugccag

SEQ ID NO: 28261 - RNA, 53 nt, Mus musculus
gacacggagacgagacagagaaguggggauggacagaggagagcgcugcgugc

SEQ ID NO: 28262 - RNA, 42 nt, Mus musculus
cagacuauacguggaaagggucguugacagucacaaccuguc

SEQ ID NO: 28263 - RNA, 26 nt, Mus musculus
cgaacaggagcuggacgcuaauuccg

SEQ ID NO: 28264 - RNA, 46 nt, Mus musculus
uggagugcugauucaacucuugagaacugggugagagucaggacag

SEQ ID NO: 28265 - RNA, 45 nt, Mus musculus
cuguguguucucaaagugacgcagcaaagugagaagcaccuggag

SEQ ID NO: 28266 - RNA, 41 nt, Mus musculus
gguguucucagugauccacaguaacgaccccguggccagag

SEQ ID NO: 28267 - RNA, 46 nt, Mus musculus
acaggaauugugagcugcuaaguggaugauaggaacugagcccagg

SEQ ID NO: 28268 - RNA, 41 nt, Mus musculus
uaaaaaagcauuaugccaguggucauugcuguaugcagggg

SEQ ID NO: 28269 - RNA, 46 nt, Mus musculus
agaagucgaagcugcuguuuuugcagccgcaaacuucucugcacag

SEQ ID NO: 28270 - RNA, 46 nt, Mus musculus
ugcuuguucauuuuuggaacugaugacaaguaacaugcccauuaau

SEQ ID NO: 28271 - RNA, 112 nt, Mus musculus
uuguguaacuuuuccuguggagacuugaacaaacauuuauucaccccagauuggacacugcugacagauaaaaaauauuucacugaguaguuuacuggaguugccuacagga

SEQ ID NO: 28272 - RNA, 42 nt, Mus musculus
gccaguaggagauccuacagguucuguuuauauaacugugau

SEQ ID NO: 28273 - RNA, 46 nt, Mus musculus
uuaagacagacuugcauaugacugauugggagugguggcuggauac

SEQ ID NO: 28274 - RNA, 42 nt, Mus musculus
uccauccaggacuuuccccuugcaacuaagaucaggccccaa

SEQ ID NO: 28275 - RNA, 66 nt, Mus musculus
ugacuuugcugucucuguagauucagcuucugcugcaguauuugaagaaugaccccaggaaagccg

SEQ ID NO: 28276 - RNA, 45 nt, Mus musculus
aguaauaauauguauuuaauaccuuuaauuugaaaacugugggag

SEQ ID NO: 28277 - RNA, 46 nt, Mus musculus
aggcagaucucugugaguucaaagcuauccuguucuaccuagugag

SEQ ID NO: 28278 - RNA, 46 nt, Mus musculus
uaucuuaaaguuuuaguuuuggguuuuuuuuaaagcuaauaaacag

SEQ ID NO: 28279 - RNA, 47 nt, Mus musculus
uuuaucugacaagaagauggcauugggucacccauuuggcuggaaau

SEQ ID NO: 28280 - RNA, 44 nt, Mus musculus
cugaguuacucuucucugcuucuuuaggaaauguaggcucuucc

SEQ ID NO: 28281 - RNA, 46 nt, Mus musculus
aaugcuguuaccauagcaacaggggcaucgcagcucauggagugag

SEQ ID NO: 28282 - RNA, 45 nt, Mus musculus
uuccagaacaggagccucugugcccuguuucugaagaugccaaca

SEQ ID NO: 28283 - RNA, 92 nt, Mus musculus
agaggaucaggaagguuccaggguuagaggcuccuccauguguaguaggaugugccauucauauugaaaggacugcaucgagugacuaguga

SEQ ID NO: 28284 - RNA, 46 nt, Mus musculus
aggccaucagauguguuaaagaaugcggacuugacuuuauagggag

SEQ ID NO: 28285 - RNA, 46 nt, Mus musculus
gacacucugcuaacucagcugcacagcucucaggaugcugcccgga

SEQ ID NO: 28286 - RNA, 43 nt, Mus musculus
ggcucacaaccauccguaaugagaucugacucccuccucugga

SEQ ID NO: 28287 - RNA, 41 nt, Mus musculus
cgggugcauuguuacgggaccaacgaucgcaccaggguuug

SEQ ID NO: 28288 - RNA, 45 nt, Mus musculus
cacagagaaacccugucucgaaaaaaaccaaaaaaauaaaguaga

SEQ ID NO: 28289 - RNA, 45 nt, Mus musculus
auggagcagaggguugagccacauaaugauuacuucagcacccag

SEQ ID NO: 28290 - RNA, 46 nt, Mus musculus
caucggugagagaugccaauggcaucgucuggaagacuggccccag

SEQ ID NO: 28291 - RNA, 41 nt, Mus musculus
cacaggcucagcggccugcugcauuggcaccucuuacccac

SEQ ID NO: 28292 - RNA, 45 nt, Mus musculus
ggaaugugguucacauaugucuuccuguuugauguaaagggaaca

SEQ ID NO: 28293 - RNA, 42 nt, Mus musculus
uuuaacaguugacuauggcugcucagugcuuuuggaccacgg

SEQ ID NO: 28294 - RNA, 46 nt, Mus musculus
gaaagaauguaaaucuaguaagacacucauuucuuuuguggcccuc

SEQ ID NO: 28295 - RNA, 42 nt, Mus musculus
ccuuacccccacccgcgagaaagacaccccacgcccagagag

SEQ ID NO: 28296 - RNA, 45 nt, Mus musculus
uccucaacacacaagggcuuagguucaggacccgagugcagagga

SEQ ID NO: 28297 - RNA, 46 nt, Mus musculus
ucugauuggcugagaaaacacaacacugcuaggcauccugggaaaa

SEQ ID NO: 28298 - RNA, 87 nt, Mus musculus
gcggccacccuggcaaccacaccaccgcgccgcucggagcccaggcucgcccgcugcaggccaaccgcgccgaaacccgagccccuc

SEQ ID NO: 28299 - RNA, 44 nt, Mus musculus
cagcaucggcaccggcuccuacggccgcugucagaagauucgga

SEQ ID NO: 28300 - RNA, 46 nt, Mus musculus
guaucugguuagguuacuuacggaggcagcuuaccuucuccaaugc

SEQ ID NO: 28301 - RNA, 42 nt, Mus musculus
aguaaaugggaaucucauccaggagucugacaaucuggaagc

SEQ ID NO: 28302 - RNA, 45 nt, Mus musculus
uuggagaugccuugggcuccgugaucguggucgugaaugccuugg

SEQ ID NO: 28303 - RNA, 38 nt, Mus musculus
aaucuuaaauuaugucuuaaagaaacuuccauagugac

SEQ ID NO: 28304 - RNA, 45 nt, Mus musculus
aaguuaacuuuugggauuugaaauaauucauugcuuaauaaucug

SEQ ID NO: 28305 - RNA, 46 nt, Mus musculus
uugguagguaaacuguuuuugaguguuuuuacuguuuuacaagcag

SEQ ID NO: 28306 - RNA, 47 nt, Mus musculus
aaaaaaugucauuaaccugcugucuuaagguaguccuacacaaaucu

SEQ ID NO: 28307 - RNA, 41 nt, Mus musculus
uccacggccucccucuucuucacccuguaaucugucaccuu

SEQ ID NO: 28308 - RNA, 46 nt, Mus musculus
uuuuacauuuaaaagacuuauuaugggggcuggagagauggcucag

SEQ ID NO: 28309 - RNA, 41 nt, Mus musculus
cuaguuggaggagguguggucuuguuggaggagguguguca

SEQ ID NO: 28310 - RNA, 45 nt, Mus musculus
aaagcuuucaucgugggugaccagaucuccuuugccgauuacaac

SEQ ID NO: 28311 - RNA, 43 nt, Mus musculus
uggauauggugaaugaugggguagaggaccuucgcggcaaaua

SEQ ID NO: 28312 - RNA, 45 nt, Mus musculus
uacauagacaagaaaugccccuucacugguaaugucuccauccaa

SEQ ID NO: 28313 - RNA, 45 nt, Mus musculus
caagaacaugucugugcaccugucccccuguuucagggauguaca

SEQ ID NO: 28314 - RNA, 45 nt, Mus musculus
uguccgauucaaugugcucaaggucaccaaggcugcuggcaccaa

SEQ ID NO: 28315 - RNA, 42 nt, Mus musculus
gggugucucugcucuaagagaaccucuaugaaggaugcugag

SEQ ID NO: 28316 - RNA, 45 nt, Mus musculus
agagcuucccuucgaagaugcagucccuuucaaaggugguucaga

SEQ ID NO: 28317 - RNA, 45 nt, Mus musculus
gaugcuucugaaagcauauaaaaacaguugacugaauucucagua

SEQ ID NO: 28318 - RNA, 45 nt, Mus musculus
uggagggacauauauuacugaugggcuugagauggggugucggau

SEQ ID NO: 28319 - RNA, 45 nt, Mus musculus
uggcagcgguuccuggaggaaauagggccgagcaagccaggagca

SEQ ID NO: 28320 - RNA, 46 nt, Mus musculus
uccaaagagaagauauaacauucacaaaguauguuuaggugccugu

SEQ ID NO: 28321 - RNA, 46 nt, Mus musculus
gccugccugcucaucuuugcuguaggucagagggcacccaggccac

SEQ ID NO: 28322 - RNA, 47 nt, Mus musculus
uuuuuccaggcauucucuuauuaaaacgucuaguugugggcaucugg

SEQ ID NO: 28323 - RNA, 47 nt, Mus musculus
ucuguggagacagguagugaagcuccugggaucugugggaccagcag

SEQ ID NO: 28324 - RNA, 40 nt, Mus musculus
caagcaguauguugcuuccaagaggagaaagugaacaaag

SEQ ID NO: 28325 - RNA, 45 nt, Mus musculus
ucugagggcaaaaaguuacggagacugaguauggaugugagauag

SEQ ID NO: 28326 - RNA, 45 nt, Mus musculus
ggcgucaugcugcacaggugaagcugauggggcagcaccccccca

SEQ ID NO: 28327 - RNA, 42 nt, Mus musculus
aagcuucuaucccacuguccucaggcuucaccacuucaagcu

SEQ ID NO: 28328 - RNA, 46 nt, Mus musculus
gacuggaggacuugauuugaacaucuuuuuugggaggugcccaggu

SEQ ID NO: 28329 - RNA, 41 nt, Mus musculus
cagcacucuuuuuuuggccaccgacccuguguccagcccca

SEQ ID NO: 28330 - RNA, 46 nt, Mus musculus
gucaagagaguagcgaaccaucguggcaggugaccucuggcccaug

SEQ ID NO: 28331 - RNA, 45 nt, Mus musculus
auaaagacagaguaagcagugucucugcacaugcaugacgagggu

SEQ ID NO: 28332 - RNA, 45 nt, Mus musculus
uggguuaauuccuaggaauagaauuaugugggucaaaggguagga

SEQ ID NO: 28333 - RNA, 46 nt, Mus musculus
auaacaagaucugacucccucuucuggagugucugaaggcagcuac

SEQ ID NO: 28334 - RNA, 46 nt, Mus musculus
aagaaugguaucgaguggcgcacuccuuuaaucccagcacucagga

SEQ ID NO: 28335 - RNA, 46 nt, Mus musculus
gcucuggguauggggagcuccaggcccuaaauuaaaguguuaaaag

SEQ ID NO: 28336 - RNA, 42 nt, Mus musculus
ccgccucugccuuggcuaagcuuuggugcugggggccgucag

SEQ ID NO: 28337 - RNA, 62 nt, Mus musculus
uucagaacuaucagaaaccgcaaguccuuccugggcuacggcacugaguguuccaucuuggg

SEQ ID NO: 28338 - RNA, 45 nt, Mus musculus
aaaucagaagcguggguuucgggggcuguuucuguacgugcaaac

SEQ ID NO: 28339 - RNA, 45 nt, Mus musculus
cagcccugaggauuuucucucuugcugcacucuccuugccggcag

SEQ ID NO: 28340 - RNA, 45 nt, Mus musculus
uggggcacgguguccucuccaugcugaagagucccguagccaccg

SEQ ID NO: 28341 - RNA, 45 nt, Mus musculus
uuugaacuugaaccucuaugcaaucugcuuugucuuggucuggga

SEQ ID NO: 28342 - RNA, 46 nt, Mus musculus
guuuccugcucauguucuucacuggcuugcucugucuuggucucug

SEQ ID NO: 28343 - RNA, 44 nt, Mus musculus
agucagcagucuuuugacuguuggguccagugugcacaggcacc

SEQ ID NO: 28344 - RNA, 54 nt, Mus musculus
cugguuuuucccuguguucuuccugggcuggaaaacuagaugguguugaaggcc

SEQ ID NO: 28345 - RNA, 46 nt, Mus musculus
gcugucaacggucucgucuugcugugucccguuuggagugucugaa

SEQ ID NO: 28346 - RNA, 46 nt, Mus musculus
uuucggcccugcucucugcagagucuggguugcaggcaccugggag

SEQ ID NO: 28347 - RNA, 46 nt, Mus musculus
aucuagcaugccacccucuaccuccugaacugggguggcuuccucu

SEQ ID NO: 28348 - RNA, 45 nt, Mus musculus
cugcagugaugucuuuuucagugaccucuccaacaggcggugugg

SEQ ID NO: 28349 - RNA, 25 nt, Mus musculus
uccuggccccgagucuucaacggcg

SEQ ID NO: 28350 - RNA, 43 nt, Mus musculus
gacuaaucucuuaaaugacucccagguggagacgcccuccccu

SEQ ID NO: 28351 - RNA, 46 nt, Mus musculus
cucgggugaggaacuuccgugcgcuuggucuuguuccugggugcug

SEQ ID NO: 28352 - RNA, 45 nt, Mus musculus
uggacgauccgacacaaaucaacgccucccaagacacugaaguau

SEQ ID NO: 28353 - RNA, 45 nt, Mus musculus
uccugcauuccagacgccgugcucuccguggaggacaagguggca

SEQ ID NO: 28354 - RNA, 27 nt, Mus musculus
uccucagcuuccgcuuccuggggugcu

SEQ ID NO: 28355 - RNA, 40 nt, Mus musculus
uucuucccggagagcuucuuuaagcccgaacugcugaaga

SEQ ID NO: 28356 - RNA, 46 nt, Mus musculus
cuucucuucaggacuuagaucugucagcugaguauggucaccccca

SEQ ID NO: 28357 - RNA, 70 nt, Mus musculus
ccaccaccacauccccuuccaccucugcuccuccuugcccuuucgucaucuucuccacggugcucacgug

SEQ ID NO: 28358 - RNA, 36 nt, Mus musculus
uucucaucaaacacuuccguugccaaaggagcacac

SEQ ID NO: 28359 - RNA, 46 nt, Mus musculus
aauuucuugaaggaagauguugucucauugcugacagggcuggucg

SEQ ID NO: 28360 - RNA, 46 nt, Mus musculus
uuuucuucuccaucuuuggcugcuucuuccucggucccuugaccag

SEQ ID NO: 28361 - RNA, 46 nt, Mus musculus
ggcucacaaccaucuguaacgagaucugacgcccucuucugggugu

SEQ ID NO: 28362 - RNA, 45 nt, Mus musculus
gguuaagcaggaagguuuguuugcaagaaacuucaaaggcuggag

SEQ ID NO: 28363 - RNA, 41 nt, Mus musculus
gaggaaaaguggaagggagugggcuguccgggaggggggca

SEQ ID NO: 28364 - RNA, 41 nt, Mus musculus
uacacuauagcugucuucagacacuccagaaaacagcauca

SEQ ID NO: 28365 - RNA, 48 nt, Mus musculus
aaaccagaaaacaaauacagugagaaagugugugugugugugugugug

SEQ ID NO: 28366 - RNA, 46 nt, Mus musculus
uagaagccuucacugcuuuuaagauucugaacaacugucugucuga

SEQ ID NO: 28367 - RNA, 24 nt, Mus musculus
gaaggccuuguucaugacuacuua

SEQ ID NO: 28368 - RNA, 42 nt, Mus musculus
cuacuguuacuuacaguucauguucauguucagaggcccaag

SEQ ID NO: 28369 - RNA, 46 nt, Mus musculus
acacacagaaagacagagagagagagagagagagagagagacagac

SEQ ID NO: 28370 - RNA, 33 nt, Mus musculus
gcauaugugcgugggugcgugugcgcaugcgcg

SEQ ID NO: 28371 - RNA, 45 nt, Mus musculus
cuugaaucagaggguaaguaaaaacacuugcugugggagcaagag

SEQ ID NO: 28372 - RNA, 92 nt, Mus musculus
uguuuuaaguguguguguguauguauguuuuaaguguguguguauguuuuaaguguguguguguauguauguuuuaaguguguguguauguu

SEQ ID NO: 28373 - RNA, 46 nt, Mus musculus
guauguuuuaaguguguauguauguuuuaaguguguguguaugugu

SEQ ID NO: 28374 - RNA, 90 nt, Mus musculus
guauguuuuaaguguguguguauguuuuaaguguguguguguguguauguuuuaaguguguauguauguuuuaaguguguguguaugugc

SEQ ID NO: 28375 - RNA, 42 nt, Mus musculus
gggaagaaaucuaucaucugugguccuagaagugugugugug

SEQ ID NO: 28376 - RNA, 41 nt, Mus musculus
uucccagcaaccacaugguggcucaugaccaucuguaauag

SEQ ID NO: 28377 - RNA, 46 nt, Mus musculus
guuaaggaggagaauggccugaaguuuuguuucuaucacuugguug

SEQ ID NO: 28378 - RNA, 41 nt, Mus musculus
ggaacuccuggaaaacgaaagagaaagaccuuuugccagga

SEQ ID NO: 28379 - RNA, 46 nt, Mus musculus
guggcucacaaccauccguaaugagaccugacucccucuucuggug

SEQ ID NO: 28380 - RNA, 46 nt, Mus musculus
guguguguguguguguguguguguguguguguguaugugcuuagug

SEQ ID NO: 28381 - RNA, 46 nt, Mus musculus
agagaaaggaaggaaggaaggaaggaaggaaggaagggagagaaaa

SEQ ID NO: 28382 - RNA, 46 nt, Mus musculus
ugugaguuaccacgugguugcugggauuugaacucaggaccuuugg

SEQ ID NO: 28383 - RNA, 46 nt, Mus musculus
gucauuugcacuguagugucaaaccaaguauaaauucaggguagag

SEQ ID NO: 28384 - RNA, 47 nt, Mus musculus
guaagaccuugucuugagagagagagagagagagagagagagagaga

SEQ ID NO: 28385 - RNA, 35 nt, Mus musculus
ggcacauaccuccaaucauaauacuuacgaggccg

SEQ ID NO: 28386 - RNA, 42 nt, Mus musculus
cucacuucccugagucugucauugaacacugcgccuggccug

SEQ ID NO: 28387 - RNA, 46 nt, Mus musculus
cacaauugagaaaaagagaagccaaucuuacuguccccaggagcag

SEQ ID NO: 28388 - RNA, 42 nt, Mus musculus
cuacugaaaagucuuaggucuucaacccuagguaaccugugg

SEQ ID NO: 28389 - RNA, 46 nt, Mus musculus
cccggggaacgcgcggggaaaugaagcuguuacuggaaaugugccu

SEQ ID NO: 28390 - RNA, 41 nt, Mus musculus
cacaaccauccauaacaaaaaucugaugcccucuucugggg

SEQ ID NO: 28391 - RNA, 46 nt, Mus musculus
aagcacaugggacauguccauguguuacccagucacacccacagaa

SEQ ID NO: 28392 - RNA, 46 nt, Mus musculus
ugugugugugugugugugugugugugugugugcaugugguuuguug

SEQ ID NO: 28393 - RNA, 46 nt, Mus musculus
aaagaauggagugugguugugugugugugugugugugugugugugu

SEQ ID NO: 28394 - RNA, 45 nt, Mus musculus
ccugugccccaucucugguuugggacaauccaacucggaggagag

SEQ ID NO: 28395 - RNA, 42 nt, Mus musculus
aagaaaaugaauuuugaaaucuugugaugcaaugcuggagca

SEQ ID NO: 28396 - RNA, 46 nt, Mus musculus
cauaagcuaagccccagcuuucaucuccaucaucacgugugcagag

SEQ ID NO: 28397 - RNA, 45 nt, Mus musculus
cuuguaaucuaacuucaaaggucugcugcccucuuguggauagga

SEQ ID NO: 28398 - RNA, 45 nt, Mus musculus
caccucgugaacuuugcucacgugcaauguuuuguuuucucuuuc

SEQ ID NO: 28399 - RNA, 46 nt, Mus musculus
cuuaguaccuuagccaccuugacaguauaacuuaccaucccuagau

SEQ ID NO: 28400 - RNA, 45 nt, Mus musculus
cacgggguaggaaccacauuccaccuuaguaguucucugcagaga

SEQ ID NO: 28401 - RNA, 46 nt, Mus musculus
ugcauguaugacuguguaccauguaccuaccuauauccauggagac

SEQ ID NO: 28402 - RNA, 42 nt, Mus musculus
cacucuacuucccuuauuuagaaagcaucccacccccgaguu

SEQ ID NO: 28403 - RNA, 44 nt, Mus musculus
aagacagcuacaguguauuuacauauaauaaaaaauaaauaaau

SEQ ID NO: 28404 - RNA, 45 nt, Mus musculus
gccacucccugggccaagcauauccaaaccauuacaggcggcaug

SEQ ID NO: 28405 - RNA, 46 nt, Mus musculus
guaccuggaaacauuuaaaaaguguuggccaggcaacaggagagaa

SEQ ID NO: 28406 - RNA, 46 nt, Mus musculus
uauaauugguauuauuauaaaaucaaacuaggaacauuggugagug

SEQ ID NO: 28407 - RNA, 46 nt, Mus musculus
auagaguuuauucagggcauggggaagggagucaagaggguaguag

SEQ ID NO: 28408 - RNA, 46 nt, Mus musculus
uaaaaagauaaagagaggggggauaguucugugaugguguguagug

SEQ ID NO: 28409 - RNA, 45 nt, Mus musculus
aaaagaauccuagugugcugagacauggagaaugguggucagagg

SEQ ID NO: 28410 - RNA, 46 nt, Mus musculus
gauuaacacuuucuaauggcuaguguggaggcuucucuggcccauu

SEQ ID NO: 28411 - RNA, 46 nt, Mus musculus
auguuauugaaaaguaugaaauaauauaaaauugucaaguggggac

SEQ ID NO: 28412 - RNA, 46 nt, Mus musculus
gugccgagggauuucacucugcccaucagugauguccgggccagca

SEQ ID NO: 28413 - RNA, 46 nt, Mus musculus
cuuuguuuuuaucugguugggggugauucauugguugcucucuuug

SEQ ID NO: 28414 - RNA, 45 nt, Mus musculus
gaaaagugugauucuaagcaguuuguggcuuuaucaggguuggga

SEQ ID NO: 28415 - RNA, 46 nt, Mus musculus
aaauagucaaggcuugacuaucugugaaucucccaagugcugagaa

SEQ ID NO: 28416 - RNA, 46 nt, Mus musculus
aaaauuauggaucuauaaaucauuucuuuugugacuuauucuggua

SEQ ID NO: 28417 - RNA, 45 nt, Mus musculus
uggccuuuggcauagaccugagagcuuuagagagcuugauguuug

SEQ ID NO: 28418 - RNA, 46 nt, Mus musculus
gacaggaaacaucgggagcuuagcagagauggaaagauguauagga

SEQ ID NO: 28419 - RNA, 46 nt, Mus musculus
gagucccauuuaguacaggucacaaagucagccuggcacgggagug

SEQ ID NO: 28420 - RNA, 46 nt, Mus musculus
uuccauacugggggucaaccccagagcuuugugcaugccaggagaa

SEQ ID NO: 28421 - RNA, 42 nt, Mus musculus
cggaacaucauugccauggaaguuucuagaaaugcauuguuc

SEQ ID NO: 28422 - RNA, 88 nt, Mus musculus
ucaaagauucaaauuugaauauauuccaguuagauguggccacugugacuuuucuugucaucgaaauuuaaggcauuugccaccagau

SEQ ID NO: 28423 - RNA, 42 nt, Mus musculus
ccauacaaaccaucacagcaaccaaucacacagucugcagua

SEQ ID NO: 28424 - RNA, 41 nt, Mus musculus
gcggguuuguauaugugugcucaugcgcacacagaggccag

SEQ ID NO: 28425 - RNA, 44 nt, Mus musculus
uaccaaacugaguaccuucccugccccugaaguguggggggaga

SEQ ID NO: 28426 - RNA, 45 nt, Mus musculus
ggaaacuugguagcuagaugcuacuacagaaugaggggugugugu

SEQ ID NO: 28427 - RNA, 45 nt, Mus musculus
ugucuaagaagcagggaaggaaagaaaggaauuuucuggguggga

SEQ ID NO: 28428 - RNA, 41 nt, Mus musculus
aggguuccuuuguucuucuugacucauagccagcugcuaga

SEQ ID NO: 28429 - RNA, 46 nt, Mus musculus
ugucuugcuuuaagaaggguuuccccuguuggagagagagagagag

SEQ ID NO: 28430 - RNA, 41 nt, Mus musculus
cguggaacgggucucuagucgcaggugggcaaagcgucaga

SEQ ID NO: 28431 - RNA, 45 nt, Mus musculus
caccaagcacaccagacuguauccuuguccuauaaugcgccagac

SEQ ID NO: 28432 - RNA, 80 nt, Mus musculus
auauaucucugugugccucucuaugugcauuucuuucccucccucucucccucccucuccccuccuuuuccccaccucuc

SEQ ID NO: 28433 - RNA, 46 nt, Mus musculus
gauccauguuuguuugcaacucuuaaggaaaaggcacaaggcagau

SEQ ID NO: 28434 - RNA, 42 nt, Mus musculus
agcugcuuaagaguccccaugucccucuaaguagccacacca

SEQ ID NO: 28435 - RNA, 46 nt, Mus musculus
aagagccuuugaaggaguuuaacacuggccacaguuuccacaugag

SEQ ID NO: 28436 - RNA, 42 nt, Mus musculus
guuauaauagucaauaauaaauugauuuguaaaacaggagaa

SEQ ID NO: 28437 - RNA, 45 nt, Mus musculus
gaguguucuuugaagguuuucuuauuuagaccgugugaaggugga

SEQ ID NO: 28438 - RNA, 46 nt, Mus musculus
aaggguuggaauuacagacaugcuccacccuaccugacucacagua

SEQ ID NO: 28439 - RNA, 47 nt, Mus musculus
cauuugugggcagugucuuguuuuggacacccccuugcuagugucau

SEQ ID NO: 28440 - RNA, 52 nt, Mus musculus
auuaauauuuacagagagacagggagagagagagaaagagaaagagaaagag

SEQ ID NO: 28441 - RNA, 47 nt, Mus musculus
cgagaucauggccgugcuggccuugacugauagccucacagacauga

SEQ ID NO: 28442 - RNA, 45 nt, Mus musculus
ugagccacuaugugguugcugggaauuaaacucaggaccucguaa

SEQ ID NO: 28443 - RNA, 46 nt, Mus musculus
acauuucugccuggaaacaucaggcugaaauuucagaacaugagaa

SEQ ID NO: 28444 - RNA, 46 nt, Mus musculus
uuggccugaggaaagcaacauuuuuguuuuaaaaacaaauacagag

SEQ ID NO: 28445 - RNA, 46 nt, Mus musculus
ucacaucuaaagaaauacauagcaugaaaacuggccaggccuggga

SEQ ID NO: 28446 - RNA, 46 nt, Mus musculus
acagucauucuugaaaaguuuggggaggaauuggauaaauggagag

SEQ ID NO: 28447 - RNA, 46 nt, Mus musculus
uaaccauuggacagggaaguacagagaaaggauauucccggcaggu

SEQ ID NO: 28448 - RNA, 41 nt, Mus musculus
ucagcaguuaagagcacuggcggcuccuucagaggaccagg

SEQ ID NO: 28449 - RNA, 46 nt, Mus musculus
uggugcccucgccaucuccucccgggaaaugucaggagucaaagau

SEQ ID NO: 28450 - RNA, 42 nt, Mus musculus
acuggggauacauaagacugauccaagcacacugaccgagga

SEQ ID NO: 28451 - RNA, 46 nt, Mus musculus
ucagagugaagucuguagauaaaucccgacaccaaagagccaagaa

SEQ ID NO: 28452 - RNA, 46 nt, Mus musculus
gcacaggccagccaagcccagaacccaaguaaaggugaaaggagaa

SEQ ID NO: 28453 - RNA, 48 nt, Mus musculus
agucacucccggcccucgccacggcaauuacugcguguucuuggcagu

SEQ ID NO: 28454 - RNA, 46 nt, Mus musculus
uagcuugaauguggucugugugcuauaccugggaacacuccaagaa

SEQ ID NO: 28455 - RNA, 45 nt, Mus musculus
agggaucugaaggcaugccuuccuccuuugauaacagcaccagau

SEQ ID NO: 28456 - RNA, 69 nt, Mus musculus
agacauagagucugacaugaucgucuuuguguuccaaggucuggcccagucccugacucaagagagugc

SEQ ID NO: 28457 - RNA, 47 nt, Mus musculus
gauguuccagagcaugugaaaccaaaugcucuuaauacggugccugu

SEQ ID NO: 28458 - RNA, 45 nt, Mus musculus
ccaugguucaguucaggagacugggggcaggaguuggcccacagu

SEQ ID NO: 28459 - RNA, 46 nt, Mus musculus
cucgaggacagacuccaaaagcuguggauguccuugccaaggagau

SEQ ID NO: 28460 - RNA, 35 nt, Mus musculus
ugaaacugcagccucucucaccugugcccagguag

SEQ ID NO: 28461 - RNA, 45 nt, Mus musculus
ccaacacaaaaacuugaagcauguauugacagagaccugggagcu

SEQ ID NO: 28462 - RNA, 46 nt, Mus musculus
gagcggagguucuccugggguccccguggacaaacucauugcagaa

SEQ ID NO: 28463 - RNA, 46 nt, Mus musculus
acacauucauuuuaccagagccacaggcugaugaaccagcccagac

SEQ ID NO: 28464 - RNA, 45 nt, Mus musculus
gucccuuauguucugggaccaugcacuuacagauugauagcaguc

SEQ ID NO: 28465 - RNA, 46 nt, Mus musculus
uaguguuuauauugagaacaguuuggacacaauuguagcuggagac

SEQ ID NO: 28466 - RNA, 46 nt, Mus musculus
uccuauuaccugcagacaugcauacagcuuuuauuuguccccuagg

SEQ ID NO: 28467 - RNA, 48 nt, Mus musculus
gcacagagagcaauggagaggguagaggcacaggagagagacagccau

SEQ ID NO: 28468 - RNA, 46 nt, Mus musculus
gucauuuuaugguugggggaucacuacaacagggggaacuguauua

SEQ ID NO: 28469 - RNA, 41 nt, Mus musculus
agggacucugcuaaugaacucuccauauguagccugcgagu

SEQ ID NO: 28470 - RNA, 46 nt, Mus musculus
ugccggugaugugcaggacgggggccauauaacuucaugcuaagug

SEQ ID NO: 28471 - RNA, 41 nt, Mus musculus
ccaccauaaagaaacugagacucaagagagacuucuccaga

SEQ ID NO: 28472 - RNA, 45 nt, Mus musculus
acauuugaagacucaaacucuuaugucugagauuuugaacccaaa

SEQ ID NO: 28473 - RNA, 42 nt, Mus musculus
ugggaauuugacugguccccucuuccccacugagggucucac

SEQ ID NO: 28474 - RNA, 42 nt, Mus musculus
uuuuagucaggccaaggggcucccuucaccccagccccgccu

SEQ ID NO: 28475 - RNA, 42 nt, Mus musculus
cauccgcuccacgcuuucaggugcauugagcauugcacagau

SEQ ID NO: 28476 - RNA, 45 nt, Mus musculus
gugugugugugugugugugugugugugugccugugugugcgugcg

SEQ ID NO: 28477 - RNA, 44 nt, Mus musculus
guuacagccccuauuuugcacgcuaagaccuagaguuucugguu

SEQ ID NO: 28478 - RNA, 46 nt, Mus musculus
agcuaugcucauagguaucagucuguuuuggacuaguauuaaagau

SEQ ID NO: 28479 - RNA, 87 nt, Mus musculus
gaccacuggagcuuugcuagcaauaacugacuuucaguguaauguucugaaggcgcggggacucagcacagaauucacuuuaaaugg

SEQ ID NO: 28480 - RNA, 47 nt, Mus musculus
cuacagugcccuccaacccucaguuuuucaguucccacugccuaaug

SEQ ID NO: 28481 - RNA, 46 nt, Mus musculus
cagugccuccgugauucccuuaagaaugcuaacacuugcccaacua

SEQ ID NO: 28482 - RNA, 42 nt, Mus musculus
uugcgccaagaccaugcugacagcuguguggugagcagugau

SEQ ID NO: 28483 - RNA, 42 nt, Mus musculus
agcacaaugaggacaagaaauccucaaagaaagcggcguggu

SEQ ID NO: 28484 - RNA, 42 nt, Mus musculus
aaauuguaaaccacaggauggguauucagugggcaugagaga

SEQ ID NO: 28485 - RNA, 45 nt, Mus musculus
uccgaagguccagaguucaaaucccagcaaccacguggcucacaa

SEQ ID NO: 28486 - RNA, 46 nt, Mus musculus
cacuagagaagagggaaggcugggguguguaaagugagcacuagac

SEQ ID NO: 28487 - RNA, 46 nt, Mus musculus
aucuaugacaaugagcugccccugggcaacaccucagcuuccagac

SEQ ID NO: 28488 - RNA, 46 nt, Mus musculus
cugggaggaaguuuucgguggugugaguuuuaauaucagcuuuucu

SEQ ID NO: 28489 - RNA, 45 nt, Mus musculus
gauucauugagcaacaaaguucucaaugcuuugaaaccagaaaaa

SEQ ID NO: 28490 - RNA, 45 nt, Mus musculus
uagaucauagaugaaauccugaagauuaaugaagaccccagagug

SEQ ID NO: 28491 - RNA, 44 nt, Mus musculus
aggcagcaaguggcuauaaagggaauuagagacagcccaggauc

SEQ ID NO: 28492 - RNA, 42 nt, Mus musculus
aggauuuguccacuuccacugcuuuguuguaggggcugaaau

SEQ ID NO: 28493 - RNA, 46 nt, Mus musculus
cuuuaaacucauaaucccccugccccagccuccuaagugccaagau

SEQ ID NO: 28494 - RNA, 46 nt, Mus musculus
agacagaauccaaagaagcaggucggccauguccaggacacucagu

SEQ ID NO: 28495 - RNA, 53 nt, Mus musculus
gugaaagggaggaggggagaugaagucuuaaugccauuuagaucauuucuaag

SEQ ID NO: 28496 - RNA, 45 nt, Mus musculus
cagaaagguuuucauuuauaaagaggaguaagccuaggugugaga

SEQ ID NO: 28497 - RNA, 46 nt, Mus musculus
uuccaucaacaggggaccaaguauuaaaaucuauaagccuguaggg

SEQ ID NO: 28498 - RNA, 46 nt, Mus musculus
uuucuccauguagcccuggcuguccuggagcucacucuguagacca

SEQ ID NO: 28499 - RNA, 46 nt, Mus musculus
agagguggaaacgaaaagcagacugacugcuagagaugugccagug

SEQ ID NO: 28500 - RNA, 46 nt, Mus musculus
cuauuaggacaacaacgagguuccacccccacccccgcccccaccc

SEQ ID NO: 28501 - RNA, 44 nt, Mus musculus
uguagcuauaacuucuuucugccccuuacuucaacuauuuuagg

SEQ ID NO: 28502 - RNA, 46 nt, Mus musculus
gcugggucagcuguacggcugcgagguaccuggacacuggcugggg

SEQ ID NO: 28503 - RNA, 44 nt, Mus musculus
augucaguugaguacaggcuaggaaaaaaauguguauguagaga

SEQ ID NO: 28504 - RNA, 45 nt, Mus musculus
ucuggaagcagagaaguuugcucgcucgauagcaggcgggacccu

SEQ ID NO: 28505 - RNA, 45 nt, Mus musculus
uuucagccucuaccccauaguccucuuuacucaaggcaccccacu

SEQ ID NO: 28506 - RNA, 41 nt, Mus musculus
aggagaaggagaaggagaaggagaaggagaagaaaugagcc

SEQ ID NO: 28507 - RNA, 46 nt, Mus musculus
uuaguauuauuuaugaauaauauaagugguuacugagagagagaga

SEQ ID NO: 28508 - RNA, 41 nt, Mus musculus
aauaaaugaugcgaaugccaguguuaaucccagcaccagag

SEQ ID NO: 28509 - RNA, 46 nt, Mus musculus
uccagauggcugagagcccccaugugguugcuggaaacaaccaggu

SEQ ID NO: 28510 - RNA, 46 nt, Mus musculus
ugauggacuaaucuacagacaagcuauugcuguucaucagcugggg

SEQ ID NO: 28511 - RNA, 41 nt, Mus musculus
aacaccucucauggggucgcucagaccauuagaaagcacag

SEQ ID NO: 28512 - RNA, 46 nt, Mus musculus
ucuuaaaacccacgcccauagugacacaccuauuccaaggccacac

SEQ ID NO: 28513 - RNA, 45 nt, Mus musculus
uugcuauuucauuuucagcaaaaacuucaagcaccgaaaguaaga

SEQ ID NO: 28514 - RNA, 46 nt, Mus musculus
cuugaaaacuuaggccugcagggucagcgacagccaccagggggag

SEQ ID NO: 28515 - RNA, 46 nt, Mus musculus
gcaagagugucaucaugugauggugauccuagaucuggggaggcag

SEQ ID NO: 28516 - RNA, 37 nt, Mus musculus
uucuggcugccauauacaauggagagagagagagaga

SEQ ID NO: 28517 - RNA, 44 nt, Mus musculus
agccaggagccaugggauuaaaugaaggugaaggagaccccaag

SEQ ID NO: 28518 - RNA, 45 nt, Mus musculus
cuggguggaguggauccucgucucugggugggauacaguagcggg

SEQ ID NO: 28519 - RNA, 45 nt, Mus musculus
ccacccagaaggcgccagagagucagaucaauccuguccagccag

SEQ ID NO: 28520 - RNA, 46 nt, Mus musculus
uaugcacugagcuguuucucagcacuauauugcuacucucacagau

SEQ ID NO: 28521 - RNA, 45 nt, Mus musculus
aacaacacuacauucugcugaugccuuaacagcucugcccccuga

SEQ ID NO: 28522 - RNA, 46 nt, Mus musculus
ucccucuuuauaagcacagucucuuaguaaacucaugggccuugau

SEQ ID NO: 28523 - RNA, 46 nt, Mus musculus
caaagagccagauauuauuguucacccuuacaguauaggucaagac

SEQ ID NO: 28524 - RNA, 44 nt, Mus musculus
aacuugcacugucaugcagucauacguauaaauuggcagccaaa

SEQ ID NO: 28525 - RNA, 46 nt, Mus musculus
cuuuaggcgagaggaaaaaggguuuaaauuaaauaaucaggcagau

SEQ ID NO: 28526 - RNA, 45 nt, Mus musculus
ccaggaaccuugucuuggcuccauuuuucucucagcugccucguu

SEQ ID NO: 28527 - RNA, 46 nt, Mus musculus
gguuugacagcgaaacaugugugggacuagaaacuucaaaucaggc

SEQ ID NO: 28528 - RNA, 46 nt, Mus musculus
ucccccuuuauaagcacagucucuuaguaaacucaugggccuugau

SEQ ID NO: 28529 - RNA, 46 nt, Mus musculus
guggugugugugcgguguguguguauaugguaugggguguaugggu

SEQ ID NO: 28530 - RNA, 54 nt, Mus musculus
gugugaaugcccacacccauuugugugguguggugugguguaugguauggugug

SEQ ID NO: 28531 - RNA, 46 nt, Mus musculus
agaacccaaagaacagauugugagugauagccauccuugccccgag

SEQ ID NO: 28532 - RNA, 41 nt, Mus musculus
aagaaaaaagaaagacagacagacagacagacagacagaca

SEQ ID NO: 28533 - RNA, 46 nt, Mus musculus
uccaugccguaaccuuccuucgaacuccugagauuguuacaguaaa

SEQ ID NO: 28534 - RNA, 45 nt, Mus musculus
acauccagaccagcagcauguuguagcuaccgguggccaggaugg

SEQ ID NO: 28535 - RNA, 46 nt, Mus musculus
gggaucacacuaaaagauaaaagcugagaaucuuauuccugugcag

SEQ ID NO: 28536 - RNA, 46 nt, Mus musculus
ccuaucuggaaaaacaaaaaacaacaaaacaagaaaauguaaagag

SEQ ID NO: 28537 - RNA, 46 nt, Mus musculus
uuccacccguccaacccagaucaccuguucacuuguucugaagaug

SEQ ID NO: 28538 - RNA, 46 nt, Mus musculus
uuuucaugaaagugaaaaaaccuaguuaucaaaauuuuaucaccag

SEQ ID NO: 28539 - RNA, 27 nt, Mus musculus
gucuggguauaagaugauagguaccga

SEQ ID NO: 28540 - RNA, 45 nt, Mus musculus
ucuagccaggcuugcuggcuuacaccuauaauaccagcacuucag

SEQ ID NO: 28541 - RNA, 46 nt, Mus musculus
cuaugacuccugcugcucccagaacuccaaccaccaugacguccag

SEQ ID NO: 28542 - RNA, 46 nt, Mus musculus
agugguuuccacauuccccaugagguaguggcugguggucugcagu

SEQ ID NO: 28543 - RNA, 47 nt, Mus musculus
agcugggagcuggcacuguacgucacaggccucucgagaacuaagau

SEQ ID NO: 28544 - RNA, 46 nt, Mus musculus
uccuucacucucugcaccuaguaaguggcuuuuuauagcuggacag

SEQ ID NO: 28545 - RNA, 24 nt, Mus musculus
uccccaccucagugccagacaggc

SEQ ID NO: 28546 - RNA, 45 nt, Mus musculus
ucaagacugcggccaucgaacuugaguuuccuagcgccucucgaa

SEQ ID NO: 28547 - RNA, 45 nt, Mus musculus
ucaaaucccaacaaccacaugguggcucacaaccaucuguacagu

SEQ ID NO: 28548 - RNA, 45 nt, Mus musculus
ggcucacaaccguccguaaugagaucugacucccucuucuggagu

SEQ ID NO: 28549 - RNA, 46 nt, Mus musculus
acuguaaauguucacaaguggcuauguuuuaaauaaacaggauuau

SEQ ID NO: 28550 - RNA, 46 nt, Mus musculus
aaccauaugcauuuuaaaagaauuaugaaauuaucagugcuuggaa

SEQ ID NO: 28551 - RNA, 46 nt, Mus musculus
ucaugcuccuuuuaagccuuaccugagaaaagcaaugccauaaggu

SEQ ID NO: 28552 - RNA, 46 nt, Mus musculus
ugucuucugaggacaucucugugaagccagcauuuaggugugagau

SEQ ID NO: 28553 - RNA, 46 nt, Mus musculus
cugagccaaaggccccgccuuccucugaaaccacaucuaaaguuca

SEQ ID NO: 28554 - RNA, 37 nt, Mus musculus
uuaacuuaaaauuguuuuuucuuuucuuccuuacaga

SEQ ID NO: 28555 - RNA, 46 nt, Mus musculus
caaucaaaacguuaaaauaggaguaaacuccaccaaagaggcagaa

SEQ ID NO: 28556 - RNA, 46 nt, Mus musculus
ugacaauauuggauuuguaggcccugugccaccaaaacccaaaggu

SEQ ID NO: 28557 - RNA, 45 nt, Mus musculus
auugacugcuuaaccaaagaaauugaucuuuuucaagcccgaggu

SEQ ID NO: 28558 - RNA, 46 nt, Mus musculus
ugcaaaagaaaaagcuggauaaacucaaaucugaggucaaugagau

SEQ ID NO: 28559 - RNA, 42 nt, Mus musculus
cucucuuugaagccguuccauccuggccuucuggugcaccag

SEQ ID NO: 28560 - RNA, 46 nt, Mus musculus
cccuaaacacuaagcaucuuggcauuuaagaaugggcuuccaugga

SEQ ID NO: 28561 - RNA, 46 nt, Mus musculus
uggcucagccguuaaagacuaggcucacaaccaaaauauaagaaau

SEQ ID NO: 28562 - RNA, 41 nt, Mus musculus
ggaaugccaaggccaggaagcaggagugggugaguugguga

SEQ ID NO: 28563 - RNA, 45 nt, Mus musculus
ggagacucagugcuucauggacaagaggguggcugaucuccagag

SEQ ID NO: 28564 - RNA, 41 nt, Mus musculus
cgggcuucgcuuauucuauccacaugugcuagagccggguc

SEQ ID NO: 28565 - RNA, 45 nt, Mus musculus
aacucugcaacgucuccucgagugguggucacucaacccaacaca

SEQ ID NO: 28566 - RNA, 45 nt, Mus musculus
ggcaagugagcauggguccugccuuuauccaucaccauccaccca

SEQ ID NO: 28567 - RNA, 49 nt, Mus musculus
cucacuugcccagacauguuccuggaggcugcagauggcccagaguuug

SEQ ID NO: 28568 - RNA, 46 nt, Mus musculus
ugcgguggcauuggcugaaauauagaccuuggguugacuacgggag

SEQ ID NO: 28569 - RNA, 67 nt, Mus musculus
ucgaacugccagcacuuccucauuggucaacagccagaccuuaaauagaaaucagcccacuguuuac

SEQ ID NO: 28570 - RNA, 113 nt, Mus musculus
cauagccaauauaacauucagaauauuucaacaggaccucgaaagaaccagauagaaaucaaacuugaacccccacaaagaaacaguucuucaaaauuacguucuucuggacc

SEQ ID NO: 28571 - RNA, 42 nt, Mus musculus
uccuuugccacauaccucaacccagcagccgaaucagcaggg

SEQ ID NO: 28572 - RNA, 61 nt, Mus musculus
gguacagcucggcagacacaacaacauucuggcugggugucucaguuuaaucccaugaacc

SEQ ID NO: 28573 - RNA, 46 nt, Mus musculus
uauaaggccuaauauagauagaauuucccuguggacuguucaguac

SEQ ID NO: 28574 - RNA, 59 nt, Mus musculus
uacugaacaguccacagggaaauucuaucuauauuaggccuuauauuacaacuccuagu

SEQ ID NO: 28575 - RNA, 67 nt, Mus musculus
acucaaaucuuccacaagcucaaagauugcugcauauaugauugauuuccaauaaguauuuuucugg

SEQ ID NO: 28576 - RNA, 45 nt, Mus musculus
uaauuuuccauccagugcuccgauuuuuuucucccauguccaaga

SEQ ID NO: 28577 - RNA, 44 nt, Mus musculus
uuucugauuuuuaaaauauaacugguugcagggcagugguggcu

SEQ ID NO: 28578 - RNA, 50 nt, Mus musculus
cagaaacugggaagagggguaagucucacuuuuuuaguuagauagaaggu

SEQ ID NO: 28579 - RNA, 45 nt, Mus musculus
gacagagaccaaccagcauaaaaguaauaaaguaggagucaaagu

SEQ ID NO: 28580 - RNA, 72 nt, Mus musculus
aggccgcaugguaugcaguuuuaagccacacgggugggagaguggcuacucugcuguacuguucacaaagau

SEQ ID NO: 28581 - RNA, 42 nt, Mus musculus
cuugauagugaguguaaggaaguagacagagccuucaaggau

SEQ ID NO: 28582 - RNA, 41 nt, Mus musculus
cuuaucuacaguagaagagaagaaaaucacgcagucuggaa

SEQ ID NO: 28583 - RNA, 42 nt, Mus musculus
aucccuaccauauacuuuuuaaguacuuaguauacagcagug

SEQ ID NO: 28584 - RNA, 46 nt, Mus musculus
uuaaugaacaaaaaguucugaaacugaagaaaaguguaacacagug

SEQ ID NO: 28585 - RNA, 46 nt, Mus musculus
aacucagaucuaucugccuuccucugccucccaaguaaugggauua

SEQ ID NO: 28586 - RNA, 42 nt, Mus musculus
ggcauggucaccucccuuacaucuccuaacacauggcgagca

SEQ ID NO: 28587 - RNA, 46 nt, Mus musculus
aaauaggagagcaguuaaaagauaacaggagacacaauauugagag

SEQ ID NO: 28588 - RNA, 46 nt, Mus musculus
acuuccaugucaaguuuuuaaaacuauuuugaaagaaaguuguggu

SEQ ID NO: 28589 - RNA, 42 nt, Mus musculus
auugaaauugagaacagugacuacaccagagaugaggaggag

SEQ ID NO: 28590 - RNA, 46 nt, Mus musculus
cuggcaaggcuuugagcaaaaggaaagucacauguauacugcugau

SEQ ID NO: 28591 - RNA, 46 nt, Mus musculus
uucagaaagccggaauggauuucuacagauacagggacugauggga

SEQ ID NO: 28592 - RNA, 56 nt, Mus musculus
uuuauuaguccacaggagcauuaguaguucugagugucgccgugaggacggaagca

SEQ ID NO: 28593 - RNA, 45 nt, Mus musculus
uugcaaaacaaagucuaauguuugauuuauuaagaacauuuuagu

SEQ ID NO: 28594 - RNA, 46 nt, Mus musculus
uaugcuugaguuaggauguggcccuauuuagagguguggccuuguu

SEQ ID NO: 28595 - RNA, 44 nt, Mus musculus
ucuaaguauucuucacacaggucagagaagaccucaagcggaga

SEQ ID NO: 28596 - RNA, 42 nt, Mus musculus
ucuuagauuacagcaauggaauugagacagugagggagggag

SEQ ID NO: 28597 - RNA, 45 nt, Mus musculus
cagguucagagguucaauucacugucaaggcaggaacauggcagc

SEQ ID NO: 28598 - RNA, 46 nt, Mus musculus
acaccaauauaagaauacuuagugaccugguuuaagcaccgggaug

SEQ ID NO: 28599 - RNA, 50 nt, Mus musculus
augguggcucacaaccauccguaacaaaaucugacccccucuucugagug

SEQ ID NO: 28600 - RNA, 45 nt, Mus musculus
guugugagccaccauguggaugcugggauuugaacucuggaccuu

SEQ ID NO: 28601 - RNA, 45 nt, Mus musculus
cauacauauuauacacauuuuuguagauuuauaccuaggccuuac

SEQ ID NO: 28602 - RNA, 46 nt, Mus musculus
acaagcaaccaucuuuacuuuuagaaacuaaagaaaacgaagcaug

SEQ ID NO: 28603 - RNA, 46 nt, Mus musculus
auggaacacagugcuuaacauucugaagacuggcuacaguggagaa

SEQ ID NO: 28604 - RNA, 45 nt, Mus musculus
gucucacaugagagagauugcaccuagucuccgaguuagaaagac

SEQ ID NO: 28605 - RNA, 46 nt, Mus musculus
ugauuuuuuaugauuuaccagugagagaaaauacuuuggaauagaa

SEQ ID NO: 28606 - RNA, 46 nt, Mus musculus
aagcuaauaacuaauguagaguugggaaggucaauggaggagagaa

SEQ ID NO: 28607 - RNA, 45 nt, Mus musculus
ggggcuucaggaaaagagucugauucacagacagguccagcagag

SEQ ID NO: 28608 - RNA, 45 nt, Mus musculus
uuccugaagccccgggagcucauuccacaguugauuagcagacga

SEQ ID NO: 28609 - RNA, 41 nt, Mus musculus
ugacaagccaaguuucaguccaugguccaccacaguaggag

SEQ ID NO: 28610 - RNA, 54 nt, Mus musculus
ggaagaaagaaagaaagaaagaaagaaagaaagggaagagggagagagggaggg

SEQ ID NO: 28611 - RNA, 46 nt, Mus musculus
acacugaacacagacaaaauuguucucauauaguuuauagguagag

SEQ ID NO: 28612 - RNA, 46 nt, Mus musculus
ugcugaugcuguagaauccuuggcucauaauuguaggccgaaagug

SEQ ID NO: 28613 - RNA, 46 nt, Mus musculus
uggcacuguguuuaccaccuugugcugguuuccuauucagagagau

SEQ ID NO: 28614 - RNA, 42 nt, Mus musculus
gagacaccggccucgggcuccagcucccgggcgggauccacc

SEQ ID NO: 28615 - RNA, 45 nt, Mus musculus
gaaaguuaaucuuuaagccgcucgcugaguucgaguuuaagagga

SEQ ID NO: 28616 - RNA, 45 nt, Mus musculus
acagcuguaauaacucauuuuucuauucacacacucaaaagccag

SEQ ID NO: 28617 - RNA, 46 nt, Mus musculus
gcccgagacuucuaguugcuaagaaaggucagggggauaaggcuaa

SEQ ID NO: 28618 - RNA, 45 nt, Mus musculus
ugcuuggcuauagggaguggcacuauuaggaguuguauccuuauu

SEQ ID NO: 28619 - RNA, 45 nt, Mus musculus
uucaggggaaugccagggccaagaagugggagugggugguuuggg

SEQ ID NO: 28620 - RNA, 46 nt, Mus musculus
gguuucuuacuccuuggaggccauguaggccaugagguccgccacu

SEQ ID NO: 28621 - RNA, 43 nt, Mus musculus
gagagagagagggagagagagagagagagaaagggggggugaa

SEQ ID NO: 28622 - RNA, 46 nt, Mus musculus
cgaucgaaguuuuguuaacgcuuugggauugucaagcucauuggaa

SEQ ID NO: 28623 - RNA, 112 nt, Mus musculus
ccgaugaaggucgaugaagaaaggcaacagcagcuucacuggaacaugcaugaggaccugaggagugagccgcucaccaugacggucggggaacaggccuguucagaugcag

SEQ ID NO: 28624 - RNA, 62 nt, Mus musculus
aucaucaucgaugaaggcccuccugagagugcacuucacagagauaagaagaggcguucaga

SEQ ID NO: 28625 - RNA, 51 nt, Mus musculus
ucugugacuuugaauguuacaguuucucccuaucguguggauaauucuugg

SEQ ID NO: 28626 - RNA, 75 nt, Mus musculus
aguuccugaucuauguucauucagaauguaaaaauguagagaaacaagaaaauguucuugaaggaucagccggug

SEQ ID NO: 28627 - RNA, 51 nt, Mus musculus
caggauuuggccuggcuacagaagagaagaggaauaaaacucuaccagaga

SEQ ID NO: 28628 - RNA, 46 nt, Mus musculus
acacugguaauucauugauguuaacuuugaaagucucaaaacccag

SEQ ID NO: 28629 - RNA, 68 nt, Mus musculus
cuaacaagacuagacuucaugagugaugcagguuccagaaugaaaaaguucaaucagcucaugaagag

SEQ ID NO: 28630 - RNA, 24 nt, Mus musculus
caguagucagagauuaugcuggcc

SEQ ID NO: 28631 - RNA, 46 nt, Mus musculus
gcuggaagaagaggaggaggguucagagagcgagcccgagggucag

SEQ ID NO: 28632 - RNA, 46 nt, Mus musculus
aagacaguggagguucuggcucugauucugacacauacccgacaag

SEQ ID NO: 28633 - RNA, 97 nt, Mus musculus
gaaaauggcuuguauucaggguugguuaccugcaaguaacugcagagaaugggacuuugguuuccugggagguuuucuuaagugaugaagaccaacu

SEQ ID NO: 28634 - RNA, 46 nt, Mus musculus
acaguaaguccuguuagugcgucacauaucuugucaacacuagaag

SEQ ID NO: 28635 - RNA, 46 nt, Mus musculus
uagaacuuagugauugacugauagcuuaguauuaauagauuguuag

SEQ ID NO: 28636 - RNA, 75 nt, Mus musculus
ucaucccaacucacuguccuagagaaaaagugaaaaauagagaaauccaggauacagaauaugaaccaaaagaga

SEQ ID NO: 28637 - RNA, 62 nt, Mus musculus
ggaguuucuauucuuucuaucuauaaguaugucagcuccauauucagauaugauguucagcg

SEQ ID NO: 28638 - RNA, 55 nt, Mus musculus
cagaucaaaggccaugguuucucugggacuuuuacacuggggaagaauuacaaag

SEQ ID NO: 28639 - RNA, 48 nt, Mus musculus
gggaguccaaggaaaauugagaaggaauugaggaaaucagugaacaag

SEQ ID NO: 28640 - RNA, 46 nt, Mus musculus
acgaugagccuuacuauuauuacuguaaggcgggaaaaagccggag

SEQ ID NO: 28641 - RNA, 67 nt, Mus musculus
aucuggauucccaaggugaugcuccagcugcuggagucugugcaaguacugauguucaugugucaga

SEQ ID NO: 28642 - RNA, 71 nt, Mus musculus
aaauacaugugucucugaagacaagcaaacccaagaagcaaaagacugugcugagucgccaaacccugcug

SEQ ID NO: 28643 - RNA, 46 nt, Mus musculus
ucaaauuggccacaagccaagaguucaaugucugaagugucaccug

SEQ ID NO: 28644 - RNA, 46 nt, Mus musculus
uuaugaggagaaaaaccugaagguuaagccuuuuuacugcccccac

SEQ ID NO: 28645 - RNA, 47 nt, Mus musculus
cuauaggucucaacucaaccugaguuccaaagguuuaaaccugagaa

SEQ ID NO: 28646 - RNA, 46 nt, Mus musculus
uggugaguccugucucuuugugguuugugagugagcuuaugcagag

SEQ ID NO: 28647 - RNA, 45 nt, Mus musculus
auacugcaagaaaaauccucagcaccuguacaguuuuauugccaa

SEQ ID NO: 28648 - RNA, 46 nt, Mus musculus
gugugccaccacugccuggcaaauuaagggaaauuugaagcagaaa

SEQ ID NO: 28649 - RNA, 46 nt, Mus musculus
cauuuucuccaauauagaacugaauaaaaauuaguugaguccucag

SEQ ID NO: 28650 - RNA, 45 nt, Mus musculus
ccugucuggcuuacauagagccuaauuuuaaucuccagcacucaa

SEQ ID NO: 28651 - RNA, 45 nt, Mus musculus
aguacaaacgggaaacugcguaagcgugagcugcuggugguggug

SEQ ID NO: 28652 - RNA, 42 nt, Mus musculus
ccagagugucaugaauacuucuuuauuacugucgaugaccaa

SEQ ID NO: 28653 - RNA, 32 nt, Mus musculus
caccuuuaaaaaaaaaaaagacaggaguaauc

SEQ ID NO: 28654 - RNA, 45 nt, Mus musculus
uaaaacagcuuugaaacacaaauuuuacauaaaauaucguucguc

SEQ ID NO: 28655 - RNA, 45 nt, Mus musculus
uauuaucauuugcaagaucacauagguuugauguugaauauguag

SEQ ID NO: 28656 - RNA, 46 nt, Mus musculus
aaagccaaacccacccguccaucacaucauugaaccacacgaggua

SEQ ID NO: 28657 - RNA, 46 nt, Mus musculus
uuucccugcccuguaugcugcuucucgucacuacagucaguuucag

SEQ ID NO: 28658 - RNA, 46 nt, Mus musculus
acgugcugaacaaaugaaaaauaguguuacuauaugauaccaagaa

SEQ ID NO: 28659 - RNA, 45 nt, Mus musculus
uucgagaccaaagaaaguaauguugauacucuaaugcagagccca

SEQ ID NO: 28660 - RNA, 86 nt, Mus musculus
ccagcaaggccgcaccuccuaauagcaccacuuuucauaggccaagcauauucaaguacgacaguccuuucuggaccacuaacacu

SEQ ID NO: 28661 - RNA, 55 nt, Mus musculus
uuuuaaaagcuggauaauaauuuugaggccuaauuauauaaauaagauugugcac

SEQ ID NO: 28662 - RNA, 46 nt, Mus musculus
cugugguguuugaagcagcaugggcuuuaccuuggugaaugggugu

SEQ ID NO: 28663 - RNA, 42 nt, Mus musculus
aguguguugguucugaggcagcucacucugguaaaugggcac

SEQ ID NO: 28664 - RNA, 46 nt, Mus musculus
ucccauuccuacucauccccuucacagaauuuucuaagcacccaaa

SEQ ID NO: 28665 - RNA, 45 nt, Mus musculus
agccauggaauguuuuaggagagacuuaaugagccauccuaguag

SEQ ID NO: 28666 - RNA, 42 nt, Mus musculus
agaacucugaugaaaauacaacuuagagauccaggggccaaa

SEQ ID NO: 28667 - RNA, 45 nt, Mus musculus
gcccauaggaauaggauuuugagagauuuuuauugcagaguaaaa

SEQ ID NO: 28668 - RNA, 46 nt, Mus musculus
gcucacaaccauccguaacgagaucugauucucucuucuggagugu

SEQ ID NO: 28669 - RNA, 46 nt, Mus musculus
uuaaaaaaaaaaagagagcauagcauaguguuugucccuuuauuac

SEQ ID NO: 28670 - RNA, 45 nt, Mus musculus
uuccccuauuuccccuaggauaucgacuagauagcuuaaguuuga

SEQ ID NO: 28671 - RNA, 47 nt, Mus musculus
gccgucacaucauuccacacaauguuaagauagaacuucacuuccag

SEQ ID NO: 28672 - RNA, 46 nt, Mus musculus
ggaauuaagaaaagggguauuaaauaauuuuuccauuaguagauag

SEQ ID NO: 28673 - RNA, 46 nt, Mus musculus
gaucuaaugcucaggaggaaacucgccuaugauauguagcaaacag

SEQ ID NO: 28674 - RNA, 46 nt, Mus musculus
uacauauaagugaauaacauaaauaugccugcugaguucuguccag

SEQ ID NO: 28675 - RNA, 45 nt, Mus musculus
uauucagguuucguuuucuguuuuaaucuuacaguugcucucuca

SEQ ID NO: 28676 - RNA, 41 nt, Mus musculus
ccaccucgaugaaaugcugcaacugaggguccacggcgccc

SEQ ID NO: 28677 - RNA, 46 nt, Mus musculus
gacggaacuuugcugggagaagugcauggauaagccugggccuaag

SEQ ID NO: 28678 - RNA, 44 nt, Mus musculus
cucuucaauucuugaacuacuuuuccaaagagguaaugcugaga

SEQ ID NO: 28679 - RNA, 46 nt, Mus musculus
agccuuucugacugaucucagcauuaccucuuuggaaaaguaguuc

SEQ ID NO: 28680 - RNA, 50 nt, Mus musculus
gggacaucuugucaccugagaaugaacaaagaccaauuuuuauguauggg

SEQ ID NO: 28681 - RNA, 50 nt, Mus musculus
ggguaaaucuugauuuguauggguucauuucugauuuuuuuagggagauc

SEQ ID NO: 28682 - RNA, 46 nt, Mus musculus
cagugccaggaucuuuccccacugccaauuugacugacacaaagau

SEQ ID NO: 28683 - RNA, 46 nt, Mus musculus
uauacugugacuuacuuaacucgcaaauugaaaauauggucucaag

SEQ ID NO: 28684 - RNA, 67 nt, Mus musculus
aucuagcucaugaguacuauucuuauuaccagacagccacgagaagaaguuaacuuacuauguauau

SEQ ID NO: 28685 - RNA, 86 nt, Mus musculus
ucgguuggguggguuggggggcaagggugucuauuugcagcauagauauuuugagacgaagaaaauuguuuuauauaaggggagag

SEQ ID NO: 28686 - RNA, 46 nt, Mus musculus
uuugguagccuaacacauauaucaucgcuaccuuucccaagaagca

SEQ ID NO: 28687 - RNA, 45 nt, Mus musculus
gggaagugagaugacagaagaacccucagagguauaagaagagau

SEQ ID NO: 28688 - RNA, 45 nt, Mus musculus
gggucuuggcuagaagacaggugucuguaaagcagucugugacac

SEQ ID NO: 28689 - RNA, 67 nt, Mus musculus
uuaugaggagccauuaauuaaaauauaccacggagccaaagcagaucuuuauaaaacauuuucuuga

SEQ ID NO: 28690 - RNA, 54 nt, Mus musculus
agugacuuugaaaugucccugguacuacagggcaauacugagaucauuacucca

SEQ ID NO: 28691 - RNA, 45 nt, Mus musculus
caugaacaugaucucagugaaaaauggaccugacaaagcagagau

SEQ ID NO: 28692 - RNA, 45 nt, Mus musculus
ugcauguagugccaauggaggcaagaagaaggagaaguggggagg

SEQ ID NO: 28693 - RNA, 42 nt, Mus musculus
ugcuacuugauuagagacacuccccuuuggccaaggauagau

SEQ ID NO: 28694 - RNA, 46 nt, Mus musculus
aggaccugcuggccccaccucacgacacuagcacggaccucacgga

SEQ ID NO: 28695 - RNA, 42 nt, Mus musculus
gugugugugugugugugcgcgcacuguaucguuccuguaugc

SEQ ID NO: 28696 - RNA, 46 nt, Mus musculus
ucccccuauguuuuuauaaagaucuauguaucguuccuguaugcuu

SEQ ID NO: 28697 - RNA, 50 nt, Mus musculus
cagcauucugcauugagcuacucacuugacacugacccaggcccacaguu

SEQ ID NO: 28698 - RNA, 45 nt, Mus musculus
ucugcuauagcagugacuuggaaacuuucuugacaacaagcagua

SEQ ID NO: 28699 - RNA, 55 nt, Mus musculus
aaacuccugcggcagcacaaagggcggcuggaggcgaggaugcaaauuuuggaag

SEQ ID NO: 28700 - RNA, 115 nt, Mus musculus
cugcagguggaguaugagcagcugaaggagcagcaccuaagaaggggucucccugugggcuccccuccagacuccaucguaucuccucaccacacaucugaggacucagaacuua

SEQ ID NO: 28701 - RNA, 47 nt, Mus musculus
ugugagucagccgcagaguccagcucagauccugaaguccguggaga

SEQ ID NO: 28702 - RNA, 45 nt, Mus musculus
gucugugugugugugucugugucuguguguuugugugugucugug

SEQ ID NO: 28703 - RNA, 45 nt, Mus musculus
cauuuaauuggggcugccuuacagguucagagguucaguucauua

SEQ ID NO: 28704 - RNA, 46 nt, Mus musculus
guugcuuuagugugugugcccuccauccuuacaccuugcccaucug

SEQ ID NO: 28705 - RNA, 46 nt, Mus musculus
gggauaguauccacaggcauuauauaacuaauuugacuugccuuuu

SEQ ID NO: 28706 - RNA, 46 nt, Mus musculus
gggauggaacaacagagagaugggccaggucaugauggugggcuuu

SEQ ID NO: 28707 - RNA, 48 nt, Mus musculus
uggaaaggacaaacggguccuuccuaacugauagcagcucuacaacag

SEQ ID NO: 28708 - RNA, 56 nt, Mus musculus
ucccaguccccucagcuguuucaugaugacacccacucaagaauagagcaauacgc

SEQ ID NO: 28709 - RNA, 46 nt, Mus musculus
cguuuuauguuucauugucaucuccuuaaagauaaaguuggcaaaa

SEQ ID NO: 28710 - RNA, 101 nt, Mus musculus
ugugagagauuucacuaaggugcugaagaacaaguucagguccaagaaauauuuugccaaacauccucggcuuggcuaccugccuguccagaccgugcugg

SEQ ID NO: 28711 - RNA, 45 nt, Mus musculus
ugucagggaaagagaaggaagcaaaagugcuugggaacuguagau

SEQ ID NO: 28712 - RNA, 45 nt, Mus musculus
acacccaguauuuucacagugccgcacuaucacuagcuuugaaag

SEQ ID NO: 28713 - RNA, 45 nt, Mus musculus
gaguaauuagagaggacuuuaaaauauucuugauaggggcuagag

SEQ ID NO: 28714 - RNA, 46 nt, Mus musculus
aggauaaugaaaugcacauuuagaagugugcaugugucccucagcu

SEQ ID NO: 28715 - RNA, 46 nt, Mus musculus
ucuccucccuuuugccagcauccuuguguucugaaggcugugagua

SEQ ID NO: 28716 - RNA, 45 nt, Mus musculus
ccuuuggcuauauaauauucuuaaugcucugaauuuguaggugga

SEQ ID NO: 28717 - RNA, 46 nt, Mus musculus
uuuuggguagaggacguggugaucucuuaagauugggcuccaaaua

SEQ ID NO: 28718 - RNA, 45 nt, Mus musculus
caccaaccuaucagcuuauugccuaugacuguguuuguguuuaga

SEQ ID NO: 28719 - RNA, 46 nt, Mus musculus
uaccuugacaucuaccuuaaaaaaugggcuuaaacagugcucaggu

SEQ ID NO: 28720 - RNA, 46 nt, Mus musculus
aucuacuacagagcuuaacuuauaaccuuuccuaacuucuggagau

SEQ ID NO: 28721 - RNA, 44 nt, Mus musculus
cuaguccauuuuuaucugauuuguguugggaaucagccccagac

SEQ ID NO: 28722 - RNA, 45 nt, Mus musculus
ccaucuugcuuuuuaauuuccuggaugguaucauccuuucggugc

SEQ ID NO: 28723 - RNA, 46 nt, Mus musculus
gacauuuagggagcugauuauaaagaucugguauuaaaugggaaaa

SEQ ID NO: 28724 - RNA, 41 nt, Mus musculus
aagguaucuacuuguucuaugcuguuaugugcagcuggagg

SEQ ID NO: 28725 - RNA, 44 nt, Mus musculus
ugguuucuuaaucuuauuuuuauuuccuuauuuguuuggcugau

SEQ ID NO: 28726 - RNA, 46 nt, Mus musculus
aagaaagaagaaagaaagaaagagagagagagagagagagagagag

SEQ ID NO: 28727 - RNA, 45 nt, Mus musculus
ucucccugaauccuccuggguaacucuuaaguaucccaccccauc

SEQ ID NO: 28728 - RNA, 41 nt, Mus musculus
uuuaauguagauuuacuugaagcacagguguugggggagcg

SEQ ID NO: 28729 - RNA, 46 nt, Mus musculus
uacauaauggucauuuccaugagcaaacuuuaaauuagcgccagcc

SEQ ID NO: 28730 - RNA, 46 nt, Mus musculus
uaaaauuuaaaauuaguaauuagucacuagcuacaaguacucagau

SEQ ID NO: 28731 - RNA, 41 nt, Mus musculus
acagaaggcagguugucuaucuccucaaugugucuguagug

SEQ ID NO: 28732 - RNA, 46 nt, Mus musculus
guacugggaugagcuggcagaugacagaaaacuaauugccccagua

SEQ ID NO: 28733 - RNA, 46 nt, Mus musculus
aaagcaagagaaaagucacugcuuugcuugauuuagagacugagau

SEQ ID NO: 28734 - RNA, 49 nt, Mus musculus
aauuuaaagguaguugcacuccuaagguaaacacacaaagcaagacucg

SEQ ID NO: 28735 - RNA, 45 nt, Mus musculus
ggaugaaaggaucaugcuguggcaugagaagacagugccccgaca

SEQ ID NO: 28736 - RNA, 69 nt, Mus musculus
gcugcuguguuuaugaguaggccuuagugagugcugcuguauuuaugaguaggccuuagugagugcugc

SEQ ID NO: 28737 - RNA, 49 nt, Mus musculus
acaauagugcugugaccaggacugaaauugcuuggaggggaaaaaagag

SEQ ID NO: 28738 - RNA, 46 nt, Mus musculus
uccuuugcuucugucuugguugccugcucuaggcaagcuggaaguu

SEQ ID NO: 28739 - RNA, 46 nt, Mus musculus
ccuucucuccacugugcccucccacaucugaaaacagccaucagag

SEQ ID NO: 28740 - RNA, 46 nt, Mus musculus
uaucagggaagggaacuuccuuuuggguaagcaaggagaaggagga

SEQ ID NO: 28741 - RNA, 68 nt, Mus musculus
aauuggccacugcugguaucagugacuuucaauugaggguggcaaggaaggcggguagaagagagaac

SEQ ID NO: 28742 - RNA, 71 nt, Mus musculus
aggaaguuuaacuauugcauaauagaugguaaugguaaguuuuguuuguggagaagcgggaaaaggguaug

SEQ ID NO: 28743 - RNA, 92 nt, Mus musculus
uguggcguguugacaguuuugauaagaccaguuuagauggaggagaaauuuaggagccaaaggcaaauugauugaguagauaaugugacagc

SEQ ID NO: 28744 - RNA, 46 nt, Mus musculus
uacuuagcauuauugucacgcuauuagaauuuccuggggcaaagug

SEQ ID NO: 28745 - RNA, 44 nt, Mus musculus
ugaaaauggaggaaguggaauguccuucugggaauagagacaau

SEQ ID NO: 28746 - RNA, 48 nt, Mus musculus
aaucaugugagccuuuuaaaaggaagaaagcagcugaggagaagccag

SEQ ID NO: 28747 - RNA, 82 nt, Mus musculus
caaacccagcucccuggacguuuuaauccagaauucaauccgcuuaccaagaggaagaugugcaugauaauaaugggaagaa

SEQ ID NO: 28748 - RNA, 46 nt, Mus musculus
auuacaucaaguaaguccacuucaguucucuuuuauguaccaagaa

SEQ ID NO: 28749 - RNA, 46 nt, Mus musculus
gcaccaaucaacuuaaaaguaaaaacaaugaaugaccuguccaguc

SEQ ID NO: 28750 - RNA, 52 nt, Mus musculus
ccgagagaagugggaaaaucuaaaugcugucacuagcaacuggcaaaagcaa

SEQ ID NO: 28751 - RNA, 46 nt, Mus musculus
auuccccauuauuuuaaucagaaauaccuuuugauuaugaagagag

SEQ ID NO: 28752 - RNA, 45 nt, Mus musculus
augaauaucacugcaagaaaguucuguguaaguaaauaagucagc

SEQ ID NO: 28753 - RNA, 42 nt, Mus musculus
guuugaggaucagaguagagacuacugucuccgugcacaccc

SEQ ID NO: 28754 - RNA, 43 nt, Mus musculus
gcucgaguuuuucuggcugaucagccaauagaggcccccgaag

SEQ ID NO: 28755 - RNA, 46 nt, Mus musculus
cucucucucucccucucucucucucugugucagaugcccccgaggg

SEQ ID NO: 28756 - RNA, 45 nt, Mus musculus
aaagacauaaacagaguaaugggaacaggaaauguacagaacggg

SEQ ID NO: 28757 - RNA, 46 nt, Mus musculus
cauguagaguuuggccaucaucuaugacuuggggaaggagauuaga

SEQ ID NO: 28758 - RNA, 46 nt, Mus musculus
uacauguaagcuaaaauuucccuuuacacuguucuguccuggagau

SEQ ID NO: 28759 - RNA, 45 nt, Mus musculus
auacacauacacacacaccacucaaaaggcaaaaugcagagagaa

SEQ ID NO: 28760 - RNA, 41 nt, Mus musculus
cucugucagcccagaaagaaaggacgcaugucaaggagaga

SEQ ID NO: 28761 - RNA, 45 nt, Mus musculus
agaggaaaauuugggagaucuguuugacuuagccauguguagagu

SEQ ID NO: 28762 - RNA, 46 nt, Mus musculus
ggcucugagauugucaguuagaaagguaauacaggaucaugcuuua

SEQ ID NO: 28763 - RNA, 46 nt, Mus musculus
acauccauacaauacacaagauauucucuguacauauagcccagug

SEQ ID NO: 28764 - RNA, 46 nt, Mus musculus
aggggacgucccugccuuacagcuccaguaugaccacugcaaggua

SEQ ID NO: 28765 - RNA, 46 nt, Mus musculus
gaggccagugcugagaaauggaaccgguugcuggcaucgcuggaag

SEQ ID NO: 28766 - RNA, 46 nt, Mus musculus
gucagauauacaucaugcaacaagcauuuugcauuaggguucauaa

SEQ ID NO: 28767 - RNA, 46 nt, Mus musculus
acacgauuuucuuuguugauaauuauauucuggagaggagucagau

SEQ ID NO: 28768 - RNA, 91 nt, Mus musculus
uaagggugcuccuugaacacugguucguacugaugauugagaacuguuuuccuuccugccucucucccucucacucccccuuacccuccca

SEQ ID NO: 28769 - RNA, 46 nt, Mus musculus
aauuugaccuucaaauauuaacauuuugccuuuuguuuuagaaguc

SEQ ID NO: 28770 - RNA, 46 nt, Mus musculus
guaauaaaagcaauuuggggagggaaggcuuuaucucccucacacu

SEQ ID NO: 28771 - RNA, 45 nt, Mus musculus
auacaauuuauuuauaaugaagcuacauuacucuagccaccugca

SEQ ID NO: 28772 - RNA, 46 nt, Mus musculus
uacuauuuguuccaggauauucauagucauguuuuaaaccauacaa

SEQ ID NO: 28773 - RNA, 45 nt, Mus musculus
uuaacuguggauuaggucuuggguucaauccucagcacuaccaaa

SEQ ID NO: 28774 - RNA, 46 nt, Mus musculus
gugaaugugugugugugugcgcgcuuauguagauuugggucuauca

SEQ ID NO: 28775 - RNA, 49 nt, Mus musculus
gcaacaaugcuucagcaucgacuggaugacaugaaccaaagauggaaug

SEQ ID NO: 28776 - RNA, 30 nt, Mus musculus
gacaguaaauuccuucauuuacuguuuagg

SEQ ID NO: 28777 - RNA, 41 nt, Mus musculus
aagucagcugguaacuuaauugcaauuuauuuggggggaga

SEQ ID NO: 28778 - RNA, 46 nt, Mus musculus
gaaacaguguccggcuuuacagaaccccaaaaccaagugcuaauuc

SEQ ID NO: 28779 - RNA, 46 nt, Mus musculus
aguagccauuaccuugacuugugaauauguuuguuauuuaugagau

SEQ ID NO: 28780 - RNA, 46 nt, Mus musculus
guccaguccuugggaauccuaggugggaaggaauuuuagggcagac

SEQ ID NO: 28781 - RNA, 67 nt, Mus musculus
ccacaugguggcucacaaccaucuguaacaaggccugauucucucuucuggugucugaagacagcua

SEQ ID NO: 28782 - RNA, 46 nt, Mus musculus
aaacauuggauagaggucagggacuccuguaaaacaguaaaaggaa

SEQ ID NO: 28783 - RNA, 45 nt, Mus musculus
acaagcauuaacugagcuuuaaagaaaucaaagcaaacuguguag

SEQ ID NO: 28784 - RNA, 42 nt, Mus musculus
gugucuccuuucucguagucacuggaguugccauccaaaggg

SEQ ID NO: 28785 - RNA, 45 nt, Mus musculus
ucauuuaucacuaaacguuuuacuugggaggauggcaauacggau

SEQ ID NO: 28786 - RNA, 30 nt, Mus musculus
cggaacaugcacagacugcgcugggggagg

SEQ ID NO: 28787 - RNA, 66 nt, Mus musculus
agagcacuuucaaugcagugcauucauguuauuugggcuacaccugcuaguguagaaugugcauuc

SEQ ID NO: 28788 - RNA, 46 nt, Mus musculus
agacuaaguuacuguauuaggcuuagcggggugugugugugugugu

SEQ ID NO: 28789 - RNA, 46 nt, Mus musculus
cuuggugaagguuuacuguuggauucuaagaguaugaagggcaggc

SEQ ID NO: 28790 - RNA, 45 nt, Mus musculus
gguuguguuucauuuuaucaaugcuccccagaauuagugacagua

SEQ ID NO: 28791 - RNA, 42 nt, Mus musculus
aguuucuaagugagcguggcuuggugcuguaggacggaguug

SEQ ID NO: 28792 - RNA, 72 nt, Mus musculus
auaggggauuucuguagaaggcaguauagaggucaacagaagugaauggaaggaaggaaggaaaggaaaaga

SEQ ID NO: 28793 - RNA, 58 nt, Mus musculus
ucuuaauucauuucuuaauuaagcccucuuguuacauuuccaggagaaugaagggaga

SEQ ID NO: 28794 - RNA, 44 nt, Mus musculus
cuaaaacagcacuguuuuucuugauccuuuguucuguugguaga

SEQ ID NO: 28795 - RNA, 46 nt, Mus musculus
uucuuuuucuuuuuuucuuuuuuacauuuuuacaaagccugguuca

SEQ ID NO: 28796 - RNA, 46 nt, Mus musculus
cucugaugcugaugaggugcauuaaucuggguguguaugugguugc

SEQ ID NO: 28797 - RNA, 46 nt, Mus musculus
ugggcguggccuuguuggaggaagugugucacugugggggugggcu

SEQ ID NO: 28798 - RNA, 44 nt, Mus musculus
acuguuggcuaaguucagugucaauacaugaucgguugggagau

SEQ ID NO: 28799 - RNA, 42 nt, Mus musculus
auauuuucuuaaaacagaagugauaaaguguguauggcagag

SEQ ID NO: 28800 - RNA, 45 nt, Mus musculus
agugguucuuucagaacauauguuaguauauuuuuggggguauau

SEQ ID NO: 28801 - RNA, 67 nt, Mus musculus
cucucucucucugucucuguguguguguguguguccguguguguguguguguguguccgugucugug

SEQ ID NO: 28802 - RNA, 47 nt, Mus musculus
aaaaccacagcacaauaaaaauuaacaggaaagcaacaacccuagac

SEQ ID NO: 28803 - RNA, 46 nt, Mus musculus
guauugugccaggugaacauuugccuaacauauguaaggcccuaag

SEQ ID NO: 28804 - RNA, 46 nt, Mus musculus
gaagcugaggcuggaagauuguuccaggccugggugguuuguagag

SEQ ID NO: 28805 - RNA, 44 nt, Mus musculus
caucucaggcaagguaaaugaguccaaguaauugaaguuggaaa

SEQ ID NO: 28806 - RNA, 23 nt, Mus musculus
ucaugagaagccaguggguuggg

SEQ ID NO: 28807 - RNA, 45 nt, Mus musculus
gaaacaagcuugacuuggccacagucugaauguuaagacagaggu

SEQ ID NO: 28808 - RNA, 36 nt, Mus musculus
aaguacauuuaaagacgagagagagagagagagaaa

SEQ ID NO: 28809 - RNA, 24 nt, Mus musculus
aggaguauucuuugggaagauuua

SEQ ID NO: 28810 - RNA, 24 nt, Mus musculus
gaagaacacaauuuucuguggcca

SEQ ID NO: 28811 - RNA, 41 nt, Mus musculus
aggacucuucagaagugugguaaacuuaaaaugauggcggu

SEQ ID NO: 28812 - RNA, 46 nt, Mus musculus
uagaggcgagaaagugcagacgauuuauagaaauaauuucagagaa

SEQ ID NO: 28813 - RNA, 45 nt, Mus musculus
aauauuaaaagauagaaucuuaugaaagacacugaacugagagac

SEQ ID NO: 28814 - RNA, 43 nt, Mus musculus
ugguuguggacagccugcagugggacgaccacagggaagagac

SEQ ID NO: 28815 - RNA, 46 nt, Mus musculus
gagagggaaaagagagaagggaaggacaaaagacagagacagagac

SEQ ID NO: 28816 - RNA, 42 nt, Mus musculus
ucucucucucucucucugucucucucucugucugucuuuguc

SEQ ID NO: 28817 - RNA, 46 nt, Mus musculus
ucucuuaaacuuccgugagaauucacuucguacuugcuuucugauc

SEQ ID NO: 28818 - RNA, 42 nt, Mus musculus
acgccauccucagcuugauuguguauuuaccuuggcccaaaa

SEQ ID NO: 28819 - RNA, 41 nt, Mus musculus
aaugcuuugcuuuaguagaagaugaggauggcucggaggca

SEQ ID NO: 28820 - RNA, 42 nt, Mus musculus
ggagacaggccaaggaggggcuguuucaguagcccugggauc

SEQ ID NO: 28821 - RNA, 42 nt, Mus musculus
guguguguguguguaugugugugugaccacaacccgaggaac

SEQ ID NO: 28822 - RNA, 76 nt, Mus musculus
aaggagaaagucagcagguguugggguauaagagacggcuagaugaggucaccugcugguuaacgaaaguggagag

SEQ ID NO: 28823 - RNA, 45 nt, Mus musculus
gguggcgcacgccuuuaauccuagcacuugggaggcaguggcagg

SEQ ID NO: 28824 - RNA, 41 nt, Mus musculus
ugcucgcucagcugaaugcaaaaugggaccgagugaauaga

SEQ ID NO: 28825 - RNA, 46 nt, Mus musculus
uagauggaugaggagcaagcccagauugaggaaguucuacaaagag

SEQ ID NO: 28826 - RNA, 42 nt, Mus musculus
ugcugagucuuucucugacuuggaaaacuuagaacaagacau

SEQ ID NO: 28827 - RNA, 45 nt, Mus musculus
ucguggaagcgccagcagggaacucguggaaccaaaauuagccga

SEQ ID NO: 28828 - RNA, 46 nt, Mus musculus
ugcuggaugagaucgaaaagaaaccagcgaguaaacaggaagaaau

SEQ ID NO: 28829 - RNA, 50 nt, Mus musculus
ugugugcucaaugcuggauggagccgagugcggacguggaccgaagacug

SEQ ID NO: 28830 - RNA, 45 nt, Mus musculus
augagugugaguguucacauguguauuugugagugugugggagau

SEQ ID NO: 28831 - RNA, 45 nt, Mus musculus
guguguguauguguguguguccguguaugcacaagugugucagug

SEQ ID NO: 28832 - RNA, 60 nt, Mus musculus
ugaauggcucucugccacagaggcagaacuagugcagaaauccacaucagaaggcgugau

SEQ ID NO: 28833 - RNA, 84 nt, Mus musculus
uuacccagaaggaaugguccuauaacuaagagggaagggagaauauccagguaaguuggggugugugugugagugagugagaga

SEQ ID NO: 28834 - RNA, 45 nt, Mus musculus
gauuacuuaauacaggaugauauuuauauuuuccauggccauugg

SEQ ID NO: 28835 - RNA, 46 nt, Mus musculus
agacugucaucaaaacagggaggcacauuguccagaagcagcagac

SEQ ID NO: 28836 - RNA, 44 nt, Mus musculus
cgcucccagcccccgacguccccugagggcagggccaccagagg

SEQ ID NO: 28837 - RNA, 47 nt, Mus musculus
gaagcaacuccagguccuccgcgaaacugaccacaugcuucaggugc

SEQ ID NO: 28838 - RNA, 64 nt, Mus musculus
ugggcagacucugauugaugguggaauccuggaugacauaaucagcgagaagcuggaggcuuuu

SEQ ID NO: 28839 - RNA, 55 nt, Mus musculus
cucuugagucuguuuugcgccauccggcggauaaucgcacccagauucgggaacu

SEQ ID NO: 28840 - RNA, 44 nt, Mus musculus
agccacaguuauuuucacugugaaugggaaagaugucugucugu

SEQ ID NO: 28841 - RNA, 42 nt, Mus musculus
guguugguguugguguugguguugguguuggugguguuggug

SEQ ID NO: 28842 - RNA, 75 nt, Mus musculus
ugguguuguuguuguuguuguuguuguuguuguugguguugguguugguguuguugguguuguuguuguuguugu

SEQ ID NO: 28843 - RNA, 42 nt, Mus musculus
aaauauccugaaugguuuuuaccuuuugcucuuucugggggu

SEQ ID NO: 28844 - RNA, 45 nt, Mus musculus
gauaauugauccccgcagguuugugugcucacuaguguucucagg

SEQ ID NO: 28845 - RNA, 42 nt, Mus musculus
auagagagauuuuuguuuguuuuguguuaaaaggagaccaag

SEQ ID NO: 28846 - RNA, 46 nt, Mus musculus
cucugguggccaggaguugacgucggaauucaacgaggugcuggag

SEQ ID NO: 28847 - RNA, 45 nt, Mus musculus
caguagacacuauuuaggauaacuugccucuaaacucugguggua

SEQ ID NO: 28848 - RNA, 46 nt, Mus musculus
auucaaaaaagcaggcugucagauagucaagaaaaagcccugaacu

SEQ ID NO: 28849 - RNA, 46 nt, Mus musculus
gaggacaaugucagauggaaaacugaugcucuggguggcuccagag

SEQ ID NO: 28850 - RNA, 46 nt, Mus musculus
aucaagaguagaacugaaggggacucggagaaacauuaggggaauu

SEQ ID NO: 28851 - RNA, 45 nt, Mus musculus
cccaugcaugccaggaaagcaguuuacugacugagccaccucccg

SEQ ID NO: 28852 - RNA, 46 nt, Mus musculus
gagcucccugggauucagguugacacauucucuuuauaacccaacc

SEQ ID NO: 28853 - RNA, 46 nt, Mus musculus
uuuaucuauuuacaucccaaauguucccccucccccucccagaguu

SEQ ID NO: 28854 - RNA, 46 nt, Mus musculus
agcacaggcaggccuuugggcucccucagcaucagaaguaccagcu

SEQ ID NO: 28855 - RNA, 45 nt, Mus musculus
augagggauuguuaagauaaaaggaaaguccauuuccccagguuc

SEQ ID NO: 28856 - RNA, 62 nt, Mus musculus
guaaagaccaagguuuccagagacuuacacuugcucgaggaaaucacccccagacuccgaga

SEQ ID NO: 28857 - RNA, 54 nt, Mus musculus
guggggaaaauguauaaacaagaauuugaugauguccaaggcagauggaauaaa

SEQ ID NO: 28858 - RNA, 46 nt, Mus musculus
gagugaagugaccguauuuucucuuccucagagggaacugacagau

SEQ ID NO: 28859 - RNA, 46 nt, Mus musculus
aaagagaagauaucauucagugugucuggugagugggcugugugug

SEQ ID NO: 28860 - RNA, 44 nt, Mus musculus
uuauuuuaagcagcuugaugccauugaggagaccaucaaggaga

SEQ ID NO: 28861 - RNA, 46 nt, Mus musculus
ccacugaagaaguaaacgauguucuggaaaggguuucguuggagug

SEQ ID NO: 28862 - RNA, 41 nt, Mus musculus
aacugaaucaaaccggacaaacccuccgggagcaaauggga

SEQ ID NO: 28863 - RNA, 78 nt, Mus musculus
caaagacugccauucagaacacagagaugaaagaauauaagaagucgcaggagaccucaggaaugaaaaagaaauuga

SEQ ID NO: 28864 - RNA, 46 nt, Mus musculus
gugugugugugugaauacagguuugugugagugugguuauguaggu

SEQ ID NO: 28865 - RNA, 42 nt, Mus musculus
gagggcaaagaacuguggggcuggggggagagaagggcagag

SEQ ID NO: 28866 - RNA, 45 nt, Mus musculus
acagagaugacuuugguucgggcaguugucauuauucaagcagaa

SEQ ID NO: 28867 - RNA, 27 nt, Mus musculus
auauugaaggaagacauggaaaugaag

SEQ ID NO: 28868 - RNA, 41 nt, Mus musculus
gaaggaacuaagugucaguguccggcgucuggcuguaagug

SEQ ID NO: 28869 - RNA, 41 nt, Mus musculus
guuguuaauaucauaguggauaagaaggagagggggguaga

SEQ ID NO: 28870 - RNA, 46 nt, Mus musculus
auauuuucugugauuguguggccuuuguaauccuguggacucuuca

SEQ ID NO: 28871 - RNA, 50 nt, Mus musculus
aagaacguuggaacagguugcaagaaaucaguauucuguggcaggaauua

SEQ ID NO: 28872 - RNA, 66 nt, Mus musculus
acaggugaagguaaauuccuuaacucacaugguggugauuguggaugaaaacaguggggagagugc

SEQ ID NO: 28873 - RNA, 57 nt, Mus musculus
gauccaggaacagaugaccuugcugaaugcaaggugggaggcgcuccggguggagag

SEQ ID NO: 28874 - RNA, 55 nt, Mus musculus
aggcuggcaaccagcugaugacacaagggacucugucagaggaggaggaguuuga

SEQ ID NO: 28875 - RNA, 60 nt, Mus musculus
gagcaagaugacauuucugaugaugucgaagaagucaaagagcaguuugcuacccaugaa

SEQ ID NO: 28876 - RNA, 52 nt, Mus musculus
agcgcuagaggaagugcugacguggcugcuguccgcggaggacacguuccag

SEQ ID NO: 28877 - RNA, 64 nt, Mus musculus
gcaagucacgauagaugccauccgagagguggagacucucccaaggaaguauaagaaagaaugu

SEQ ID NO: 28878 - RNA, 61 nt, Mus musculus
aucucccugacaagaaauccauaauuauguauuuaacgucucuguuugaggugcuuccuca

SEQ ID NO: 28879 - RNA, 78 nt, Mus musculus
uguccccaauugagagacuugaacaugcuuuuagcaaggcccacacuuauuugggaauugaaaagcuucuagauccug

SEQ ID NO: 28880 - RNA, 45 nt, Mus musculus
caucugauaugggggaggcugguggcugugguggcuaagggacag

SEQ ID NO: 28881 - RNA, 46 nt, Mus musculus
uguugaauuuucucagucaccgugucagggucaugugcugccaacu

SEQ ID NO: 28882 - RNA, 46 nt, Mus musculus
gaagggcacacauucacagcacauucuguauagcuugucgucagug

SEQ ID NO: 28883 - RNA, 43 nt, Mus musculus
gugugugggugcaugcauguguuaauuuucuuuucuuguagug

SEQ ID NO: 28884 - RNA, 45 nt, Mus musculus
cugucuucagaaacaccagaagaggucaucagaucccauuacaga

SEQ ID NO: 28885 - RNA, 45 nt, Mus musculus
uguuaacuguauuucuuuugaaaauuagaauuguguguacuuaag

SEQ ID NO: 28886 - RNA, 41 nt, Mus musculus
guggaacauaaucauugcuaugcucagaauugggggagagg

SEQ ID NO: 28887 - RNA, 45 nt, Mus musculus
uggacagagaaaagggaggcagagcuaagaguugcagggacagag

SEQ ID NO: 28888 - RNA, 42 nt, Mus musculus
agcaagucuccuugauuaaugacuuuguagcaucgaucagau

SEQ ID NO: 28889 - RNA, 42 nt, Mus musculus
agccuuuccuuuacugaaaauuuguagaucaugggguuagag

SEQ ID NO: 28890 - RNA, 46 nt, Mus musculus
augguguauacaauuuucuuccaugugcaccaguguugugccuccu

SEQ ID NO: 28891 - RNA, 45 nt, Mus musculus
augccuucaagaggcauguguugggaagaaaaagaaagagcuagu

SEQ ID NO: 28892 - RNA, 33 nt, Mus musculus
aggacacacguccuuggcagcucaucaggaagg

SEQ ID NO: 28893 - RNA, 46 nt, Mus musculus
ucacauggccuguuacauuucguucuuauuaaugucaauuuuagag

SEQ ID NO: 28894 - RNA, 46 nt, Mus musculus
cuguggcauguagaauguccagagagggugagaauggugugaagac

SEQ ID NO: 28895 - RNA, 45 nt, Mus musculus
aguggagugauaacaggacugaaguggugaaggcaauggggugga

SEQ ID NO: 28896 - RNA, 24 nt, Mus musculus
uugcuauggggggagggguggcac

SEQ ID NO: 28897 - RNA, 45 nt, Mus musculus
caucucuccagcugccuguguguguguuuuuaaaagucugcauuu

SEQ ID NO: 28898 - RNA, 45 nt, Mus musculus
ugcagaauuaauuucaaggucaggggcaugugugggugugggugu

SEQ ID NO: 28899 - RNA, 51 nt, Mus musculus
cacacaugcacacacgugcacauacagagacaaagagagaccgagagagag

SEQ ID NO: 28900 - RNA, 42 nt, Mus musculus
uucagauuuagcugcuuccuacugugaugugugcacccuguc

SEQ ID NO: 28901 - RNA, 46 nt, Mus musculus
uaaaugcagacacaaauucacauacauagaagacagacacagagac

SEQ ID NO: 28902 - RNA, 79 nt, Mus musculus
acauauacaaagagacagacagagacacacacagagacagacacacacggacacacauacauagacauauauaggcaga

SEQ ID NO: 28903 - RNA, 71 nt, Mus musculus
cacacacacacacacagauacacagauagacagacagacagacacaugagacacacagaugcacacacaca

SEQ ID NO: 28904 - RNA, 42 nt, Mus musculus
auuccuuccucucugauuuuugcuuccuggguaccgugagca

SEQ ID NO: 28905 - RNA, 45 nt, Mus musculus
aaagaggaggaggaagagaaagaagaggaagaggaaggagaagaa

SEQ ID NO: 28906 - RNA, 42 nt, Mus musculus
ucuaucucccaguauuaauuaaaagaaaaaagaaugaagcgg

SEQ ID NO: 28907 - RNA, 44 nt, Mus musculus
agcgugggagcaaaaauggcaagccuuaagguucagugggacac

SEQ ID NO: 28908 - RNA, 42 nt, Mus musculus
ccuucuuacuggaggaggcaugaugcuuuguucuuagcugug

SEQ ID NO: 28909 - RNA, 46 nt, Mus musculus
cauaugaaauucuuuuaucuuuaucuucuguuauuuacugacacag

SEQ ID NO: 28910 - RNA, 24 nt, Mus musculus
ucuggagaaugugacgguggcagc

SEQ ID NO: 28911 - RNA, 30 nt, Mus musculus
ggugggagcccucucuuccuagccacuucc

SEQ ID NO: 28912 - RNA, 46 nt, Mus musculus
gaaaagguucaaauauaaaauuguuuggguguaagaauaagaaaua

SEQ ID NO: 28913 - RNA, 46 nt, Mus musculus
uuaauuagugaaacuugugcugcaucaggcucugguaggguuggua

SEQ ID NO: 28914 - RNA, 42 nt, Mus musculus
uaccuucuucuucuugauggcauccuuggagcuggcacagau

SEQ ID NO: 28915 - RNA, 45 nt, Mus musculus
aaaaacaaaaaacaaacaacaacaacaacaacaacaagaaagaug

SEQ ID NO: 28916 - RNA, 72 nt, Mus musculus
uuauuccuuucguauuuucugagguuuuagguuggcuguggagugagcauuagagagguaauaugaaagaug

SEQ ID NO: 28917 - RNA, 46 nt, Mus musculus
gaauguacacugcaugagccaccaccacaguaacuuugaagcagac

SEQ ID NO: 28918 - RNA, 46 nt, Mus musculus
uuaagcaguggaaaggucauuggaguuuagucaauaaagcugagau

SEQ ID NO: 28919 - RNA, 68 nt, Mus musculus
cuguguuaccgaauucagcuucagcagagacgauggaguaaaugcaaauuaaaaauaaaucgagagca

SEQ ID NO: 28920 - RNA, 24 nt, Mus musculus
auuccuagagaaggcaacccucaa

SEQ ID NO: 28921 - RNA, 41 nt, Mus musculus
agcaaaagccuugccugugucacagguccucacgaggcuga

SEQ ID NO: 28922 - RNA, 46 nt, Mus musculus
auagagcgcaugacugaagcagcgacguguucauaagaagugauga

SEQ ID NO: 28923 - RNA, 41 nt, Mus musculus
cugugacuaugcagugguuuuuguagcuuuaaggacucuuu

SEQ ID NO: 28924 - RNA, 46 nt, Mus musculus
ccugaugaugggcagaacgaauucagugacaucauuaaguccagau

SEQ ID NO: 28925 - RNA, 46 nt, Mus musculus
guaucuauuuauuuuuuuuccaucuaauccauugaggccacaauca

SEQ ID NO: 28926 - RNA, 81 nt, Mus musculus
ucgcugguuacuuuugacuuucauuuuguuuuuguaguucuggggaucgaacucaggaccaugcaugcacacccugcaggc

SEQ ID NO: 28927 - RNA, 45 nt, Mus musculus
aaccaaaccaaaccaaaacaaaaaaacccaaagaaaauaggagaa

SEQ ID NO: 28928 - RNA, 46 nt, Mus musculus
gaaagacugcaugugaacacguuaaacuuugagggggggggaaaug

SEQ ID NO: 28929 - RNA, 45 nt, Mus musculus
agccaauaccagaccucuccggggagccucuucccgccuggcuca

SEQ ID NO: 28930 - RNA, 72 nt, Mus musculus
caaaguacagagucaucaaagguuaggagauauaugcuggggaauacacucucaaaaacaaaguacagaguc

SEQ ID NO: 28931 - RNA, 83 nt, Mus musculus
augcuggggaauacagucucaaaaacaaaguacauagucaucaaagguuaggagauauaugcuggggaauacagucucaaaaa

SEQ ID NO: 28932 - RNA, 89 nt, Mus musculus
ucucaaaaacaaaauggagauucuucaaagguuaggagauauaugcuggggaauacagucucaaaaacaaaguacagagucaucaaagg

SEQ ID NO: 28933 - RNA, 50 nt, Mus musculus
auauaugcuggggaauacagucucaaaaacaaaguacagagucaucaaag

SEQ ID NO: 28934 - RNA, 46 nt, Mus musculus
uaugcuggggaauauagucucaaaaaaaugcagugucuucaaaagu

SEQ ID NO: 28935 - RNA, 42 nt, Mus musculus
agucucaaaaagaaaauggagauucuucaaagguuaggagau

SEQ ID NO: 28936 - RNA, 46 nt, Mus musculus
gagagagagacggagacagagacagagagacagagagagacagaga

SEQ ID NO: 28937 - RNA, 45 nt, Mus musculus
guaguucaguaauaaauguccuagagcugugugugugugugugug

SEQ ID NO: 28938 - RNA, 45 nt, Mus musculus
uauagggaggcccaccugcagagugccuaagaacuccggugugag

SEQ ID NO: 28939 - RNA, 38 nt, Mus musculus
cauagagaaacgcugucucaaaacagcaacaacaacac

SEQ ID NO: 28940 - RNA, 87 nt, Mus musculus
ugcaagccaguccuguuccucacagccaccucaagcuccuugacaaugucccucuuuggccccucaucgacugcauuccaguuccaa

SEQ ID NO: 28941 - RNA, 42 nt, Mus musculus
uggugaacagauaccagccugaaguccuguggucagacggag

SEQ ID NO: 28942 - RNA, 45 nt, Mus musculus
ucagcccaguucggaaaacaguagucaccaaugaucgcuggggag

SEQ ID NO: 28943 - RNA, 64 nt, Mus musculus
ggcaccauuccugucauuuuugaggagcgauuaaggcaaaugggaaccuggcugaaggucaacg

SEQ ID NO: 28944 - RNA, 46 nt, Mus musculus
aauaagcuagccaggagaagauuccgagaaaaugguaaaauaaaag

SEQ ID NO: 28945 - RNA, 42 nt, Mus musculus
ccuguagcugggcagaaaagagggcuggggcccgggggucug

SEQ ID NO: 28946 - RNA, 45 nt, Mus musculus
ugcuauguacuguaaugcuguauguacuguaauugggccccgaga

SEQ ID NO: 28947 - RNA, 41 nt, Mus musculus
ucugcgcgggcagacgggaaagaaaggaggaggcuggagau

SEQ ID NO: 28948 - RNA, 46 nt, Mus musculus
caaauuguucugcaagacguaguauuaugaauaaacggagagaaug

SEQ ID NO: 28949 - RNA, 45 nt, Mus musculus
gaaagaagugugaugcagucaucaaagcugaaaagaaucggagau

SEQ ID NO: 28950 - RNA, 42 nt, Mus musculus
cagcccggucagccuccagaguuagaacuaagaugugcaagg

SEQ ID NO: 28951 - RNA, 42 nt, Mus musculus
auguaagcugcagguaccucuaacuacaggaaauggcagggu

SEQ ID NO: 28952 - RNA, 42 nt, Mus musculus
gggcuagcccuaauaccagaggacuuggugucuuauaaggga

SEQ ID NO: 28953 - RNA, 45 nt, Mus musculus
uucuguuccugucaugaaacauaaugaccaaagcaguauacugga

SEQ ID NO: 28954 - RNA, 46 nt, Mus musculus
acagcagcuggagaccaccacaucuucaacugcuagcaugaggcag

SEQ ID NO: 28955 - RNA, 110 nt, Mus musculus
agcuaagaaggcggugcugaaaggcguccacagccacaaaaagaagaagauccgaacgucacccaccuuccggcggcccaagacccugcggcuccggaggcagccaaaau

SEQ ID NO: 28956 - RNA, 57 nt, Mus musculus
gauauuuuggcugccuccggagccgcagggucuugggccgccggaaggugggugacg

SEQ ID NO: 28957 - RNA, 45 nt, Mus musculus
aacacucuuguguucauuguggaugucaaggccaauaagcaucag

SEQ ID NO: 28958 - RNA, 46 nt, Mus musculus
gacaucgauguggccaaagucaauacccugauaaggcccgacggag

SEQ ID NO: 28959 - RNA, 46 nt, Mus musculus
cugaguccagauggcuaauucuaaauauauacuuuuuucaccauaa

SEQ ID NO: 28960 - RNA, 41 nt, Mus musculus
agccuucaggagcaggggacuacagaaggccucaguucccc

SEQ ID NO: 28961 - RNA, 44 nt, Mus musculus
caagugcacaaaaccaaaagggaaccacacaguggccuugggga

SEQ ID NO: 28962 - RNA, 47 nt, Mus musculus
caggggaaagaucaguauucaucaguuguggugagaaaaacagggau

SEQ ID NO: 28963 - RNA, 27 nt, Mus musculus
ugaaaaagaaacaguggauuugagaaa

SEQ ID NO: 28964 - RNA, 32 nt, Mus musculus
uuugagacagagucucacuguguggcccuggu

SEQ ID NO: 28965 - RNA, 44 nt, Mus musculus
gggggaggagagagagagagggugagagaggagagagaaagaga

SEQ ID NO: 28966 - RNA, 47 nt, Mus musculus
cuuagaaagaaaauacaaaauguaugguucaaaguaaaggggcacaa

SEQ ID NO: 28967 - RNA, 80 nt, Mus musculus
gacuaaaguaaagaaauuuauauuaauuguauugacaaaggaagucucaaagcccagcauagacuuaguccuuugguuua

SEQ ID NO: 28968 - RNA, 45 nt, Mus musculus
uuaaaaauuugugaaauauuuuaagugggacuuaaugggcauaau

SEQ ID NO: 28969 - RNA, 46 nt, Mus musculus
gcaauugaaacccuaaccaagacagaaguugguaccagggacuagg

SEQ ID NO: 28970 - RNA, 42 nt, Mus musculus
gcuucugugguuccagggaacauugcggaagguggggcagaa

SEQ ID NO: 28971 - RNA, 45 nt, Mus musculus
aguaaguugguuuauaauauuuaauaaugaaaauauaagcaucua

SEQ ID NO: 28972 - RNA, 46 nt, Mus musculus
gaaugugcugaaaagagacuauauuggcuuuuucaagcuggcaacu

SEQ ID NO: 28973 - RNA, 46 nt, Mus musculus
aaaagaaaaugaggaagccuagagauccaguaaaacaagugcaaau

SEQ ID NO: 28974 - RNA, 23 nt, Mus musculus
ggguggcauguaaggaaggcuac

SEQ ID NO: 28975 - RNA, 46 nt, Mus musculus
aguaccucagaaaaacagcaaaauuauaaaagaauugccaugagaa

SEQ ID NO: 28976 - RNA, 46 nt, Mus musculus
aauaaaaaaaaugaaaaauacuuuuaagguauuuuuagggagucaa

SEQ ID NO: 28977 - RNA, 46 nt, Mus musculus
auacuuugaaaaauaacuugauuuuucacuuaaaaaaaggagagag

SEQ ID NO: 28978 - RNA, 46 nt, Mus musculus
cagccuuuuaauagaugucaucacaguguuuggugaacucacagau

SEQ ID NO: 28979 - RNA, 53 nt, Mus musculus
uuuggaaaauuaugcuuugaaaauguucuuguaugcagacaaugaagaucgag

SEQ ID NO: 28980 - RNA, 24 nt, Mus musculus
uuuaaaugacaucagguaaguuca

SEQ ID NO: 28981 - RNA, 46 nt, Mus musculus
ccagaaagcuggaccaaagguaaagccuagcaccaagaaagcagug

SEQ ID NO: 28982 - RNA, 24 nt, Mus musculus
guguguuugcuagaagaacccaug

SEQ ID NO: 28983 - RNA, 46 nt, Mus musculus
aauugaaauuacugaguguugugcuccuccuuguaggugcugagaa

SEQ ID NO: 28984 - RNA, 46 nt, Mus musculus
gagacucaauuuauuaccauuuccuuuuggaaagaggacuguacau

SEQ ID NO: 28985 - RNA, 46 nt, Mus musculus
cuccccacacacacaccccuaguccccccucccuuccaucccaggu

SEQ ID NO: 28986 - RNA, 46 nt, Mus musculus
ucaaauucuuccuucucugcagucugguucuuauccagccagcuga

SEQ ID NO: 28987 - RNA, 78 nt, Mus musculus
ugcuucucauccucagccuuguacuucucagcuucuuggaccaugcgcucaauaucuuccuuacucaagcggcccuug

SEQ ID NO: 28988 - RNA, 46 nt, Mus musculus
ccucaaucugagggaccccacggggugcuggagggaugccugugag

SEQ ID NO: 28989 - RNA, 45 nt, Mus musculus
gcccuuucaccuucauacaccugaaugaguacaccaggcugguug

SEQ ID NO: 28990 - RNA, 45 nt, Mus musculus
uuucaauaccaagggaaagaggaaugacauccaagagcagcaaau

SEQ ID NO: 28991 - RNA, 46 nt, Mus musculus
uugcagaaguuucugaaucuuggggauucugguagaaccacccacc

SEQ ID NO: 28992 - RNA, 45 nt, Mus musculus
caauucccucauagagagaaucaaucucaauacuggccugggugc

SEQ ID NO: 28993 - RNA, 49 nt, Mus musculus
uccacuuggaccuugggccugccugcaucauucaccaccaugaagggcc

SEQ ID NO: 28994 - RNA, 46 nt, Mus musculus
uuuccaugcugaaagacacccacacaggaguagguggugccgagau

SEQ ID NO: 28995 - RNA, 49 nt, Mus musculus
gucuugcggagcggcuagggcagcggaggaaaagaaaagggaacggcuc

SEQ ID NO: 28996 - RNA, 42 nt, Mus musculus
agggcguugaaggcgugcuggggcugcugcugcuggugauga

SEQ ID NO: 28997 - RNA, 46 nt, Mus musculus
ccuucaacgcccucaugggcgagcacauacacuacggcgcgggcaa

SEQ ID NO: 28998 - RNA, 42 nt, Mus musculus
ugcuggccggcagggagccucccuggcuggccaccgggggac

SEQ ID NO: 28999 - RNA, 46 nt, Mus musculus
gcagaagcucaacaaccaguauuucaaccaucaccccuacccccac

SEQ ID NO: 29000 - RNA, 46 nt, Mus musculus
auaaacuuguacaaauugguuuaaaaaaaaaaaagauugcugccac

SEQ ID NO: 29001 - RNA, 42 nt, Mus musculus
gccaacuugaaagugaacgguaugacuuuuccugauccagaa

SEQ ID NO: 29002 - RNA, 41 nt, Mus musculus
uguuuuguuuuuugguuacuggcucaaggauaugcagauuu

SEQ ID NO: 29003 - RNA, 45 nt, Mus musculus
uugugagcugcaguguggaggcugggagcugaaugugcuugucug

SEQ ID NO: 29004 - RNA, 46 nt, Mus musculus
ugguccugugaagguucuaugccccaguauaaaggaaugucugggc

SEQ ID NO: 29005 - RNA, 42 nt, Mus musculus
augguggaaaaggugcugauaggagcauuuugguacacagac

SEQ ID NO: 29006 - RNA, 44 nt, Mus musculus
guucaaguccuugaagcaguuguugaauaauuuuaguugggaga

SEQ ID NO: 29007 - RNA, 46 nt, Mus musculus
aauaguuuuuauucuuuuaaaaguaaguucaguuuugggagcagua

SEQ ID NO: 29008 - RNA, 37 nt, Mus musculus
uugugcagguuugguaggguuuuagucucaugcagag

SEQ ID NO: 29009 - RNA, 42 nt, Mus musculus
ucuaauuugaagcagaguuuacuuuguauauuugugccacua

SEQ ID NO: 29010 - RNA, 46 nt, Mus musculus
cagagggaugaaguaguuaaaagagaguucauuuuaggcuuuggaa

SEQ ID NO: 29011 - RNA, 46 nt, Mus musculus
guauuuguauuggucagaaucuggcagagccucucgggagacagcu

SEQ ID NO: 29012 - RNA, 45 nt, Mus musculus
uuuuugcucauuaguguuuuacagaagagaaaugugcuugugagc

SEQ ID NO: 29013 - RNA, 41 nt, Mus musculus
cucaaauaaaacauuugcuuuuuguugaugaugggggcuuu

SEQ ID NO: 29014 - RNA, 46 nt, Mus musculus
guacuuuuuagccauaacuuaaauagcaaguaguugggcaguagag

SEQ ID NO: 29015 - RNA, 41 nt, Mus musculus
ugugcccagcaggcuguuauccuuguaaacagggaaaggag

SEQ ID NO: 29016 - RNA, 60 nt, Mus musculus
agggccacuuaaaaaaggacacagacugguaccagguaaagcgaaugcaagaugaaaaga

SEQ ID NO: 29017 - RNA, 44 nt, Mus musculus
augaaacuuuauuuugcuccugauuguaagaggccugggucagg

SEQ ID NO: 29018 - RNA, 46 nt, Mus musculus
uguagagagaugugugaguuggagucaggagucuauggccuaggag

SEQ ID NO: 29019 - RNA, 56 nt, Mus musculus
aacaagaagugaggucgagaguaguacaggcaagauagugguggcguuuugcauga

SEQ ID NO: 29020 - RNA, 83 nt, Mus musculus
gguuggagaagauauaaaguacuuauuuuuugauauugaggacaucuuuaagauguuaaaacaagucaguuagugaaguguuu

SEQ ID NO: 29021 - RNA, 45 nt, Mus musculus
uuagaagaaguaggucacaaguuuagcuuuaguucuagcacaagg

SEQ ID NO: 29022 - RNA, 45 nt, Mus musculus
agcagucucagucaggugaguuuuggaaacugaguucuuuuggug

SEQ ID NO: 29023 - RNA, 45 nt, Mus musculus
gaaaggggaagcaaauaacuuauacuguuauacuuaggacuauaa

SEQ ID NO: 29024 - RNA, 45 nt, Mus musculus
ugaaacaguuaugccuuccuuauaaagaacuaaacacaaggauuu

SEQ ID NO: 29025 - RNA, 41 nt, Mus musculus
uuguggguaggggaaaaaaagguuuauugggcuaucucagg

SEQ ID NO: 29026 - RNA, 65 nt, Mus musculus
cguggaggaugaugggaagaucugaccauguuugcugauagagggaaaggaaccaauggaagggg

SEQ ID NO: 29027 - RNA, 42 nt, Mus musculus
guaugggaagcucuggcuucauuucucaguacugggcuagag

SEQ ID NO: 29028 - RNA, 42 nt, Mus musculus
gacuuuuucauauaguacuucauguugugaugacccccaaau

SEQ ID NO: 29029 - RNA, 46 nt, Mus musculus
aauuuuaacauagguucuuaggccuacacaaaaugaauaaggagau

SEQ ID NO: 29030 - RNA, 45 nt, Mus musculus
uuaaguucccauuucguguuauuuaaaggcuuauuauguaaaggu

SEQ ID NO: 29031 - RNA, 42 nt, Mus musculus
cggucuccuccacacagggcgauaugguccagaagaugccag

SEQ ID NO: 29032 - RNA, 42 nt, Mus musculus
cauauaucugucugugguuguauaaaaugaaaagggggccag

SEQ ID NO: 29033 - RNA, 46 nt, Mus musculus
augauaaaucaaccccagagaaguguguguaggaaaucaugagagg

SEQ ID NO: 29034 - RNA, 44 nt, Mus musculus
ugaagaagaaaggaggaggaaggaggaagaggaagaggaggaga

SEQ ID NO: 29035 - RNA, 46 nt, Mus musculus
uuagagaaugcuaguuagaagugccaggcaucaucauauugaguag

SEQ ID NO: 29036 - RNA, 43 nt, Mus musculus
uccaggaaaggucgggcccccuggccuggagaucaggaggaag

SEQ ID NO: 29037 - RNA, 46 nt, Mus musculus
gaauggagagagccagggaaccauguuuggugacgggagcaccugu

SEQ ID NO: 29038 - RNA, 42 nt, Mus musculus
cagcacagggccagggguuuggggagagaggugccggggcag

SEQ ID NO: 29039 - RNA, 46 nt, Mus musculus
uuucaguagacggaaucucaucuuucuggcaaguuagaacagaaaa

SEQ ID NO: 29040 - RNA, 46 nt, Mus musculus
gagacaaaaccugaaucgaaguauucacuugucacaccgcaccagc

SEQ ID NO: 29041 - RNA, 46 nt, Mus musculus
agccccuguccacagugacagcuccagacagccccgaagcagcaga

SEQ ID NO: 29042 - RNA, 46 nt, Mus musculus
auagaacacauuggugggagcuuguacauacuuuuuuauggagcau

SEQ ID NO: 29043 - RNA, 46 nt, Mus musculus
uaaaaacccauuuucaaagggcagucaucauuuuaaaggguguuag

SEQ ID NO: 29044 - RNA, 47 nt, Mus musculus
gguuucuugcuccuuggaggccauguaggccaugagguccaccaccc

SEQ ID NO: 29045 - RNA, 47 nt, Mus musculus
guagucuccguuagcaccuggcacucgacuguacuuugcagacauuu

SEQ ID NO: 29046 - RNA, 42 nt, Mus musculus
uagcuaugaaccugaacuucauccugccgugugcuaucggau

SEQ ID NO: 29047 - RNA, 45 nt, Mus musculus
cguuugccagaauuuacaaagaacaauagaccucaugccagguag

SEQ ID NO: 29048 - RNA, 46 nt, Mus musculus
uaaugaagcuuagaaaaccuagaauuacagcuacaauuugguccuc

SEQ ID NO: 29049 - RNA, 46 nt, Mus musculus
uauuuauuuuuuugagcaauauuaaauagguguacuuuguguggga

SEQ ID NO: 29050 - RNA, 46 nt, Mus musculus
aaagaggauguuguggucuggcuacacuggggcuggcuacacuggg

SEQ ID NO: 29051 - RNA, 45 nt, Mus musculus
aauucugcccucaauccgaugguuuaugccuuuuucuaucccugg

SEQ ID NO: 29052 - RNA, 46 nt, Mus musculus
caacucuacuugcaacccccucauccauggcuuuuuuuacccgugg

SEQ ID NO: 29053 - RNA, 42 nt, Mus musculus
ccccgggugacagcggcuggagguggccgaggaagccggcga

SEQ ID NO: 29054 - RNA, 46 nt, Mus musculus
uuuugcuugcauuuuauaugcauauaucaauuuuugauugcgucag

SEQ ID NO: 29055 - RNA, 46 nt, Mus musculus
cugaacagucaggugaugaguucuaguaacuucaaagauauaggag

SEQ ID NO: 29056 - RNA, 47 nt, Mus musculus
gaaguuguugguaguugauaaaccucgagcaauuaagggaagaggga

SEQ ID NO: 29057 - RNA, 42 nt, Mus musculus
cagagaugaugcaccgaacccucaagagacuggaggccccag

SEQ ID NO: 29058 - RNA, 62 nt, Mus musculus
acaagguuuggggcagagguucacaguggcagugcagaggcagagggagcauggucggagau

SEQ ID NO: 29059 - RNA, 83 nt, Mus musculus
gugucagagauaguuaagcuggcggaugugugcaagagagagcagauacagugacagacgguggagugugcauuccgucaggu

SEQ ID NO: 29060 - RNA, 46 nt, Mus musculus
uuguguguugaaaucaacaggaauuaagacaggagucugggcaagc

SEQ ID NO: 29061 - RNA, 42 nt, Mus musculus
uuccugcacauugguucuuucugguaccccagccgcccccag

SEQ ID NO: 29062 - RNA, 46 nt, Mus musculus
agguggauggauggauggauagauagauagauagauggauagauag

SEQ ID NO: 29063 - RNA, 46 nt, Mus musculus
uggcuuugcaggacugcucccccacucuccuaccccucacccccac

SEQ ID NO: 29064 - RNA, 46 nt, Mus musculus
aguguguaauagaugagaucauuaaaaaguaaaaguaugggagcug

SEQ ID NO: 29065 - RNA, 46 nt, Mus musculus
uacaugugcauguacacaacuugcacacacacacacacacacacac

SEQ ID NO: 29066 - RNA, 24 nt, Mus musculus
gcauaaagauggauucuauggacu

SEQ ID NO: 29067 - RNA, 47 nt, Mus musculus
cuguuugugggauguuuuauccgcugugguccacagcagugcagauc

SEQ ID NO: 29068 - RNA, 45 nt, Mus musculus
auggucuggcuuuguggccauuauaccuucccucgugcgccaugg

SEQ ID NO: 29069 - RNA, 41 nt, Mus musculus
ccaagaagacucagccagauccacuccagcuccgaccccag

SEQ ID NO: 29070 - RNA, 82 nt, Mus musculus
cucgucgccucugcacccugcugugcauccuccuaccgcgucccgaucaugcucgccuccgucgcaggucccaucagccucg

SEQ ID NO: 29071 - RNA, 46 nt, Mus musculus
agacacauuuggcccagacccaacuaugaugcgagccaacugccug

SEQ ID NO: 29072 - RNA, 41 nt, Mus musculus
cgccucugcauggucaggcccugcgaagcugaccuggagga

SEQ ID NO: 29073 - RNA, 44 nt, Mus musculus
aaucgccaagccugucaaguuugagcuuucuggcugcaccagug

SEQ ID NO: 29074 - RNA, 44 nt, Mus musculus
agaaccaccacucugccaguggaguucaaaugccccgauggcga

SEQ ID NO: 29075 - RNA, 55 nt, Mus musculus
auggcguaaagccaggaaguaagggacacgaacucauuagacuauaacuugaacu

SEQ ID NO: 29076 - RNA, 52 nt, Mus musculus
uaacuaccgugggaggaacuaucccaccaaagugagaacguuaugucauggc

SEQ ID NO: 29077 - RNA, 46 nt, Mus musculus
auuuuaaaagcagcagugugccuacuuuuuggaguguaaccgggga

SEQ ID NO: 29078 - RNA, 46 nt, Mus musculus
accauagguaggacacgaagcuuaucugugauucaaaacaaaggag

SEQ ID NO: 29079 - RNA, 46 nt, Mus musculus
cauuccuaagcgaaaauuuuagcaugguuacaaagcagggacauuu

SEQ ID NO: 29080 - RNA, 29 nt, Mus musculus
uugaaacaauuaagcugauuacccuucgu

SEQ ID NO: 29081 - RNA, 45 nt, Mus musculus
acaauguuuucaagaacaggaccacagugggaagaaggugaaggc

SEQ ID NO: 29082 - RNA, 47 nt, Mus musculus
gagcugguuacaauuccuauaaucccgaggaaacaggcagcgguggc

SEQ ID NO: 29083 - RNA, 74 nt, Mus musculus
acuuggccugaagcauccuaguggggcuucauuaaauggauaggcucccguucucugagcuagacacugaaguc

SEQ ID NO: 29084 - RNA, 70 nt, Mus musculus
cuggcaucuucaugcuccuucaucaagucugagggaaaugagcuaaaaggaaaacuugggacacggaacg

SEQ ID NO: 29085 - RNA, 46 nt, Mus musculus
cuuggcuggugugggagggucuuuuuuguguuucacagaagcaaag

SEQ ID NO: 29086 - RNA, 46 nt, Mus musculus
gugaugcaggcauccuggagaaagcuucaucaccacuggauagaga

SEQ ID NO: 29087 - RNA, 46 nt, Mus musculus
ccugccagucugucuaagguuuuguuugguuuuuaugcuaccuuuu

SEQ ID NO: 29088 - RNA, 45 nt, Mus musculus
cuuuguguguguguauguguguuuguguguguguguaugugugug

SEQ ID NO: 29089 - RNA, 45 nt, Mus musculus
ccaggaugcucuggaaggcaggcuucagugugagcauggcuuugg

SEQ ID NO: 29090 - RNA, 42 nt, Mus musculus
ugauaugaaauaaacaccaugaccaaagcagcuaaggaggaa

SEQ ID NO: 29091 - RNA, 46 nt, Mus musculus
cccugaaaaugcuuccuaaacucaggaccacuggaaaugucagcua

SEQ ID NO: 29092 - RNA, 45 nt, Mus musculus
uaaugggauuugaugcccucuucuggugugcagguguauaugcag

SEQ ID NO: 29093 - RNA, 86 nt, Mus musculus
uguuuaguuacguagaaacuucuggaaaauugucauuuugcacagaaaggaaauaaagaugcuucauuaugucuaauaaauauggc

SEQ ID NO: 29094 - RNA, 97 nt, Mus musculus
caaggacaaaaacuuaccuaaacugacaacuacagacuugacauuguaaggacagucucugaaggggaaacuaaauguuuugucuucaggaagaggg

SEQ ID NO: 29095 - RNA, 46 nt, Mus musculus
cuagccugcaagcaauaaaugucauuuucccacuagauuuggccua

SEQ ID NO: 29096 - RNA, 46 nt, Mus musculus
uuuucuuuuuuuuuccccucucuuuccuuuuggcgugucggugguu

SEQ ID NO: 29097 - RNA, 41 nt, Mus musculus
cccagauagccuuagcuaccuaugacucccuccucccccag

SEQ ID NO: 29098 - RNA, 45 nt, Mus musculus
uauaaauucaagaaaucauaucccuuuuucauggcaaaagacauc

SEQ ID NO: 29099 - RNA, 46 nt, Mus musculus
cucucccccccucauccauugcugugauaaaacaccaugcaccaug

SEQ ID NO: 29100 - RNA, 46 nt, Mus musculus
gccuccauugcuggcucacugguuucuacuuggugaugagcaggac

SEQ ID NO: 29101 - RNA, 46 nt, Mus musculus
cacuugacaaauauccaguggcuguuaacuuaggaugaagcgccau

SEQ ID NO: 29102 - RNA, 45 nt, Mus musculus
cucgcuucggcagcacauauacuaaaauugggacaauacagagaa

SEQ ID NO: 29103 - RNA, 46 nt, Mus musculus
cuugacucuauaaaaauacccaaaagguaacugugaugugcggcag

SEQ ID NO: 29104 - RNA, 44 nt, Mus musculus
agauguucagccaccgaaugcaccacauucagccccacuaccga

SEQ ID NO: 29105 - RNA, 46 nt, Mus musculus
uccuuguugaaaucaggugguguauaauaguguagucuggugccuu

SEQ ID NO: 29106 - RNA, 46 nt, Mus musculus
cucugugcagggcuucccuccacucuuccucugucuccucuggaag

SEQ ID NO: 29107 - RNA, 42 nt, Mus musculus
aggugagauaugcaagaucuacaggguaccauuguuaccagg

SEQ ID NO: 29108 - RNA, 46 nt, Mus musculus
cacaccacauauuuacaguauaucugauagauggugaaucaguagu

SEQ ID NO: 29109 - RNA, 46 nt, Mus musculus
caauaaacaacaacaacaacaaaacaaaacaaaaauaaaaccccca

SEQ ID NO: 29110 - RNA, 42 nt, Mus musculus
gaagagcgcuucuguuuguguuugagugagugcagggaagag

SEQ ID NO: 29111 - RNA, 46 nt, Mus musculus
auuuuuaaguaauaauuacuguuguaugaaacaagcuuucguguag

SEQ ID NO: 29112 - RNA, 32 nt, Mus musculus
uauguggugcuggggucugacccagagcgcac

SEQ ID NO: 29113 - RNA, 46 nt, Mus musculus
caaccaaaguucacccuuugaggcagcagcuugauaugggguuaag

SEQ ID NO: 29114 - RNA, 42 nt, Mus musculus
gcaugcuagugugugcacagugcuuguggggucucuggaggu

SEQ ID NO: 29115 - RNA, 46 nt, Mus musculus
acacgugugcuauuuaauuuacaguggaaauggcacucccuggagg

SEQ ID NO: 29116 - RNA, 46 nt, Mus musculus
gggugcuuggccagugcuggagucauucacagaaguucguccugag

SEQ ID NO: 29117 - RNA, 85 nt, Mus musculus
uagugaaagugauuuuaaaauguccuuauuaaaaauaggugaaagauuuugguaaaauauuugaugauaucauuauagcaacuuu

SEQ ID NO: 29118 - RNA, 46 nt, Mus musculus
gaaagccauugagugcucagaggucagugggcuguuuuguuggcgc

SEQ ID NO: 29119 - RNA, 46 nt, Mus musculus
ggauuacacugugauuggccagucauuguuuuuguaugauguccag

SEQ ID NO: 29120 - RNA, 46 nt, Mus musculus
aaugaaaacccaacccaguucauaugauuacaugcugugcgccuag

SEQ ID NO: 29121 - RNA, 42 nt, Mus musculus
aaggaugagaaucuuagaccuaccggauaguaccauggcaag

SEQ ID NO: 29122 - RNA, 46 nt, Mus musculus
uuuuauugaugauuauguugcucagaauaaucagaucuuggcucag

SEQ ID NO: 29123 - RNA, 42 nt, Mus musculus
ucccagggggaucuaagcagaucuauagggacauggccccau

SEQ ID NO: 29124 - RNA, 61 nt, Mus musculus
acugagcauaguagauuaacaaugcuagucacuauacagccugcgauguguaucauugagg

SEQ ID NO: 29125 - RNA, 64 nt, Mus musculus
cuauaaggguauguaagggaagaagguggacagugagcgcggggaauuggaaagggaagggaag

SEQ ID NO: 29126 - RNA, 46 nt, Mus musculus
ccuuaauaaacuguguacacuuuagaaguggugugcuaggcuuccu

SEQ ID NO: 29127 - RNA, 46 nt, Mus musculus
uucuagaucuuuuucuuauaucaucuguauugcugugugugugugu

SEQ ID NO: 29128 - RNA, 46 nt, Mus musculus
auuuugauuguuuuggaauaugugaaagcauagacaguuggauuca

SEQ ID NO: 29129 - RNA, 48 nt, Mus musculus
aauaugagacucacgaccacauggugcuuauaaaacccuuaugugaau

SEQ ID NO: 29130 - RNA, 87 nt, Mus musculus
acaucugcacucggucuucaagggcucuguuguguugcagcaugagaagguaucuagccagugaggagccagcugcaagcggccgag

SEQ ID NO: 29131 - RNA, 65 nt, Mus musculus
auguccuaaaugcucuguguggccauugcauguuauauuugagggauccagaagagucuaauggu

SEQ ID NO: 29132 - RNA, 58 nt, Mus musculus
ggcucaguugugauauaacugcuuuccagaaugcguacccccacuuucgaggcaccuu

SEQ ID NO: 29133 - RNA, 47 nt, Mus musculus
agaaacugcaggucagcaaacuaaaguuuggcagcugcugugagcgg

SEQ ID NO: 29134 - RNA, 46 nt, Mus musculus
acuuugccguuuaguuuagucuaguuggucaaacugaaauuaccaa

SEQ ID NO: 29135 - RNA, 45 nt, Mus musculus
uccauaccauaccucuugaauauguaaucaucagauuaguguuga

SEQ ID NO: 29136 - RNA, 69 nt, Mus musculus
cuuugcacacugguugugugguucauaggguguggauggcagagagagagggggcagagaaagaggggg

SEQ ID NO: 29137 - RNA, 47 nt, Mus musculus
cucaggcccaagugucauucuacauauuuuguaacugaaaaaucagu

SEQ ID NO: 29138 - RNA, 99 nt, Mus musculus
auuaaugcacaugggagcauggagaugcauuucuuguugcagaaguugguguguggcuggaguugaagggcgugagggcuguggaggggcaguggaagg

SEQ ID NO: 29139 - RNA, 42 nt, Mus musculus
guaguuuuucuaucuuguaaaauaaauguaguugggcccuug

SEQ ID NO: 29140 - RNA, 46 nt, Mus musculus
ccugcacgguaguguucuguuggacauguuucugcucuguccugag

SEQ ID NO: 29141 - RNA, 42 nt, Mus musculus
gcccaugaaaagacuucuguaaaggaaguuuuaagcacauag

SEQ ID NO: 29142 - RNA, 58 nt, Mus musculus
cagugaucaugugacuaaggggugcuguuguggauagcccugggguuaauuauauuug

SEQ ID NO: 29143 - RNA, 88 nt, Mus musculus
gcagauaaaagggaagguggaguggaaggagggagagagaaggagaaaauggaagagggagaggacgcagaggaggaggaggaggaag

SEQ ID NO: 29144 - RNA, 55 nt, Mus musculus
agaagaagaagaagaagaagaaggaaagaaagaaaagcagaguagaagcauaugg

SEQ ID NO: 29145 - RNA, 45 nt, Mus musculus
gaaggaacuaagaguucuucauauagauccgcagggagcaaggag

SEQ ID NO: 29146 - RNA, 46 nt, Mus musculus
acacacacacacacacacacacacugagagagagagagagagaaag

SEQ ID NO: 29147 - RNA, 46 nt, Mus musculus
gguuuuaauuuuuucagaaguuugacuuuucgaauagugcagguga

SEQ ID NO: 29148 - RNA, 41 nt, Mus musculus
ucuucccacccugcuuugcccuuuccaucaccucaccacca

SEQ ID NO: 29149 - RNA, 42 nt, Mus musculus
cuaaagaaguagaaaaugagcagacuccaguaucugagccag

SEQ ID NO: 29150 - RNA, 45 nt, Mus musculus
cguggcuuaagaagcagaggucuuacaauuuaguaguagccaaag

SEQ ID NO: 29151 - RNA, 38 nt, Mus musculus
agaagaaauggcucagaggaagcaccuggagguucagg

SEQ ID NO: 29152 - RNA, 72 nt, Mus musculus
ugaagaagugaggaaggacaaggaggaaacgauacaagacacacaggaagagaaacuggaaggaggugcagc

SEQ ID NO: 29153 - RNA, 44 nt, Mus musculus
cuauauagaauguccauucacagggucuuuauugaauagacagg

SEQ ID NO: 29154 - RNA, 47 nt, Mus musculus
aaaccuguuuauuuugcucuagagccccaggauaaagacagcugcca

SEQ ID NO: 29155 - RNA, 46 nt, Mus musculus
cagucuuacaacuucuauuuugacacuguugauaguuuucuuagag

SEQ ID NO: 29156 - RNA, 42 nt, Mus musculus
cacaacauaaguucuuuucuguaaaauaguaaaacagccuag

SEQ ID NO: 29157 - RNA, 46 nt, Mus musculus
uuguuuaaagagaaauuucucauaagcuagucugcuaguccucgag

SEQ ID NO: 29158 - RNA, 46 nt, Mus musculus
aucagcccuacauacagacacauaaaaugucuguccaugccuggag

SEQ ID NO: 29159 - RNA, 53 nt, Mus musculus
auuauaauaauagcccaugaacuaacugauguguuuauaaaaugauaaagaga

SEQ ID NO: 29160 - RNA, 53 nt, Mus musculus
uuuauucagggcauggggaggggaguuaagaggguaggggagagagagagaga

SEQ ID NO: 29161 - RNA, 111 nt, Mus musculus
uuaaaauauauuuuucaaaaaauuaaaguguaacuaucauuuucucacuucauuuccuucccacagugccucccauguuguuguccuccaaccuuccugugcccuucauau

SEQ ID NO: 29162 - RNA, 46 nt, Mus musculus
ggaguucauaugacuugugcgaggucacaucagucagggucggggg

SEQ ID NO: 29163 - RNA, 42 nt, Mus musculus
cgggggcggaguucauaugacuugugcgaggucacgucaguc

SEQ ID NO: 29164 - RNA, 71 nt, Mus musculus
ggaguucauaugacuugugcgaggucacaucagucagggucgggggcggaguucauaugacuugugcgagg

SEQ ID NO: 29165 - RNA, 69 nt, Mus musculus
ucacaucagucagggucgggggcggaguucauaugacuugugcgaggucacaucagucagggucggggg

SEQ ID NO: 29166 - RNA, 43 nt, Mus musculus
cgggggcggaguucauaugacuugugcgaggucacgucaguca

SEQ ID NO: 29167 - RNA, 46 nt, Mus musculus; identical to SEQ ID NO: 29162

SEQ ID NO: 29168 - RNA, 41 nt, Mus musculus
cucugaaauccuaagauccagccugaagaguagugggcgac

SEQ ID NO: 29169 - RNA, 46 nt, Mus musculus
aggaaauugaggcuuagucggggugaaaaauguaaugaagucauag

SEQ ID NO: 29170 - RNA, 42 nt, Mus musculus
cugagguuuguaccaguugucccugagucccuucccuuugug

SEQ ID NO: 29171 - RNA, 46 nt, Mus musculus
acuugugaaagugacuuuagcuggacauggugucaggagcuugcag

SEQ ID NO: 29172 - RNA, 42 nt, Mus musculus
aaggcauuuuaggaaaagaggaaauuaguaugaaaggguaag

SEQ ID NO: 29173 - RNA, 46 nt, Mus musculus
gguaguaugaaaugcuguguuggaaaugaagacuuuugagacagag

SEQ ID NO: 29174 - RNA, 45 nt, Mus musculus
ggggacagacuuguuccaggggcgugcucuguccuguagccucaa

SEQ ID NO: 29175 - RNA, 46 nt, Mus musculus
aucguuuugcuuggccgaagauuuugaaaauuuccuauaagcgcag

SEQ ID NO: 29176 - RNA, 47 nt, Mus musculus
cacgggugugugugugugugugugugugugugugauugugugugcac

SEQ ID NO: 29177 - RNA, 33 nt, Mus musculus
cggggugcugggcugcguaaguagaguccucag

SEQ ID NO: 29178 - RNA, 30 nt, Mus musculus
ccaacaaaagcuacaccccugcccgcugag

SEQ ID NO: 29179 - RNA, 46 nt, Mus musculus
aaauauuuguuuccguguaaauuauacuaaugcaagaacagaguag

SEQ ID NO: 29180 - RNA, 57 nt, Mus musculus
aaugcauggggcucuugaucuugggagugcauguuaccaguccgccuugguucuuag

SEQ ID NO: 29181 - RNA, 84 nt, Mus musculus
auuagguuuauucuuuacuaaguaagccuguuuuucuaauagaucaccuuuaagcuauacaauaugaaguaauacaaccucgag

SEQ ID NO: 29182 - RNA, 47 nt, Mus musculus
uggaccugagaauaugcuaguuaauaggauugucccuacugaaagaa

SEQ ID NO: 29183 - RNA, 46 nt, Mus musculus
caauuucauggcguccacaccugagccucgccccagugaaugggag

SEQ ID NO: 29184 - RNA, 46 nt, Mus musculus
cuuagggcacuucuuggaaaaacuuuuaaacaccagugaaccccaa

SEQ ID NO: 29185 - RNA, 44 nt, Mus musculus
uaaagccugucaaauggagagguuagauaagcugcacgcugugu

SEQ ID NO: 29186 - RNA, 42 nt, Mus musculus
gcuuagcuggcuugguagcccugagagcuuagagucugcugg

SEQ ID NO: 29187 - RNA, 45 nt, Mus musculus
uuagaagggucaggaggacccuuaaaguggguucuuaauggugag

SEQ ID NO: 29188 - RNA, 45 nt, Mus musculus
auacacaacuguugaggcuuaagcuauaaggacacacaauggcua

SEQ ID NO: 29189 - RNA, 45 nt, Mus musculus
cuggaucucauguucuaagaauauauaauaauauaaaauaaugua

SEQ ID NO: 29190 - RNA, 45 nt, Mus musculus
gauccagugcacacauagcacgguaauugcacaauuuuuauuaag

SEQ ID NO: 29191 - RNA, 46 nt, Mus musculus
ugugguuuauuaagaauucucacaaaguuccacuuagucggggcag

SEQ ID NO: 29192 - RNA, 46 nt, Mus musculus
gucacgagggugcucagagauccagagugcauauggaagugcaugg

SEQ ID NO: 29193 - RNA, 42 nt, Mus musculus
uuggacagcagagggcccuguugugaacgcuaaugcacccag

SEQ ID NO: 29194 - RNA, 45 nt, Mus musculus
gccauuggaggcucaguaacaguucugccacuggccuauagugag

SEQ ID NO: 29195 - RNA, 44 nt, Mus musculus
ugagguuuucaguuuacucuccgcaacucuugagucuucaguaa

SEQ ID NO: 29196 - RNA, 42 nt, Mus musculus
uaaauagcuguuugaaaccaaccacaauaaugccaauccaag

SEQ ID NO: 29197 - RNA, 49 nt, Mus musculus
gaagcgggcagagguugggaaagacgaaagcguaaucacagaagaaaug

SEQ ID NO: 29198 - RNA, 46 nt, Mus musculus
ugggagaguaccagccccaccaccgagugaccgagggcaccauaag

SEQ ID NO: 29199 - RNA, 90 nt, Mus musculus
aaguuaccuggagaaaagggugcacacggaggcacugcugagcaggacccgagagaagaagcagaggaagacccgcacagaguuaaugga

SEQ ID NO: 29200 - RNA, 46 nt, Mus musculus
ugugugugugugugugugugugugugugcaugugugcacgugugug

SEQ ID NO: 29201 - RNA, 47 nt, Mus musculus
uacagacucuggaucugcaaagauauuuuagauaagaaagcuggaga

SEQ ID NO: 29202 - RNA, 42 nt, Mus musculus
uggcuccccccuaagggcaagcaaacugaugugggcaggcag

SEQ ID NO: 29203 - RNA, 46 nt, Mus musculus
gcuccuuauguugguguuuuccaucuaucauucuuuguagggcugg

SEQ ID NO: 29204 - RNA, 52 nt, Mus musculus
cacccugauaugucggucacaagggugguagugcacaaagaaacagaguugg

SEQ ID NO: 29205 - RNA, 45 nt, Mus musculus
uuuuuacccaugugguaaaaauguauguuuuaaucacugcuugga

SEQ ID NO: 29206 - RNA, 41 nt, Mus musculus
guauccauuuaccugcaaaguucaugauuucaucgcaccuu

SEQ ID NO: 29207 - RNA, 48 nt, Mus musculus
aaacacuucucagccauuugauuuuccucuuuugagaauucucuuuua

SEQ ID NO: 29208 - RNA, 46 nt, Mus musculus
ucuggguaugguaaaugggauggauccccagaugagucagucucua

SEQ ID NO: 29209 - RNA, 42 nt, Mus musculus
ugugauuugguuacucuuacaugcauucacgcgaccggccag

SEQ ID NO: 29210 - RNA, 41 nt, Mus musculus
gaaucagcuaugucuucauuaugagagugagagaaguggca

SEQ ID NO: 29211 - RNA, 25 nt, Mus musculus
uuaauugagguuuuucuuucucccu

SEQ ID NO: 29212 - RNA, 30 nt, Mus musculus
gaagugcuaaugaguaaugagauaguccaa

SEQ ID NO: 29213 - RNA, 42 nt, Mus musculus
agacugcaguagggauacugcaugagaacauauuaauaccaa

SEQ ID NO: 29214 - RNA, 44 nt, Mus musculus
ugcagcuuugaagacacugggaagaagagguuggggacagucgg

SEQ ID NO: 29215 - RNA, 47 nt, Mus musculus
ucaccgacgagucgggaugcuucuucuugugcuccucgcggcagguc

SEQ ID NO: 29216 - RNA, 46 nt, Mus musculus
ggccuggguguucaauuuugaucuuugggcgauuuucagagcaaaa

SEQ ID NO: 29217 - RNA, 42 nt, Mus musculus
uuagcugcuuucugcucauacgguuguuuaucuuuggcagau

SEQ ID NO: 29218 - RNA, 45 nt, Mus musculus
ccagacguagcgguggagaccugugccacugggaggcccggagcc

SEQ ID NO: 29219 - RNA, 42 nt, Mus musculus
agcuaagaacucccaaugagaggguagcaagggggcgggggg

SEQ ID NO: 29220 - RNA, 42 nt, Mus musculus
caacagaaugacuccaucagaacauuagaccccuccccagac

SEQ ID NO: 29221 - RNA, 63 nt, Mus musculus
auggucaguuucacuguaauucugagacccuuccagucaccgguagccuuggcaaugucaucg

SEQ ID NO: 29222 - RNA, 88 nt, Mus musculus
ccaacuuucuucggagacagacccagaggaccgaucuucggggccaaggcggauguggcgccgaccucgccuccggugcaccucaggu

SEQ ID NO: 29223 - RNA, 46 nt, Mus musculus
cagccagugaaucucucuucaucucuaaccaugccuacuaaccaga

SEQ ID NO: 29224 - RNA, 51 nt, Mus musculus
ucuacaaggcucugagcaaccaccaugucuaucuggaaggcacauugcuga

SEQ ID NO: 29225 - RNA, 45 nt, Mus musculus
aaaaugccaauguucuggcccguuaugccagcaucuaccagcaga

SEQ ID NO: 29226 - RNA, 42 nt, Mus musculus
uuaucaagcccaagggugguguugugggcaauuggggaagau

SEQ ID NO: 29227 - RNA, 43 nt, Mus musculus
cuggcaccaugcccuacccauacccagcacugaccccggagca

SEQ ID NO: 29228 - RNA, 49 nt, Mus musculus
cugaggagggugaaggguugggugcaggacccacagcuccaccugcugc

SEQ ID NO: 29229 - RNA, 42 nt, Mus musculus
cuucagccagaccagugagauugaggucucugagcaccagcg

SEQ ID NO: 29230 - RNA, 42 nt, Mus musculus
cgcuggugcucagagaccucaaucucacuggucuggcugaag

SEQ ID NO: 29231 - RNA, 45 nt, Mus musculus
cugcuggccuccaagucauccaggccaguccugauggcauuuagg

SEQ ID NO: 29232 - RNA, 46 nt, Mus musculus
aaggaaagcucaugagaagauguguauguugacauuugaacaugag

SEQ ID NO: 29233 - RNA, 46 nt, Mus musculus
cgugugauaucagaguuuguaauuccaaguguguauuggguagaaa

SEQ ID NO: 29234 - RNA, 44 nt, Mus musculus
cgacucucuaaggcggguccacucaggaguacacagaccacaga

SEQ ID NO: 29235 - RNA, 44 nt, Mus musculus
ugugggaaaggacuugcaauagaaaaaaaauagagaaagcuaaa

SEQ ID NO: 29236 - RNA, 46 nt, Mus musculus
aggaaggaaggaaggaaggaagaaggaagaaaggaaggaaggaaga

SEQ ID NO: 29237 - RNA, 46 nt, Mus musculus
caugauguuugugcaggaauagaaacccuaacuaagacagggugua

SEQ ID NO: 29238 - RNA, 45 nt, Mus musculus
ccuuggacccaaguuguuuacuuggaaauggggccacugccuugg

SEQ ID NO: 29239 - RNA, 41 nt, Mus musculus
caugggcucuccuuuugggccaguuaguuguggccggucga

SEQ ID NO: 29240 - RNA, 41 nt, Mus musculus
ugugaguacacaauggaucuuggccuagacuuugcugcagg

SEQ ID NO: 29241 - RNA, 45 nt, Mus musculus
ggauacaaaauggcagaugguuuggcgguaaugugacgugguagg

SEQ ID NO: 29242 - RNA, 42 nt, Mus musculus
ggcgaaaucugaugcccuuuucuggagcaucugaggacagcu

SEQ ID NO: 29243 - RNA, 45 nt, Mus musculus
uauuaggaggcauguccuuguuggaauagguguagccuuguugga

SEQ ID NO: 29244 - RNA, 45 nt, Mus musculus
agauaaacaggauugacagacccuuagucaaccuuaacugaaaga

SEQ ID NO: 29245 - RNA, 41 nt, Mus musculus
agggcaggaggggggaaagggaauggaauauggaguguaaa

SEQ ID NO: 29246 - RNA, 46 nt, Mus musculus
uauacaauuugacuuuggucugcucacacacaugaguuggcgagau

SEQ ID NO: 29247 - RNA, 89 nt, Mus musculus
cugauuauuuaggguaauauaaucuuuauuuauuaagagagugagagagagggagagagagagagagagagagucaaaaagacagagac

SEQ ID NO: 29248 - RNA, 45 nt, Mus musculus
gagacaaggagaggacagcucaguuaccuacccugaaggcauaug

SEQ ID NO: 29249 - RNA, 46 nt, Mus musculus
agugagccuggcuaccaccccugucaaaggcuccuuuucguaagau

SEQ ID NO: 29250 - RNA, 46 nt, Mus musculus
cucgucaggguggaaaaguaccaccuguaaguaaauagcccgggau

SEQ ID NO: 29251 - RNA, 44 nt, Mus musculus
gaucgacaauuucuucagugagccgaccaccaagagcugggagg

SEQ ID NO: 29252 - RNA, 47 nt, Mus musculus
augucuaugggaaagaugccaaggagcaaggcuuuguggugguggag

SEQ ID NO: 29253 - RNA, 46 nt, Mus musculus
cuuuuuccccugacaguauguauccaauaagugaaaguccccugaa

SEQ ID NO: 29254 - RNA, 46 nt, Mus musculus
auuggaucacacagaucauucccuccaaucuuucucacccccagcc

SEQ ID NO: 29255 - RNA, 33 nt, Mus musculus
guuaucuucagcaaugggacuuugcugucaguu

SEQ ID NO: 29256 - RNA, 45 nt, Mus musculus
uauauagagacauccaacgaguucugugauucuagaggacccuga

SEQ ID NO: 29257 - RNA, 46 nt, Mus musculus
ugugaugaauaggaagggagcuacauguaaucugugacugugggau

SEQ ID NO: 29258 - RNA, 46 nt, Mus musculus
gaucuuuucucuguacauuuucuuacuuaacacuauggggccacau

SEQ ID NO: 29259 - RNA, 46 nt, Mus musculus
guguuuuuguuguuuguuuguuuguuuggguuuuguuuuuucaaga

SEQ ID NO: 29260 - RNA, 42 nt, Mus musculus
guccccaggguagauagcagaguuacauggcuuuaaggagau

SEQ ID NO: 29261 - RNA, 46 nt, Mus musculus
ggcgagaacugacuauucuagggccuucugaagggagcguuugaca

SEQ ID NO: 29262 - RNA, 79 nt, Mus musculus
cuguauauguguguaugaguguaugagagagauggggggaugaauagcaggggaggacagaagaggggaggguagagga

SEQ ID NO: 29263 - RNA, 45 nt, Mus musculus
uguuuuguuugguguguguguauauguguguguguguguguguau

SEQ ID NO: 29264 - RNA, 31 nt, Mus musculus
agucagaguuaagugaccgcaaaaguauuga

SEQ ID NO: 29265 - RNA, 46 nt, Mus musculus
ugaggagucaacugaacguacuugcacacgcauagagcccccagac

SEQ ID NO: 29266 - RNA, 46 nt, Mus musculus
gcaagaaacacuauguauauucaaagucaguuuauagagaacagau

SEQ ID NO: 29267 - RNA, 45 nt, Mus musculus
ggugggggguugggggagguaaagagguagaagguggggcaaaga

SEQ ID NO: 29268 - RNA, 46 nt, Mus musculus
augauuaagaaaauuuaguaaaguuucccaaauaguaaaggaaaaa

SEQ ID NO: 29269 - RNA, 89 nt, Mus musculus
ugaaaacgguugcgaagaauauggucucaucugccccauggaagagguggucuccauugcccuguacagugacauaucccacaugaaga

SEQ ID NO: 29270 - RNA, 46 nt, Mus musculus
augcagaacacuuucaaguuacuugcuuuccguccuacugccaucg

SEQ ID NO: 29271 - RNA, 46 nt, Mus musculus
guguugguugauuuuuuuuuuuuuuaauguucauugguguuuuauc

SEQ ID NO: 29272 - RNA, 46 nt, Mus musculus
ucauuaauuuauuuauucacuuuacauuccaauauagccccccucc

SEQ ID NO: 29273 - RNA, 46 nt, Mus musculus
acuaaccagucauaacaauauacugggugugcuguacaugagagag

SEQ ID NO: 29274 - RNA, 46 nt, Mus musculus
cauccaggacaacugucaugugugugguaaaaacaguccucuagau

SEQ ID NO: 29275 - RNA, 42 nt, Mus musculus
cuauggcuaauauaaaucagaugcugaccaaaaccacuggaa

SEQ ID NO: 29276 - RNA, 46 nt, Mus musculus
accuguucucaugauugucgcaauacacacacacacacacacacac

SEQ ID NO: 29277 - RNA, 46 nt, Mus musculus
uaaaacuuacuuuacuuaaaaaauuguaaaauaucagcacugguaa

SEQ ID NO: 29278 - RNA, 42 nt, Mus musculus
aaaaaacaagccaaacaaaaugcagagauaguuucagcugcg

SEQ ID NO: 29279 - RNA, 46 nt, Mus musculus
agagacagagaaacagagagacagacagagagauacagacagagag

SEQ ID NO: 29280 - RNA, 85 nt, Mus musculus
ugcgacauacucauugggagaagaacaggaagagagguagacuugcuugggagguuuagcagcuggaagggaugggguuuaaaug

SEQ ID NO: 29281 - RNA, 41 nt, Mus musculus
agaagagcaguggcaggugacagaacaauagagccaucuag

SEQ ID NO: 29282 - RNA, 46 nt, Mus musculus
auagugcucuuaacugcuaagccaucuugccagccccaacuuauuu

SEQ ID NO: 29283 - RNA, 24 nt, Mus musculus
uuuagcuuacuguggguuuaucua

SEQ ID NO: 29284 - RNA, 45 nt, Mus musculus
cuuugaaugggggaaagggagugguuggugggugggguuggcaag

SEQ ID NO: 29285 - RNA, 45 nt, Mus musculus
augccaugaaggagauuauagaauucugagaaggauguuuuuagg

SEQ ID NO: 29286 - RNA, 48 nt, Mus musculus
caaagcggaaggaagguucagcaguuuagaaagcuacagcagagagua

SEQ ID NO: 29287 - RNA, 84 nt, Mus musculus
guuggaacuucagcacuuaguggucucguacagaaaagggaagcagaaggagcccaaaggaggaggagucacagcaaccacgua

SEQ ID NO: 29288 - RNA, 46 nt, Mus musculus
aaaacuaaacuggaauauguagcaggccaaguuuaaggagacagau

SEQ ID NO: 29289 - RNA, 46 nt, Mus musculus
guuaaggucuaaacuuggugugaauguuuuaucuguggccccgaaa

SEQ ID NO: 29290 - RNA, 41 nt, Mus musculus
gugugugugugugguguuugugugugugugugugugugugu

SEQ ID NO: 29291 - RNA, 41 nt, Mus musculus
agacuaguacaaugagacucagucucauaaaggaaggaagg

SEQ ID NO: 29292 - RNA, 42 nt, Mus musculus
acacaggcgaauuuuucuggggcaguguacucaagggcaguc

SEQ ID NO: 29293 - RNA, 46 nt, Mus musculus
uagaaaaagacagagauacagagaaaggaggagaaucgggagacac

SEQ ID NO: 29294 - RNA, 46 nt, Mus musculus
auaggggaaggaagaaaucaaccaugugauagaugagccauuagaa

SEQ ID NO: 29295 - RNA, 47 nt, Mus musculus
ugaauuguuccagauaccuucaauuuggaaaguuuucugagacaugg

SEQ ID NO: 29296 - RNA, 41 nt, Mus musculus
cucugauguugcuguucacagcuuuucuugauaggccuagu

SEQ ID NO: 29297 - RNA, 64 nt, Mus musculus
ccaaugaccuagccccaucccuccauucacucccagguaagaauucagacaaauguccacagag

SEQ ID NO: 29298 - RNA, 46 nt, Mus musculus
aacccuuggauugaccccaccaacaacugaacauuuuggccaagcu

SEQ ID NO: 29299 - RNA, 46 nt, Mus musculus
aggaaggauucaagggaaccuucccugaugcgagagaacaagagau

SEQ ID NO: 29300 - RNA, 37 nt, Mus musculus
uuaugcuaaugaggcaggauuugaugagaugucaaga

SEQ ID NO: 29301 - RNA, 90 nt, Mus musculus
ggaaggcacucauugagauggagaagcagcagcaggaucaaguggaccggaacaucaaggaggcucgugagaagcuggagauggaaaugg

SEQ ID NO: 29302 - RNA, 45 nt, Mus musculus
ccucagggaaaggcauuguugaguucucagggaagccagcugcuc

SEQ ID NO: 29303 - RNA, 62 nt, Mus musculus
cccugauaucacugaggaggaaaugaggaaacuuuuugagaaauauggaaaagcaggcgaag

SEQ ID NO: 29304 - RNA, 66 nt, Mus musculus
gaauuuuaggaaaccaggagagaagaccuuuacacagcauagccgucucuuugugggcaaucuucc

SEQ ID NO: 29305 - RNA, 45 nt, Mus musculus
acaaaaaugcagagcaauaaagccuuuaacuuggagaagcagaau

SEQ ID NO: 29306 - RNA, 45 nt, Mus musculus
ccauacucugagcaaagaacugugggcagaggagucgggguuagu

SEQ ID NO: 29307 - RNA, 46 nt, Mus musculus
ucuugugucagaaugucuuaucaaaguaacagaaagaaggaaagaa

SEQ ID NO: 29308 - RNA, 45 nt, Mus musculus
acuagguaauuuaaaaaaaaauuaaauuccauguccagucccagc

SEQ ID NO: 29309 - RNA, 45 nt, Mus musculus
uauacuuagucaucaaaauaaugguuuuaaauaauauuugacccu

SEQ ID NO: 29310 - RNA, 45 nt, Mus musculus
uuccaggaucuaaaaauggaaacagaaacaauaaagaaaucagua

SEQ ID NO: 29311 - RNA, 41 nt, Mus musculus
uuuugccugaaugcaccacuugugugccugaugcccaagga

SEQ ID NO: 29312 - RNA, 42 nt, Mus musculus
uggcauauugcugugacagaccugaccuuauuugggggagga

SEQ ID NO: 29313 - RNA, 46 nt, Mus musculus
cuguuugagucccugucuuaacuuccuucaauaaugagcagcagua

SEQ ID NO: 29314 - RNA, 46 nt, Mus musculus
cuggcgguccuaggcucuguaagaaagcaggcucagcaagccagua

SEQ ID NO: 29315 - RNA, 47 nt, Mus musculus
uuaugguuuugugugucaacuugacacaagccagaguuaucggagag

SEQ ID NO: 29316 - RNA, 76 nt, Mus musculus
ugaaacuggauaaaugaaacaauugcaguugacccccaaacaugugguguuucugaugaacacuuucaaauuggcu

SEQ ID NO: 29317 - RNA, 30 nt, Mus musculus
cugggugccaaagccaucuauccccugaac

SEQ ID NO: 29318 - RNA, 74 nt, Mus musculus
ccauuacaugcacuggaaaugauucacauagcagacuguggaaaagaaacuacuguuagaucacuucauagaug

SEQ ID NO: 29319 - RNA, 46 nt, Mus musculus
aggucuugccaucugccugucuuucucuuauuuagaccaggagaag

SEQ ID NO: 29320 - RNA, 70 nt, Mus musculus
caauaaacuugauaugauuaacugauaaaaacaaaacaaaacaaaacaaaacaaaacaaaaccgguuugu

SEQ ID NO: 29321 - RNA, 46 nt, Mus musculus
acuuuuagauaaaagguaggaagaccagaggauauugugggaagag

SEQ ID NO: 29322 - RNA, 46 nt, Mus musculus
gaguacugagacuugcauuacauauuuuagaauauaaaacauugau

SEQ ID NO: 29323 - RNA, 46 nt, Mus musculus
gauaucauguaggcaggcucagccaaauaaaacccaaagagaaaau

SEQ ID NO: 29324 - RNA, 47 nt, Mus musculus
gcuuucaauaacgugggaacugccaucagcaagaaguuuggagauau

SEQ ID NO: 29325 - RNA, 46 nt, Mus musculus
ucuaguuagugugcuugcucaguuaauagaguuaccuuccuucugc

SEQ ID NO: 29326 - RNA, 53 nt, Mus musculus
uugucagcaaaagaaagacaucugguugagaucaaacagaaacucggcaugaa

SEQ ID NO: 29327 - RNA, 45 nt, Mus musculus
cagggauggccgauuaggucaucuuuugauacauaugcagcuaga

SEQ ID NO: 29328 - RNA, 46 nt, Mus musculus
auccuuagauuuggucuucucauuguguccuagauuuccuggaugu

SEQ ID NO: 29329 - RNA, 45 nt, Mus musculus
ugggaugcuuuaaaugggacuuaauggaucauccuaguaggaaua

SEQ ID NO: 29330 - RNA, 46 nt, Mus musculus
gcaguaggcagugcugacuucucuagcaugcucucugaggaggaga

SEQ ID NO: 29331 - RNA, 46 nt, Mus musculus
aagacuuuauugaaauauuagguuuaaaaauuugggggcugggaag

SEQ ID NO: 29332 - RNA, 42 nt, Mus musculus
cccacauccccugcugccccagcagguaggagagcuggagag

SEQ ID NO: 29333 - RNA, 46 nt, Mus musculus
uggauacuucaguccuucuuagaaaggggaacaaaaugcccauggg

SEQ ID NO: 29334 - RNA, 46 nt, Mus musculus
gcugcgaggaauaaagggugggguguaugggaggaagcagucaguu

SEQ ID NO: 29335 - RNA, 47 nt, Mus musculus
ccuuuguaugggagugcaugcacauuugugugugugugugugugugu

SEQ ID NO: 29336 - RNA, 42 nt, Mus musculus
uuuuagaagagaugcuuuuuugggaccaauagggcccuggug

SEQ ID NO: 29337 - RNA, 46 nt, Mus musculus
cucucacuggacuuggaacucacuacuuuggcuagacugugaccag

SEQ ID NO: 29338 - RNA, 46 nt, Mus musculus
uaggccaugaauuugagauggaauguggguggauguguaaggaaua

SEQ ID NO: 29339 - RNA, 47 nt, Mus musculus
accucuagaugcauagcuacagacaauuaacuacugcugcaaggggg

SEQ ID NO: 29340 - RNA, 46 nt, Mus musculus
cauuucuuguauucuguugcugaugcucgcaucuauaguuccagau

SEQ ID NO: 29341 - RNA, 46 nt, Mus musculus
augcuguguccgucacuggucgccugccccaaggaaucgugcggga

SEQ ID NO: 29342 - RNA, 46 nt, Mus musculus
aucucucaggcuguucuuugcucuugaaaucucgacagacaugauc

SEQ ID NO: 29343 - RNA, 45 nt, Mus musculus
aaggccacaccaaugauugucucugaugucuguguccugacugga

SEQ ID NO: 29344 - RNA, 45 nt, Mus musculus
uuuuguuuuaguuuuucuuuuacacauacacggacugagagcagc

SEQ ID NO: 29345 - RNA, 46 nt, Mus musculus
gguagcagaguuaagaauucaucaccaugaguaauaguucauagag

SEQ ID NO: 29346 - RNA, 41 nt, Mus musculus
gggucaguggaugcagggucacucaaagaagcauuaggaag

SEQ ID NO: 29347 - RNA, 42 nt, Mus musculus
ccggucgcccccgaggucugguccucagauguacagagagac

SEQ ID NO: 29348 - RNA, 44 nt, Mus musculus
cuugacaaaguugucauugagagcaaugccagccccggcaaagg

SEQ ID NO: 29349 - RNA, 62 nt, Mus musculus
auccaucccaaaacaaccaccaaacccagacacuauugcagaugccaaaaauaacuugcuga

SEQ ID NO: 29350 - RNA, 46 nt, Mus musculus
caagauacaauuuacaaaauacaugaaacucaugaaauaggaagac

SEQ ID NO: 29351 - RNA, 46 nt, Mus musculus
uaguacuugaaguccaagucagagcaaguagacaacaaaaggagau

SEQ ID NO: 29352 - RNA, 46 nt, Mus musculus
aaaaaaucaccagauaccagauaccaaaguuaaaucaggaucagau

SEQ ID NO: 29353 - RNA, 46 nt, Mus musculus
auaaagccacaacauacccaaacuuuugggacacaaugaaaccugu

SEQ ID NO: 29354 - RNA, 74 nt, Mus musculus
aagcaguaagggaaaaaggucaaguaagauaugaaggcagaccuauuauaauuauaccagacuucucaccggag

SEQ ID NO: 29355 - RNA, 45 nt, Mus musculus
uccuggauguccuucucgagaaaugcagaaacuguuaaagcaaga

SEQ ID NO: 29356 - RNA, 46 nt, Mus musculus
ugcauugaauaggucacagucgaacaguuguuggaauugaagagaa

SEQ ID NO: 29357 - RNA, 45 nt, Mus musculus
gcauaguggcagaauguagacuuuugucacagugcaauggcaguc

SEQ ID NO: 29358 - RNA, 45 nt, Mus musculus
aaguaaacuuuugugucucaggcuuugcagaugaagagcuuaaag

SEQ ID NO: 29359 - RNA, 44 nt, Mus musculus
gucugaugcacuuuucuggugugugucugaagacagcuacagcg

SEQ ID NO: 29360 - RNA, 46 nt, Mus musculus
cuuaaugauucuguaaguaugcuguuuuauauuuucaccugcauau

SEQ ID NO: 29361 - RNA, 46 nt, Mus musculus
cuuccccuuccccuucuuccccuucuuccccuuucccuuccccuuc

SEQ ID NO: 29362 - RNA, 65 nt, Mus musculus
uggauauuuauucauauaaauacacacacacacacauacauauuucccuuucccuuucccuuucc

SEQ ID NO: 29363 - RNA, 54 nt, Mus musculus
gcucaccggcuucagcaagaagaagacagaaagaggaaaucugaagaaucaaga

SEQ ID NO: 29364 - RNA, 46 nt, Mus musculus
ugggcagguagcaucuaauguaacuaggauucuagagggaccagga

SEQ ID NO: 29365 - RNA, 46 nt, Mus musculus
uaugauuucuggggagauacaacacacacaucuacuuaccgcagau

SEQ ID NO: 29366 - RNA, 46 nt, Mus musculus
ucccgaauguccauuuuguggaaaaauugagggguguagucaagau

SEQ ID NO: 29367 - RNA, 46 nt, Mus musculus
caaaagagcagagaaaagaagccuggauugucugaggcccaaggau

SEQ ID NO: 29368 - RNA, 45 nt, Mus musculus
gaucugcagcggggcaugcugggaucucuacccucucuggccagu

SEQ ID NO: 29369 - RNA, 42 nt, Mus musculus
gcuaucugcagcugaguuuuuggaagacauaugcacaaaggg

SEQ ID NO: 29370 - RNA, 46 nt, Mus musculus
cugagguagaggagaauggauuuuacacaagggcccagucauaggg

SEQ ID NO: 29371 - RNA, 46 nt, Mus musculus
gugagaaaacugucaggauuugggggcagagacaaauagggcaaau

SEQ ID NO: 29372 - RNA, 47 nt, Mus musculus
cuuuaaauggucuuugguaaagugugaccacauucccuggggcaguu

SEQ ID NO: 29373 - RNA, 46 nt, Mus musculus
ugccuuggugggacucgaacuccacggcguggcccaucgcccauca

SEQ ID NO: 29374 - RNA, 45 nt, Mus musculus
gaagagcaaagacuugaaagccacaaucuugaaacuacuggagac

SEQ ID NO: 29375 - RNA, 45 nt, Mus musculus
ucuguacuucguucuuugcauggcuuggucccugucugugacaug

SEQ ID NO: 29376 - RNA, 46 nt, Mus musculus
ccgauaucuauguacugugaagaaccgugaguuucaccacugcaag

SEQ ID NO: 29377 - RNA, 46 nt, Mus musculus
uuccucaggaacuaucuaaggaccuaaguuccuaggcagcacacag

SEQ ID NO: 29378 - RNA, 46 nt, Mus musculus
aguacccuuagcuuaucucugucuagaggaccaaacgcccugagau

SEQ ID NO: 29379 - RNA, 46 nt, Mus musculus
aaagaacaccggcaucuugcuuaggaacucuucuacuguggugaag

SEQ ID NO: 29380 - RNA, 49 nt, Mus musculus
acucaaacuguauugcauguuuauuugaaguuacaccaucauggagagc

SEQ ID NO: 29381 - RNA, 45 nt, Mus musculus
uaugacguuggggucauagcaaagcccugaccugcauucucugau

SEQ ID NO: 29382 - RNA, 45 nt, Mus musculus
acauuucagaauguuggcuaaucucuuacuaaacuaaaagacaaa

SEQ ID NO: 29383 - RNA, 41 nt, Mus musculus
gcugagacugcgggggaagaagggugagcauucgcuguaag

SEQ ID NO: 29384 - RNA, 46 nt, Mus musculus
cauuccauaaauauggggaauacuuuccuggaacaggagacuugag

SEQ ID NO: 29385 - RNA, 47 nt, Mus musculus
ccuaugggucugggucacagggcuccucacuuugagaaugguggaua

SEQ ID NO: 29386 - RNA, 45 nt, Mus musculus
ggaguccuccugccauggguggauccuggggaucaaaccgugggg

SEQ ID NO: 29387 - RNA, 44 nt, Mus musculus
agaauacccaagacacaauuuacaaaacucaugaaacucaagaa

SEQ ID NO: 29388 - RNA, 46 nt, Mus musculus
ccauaaacaaccaccauacccagacauuauuacauauaccaacaag

SEQ ID NO: 29389 - RNA, 47 nt, Mus musculus
cccaguacaggggaaugccagugacaggaagcaggaaaugggagugg

SEQ ID NO: 29390 - RNA, 46 nt, Mus musculus
cauuuuaaaauaugucagacuuuuuguuaugaaauagucuucuaag

SEQ ID NO: 29391 - RNA, 42 nt, Mus musculus
ugucuggggacaggcuugguuguuucaaucuaacugucaaag

SEQ ID NO: 29392 - RNA, 59 nt, Mus musculus
aauguugcccgauguuggacauaugagacugcaguugcccuugauugugaaauucccaa

SEQ ID NO: 29393 - RNA, 101 nt, Mus musculus
cagcguuuauuugaaaaucuacguauguuaccacaugcaccugguguucaaaugcaagcuauuccagaggaugcuguucaugaagacaguggagaugagga

SEQ ID NO: 29394 - RNA, 64 nt, Mus musculus
acaaacggauagcuugcgaugaagaguuuucagauucugaggaugaaggugaaggaggucguag

SEQ ID NO: 29395 - RNA, 66 nt, Mus musculus
gaauguugcugaucauaagaaaggagcaaagaaggcuaggauugaagaagacaagaaggagacaga

SEQ ID NO: 29396 - RNA, 42 nt, Mus musculus
cuuugggacccacauucuagagaacugugucugcacuguaag

SEQ ID NO: 29397 - RNA, 46 nt, Mus musculus
uaugugauuguauuuaaauugauguguuauuaugucaaaagccgga

SEQ ID NO: 29398 - RNA, 45 nt, Mus musculus
aauguuaauauggcuuuuuuguacuacuaaaaauagcuuugagau

SEQ ID NO: 29399 - RNA, 46 nt, Mus musculus
gaaaaguauucuauauugcuagguuuguucuuuuaacagcugagau

SEQ ID NO: 29400 - RNA, 46 nt, Mus musculus
agcucagaaauucauaaucagugucaaauuaaguauguaggaagau

SEQ ID NO: 29401 - RNA, 45 nt, Mus musculus
uaaauacuggaggagcuuugaccaauuugacauagagcuggaaug

SEQ ID NO: 29402 - RNA, 48 nt, Mus musculus
aaaccauaggaacuuccugcuuaucucauguuagcuguaccagucagu

SEQ ID NO: 29403 - RNA, 46 nt, Mus musculus
ucguaauaauuuuucuuuaaaaaaaaaaagaaagaaagaaagaaag

SEQ ID NO: 29404 - RNA, 46 nt, Mus musculus
aggggccacuaugggaaauugaagcagugcauaacauugccaagau

SEQ ID NO: 29405 - RNA, 46 nt, Mus musculus
uuaagcagcaaauuuuuuguuuuuuguuuuuuuuaagcccccuucc

SEQ ID NO: 29406 - RNA, 42 nt, Mus musculus
uuuuauuacuucuuuuuuuaaaaaaacuacacuugggcuccu

SEQ ID NO: 29407 - RNA, 46 nt, Mus musculus
aaaaagaaguaauaaaaaaaaaucccagauuuguagccgcacugua

SEQ ID NO: 29408 - RNA, 46 nt, Mus musculus
ucugugcacuugggcguuggaccccgcaucuuauuagcaaccaggg

SEQ ID NO: 29409 - RNA, 41 nt, Mus musculus
ccaaucaagacaugcauuauuauuuucaggccgagggagac

SEQ ID NO: 29410 - RNA, 35 nt, Mus musculus
auacacacuuauacacguaaacacacgggaaagau

SEQ ID NO: 29411 - RNA, 45 nt, Mus musculus
gggaagcaaucaggaacgcugaauauucauuucgaguccuuggag

SEQ ID NO: 29412 - RNA, 42 nt, Mus musculus
aauggaaagguguuaagaauggcgauggcaaauuagggaagu

SEQ ID NO: 29413 - RNA, 46 nt, Mus musculus
ugcaggguugcauuuuaaaaauagauuaaaaaaaaaaaagccauuu

SEQ ID NO: 29414 - RNA, 45 nt, Mus musculus
aaagacuccuuuuucaaguagaguuugaugcugugaaccuuggaa

SEQ ID NO: 29415 - RNA, 46 nt, Mus musculus
gaccuauucaguuauaauuguuagagauuucuuuuggagcgcacag

SEQ ID NO: 29416 - RNA, 46 nt, Mus musculus
agguaaauaaaacuuguaagcucauuuguacuuuugaaaagggccc

SEQ ID NO: 29417 - RNA, 46 nt, Mus musculus
ucucaauuucaaguaaguaauuuauuuugguuaauauauugggggc

SEQ ID NO: 29418 - RNA, 25 nt, Mus musculus
caauugcacccaugcuguaugugug

SEQ ID NO: 29419 - RNA, 46 nt, Mus musculus
cuuuugcucauuuucuuguuuuccaacaagaagucuugguucugag

SEQ ID NO: 29420 - RNA, 46 nt, Mus musculus
aaauaaauaaauaaagauccagcaugggcauuucuuauuuggagag

SEQ ID NO: 29421 - RNA, 50 nt, Mus musculus
cugccuuagauccaagaauuuuugagcaacacaaauugacuuugacaggg

SEQ ID NO: 29422 - RNA, 42 nt, Mus musculus
uggguuccacugaacauagugcuuugcccuagagcaccacag

SEQ ID NO: 29423 - RNA, 64 nt, Mus musculus
ccaaauaauguuuucagauacuguuuuggggugauugugcauguagaaugguuuuucugaaccc

SEQ ID NO: 29424 - RNA, 56 nt, Mus musculus
uagauuaucugacaaugacuuguugcguguacacguuacugacuggcaugguugag

SEQ ID NO: 29425 - RNA, 46 nt, Mus musculus
agagaggggagagagaaugaauaugagugaaugaauaagugugcag

SEQ ID NO: 29426 - RNA, 45 nt, Mus musculus
aucucucacugggcugaagaaacuccuuuugauacaaagaugcag

SEQ ID NO: 29427 - RNA, 45 nt, Mus musculus
uuguuucuucuuggccuuuucaguuuauuugcuuuccucaugaca

SEQ ID NO: 29428 - RNA, 46 nt, Mus musculus
cugaccucuagguaugaggcagucacacacacacacacacacacac

SEQ ID NO: 29429 - RNA, 45 nt, Mus musculus
auucaucacaacagauaaaaccccaauacaauaauccgcccccaa

SEQ ID NO: 29430 - RNA, 41 nt, Mus musculus
uaacaaacaaaucccccaaacaaaauaacaaaacaccccac

SEQ ID NO: 29431 - RNA, 46 nt, Mus musculus
aaugauaaaagccaucacauugaaguugaacaagacaaaccagcag

SEQ ID NO: 29432 - RNA, 46 nt, Mus musculus
uuagucaggcucauuuuuacuuugauguaucuuauaaaaccaccuu

SEQ ID NO: 29433 - RNA, 46 nt, Mus musculus
uggguuucucuucccuguacucgcuagagacuguaagugggaagug

SEQ ID NO: 29434 - RNA, 42 nt, Mus musculus
cagucugagggcuggugcuuguuuuuggauuugugcugacua

SEQ ID NO: 29435 - RNA, 54 nt, Mus musculus
uguaaauaauacuguaggcaaugaccuucauagugggagauucccgauuaggaa

SEQ ID NO: 29436 - RNA, 46 nt, Mus musculus
aacauacauauacccgccuccauccacaaaggugauuauaggacaa

SEQ ID NO: 29437 - RNA, 47 nt, Mus musculus
cagcucacggccaucugagcuccauagaagaccugacuaggaugaga

SEQ ID NO: 29438 - RNA, 46 nt, Mus musculus
cagugauacgcauuuccuaaguuuucaaaacuagaacaguuggugg

SEQ ID NO: 29439 - RNA, 46 nt, Mus musculus
agcagccagaaagcuaucuuucucagauggcauucaguaucgacag

SEQ ID NO: 29440 - RNA, 36 nt, Mus musculus
cucauauacacacaaaauaaauacaucuuaacauaa

SEQ ID NO: 29441 - RNA, 46 nt, Mus musculus
gaugaaaggaagcuaugcaaaagccaggaacagggcuuuccaggcu

SEQ ID NO: 29442 - RNA, 46 nt, Mus musculus
agaggacaaccucaggugucaacuucaccuuucgccuuguuuugag

SEQ ID NO: 29443 - RNA, 46 nt, Mus musculus
uugaguuugggucucugacacccuaaaaauauuugugugcaucccu

SEQ ID NO: 29444 - RNA, 45 nt, Mus musculus
uaaagcuccucuucugugucuagagguuuugcuugauagguucau

SEQ ID NO: 29445 - RNA, 42 nt, Mus musculus
acucauacagguaaaauaaaaacguauuucccaguggaucag

SEQ ID NO: 29446 - RNA, 46 nt, Mus musculus
uuuuucaucuccucaaauacaguuugugcuggccauauccuuguag

SEQ ID NO: 29447 - RNA, 42 nt, Mus musculus
cccaucaucuuuucugcaguggucccugagccuuaggaggag

SEQ ID NO: 29448 - RNA, 45 nt, Mus musculus
cguucguucguucgugugugugugugugugugugugugugugugu

SEQ ID NO: 29449 - RNA, 45 nt, Mus musculus
uacccaauagauugugugugucuguguguguaugggggggggcga

SEQ ID NO: 29450 - RNA, 23 nt, Mus musculus
acuuuugccauagcauuuucuuu

SEQ ID NO: 29451 - RNA, 46 nt, Mus musculus
cgugaugcugaugacauauuaaucauagauggauuuccagccacag

SEQ ID NO: 29452 - RNA, 81 nt, Mus musculus
ggaugcuagguauaaaagcugaauuuucugauagaguagccgguucuuuuaacugcugaaccaucucucauagccucuuuu

SEQ ID NO: 29453 - RNA, 46 nt, Mus musculus
acuucuuuuuuuccuucccuuuuucuuuucuucuccuaguccucuu

SEQ ID NO: 29454 - RNA, 46 nt, Mus musculus
ggaaguagauuaucaaaaguuaagaucuuagcaaguuacgggccag

SEQ ID NO: 29455 - RNA, 46 nt, Mus musculus
aguagaagaagcacuuauuaaugaagaagcaauuuugaaccucaua

SEQ ID NO: 29456 - RNA, 45 nt, Mus musculus
gaggaaaaaaaauauguaugucacgacagcaggugugccaguuga

SEQ ID NO: 29457 - RNA, 45 nt, Mus musculus
aaauagugacgaugaagagaacgaaccccagauugagaaggagga

SEQ ID NO: 29458 - RNA, 45 nt, Mus musculus
ucaaaucccgaaaacgaagaaaaaugucuaaaaaguugcccccug

SEQ ID NO: 29459 - RNA, 45 nt, Mus musculus
caaccaaauaucccauuuauccacuaacaccaaagaagagucaca

SEQ ID NO: 29460 - RNA, 45 nt, Mus musculus
agaugauucacauucuucuguuguuuauaguucuauagggcccgg

SEQ ID NO: 29461 - RNA, 28 nt, Mus musculus
augggaaaguuaaaugaguaucgcaguu

SEQ ID NO: 29462 - RNA, 46 nt, Mus musculus
aaucaaaaaccagugaaacuuguucuccagggaaugcagcuucuga

SEQ ID NO: 29463 - RNA, 49 nt, Mus musculus
caaaccaaagcgcugucucaauguaagaaucaaaauguaucaacaccuu

SEQ ID NO: 29464 - RNA, 78 nt, Mus musculus
ucuaaaagaauuguuacaaaaaagacaacagaaagcacaaaguacaaaugucguacaagacucaacgucuacucauca

SEQ ID NO: 29465 - RNA, 63 nt, Mus musculus
accagugacuucuccaagaaaaccucgaacucccagaagaacaaaaccuaaggaacaaacccc

SEQ ID NO: 29466 - RNA, 45 nt, Mus musculus
cucugguagucaguuuguuccagcugaucagaauuugccgcagaa

SEQ ID NO: 29467 - RNA, 46 nt, Mus musculus
gcaaacaguucagacuggauucaaggucauaaccgcaaagaagcag

SEQ ID NO: 29468 - RNA, 42 nt, Mus musculus
guaaccacaugguggcucaugaccaucuguaaugagauccga

SEQ ID NO: 29469 - RNA, 45 nt, Mus musculus
uucauaacccauggugagauggcuuuacauaauggaaauaggcaa

SEQ ID NO: 29470 - RNA, 46 nt, Mus musculus
acaucuuacuucuccuuccucacucuagaccauccuuuguccccac

SEQ ID NO: 29471 - RNA, 102 nt, Mus musculus
gagaggcagccaucagguauacuuguuaauuacuuugguuguaagagauaaagaugaaaagacugauugaaaauguccuagauuaggcuguagcucagcucu

SEQ ID NO: 29472 - RNA, 103 nt, Mus musculus
agggugucugucugaaggacuugagguuuagagauugaucccagcaccacagaaaagaaaguagcuguggaaagaggaaaggaaaggaaaggagaagagggag

SEQ ID NO: 29473 - RNA, 46 nt, Mus musculus
uuacauguaaucuaauuugaaacagugcaugagugaaucugcuuga

SEQ ID NO: 29474 - RNA, 46 nt, Mus musculus
uuccuuaaaguccugaaugcuaguuguacccuguaucuccagccau

SEQ ID NO: 29475 - RNA, 46 nt, Mus musculus
ugguaugguuuuuugguuuuuuguuuuucaaaucagcauuauuagg

SEQ ID NO: 29476 - RNA, 46 nt, Mus musculus
agcaaggcagguguucaguuuuuaaaaauuagugcauucuggcuua

SEQ ID NO: 29477 - RNA, 46 nt, Mus musculus
uuuagcuuuguagacagauggcucaugugaggagagccgugagcag

SEQ ID NO: 29478 - RNA, 41 nt, Mus musculus
cuaccaauuaagagaugauauugaacuuuaauuacaaguca

SEQ ID NO: 29479 - RNA, 46 nt, Mus musculus
cuaaggaggcagaguuacgcagguaucuaugaguucaagcuagcuu

SEQ ID NO: 29480 - RNA, 45 nt, Mus musculus
acugugagaccuuaucuaagaaauaaaaauuaugaaacacuggag

SEQ ID NO: 29481 - RNA, 46 nt, Mus musculus
auauuguuaaaaugaaauaaugucaaaauugaacuacauaaugcag

SEQ ID NO: 29482 - RNA, 45 nt, Mus musculus
auggaaacacaaaugauaucaaauagcaaaagccaauccuaagca

SEQ ID NO: 29483 - RNA, 46 nt, Mus musculus
gcaccugaaguaagcaggaucugcuaggaaaggcaaaggcaaggag

SEQ ID NO: 29484 - RNA, 24 nt, Mus musculus
uuuuucugggagaaugccgugcau

SEQ ID NO: 29485 - RNA, 47 nt, Mus musculus
ugguaguuagguccaaauauuacauuaaagaaaaaacaccccaugga

SEQ ID NO: 29486 - RNA, 46 nt, Mus musculus
uaacugcauaaacucuggguuccauggaagaccuugucucaaaaag

SEQ ID NO: 29487 - RNA, 46 nt, Mus musculus
ucuaaugucaaccccugaccacugcacacacaugucuugugcacag

SEQ ID NO: 29488 - RNA, 45 nt, Mus musculus
cugacuucaguucagucccuaggacccacaaaaauguggaaggag

SEQ ID NO: 29489 - RNA, 50 nt, Mus musculus
ugugugcgcacgcgcgcagucacguaccaacauaaggcuagagagauggu

SEQ ID NO: 29490 - RNA, 45 nt, Mus musculus
uuaagguggacauagcuaugucuguaacuccaguguuacaaggaa

SEQ ID NO: 29491 - RNA, 41 nt, Mus musculus
auauuaaaagcuagacauggacacaugaguauccccagcag

SEQ ID NO: 29492 - RNA, 51 nt, Mus musculus
auauuaccugcuucagccaaugacaagcuguuuauaaggguaauucauagu

SEQ ID NO: 29493 - RNA, 45 nt, Mus musculus
uacuaauuaauauucuaaauguguacuugaaccucuuaacccaaa

SEQ ID NO: 29494 - RNA, 46 nt, Mus musculus
ugaucuguaauaacagaaagccaaucauguguuaauccuggggcag

SEQ ID NO: 29495 - RNA, 25 nt, Mus musculus
uuggggguuauuggguaguucauau

SEQ ID NO: 29496 - RNA, 48 nt, Mus musculus
gcuauugacuuaaauauacaacgugcaaagcaguguaugcgguaagcu

SEQ ID NO: 29497 - RNA, 46 nt, Mus musculus
caucuaguucaagaacuaugccucauaauuacaugaaaauaccgga

SEQ ID NO: 29498 - RNA, 46 nt, Mus musculus
augggcgcgcgugugugugugugugugucugugugugugugugugu

SEQ ID NO: 29499 - RNA, 44 nt, Mus musculus
gauacuugagcguucucuaaagcugcuguucgaaacaagagaua

SEQ ID NO: 29500 - RNA, 42 nt, Mus musculus
auugaauauuguuuauuaaaccuagauuacaauggccaucua

SEQ ID NO: 29501 - RNA, 45 nt, Mus musculus
cuggaggagggccuguucaaguugcugggauggcuuaguaauggg

SEQ ID NO: 29502 - RNA, 45 nt, Mus musculus
uuauauaagguggucaagaagagagagaaggaaucuaggagcaua

SEQ ID NO: 29503 - RNA, 45 nt, Mus musculus
gcagggauggacuacaaagaaaaagaucaucuacauauuguauaa

SEQ ID NO: 29504 - RNA, 42 nt, Mus musculus
ugagagaggcuaguaagggaaaagguaugucaaagugugugg

SEQ ID NO: 29505 - RNA, 46 nt, Mus musculus
gaaccuugucagaacugaaaauguggccccaguguccagaaggcag

SEQ ID NO: 29506 - RNA, 46 nt, Mus musculus
uuauggguaugcaccacugcacucgguuuauguauaucagcacugg

SEQ ID NO: 29507 - RNA, 46 nt, Mus musculus
uacuugcaucacgacuaguucuauuccuaaauguuaauguccccau

SEQ ID NO: 29508 - RNA, 45 nt, Mus musculus
ggucaaagaaagcaugagaaaaaucagaaaaggacuagggaagag

SEQ ID NO: 29509 - RNA, 44 nt, Mus musculus
cgcggggacuggcaucucuucauauguucucuccaagucuaggg

SEQ ID NO: 29510 - RNA, 45 nt, Mus musculus
ugcagggaugauguucugggcagccccacggccaucaugccacag

SEQ ID NO: 29511 - RNA, 47 nt, Mus musculus
gacaaaguugucauugagagcaaugccagccccggcauugaaggugg

SEQ ID NO: 29512 - RNA, 46 nt, Mus musculus
aggguuucuuacucuuuggaggccauguaggccaugagguccacca

SEQ ID NO: 29513 - RNA, 44 nt, Mus musculus
auuugaaugaggguguaacaaaauuucacacuauagcccgggcu

SEQ ID NO: 29514 - RNA, 82 nt, Mus musculus
caaacuacaaacgaggaaaaugaagggguugaagaagcgaccugcagagaauggaguagacgaccaggggaaaaaaucaaag

SEQ ID NO: 29515 - RNA, 81 nt, Mus musculus
gccaaagaagagaaagaauaucucucaggauacuuuuggcacaacauuuggaaggauucauaugcaaaagcaagacuuaag

SEQ ID NO: 29516 - RNA, 46 nt, Mus musculus
uuucuccagaucaggaguucuguuggacacaguguguugaagaggu

SEQ ID NO: 29517 - RNA, 45 nt, Mus musculus
agcacucagaaaacaacuggggugagaugaguugugugccugaga

SEQ ID NO: 29518 - RNA, 42 nt, Mus musculus
ccuccuggcuuagcccaugaucgaucacaaccaucccccaac

SEQ ID NO: 29519 - RNA, 46 nt, Mus musculus
cauauauuaauaaaauaaaucuuuaaaaaaaaaaaaaaaaagcaua

SEQ ID NO: 29520 - RNA, 46 nt, Mus musculus
cagcugacagagccuucggguguguucuuaugcaucgugugacagg

SEQ ID NO: 29521 - RNA, 46 nt, Mus musculus
uguuaaguaagaugcucacccugggcuuccauucacagcacaagaa

SEQ ID NO: 29522 - RNA, 46 nt, Mus musculus
ggcugggcuguaagcgacugucugaggaaacagaaaugugcuggag

SEQ ID NO: 29523 - RNA, 41 nt, Mus musculus
aguagggagugaguuagcuuauaauaacuuagugagucagu

SEQ ID NO: 29524 - RNA, 46 nt, Mus musculus
acaccuaaguagauaucaaaguuuaagggagugugugaguucagag

SEQ ID NO: 29525 - RNA, 42 nt, Mus musculus
uauuuuugaguagaaucuuuaucuccaggcuggcccaggauu

SEQ ID NO: 29526 - RNA, 46 nt, Mus musculus
gaaaaguagcaacaugcauaaaaaacucaagaacccagguccagac

SEQ ID NO: 29527 - RNA, 46 nt, Mus musculus
ucaugcuagagaugagauccaggguccuguccaugcuagagaugag

SEQ ID NO: 29528 - RNA, 75 nt, Mus musculus
ucaugcuagagaugagauccaggguccuguccaugcuagagaugagauccaggguccuauccaugcuagagauga

SEQ ID NO: 29529 - RNA, 65 nt, Mus musculus
agaugagauccaggguccuguccaugcuagagaugagauccaggguccuauccaugcuagagaug

SEQ ID NO: 29530 - RNA, 63 nt, Mus musculus
ugcuagagaugagauccaggguccuguccaugcuagagaugagauccaggguccuguccaugc

SEQ ID NO: 29531 - RNA, 46 nt, Mus musculus
gugcuagagaugagauccaggguccuauccaugcuagagaugagau

SEQ ID NO: 29532 - RNA, 42 nt, Mus musculus
ucauagaaaacugugaaaaguaucauguuuacugcagcaaau

SEQ ID NO: 29533 - RNA, 46 nt, Mus musculus
cuuauuuaagcuggauuuuguaacccaguagauuuuggcuugaggu

SEQ ID NO: 29534 - RNA, 29 nt, Mus musculus
aucaagugguuggaacacugucuggacuc

SEQ ID NO: 29535 - RNA, 83 nt, Mus musculus
cucuccagguuacucagccagauagugaauguaugaauggauggaacggcgcaauauucugaaucuauuuaauggcacuagaa

SEQ ID NO: 29536 - RNA, 46 nt, Mus musculus
caguaagugcugccguugccaccagguuuuauuuacuaaaggagau

SEQ ID NO: 29537 - RNA, 46 nt, Mus musculus
cacuaauuuacuaagugauaggaauguccacuaugucaaagcagaa

SEQ ID NO: 29538 - RNA, 46 nt, Mus musculus
uuauaauuuuacaccccaggugagaguuuggagauggucccuugcu

SEQ ID NO: 29539 - RNA, 47 nt, Mus musculus
cggccucagcugacaucugugacuguucuauuaaauugcugccagag

SEQ ID NO: 29540 - RNA, 72 nt, Mus musculus
uuuuaccaguuuugcuaagaaacagcaacaacagcagaguugauuaggaaaaaugaagaagaaaaaacgcaa

SEQ ID NO: 29541 - RNA, 45 nt, Mus musculus
ucgccccagaagauugacggcuuuaaacgucuugauugccagagu

SEQ ID NO: 29542 - RNA, 46 nt, Mus musculus
uggacacacaaacacuugaaauaucaaucuuuuuaaaugcauaguu

SEQ ID NO: 29543 - RNA, 45 nt, Mus musculus
guuuguuuuccgcauagguggggaagcaggguugucugucaacag

SEQ ID NO: 29544 - RNA, 47 nt, Mus musculus
cauacacaagaccuugaagaccuuggauagccgagagagagagagag

SEQ ID NO: 29545 - RNA, 80 nt, Mus musculus
guuagcuuugaaacaaaccuaagucagaccuccuaugacgaccugaucaggaaaguuguggaagucuucaagccaggaaa

SEQ ID NO: 29546 - RNA, 47 nt, Mus musculus
ccacacuguucaauccuuguggcuacucgaugaauggaaugaaaucg

SEQ ID NO: 29547 - RNA, 78 nt, Mus musculus
guaaaacuuguuuuacuucuacauagguacuuguauacuuuggauuucccagagagccgaguaaucagucagccagau

SEQ ID NO: 29548 - RNA, 46 nt, Mus musculus
guguaugaagacagcuacaguguacuuacauauaauaaauaaguaa

SEQ ID NO: 29549 - RNA, 46 nt, Mus musculus
uuaugugauuuuuuuuuuaaaaagauucucuuuccuugcagaugga

SEQ ID NO: 29550 - RNA, 46 nt, Mus musculus
uaaguugguuugcugggccagggaaaaucuugaaaacaguuuggga

SEQ ID NO: 29551 - RNA, 46 nt, Mus musculus
gaagggacgcuugagguuaaggagucagggccagugugggccagau

SEQ ID NO: 29552 - RNA, 45 nt, Mus musculus
aauuucaugaagccuucucaccaaggguacccacaccggaauuuc

SEQ ID NO: 29553 - RNA, 46 nt, Mus musculus
gaaccuaaagugcugccugccaugguaauacuguuugggggcuuuu

SEQ ID NO: 29554 - RNA, 46 nt, Mus musculus
caaguaaguacgcauugugugaaacuugaguaguuucugcucuggu

SEQ ID NO: 29555 - RNA, 62 nt, Mus musculus
agacaugugguaccacccucuuacugaaagcacugguuccccuguugaagcuugcuagggau

SEQ ID NO: 29556 - RNA, 57 nt, Mus musculus
guccuuuugaaggaugugcagugcucaaucauaagugugacaaagacugacaagcag

SEQ ID NO: 29557 - RNA, 46 nt, Mus musculus
cagaaaaaggaaagaauacuugggggguguucuaaagauggcgaua

SEQ ID NO: 29558 - RNA, 46 nt, Mus musculus
cuagcacuggagagagaggcuaagucagcuauaggccagcaccaac

SEQ ID NO: 29559 - RNA, 46 nt, Mus musculus
ugggcuuugaauaaaugccuguagcuuacuuaugcuauauaaagau

SEQ ID NO: 29560 - RNA, 46 nt, Mus musculus
uuuagccguuugugugcaugcauguggaugccuuugggggccagaa

SEQ ID NO: 29561 - RNA, 47 nt, Mus musculus
guugaccccaaauucucucucuuuaagaagcauacacugagcauacu

SEQ ID NO: 29562 - RNA, 46 nt, Mus musculus
uggcaguuuuguguuaguccccaaacugcaaaucuacuaaugggga

SEQ ID NO: 29563 - RNA, 45 nt, Mus musculus
gcuuuccacaucuucacaagguuaccaggccugguaguuuuaaga

SEQ ID NO: 29564 - RNA, 45 nt, Mus musculus
gccagggcuauacagagaaacccugucuaaagacagaugggcagu

SEQ ID NO: 29565 - RNA, 42 nt, Mus musculus
ggaaaauaacaguaauauaaaaacacuagguauuaaagcugu

SEQ ID NO: 29566 - RNA, 43 nt, Mus musculus
aaauaagugucugagagacagcagguggauaaaucacgaguca

SEQ ID NO: 29567 - RNA, 46 nt, Mus musculus
uguguaaccagaaacugauuugugugugugugugugacuguuauau

SEQ ID NO: 29568 - RNA, 46 nt, Mus musculus
acaagccugucagcccgaagaucuauuuuacuuaaugccuuaagcu

SEQ ID NO: 29569 - RNA, 43 nt, Mus musculus
cgccgccguugcggggccgccugcgccgccugggggaggggag

SEQ ID NO: 29570 - RNA, 46 nt, Mus musculus
guucgcuagucucacggugauggaagcugcacauuuuuucgaaggg

SEQ ID NO: 29571 - RNA, 44 nt, Mus musculus
acacagcuggaacaauccgcagcggcggcaggagcggcgggaga

SEQ ID NO: 29572 - RNA, 46 nt, Mus musculus
ugugggguguguguaugugugguauauguauguaugguguauuugu

SEQ ID NO: 29573 - RNA, 87 nt, Mus musculus
uguguauuauugugucuguguguguauguauguggugugugucugugugugaguguauaacugugucuguguguguguggugggugu

SEQ ID NO: 29574 - RNA, 46 nt, Mus musculus
uugauccucugguugccccgccccuugccucggcuuauuggcagag

SEQ ID NO: 29575 - RNA, 42 nt, Mus musculus
gccgcggcagccaccuccuccgccuccuccuccuccgcggcg

SEQ ID NO: 29576 - RNA, 44 nt, Mus musculus
uauggauuguuauaucaguaaaagacaaguugauaaagcaucga

SEQ ID NO: 29577 - RNA, 42 nt, Mus musculus
ugaugguuaaucgcuauugcagguagaccugucuaggccaag

SEQ ID NO: 29578 - RNA, 45 nt, Mus musculus
guagauuuuuguguuugcuuuguguguguguguguuugcauuuug

SEQ ID NO: 29579 - RNA, 46 nt, Mus musculus
ucagggaaacucagggcuccaagguuauuaacucacugucacacag

SEQ ID NO: 29580 - RNA, 42 nt, Mus musculus
aaaaaacuacaggaaaagaacauuuaaaaaaggagugcagag

SEQ ID NO: 29581 - RNA, 46 nt, Mus musculus
cccugugucaccacugugguccuuccugugacucacacagcugcag

SEQ ID NO: 29582 - RNA, 46 nt, Mus musculus
uuuuucaauuucucuuuacuucucagaaguaaacacucgugcuagc

SEQ ID NO: 29583 - RNA, 36 nt, Mus musculus
ugccucaggaucaagccuguggcuuugggguuccag

SEQ ID NO: 29584 - RNA, 45 nt, Mus musculus
ugugugugugagagagagagagagagagagagagagagacugacu

SEQ ID NO: 29585 - RNA, 42 nt, Mus musculus
gagguggcaguggaagaggaggagguguugguggggguggag

SEQ ID NO: 29586 - RNA, 42 nt, Mus musculus
uucuggacacaagaaggcauuuguaauugcacaguugcggag

SEQ ID NO: 29587 - RNA, 42 nt, Mus musculus
agggaguuagugggucagccgggggauugggacguggaagcg

SEQ ID NO: 29588 - RNA, 45 nt, Mus musculus
uguuuuaauuuacauauucuaaaaaccaauauauaaaaaugacag

SEQ ID NO: 29589 - RNA, 42 nt, Mus musculus
ggggcagagggcagaggguaugugagccagagcaggagccua

SEQ ID NO: 29590 - RNA, 46 nt, Mus musculus
gauggagggggacagaaguguggccagaaccagagaccugaaccag

SEQ ID NO: 29591 - RNA, 25 nt, Mus musculus
ggaacucaccuuuuagaccagacug

SEQ ID NO: 29592 - RNA, 46 nt, Mus musculus
ugcacgcacgaaugcacaccucacaugaaugcacaccuuacuccag

SEQ ID NO: 29593 - RNA, 45 nt, Mus musculus
gaauaugggcgaagggguuccuuauaggagcagaaaugacucaaa

SEQ ID NO: 29594 - RNA, 46 nt, Mus musculus
guuuacuuucugucuuaagaugcaggauggaauguuuccaaaggag

SEQ ID NO: 29595 - RNA, 53 nt, Mus musculus
augguuguauaaagcuaaggucuggccacugaggggaaggaaguguugcuguu

SEQ ID NO: 29596 - RNA, 45 nt, Mus musculus
cuucuuccucuucuuccaccuuuuuccgggcaacuuuagcaggcc

SEQ ID NO: 29597 - RNA, 41 nt, Mus musculus
ccuaggcacuggacaugggaccuagguuauaucuggcagga

SEQ ID NO: 29598 - RNA, 46 nt, Mus musculus
accuaacaagacccugccuuacaauguauagcgauuagggauauag

SEQ ID NO: 29599 - RNA, 46 nt, Mus musculus
auaaaucucuauauagacuuguuuguuuuuuaccggcuauggugag

SEQ ID NO: 29600 - RNA, 45 nt, Mus musculus
gggaagaaaguguuucuuucuuuccuuuuauagauaauuguccau

SEQ ID NO: 29601 - RNA, 45 nt, Mus musculus
cacauaggaguuacuuguuuauguuucccacuuaaucacccagaa

SEQ ID NO: 29602 - RNA, 46 nt, Mus musculus
cuaugguuggggucaucauaacaugaggaaaggguugcagcauuag

SEQ ID NO: 29603 - RNA, 46 nt, Mus musculus
uuccagagccuuuacagaacauuuggguaaacagaaaauauagcag

SEQ ID NO: 29604 - RNA, 108 nt, Mus musculus
caugguguugcacacuuacucucagcaccuggggaaagaggcagaaggagagcuuugugaauuccaggcaagccuagucuacacagcaaguuccaaguuagcuaggga

SEQ ID NO: 29605 - RNA, 60 nt, Mus musculus
uacagaggaagaccugggagauagguggagggggagagggaaaaggagggaaagaaagaa

SEQ ID NO: 29606 - RNA, 50 nt, Mus musculus
uaaaaacuggaggguauagauuaugccccuguuauuggaacaauccacag

SEQ ID NO: 29607 - RNA, 45 nt, Mus musculus
cuggucuguacucugaggauauuuuaucuguuaagauagccacua

SEQ ID NO: 29608 - RNA, 45 nt, Mus musculus
uagauuucuccaccaguguuuugagaaagcaauguuggugcugag

SEQ ID NO: 29609 - RNA, 46 nt, Mus musculus
agaaaagaugaaaaggaauaugcacuuaagcaaaucgaaggcacag

SEQ ID NO: 29610 - RNA, 42 nt, Mus musculus
ggggagagguuguaagguggagggcagagaaaaaagggacag

SEQ ID NO: 29611 - RNA, 46 nt, Mus musculus
ugaguacacuguagcucucuucagacacuccagaagagggagucag

SEQ ID NO: 29612 - RNA, 42 nt, Mus musculus
ugggccuuauuuuaccaauuguuagguagcuauagagaugag

SEQ ID NO: 29613 - RNA, 45 nt, Mus musculus
aaguaccaccugagugacucuuuuuauuaccaaguccaaccgcag

SEQ ID NO: 29614 - RNA, 48 nt, Mus musculus
cuuugugcucccagaaaacaacucccagauuucaacucaguagcucca

SEQ ID NO: 29615 - RNA, 46 nt, Mus musculus
gaacuagaacaugauccccuugcacuauuacauuaucacuggcuuu

SEQ ID NO: 29616 - RNA, 46 nt, Mus musculus
ccuaagcuuggcuauccugguucuugcuguggauauugaccuugaa

SEQ ID NO: 29617 - RNA, 46 nt, Mus musculus
ccacauggugacucacagccaucuguaaugagaucugaugcccucu

SEQ ID NO: 29618 - RNA, 52 nt, Mus musculus
uacagugaacucagaaauaaaucuuuaagagagagagagagagagagagaga

SEQ ID NO: 29619 - RNA, 45 nt, Mus musculus
uauugugguaucccccauuauuuaugcaguaguugaaaauacuga

SEQ ID NO: 29620 - RNA, 45 nt, Mus musculus
agggaggcagcucucagaaucagauccuguaagcugcagauagag

SEQ ID NO: 29621 - RNA, 52 nt, Mus musculus
uaaaagagacauuuaaacauagugccguugcacccugagggacagcauggga

SEQ ID NO: 29622 - RNA, 46 nt, Mus musculus
gccucuggaguguuggaacuaaaaguuuauaccaccacaccuagag

SEQ ID NO: 29623 - RNA, 49 nt, Mus musculus
ccagauucugauggcuucagucuguaacacccgauacuaaagucagcca

SEQ ID NO: 29624 - RNA, 46 nt, Mus musculus
gcuuaggcaaguacuuuacccccuaagccaccucgcuagcccauag

SEQ ID NO: 29625 - RNA, 45 nt, Mus musculus
gaccaaugguugacuucuaguuaccucuguuaaaaucucugugag

SEQ ID NO: 29626 - RNA, 51 nt, Mus musculus
aucgagucuaauucauuguguuuaugccuccucuugaagugucgugaacca

SEQ ID NO: 29627 - RNA, 47 nt, Mus musculus
auuucuuacaguacuuggaguggucacucaaccauuuagauuuagaa

SEQ ID NO: 29628 - RNA, 46 nt, Mus musculus
gcuuagauacugcucucagagcaaguaugugcacaacuugaaguca

SEQ ID NO: 29629 - RNA, 45 nt, Mus musculus
cguuauaggcagcacaaggagugugggugaaaauagauaugcaug

SEQ ID NO: 29630 - RNA, 46 nt, Mus musculus
uuagagaaaaaugguuuaacuuagauuuuguauguguuuaggacag

SEQ ID NO: 29631 - RNA, 46 nt, Mus musculus
aguaccucuguacaaugacgguuaaaagaaugauaauuuuggaaag

SEQ ID NO: 29632 - RNA, 45 nt, Mus musculus
cagcuuuagccauuagacacugaaguagagaugcugcauuugggg

SEQ ID NO: 29633 - RNA, 45 nt, Mus musculus
cugugcuccaucacguucucagcagcauccacgaaacauguacag

SEQ ID NO: 29634 - RNA, 46 nt, Mus musculus
augcuaggcaaacauuuuagugcugaacuguaucauuuuugcuuuu

SEQ ID NO: 29635 - RNA, 63 nt, Mus musculus
ucucauauauucucaugccuuugggguguaagguggagagagagguagagggagagggagaga

SEQ ID NO: 29636 - RNA, 44 nt, Mus musculus
agagugguucagaguaucggcuguucuucauaggaccuggaugg

SEQ ID NO: 29637 - RNA, 50 nt, Mus musculus
gccacuuaaaagauuauuugggucgaggaauuggcuuuaaaaggaaaggc

SEQ ID NO: 29638 - RNA, 46 nt, Mus musculus
gagacaaugaaggagaggcguaagucuauaaauauugaacguguaa

SEQ ID NO: 29639 - RNA, 45 nt, Mus musculus
uuuauauuagugagcugaauuuauauuuguuuaaaguucagaggg

SEQ ID NO: 29640 - RNA, 46 nt, Mus musculus
ccuuaaagggaaggagaggcuuccuggagaagaccuugguuaggag

SEQ ID NO: 29641 - RNA, 42 nt, Mus musculus
auugacuuguagaggcaaggaacugagucagugugccuagag

SEQ ID NO: 29642 - RNA, 46 nt, Mus musculus
cuuaguucuuaagaagcagaggagcaaugacuagauucaaggacag

SEQ ID NO: 29643 - RNA, 45 nt, Mus musculus
gccagcugggcucuguagaaaguucuuguuuuaaagaaagagaga

SEQ ID NO: 29644 - RNA, 42 nt, Mus musculus
cucaaccuacacaccccagauagggagcucaugacagagcag

SEQ ID NO: 29645 - RNA, 61 nt, Mus musculus
agaugggcaggugcagacucagaugggcaggugcagacucagaugggcaggugcagacuca

SEQ ID NO: 29646 - RNA, 46 nt, Mus musculus
cacgccuuccuugcuuuaugcucacauagcauauuuaucugaagaa

SEQ ID NO: 29647 - RNA, 45 nt, Mus musculus
acuauugagaacauuuccuuagaaaaccucaaaaggcagcagaag

SEQ ID NO: 29648 - RNA, 45 nt, Mus musculus
caggaggauauaaaaacaagcaauccuuuucaucaugaucaguua

SEQ ID NO: 29649 - RNA, 45 nt, Mus musculus
aaagaaguuugucuuuuaugucuuuuaucuugaauguccccagag

SEQ ID NO: 29650 - RNA, 46 nt, Mus musculus
cacguguaacugaacuaacugggugcuguugucccacacaccuaag

SEQ ID NO: 29651 - RNA, 45 nt, Mus musculus
ccuacccuauuuaaauacucuuaagaggcaccaauucugcuucaa

SEQ ID NO: 29652 - RNA, 45 nt, Mus musculus
ucuuacgcugggccugaugacaaagaccugugacccuagcugcuc

SEQ ID NO: 29653 - RNA, 67 nt, Mus musculus
agaaaagaauuuuaaggggccuaauugguaauuucaggacaaucaguauagugcuagguguacagua

SEQ ID NO: 29654 - RNA, 46 nt, Mus musculus
aaugaauuuucauguugaagcagauacaaacaguuuagauuggugc

SEQ ID NO: 29655 - RNA, 46 nt, Mus musculus
ggcugccagauuccguaccccaaaagagaauuccuuaaugaagaug

SEQ ID NO: 29656 - RNA, 46 nt, Mus musculus
uuguauucaagccuggguuacuuuugccuuguuuauucagcagcac

SEQ ID NO: 29657 - RNA, 45 nt, Mus musculus
aagaauuuccagguggagcauuguuaaucaauagagugucucaga

SEQ ID NO: 29658 - RNA, 42 nt, Mus musculus
cuucuuauuuccaaauccuuuauucugacaaaggguguauau

SEQ ID NO: 29659 - RNA, 46 nt, Mus musculus
gacggccucgaggacaguguccucugugagaaggcgugccccagau

SEQ ID NO: 29660 - RNA, 49 nt, Mus musculus
uccaagaguagacagaaagucuacagagaucuuccaggcccauauccaa

SEQ ID NO: 29661 - RNA, 46 nt, Mus musculus
acacuucacugagccaucuccucacacuucacugacugagccaucu

SEQ ID NO: 29662 - RNA, 46 nt, Mus musculus; identical to SEQ ID NO: 29661

SEQ ID NO: 29663 - RNA, 46 nt, Mus musculus; identical to SEQ ID NO: 29661

SEQ ID NO: 29664 - RNA, 46 nt, Mus musculus; identical to SEQ ID NO: 29661

SEQ ID NO: 29665 - RNA, 42 nt, Mus musculus
agagagagagagagagagaggaagagacagagagacagagac

SEQ ID NO: 29666 - RNA, 42 nt, Mus musculus
ugaaagucccuggucugaguuggccauggucugggaccaggu

SEQ ID NO: 29667 - RNA, 46 nt, Mus musculus
gagaauagagcauuacaguuauaugaaucguagcagugagugagca

SEQ ID NO: 29668 - RNA, 46 nt, Mus musculus
auuucuguaacauguaucugauggaaaccauucaaaaagaggguag

SEQ ID NO: 29669 - RNA, 58 nt, Mus musculus
cuagcacaaauacaauaauuuuaaaacucuaucuccaaauguucacacaaaagcggaa

SEQ ID NO: 29670 - RNA, 42 nt, Mus musculus
ugucuguccauggaauggauggcuuucgugcugggucaagua

SEQ ID NO: 29671 - RNA, 45 nt, Mus musculus
uaugguugugagccauugugugguugcuaggaauugaacucaaga

SEQ ID NO: 29672 - RNA, 46 nt, Mus musculus
uuuuuugagacagucuuacucuauagccuaagcucucugggaaguc

SEQ ID NO: 29673 - RNA, 46 nt, Mus musculus
ugcugucugauguaggauucuucuagaacaggaaaggugaaaugua

SEQ ID NO: 29674 - RNA, 46 nt, Mus musculus
ugagggcugccucaugcugucauggcaacugccaaguguguuuuua

SEQ ID NO: 29675 - RNA, 46 nt, Mus musculus
gcuaggucaugugaugcaaaccgacccuuccaguaaaaugggaagg

SEQ ID NO: 29676 - RNA, 46 nt, Mus musculus
acuauagcuucuuaacacaucgaguugaaauugacgagacaaagag

SEQ ID NO: 29677 - RNA, 46 nt, Mus musculus
aauugguaggugcuaggugcuggguuucugccccaagugugguggu

SEQ ID NO: 29678 - RNA, 45 nt, Mus musculus
auuuauuuguuuuguguguguguguguguguguguguguguguau

SEQ ID NO: 29679 - RNA, 48 nt, Mus musculus
guuuguucagcuggggcaaagucaacauaaacaggaccgagguaacca

SEQ ID NO: 29680 - RNA, 44 nt, Mus musculus
caucaaaaggcauuuccugaaauggugccaaauuaggugaguag

SEQ ID NO: 29681 - RNA, 41 nt, Mus musculus
gugcuggggagaggaucuagugcuucagacacugccucaga

SEQ ID NO: 29682 - RNA, 42 nt, Mus musculus
caguccaucccuggggaagucagggcaggaacucaggcagga

SEQ ID NO: 29683 - RNA, 49 nt, Mus musculus
gucagaggaggaucacuccauuuaugccagguaagagaccgaagcacag

SEQ ID NO: 29684 - RNA, 58 nt, Mus musculus
gaaggcuccaucucucagcgauccacuccugugaagaugacugacacgggagacagug

SEQ ID NO: 29685 - RNA, 34 nt, Mus musculus
cagccagcgccccgccacccccgagcgaggaggc

SEQ ID NO: 29686 - RNA, 45 nt, Mus musculus
aggagaccuacuaagucaacagcucuccaaaugugccaucucagg

SEQ ID NO: 29687 - RNA, 46 nt, Mus musculus
aguuaauucugugagccauguucuugugggguucuuggccccucua

SEQ ID NO: 29688 - RNA, 48 nt, Mus musculus
cuguaggaaaugaauuaccaagugccauaagucucuucaagaaggaca

SEQ ID NO: 29689 - RNA, 25 nt, Mus musculus
acagaacacuugcugcuucacaaau

SEQ ID NO: 29690 - RNA, 46 nt, Mus musculus
gaaucccuaucccuggggcuagugacauauuaaaagugaccaagug

SEQ ID NO: 29691 - RNA, 47 nt, Mus musculus
ucucugcuacaguuuuucuuucuuuuaaguaaaggcccaaugaaggu

SEQ ID NO: 29692 - RNA, 44 nt, Mus musculus
gguugugagccaccauguaguugcugggauuugaacucagccag

SEQ ID NO: 29693 - RNA, 46 nt, Mus musculus
ucuacauuaaauuccuuagucccacacuuuaagaagaaugcagauc

SEQ ID NO: 29694 - RNA, 49 nt, Mus musculus
ccaugucacuucuucugggcuugccuuggggaacugguacuagaucuuu

SEQ ID NO: 29695 - RNA, 46 nt, Mus musculus
uggccaacugugcucugccuuccccaggaaaagagggaaaaggagg

SEQ ID NO: 29696 - RNA, 42 nt, Mus musculus
gccaucuuaccagccuacaaaaaucuacaaauguguugagca

SEQ ID NO: 29697 - RNA, 41 nt, Mus musculus
agcgcagugcuguccaggccugcaucugaucuugaagcaga

SEQ ID NO: 29698 - RNA, 42 nt, Mus musculus
ugguaugucugugccccaugugugggcuugaugccaagaggu

SEQ ID NO: 29699 - RNA, 42 nt, Mus musculus
cagggucauucugucuggggaagcugguagagacggggagug

SEQ ID NO: 29700 - RNA, 78 nt, Mus musculus
aaagaagucuguuuguuuuuuaaugaaaaacagaagagguuggaucgagauggguggagagguguggaggaccuggga

SEQ ID NO: 29701 - RNA, 40 nt, Mus musculus
gcacaggccugcuccggucugcaucagaugggguccuaga

SEQ ID NO: 29702 - RNA, 46 nt, Mus musculus
acacaaacauaauguaaagauaaaguuauuaagucauaggacagag

SEQ ID NO: 29703 - RNA, 46 nt, Mus musculus
cagaggucaugaguuacaggaugaauucuguauauagccaggagau

SEQ ID NO: 29704 - RNA, 51 nt, Mus musculus
ucagguucuuagaaggcuacuauauuguauuaauaacuaagcggaggaaga

SEQ ID NO: 29705 - RNA, 78 nt, Mus musculus
guuguacugaagcuaaguuguucuuagcuuuauuuggcaggaauauuuuuacaaagagggucacuuauacuuuguagu

SEQ ID NO: 29706 - RNA, 49 nt, Mus musculus
auaccacacucaagugauguggccuucuuuauauuagagagagaggaac

SEQ ID NO: 29707 - RNA, 44 nt, Mus musculus
cuuaauuagucagauaaggcuagagccugugauugggcagugga

SEQ ID NO: 29708 - RNA, 46 nt, Mus musculus
uguaguuacugacuagagauguguuucaugcucaguuuacccagau

SEQ ID NO: 29709 - RNA, 48 nt, Mus musculus
uuauuggcuagcauucaaaauagaaauuaccuugauuaaguauacaaa

SEQ ID NO: 29710 - RNA, 46 nt, Mus musculus
cucaaccugugagucauuacucccguaggucauuaucaugucagau

SEQ ID NO: 29711 - RNA, 83 nt, Mus musculus
guuuaggcccauuuugggucccggugguuacccaugaagacagagugguaagacguguguaaugggcaaucuugauugccaac

SEQ ID NO: 29712 - RNA, 46 nt, Mus musculus
guccuauggugaaguucagacauguuggaguuuggaauacucagau

SEQ ID NO: 29713 - RNA, 45 nt, Mus musculus
caacagccaugguaggaggcagcuggucacauggcagccacaguc

SEQ ID NO: 29714 - RNA, 90 nt, Mus musculus
cacagacaacacuugaggaaaugguuuauuuggcuuguguuuauagucagagaagacagggcagaaacuagagguagggaugaugcagag

SEQ ID NO: 29715 - RNA, 46 nt, Mus musculus
agcucauauggcucuauagcuauauagucuuaacacauccccguca

SEQ ID NO: 29716 - RNA, 41 nt, Mus musculus
gcauauggagaggggugggaggguaggggugagcaggaagu

SEQ ID NO: 29717 - RNA, 44 nt, Mus musculus
ucugacacuguuuuugucagcugugucuggugugcuggaggucu

SEQ ID NO: 29718 - RNA, 33 nt, Mus musculus
gcgggcaaugaaggggcugcugggggaugauag

SEQ ID NO: 29719 - RNA, 42 nt, Mus musculus
gucuccagagauuccugggagagcacagaggaacgccguggg

SEQ ID NO: 29720 - RNA, 46 nt, Mus musculus
uucucaggcuauuugugaggguaguuuggguggcugagaaguggaa

SEQ ID NO: 29721 - RNA, 46 nt, Mus musculus
gguguuaguuccugcugucuacaagaagggaaaccuccgcccccac

SEQ ID NO: 29722 - RNA, 41 nt, Mus musculus
uugugaaugggcgcacgguggaggagacacaggugccggag

SEQ ID NO: 29723 - RNA, 42 nt, Mus musculus
gcugaggcugggggugcugcgccagguaggcccugugcccag

SEQ ID NO: 29724 - RNA, 46 nt, Mus musculus
ucugucacaaacaucccccgagaauaugcaucgaaauguagcccag

SEQ ID NO: 29725 - RNA, 44 nt, Mus musculus
cagguacaggaccucuaugauaugauggacaaggagcaugcuca

SEQ ID NO: 29726 - RNA, 44 nt, Mus musculus
acagagucuaaugcauccagauagagaagucagaagcuguggaa

SEQ ID NO: 29727 - RNA, 46 nt, Mus musculus
ucagccacuuccacagugccuucaagaacacgagccacagcucagg

SEQ ID NO: 29728 - RNA, 41 nt, Mus musculus
ccaacguggcgucgaacccucaugcgccgugccaaagagga

SEQ ID NO: 29729 - RNA, 42 nt, Mus musculus
cgggaggagcccgacauugugucuucagcccaggcguccggg

SEQ ID NO: 29730 - RNA, 46 nt, Mus musculus
aagccuuaacgaacccuagaguugaacaaaaggcguguuccuugau

SEQ ID NO: 29731 - RNA, 46 nt, Mus musculus
cgaauauuaaacaauuauuuaagccugggguaguguaaucccagca

SEQ ID NO: 29732 - RNA, 46 nt, Mus musculus
uaaaaucuacaaggguauguagucaaacuguuucaacagagguagu

SEQ ID NO: 29733 - RNA, 46 nt, Mus musculus
gacacagaugauucaaggcaagaaugaacaacaggaggguggagau

SEQ ID NO: 29734 - RNA, 58 nt, Mus musculus
uaccugaugugacaacugagggaguagguguaggagaggaaggccgaguugugggcuu

SEQ ID NO: 29735 - RNA, 42 nt, Mus musculus
agagagagagagagagagagagagugagagagagaaagagag

SEQ ID NO: 29736 - RNA, 44 nt, Mus musculus
aagcuggcugcaucaaaggucgacuuccgcucaggcugggaggu

SEQ ID NO: 29737 - RNA, 46 nt, Mus musculus
cccugccauguacagggugccccgcacucgcuacucacccaccaug

SEQ ID NO: 29738 - RNA, 45 nt, Mus musculus
gcaacccagaggguucugaguccaccuccagcuucgaguccacgg

SEQ ID NO: 29739 - RNA, 46 nt, Mus musculus
cugaggcucuccguccugaggucugcauuagaacugcagcccugag

SEQ ID NO: 29740 - RNA, 46 nt, Mus musculus
uaguaaugaacuuuguccugggcccggggaaacugagcacaucugg

SEQ ID NO: 29741 - RNA, 45 nt, Mus musculus
cugcaccaggaugcgcccuccuucccggaacucuuuacuagacag

SEQ ID NO: 29742 - RNA, 91 nt, Mus musculus
gccggguaagguguggucauccaugugauucagcugcaccucacucagccccgacaugaacagacacuuccagaagugauuuccaggccca

SEQ ID NO: 29743 - RNA, 49 nt, Mus musculus
cuguucugucacgguugccauguuaggagcuacugcuggcaccugcugu

SEQ ID NO: 29744 - RNA, 49 nt, Mus musculus
ugaaauggaaaugaauacaaagcuugaacuugcuccagagaauagcaca

SEQ ID NO: 29745 - RNA, 46 nt, Mus musculus
uucuuacuuuuccuuuuccuuacuuccugucaaucucucuguuauu

SEQ ID NO: 29746 - RNA, 54 nt, Mus musculus
uuugcuguaguuuuauaucaagagagcuaccaguauauauuguuuggggucuag

SEQ ID NO: 29747 - RNA, 44 nt, Mus musculus
uuucuccguuuccuuuccucuggaguuuccuguuuacaacggaa

SEQ ID NO: 29748 - RNA, 46 nt, Mus musculus
ucaauguccuauaaaauuaucuaguuucauaauagaacucaaguaa

SEQ ID NO: 29749 - RNA, 46 nt, Mus musculus
cauggauauuaccaucauagaauaaaaacaagaauuaaugcccuaa

SEQ ID NO: 29750 - RNA, 42 nt, Mus musculus
cuguuuaguuucagauucccugaccuuuuucaaaacugccug

SEQ ID NO: 29751 - RNA, 42 nt, Mus musculus
guacuuauguauaauaauaaauaaaucuuugggcuggaucga

SEQ ID NO: 29752 - RNA, 42 nt, Mus musculus
uuuuagaaauagucuuacuugggcuguccccacuugccccuc

SEQ ID NO: 29753 - RNA, 45 nt, Mus musculus
agggaggugagagguauucaacuugccucaagccauuagcuguaa

SEQ ID NO: 29754 - RNA, 90 nt, Mus musculus
caauucccagcaaccacaugguggcucacaaccaucuauaaagagaucugacucccucuucuggagugucugaagacagcuacacuguac

SEQ ID NO: 29755 - RNA, 42 nt, Mus musculus
uccguaaauacaaauguaaaaaccaaaccgaaacagaccaaa

SEQ ID NO: 29756 - RNA, 41 nt, Mus musculus
cauguucuaagaaaaaagauuaaaguggcagagcuguggca

SEQ ID NO: 29757 - RNA, 46 nt, Mus musculus
uucaguaauaaauaaucuuuaauuccaaaugaagauuagggcauga

SEQ ID NO: 29758 - RNA, 41 nt, Mus musculus
uuuugcuuuguggcuuauuccuugccuguacauggccagga

SEQ ID NO: 29759 - RNA, 69 nt, Mus musculus
gaucaucuuccuuuauauagcagcuggggcuacaugugugugagagagagagagagagagagagagaga

SEQ ID NO: 29760 - RNA, 67 nt, Mus musculus
agcugaguugaaggacaaauauagaguuuguguagguagacacacauacauggggacugagaauuug

SEQ ID NO: 29761 - RNA, 42 nt, Mus musculus
gugguggugagcaccuuuaaucccagcacucagggcaggcag

SEQ ID NO: 29762 - RNA, 42 nt, Mus musculus
uuuugguugauaaaccucuacagaaugaagugagaacugaag

SEQ ID NO: 29763 - RNA, 55 nt, Mus musculus
ucauccagauaaaggaggugaugaagucauguucaugaggauagcaaaagcauau

SEQ ID NO: 29764 - RNA, 45 nt, Mus musculus
uauaucauaucuauguggugugguguguguguuacacagguggga

SEQ ID NO: 29765 - RNA, 49 nt, Mus musculus
uuguaagggcuuacaguuuauuuccuagcacuauuuuugcaagauuuga

SEQ ID NO: 29766 - RNA, 46 nt, Mus musculus
ucuuccaccagcaguuaagaaaaugcccucacagucaugcccacag

SEQ ID NO: 29767 - RNA, 46 nt, Mus musculus
aaguuacagaacaaguguaggugucugucaacugauaaauggacaa

SEQ ID NO: 29768 - RNA, 61 nt, Mus musculus
acccaaagagcaaggucucagcacaaagacagagaacaggggauagagacaaagacaagag

SEQ ID NO: 29769 - RNA, 48 nt, Mus musculus
ccuuggugguuagcuuuaggaauguaaucuaaauguuuuuuagaaagg

SEQ ID NO: 29770 - RNA, 46 nt, Mus musculus
agauauguucugcuguguuaaagguaagacuggugcuuaaaaugag

SEQ ID NO: 29771 - RNA, 42 nt, Mus musculus
gucucaucaugguuuuagcuggagcuucugaauuugacccuc

SEQ ID NO: 29772 - RNA, 81 nt, Mus musculus
ucaacaguucaugcugaaaaaauguccugcucugcuucaagaaaugguuaauguaaucugccagcuaauaauaauggcccg

SEQ ID NO: 29773 - RNA, 45 nt, Mus musculus
uccaacuuuggcauccuuagaaaacuguaugaagcuuucccagau

SEQ ID NO: 29774 - RNA, 50 nt, Mus musculus
aauuaaaacuauccaggauuugguuaguuuaaaagaaucagaucgucaua

SEQ ID NO: 29775 - RNA, 41 nt, Mus musculus
guauuuacauauaguaaauacuuuagacaacuuuuucuggg

SEQ ID NO: 29776 - RNA, 99 nt, Mus musculus
aggaguaauugagagcuugcauccugaucugggaguuggaggcagagagagugagcaugcaagacugggccugguaugggcuuugaaacuucgaagauc

SEQ ID NO: 29777 - RNA, 45 nt, Mus musculus
uaucaaggcaggaagcauggcagcguuuaggcagacauggugcug

SEQ ID NO: 29778 - RNA, 46 nt, Mus musculus
cauucagacaugagccuaugggcgccacccucauuuaaaccaccac

SEQ ID NO: 29779 - RNA, 42 nt, Mus musculus
guaggaucccuaguuacaguguugguuaaguugacgaggcag

SEQ ID NO: 29780 - RNA, 45 nt, Mus musculus
uguuugaaaaggagcaguccaucugcgccgcugaggagcagccca

SEQ ID NO: 29781 - RNA, 43 nt, Mus musculus
cagagugaugccaacaagaucaaggcaaaaggaggauggcagc

SEQ ID NO: 29782 - RNA, 65 nt, Mus musculus
agcugcaauaaaggaggaagaagacgacauuucugacaagggcagugauucugaagaggaagaaa

SEQ ID NO: 29783 - RNA, 90 nt, Mus musculus
ccaauagagauucucagagugagaaagaagaugguagugacagggagucugauagagagcaagaugagaaacaaagcaaagaugaugaag

SEQ ID NO: 29784 - RNA, 36 nt, Mus musculus
ggaguggcaagaguuacaacagaguauacagaggaa

SEQ ID NO: 29785 - RNA, 46 nt, Mus musculus
gucaaagauaacacacccugucuauagucucuacuuuccugaggug

SEQ ID NO: 29786 - RNA, 56 nt, Mus musculus
cuucuuuuaaaucuagcaccauauaccauuggcgcuuaggaggaacagcauucaaa

SEQ ID NO: 29787 - RNA, 48 nt, Mus musculus
auggguuacccuguucacucccaaguccacuguucuuuggguagguag

SEQ ID NO: 29788 - RNA, 46 nt, Mus musculus
ccugucuccccaaagauuugucugccucugccucccuauuccugag

SEQ ID NO: 29789 - RNA, 47 nt, Mus musculus
aaaccugucaaaaauaaauuagauagauagauagauagauagauaga

SEQ ID NO: 29790 - RNA, 46 nt, Mus musculus
ucaaaucccagcaaccacaugguggcucacaaccauucauaacaag

SEQ ID NO: 29791 - RNA, 47 nt, Mus musculus
gaacaaacauuaauauccaugccauaucaugugugcacacugaagga

SEQ ID NO: 29792 - RNA, 46 nt, Mus musculus
uucaugacaagguuaagacacagaaguaaacuuguucuuauagcag

SEQ ID NO: 29793 - RNA, 46 nt, Mus musculus
gaaguauuugaaagcuguaucuugauuuguuggcagagaaagggag

SEQ ID NO: 29794 - RNA, 41 nt, Mus musculus
aauaugcuuucuugagcuguguacauagaaaugaaccccag

SEQ ID NO: 29795 - RNA, 58 nt, Mus musculus
auuuuuaucuucuuagguagaacugaaguuucccgcacccggcaagccuggaaauuau

SEQ ID NO: 29796 - RNA, 62 nt, Mus musculus
caguauacaguguuccugagaucagacuccuauaugggcuuggaucagauuaaaccacugaa

SEQ ID NO: 29797 - RNA, 71 nt, Mus musculus
ugggacacagcgauagaaggugacgaagaccaggaagacagugaaggauuugaagacagcuuugaggaaga

SEQ ID NO: 29798 - RNA, 64 nt, Mus musculus
gcguuugcacauccuugcaaacauugcugcucugugagaggucauaaagcagcagcagugaggg

SEQ ID NO: 29799 - RNA, 42 nt, Mus musculus
gacugacugcaauaauccuaucaaacucuccauaggccaaag

SEQ ID NO: 29800 - RNA, 42 nt, Mus musculus
cuuccuuccucugcaggcccggggguguggcuuugccuucag

SEQ ID NO: 29801 - RNA, 45 nt, Mus musculus
cucuggauuaauaauuugucugaguuugcauuuaguugaagggag

SEQ ID NO: 29802 - RNA, 45 nt, Mus musculus
uugccuaauuugcauuuuagcaugguuuugucucuuuaagcauag

SEQ ID NO: 29803 - RNA, 46 nt, Mus musculus
acaggccucauaggguuguucagcccugcagaguacgcucccagau

SEQ ID NO: 29804 - RNA, 46 nt, Mus musculus
ucacugggcugcagccccaacaagacugacauuucuggaugcaucu

SEQ ID NO: 29805 - RNA, 46 nt, Mus musculus
guuaucugaaaaugugaagaagauaaaaaagccguguucagaagau

SEQ ID NO: 29806 - RNA, 47 nt, Mus musculus
uucucaguuaagcccaaaagggcuguuuuauaagagcacaaaggaua

SEQ ID NO: 29807 - RNA, 48 nt, Mus musculus
agaauguaaguccccagaaaucacaaacugacaggaaagagaagggag

SEQ ID NO: 29808 - RNA, 46 nt, Mus musculus
uuuacccaguuucuacucuucagucucauuugcuuucccuggagac

SEQ ID NO: 29809 - RNA, 44 nt, Mus musculus
gauccugauuugucaagcaggaauaggaacaucucuguguugug

SEQ ID NO: 29810 - RNA, 44 nt, Mus musculus
cauccuaagacaccccacaaucaccauaaccuuagagccgcagu

SEQ ID NO: 29811 - RNA, 45 nt, Mus musculus
uuguucuacugaaaacuauggcugaacggaguuaugcuauuagau

SEQ ID NO: 29812 - RNA, 42 nt, Mus musculus
gcuucccugguaggcccuuucaggaaacaaugggcuguagau

SEQ ID NO: 29813 - RNA, 55 nt, Mus musculus
cucugucuugaaaaaaaaagaaaaagaaaaaaacgagagagagagagagagauag

SEQ ID NO: 29814 - RNA, 99 nt, Mus musculus
ucaaucucagaggcagacugucugcuccaagccaugcacauagaagcuguuucugucccaagguauaagcuacauaaaagcaggagagaacuguauagg

SEQ ID NO: 29815 - RNA, 41 nt, Mus musculus
uacuuaaauuuacuucuagaaaaaguucuaucagggcuaga

SEQ ID NO: 29816 - RNA, 55 nt, Mus musculus
gugugucugugucuuugugugucugugugucuuuguguaucugugugugugugug

SEQ ID NO: 29817 - RNA, 67 nt, Mus musculus
uaucugucugugugugucuguguaugucugugugugucugugugucugucugugugucugucugucu

SEQ ID NO: 29818 - RNA, 45 nt, Mus musculus
ucuucaguccuuaaggggaaaggcagcaagccaugauauaucaga

SEQ ID NO: 29819 - RNA, 46 nt, Mus musculus
auuguugacuugggauacauaguaaaugaaauauaaaucaguaggc

SEQ ID NO: 29820 - RNA, 46 nt, Mus musculus
uucauguuguguugguacgaagaagaagaaggagaagaagaaagaa

SEQ ID NO: 29821 - RNA, 46 nt, Mus musculus
ccaguuugauuuuucuccuaauaaaaacuagagagaggagguuaau

SEQ ID NO: 29822 - RNA, 46 nt, Mus musculus
caggcaggaggauagagaguaagagcaaguacgaagcagcaaacaa

SEQ ID NO: 29823 - RNA, 41 nt, Mus musculus
ugaaauuauuggcugguuugauucaguucuugagauggagg

SEQ ID NO: 29824 - RNA, 42 nt, Mus musculus
cccucaagucucugaguucauaugugcaucaauucugcuggu

SEQ ID NO: 29825 - RNA, 46 nt, Mus musculus
ggauuucugaguucgaggccagccuggucuacaaaaaaaaaaaaaa

SEQ ID NO: 29826 - RNA, 46 nt, Mus musculus
aaaagcuuaggcccaggcaagguaguaugugccuuuaaucccagau

SEQ ID NO: 29827 - RNA, 45 nt, Mus musculus
ugccuaacgcgugcaaggcccugcguccaauccucagcacaagug

SEQ ID NO: 29828 - RNA, 42 nt, Mus musculus
auuaggacacggagacucggugggaggcuagggagacaaggu

SEQ ID NO: 29829 - RNA, 32 nt, Mus musculus
auucauuauuuaaaaauuuaaaacgggaugga

SEQ ID NO: 29830 - RNA, 44 nt, Mus musculus
cuuaagaaaugggguuucaaagaauggagccggggugguguuua

SEQ ID NO: 29831 - RNA, 44 nt, Mus musculus
uuaauauuuaauauuuucuuuccuuuuuuuuuccuucguguaga

SEQ ID NO: 29832 - RNA, 45 nt, Mus musculus
uagaauguagaaaaaugagggggugaagggaauuccacauuaaag

SEQ ID NO: 29833 - RNA, 45 nt, Mus musculus
uuugucucguuuuguuuuaugggucaguuuuacuuuaagccccau

SEQ ID NO: 29834 - RNA, 46 nt, Mus musculus
guguguguguauuaguaugugugugugugugaguguacaugugugu

SEQ ID NO: 29835 - RNA, 54 nt, Mus musculus
uuucgcuuacccccggucuugcggcgcuugugccaguugucccgagagaugccc

SEQ ID NO: 29836 - RNA, 45 nt, Mus musculus
cuuauugccuccucgaacucggacuguguguaugcggcgagggcc

SEQ ID NO: 29837 - RNA, 45 nt, Mus musculus
uuuugaugaaucuuugaauucucuuaguuuggcucuuucagguag

SEQ ID NO: 29838 - RNA, 41 nt, Mus musculus
auguuacuagugagugauguggacgagucaucccgcgcagg

SEQ ID NO: 29839 - RNA, 45 nt, Mus musculus
aauuaaaaaaaaagcuucucagcguccuuuucacguguggaggaa

SEQ ID NO: 29840 - RNA, 41 nt, Mus musculus
ggugaaggucaggcuguaagaggacauuacagaggcccaca

SEQ ID NO: 29841 - RNA, 42 nt, Mus musculus
agugugugguuguguauguguuuggguauggguggccaggag

SEQ ID NO: 29842 - RNA, 45 nt, Mus musculus
uacagaagauauaagauauaauuugcuaaacacaugaaacucaag

SEQ ID NO: 29843 - RNA, 42 nt, Mus musculus
acaggggaacaccagggccaaaagggggagugggugggcagg

SEQ ID NO: 29844 - RNA, 42 nt, Mus musculus
ugguguguuguggcuuuuuccugcuccagcaaacuugggcug

SEQ ID NO: 29845 - RNA, 45 nt, Mus musculus
aauuaucucggguuggguaggagaaaguuguaguauuugggcuaa

SEQ ID NO: 29846 - RNA, 45 nt, Mus musculus
ucuagagagacuguucaaauauagugcuucugaaauaaaggccuu

SEQ ID NO: 29847 - RNA, 46 nt, Mus musculus
ccgagcucagucggccccccucaauccgugggaaucagggucucgg

SEQ ID NO: 29848 - RNA, 45 nt, Mus musculus
aacuauaauaagaauuuuaaacuuacguugcuaagcuugcccuga

SEQ ID NO: 29849 - RNA, 44 nt, Mus musculus
uuggucugaauuucucuuucguuguugggucuuugugugguuua

SEQ ID NO: 29850 - RNA, 42 nt, Mus musculus
ccgcaaguacucuuaaacauugagccaucuuuccagccccaa

SEQ ID NO: 29851 - RNA, 46 nt, Mus musculus
uacuugacaaauuacaaccaacaguaaccaacaacauucaaccauc

SEQ ID NO: 29852 - RNA, 49 nt, Mus musculus
auuauguuuaauaucaguuuuaacaaguaucacaacauuuuuauuaagu

SEQ ID NO: 29853 - RNA, 47 nt, Mus musculus
auaguuguuuucuccacaugauggaaguaacuuucugucggcacauu

SEQ ID NO: 29854 - RNA, 46 nt, Mus musculus
ccauccuuauuccacccuaauuccaacccucagcacuaggcaggag

SEQ ID NO: 29855 - RNA, 46 nt, Mus musculus
gagcugcaggacaucagccuucauaggcacucuccagaguccccag

SEQ ID NO: 29856 - RNA, 25 nt, Mus musculus
ugcuagugaccuaauucaugaggca

SEQ ID NO: 29857 - RNA, 26 nt, Mus musculus
guaugugugcgcaugagaucaugagu

SEQ ID NO: 29858 - RNA, 26 nt, Mus musculus
augugugugcacaugagaucaugagu

SEQ ID NO: 29859 - RNA, 26 nt, Mus musculus
augugugugcacaugagaucaugagu

SEQ ID NO: 29860 - RNA, 26 nt, Mus musculus
augugugugcacaugagaucaugagu

SEQ ID NO: 29861 - RNA, 25 nt, Mus musculus
augugugugcacaugagaacaugag

SEQ ID NO: 29862 - RNA, 47 nt, Mus musculus
guguaauuugauguagguuuuauuuuccaugauguuucacgucuaga

SEQ ID NO: 29863 - RNA, 45 nt, Mus musculus
ggagauaccaucguuuucuauaaucuuuaauuuuuucugcuggga

SEQ ID NO: 29864 - RNA, 46 nt, Mus musculus
ucuuauuuucuguuuauuugcuauuucugucuuguugaggucccaa

SEQ ID NO: 29865 - RNA, 24 nt, Mus musculus
agcuguuauaauuaaggaguuuuu

SEQ ID NO: 29866 - RNA, 50 nt, Mus musculus
ggaaagccaaggcagcaauucaagacaggaaacuggaggcaggaacggaa

SEQ ID NO: 29867 - RNA, 42 nt, Mus musculus
cucagaaauccaccugucucugccucacuacugcccggcgaa

SEQ ID NO: 29868 - RNA, 45 nt, Mus musculus
ggaaaacaugguagcauaagcuugcuaauagguuguaaaugagua

SEQ ID NO: 29869 - RNA, 46 nt, Mus musculus
ucuccaaagggccuccaacuucagagcaagcaugcauaugccuagg

SEQ ID NO: 29870 - RNA, 45 nt, Mus musculus
auuuuaggaagauuuuacugugcuagguuucuguaauacuccuca

SEQ ID NO: 29871 - RNA, 45 nt, Mus musculus
cuuugggugaaugcccaagaaugcuauagcugcgucuugagguag

SEQ ID NO: 29872 - RNA, 45 nt, Mus musculus
ggauguuguuucuaauuucuuucucaacccauuuauccuuugagu

SEQ ID NO: 29873 - RNA, 46 nt, Mus musculus
acagugcaugcuugagguccuggcuuuauucuggcacugggggcag

SEQ ID NO: 29874 - RNA, 27 nt, Mus musculus
uccuucuuacuggcuuuauuuuuaguc

SEQ ID NO: 29875 - RNA, 45 nt, Mus musculus
cuagaauugacuuuuucuguugagacugauguauuuggagcuaug

SEQ ID NO: 29876 - RNA, 48 nt, Mus musculus
cauguugagggggccauucauugggaaugugaaucuuauccaagguug

SEQ ID NO: 29877 - RNA, 66 nt, Mus musculus
aaugguaccaaagucuaagccuuugugauuaggauugggaaucgcuguuaauaacauagaucaauc

SEQ ID NO: 29878 - RNA, 73 nt, Mus musculus
auuaguauuaguauaaucuuuuuuuuuuuuuugagauagugucuuuucuuuuuuguugcugugaagagauucc

SEQ ID NO: 29879 - RNA, 46 nt, Mus musculus
gauaguugcuaagauacgggcuggaugucaauguguuuacugguuu

SEQ ID NO: 29880 - RNA, 27 nt, Mus musculus
uguuuucuugauucuuuguauuuuuag

SEQ ID NO: 29881 - RNA, 45 nt, Mus musculus
ugucugcuugcuguagugugcaugugugugcauacagaggucaga

SEQ ID NO: 29882 - RNA, 45 nt, Mus musculus
uguagcugagggugacucugaacuccuuccuucugucaccuccca

SEQ ID NO: 29883 - RNA, 36 nt, Mus musculus
gaaguaaucacauuucugugaguucuaggccuguag

SEQ ID NO: 29884 - RNA, 45 nt, Mus musculus
gggauuuaaauaauuuaauuaaaauaauuuauaauuaagcagcau

SEQ ID NO: 29885 - RNA, 46 nt, Mus musculus
auuuuaagaacuugaucuguagaucaggcuggccucaaacucagag

SEQ ID NO: 29886 - RNA, 45 nt, Mus musculus
cugugaguuuuaugugcacucauuugugcagcacacuuucuggag

SEQ ID NO: 29887 - RNA, 45 nt, Mus musculus
aguuaaaaccaaauuaaacuaaauaccugaugacauaagagacag

SEQ ID NO: 29888 - RNA, 46 nt, Mus musculus
aaggccaggauucguaaaccacacucagcauaucgggcaugcagau

SEQ ID NO: 29889 - RNA, 42 nt, Mus musculus
cggcugcaaacuccuugauuucuugauuacuuccuggcuccu

SEQ ID NO: 29890 - RNA, 46 nt, Mus musculus
aggugaacuggaacagacuaaagacaaacugggacaagcccaaaau

SEQ ID NO: 29891 - RNA, 69 nt, Mus musculus
gaaacauauguucaagcuuuggagggaaaguacacagaucuuaauucaaacgaugugucugguuuaaga

SEQ ID NO: 29892 - RNA, 41 nt, Mus musculus
caaagugacccuuuugguucaacuacugcauuucccauuca

SEQ ID NO: 29893 - RNA, 46 nt, Mus musculus
aggaagagagagaaaagggaaagggcgcccuggagagaaaagggag

SEQ ID NO: 29894 - RNA, 45 nt, Mus musculus
ggaaaaaacgacacgggagcuggccaagaccucucuggaugauga

SEQ ID NO: 29895 - RNA, 48 nt, Mus musculus
ccuccccagaagagaagccccaggagcaagcaucccaggaaguccgcg

SEQ ID NO: 29896 - RNA, 45 nt, Mus musculus
cugcucuccuuccucuucggagcguccacggggcaagaggcagag

SEQ ID NO: 29897 - RNA, 42 nt, Mus musculus
cccaggagacauuuuccucucagcaggaucaagaagccucag

SEQ ID NO: 29898 - RNA, 46 nt, Mus musculus
caagaggagaggcugcaaaccgucauaggccgccuccaaagcacaa

SEQ ID NO: 29899 - RNA, 83 nt, Mus musculus
gcccugaaggacuacagaaagugcuucuauaaaaggugaaccccagaugauuuccaccaccagaaaaccugcaacuccugaga

SEQ ID NO: 29900 - RNA, 46 nt, Mus musculus
gggagaccagguggagugggguuggguggggggcaucuucuuggag

SEQ ID NO: 29901 - RNA, 45 nt, Mus musculus
aggaagaggaugaaucauuaaagucguuuagaaagcuagcaccca

SEQ ID NO: 29902 - RNA, 46 nt, Mus musculus
acgugcacaaauccuuccuguguagcuguguagguaucuccuagau

SEQ ID NO: 29903 - RNA, 46 nt, Mus musculus
gcucuuugaaggaauguaggaaucugcucuuuaaacauaggaagac

SEQ ID NO: 29904 - RNA, 46 nt, Mus musculus
uuguuaaagugcuacaaaacuucagaucugcuuuaaggccacguuc

SEQ ID NO: 29905 - RNA, 46 nt, Mus musculus
ccuguagccauuuucuuaauaagcacacuauuuguuccaaucuaag

SEQ ID NO: 29906 - RNA, 48 nt, Mus musculus
aauuuagaaucuuuucaguuucuauaaauuugucaugcugaauaaaaa

SEQ ID NO: 29907 - RNA, 45 nt, Mus musculus
uaacacaaugcagccucguuuucuggaaaugucacuaucacccca

SEQ ID NO: 29908 - RNA, 45 nt, Mus musculus
uugaaugcuuggcccauagggaggggcacauuaggagguguagcu

SEQ ID NO: 29909 - RNA, 42 nt, Mus musculus
ugcacagugcuagagauggagcugagaguucugcaggcagca

SEQ ID NO: 29910 - RNA, 42 nt, Mus musculus
uggggacugaggcaaacccagcuucgauggcacagggguaag

SEQ ID NO: 29911 - RNA, 44 nt, Mus musculus
aaggcuucaaggaugaucccaucaagaacaugguaaaaacugga

SEQ ID NO: 29912 - RNA, 42 nt, Mus musculus
aaauaaaugaaaaacaccauuuggaggugucaucuggcccag

SEQ ID NO: 29913 - RNA, 46 nt, Mus musculus
auaguggaucccuuacaauggcuuucaaccuuccuaaugcugcgac

SEQ ID NO: 29914 - RNA, 23 nt, Mus musculus
gagcccaggccggaggggcgaga

SEQ ID NO: 29915 - RNA, 45 nt, Mus musculus
cucaguacgaaauggucaccuccuccaccuuuuucuuccccacug

SEQ ID NO: 29916 - RNA, 46 nt, Mus musculus
uuagcaucaagcaaaauauuuuugaagacucuucuaaugugaugag

SEQ ID NO: 29917 - RNA, 23 nt, Mus musculus
ggaggcaguaaggagcacugugg

SEQ ID NO: 29918 - RNA, 44 nt, Mus musculus
guggcagggugcaugaagguucccaggagagcuuuuggccacag

SEQ ID NO: 29919 - RNA, 42 nt, Mus musculus
caagggucggauggggccccugcagguccggaaggcagagag

SEQ ID NO: 29920 - RNA, 42 nt, Mus musculus
uguugguggcagugguguggcacgggaaucccggcggcgcag

SEQ ID NO: 29921 - RNA, 46 nt, Mus musculus
guggcagggugcaugaagguucccagaagagcuuuuggccacagga

SEQ ID NO: 29922 - RNA, 42 nt, Mus musculus
caagggucggauggggccccuacagguccggaaggcagagag

SEQ ID NO: 29923 - RNA, 45 nt, Mus musculus
cuucaaggagaggaaggagcuggccaagcgaaugggggucucaga

SEQ ID NO: 29924 - RNA, 42 nt, Mus musculus; identical to SEQ ID NO: 29920

SEQ ID NO: 29925 - RNA, 46 nt, Mus musculus
cuggcaguugcugcagcuuguguuuguucugaagcuguccugaguc

SEQ ID NO: 29926 - RNA, 45 nt, Mus musculus
auguguuuugaaugaacuauuuaaaagaaauucgauuuuaaguag

SEQ ID NO: 29927 - RNA, 45 nt, Mus musculus
uugcagggguuacagaugugaccaccaugugcgccccgcccccau

SEQ ID NO: 29928 - RNA, 46 nt, Mus musculus
gccuaauucuccaaguauauuuucaguaacacauuuguucuugaga

SEQ ID NO: 29929 - RNA, 46 nt, Mus musculus
gguguguguguauguaaguguaccauugccguguauugcccucaga

SEQ ID NO: 29930 - RNA, 46 nt, Mus musculus
gcuguccuggaacucacucuguagaccaggcuguccuuaaacccag

SEQ ID NO: 29931 - RNA, 46 nt, Mus musculus
cuucgugugggcacuggaggggaaaguccacucaccacacuagcag

SEQ ID NO: 29932 - RNA, 61 nt, Mus musculus
acuacuuguuuguuguagccuaacagcaaaacaggaauuaagaaaugagauugggugcagu

SEQ ID NO: 29933 - RNA, 46 nt, Mus musculus
uagugggcuaaagacacuaauuaagacacagauuuugauuauguag

SEQ ID NO: 29934 - RNA, 46 nt, Mus musculus
agaaauucaucuuguauauauaacaguauaggcaaauugaaaguaa

SEQ ID NO: 29935 - RNA, 46 nt, Mus musculus
cucagcccaggaaagauugauaggacuaguuaguaucuaugaccag

SEQ ID NO: 29936 - RNA, 46 nt, Mus musculus
gaaaucccauucaaagacuuagaaagugugauaaguauguuuaaag

SEQ ID NO: 29937 - RNA, 42 nt, Mus musculus
gcugccaauucaaucuacuauauugcauaaacuauuugucag

SEQ ID NO: 29938 - RNA, 47 nt, Mus musculus
agauuccuuucuacaagaugaaguacaaauguacuuuuauaguguag

SEQ ID NO: 29939 - RNA, 45 nt, Mus musculus
guucucuaucaugacugaaauuuagggcuggauagauggcucaga

SEQ ID NO: 29940 - RNA, 46 nt, Mus musculus
uggccuccgugagcaucugcauaacauguaccuaaguagacaggaa

SEQ ID NO: 29941 - RNA, 46 nt, Mus musculus
guucauuggugaagucacaacgguggggcaggauaaaaagcuaggg

SEQ ID NO: 29942 - RNA, 46 nt, Mus musculus
aacauggguccucugaaagagcagccaauggucucuccagcccaag

SEQ ID NO: 29943 - RNA, 45 nt, Mus musculus
auaaagaggccaugucuugugaaugggacgcagacagacacagug

SEQ ID NO: 29944 - RNA, 45 nt, Mus musculus
accuaacccccccacaaaaucagaaacgacaaccuucaacuaaaa

SEQ ID NO: 29945 - RNA, 47 nt, Mus musculus
uugcuuccaaguuuguuuuauuauuucuauguauguguauauauggu

SEQ ID NO: 29946 - RNA, 46 nt, Mus musculus
agcccucagugugaguagaaauuauccaaacaggccauuuagggag

SEQ ID NO: 29947 - RNA, 45 nt, Mus musculus
uauugcaaacaacacuaaggaagaauuuuguggaaaauaguggga

SEQ ID NO: 29948 - RNA, 46 nt, Mus musculus
gucuuguuugccacuuagauauccaggguuugagaaauagucugag

SEQ ID NO: 29949 - RNA, 26 nt, Mus musculus
auguaaccagaagacggcaucagacu

SEQ ID NO: 29950 - RNA, 36 nt, Mus musculus
caagagauuuauugggguggaaaguaaaagaccauc

SEQ ID NO: 29951 - RNA, 46 nt, Mus musculus
acugaaugucaugccuagggcuuuuggaaugguuaaaaauaaaaag

SEQ ID NO: 29952 - RNA, 46 nt, Mus musculus
uugccuaggaagugaaagacucugcugaguucaggagaagcaagga

SEQ ID NO: 29953 - RNA, 43 nt, Mus musculus
gcaagaaagagaagguuaaaaaaugauggucuggaagcuaaga

SEQ ID NO: 29954 - RNA, 48 nt, Mus musculus
uugucucaaaguuaaauauacuccggcauggagguguacaccugcagu

SEQ ID NO: 29955 - RNA, 45 nt, Mus musculus
cagccuggguuauauagcaauaaccuguaucaacacauacuuaaa

SEQ ID NO: 29956 - RNA, 58 nt, Mus musculus
ggcagagaggcagagaggcgcagagaggcgcagagagggacagagaggcgcagagagg

SEQ ID NO: 29957 - RNA, 45 nt, Mus musculus
ggcuacacagagaaacccugucucaacaaacaaacaaaacaacaa

SEQ ID NO: 29958 - RNA, 45 nt, Mus musculus
gauuauaagaauaugcuaacaugccuagaaagacuugguuuuuaa

SEQ ID NO: 29959 - RNA, 45 nt, Mus musculus
aaugggaaacguacuugucuuccagaugaagacugacagggccua

SEQ ID NO: 29960 - RNA, 46 nt, Mus musculus
guaggaagcucucucuggguguuuaaucucugaggauuauaaagag

SEQ ID NO: 29961 - RNA, 57 nt, Mus musculus
agauaauuugcuuucauggacauggcuguccaaguucugauagaugacuugaaauaa

SEQ ID NO: 29962 - RNA, 34 nt, Mus musculus
agucuugagaguugcugaguagucauuuucaauu

SEQ ID NO: 29963 - RNA, 45 nt, Mus musculus
cuuacguuguuggaaccuuuuagauuuuuuuuccuuccugagaca

SEQ ID NO: 29964 - RNA, 140 nt, Mus musculus
ggauagagaauagcagagucaauagcugugcugaucugggguacagugaggaagaagccaguuaguuguuggaagaagcagguaaaucucugaguucaagaccagcuuugucuauauagugauuuucaggccaagaccac

SEQ ID NO: 29965 - RNA, 78 nt, Mus musculus
aaaaaaaaaaaaagguauuaaguuucagggaaaagaggggaauacuaaaauuuacauguggauuaguaauacugugca

SEQ ID NO: 29966 - RNA, 42 nt, Mus musculus
gcuucugccucccaagugccgggauuaaaggcaugccaccac

SEQ ID NO: 29967 - RNA, 46 nt, Mus musculus
accacccagcuucucacguugauuuuuuucauuuuauacugcccaa

SEQ ID NO: 29968 - RNA, 44 nt, Mus musculus
cuuccuucuuucuuuccauccuuccuuccucucucuugccccuc

SEQ ID NO: 29969 - RNA, 46 nt, Mus musculus
acccguuucuguuccccacacuagcguuuuguauguucuggcccua

SEQ ID NO: 29970 - RNA, 46 nt, Mus musculus
ucaugacagagcacuccugagagaccuuauuuaggaagaccuuaug

SEQ ID NO: 29971 - RNA, 46 nt, Mus musculus
guuuaaaagacccacacugggaguuggagguguucagaaaagggag

SEQ ID NO: 29972 - RNA, 27 nt, Mus musculus
gucugagagucaaugggcacgcagagg

SEQ ID NO: 29973 - RNA, 45 nt, Mus musculus
uuguggaacuacugaauauaguuuagcagugauggacaucaaaaa

SEQ ID NO: 29974 - RNA, 50 nt, Mus musculus
uguguguguguguauguauauauguguguguguguguguguauauaugug

SEQ ID NO: 29975 - RNA, 43 nt, Mus musculus
acucaggucuaccuauuguuggauuuaauuuuuaugacuggga

SEQ ID NO: 29976 - RNA, 45 nt, Mus musculus
gaggagaauaauagugauucuuugacaguuauacauuuccucuag

SEQ ID NO: 29977 - RNA, 46 nt, Mus musculus
cuucgugagaaauagaccccaaaguaagcuauuguuacuuguuaaa

SEQ ID NO: 29978 - RNA, 81 nt, Mus musculus
ccuugcugcaucuugccugaucugaguggccucucuauucugcagacaccagagaggaguucuugccgcaccugauaguag

SEQ ID NO: 29979 - RNA, 48 nt, Mus musculus
augggacaaaguaucuacuaguguacuuccugacaaguuuccagccua

SEQ ID NO: 29980 - RNA, 46 nt, Mus musculus
ccuuuauuuuacauguuuuauuucaguggucaauucuuaggaacag

SEQ ID NO: 29981 - RNA, 46 nt, Mus musculus
gauacaguaaagucagagugcucuuauuuccuuuuaauaaccguag

SEQ ID NO: 29982 - RNA, 71 nt, Mus musculus
caaaacuucugggaaaaggaaucaagaaagcaaucugauuuacaguagaggaaauaaaauaggaaaggauu

SEQ ID NO: 29983 - RNA, 45 nt, Mus musculus
ucucucucucauuuuucuuaaguagucagguacaaauuacaaaga

SEQ ID NO: 29984 - RNA, 45 nt, Mus musculus
ggagccaaggccagccuccacuucauagugaauuugagaugccua

SEQ ID NO: 29985 - RNA, 45 nt, Mus musculus
accccccacugcuacauauuucuauuugauuuccugacccucugu

SEQ ID NO: 29986 - RNA, 46 nt, Mus musculus
gcaacauaagaucaaacuacauauacguaucuagcaaccuggacag

SEQ ID NO: 29987 - RNA, 46 nt, Mus musculus
agccagcuaguguguuuuaauuuagcagggcuuuuccaggguguac

SEQ ID NO: 29988 - RNA, 45 nt, Mus musculus
uuccugcacauaugggcagcacuaauuagacucagugugucauca

SEQ ID NO: 29989 - RNA, 41 nt, Mus musculus
acgugugagcgcugcaagggaggcuuugcgccugcugagaa

SEQ ID NO: 29990 - RNA, 45 nt, Mus musculus
ugagcauugagucauagaaugaaauuuuauucaguaguacgcaua

SEQ ID NO: 29991 - RNA, 58 nt, Mus musculus
uaaggcuuuuauuauucauucaugaaagucaauacacagagguuagaaaaguacaggc

SEQ ID NO: 29992 - RNA, 41 nt, Mus musculus
ugauccucauggaaugaaaggguugaggggguguguaguga

SEQ ID NO: 29993 - RNA, 102 nt, Mus musculus
ucauaaucgugaaaaagccagaggccuuggaaaauacaucugccagaaaugccaugccaucauugaugaacagccucugaucuucaagaacgacccuuacca

SEQ ID NO: 29994 - RNA, 45 nt, Mus musculus
acagacaugcccacaggccagucuuagagaggcaacuccuagaau

SEQ ID NO: 29995 - RNA, 44 nt, Mus musculus
uuugugccaaaugugaaaaaccauuucuugggcaucgccauuau

SEQ ID NO: 29996 - RNA, 46 nt, Mus musculus
cagauuuacccuaccuuccuauacuuugccuucuuauaacccccag

SEQ ID NO: 29997 - RNA, 44 nt, Mus musculus
cugagcaaggugagacagaugguuaucuacugcccacggugcua

SEQ ID NO: 29998 - RNA, 41 nt, Mus musculus
augauggugcacauauguaauuccguaaucaaggaggauaa

SEQ ID NO: 29999 - RNA, 42 nt, Mus musculus
agaggaaaggaaccucucaggaaagaaggcuugagccccccu

SEQ ID NO: 30000 - RNA, 46 nt, Mus musculus
ggaagugaagcccucuucccgcagugaaaugcucccgugugaccag

SEQ ID NO: 30001 - RNA, 46 nt, Mus musculus
uccaccugcaauaccaaacucacacucaaguaaguacuggguccag

SEQ ID NO: 30002 - RNA, 46 nt, Mus musculus
ccuuuggagcugaagaaaagacuuaagaaacuaucugagaccuuag

SEQ ID NO: 30003 - RNA, 46 nt, Mus musculus
guuaagcauuuuaaauuugucuuugcuuuugacaauaagaaccaaa

SEQ ID NO: 30004 - RNA, 46 nt, Mus musculus
augguuuauauaacacacacacacacacauacacacacacacacac

SEQ ID NO: 30005 - RNA, 46 nt, Mus musculus
cguccacaaauaaaaacuacaaaacaugauggguaccuagcccaua

SEQ ID NO: 30006 - RNA, 45 nt, Mus musculus
uauagguuuuccagugaauaaucauauuugaaaauaagggcagga

SEQ ID NO: 30007 - RNA, 45 nt, Mus musculus
caugagcacuuccuccaucugucucaugacuuuuauuugccagcu

SEQ ID NO: 30008 - RNA, 56 nt, Mus musculus
auucuucuucaucuuccucgccaguuuuuacuucuaucuugucaggaagagguacc

SEQ ID NO: 30009 - RNA, 45 nt, Mus musculus
caucacuguccucagucuuauaugcaucaucaucuuucucgagau

SEQ ID NO: 30010 - RNA, 46 nt, Mus musculus
agaaaucacuagcuagccacauccaugcucuaucugaccccgagag

SEQ ID NO: 30011 - RNA, 23 nt, Mus musculus
agggagaaacagagaggaguuga

SEQ ID NO: 30012 - RNA, 42 nt, Mus musculus
aggaaaagaaaggaaggaaggaaggaaggaaggaagagagag

SEQ ID NO: 30013 - RNA, 46 nt, Mus musculus
cagugaauuccucuauugccccugaucucaaaagaggguaacagau

SEQ ID NO: 30014 - RNA, 46 nt, Mus musculus
ucaaucaaguuaaaaggcaugugaagguagagacucaccagcauaa

SEQ ID NO: 30015 - RNA, 46 nt, Mus musculus
aagcuguucuacuuuugcuucuccaucuguuauaaggaguggaggu

SEQ ID NO: 30016 - RNA, 45 nt, Mus musculus
ugaaauacaccaguguuuaaacuuuuauuucacaccaugcaagau

SEQ ID NO: 30017 - RNA, 45 nt, Mus musculus
uaugguugugugagacuuuuaaacugaauuuugugauugacccca

SEQ ID NO: 30018 - RNA, 51 nt, Mus musculus
aaaaccaaaaacaacaaaaacaaaauaaaaaaccaaggaggagguggaaga

SEQ ID NO: 30019 - RNA, 69 nt, Mus musculus
acauagaacaccagggaagaggauuuaaagcagguauugggguuagugaagaggaaaaaaaacaaugag

SEQ ID NO: 30020 - RNA, 46 nt, Mus musculus
ccaccacugcccagcaguagugaauauuuuaauguauagccaucau

SEQ ID NO: 30021 - RNA, 56 nt, Mus musculus
aauggacucuauaaacagcucauuggaagcuuuuauaaggucucuggagagggaau

SEQ ID NO: 30022 - RNA, 46 nt, Mus musculus
auggugucaaguggucguuugggucuaggaguccaaucccgguucu

SEQ ID NO: 30023 - RNA, 46 nt, Mus musculus
agcagggcuacauagaaagacucagucucuaaaauaaaaugugcag

SEQ ID NO: 30024 - RNA, 45 nt, Mus musculus
gcaaaguuuagauuagaauaucaagcauucuuucaucucuguuaa

SEQ ID NO: 30025 - RNA, 42 nt, Mus musculus
cuacucuauaguauuugcuuuguagacuucgaagagggagag

SEQ ID NO: 30026 - RNA, 49 nt, Mus musculus
auuagaggaaccauucaguugcgugauucuguuuuuccagaagaaaaau

SEQ ID NO: 30027 - RNA, 41 nt, Mus musculus
agugugggugugugugugugugugggugugugugggugugu

SEQ ID NO: 30028 - RNA, 45 nt, Mus musculus
uccucagucuuuagcccauccaggguuuuuuacgucaauugguaa

SEQ ID NO: 30029 - RNA, 80 nt, Mus musculus
ggucagaugacugacuugauccauaaugagaaagaccuggugacaucacuaaaagauuauauuaaagcagaagaggacaa

SEQ ID NO: 30030 - RNA, 45 nt, Mus musculus
uuccuuacuacagcugucuccgucuggauguuuucacacuuucac

SEQ ID NO: 30031 - RNA, 42 nt, Mus musculus
uugcacacaugugauuccagcacugggaguggagucaggaag

SEQ ID NO: 30032 - RNA, 71 nt, Mus musculus
aguuagaccggcuaacgaguacagcaacaaaagacccagagggguuuguugggcauccuguaaacgcauuc

SEQ ID NO: 30033 - RNA, 62 nt, Mus musculus
aaguuaaugaaacgucugaacacugaguggagugaguuggagaaucugauccucaaggacau

SEQ ID NO: 30034 - RNA, 32 nt, Mus musculus
aucucuaaccuaaccauucagaggcaguacuu

SEQ ID NO: 30035 - RNA, 66 nt, Mus musculus
uaacauuuaaaaauugguuucugguuuacaaccccacauuuaauagauauuaauuacgucaugugu

SEQ ID NO: 30036 - RNA, 46 nt, Mus musculus
uuccaaaacccaauucccagaaauuuuucuguaauaauucugagua

SEQ ID NO: 30037 - RNA, 46 nt, Mus musculus
uugaugugugcuuuccccuaaugugcuuucuuugcauggcccccaa

SEQ ID NO: 30038 - RNA, 49 nt, Mus musculus
cgaggacugcuuugagcugggcaaaguggccuauacagaggcagauuau

SEQ ID NO: 30039 - RNA, 46 nt, Mus musculus
ucucugacgguuuuucuccaggaauuuaaaaauuggaacuagccaa

SEQ ID NO: 30040 - RNA, 45 nt, Mus musculus
aaaaagcaaaacaaaacaaaacaacaaugaguaaauaagaacuag

SEQ ID NO: 30041 - RNA, 46 nt, Mus musculus
uauaaaaugaugaauucagccagccuuugguacauugugaagaaag

SEQ ID NO: 30042 - RNA, 49 nt, Mus musculus
acuuaguauauuuugaauauauaaugaguaaagaaaaagaugccaauaa

SEQ ID NO: 30043 - RNA, 46 nt, Mus musculus
aacugcaccaaagaaaaaagggauagcuguggauuaccugccagag

SEQ ID NO: 30044 - RNA, 41 nt, Mus musculus
gucccuaauccaucccauucacuggaaugagcccagggcca

SEQ ID NO: 30045 - RNA, 46 nt, Mus musculus
cgcuaccaugaugggaaccggaauccuaaguucauccuggccccag

SEQ ID NO: 30046 - RNA, 46 nt, Mus musculus
caagccccggauuauccguuuccaugacaucaucucugacgcggag

SEQ ID NO: 30047 - RNA, 45 nt, Mus musculus
uuuauuuggcuaguggguuugcuggccagguguguauauacuuag

SEQ ID NO: 30048 - RNA, 46 nt, Mus musculus
cccccuuaaaucauguaguuuuugugaugcaaugggugcuguccag

SEQ ID NO: 30049 - RNA, 46 nt, Mus musculus
uaccaguauuucuugguagaaucuuuguuaagaauucacuuuugag

SEQ ID NO: 30050 - RNA, 45 nt, Mus musculus
cugaggcgagccaccauuucaaacccaguaacaggagccuuggag

SEQ ID NO: 30051 - RNA, 41 nt, Mus musculus
ugacccugagacggggaaauugaccacagcacaguacagag

SEQ ID NO: 30052 - RNA, 46 nt, Mus musculus
auguguacuugauuuucacgauggaccaauagacagauacaggcag

SEQ ID NO: 30053 - RNA, 46 nt, Mus musculus
uauagcauugaccucucuguuggcucacgggauaaaaggcugcuca

SEQ ID NO: 30054 - RNA, 46 nt, Mus musculus
agagggggaggccuuagcuauuaaagaagcuuccuacuggaaauau

SEQ ID NO: 30055 - RNA, 46 nt, Mus musculus
agacuauauaagucuuacuaauuagucauugcuuacaccagcaccu

SEQ ID NO: 30056 - RNA, 47 nt, Mus musculus
ugagaauacaagaucucacaggacuggauguuucuacggccgaggag

SEQ ID NO: 30057 - RNA, 29 nt, Mus musculus
cucagauuuucacaccugugcagcaagca

SEQ ID NO: 30058 - RNA, 30 nt, Mus musculus
cgucaugagggccccaagaugcuugccuag

SEQ ID NO: 30059 - RNA, 56 nt, Mus musculus
cucacaccuucugugauuccauuuccaggggaucuaguacccacuucuugccucca

SEQ ID NO: 30060 - RNA, 42 nt, Mus musculus
uuuaaaagaauuuaucguuuaccuaacuauauaggaggucag

SEQ ID NO: 30061 - RNA, 41 nt, Mus musculus
cggaguuggaggacaguaugagccccauuuugacuuugcaa

SEQ ID NO: 30062 - RNA, 30 nt, Mus musculus
ucugguauaaucuguuugccaguggggaag

SEQ ID NO: 30063 - RNA, 75 nt, Mus musculus
augaacguggacaagaauuucgaaggccgugcacccugucagaauuggaaugacaaccaggcuucccuuggcucc

SEQ ID NO: 30064 - RNA, 82 nt, Mus musculus
uguuguccucuaacgcaccaggcacgauggcugauuauaacuccgacguuuacagcugacuaacacuccaugauuaauuggg

SEQ ID NO: 30065 - RNA, 46 nt, Mus musculus
caaucacuuauuuuguggauuucuuuaauuaauacucaaucaccac

SEQ ID NO: 30066 - RNA, 50 nt, Mus musculus
uuuuugguuaauuuuuuuaaaaaaagcauccagaaguagauuucaccaca

SEQ ID NO: 30067 - RNA, 45 nt, Mus musculus
ugguaacuaacuagggcccagucaggucugcuauuccacgugcag

SEQ ID NO: 30068 - RNA, 49 nt, Mus musculus
cuuuuuaucaaaucccccuccucaccacgggugaauucagccaguuuga

SEQ ID NO: 30069 - RNA, 81 nt, Mus musculus
ggcacugguguuggcauucugauucaauucugugccuuaggagacugggaguuagaaaacggacagguccuuggacugagg

SEQ ID NO: 30070 - RNA, 78 nt, Mus musculus
gaguugauuuuuaaaaagaaauguuuuauaagaagccaagauguuuguuuuucuccauucugaaauguguuauaacaa

SEQ ID NO: 30071 - RNA, 45 nt, Mus musculus
uguuuaaauccaaauguaagaauugagcacugcucccaggcccgu

SEQ ID NO: 30072 - RNA, 46 nt, Mus musculus
cagcaguguuaacccaggguccuaucaggacaauaaaguugccuag

SEQ ID NO: 30073 - RNA, 42 nt, Mus musculus
agacccuaauucugcaucugcagcuaugcacugcuaugaaag

SEQ ID NO: 30074 - RNA, 57 nt, Mus musculus
aggauauuuuggcugccuccggagccgcagggucuugggccgccggaagguggguga

SEQ ID NO: 30075 - RNA, 45 nt, Mus musculus
ggaaguaauuauuauuccuauuuacaacgaagcaucuggugccca

SEQ ID NO: 30076 - RNA, 45 nt, Mus musculus
uuccaucuagaaccuguuuacaugaaguuacucgcgguucaugaa

SEQ ID NO: 30077 - RNA, 44 nt, Mus musculus
ggagcugcagccagcccaucccggugcccauguacuggaggauu

SEQ ID NO: 30078 - RNA, 42 nt, Mus musculus
uguuuugucauuuguuuuguaucuugguuuuggggggugggg

SEQ ID NO: 30079 - RNA, 46 nt, Mus musculus
ugcggggaggguuucucacugccccccaaagugaagacaaggaauu

SEQ ID NO: 30080 - RNA, 46 nt, Mus musculus
ucguccuccucuuccucuucguccucgucucgaacuccggccgcug

SEQ ID NO: 30081 - RNA, 46 nt, Mus musculus
caaauccuugucccucuugucuuucagcggcuucugugcgccuuca

SEQ ID NO: 30082 - RNA, 46 nt, Mus musculus
cacagucgcugccagggaggagcuggccucauuuacuggggaaagu

SEQ ID NO: 30083 - RNA, 53 nt, Mus musculus
uuaaguacuuuuacauacaaauuuacccuagccagcauuuagcguucugcuca

SEQ ID NO: 30084 - RNA, 42 nt, Mus musculus
aagucgcuuaaguaagccguagguuucuuuaugugggcuguu

SEQ ID NO: 30085 - RNA, 46 nt, Mus musculus
gucauucagaggcugucuggaagcuuucaccagccaagcccaaggu

SEQ ID NO: 30086 - RNA, 45 nt, Mus musculus
gugucuccaauucugcuaauaggcaacaagugcucaugugagaug

SEQ ID NO: 30087 - RNA, 46 nt, Mus musculus
auaaaaaagaagcacuaggcucuguagucagugcacugcugccugu

SEQ ID NO: 30088 - RNA, 46 nt, Mus musculus
ugcauauauaaaauaaagaaauccuuuaaaaaaaaaaacaaaggaa

SEQ ID NO: 30089 - RNA, 46 nt, Mus musculus
auuaaaaguuuaccaggcuauaguuugagccgcugugccacaaagg

SEQ ID NO: 30090 - RNA, 46 nt, Mus musculus
acuaacugggagcguaggaagagacccuggaggcucgcccgcgccg

SEQ ID NO: 30091 - RNA, 45 nt, Mus musculus
guuccuagaaccaaacagaacauguaugguagcacaggcaggcag

SEQ ID NO: 30092 - RNA, 46 nt, Mus musculus
agcaaaaugcagccaucugcgcagcucaucuggucagguucuugaa

SEQ ID NO: 30093 - RNA, 46 nt, Mus musculus
aucaagccacuugggaggcauagguaggugagucucugaguuugag

SEQ ID NO: 30094 - RNA, 46 nt, Mus musculus
uauguucuggugguaacauuaagauauuguuucugggaguugacag

SEQ ID NO: 30095 - RNA, 45 nt, Mus musculus
ucuucuggagugucugaagacagcuacaguguacuuacacguaau

SEQ ID NO: 30096 - RNA, 41 nt, Mus musculus
gcuucccagacuucugguuugugugugugugugugugugug

SEQ ID NO: 30097 - RNA, 42 nt, Mus musculus
aagacggcgguggacuguggggccgugaagcacugccagcag

SEQ ID NO: 30098 - RNA, 79 nt, Mus musculus
guuagaaaucccuuccuugcgacauaugcaaaacuguugucaccgaagcugggaacuugcugaaagauaaugcuacgca

SEQ ID NO: 30099 - RNA, 54 nt, Mus musculus
ugcaaggaggugguugacucuuaccugccugucauccuggacaugauuaagggc

SEQ ID NO: 30100 - RNA, 44 nt, Mus musculus
cuuccuaaucuucuaggcacacugagugagggaggaacugacug

SEQ ID NO: 30101 - RNA, 48 nt, Mus musculus
caaccucugccagucccuucaggaguacuuggccgagcaaaaccagaa

SEQ ID NO: 30102 - RNA, 50 nt, Mus musculus
aacaucccucuccugcuguacccucaggaucacccccgcagccagcccca

SEQ ID NO: 30103 - RNA, 42 nt, Mus musculus
ucguggaccacgugaaggaggauugugaccgcuuggggccag

SEQ ID NO: 30104 - RNA, 46 nt, Mus musculus
uuuagugagaccuagauguaauuuugguuaguugaaucugcagugg

SEQ ID NO: 30105 - RNA, 42 nt, Mus musculus
cagaacucacuuagugcccgagagccugugaauggccuugga

SEQ ID NO: 30106 - RNA, 52 nt, Mus musculus
ccugccaccgagaccauuaagaacauccucccugcccuggagaugauggacc

SEQ ID NO: 30107 - RNA, 45 nt, Mus musculus
cacagcagaaucugguccaggcccacaaugugauuuuaugccaga

SEQ ID NO: 30108 - RNA, 46 nt, Mus musculus
aaagguuugagcaacgcaugcgcacugcuccccgauccugccagaa

SEQ ID NO: 30109 - RNA, 42 nt, Mus musculus
ccccucccuguuggacaucuuuauccaugagguaaaccccag

SEQ ID NO: 30110 - RNA, 46 nt, Mus musculus
guaucugcacugcucaaagagcccacaccgccaaagcagcccgcac

SEQ ID NO: 30111 - RNA, 42 nt, Mus musculus
gugugcaagaaacugguccucuauuuggaacauaaccuggag

SEQ ID NO: 30112 - RNA, 47 nt, Mus musculus
gucuggggcccuagcuacuggugucagaacauggagacugccgcccg

SEQ ID NO: 30113 - RNA, 59 nt, Mus musculus
ucgaucauugcaaacgccauguguggaacuaguuucccagcugcagaagucaccuacuu

SEQ ID NO: 30114 - RNA, 46 nt, Mus musculus
gugggucuaggguaaugaacacauagaucuauuugacuuaauaagu

SEQ ID NO: 30115 - RNA, 91 nt, Mus musculus
agcuuccugugguaccaaggaguuauuuuggaugauuagaagcacagaaugaucaggccuuuagagcgauggaauggccauugucauagca

SEQ ID NO: 30116 - RNA, 42 nt, Mus musculus
uuaauaaaacuuuauuuacaaaaauaaggugacgggacagau

SEQ ID NO: 30117 - RNA, 45 nt, Mus musculus
cucaugaucccuagggcuguaagcagagcuucuaacgagacccca

SEQ ID NO: 30118 - RNA, 41 nt, Mus musculus
ucaucuacccauuuuacagaccagagagcugaggaccggau

SEQ ID NO: 30119 - RNA, 46 nt, Mus musculus
gcggguguuuuagaggcuggggaggggcucgaaggaaggcuggggg

SEQ ID NO: 30120 - RNA, 46 nt, Mus musculus
acagcacaaauaugagauccacagaccaaaagaagcuugcccccac

SEQ ID NO: 30121 - RNA, 46 nt, Mus musculus
uguaucugaccuguauuauagcuggugcugagacauucacuccugu

SEQ ID NO: 30122 - RNA, 44 nt, Mus musculus
caaaggggggucacaacccacagguugagaacuauugcuguagu

SEQ ID NO: 30123 - RNA, 45 nt, Mus musculus
cucugaacugcuguggaauugcaccuugauuuguuggguccuuag

SEQ ID NO: 30124 - RNA, 42 nt, Mus musculus
ugugugugugugugugugugugagagagagagaguguaugug

SEQ ID NO: 30125 - RNA, 42 nt, Mus musculus
auaaugugaccucugaguguuuggaagaucugagaggccauu

SEQ ID NO: 30126 - RNA, 44 nt, Mus musculus
ugagccaccaugugguugcugggauuugaacucaggccaagguu

SEQ ID NO: 30127 - RNA, 52 nt, Mus musculus
aauuuaaaaaaaaaaaaagauuuauuuauuuuauguaugugaguacacuaua

SEQ ID NO: 30128 - RNA, 42 nt, Mus musculus
aaggcauugauacaaacggaugaaucuuuuggugccauguua

SEQ ID NO: 30129 - RNA, 46 nt, Mus musculus
cuauaacugguagguuaggcaggauacacaaaacggagaugaauuu

SEQ ID NO: 30130 - RNA, 46 nt, Mus musculus
uuugaggggcuuuuaggcagaauugaaacuuaguuugucauuggga

SEQ ID NO: 30131 - RNA, 46 nt, Mus musculus
aaacuaaaaaaauacaggacccagagucuaucaguaaacggcccag

SEQ ID NO: 30132 - RNA, 42 nt, Mus musculus
uuucuguagaguucccagccucaguaauguuccaggcugcuu

SEQ ID NO: 30133 - RNA, 98 nt, Mus musculus
cugugauaaagcaugacauaaaagcccaauucagauccuacuaauaaaacaagcuccaauguauuauggaaacaugugcuuuuacgccuccaauaaaa

SEQ ID NO: 30134 - RNA, 46 nt, Mus musculus
gcagcaauaacccuucaaaagcaauugaauaauaaaugucccaaac

SEQ ID NO: 30135 - RNA, 46 nt, Mus musculus
uguuucuguauuagaugucgguaaucaugugaauauacugccaugu

SEQ ID NO: 30136 - RNA, 46 nt, Mus musculus
cgacagcauuuuagcuucagguacuggacguuccucaggccccgcu

SEQ ID NO: 30137 - RNA, 46 nt, Mus musculus
cagaggacacuugcuccaucaguguguguucuuccugccccuuccc

SEQ ID NO: 30138 - RNA, 42 nt, Mus musculus
uacuggccucuuuuuuuguuuuauuuuuaaauaacuggagua

SEQ ID NO: 30139 - RNA, 45 nt, Mus musculus
ggggagguucagccucugcuucaggagaugccucuuguccucagg

SEQ ID NO: 30140 - RNA, 45 nt, Mus musculus
aagagggugucucugcugccucagugggguguucuggccaucagg

SEQ ID NO: 30141 - RNA, 46 nt, Mus musculus
ucgucuuuacuuaaucauugugugguggcuccgaccuguccugauu

SEQ ID NO: 30142 - RNA, 46 nt, Mus musculus
uggcuccguagagcacaauaggauaaaccauaagauagcuucagcc

SEQ ID NO: 30143 - RNA, 48 nt, Mus musculus
ucggaagcgaguggcgauccaguuccuaaaggauauccgggaaucagu

SEQ ID NO: 30144 - RNA, 46 nt, Mus musculus
auuuugacauuuaccgacuaucuaauaugaugucugcuaaggggug

SEQ ID NO: 30145 - RNA, 44 nt, Mus musculus
gacuuaggagucggguagacugggaaaagccagugguucuggau

SEQ ID NO: 30146 - RNA, 46 nt, Mus musculus
ugcacuucggugagaacggcuauguugaagcuaccaaacagaucau

SEQ ID NO: 30147 - RNA, 46 nt, Mus musculus
guacaggacguaccaguucuuuguuggugcagacuggcaagguggu

SEQ ID NO: 30148 - RNA, 46 nt, Mus musculus
acuggagaaguagcuaagaguucuacaucuggauccgcaggcagcu

SEQ ID NO: 30149 - RNA, 72 nt, Mus musculus
gaaagcaggguacccacuggagaaaccauuugauuuccgggugaaaggugugaccagcauuucagcagauac

SEQ ID NO: 30150 - RNA, 41 nt, Mus musculus
uugcacugaaaaagaacauggagguggaugugcaggugagu

SEQ ID NO: 30151 - RNA, 49 nt, Mus musculus
cggaaagcauccugauggccugcaaagcuuaccgggacuuggcguuaga

SEQ ID NO: 30152 - RNA, 43 nt, Mus musculus
gcauccagauaucuucccuggauugcggaaguuagaggcagaa

SEQ ID NO: 30153 - RNA, 46 nt, Mus musculus
cucuuguaccuucuaguuaacuuuuuuuuccuuuauccuuggagau

SEQ ID NO: 30154 - RNA, 45 nt, Mus musculus
gggaauaguuuccugauugcuagguuggaaacuuaaagagauaac

SEQ ID NO: 30155 - RNA, 46 nt, Mus musculus
uucuguaaagagccaaauaggaaacauuuuugucuacucugggccc

SEQ ID NO: 30156 - RNA, 71 nt, Mus musculus
caugugacuaauaacaacuauuuguuucuuguagguuuauggucucgguuuaaaaaaaaauuauuuaagcu

SEQ ID NO: 30157 - RNA, 46 nt, Mus musculus
uuuauaaaaaaauugaaagaaacucucccucuggaggaaguaaagu

SEQ ID NO: 30158 - RNA, 46 nt, Mus musculus
gccuuauuuggagauuuuggaaucauauuccacaaaagccaagaau

SEQ ID NO: 30159 - RNA, 45 nt, Mus musculus
ccaaugcacacauaagccccuuucuauacauuuuccucugaagau

SEQ ID NO: 30160 - RNA, 46 nt, Mus musculus
cgaugacucuucauaacuucuucaagcugaauaugggcgaugagau

SEQ ID NO: 30161 - RNA, 46 nt, Mus musculus
aacucacagagauucaccugccucugccuucugagugcugggguua

SEQ ID NO: 30162 - RNA, 42 nt, Mus musculus
uauauuuugaaaggcagccuggcugggucugaacagcaaguc

SEQ ID NO: 30163 - RNA, 46 nt, Mus musculus
ggaguugauuuguagugaaucagucuucauguauaaauacacagag

SEQ ID NO: 30164 - RNA, 46 nt, Mus musculus
gaaauuucauuugauacagcacuuaaaauugugugggcacccugga

SEQ ID NO: 30165 - RNA, 46 nt, Mus musculus
aaauugagauugacacaaaaaguuauuuuuauuauuugagccaggu

SEQ ID NO: 30166 - RNA, 41 nt, Mus musculus
gacgcagaggcagggcagccccggggagggagccggcugca

SEQ ID NO: 30167 - RNA, 41 nt, Mus musculus
gcugaggggagcggggcccgagcugagagggagccgggcug

SEQ ID NO: 30168 - RNA, 46 nt, Mus musculus
gcugagggagagcugggcugaggggagcggggcccgggcugagggg

SEQ ID NO: 30169 - RNA, 42 nt, Mus musculus
cugcgcugagggaggcaggucugugguucauggagagcuggg

SEQ ID NO: 30170 - RNA, 45 nt, Mus musculus
gaccagcuggugcggccggagugucgcaguggcuccuuugcagag

SEQ ID NO: 30171 - RNA, 41 nt, Mus musculus
ugaaagugugcucugagacgcccagcagaggugguaagugu

SEQ ID NO: 30172 - RNA, 41 nt, Mus musculus
gcgcagaccuucaacaccaguaagggucuucaccaggaugc

SEQ ID NO: 30173 - RNA, 43 nt, Mus musculus
augggugugaaagcuuugaccacagcaccugagaggcugaggc

SEQ ID NO: 30174 - RNA, 42 nt, Mus musculus
ugguacaugccuuuaaucccagcacuugggagacagaaucuc

SEQ ID NO: 30175 - RNA, 46 nt, Mus musculus
uaaaauaagaacaucuuuaaaaaaccaaaccaggggcuggugagac

SEQ ID NO: 30176 - RNA, 47 nt, Mus musculus
auuaaucuagaguauaaaauaggggacagggagacagcauuggggag

SEQ ID NO: 30177 - RNA, 42 nt, Mus musculus
uccccugaggguuuuuccuggguucucuuguugcugccagau

SEQ ID NO: 30178 - RNA, 45 nt, Mus musculus
ggccgcccacggggguccgagaucgcgcagaggcaggccccgugg

SEQ ID NO: 30179 - RNA, 45 nt, Mus musculus
ggcaguuugcucaagcuucgcugggcccuaucaagaggcccagau

SEQ ID NO: 30180 - RNA, 45 nt, Mus musculus
gccacaucaaucauuaccucagggcuuucguuuaucacuuacagg

SEQ ID NO: 30181 - RNA, 41 nt, Mus musculus
agagaggccccuuggucucgcaaacuuuauaugcuccagua

SEQ ID NO: 30182 - RNA, 42 nt, Mus musculus
ggcaaaccccccuuuuaucucccgaggaagcaaguugggcag

SEQ ID NO: 30183 - RNA, 42 nt, Mus musculus
gcaagcggcaguucuccgggccgcggauaguagcggggggag

SEQ ID NO: 30184 - RNA, 46 nt, Mus musculus
gacagcuacucagcugcuuaagcuugcccacaaguacaguccagag

SEQ ID NO: 30185 - RNA, 46 nt, Mus musculus
ccuuguuccuucagccacacgaggaugcaggagguguccaggccac

SEQ ID NO: 30186 - RNA, 46 nt, Mus musculus
acucuuccacaaauuccuugcucacauccucaaugaacaccuuuuu

SEQ ID NO: 30187 - RNA, 46 nt, Mus musculus
gcaggugagcucaaagcggaccuggucauuccccuuucccguggcg

SEQ ID NO: 30188 - RNA, 45 nt, Mus musculus
agacagggauggggauuccguguugcuuugcauacuccaucagau

SEQ ID NO: 30189 - RNA, 45 nt, Mus musculus
agacccggaggugcuugauucuugggguuuuccaggaucccagcc

SEQ ID NO: 30190 - RNA, 46 nt, Mus musculus
cuuuuuugaauucuaucucaaggacaucugggguguugggugcuuu

SEQ ID NO: 30191 - RNA, 31 nt, Mus musculus
ugauuuugcguacuucccgauccaucgugaa

SEQ ID NO: 30192 - RNA, 43 nt, Mus musculus
gcaguggcgaacaaauucacauucagggcugugccagaaaccu

SEQ ID NO: 30193 - RNA, 45 nt, Mus musculus
auggugagcgcauccaagggaugaggcgccauccugcgguuggga

SEQ ID NO: 30194 - RNA, 45 nt, Mus musculus
guggaauuggaacugagcacuucgugguccgaggcuccgggaaaa

SEQ ID NO: 30195 - RNA, 46 nt, Mus musculus
uggucacuaagauacaggcuggagccugauccugguggcaggagau

SEQ ID NO: 30196 - RNA, 45 nt, Mus musculus
gcaaugggagaugagugggcagcuuccucugggagugugucagug

SEQ ID NO: 30197 - RNA, 46 nt, Mus musculus
gggcccuggugcccccacucugguaccuccauccccaccuccaccc

SEQ ID NO: 30198 - RNA, 46 nt, Mus musculus
cagcagccuuuccuguccucccaguuauaaagcuaugcccccaccu

SEQ ID NO: 30199 - RNA, 24 nt, Mus musculus
ggugcccagauugugugucccagu

SEQ ID NO: 30200 - RNA, 46 nt, Mus musculus
ugggcaugugguggaugccuuuaaccccagcacgugggaagcagaa

SEQ ID NO: 30201 - RNA, 46 nt, Mus musculus
gcauagugaugcacaccuauaaucccagaccuugagaggcugaggc

SEQ ID NO: 30202 - RNA, 47 nt, Mus musculus
uugcugagaguuugaacuauguacugaguacuagguuagccagaggu

SEQ ID NO: 30203 - RNA, 46 nt, Mus musculus
uuguuuuuggccauccuuggagaauagggucaugagcaaggaauca

SEQ ID NO: 30204 - RNA, 45 nt, Mus musculus
gcucuguaguucauuuggggccaugacauagcuuccuucuuuuag

SEQ ID NO: 30205 - RNA, 45 nt, Mus musculus
cugacucacguccgucucacucuagcagccgaguggagaacaggc

SEQ ID NO: 30206 - RNA, 42 nt, Mus musculus
guggcuaggagggcagaggugggcagagccucugggcagguu

SEQ ID NO: 30207 - RNA, 25 nt, Mus musculus
gacuggcuagcccuagcaaggagau

SEQ ID NO: 30208 - RNA, 45 nt, Mus musculus
gagcugguguguguguguguguguguguguguguguguguaggug

SEQ ID NO: 30209 - RNA, 42 nt, Mus musculus
gugcagaggaggaaccuagaagaagccagauauggguggaga

SEQ ID NO: 30210 - RNA, 47 nt, Mus musculus
gcuuuuguuugggaggcagggucucaggaugccuuugaacuucagau

SEQ ID NO: 30211 - RNA, 46 nt, Mus musculus
ugugaguuugaggccagccugagagggaaagggagagagagaggga

SEQ ID NO: 30212 - RNA, 72 nt, Mus musculus
gcagcuccagaaggaguggcugacacagcagccagaacacagcagagagaaaguggggacacggagaaagaa

SEQ ID NO: 30213 - RNA, 45 nt, Mus musculus
cacuaagucuccgggugagguauguguucugcacagcccccauca

SEQ ID NO: 30214 - RNA, 46 nt, Mus musculus
uuuacuccaggcuguccaaugacuucauucuauuucacccccagga

SEQ ID NO: 30215 - RNA, 42 nt, Mus musculus
ccuucuuguacuuagcugugggcauugcuuaauacugcagua

SEQ ID NO: 30216 - RNA, 42 nt, Mus musculus
agcuggggaaaccaugacaugaaagcucuccuugggccagag

SEQ ID NO: 30217 - RNA, 46 nt, Mus musculus
uaaagaggggcagguuaccacaaugcaccgagacgaccuggcuuua

SEQ ID NO: 30218 - RNA, 45 nt, Mus musculus
agcauaaggagaauuauuuuuuacucccuuauaaagcccagcauc

SEQ ID NO: 30219 - RNA, 68 nt, Mus musculus
guagccacagaugcaauuggcaugggacuuaauuuguaaguaauuuguuugugauaagcaguggguug

SEQ ID NO: 30220 - RNA, 45 nt, Mus musculus
aaugacauuuauucugugagccgacagauugaaauucggggacug

SEQ ID NO: 30221 - RNA, 74 nt, Mus musculus
uguacguugcuuuucucauugcuauugcaagguagacgaaguagcuuguggagggaaggaaggcgugacgguag

SEQ ID NO: 30222 - RNA, 44 nt, Mus musculus
uuuaucuuguguuggagcuuuuggaauuuaucaauugucagauc

SEQ ID NO: 30223 - RNA, 65 nt, Mus musculus
caagcuuuugucuucuugaaacccuuuugugaacuuacuuauuuguggugcugggaauggagcua

SEQ ID NO: 30224 - RNA, 43 nt, Mus musculus
uguguguguguguguguguguauuugagcuucaugugggagau

SEQ ID NO: 30225 - RNA, 45 nt, Mus musculus
aguacauaaugaacaaaguacugcauguguaugcagcuggcagaa

SEQ ID NO: 30226 - RNA, 23 nt, Mus musculus
ggcugacuuugaccucugggucc

SEQ ID NO: 30227 - RNA, 46 nt, Mus musculus
ucugggccucauuuuacuuuccugucaauaaacucagccccaauac

SEQ ID NO: 30228 - RNA, 45 nt, Mus musculus
auuucuucagauuuaucuaacguauacaacagaguagcuagcugu

SEQ ID NO: 30229 - RNA, 48 nt, Mus musculus
cguggugcaugucuauaaucccagaacuuuggaauuggacgaucggga

SEQ ID NO: 30230 - RNA, 50 nt, Mus musculus
cuggguuaacuaacgccauuagugcugaaaugugcagagagaaacugaaa

SEQ ID NO: 30231 - RNA, 49 nt, Mus musculus
aagccuugcauuccugacugaguaccccaguauaccauaccgcugaugu

SEQ ID NO: 30232 - RNA, 46 nt, Mus musculus
guguucuguuugcacuacaugcaugaaaugccugcagaggccagag

SEQ ID NO: 30233 - RNA, 58 nt, Mus musculus
ugagagccggagggaggaugauagaguugaggggaggagaaggaagaagagguggagg

SEQ ID NO: 30234 - RNA, 23 nt, Mus musculus
cguucccugcuuggccgccuccu

SEQ ID NO: 30235 - RNA, 45 nt, Mus musculus
cuuuagaauauguguguguguguuuguaugugugugugagugagu

SEQ ID NO: 30236 - RNA, 46 nt, Mus musculus
ccagcaaccacaugguggcucacaaccaucuguaaagugaucagau

SEQ ID NO: 30237 - RNA, 45 nt, Mus musculus
aauuuauguaucuuugugugugugugugugugugugugugugugu

SEQ ID NO: 30238 - RNA, 46 nt, Mus musculus
uaacguacauuuggaguuugugugugucugugugagggugucagau

SEQ ID NO: 30239 - RNA, 46 nt, Mus musculus
uacagagaaacccugucuugaaaaaaaaaaaaaguaaguaaguaac

SEQ ID NO: 30240 - RNA, 46 nt, Mus musculus
ugaagccacuccccuccccuauagcaaaugaggcccagccccacag

SEQ ID NO: 30241 - RNA, 46 nt, Mus musculus
aauuuauuguugauuacugugaaacucaccccgaggcugcccagga

SEQ ID NO: 30242 - RNA, 29 nt, Mus musculus
gucuguauggcaaaaucaucacugcagau

SEQ ID NO: 30243 - RNA, 66 nt, Mus musculus
aaggucgccauugcugacaagcucagggaccccgacucacacauugucaaaaaaauaaauagccug

SEQ ID NO: 30244 - RNA, 61 nt, Mus musculus
cuguucaaggugcucucguucuuugaggcugacauggagagacggugcaagaugcacaagc

SEQ ID NO: 30245 - RNA, 46 nt, Mus musculus
cucacaaccaucuguacagcuacaguguacacauauacaaucaauc

SEQ ID NO: 30246 - RNA, 46 nt, Mus musculus
gcauuacaauacauaucaacacuggccccugugucagccugcagau

SEQ ID NO: 30247 - RNA, 46 nt, Mus musculus
acacgcauaugcgugcugcacaauaugaacaauuuaaaagaaccag

SEQ ID NO: 30248 - RNA, 58 nt, Mus musculus
aucagguagacagagucgacagggaagucggucaggaagucggcaagaugguagaaga

SEQ ID NO: 30249 - RNA, 45 nt, Mus musculus
gaucugaggguuucucuauacuugaucuuagccugaugacugaga

SEQ ID NO: 30250 - RNA, 24 nt, Mus musculus
aaggacuaauuuuuaagagaaaug

SEQ ID NO: 30251 - RNA, 41 nt, Mus musculus
gugaccaugacucuggagagcccagaagaaauacaggaugu

SEQ ID NO: 30252 - RNA, 45 nt, Mus musculus
ucacagauuuguuacuuuaacugggauauaagugggguugaggua

SEQ ID NO: 30253 - RNA, 46 nt, Mus musculus
aaagacuguuaggucaaauacagagguagguguugaaaggcuagua

SEQ ID NO: 30254 - RNA, 74 nt, Mus musculus
gcuggccggacaggaauuuguguauguuuuuaucaaccaagggaaagaggucaacugagauauguggagcagaa

SEQ ID NO: 30255 - RNA, 46 nt, Mus musculus
cauugcacagucacaaagagaaauuaccuugaaaggcuucagagaa

SEQ ID NO: 30256 - RNA, 46 nt, Mus musculus
agcacaugcaugcaguaacaacagaagccagaagugagcauagaua

SEQ ID NO: 30257 - RNA, 46 nt, Mus musculus
guuugcaguguuagggaucuaacccagaacuaaauuuaugccaggc

SEQ ID NO: 30258 - RNA, 45 nt, Mus musculus
gugacagucugaagaguugucucaaaagcaguaauacauccaaaa

SEQ ID NO: 30259 - RNA, 42 nt, Mus musculus
ggggaaaaaaaaaaggauuuugaaaccgaggaacagcuagaa

SEQ ID NO: 30260 - RNA, 88 nt, Mus musculus
uugcccacaguggguauacaaaguugcaaaaaaauacaugaaauccagauacgaacagguugaccuuguuggaaaaaugacucaaaaa

SEQ ID NO: 30261 - RNA, 45 nt, Mus musculus
augggacauuaagaaaacauuugaauucuuuuuguuuguuuaaga

SEQ ID NO: 30262 - RNA, 45 nt, Mus musculus
gaucuuucaaagcuacgccauguugugcuugaugaaguagaucaa

SEQ ID NO: 30263 - RNA, 46 nt, Mus musculus
uuguuugucucucugucuguagauacauaacuauuuuaggggagua

SEQ ID NO: 30264 - RNA, 46 nt, Mus musculus
uucugaaagguacugaguuucgugucuugaaaaucugcugcugacu

SEQ ID NO: 30265 - RNA, 46 nt, Mus musculus
uguguguauauguaaacauauacacacacauauauauaggccagua

SEQ ID NO: 30266 - RNA, 45 nt, Mus musculus
guauuggugaguaccuaacaugggaacuucaaauuaaacucaggu

SEQ ID NO: 30267 - RNA, 46 nt, Mus musculus
cuguuggcuguuguuauuauuagugugugugugugugugugugaga

SEQ ID NO: 30268 - RNA, 45 nt, Mus musculus
agaaggaagucaaggcaccauucugaaucagaggagagaacagaa

SEQ ID NO: 30269 - RNA, 57 nt, Mus musculus
gguaaggagaaggaaacacuaaagaagguugagagcuaagagauaaggagaugaaca

SEQ ID NO: 30270 - RNA, 45 nt, Mus musculus
aaaaaaugcagagguaaaauuuuuacuggagacauuugaccugga

SEQ ID NO: 30271 - RNA, 46 nt, Mus musculus
guucuauccccaccuccguccaagacauuaagaaagaaagaaagaa

SEQ ID NO: 30272 - RNA, 42 nt, Mus musculus
ccuccaugauuggguaauagaggcuuaaggaacagugucaaa

SEQ ID NO: 30273 - RNA, 46 nt, Mus musculus
uugagacagagaugaugauggcuuugccuauguguugccucccggu

SEQ ID NO: 30274 - RNA, 38 nt, Mus musculus
cgaggcacccuuggaagaguccgagagccagaggaagg

SEQ ID NO: 30275 - RNA, 46 nt, Mus musculus
aguacuugaauaccugugaguuggaauugcauguuacuugaaagau

SEQ ID NO: 30276 - RNA, 46 nt, Mus musculus
ugagucgucuugccaacaucaguuugugcugugauaaaacggcuga

SEQ ID NO: 30277 - RNA, 48 nt, Mus musculus
ugcuuugcugguagccauaucaaucuuuggagcaaguauccuagaguu

SEQ ID NO: 30278 - RNA, 45 nt, Mus musculus
gacugcagguguaaaccucuccauucagugauaauaagcagagag

SEQ ID NO: 30279 - RNA, 42 nt, Mus musculus
uguaguugccugcauguaugugugugccuuguguguugucua

SEQ ID NO: 30280 - RNA, 46 nt, Mus musculus
aaccugcaaggcaguuuuagucacuggaucuuauaugcagacagag

SEQ ID NO: 30281 - RNA, 29 nt, Mus musculus
ugguucaaucccagcaccagagaaacuaa

SEQ ID NO: 30282 - RNA, 46 nt, Mus musculus
aacauccuuagccauaguucaaaacugugcuauacgccaccaugag

SEQ ID NO: 30283 - RNA, 45 nt, Mus musculus
aauacuagguuccagagggaauggcagagacaaggauugccuucu

SEQ ID NO: 30284 - RNA, 46 nt, Mus musculus
aaugauuucuagauaaggucugaaaccucaaagguuaacucaugag

SEQ ID NO: 30285 - RNA, 45 nt, Mus musculus
gauccacauguguauggaucccaagagcauccagcucccugugca

SEQ ID NO: 30286 - RNA, 42 nt, Mus musculus
ucuguguggagucuugaggauaguucauaagcauggccacag

SEQ ID NO: 30287 - RNA, 42 nt, Mus musculus
agucaggugcccuuacccacugagccaucucaccagccccgg

SEQ ID NO: 30288 - RNA, 46 nt, Mus musculus
ugagaucaaaggugggagccaacaugcuuggccugauuacaugguu

SEQ ID NO: 30289 - RNA, 51 nt, Mus musculus
ucaugccuacgaggugggagacgagguugguaaggagguaagguuucaaag

SEQ ID NO: 30290 - RNA, 46 nt, Mus musculus
auuucauguucccagugaguucuaugaguaccaugcacugaugaug

SEQ ID NO: 30291 - RNA, 46 nt, Mus musculus
gguuggggugauugacuucuccauguacuuaaagaaugaagaagag

SEQ ID NO: 30292 - RNA, 41 nt, Mus musculus
ggguuguacuuuccuugucgcuauuugcgaaugggcgagcc

SEQ ID NO: 30293 - RNA, 59 nt, Mus musculus
ccuaucauaggaacguucaaaucgccgccaucuuagaccaaaagaauuauguugaagag

SEQ ID NO: 30294 - RNA, 46 nt, Mus musculus
ccuccauucaagaguggacucguuagaaaagucaaacacuaagcug

SEQ ID NO: 30295 - RNA, 41 nt, Mus musculus
acauacagugagucugacaagugcaccguuucucacaagca

SEQ ID NO: 30296 - RNA, 65 nt, Mus musculus
ucucgauguuuuuaccuuuuuuucuuuuaaaugggggagguugcaagggaagaggguacauacua

SEQ ID NO: 30297 - RNA, 45 nt, Mus musculus
acaagucugugagacauuucuuuuucucaaauuaaugaucagugu

SEQ ID NO: 30298 - RNA, 45 nt, Mus musculus
gaaaaaaaugaaauaauugcccgacuagaagaaaagaccaauaag

SEQ ID NO: 30299 - RNA, 44 nt, Mus musculus
uggcucacaaccaucuguauugaaaucugacucccucuucugga

SEQ ID NO: 30300 - RNA, 46 nt, Mus musculus
ucucguuagcuuuuauaaaugauuugggggcggaggggauggcugu

SEQ ID NO: 30301 - RNA, 45 nt, Mus musculus
agcugaauuuugaaaauguccagggcuuucagacuauugacagag

SEQ ID NO: 30302 - RNA, 45 nt, Mus musculus
gaguacacuguagcugucuucaaacacaccagaagagagcaucag

SEQ ID NO: 30303 - RNA, 42 nt, Mus musculus
ugcuuccaucccaggucuguguagucuucauugucugguaag

SEQ ID NO: 30304 - RNA, 41 nt, Mus musculus
accaaugauuuaaucccuuccuuuccuuuuuacuugcccac

SEQ ID NO: 30305 - RNA, 42 nt, Mus musculus
uuauuuuuucaagcgggggugugugugggagacacggagcau

SEQ ID NO: 30306 - RNA, 45 nt, Mus musculus
acauuaauaacauaucuagcaaaaaacaaguaacucaauaacuga

SEQ ID NO: 30307 - RNA, 46 nt, Mus musculus
aaaagauggguggaaaagguaagaggauuagagaaaggaaugcuag

SEQ ID NO: 30308 - RNA, 46 nt, Mus musculus
gcugcgagcauuugaaggccucguucaauacccaagcacucagaga

SEQ ID NO: 30309 - RNA, 58 nt, Mus musculus
ggaaaguuucacgggcgagccgggcagcagaggcagcggagcugcggucggggacguc

SEQ ID NO: 30310 - RNA, 44 nt, Mus musculus
cguccccgaccgcagcuccgcugccucugcugcccggcucgccc

SEQ ID NO: 30311 - RNA, 66 nt, Mus musculus
ggaggagccgugguaaucgccgcggccggcugaaggaggaaggucuugggagcuggagagccgccc

SEQ ID NO: 30312 - RNA, 46 nt, Mus musculus
ucuggaacuuucgaguuuuggugucccaaacuuuuucugauaggag

SEQ ID NO: 30313 - RNA, 41 nt, Mus musculus
ccucccaguuuccaguguuucagaagggacuuuuguauuga

SEQ ID NO: 30314 - RNA, 47 nt, Mus musculus
acaacuagguuugggaggaauugaugaagaaauuguacuagagccca

SEQ ID NO: 30315 - RNA, 45 nt, Mus musculus
auguggauguaaugaucuaggacagcuaggucaugaaaaguccag

SEQ ID NO: 30316 - RNA, 44 nt, Mus musculus
auuguguguguguguguguguguguguguguguggugugggggg

SEQ ID NO: 30317 - RNA, 44 nt, Mus musculus
uagcuuuuaaaggguugugaaugccaggucugacuauggagaga

SEQ ID NO: 30318 - RNA, 44 nt, Mus musculus
agaaucucuuaauuauaccagauuuucauaaucucgggcacuga

SEQ ID NO: 30319 - RNA, 46 nt, Mus musculus
cccaccuccacguguaccaguaggaaguauaacuuaaaccgcaggg

SEQ ID NO: 30320 - RNA, 56 nt, Mus musculus
gauugacucguugguguccaggacguagcaaacagucccuagaaaaggaaaaagga

SEQ ID NO: 30321 - RNA, 41 nt, Mus musculus
aggaguuggccuugcuguuuaguaguucggaccuguaaccu

SEQ ID NO: 30322 - RNA, 45 nt, Mus musculus
gaggcucgcacacugccugcuguuagucauuagucaucccggcga

SEQ ID NO: 30323 - RNA, 45 nt, Mus musculus
ucaggaugucagacaugcuuugagcacuaugagaaucagugccca

SEQ ID NO: 30324 - RNA, 47 nt, Mus musculus
aaauugcaagaauuauccucaucuuaggggauaaguuuucggagaaa

SEQ ID NO: 30325 - RNA, 46 nt, Mus musculus
ucugacuguggcuugucccuccugcaagccuguguguccgcacuac

SEQ ID NO: 30326 - RNA, 46 nt, Mus musculus
aaaccaccuccuuugguaugcaugucauacccaaacauacauguag

SEQ ID NO: 30327 - RNA, 98 nt, Mus musculus
ugcuagaaccuugugaaacagugugguuuacaggggugcguagcagaggugaguaggaaagauagauauucagugcucuuagagcagagagugggaag

SEQ ID NO: 30328 - RNA, 41 nt, Mus musculus
ugggaagcaugguggcaugcaggcagacauggugcugggga

SEQ ID NO: 30329 - RNA, 46 nt, Mus musculus
ucauucaucuguucauauaugauguucauuauauuguacccagaag

SEQ ID NO: 30330 - RNA, 48 nt, Mus musculus
cugucccuccugacauuaauaguuuuuaaugguauucacugauuuuau

SEQ ID NO: 30331 - RNA, 46 nt, Mus musculus
agauggacagccuuuguuaacuuacuggaugugaauugugucucag

SEQ ID NO: 30332 - RNA, 84 nt, Mus musculus
gugugagcacuguuaacuauuugaagagagaagauccggugagguagauuuuauugugaaugugagagcaguauucaguggaca

SEQ ID NO: 30333 - RNA, 46 nt, Mus musculus
uuucugauccaagcauuugcuaguuauuuccuaacuuuaacaacag

SEQ ID NO: 30334 - RNA, 45 nt, Mus musculus
auauguuuacacauauacucaggugagcaguugaguaagucugca

SEQ ID NO: 30335 - RNA, 86 nt, Mus musculus
auuuauucaaccaccguaauuguagugcuauguaguugaggucugguauggaagacaucuaauauacuaggaaagaaauaacgagg

SEQ ID NO: 30336 - RNA, 46 nt, Mus musculus
auagauguauucaaacagguacucaguaguuacuguaggugcagag

SEQ ID NO: 30337 - RNA, 47 nt, Mus musculus
ucaagugagaacacaugcagugcuuggcauguggugagggaguauuc

SEQ ID NO: 30338 - RNA, 45 nt, Mus musculus
aauggaugggguuccuucaccuucagauguaaaaggugacuuggg

SEQ ID NO: 30339 - RNA, 46 nt, Mus musculus
uugguggagacaagugugcaugugcagguuuacauggagaggucag

SEQ ID NO: 30340 - RNA, 45 nt, Mus musculus
gguuuuuaaacauagcugaacugaaaugaugaacugaccuguaag

SEQ ID NO: 30341 - RNA, 46 nt, Mus musculus
gaccucacaccugagauugaucuugggcuccuuuccuugucacagg

SEQ ID NO: 30342 - RNA, 44 nt, Mus musculus
guuuuguauauuauaaaauucaguuguuuaguaauuaagggagg

SEQ ID NO: 30343 - RNA, 45 nt, Mus musculus
aucugguaguguuuuuaagugaaaauggaauucuguaugugguac

SEQ ID NO: 30344 - RNA, 46 nt, Mus musculus
gaacccucccuccauuggagaaaauggacuuucccuuucacugcag

SEQ ID NO: 30345 - RNA, 45 nt, Mus musculus
guucguuagccucucaaguguucaacauguagcauuugccaccac

SEQ ID NO: 30346 - RNA, 69 nt, Mus musculus
uauuuuaucuuuuacuuuuuucuuugaccuuuuaguuguucaggaguauguuggucuaaauacccccag

SEQ ID NO: 30347 - RNA, 46 nt, Mus musculus
uuucuacuuucaugcuguuugugaucaaaaauaacacuuugguaag

SEQ ID NO: 30348 - RNA, 46 nt, Mus musculus
auaaugacguuuagucuuguaagagauuugauuuaaagguguuuuu

SEQ ID NO: 30349 - RNA, 46 nt, Mus musculus
ccuauuucuucuauuucucucagacuucacuuuuguauuucagcag

SEQ ID NO: 30350 - RNA, 46 nt, Mus musculus
gggcugguuaugcacaccuguaauccuagcgcuugggaagugggag

SEQ ID NO: 30351 - RNA, 46 nt, Mus musculus
auaaacuuaauuuuaaaugucauguuaaaaaguuguaugcugguaa

SEQ ID NO: 30352 - RNA, 42 nt, Mus musculus
guuugaauuguaauuauagugcugaaauucccauagcccagu

SEQ ID NO: 30353 - RNA, 45 nt, Mus musculus
acagcuuggccuacagggaucagaggaauguaucagaguacccag

SEQ ID NO: 30354 - RNA, 46 nt, Mus musculus
gcauguauguguauaugugggugugcauaugcagcagugucaugug

SEQ ID NO: 30355 - RNA, 45 nt, Mus musculus
aaauaaacugccagguuuuacacuaaaaauuaagaaaagucuuag

SEQ ID NO: 30356 - RNA, 52 nt, Mus musculus
augaugaaaggaaauaagaaggaugcuaaaacagaucuauuuaccagaaaga

SEQ ID NO: 30357 - RNA, 96 nt, Mus musculus
acaucccggguaucugaccucugcuggugaagggcaacgcggggaggagagcccugaggauuggcaaugggguggaagccauauucagucugggca

SEQ ID NO: 30358 - RNA, 48 nt, Mus musculus
guuucuuaguuuagauuugcauaugcugauagcugaagccuugagauu

SEQ ID NO: 30359 - RNA, 46 nt, Mus musculus
cagcugauuaagucuuugcuuggaauaccauucaugcaagucgcag

SEQ ID NO: 30360 - RNA, 42 nt, Mus musculus
uuaguuuaacauuuuaauguguuugggaggauccugggaagg

SEQ ID NO: 30361 - RNA, 46 nt, Mus musculus
aaaauaaacauuuuaauuuuaaacaacuauuugaaacaagucacaa

SEQ ID NO: 30362 - RNA, 45 nt, Mus musculus
aagucacuaagaucucagaaaauaguuuauauuuguugcggagaa

SEQ ID NO: 30363 - RNA, 28 nt, Mus musculus
ucuuguuuuucuguucucuccccuccac

SEQ ID NO: 30364 - RNA, 45 nt, Mus musculus
caccaguaacuacagugaaggcaggacaguauaaaugggaggcag

SEQ ID NO: 30365 - RNA, 46 nt, Mus musculus
gguucugaagacuauuucugugucaaaagaauuuucucagguggag

SEQ ID NO: 30366 - RNA, 42 nt, Mus musculus
ggaccuccagaugacuuuagaugcuccgacccuuccaagcag

SEQ ID NO: 30367 - RNA, 41 nt, Mus musculus
caggcaaggcuacauagugagacuuugauagauagguggau

SEQ ID NO: 30368 - RNA, 46 nt, Mus musculus
uccugcaccaggcacuuuaucaacugagccaacuuggcugcugaag

SEQ ID NO: 30369 - RNA, 46 nt, Mus musculus
uauagaacagguaccagauuuucagggguugauaugaacgcugcua

SEQ ID NO: 30370 - RNA, 42 nt, Mus musculus
ugauuugggucuguuaauagcuuuauuuagccauugugauag

SEQ ID NO: 30371 - RNA, 45 nt, Mus musculus
ccuaccugauguugaagcucugagguuuuaucuuacccugccaga

SEQ ID NO: 30372 - RNA, 46 nt, Mus musculus
uuuucucccuuguugccuugagugauuuugcuguuaaagaacuaag

SEQ ID NO: 30373 - RNA, 45 nt, Mus musculus
agcugcauuauuaccucucuaguuuugauuucccagagugcuuca

SEQ ID NO: 30374 - RNA, 46 nt, Mus musculus
uagaacuuuuuaaggaaguugugguacaucuuuugaaacucuacaa

SEQ ID NO: 30375 - RNA, 41 nt, Mus musculus
gauagcaguuucuuuccaagaaaacaggucauuccccagaa

SEQ ID NO: 30376 - RNA, 46 nt, Mus musculus
cucucugccucucugccuuuguguauacuuuugccuaggacucaag

SEQ ID NO: 30377 - RNA, 45 nt, Mus musculus
cugugccagaugcuaggauuggccuccuuguuaguucaagguuga

SEQ ID NO: 30378 - RNA, 82 nt, Mus musculus
uaaauucuguagagugcauuaugucuauuaucucaaauggguuuuguaugguguguguguguguguguguguguggugugug

SEQ ID NO: 30379 - RNA, 46 nt, Mus musculus
agugggauagguaauauuucacacuuuauaucuguuuuuuaaguag

SEQ ID NO: 30380 - RNA, 46 nt, Mus musculus
uaacaauagcuguucauugcacuucauccuuuuaaagaugcaacag

SEQ ID NO: 30381 - RNA, 45 nt, Mus musculus
gggccuucaugauugugcuuguccauccucuguguucuccgcaaa

SEQ ID NO: 30382 - RNA, 42 nt, Mus musculus
gguugcccagugguuaagaacacuuaauugcagguuggcgag

SEQ ID NO: 30383 - RNA, 46 nt, Mus musculus
aaaacaggacaacuuauucaauaugacaaguuuuacauccaugaag

SEQ ID NO: 30384 - RNA, 42 nt, Mus musculus
uaaauguacaugacacugaguacacacuauugcacgaaacug

SEQ ID NO: 30385 - RNA, 46 nt, Mus musculus
gaugccugcugaggucagaagauggccuuggauucucagggacuag

SEQ ID NO: 30386 - RNA, 46 nt, Mus musculus
cccuuucuuuuucccucuuuuccucccucccuuccuuaugcaccaa

SEQ ID NO: 30387 - RNA, 47 nt, Mus musculus
cacaaaacugggcaugcugacagaggucuacaaccccaggaaguagg

SEQ ID NO: 30388 - RNA, 47 nt, Mus musculus
auacaaugagacccuguuuaaaaaaaaaaccaaacaaacaaaaaaua

SEQ ID NO: 30389 - RNA, 46 nt, Mus musculus
ucagccauggaguaacugagguaagucuggggacauacaguuucag

SEQ ID NO: 30390 - RNA, 46 nt, Mus musculus
guuacuuugaaauaccuguucuugucucccaauguaaaauacagua

SEQ ID NO: 30391 - RNA, 45 nt, Mus musculus
gguggucuuuugcuuuguuuuggcuuauugaguaugauuuuccca

SEQ ID NO: 30392 - RNA, 46 nt, Mus musculus
cauauaaaacuaugaacggauggggcuaguaucagacacagcucag

SEQ ID NO: 30393 - RNA, 46 nt, Mus musculus
auuaggaggguugaaaccacugagcuaaacauauccauaguaauga

SEQ ID NO: 30394 - RNA, 46 nt, Mus musculus
ucaaaucccagccaccacaugguggcucacaaccauccauaaugag

SEQ ID NO: 30395 - RNA, 46 nt, Mus musculus
uaauaaauaaauaaaucuugaaaaaaaaagaaaaaaagaaaugaag

SEQ ID NO: 30396 - RNA, 46 nt, Mus musculus
uguccucugaccuccaugcacgcguauggcauguaugcacucacag

SEQ ID NO: 30397 - RNA, 42 nt, Mus musculus
uaaguauuugaaacacuggugauaauacuaauguggggacgc

SEQ ID NO: 30398 - RNA, 46 nt, Mus musculus
auucucuguuuugcuuauguguauguacaguauguacaagccagag

SEQ ID NO: 30399 - RNA, 46 nt, Mus musculus
gucauauaaauuauaucuuuaacuuuugaaauuauagguugcugag

SEQ ID NO: 30400 - RNA, 28 nt, Mus musculus
gcauguuucgauauuaugaagauuccag

SEQ ID NO: 30401 - RNA, 45 nt, Mus musculus
ccaaaauggucaagacuuuaaaauacagccaaacaauagcaccaa

SEQ ID NO: 30402 - RNA, 72 nt, Mus musculus
uguggauuagcaauuuauaauuuuaccauuguggaccuccauuucccuuuggcuuuauauaagaaacugcug

SEQ ID NO: 30403 - RNA, 46 nt, Mus musculus
ucgugaaaucgccuauaaguaaaggaacaaaacaaacaugagaaau

SEQ ID NO: 30404 - RNA, 46 nt, Mus musculus
gguuugguuuauuuuuaaugaaggaauuagcuaugguuuaguguag

SEQ ID NO: 30405 - RNA, 48 nt, Mus musculus
uacaagcuaugguuauugggaauacaaauuaugauuggaaagaacugg

SEQ ID NO: 30406 - RNA, 50 nt, Mus musculus
aaaagguuguauuacuuuuagaauacagaauacaaaggagaguauugggc

SEQ ID NO: 30407 - RNA, 49 nt, Mus musculus
guuauuaagauuuuuauuuacauguauguuguaucugugccgaguauaa

SEQ ID NO: 30408 - RNA, 53 nt, Mus musculus
agugaugucugcaguugccugagauccugugucaaagaaacagcguuggagaa

SEQ ID NO: 30409 - RNA, 56 nt, Mus musculus
ugcaaaacuagacuguguugucuaaauuguuuuccuuggcaguauuuuugacaggu

SEQ ID NO: 30410 - RNA, 46 nt, Mus musculus
uuccauuuuguaaauaaaaauuuuguaauaaaauagugacauucag

SEQ ID NO: 30411 - RNA, 42 nt, Mus musculus
gcauaaacaauaagcuuagcugggugggaucuugccccaagg

SEQ ID NO: 30412 - RNA, 41 nt, Mus musculus
uggaauuugccaaaagacccucacucacaaagaccaccgag

SEQ ID NO: 30413 - RNA, 45 nt, Mus musculus
ucucuuaacuguaauccccuauaaaaucaaaaucaaaaagcagac

SEQ ID NO: 30414 - RNA, 46 nt, Mus musculus
guauguuguuuuuguuuuuaaaguucccuuuauauagcccccagcu

SEQ ID NO: 30415 - RNA, 42 nt, Mus musculus
uuauuaaaaauauuacuauugggcuggaaagauggcucagcg

SEQ ID NO: 30416 - RNA, 45 nt, Mus musculus
cguggcccagagggcugacuaauuggaauuaggagcagcgaagau

SEQ ID NO: 30417 - RNA, 46 nt, Mus musculus
aagaucgagacggaacucaagaacaagaugcaacagaagucgcaga

SEQ ID NO: 30418 - RNA, 36 nt, Mus musculus
gaaaaacacaagaugggacugcuuaacacaggugga

SEQ ID NO: 30419 - RNA, 48 nt, Mus musculus
ugaaccauuaauaaagcguggguggaacccagagagaagcaagccaga

SEQ ID NO: 30420 - RNA, 46 nt, Mus musculus
uccuucucuccuuucuuuacaaugaccaaguugagaacacugagau

SEQ ID NO: 30421 - RNA, 46 nt, Mus musculus
auguuacuguaccgcgaugguuggggaaaucaaaaucuguuaaggu

SEQ ID NO: 30422 - RNA, 45 nt, Mus musculus
acagagagagacagagagagacagggagagacagggagagacggg

SEQ ID NO: 30423 - RNA, 45 nt, Mus musculus
gaagggaauaaaggcagagaaagagagggacagaaagagagggag

SEQ ID NO: 30424 - RNA, 41 nt, Mus musculus
ggauauguuuuguaaaacaugguauugugcugucgggguga

SEQ ID NO: 30425 - RNA, 46 nt, Mus musculus
auucuggggaugauuuauggauggaaaaaaagagaaagaaauggga

SEQ ID NO: 30426 - RNA, 45 nt, Mus musculus
gagagagcagagaaguagaggccggccaugaccacagggagagag

SEQ ID NO: 30427 - RNA, 28 nt, Mus musculus
caugagcacacacagguuagaguacaua

SEQ ID NO: 30428 - RNA, 25 nt, Mus musculus
cuaggaaaugaacuuuggucuuugg

SEQ ID NO: 30429 - RNA, 46 nt, Mus musculus
gaacagcuggggugcacaggauaacauagggagugacaggagcuag

SEQ ID NO: 30430 - RNA, 42 nt, Mus musculus
cagucccuuuucuucugauucggaugaggcccacccacauua

SEQ ID NO: 30431 - RNA, 46 nt, Mus musculus
gaucugacucccucuucuggugugucuucagagacagcuacagugu

SEQ ID NO: 30432 - RNA, 46 nt, Mus musculus
aaggaaaggaaaggaaaggaaaggaaaggaaaggaaaaaucccuua

SEQ ID NO: 30433 - RNA, 46 nt, Mus musculus
gauagauagauagauagauauuagauagauagauagauagauagau

SEQ ID NO: 30434 - RNA, 46 nt, Mus musculus
gugucuacaccuugcccuucccaagaugaauaaaccgcuaacagau

SEQ ID NO: 30435 - RNA, 46 nt, Mus musculus
ugguugguugguugauugguugguugcuuugauggcugguugacug

SEQ ID NO: 30436 - RNA, 46 nt, Mus musculus
ugcuacacacacccaucacaucacaagcuacaugucugugggaguu

SEQ ID NO: 30437 - RNA, 46 nt, Mus musculus
cugacuguccuggaacucacuauguagacuaggcuagccucgaacu

SEQ ID NO: 30438 - RNA, 46 nt, Mus musculus
ggacagccagggcuacauacugagauccuuugaaaaaaagagagag

SEQ ID NO: 30439 - RNA, 46 nt, Mus musculus
acacugcagucacagacagcugcuaacaucucugcuguggccagug

SEQ ID NO: 30440 - RNA, 30 nt, Mus musculus
guuaucgguaaccagccauacugagucacg

SEQ ID NO: 30441 - RNA, 41 nt, Mus musculus
auguuaguugcugcccaaggaggucagaagaggguaucaga

SEQ ID NO: 30442 - RNA, 46 nt, Mus musculus
ucugagaagugaaugcucucuggucaagagaaaacaaauaugagaa

SEQ ID NO: 30443 - RNA, 49 nt, Mus musculus
uaaaagccaugaauuauugaaagaggauucacaggaagagaaaggcacg

SEQ ID NO: 30444 - RNA, 45 nt, Mus musculus
uagcaaucacaacugauaaguuucugugccugagcaguagcagcu

SEQ ID NO: 30445 - RNA, 45 nt, Mus musculus
gcuacacagagaaacccugucucgaaaaaaaaaaaaaacaacaac

SEQ ID NO: 30446 - RNA, 42 nt, Mus musculus
gaaugguagcucucaacuggacauaguuuguggccccaccaa

SEQ ID NO: 30447 - RNA, 46 nt, Mus musculus
acuuacugaggcagacauuucaaauucaaguaaauuggaaccaaac

SEQ ID NO: 30448 - RNA, 46 nt, Mus musculus
ucuguaguuaaugacucaaaaucaucucuccaccucccaggcagga

SEQ ID NO: 30449 - RNA, 46 nt, Mus musculus
ggugaaggauuuaacuaacaacugugaucuugcugugcugagaaac

SEQ ID NO: 30450 - RNA, 46 nt, Mus musculus
gugugugugugucugugugugugugucugugugugugucuggugug

SEQ ID NO: 30451 - RNA, 44 nt, Mus musculus
auaacugauuuuagugugugguguguggggaaaaagaaaaaaga

SEQ ID NO: 30452 - RNA, 25 nt, Mus musculus
agccgccgucacugcagcagugaag

SEQ ID NO: 30453 - RNA, 46 nt, Mus musculus
gaaaggauuuccaugguagaagcuuaaagcaagagguuggggggau

SEQ ID NO: 30454 - RNA, 46 nt, Mus musculus
ccugagugcugagauuaaaugcagggcuugucacaccuggccagac

SEQ ID NO: 30455 - RNA, 61 nt, Mus musculus
agagagagauacagagauagauacagagauugauacauggcuugauagaugauacauagau

SEQ ID NO: 30456 - RNA, 53 nt, Mus musculus
uaucuuuucuuuaccugggcuacuaaugcaaauggaugcagagagagaaagag

SEQ ID NO: 30457 - RNA, 45 nt, Mus musculus
caagucauaguccgcugcuguagacagucugaaguaaccccagau

SEQ ID NO: 30458 - RNA, 46 nt, Mus musculus
aacaaauaaaaaaaccugaaccuacuugaaaauguaucugcuagua

SEQ ID NO: 30459 - RNA, 46 nt, Mus musculus
uggugacagggggacauggggauuuauucuguucagugccagagag

SEQ ID NO: 30460 - RNA, 45 nt, Mus musculus
cggaggcccugaagacaguucuccgugucuccaucacugccaguc

SEQ ID NO: 30461 - RNA, 46 nt, Mus musculus
cagcucuguucagaacccauacccuccccaccagaagaaaacagau

SEQ ID NO: 30462 - RNA, 46 nt, Mus musculus
uuuaccauuacuguuguaaaaauacaauggaaaugagccccuagua

SEQ ID NO: 30463 - RNA, 42 nt, Mus musculus
ggaagccugggcucccaauguaagauaauaaugggggcagag

SEQ ID NO: 30464 - RNA, 46 nt, Mus musculus
cuggaggcauagugagagucugggauggagcagaugguuuguauga

SEQ ID NO: 30465 - RNA, 46 nt, Mus musculus
cugggaaaguguccauuaaauccuaggaacccaccugcccccaccu

SEQ ID NO: 30466 - RNA, 46 nt, Mus musculus
agauaccuguaauucuuacacuugggagauggagguucggcaagcu

SEQ ID NO: 30467 - RNA, 46 nt, Mus musculus
ggaaagcaucuuuguuuucaaagauguauaaguugugagcugagac

SEQ ID NO: 30468 - RNA, 42 nt, Mus musculus
uccaucgcuggacuguaacaaguguauuguguuccacuugac

SEQ ID NO: 30469 - RNA, 42 nt, Mus musculus
auauggcuugccuuaccaggcucugcuucauuggcguaaucg

SEQ ID NO: 30470 - RNA, 46 nt, Mus musculus
uuugagaggaguguggcugucaucaugaagagagauuguucuagcc

SEQ ID NO: 30471 - RNA, 46 nt, Mus musculus
uaccuggucuacagauuuuucaggacagccaggacugcacggagaa

SEQ ID NO: 30472 - RNA, 45 nt, Mus musculus
acaaaacagccagggauacacagagaaacccugucuagaaaaaga

SEQ ID NO: 30473 - RNA, 41 nt, Mus musculus
agaaguuacauguagauucucugcacaaacuaacaaugaau

SEQ ID NO: 30474 - RNA, 45 nt, Mus musculus
aaaaaaaaaaaaaaaaggaaggaaggaaggaaggaaggaaagaaa

SEQ ID NO: 30475 - RNA, 45 nt, Mus musculus
caucggcgcgcgcgcgcacacacacacacacacacacacacacag

SEQ ID NO: 30476 - RNA, 42 nt, Mus musculus
uaaaaaaaaaaaaagagagagagagagagagagaggccgggc

SEQ ID NO: 30477 - RNA, 45 nt, Mus musculus
uccuggguucagucccugucucugcaagacaaggaaaagacaagg

SEQ ID NO: 30478 - RNA, 80 nt, Mus musculus
ugcuuccucuggagagccauaggugagaugcuuagggaagacucguguguaugugugugugugugugugugugugugugu

SEQ ID NO: 30479 - RNA, 26 nt, Mus musculus
ugauagaccacaaacgaggucacuuc

SEQ ID NO: 30480 - RNA, 46 nt, Mus musculus
uguuuuaugaagacuuuuauaaucccagaaacacugaguccaguac

SEQ ID NO: 30481 - RNA, 45 nt, Mus musculus
gcugggcugggcacuaaggccagaaugagcucaaccguauugcau

SEQ ID NO: 30482 - RNA, 46 nt, Mus musculus
uauuugauuauuuguaauugugugugugugugugugugugugugug

SEQ ID NO: 30483 - RNA, 46 nt, Mus musculus
uguuuguguauauguaugugugugugucuuuguguaugugugugag

SEQ ID NO: 30484 - RNA, 45 nt, Mus musculus
agaaagaaagaaagagaaagaaagaaagaaagaaagaaagaagga

SEQ ID NO: 30485 - RNA, 41 nt, Mus musculus
cggucccagcuacagcagaugagaaccuggaagggugguga

SEQ ID NO: 30486 - RNA, 60 nt, Mus musculus
guguguuugugugugcauguuugugugugcauguuuguguguguauuuuuguguguguuu

SEQ ID NO: 30487 - RNA, 52 nt, Mus musculus
aggagguguguaguguguagcguaagguguguugaguggguuuguaagaggg

SEQ ID NO: 30488 - RNA, 42 nt, Mus musculus
cuuaggcuaagacagggaugcgcggguguccggcuuggccga

SEQ ID NO: 30489 - RNA, 55 nt, Mus musculus
augaucccagacuauccuggauuuuuuccaucuccgugccagagagauccacacg

SEQ ID NO: 30490 - RNA, 46 nt, Mus musculus
uugcaaaagaaggaggagaaauauuaaagguuuguuauaagcaguu

SEQ ID NO: 30491 - RNA, 46 nt, Mus musculus
guacuuuacagcauacucuggagguccuuucauggagccuguagaa

SEQ ID NO: 30492 - RNA, 45 nt, Mus musculus
cauaaaccaaguguagcacacagcauuuaggaaauauaggcagga

SEQ ID NO: 30493 - RNA, 42 nt, Mus musculus
uccccgagaaguguggcuccuggagacaccacaggccgacga

SEQ ID NO: 30494 - RNA, 69 nt, Mus musculus
ucuuuauuguuuaaucuaaguauuuauuauuacuuuauuguugcuauugugugugugucugugugugug

SEQ ID NO: 30495 - RNA, 46 nt, Mus musculus
cuuagcagcuuggugucugaucacccuagguuaacgacucuuggau

SEQ ID NO: 30496 - RNA, 48 nt, Mus musculus
uuagugcgacagugacauucaagaaugcuacagaagagaaaagaggau

SEQ ID NO: 30497 - RNA, 46 nt, Mus musculus
gaauuacuuacaguauggcuucugucuuguuucaccaagcccccau

SEQ ID NO: 30498 - RNA, 46 nt, Mus musculus
uaaaaaaauuaauugcuuaaaaacggacaaaaucagucccuuauag

SEQ ID NO: 30499 - RNA, 41 nt, Mus musculus
ggauauacucaacucucaggagaacagagaggaaagggaag

SEQ ID NO: 30500 - RNA, 46 nt, Mus musculus
uaaucucuuggcaugugagcuuauccacggccuucucucugugcau

SEQ ID NO: 30501 - RNA, 42 nt, Mus musculus
cgagucuuguuauuuucucguuuaugaagguguggcugccag

SEQ ID NO: 30502 - RNA, 45 nt, Mus musculus
gugacauuuuccuggacuaagauguggcgguauaagugggucauu

SEQ ID NO: 30503 - RNA, 41 nt, Mus musculus
auaaagaaggagaauccugcagaggaaagaucgcccuguca

SEQ ID NO: 30504 - RNA, 42 nt, Mus musculus
guuuguaauuuaacuggaaaaacauccugcaacagaggggaa

SEQ ID NO: 30505 - RNA, 45 nt, Mus musculus
cucccugucuuaaucuucugggauucauagccacugugccucaag

SEQ ID NO: 30506 - RNA, 46 nt, Mus musculus
cuccagaccuuugaguccguaaccggaaggagaugacauuugucag

SEQ ID NO: 30507 - RNA, 44 nt, Mus musculus
cugaggcuggcaaggaugaugcugagggguuuuaaagggagacu

SEQ ID NO: 30508 - RNA, 46 nt, Mus musculus
auaaaugugaaaucacacacacacacacacacacacacacacacac

SEQ ID NO: 30509 - RNA, 73 nt, Mus musculus
aaucuccaacuuaaaacagaaaacuuacaaguuuauugccaaggucuucccucccccacacaugcuaccgagc

SEQ ID NO: 30510 - RNA, 89 nt, Mus musculus
ugcuuacagcucacaaaccccaagaaccuuaaguacccucgaccaccaccgccugcuucagcaagcaagguucuuucuaaugcagaccc

SEQ ID NO: 30511 - RNA, 46 nt, Mus musculus
caggagcugaugcagaggccauggagggauguuacuuacguacugg

SEQ ID NO: 30512 - RNA, 42 nt, Mus musculus
agccguagccccagcccugugagaugcuguguucacgaggag

SEQ ID NO: 30513 - RNA, 41 nt, Mus musculus
uuauauuuaucaagcgcauuuagaaagcccaauaaccacag

SEQ ID NO: 30514 - RNA, 46 nt, Mus musculus
cuaaaucacccucugcuacugauaacaaaacuuuguuuuaaaggag

SEQ ID NO: 30515 - RNA, 46 nt, Mus musculus
uguccaucuguccgugugugcauauggauauauauguagugugucu

SEQ ID NO: 30516 - RNA, 47 nt, Mus musculus
gguauauguguguguuugucugucugguguguauuuuguaugugugc

SEQ ID NO: 30517 - RNA, 89 nt, Mus musculus
aguuugucuguuuugucuuguuuuuguuucucauuucugcacagugcuccucuaacuaacagguaauauguacacuauugcuugcccag

SEQ ID NO: 30518 - RNA, 46 nt, Mus musculus
gagacuccuacagccauggaaacuugaagaauagguggccgugguu

SEQ ID NO: 30519 - RNA, 46 nt, Mus musculus
aguaaaguuguauuuuuugcuugaaaaugccucuguuagcccucac

SEQ ID NO: 30520 - RNA, 46 nt, Mus musculus
uaaaagcagugaaggcaggaaccuggaggcuggagcugaugcagag

SEQ ID NO: 30521 - RNA, 41 nt, Mus musculus
gggaggggggagggaaggagagagagagagagagagagaga

SEQ ID NO: 30522 - RNA, 45 nt, Mus musculus
agagagagagagagagagagagagagcgagagagagaggaggggc

SEQ ID NO: 30523 - RNA, 42 nt, Mus musculus
ggggaaugacacaugaagagaggggggaaugaaaggggagaa

SEQ ID NO: 30524 - RNA, 46 nt, Mus musculus
ccauugucugaaggcauuuauuguagaaaggcagagggagagagaa

SEQ ID NO: 30525 - RNA, 42 nt, Mus musculus
guugucgugauuaaagauaggaaacaaaaacaaaggcugcag

SEQ ID NO: 30526 - RNA, 45 nt, Mus musculus
cacagagaaacccugucucgaacccccccacacaaaaaaaaagca

SEQ ID NO: 30527 - RNA, 42 nt, Mus musculus
ggaugcucacagucagcuauuggauggauaacagagccccca

SEQ ID NO: 30528 - RNA, 45 nt, Mus musculus
gacaggcaaacuuuauaugccccaguacaggggaaugucagggcc

SEQ ID NO: 30529 - RNA, 45 nt, Mus musculus
ugacacguuagugaccacgaggagaggagagaaaauggguauccu

SEQ ID NO: 30530 - RNA, 45 nt, Mus musculus
ucaacauuuugccuuacuuuugucuugucuuuugcuuugguuuua

SEQ ID NO: 30531 - RNA, 46 nt, Mus musculus
agcucgggcagggccggggcuuacaagugggagcaacuggaggcac

SEQ ID NO: 30532 - RNA, 42 nt, Mus musculus
ucuagcuaccacgacuggaaagagagagagggaagauaggag

SEQ ID NO: 30533 - RNA, 45 nt, Mus musculus
agucucuggagucgaucaacucuaggcuccaacuuguugugaaaa

SEQ ID NO: 30534 - RNA, 45 nt, Mus musculus
gaguuccuggugcuucugaugaagaaaaggugaccagccccguga

SEQ ID NO: 30535 - RNA, 46 nt, Mus musculus
gaagugauuaaguaggauguaacugagcuacuaaaucugagggcag

SEQ ID NO: 30536 - RNA, 42 nt, Mus musculus
caucgcacuccacaaugaggaccccucagcuucugaagagag

SEQ ID NO: 30537 - RNA, 46 nt, Mus musculus
gacaagauuuaguccuaggcaaguucuguguagucagcaauggaag

SEQ ID NO: 30538 - RNA, 42 nt, Mus musculus
acagaaccaucgcacugagggaaagugaguuagcacgaagag

SEQ ID NO: 30539 - RNA, 45 nt, Mus musculus
gucaacccuccuaaugcuguaacccuuuaauaugguggugagccc

SEQ ID NO: 30540 - RNA, 44 nt, Mus musculus
ccacaccaacacagguuucugcagcaguugguguuugcugacca

SEQ ID NO: 30541 - RNA, 46 nt, Mus musculus
aagaaaaguccagaugacaguuuacaaacaaagaaaacuauacaag

SEQ ID NO: 30542 - RNA, 46 nt, Mus musculus
ggccaaccagggcaagucagugagacguucucaaaacaaggagcag

SEQ ID NO: 30543 - RNA, 46 nt, Mus musculus
uuaaguaauaauugaggaggggaaaguaucagguaaggcuggggag

SEQ ID NO: 30544 - RNA, 45 nt, Mus musculus
guggaugucacuggcgaggggaagguguuaccaaggaaggagaca

SEQ ID NO: 30545 - RNA, 42 nt, Mus musculus
guucugcaccuugguaggaauaagcuuuuuaaacgaccacgg

SEQ ID NO: 30546 - RNA, 46 nt, Mus musculus
ggugagaccgcucugcaagagaucccaagggcauggccgucaguca

SEQ ID NO: 30547 - RNA, 86 nt, Mus musculus
gaagggaagaccuuggagaggaaaugaagagagaggagagagauaggaaggggcagacagagagacagagacagagcuacagagga

SEQ ID NO: 30548 - RNA, 46 nt, Mus musculus
ccgggggaccgcaaauguuuguugcugugauccagguucuggaagu

SEQ ID NO: 30549 - RNA, 42 nt, Mus musculus
caguuucuucccaaagaauugugcaagucaaagccuccugug

SEQ ID NO: 30550 - RNA, 41 nt, Mus musculus
aaaacgcuguugcggagaaaaacaacgcuguugcgacgaaa

SEQ ID NO: 30551 - RNA, 46 nt, Mus musculus
uauuuaaacauguagucaugucugcacagucccuauccuccaguau

SEQ ID NO: 30552 - RNA, 54 nt, Mus musculus
ccuguaggcuugcaggaagaagcagagcugccugccaagaucauggaggaguuu

SEQ ID NO: 30553 - RNA, 45 nt, Mus musculus
aggcaacugaaacuaaggagcaguggaaggacaugaaggccacau

SEQ ID NO: 30554 - RNA, 46 nt, Mus musculus
uugacggaucccaucaggaacuggaaaccuugaagcagcaagcggg

SEQ ID NO: 30555 - RNA, 45 nt, Mus musculus
ggacagaagccaacucagaaugugaugugcuugagcugccaagac

SEQ ID NO: 30556 - RNA, 62 nt, Mus musculus
agaccccagauuagguacaaaccauacucaagcacguguugucacagagauucuuuauuaag

SEQ ID NO: 30557 - RNA, 46 nt, Mus musculus
ugguaagguuucagagggugaguucaugcacauuguguacgccagg

SEQ ID NO: 30558 - RNA, 42 nt, Mus musculus
accaacuuguccuggugccugcgcuauacaguagacugccag

SEQ ID NO: 30559 - RNA, 46 nt, Mus musculus
uauuuuauguacauacuguagcugacacaccagaagaaggcaucag

SEQ ID NO: 30560 - RNA, 46 nt, Mus musculus
cuuuggaauuuuaauuuccauuuuaagauauuauauuggagccuag

SEQ ID NO: 30561 - RNA, 90 nt, Mus musculus
ugugaaauggaauacaggagauucagaugagaacaggcagaguuaguaggaagacaggaguccgguaccagggagguuaucauacagcag

SEQ ID NO: 30562 - RNA, 46 nt, Mus musculus
uucuugugucugaguaauaauaaucuaccuaucauggauguaggag

SEQ ID NO: 30563 - RNA, 46 nt, Mus musculus
uucagaagcuucagaucgcagucaguuguuuccuuguuuuugggaa

SEQ ID NO: 30564 - RNA, 86 nt, Mus musculus
aauacauuguuguauucucgucucaaggacuucauaccucaguggaaaguuucuuuuuuaaagguuuauuuaaauguauaugauuu

SEQ ID NO: 30565 - RNA, 46 nt, Mus musculus
cagaggacucuuagcagccauguagguauugaguauugguauugaa

SEQ ID NO: 30566 - RNA, 42 nt, Mus musculus
aaccagugcccuuagcugcugagccuucugucuagccuccag

SEQ ID NO: 30567 - RNA, 51 nt, Mus musculus
auaugguagaacugcaguuaaugaugccaacauagcauccagaaaggaagg

SEQ ID NO: 30568 - RNA, 47 nt, Mus musculus
ggagagcacuuuguaccuuugggaccaguuagaaggcuaagggugag

SEQ ID NO: 30569 - RNA, 70 nt, Mus musculus
ggcaaaagguuauuguugauugaaucaggguaguacuuuugggaggagugauagacaguaaaauguggau

SEQ ID NO: 30570 - RNA, 41 nt, Mus musculus
uugaccuugguguucaaguuugccacaggacauuaguggga

SEQ ID NO: 30571 - RNA, 46 nt, Mus musculus
auguaaauaaauaucaaauguaaucuuuugauggacacugggcaga

SEQ ID NO: 30572 - RNA, 46 nt, Mus musculus
uauuuuaagacuuaaucugauuuaggaagauauaaugaagcaagag

SEQ ID NO: 30573 - RNA, 46 nt, Mus musculus
guuacagguaucugcagagacagaagaaugugugacauuccuggag

SEQ ID NO: 30574 - RNA, 46 nt, Mus musculus
auuuaauguuucccugagcaauaguuaguaauagauauggagugag

SEQ ID NO: 30575 - RNA, 45 nt, Mus musculus
aaaguuaaauccaccuacuguacagcuguccugcaacgagagcau

SEQ ID NO: 30576 - RNA, 46 nt, Mus musculus
aacugauaaggaccacauugacuucucuguacagauuagaccaggg

SEQ ID NO: 30577 - RNA, 45 nt, Mus musculus
cuugugguuauuggauagauuuaggcuguuuuacuuauaccauug

SEQ ID NO: 30578 - RNA, 46 nt, Mus musculus
gguacacuugaccacugcauucaugugucuaaggaccauugagcag

SEQ ID NO: 30579 - RNA, 46 nt, Mus musculus
aacaccuguuauauuaugcauguuuguauuuugaaagggacaaaga

SEQ ID NO: 30580 - RNA, 46 nt, Mus musculus
cugagaaugagaaguggccugauauacuuauagcuugacaagugag

SEQ ID NO: 30581 - RNA, 46 nt, Mus musculus
cugguugugaagccuguuagcagaucuucaggauggacguagugag

SEQ ID NO: 30582 - RNA, 45 nt, Mus musculus
gauuguugacccauugcauggauauggacuuucugggaaaccuua

SEQ ID NO: 30583 - RNA, 47 nt, Mus musculus
aauagugcuagcuugugagaguuagccugccaaggacugugagggcu

SEQ ID NO: 30584 - RNA, 46 nt, Mus musculus
cacccuuucuucaacaaggccacaccucccaauacuuugcaaacag

SEQ ID NO: 30585 - RNA, 46 nt, Mus musculus
aauuuaaacuugaaauuaagguguagcuucuagauaauaccaagag

SEQ ID NO: 30586 - RNA, 81 nt, Mus musculus
cacacagagagagagagagagagagagagagaaggaaggccaugaauuuggaaaagaguaaggacuguaggggacuggagg

SEQ ID NO: 30587 - RNA, 46 nt, Mus musculus
uauuagauugaaaauguuggcuagaagauaauaguucacagagcuc

SEQ ID NO: 30588 - RNA, 45 nt, Mus musculus
cagauugguuccuucacuguuguaucucuaggccuaagccuggaa

SEQ ID NO: 30589 - RNA, 42 nt, Mus musculus
uccucuuguccucucuuuuucuuugucuucucucccuaccag

SEQ ID NO: 30590 - RNA, 45 nt, Mus musculus
uugaauccagaaugugaauccaugccuuugugacugugaccucac

SEQ ID NO: 30591 - RNA, 45 nt, Mus musculus
cgggccggucguucucucgccuucgccuucuaacguuugugccag

SEQ ID NO: 30592 - RNA, 41 nt, Mus musculus
gggaaguauaccgagggaagcucauugaagcagaggacaac

SEQ ID NO: 30593 - RNA, 46 nt, Mus musculus
aaagggcuguggcuucuauccuguggguagagcgguguacuuggag

SEQ ID NO: 30594 - RNA, 45 nt, Mus musculus
ggguauccuggucacuuguucuccccugaauaaaaugaggaugga

SEQ ID NO: 30595 - RNA, 45 nt, Mus musculus
cuucagcaaggcugcauccccuagccgcugccccuuuccccaaaa

SEQ ID NO: 30596 - RNA, 41 nt, Mus musculus
ugugugugugugugugugugugugcgcgcgcauguggaaca

SEQ ID NO: 30597 - RNA, 46 nt, Mus musculus
agauagcuccuacauguuccccugaugucuccuuucuugcccccag

SEQ ID NO: 30598 - RNA, 46 nt, Mus musculus
cccugagcugacccugcaaagggagaaaacugauucugaccaccac

SEQ ID NO: 30599 - RNA, 46 nt, Mus musculus
gcuucuuaauuuuuacugugugauucacucuagaccauauuccaag

SEQ ID NO: 30600 - RNA, 45 nt, Mus musculus
aagagacccccaugcccagaacuggugcugcuuauauaggccuag

SEQ ID NO: 30601 - RNA, 46 nt, Mus musculus
cagaacagaacagaacagaacagaacagaacaaaacagaaaggcag

SEQ ID NO: 30602 - RNA, 46 nt, Mus musculus
gggucuguaugacagccuuguggagacuucgaggcacaguggagag

SEQ ID NO: 30603 - RNA, 46 nt, Mus musculus
caacaucacagucacauacagagauggucgaguggcacagcuggaa

SEQ ID NO: 30604 - RNA, 46 nt, Mus musculus
agauccgauuucugauuuugccugacaugcugaaaaaugcacccau

SEQ ID NO: 30605 - RNA, 46 nt, Mus musculus
cauugaagagaacguuguccuuucuucucuuugauuauugcagggg

SEQ ID NO: 30606 - RNA, 45 nt, Mus musculus
acccagccaaaaaacaaagcuugaguucaucucugccucugucga

SEQ ID NO: 30607 - RNA, 41 nt, Mus musculus
ugguguuggggcagcagggcaggccaugggaucaacuggcg

SEQ ID NO: 30608 - RNA, 42 nt, Mus musculus
agaggcagagacagagagacagagacagagagacagagagag

SEQ ID NO: 30609 - RNA, 46 nt, Mus musculus
gggugaccucacggacaguuauggaaccguggggaaacacaaacag

SEQ ID NO: 30610 - RNA, 45 nt, Mus musculus
acuccaguucuaggacgggacaagaaggccaucccuuaagucuga

SEQ ID NO: 30611 - RNA, 46 nt, Mus musculus
cauucauaggacuaggguacauguucuuugcgcuucucccggggag

SEQ ID NO: 30612 - RNA, 28 nt, Mus musculus
ccuccgaagaugauacucaguagcaccg

SEQ ID NO: 30613 - RNA, 23 nt, Mus musculus
gcccuuggccuuucaggacucca

SEQ ID NO: 30614 - RNA, 41 nt, Mus musculus
guccggcacugauuggcccaaaguucuuguggucauccaau

SEQ ID NO: 30615 - RNA, 45 nt, Mus musculus
ccucaccuucacauugccuaugccuccauggagaccucagcccag

SEQ ID NO: 30616 - RNA, 42 nt, Mus musculus
cgggauuuccccaaaucuggccuguuauuucuauggcaucaa

SEQ ID NO: 30617 - RNA, 46 nt, Mus musculus
ggcagcugcuuccucccagagacacggaaccucaaaggccccacau

SEQ ID NO: 30618 - RNA, 45 nt, Mus musculus
cuuuggaugcauucagggguacugacuccugccagggcacuuaga

SEQ ID NO: 30619 - RNA, 46 nt, Mus musculus
ugagguucccaguaccgacuggaccugacccuguggacagacagac

SEQ ID NO: 30620 - RNA, 42 nt, Mus musculus
ggcuuuguguggaggcugcgcagugggcgacugcagcccggg

SEQ ID NO: 30621 - RNA, 29 nt, Mus musculus
ugggggcauccuggcccaugccuucuucc

SEQ ID NO: 30622 - RNA, 46 nt, Mus musculus
acaggagcuggugacagacagcccagggcccucuagcagggcagga

SEQ ID NO: 30623 - RNA, 46 nt, Mus musculus
gaccugucagggagugggcaaagugucucagaacuggggccucaga

SEQ ID NO: 30624 - RNA, 46 nt, Mus musculus
gcacccuaccauucuuugagagggucacugacucccccugagagag

SEQ ID NO: 30625 - RNA, 45 nt, Mus musculus
agucagaauagaagggagcaccgggggaacaaaagcauaaagaag

SEQ ID NO: 30626 - RNA, 44 nt, Mus musculus
guuccaguaagcaccccugcaagguguguaccguggauggagaa

SEQ ID NO: 30627 - RNA, 42 nt, Mus musculus
cacuggaaugaagcaaagcaagucuggggggaggggggagca

SEQ ID NO: 30628 - RNA, 45 nt, Mus musculus
uacucccagucacauggaaccucuccuuuccaucaagcugucggu

SEQ ID NO: 30629 - RNA, 44 nt, Mus musculus
cucccacauccucucucccaccuccgcaaagaugaggcauagca

SEQ ID NO: 30630 - RNA, 92 nt, Mus musculus
augugagaguugccccccccccacuccccgagcgcuugagauccccaccccaccccauuugagugcagaaaaaagaacucaaggacaaaaua

SEQ ID NO: 30631 - RNA, 41 nt, Mus musculus
ugucucgaaaaaccaaaaaaaaaaaaagaaagaaagaaaga

SEQ ID NO: 30632 - RNA, 46 nt, Mus musculus
auacaugcauacauuaauaaauagauagauagauagauagauagau

SEQ ID NO: 30633 - RNA, 42 nt, Mus musculus
cuaugacccggauguugauccaacccauacuucucucugcag

SEQ ID NO: 30634 - RNA, 46 nt, Mus musculus
aaaaacaaaaacaaaaacaaaaaacaaaacaacaacaaacccagaa

SEQ ID NO: 30635 - RNA, 45 nt, Mus musculus
acugaugcuuacaaagcaagcccaugacuccuuagccacucagaa

SEQ ID NO: 30636 - RNA, 45 nt, Mus musculus
ugggggcucaccacagcaugaggagcuuguacugaaggucacagc

SEQ ID NO: 30637 - RNA, 44 nt, Mus musculus
gcagcuacccugaaggcaaaggaagcaaucaucgagcagagaga

SEQ ID NO: 30638 - RNA, 45 nt, Mus musculus
agcugaaaagccucaucgagaacuuacaggaaaaccagaggcaau

SEQ ID NO: 30639 - RNA, 45 nt, Mus musculus; identical to SEQ ID NO: 29343

SEQ ID NO: 30640 - RNA, 46 nt, Mus musculus
aguacacuguagcuuucuaaagacacaccagaagagggcaucagau

SEQ ID NO: 30641 - RNA, 40 nt, Mus musculus
uacaaagacaaaugguccagcuccaggaagaacuggaaaa

SEQ ID NO: 30642 - RNA, 47 nt, Mus musculus
cuccaccugggcucccggcgagucgcucggaggugacagggcggcgg

SEQ ID NO: 30643 - RNA, 46 nt, Mus musculus
gcggccggcuuccggaguguuaagcaucggggauaaaaagcuauua

SEQ ID NO: 30644 - RNA, 46 nt, Mus musculus
uaaagaggagagcuacuuguguauaguccauauuuauugccuucag

SEQ ID NO: 30645 - RNA, 42 nt, Mus musculus
auccccuguccaggggcgaccaucccccagauaaacggccag

SEQ ID NO: 30646 - RNA, 42 nt, Mus musculus
ggaugacauaguuuguuuuccuaaccugggcgugugcagguc

SEQ ID NO: 30647 - RNA, 45 nt, Mus musculus
uguguaugauguguguguguguguguguguguguguguguggugu

SEQ ID NO: 30648 - RNA, 90 nt, Mus musculus
gcuucuagucugauuucccgggauagggucuugcuguguugcccagacucacuuggaagugcagggcccuuaccucagccuuuggaggag

SEQ ID NO: 30649 - RNA, 45 nt, Mus musculus
gguuguuuguacauaugccacuguaccuugcuucuuuauguauuu

SEQ ID NO: 30650 - RNA, 45 nt, Mus musculus
ucuccuccuccucuccuccuccuucucuuccuccuccugucccuc

SEQ ID NO: 30651 - RNA, 46 nt, Mus musculus
uuuucuuuuuuuaaguuuugugugugugugugugugugugugugag

SEQ ID NO: 30652 - RNA, 46 nt, Mus musculus
acacuuuguguugugaacuguuuuucaggcaucggcagcccuggcu

SEQ ID NO: 30653 - RNA, 26 nt, Mus musculus
ucugaagaugcaccaguuugaggcgg

SEQ ID NO: 30654 - RNA, 42 nt, Mus musculus
ugagccaccaucuaugugcugggaauugaaccugggucuuug

SEQ ID NO: 30655 - RNA, 46 nt, Mus musculus
uacauuucuaauaaauuuguugucuuaggauuucucuugcugccau

SEQ ID NO: 30656 - RNA, 46 nt, Mus musculus
ugcccacuuuaugugugaggagccuaugucuuccuuugaugccaag

SEQ ID NO: 30657 - RNA, 42 nt, Mus musculus
ugugugugcacauguggaaaugaaugcaggguccugucaggg

SEQ ID NO: 30658 - RNA, 46 nt, Mus musculus
uguuggcaauuaaugaccacugggaggaaacagcauaagugcucag

SEQ ID NO: 30659 - RNA, 46 nt, Mus musculus
uucaggggauguuggacacuugguuuucaugcccuuuccuugguag

SEQ ID NO: 30660 - RNA, 46 nt, Mus musculus
gcuucuuuucuguccuguuuguucuucuguuuuccuggaacuguaa

SEQ ID NO: 30661 - RNA, 45 nt, Mus musculus
ucucuuaucagacacagaagugcauguauuuucucucauucucug

SEQ ID NO: 30662 - RNA, 45 nt, Mus musculus
cugaggcacguugccgcugaggaaguuuccauggaaaggcagaga

SEQ ID NO: 30663 - RNA, 67 nt, Mus musculus
ugaagcaagagagagaacugauguuaacucagcugagcgagggucuggccgcagagcugacagaacu

SEQ ID NO: 30664 - RNA, 42 nt, Mus musculus
gaagcgaagguuuuggaaacuggugcugguguugccugaugu

SEQ ID NO: 30665 - RNA, 45 nt, Mus musculus
cccuguguguuccauggucauucaguacaccucccagauucccag

SEQ ID NO: 30666 - RNA, 45 nt, Mus musculus
uaguuuguuuauuuuaaauagggucuuauuguguagcucuggcaa

SEQ ID NO: 30667 - RNA, 43 nt, Mus musculus
cuccuggcacagagucuguccagcagucugcuggaagagaagg

SEQ ID NO: 30668 - RNA, 43 nt, Mus musculus
uugcagcugagcugcuccugggacaauaacaucucucgggcuu

SEQ ID NO: 30669 - RNA, 82 nt, Mus musculus
auccguggccuggccuggccucucauggugccaaagccucagcuguucuucacaaccccuauaugccuucaaaaccaguaua

SEQ ID NO: 30670 - RNA, 45 nt, Mus musculus
ugagggacucaagacuucucucucaaacaucacaagccaggccac

SEQ ID NO: 30671 - RNA, 46 nt, Mus musculus
guauagaccaggcugggcuggccuugaacucagaaauccgccugcc

SEQ ID NO: 30672 - RNA, 105 nt, Mus musculus
ucauuaaacucugaacacucgagugcuuuucuagucugaaguuccagaggccaugcacaauccuccaaaauacaugcucaggucugucacaguaaugccccaagg

SEQ ID NO: 30673 - RNA, 42 nt, Mus musculus
aguccauccaaagaaguuaggacaggaacucaaacaaggcag

SEQ ID NO: 30674 - RNA, 46 nt, Mus musculus
cccacccacaauaaggcccucccacauuaaucagaaugugccacag

SEQ ID NO: 30675 - RNA, 49 nt, Mus musculus
ucccucucuccauugcccauuguggcucacucuccagcccagccuuccc

SEQ ID NO: 30676 - RNA, 42 nt, Mus musculus
gacaggagaaaagaccaaagaagaacuagaagucaggcagaa

SEQ ID NO: 30677 - RNA, 46 nt, Mus musculus
ccuguuauuuccuaucucaggagaucagaccugagagccccauauc

SEQ ID NO: 30678 - RNA, 63 nt, Mus musculus
agggggaaagggaaguaagggggcagaggcugugggaaacaggcagugggaagacucuggggu

SEQ ID NO: 30679 - RNA, 59 nt, Mus musculus
uucccacugccuguuucccacagccucugcccccuuacuucccuuucccccuucaugca

SEQ ID NO: 30680 - RNA, 58 nt, Mus musculus
ccuccaaugcuugagggcaagguauagguaggauggagacuugggguaggggaagcca

SEQ ID NO: 30681 - RNA, 69 nt, Mus musculus
gacagaaggacucugaacccaaagccccuuaccuacuuucagcucucuuggcuuccccuaccccaaguc

SEQ ID NO: 30682 - RNA, 83 nt, Mus musculus
ccgucuagcugggaccggcagggcuaggguccuauuagcaccacagaugggauggagagguggccgagcauggcggugcuaac

SEQ ID NO: 30683 - RNA, 46 nt, Mus musculus
ggaugugcuuacuaagaucagccugggugacagggcggccaucuuc

SEQ ID NO: 30684 - RNA, 41 nt, Mus musculus
gcacugacuccuccaggcugucauugccggugacaccgucc

SEQ ID NO: 30685 - RNA, 46 nt, Mus musculus
ucgucuuccucacggacggugucaccggcaaugacagccuggagga

SEQ ID NO: 30686 - RNA, 46 nt, Mus musculus
ccacgaggcccuggagagggccaccuaccucaauuccuuuucucac

SEQ ID NO: 30687 - RNA, 43 nt, Mus musculus
cucaacgcccgcauggcucuguugcaauauggcagccagaauc

SEQ ID NO: 30688 - RNA, 55 nt, Mus musculus
uuccugcuggauggcucggagcggcugggcgagcagaacuuccacaaggugcggc

SEQ ID NO: 30689 - RNA, 41 nt, Mus musculus
gagaauaaccucuuugugaguaacugaaauaugggcugagu

SEQ ID NO: 30690 - RNA, 45 nt, Mus musculus
cacacacacacacacacacacacacacacacacacagagaagugu

SEQ ID NO: 30691 - RNA, 47 nt, Mus musculus
cuguagauguugcuauuaagguaaaguucucaagccagcagcccaca

SEQ ID NO: 30692 - RNA, 77 nt, Mus musculus
ccugcugggagggugacaucccauagcaggcuggggccagacucccugcugggaggucacagguagaagaagggaac

SEQ ID NO: 30693 - RNA, 42 nt, Mus musculus
cugcaaagucaccaagaccaguucaagccaccaaggcaaguu

SEQ ID NO: 30694 - RNA, 45 nt, Mus musculus
caggcugugggcccagccuggucucuguaucugaaggcaucauga

SEQ ID NO: 30695 - RNA, 42 nt, Mus musculus
ccacuuuguucagugauuggaggcccaccuuaugccccagaa

SEQ ID NO: 30696 - RNA, 46 nt, Mus musculus
guauuacagccuuggcuguucuggaacuugcuuuguaggccuggga

SEQ ID NO: 30697 - RNA, 45 nt, Mus musculus
aaacuuugucucuaaaaacaaaaugcaaaacacaaggaggaggag

SEQ ID NO: 30698 - RNA, 97 nt, Mus musculus
ggaaaaggaggaggaaaaggagagagaggaggagaaggaggaggaggaagaagaggcagagaaggagggggaggaaaaagaagaagaguaggaggag

SEQ ID NO: 30699 - RNA, 46 nt, Mus musculus
gguagagcuuccauccuuggcuugugggcacaccucuccagcauca

SEQ ID NO: 30700 - RNA, 41 nt, Mus musculus
aaauaagcccagggagacaaguaggagaugggaggauggag

SEQ ID NO: 30701 - RNA, 42 nt, Mus musculus
gcccuagucauccaggaguguugaguaggggcugggccaguu

SEQ ID NO: 30702 - RNA, 23 nt, Mus musculus
cacacgaucugggggucuagaag

SEQ ID NO: 30703 - RNA, 35 nt, Mus musculus
ucuuccaugucaucgaugaacuucucggccaccag

SEQ ID NO: 30704 - RNA, 45 nt, Mus musculus
cuguucucugaccugguggccgagaaguucaucgaugacauggaa

SEQ ID NO: 30705 - RNA, 46 nt, Mus musculus
augucacugugacagccauuggcaucggugacauguuccacgagac

SEQ ID NO: 30706 - RNA, 53 nt, Mus musculus
ggcugucacagugacaucucggucacacagugcccgaagauugaggucaucau

SEQ ID NO: 30707 - RNA, 55 nt, Mus musculus
ucugcccucaaguuugccuauaaucagcucaucaaagaaagccggcgccagaaga

SEQ ID NO: 30708 - RNA, 51 nt, Mus musculus
ccggcuuucuuugaugagcugauuauaggcaaacuugagggcagagggcgu

SEQ ID NO: 30709 - RNA, 45 nt, Mus musculus
guugacucgcucgucguccagccggauggccucaaaggugcccuc

SEQ ID NO: 30710 - RNA, 42 nt, Mus musculus
cugaccuguuucugacuugggguccuuggcaauggcaccuag

SEQ ID NO: 30711 - RNA, 48 nt, Mus musculus
ucaucaauguggucaacaggcuaggugccauugccaaggaccccaagu

SEQ ID NO: 30712 - RNA, 72 nt, Mus musculus
cacagggaggccgaggagacuuuggucugaaaggaacacccggacggaagggagauaaaggggagccaguga

SEQ ID NO: 30713 - RNA, 44 nt, Mus musculus
uuacgggugucccucgaggucccggguagcugaauccaggccuu

SEQ ID NO: 30714 - RNA, 26 nt, Mus musculus
uauucaaacagugaaggguguuuggu

SEQ ID NO: 30715 - RNA, 45 nt, Mus musculus
guccugaauccccucgagguccggcgucaccagggucuccucgag

SEQ ID NO: 30716 - RNA, 41 nt, Mus musculus
aggcccccagggggcucuuggagagccaggaaagcagguga

SEQ ID NO: 30717 - RNA, 46 nt, Mus musculus
ccuggcucuccaagagcccccugggggccucuggguccaggcaaac

SEQ ID NO: 30718 - RNA, 44 nt, Mus musculus
ccucgaggccuggcuggagaaguuggcaguaaaggagccaaggu

SEQ ID NO: 30719 - RNA, 52 nt, Mus musculus
cuccuuuacugccaacuucuccagccaggccucgaggccccucaggaccagg

SEQ ID NO: 30720 - RNA, 44 nt, Mus musculus
cucucccuuuggaccaucgcugccggggccgcccuuggucccgg

SEQ ID NO: 30721 - RNA, 46 nt, Mus musculus
gggacgcagaggagaccccgggaccaagggcggccccggcagcgau

SEQ ID NO: 30722 - RNA, 76 nt, Mus musculus
auaucaaggcaacaacggagccccuggaagcccgggagugaaaggaggcaagggagggccuggcccccguggacca

SEQ ID NO: 30723 - RNA, 46 nt, Mus musculus
ucuggccgcccaggacgcaggggaccaccaggagauccuggagaca

SEQ ID NO: 30724 - RNA, 46 nt, Mus musculus
ucuccaggaucuccuggugguccccugcguccugggcggccagagu

SEQ ID NO: 30725 - RNA, 42 nt, Mus musculus
gagacagggacaccuaccccauggcuaaaggucuagggcuau

SEQ ID NO: 30726 - RNA, 41 nt, Mus musculus
ggauacccuggagaagcuggaagcccaggcgagcgaggaga

SEQ ID NO: 30727 - RNA, 45 nt, Mus musculus
cuuaccuuggcacccuggucuccucgcucgccugggcuuccagcu

SEQ ID NO: 30728 - RNA, 41 nt, Mus musculus
cuuccggggucucccuugcaaccaggaggcccaaugcggcc

SEQ ID NO: 30729 - RNA, 45 nt, Mus musculus
agggagcgccuggccuagcuggcaagaauggaacagauggacaga

SEQ ID NO: 30730 - RNA, 42 nt, Mus musculus
uucuguccaucuguuccauucuugccagcuaggccaggcgcu

SEQ ID NO: 30731 - RNA, 46 nt, Mus musculus
ccucaaccaacacuuugcuuuccucccgcacagggugaauuuggau

SEQ ID NO: 30732 - RNA, 29 nt, Mus musculus
ggugugccuggcuucaagggagagaaggu

SEQ ID NO: 30733 - RNA, 46 nt, Mus musculus
cagggagaccccggcaucgaaggccccauuggauucccgggaccga

SEQ ID NO: 30734 - RNA, 47 nt, Mus musculus
gugccaagggcaacaugggugaaccaggagagccuggacagaaagga

SEQ ID NO: 30735 - RNA, 42 nt, Mus musculus
ucuguccaggcucuccugguucacccauguugcccuuggcac

SEQ ID NO: 30736 - RNA, 44 nt, Mus musculus
ggagauuccuggaccccacggacccaaggguuaccgaggacaga

SEQ ID NO: 30737 - RNA, 60 nt, Mus musculus
acgccaccaugcgacccgacucuaccgagauugaccaggacaccaucaaccgcaucauca

SEQ ID NO: 30738 - RNA, 49 nt, Mus musculus
gcuguggccccuaacaggaaccuaaacgaacaaggccugagggacaucg

SEQ ID NO: 30739 - RNA, 57 nt, Mus musculus
cugacugugcauuggcuaacaugacgcagcagauccggcagcacguaggcaaggggg

SEQ ID NO: 30740 - RNA, 47 nt, Mus musculus
cugcugcgucauguuagccaaugcacagucagugaaggugccccugc

SEQ ID NO: 30741 - RNA, 43 nt, Mus musculus
acacuucucggaccaaguggagguguucagcccaccgggcagu

SEQ ID NO: 30742 - RNA, 50 nt, Mus musculus
gcaguccccgacagacagccugcucuaucauaugcagcaguucguaccgc

SEQ ID NO: 30743 - RNA, 45 nt, Mus musculus
aggaagcugucucaccagacaucuccaccacugaaaggaacaaca

SEQ ID NO: 30744 - RNA, 42 nt, Mus musculus
cugauugggggacucuuggggguccuccaugcccagcagcag

SEQ ID NO: 30745 - RNA, 44 nt, Mus musculus
uuuguguguguaugugugugugcauguaugugugcaugugugug

SEQ ID NO: 30746 - RNA, 45 nt, Mus musculus
uacauguuuguguguauguguaugagugugugcauguguguggug

SEQ ID NO: 30747 - RNA, 46 nt, Mus musculus
ugugguguguguguguaugugcauauaugugcauguguguguaugu

SEQ ID NO: 30748 - RNA, 41 nt, Mus musculus
cggacuaagaugaagcuggggaaugagcugggggaggggag

SEQ ID NO: 30749 - RNA, 98 nt, Mus musculus
aauagugacuugucucccccugguccccaaaggcuccccuuuaguuaguuucuucauggcucccccacauuccccguaaucugauccaagccagcuau

SEQ ID NO: 30750 - RNA, 45 nt, Mus musculus
gcaaaggugcuaucuaucuguaagggcucucucuacacacccaga

SEQ ID NO: 30751 - RNA, 46 nt, Mus musculus
guguguagagagagcccuuacagauagauagcaccuuugcuuucag

SEQ ID NO: 30752 - RNA, 45 nt, Mus musculus
cugcagugauggugugaagacaccacggauagguuaggggcagug

SEQ ID NO: 30753 - RNA, 46 nt, Mus musculus
acugccccuaaccuauccguggugucuucacaccaucacugcaguu

SEQ ID NO: 30754 - RNA, 45 nt, Mus musculus
gcccuugguuuguacaucaugguggccaucuugcugaccccuccc

SEQ ID NO: 30755 - RNA, 46 nt, Mus musculus
guugaguugaccaguugggucacauuuccuauuccuguuuugucag

SEQ ID NO: 30756 - RNA, 124 nt, Mus musculus
ucuaccagacagucuccaggaagguggcacugggcuagagggccacacacguggcuggacacacauggcauggagacacauuucaacaggccuucccgcccuucccacugacaaaacaggaaua

SEQ ID NO: 30757 - RNA, 59 nt, Mus musculus
gggaccccaggugaacgagccccacauccgugugcuugucacuggcaagacugcagagu

SEQ ID NO: 30758 - RNA, 64 nt, Mus musculus
aggccauugagaaggcugugcaggaggcccagcgugcaggcauugagaucuuuguggugguggu

SEQ ID NO: 30759 - RNA, 42 nt, Mus musculus
cuccugcacagccuucucaauggccucugcuguggcccccug

SEQ ID NO: 30760 - RNA, 32 nt, Mus musculus
agcucuguggacagcauggauuucaucaacga

SEQ ID NO: 30761 - RNA, 46 nt, Mus musculus
gguggccgugguacaguauaguggccaggggcagcaacagccaggu

SEQ ID NO: 30762 - RNA, 42 nt, Mus musculus
uggcuguugcugccccuggccacuauacuguaccacggccac

SEQ ID NO: 30763 - RNA, 68 nt, Mus musculus
acauucuccuccccggcugacaucaccauccugcuagacagcucagccagugucggcagccacaacuu

SEQ ID NO: 30764 - RNA, 46 nt, Mus musculus
agucgggcccuuggccuucucuuaaaagggggaaacugagucucag

SEQ ID NO: 30765 - RNA, 48 nt, Mus musculus
augcagagcuucucgaugacggcuuucugaagaacauaacagcccaga

SEQ ID NO: 30766 - RNA, 46 nt, Mus musculus
cgaccuugcgauaagccuuggcaggaaaugacauugagcuggucgg

SEQ ID NO: 30767 - RNA, 46 nt, Mus musculus
acccacacagaacaaccgaauugcccuggucauuacggauggacgu

SEQ ID NO: 30768 - RNA, 42 nt, Mus musculus
guucugugugggugggaguagccggucccggguguacugcag

SEQ ID NO: 30769 - RNA, 50 nt, Mus musculus
ugcucuugcaucugguuguggcuguacuguaccacgcccgcgugagacug

SEQ ID NO: 30770 - RNA, 46 nt, Mus musculus
gagccagggcagucucacgcgggcgugguacaguacagccacaacc

SEQ ID NO: 30771 - RNA, 46 nt, Mus musculus
caaccggucaaugaccuugaugaugaaguccuuggcaaucucaaag

SEQ ID NO: 30772 - RNA, 56 nt, Mus musculus
ccucuucgugcuggacagcucggagagcauuggccuacagaacuuugagauugcca

SEQ ID NO: 30773 - RNA, 45 nt, Mus musculus
cccuggccucaagggggaugagggugaagugggagacccaggaga

SEQ ID NO: 30774 - RNA, 45 nt, Mus musculus
ccugggucucccacuucacccucaucccccuugaggccaggguag

SEQ ID NO: 30775 - RNA, 47 nt, Mus musculus
ucucacccaucaguccggggucuccaggaggaccaacagguccuggg

SEQ ID NO: 30776 - RNA, 47 nt, Mus musculus
cccaggaccuguugguccuccuggagaccccggacugaugggugaga

SEQ ID NO: 30777 - RNA, 41 nt, Mus musculus
ugaggcuggccccauuggaccuaaaggauaccgaggugaug

SEQ ID NO: 30778 - RNA, 47 nt, Mus musculus
cuggagagccugguccccccggagaaaaaggagaggccggugaugaa

SEQ ID NO: 30779 - RNA, 41 nt, Mus musculus
caagggugaugcuggugccuuugggaugaagggagaaaagg

SEQ ID NO: 30780 - RNA, 46 nt, Mus musculus
gguacccaggacuaccgggcugcaagggcuccccaggauuugaugu

SEQ ID NO: 30781 - RNA, 45 nt, Mus musculus
guccuggguaccccgucucucccuggaaggagaagaaaacgucaa

SEQ ID NO: 30782 - RNA, 44 nt, Mus musculus
ggcgagaaaggcaagcgcggaaucgacggggucgacggcaugaa

SEQ ID NO: 30783 - RNA, 42 nt, Mus musculus
gcaucagggggaggcagcugguguuccugucagaggggagca

SEQ ID NO: 30784 - RNA, 44 nt, Mus musculus
ccuggggaucuuggaccagucggguaccaggguaugaagguacg

SEQ ID NO: 30785 - RNA, 42 nt, Mus musculus
cuucauacccugguacccgacugguccaagauccccaggucg

SEQ ID NO: 30786 - RNA, 27 nt, Mus musculus
cagggggagcgaggaaagccaggucuu

SEQ ID NO: 30787 - RNA, 44 nt, Mus musculus
cugccagaggaccuccagggccccgaggcgacccuggguaugag

SEQ ID NO: 30788 - RNA, 42 nt, Mus musculus
cauacccagggucgccucggggcccuggagguccucuggcag

SEQ ID NO: 30789 - RNA, 42 nt, Mus musculus
ggacaucuucccggucaggggucagggggucagaggucaggg

SEQ ID NO: 30790 - RNA, 46 nt, Mus musculus
cacauaccggcgcaauuucacggcagcugacugggggcauagccgc

SEQ ID NO: 30791 - RNA, 121 nt, Mus musculus
gaccgacgggcauccucuagagggcuacaaggaaccaugcgggggucuggaagaugcaguaaaugaggccaaacaccugggcaucaaggucuuuucuguggccaucacaccugaccaccug

SEQ ID NO: 30792 - RNA, 42 nt, Mus musculus
ucggucaccacgaucaaguacuuguucuccuucaggugggag

SEQ ID NO: 30793 - RNA, 73 nt, Mus musculus
gcucaaggccagcguggaugcggucaaguacuucgggaaaggcaccuacaccgacugcgccauuaagaagggg

SEQ ID NO: 30794 - RNA, 48 nt, Mus musculus
cgcaaccugguuuggaaugcgggugcgcugcacuacagugacgaggug

SEQ ID NO: 30795 - RNA, 46 nt, Mus musculus
acaaggugaaguccuucacuaagcgcuucauugacaaccugagaga

SEQ ID NO: 30796 - RNA, 23 nt, Mus musculus
gcuuagugaaggacuucaccuug

SEQ ID NO: 30797 - RNA, 63 nt, Mus musculus
gaaacaugaggcuggcccacgcucugcugccccugcugcuacaagccugcuggguggccacac

SEQ ID NO: 30798 - RNA, 42 nt, Mus musculus
cacucugccuuucccagcgcccacccugacccuggcccacau

SEQ ID NO: 30799 - RNA, 46 nt, Mus musculus
ccuccccacaguaguggaacguagcucuaagggacacuagucaugg

SEQ ID NO: 30800 - RNA, 46 nt, Mus musculus
uuagcagacuuucaauaggacccucuguccccauggcugaguaaga

SEQ ID NO: 30801 - RNA, 46 nt, Mus musculus
aagcagugcucagaggagcugggagagcaaguaggucaaguccaga

SEQ ID NO: 30802 - RNA, 42 nt, Mus musculus
cagggauaugucaccaggggaugugagaagggaguccaagaa

SEQ ID NO: 30803 - RNA, 44 nt, Mus musculus
ccagacaucauuaaucacagcacaggaggcaaaagaugccaggu

SEQ ID NO: 30804 - RNA, 44 nt, Mus musculus
uucagaggcuaagagcacuggcuauucuuccagagguacugagu

SEQ ID NO: 30805 - RNA, 45 nt, Mus musculus
ucuuggcccaaggagggucacuauuaugagguguggccuuaugga

SEQ ID NO: 30806 - RNA, 46 nt, Mus musculus
acacacacacacacacacacacacacacacacagagaugaggcauu

SEQ ID NO: 30807 - RNA, 46 nt, Mus musculus
gcuugcacagaagucuccaagggacuccucagcuccugggccuggg

SEQ ID NO: 30808 - RNA, 46 nt, Mus musculus
gggcauaguugagcccgacacagguucuucuuggcaagcaauagac

SEQ ID NO: 30809 - RNA, 46 nt, Mus musculus
gagaccugggagccuccguuccuguacuugcuaagggagcucagau

SEQ ID NO: 30810 - RNA, 46 nt, Mus musculus
ucugugacaaugugugcuaugaugccauuucaaagaggcaccaaau

SEQ ID NO: 30811 - RNA, 46 nt, Mus musculus
aagcuggacaucagcuugaaguccagaaaucucacagcagccacau

SEQ ID NO: 30812 - RNA, 46 nt, Mus musculus
cucagguuugucucucagacuggccucucuggcgaccccugagauc

SEQ ID NO: 30813 - RNA, 43 nt, Mus musculus
agugggaaccagcucuccugacugccccacucuccugcagcca

SEQ ID NO: 30814 - RNA, 49 nt, Mus musculus
ugccucagaccugcagacucuaucuagccugggaucuuucugugcagau

SEQ ID NO: 30815 - RNA, 48 nt, Mus musculus
ggauacaauccuguauaguucccauuuuuauguaauccucaagaaaua

SEQ ID NO: 30816 - RNA, 48 nt, Mus musculus
agcugcgagcugccacaacagcuacaucguccugugcauugagaauag

SEQ ID NO: 30817 - RNA, 41 nt, Mus musculus
ggaccccagugggcggaggcugauggagaguuacugugaga

SEQ ID NO: 30818 - RNA, 42 nt, Mus musculus
cccuaccuuggagaagggacucucuaugcuucagccccaugu

SEQ ID NO: 30819 - RNA, 46 nt, Mus musculus
ggcugucgggcaccuuccgggcuuuccuguccucuaggcugcagga

SEQ ID NO: 30820 - RNA, 46 nt, Mus musculus
acugaacaccccccugucuggaggcaugcgugguauccguggagca

SEQ ID NO: 30821 - RNA, 113 nt, Mus musculus
uggcgagcagaugacauccuggccaacccaccgcgccugccagaccgccagccuuaccccggaguuccacaucaccacaguuccuaugugcaccugccgccagcccgccccac

SEQ ID NO: 30822 - RNA, 49 nt, Mus musculus
ccauugguccagcuucaugagggcaguccauacacccggagggaguacu

SEQ ID NO: 30823 - RNA, 46 nt, Mus musculus
cuggugacaucaucucugcugucaggaagaugaauggccccaagau

SEQ ID NO: 30824 - RNA, 46 nt, Mus musculus
aguaagcgggagccaggcaugguggcgugugccuuuaaucccagca

SEQ ID NO: 30825 - RNA, 87 nt, Mus musculus
caggugaggaucugggccacauaccagaccaugcuggacaagauccgggaggugccggagggcuggcucaucuuuguggccgagagg

SEQ ID NO: 30826 - RNA, 46 nt, Mus musculus
gucccccaggagccaugggugccucugcugggguaaguguccaguu

SEQ ID NO: 30827 - RNA, 46 nt, Mus musculus
cgggaccuccaggaccucccuccuucccuggcccucacagacagag

SEQ ID NO: 30828 - RNA, 46 nt, Mus musculus
ccaguacaaugaauggcuucucuguuguuccuaggguccaaaggga

SEQ ID NO: 30829 - RNA, 47 nt, Mus musculus
gggggacaagggagaccgaggggaugcuggacagaaaggagagaggg

SEQ ID NO: 30830 - RNA, 41 nt, Mus musculus
acucgguccuucugguagugcuugcuuugcuuccgugcuuu

SEQ ID NO: 30831 - RNA, 42 nt, Mus musculus
gggcaaggguaguccugucucaguguguuaggguacagcgag

SEQ ID NO: 30832 - RNA, 45 nt, Mus musculus
acgaagaaacacggggucugaaugucuccugccuguccguccagg

SEQ ID NO: 30833 - RNA, 45 nt, Mus musculus
acccggcgcagcaugguguuugcaaagcacuugcgggcuguggga

SEQ ID NO: 30834 - RNA, 52 nt, Mus musculus
cugcugccggaaauggugagguuugagcccacgugggaggagcuggagcugu

SEQ ID NO: 30835 - RNA, 48 nt, Mus musculus
uggcaccucuguuuccacauuuuccuuucggauucaugaagagagaga

SEQ ID NO: 30836 - RNA, 41 nt, Mus musculus
aaccgguuuuguggagaccaggagaaagcaugugagcagcc

SEQ ID NO: 30837 - RNA, 42 nt, Mus musculus
gugcugugcacugagcagcccccacucagcuacugccagguc

SEQ ID NO: 30838 - RNA, 42 nt, Mus musculus
cugucuucagacaccagaagagggaauuagaucucgugacaa

SEQ ID NO: 30839 - RNA, 45 nt, Mus musculus
augccucaaaucuuuugaguucagcuucuuauacucaggguccca

SEQ ID NO: 30840 - RNA, 46 nt, Mus musculus
ugaggaaguacagcuuacuuggcagagucugaguuuuuuuggccag

SEQ ID NO: 30841 - RNA, 46 nt, Mus musculus
aaaaugacacacauauagggucacaguggccaggugaggaccagga

SEQ ID NO: 30842 - RNA, 46 nt, Mus musculus
ccagggccuuuauucaguucuuuuugaaaugcucuuguacccucug

SEQ ID NO: 30843 - RNA, 42 nt, Mus musculus
aggcuccagccucauacacuuagccugugaguuggucauggg

SEQ ID NO: 30844 - RNA, 46 nt, Mus musculus
ccgguacuuugcucugggaaagggcaaacaucucuguguucagaug

SEQ ID NO: 30845 - RNA, 45 nt, Mus musculus
gagcacuaggcagggacuucagguacuccaggugucgucuggcau

SEQ ID NO: 30846 - RNA, 45 nt, Mus musculus
gaggacgggaucagggaggaaaggaaucguaggcauaucagguuu

SEQ ID NO: 30847 - RNA, 42 nt, Mus musculus
ccggcgccgcggcgacccgccccgugcccaccgagcggccag

SEQ ID NO: 30848 - RNA, 45 nt, Mus musculus
accaucagaucuguggaucagaccugggcugugggcuccacaguc

SEQ ID NO: 30849 - RNA, 45 nt, Mus musculus
accuaaucagcaggaucccucaaccugagauccacaugggcagcu

SEQ ID NO: 30850 - RNA, 46 nt, Mus musculus
gugagggaagggagacugugaacacagcucugcucuuggaauagag

SEQ ID NO: 30851 - RNA, 46 nt, Mus musculus
gaguaacuuacuuuagcuucugaccccugaccucuauagcauacua

SEQ ID NO: 30852 - RNA, 23 nt, Mus musculus
ucccagaccuuccagcucaaaca

SEQ ID NO: 30853 - RNA, 42 nt, Mus musculus
ugggaagcauggcggcaugcaggcagauguggugcuggagag

SEQ ID NO: 30854 - RNA, 46 nt, Mus musculus
cacggcugaaaagagccucacuuuuuuagaaauaaagucaccuguc

SEQ ID NO: 30855 - RNA, 46 nt, Mus musculus
aaucugccgggguucccaucuccauuccuauuuuuuucucuggggu

SEQ ID NO: 30856 - RNA, 42 nt, Mus musculus
uuguagugagcugccaaugcugggcucugacggcccccuuga

SEQ ID NO: 30857 - RNA, 42 nt, Mus musculus
uaggauaucaggagaaauagguccccaaaaggaggggcagcg

SEQ ID NO: 30858 - RNA, 33 nt, Mus musculus
ugggacgugguggcucgaugcuggggaccaaga

SEQ ID NO: 30859 - RNA, 42 nt, Mus musculus
cguggcaggugaggagggucgccauuguuucuggcagcaggg

SEQ ID NO: 30860 - RNA, 47 nt, Mus musculus
gguucuaaaccagcauauaacugucuagaagugucugccgguggcgu

SEQ ID NO: 30861 - RNA, 46 nt, Mus musculus
aaguggcuucauaagcuagggcccagagcaagaacccugugagaga

SEQ ID NO: 30862 - RNA, 42 nt, Mus musculus
ucauuuaauguuaugaauaugagggagcccuggcaggcagua

SEQ ID NO: 30863 - RNA, 46 nt, Mus musculus
uacacccauuuucuucuccacagucaccagaggaccuuuguuuugg

SEQ ID NO: 30864 - RNA, 42 nt, Mus musculus
cggucuggugggcuccaucgauaacgacuucuguggcacuga

SEQ ID NO: 30865 - RNA, 52 nt, Mus musculus
ugugggauguguauggguggauguguguggauguguugaggucuguguugua

SEQ ID NO: 30866 - RNA, 42 nt, Mus musculus
ccuaagcgggguuccugacugcccagcccuuaccuaagagau

SEQ ID NO: 30867 - RNA, 45 nt, Mus musculus
uuugccugggcugcuuccugucccuuggauggagacuuaagugga

SEQ ID NO: 30868 - RNA, 45 nt, Mus musculus
ugcagccugugauuccuaccuucucuguacugggauggggugaga

SEQ ID NO: 30869 - RNA, 53 nt, Mus musculus
ucuccgcugccgccauggcuaccguggaccuggagaaacugcggaugucgggg

SEQ ID NO: 30870 - RNA, 41 nt, Mus musculus
aaccaucuauaauggggauccaaugcccucuucuggugugu

SEQ ID NO: 30871 - RNA, 46 nt, Mus musculus
ggcucacaaccaucuguaacaagaucugacucccuuuucugaagug

SEQ ID NO: 30872 - RNA, 42 nt, Mus musculus
uccccugaccccaggaauguccgucuaauuccuagccccggg

SEQ ID NO: 30873 - RNA, 42 nt, Mus musculus
cacucaguagagggcacagugcugaaggcuccagcagaggag

SEQ ID NO: 30874 - RNA, 45 nt, Mus musculus
ucccagcaaccacaugguggcucacaaccaucuguaaggaggucu

SEQ ID NO: 30875 - RNA, 46 nt, Mus musculus
uucuaacaggagagcuaccaaggcuuuuggagaauauuggcagugg

SEQ ID NO: 30876 - RNA, 46 nt, Mus musculus
ugggcucucucagcuacaauguuuccauccuaggugcacaaaccgu

SEQ ID NO: 30877 - RNA, 27 nt, Mus musculus
uguuuccauccuuggcacacccacagu

SEQ ID NO: 30878 - RNA, 46 nt, Mus musculus
ugugcagucagugauagggguaacaguacaucauugugugagugag

SEQ ID NO: 30879 - RNA, 46 nt, Mus musculus
uucuaggcuuccucaaugucagcggauaaggacggugauggaucag

SEQ ID NO: 30880 - RNA, 46 nt, Mus musculus
uggugacuguacccuuaaacagugcccuuccucacaagcucagaac

SEQ ID NO: 30881 - RNA, 46 nt, Mus musculus
acacagggaaacuuaggauguccccugugacuagcagcaccccuug

SEQ ID NO: 30882 - RNA, 45 nt, Mus musculus
acagggauaguuuccuugugguucuuuuucugggcuggcuagaag

SEQ ID NO: 30883 - RNA, 42 nt, Mus musculus
ugguagggggaggguauggguauaguauggguuuuggcugag

SEQ ID NO: 30884 - RNA, 45 nt, Mus musculus
acgguacccagugacaugaguugucagugagucucggcucugagu

SEQ ID NO: 30885 - RNA, 27 nt, Mus musculus
ggucccuguagccacagaauaaacucu

SEQ ID NO: 30886 - RNA, 45 nt, Mus musculus
aggagcacauucgccguggacggaaaggacugcaagguuaacaag

SEQ ID NO: 30887 - RNA, 46 nt, Mus musculus
gguugucagggagagccuugagcaggcucugcaauauccccaagga

SEQ ID NO: 30888 - RNA, 46 nt, Mus musculus
gcugccauuuucccaggaggcuuuggagcugccaaaaaccugugcg

SEQ ID NO: 30889 - RNA, 45 nt, Mus musculus
gagaaaaagaagaaagaaagcaucuuggaccucuccaaguacauc

SEQ ID NO: 30890 - RNA, 42 nt, Mus musculus
gacccugaugaccaguacaagcugacggaggacacucggcag

SEQ ID NO: 30891 - RNA, 60 nt, Mus musculus
agugaggcagaauccucaagugcagacccaggcccaggaaggaagaggaagaggaacagg

SEQ ID NO: 30892 - RNA, 41 nt, Mus musculus
gacuagccagaggacagggugaagggcccagacauggagca

SEQ ID NO: 30893 - RNA, 42 nt, Mus musculus
agacagggugaaugcagugaccuuuggcagggcagauggcag

SEQ ID NO: 30894 - RNA, 42 nt, Mus musculus
caugaagggaagccuuaagcauaggcaggacaggcaggggag

SEQ ID NO: 30895 - RNA, 46 nt, Mus musculus
ccugaaaaagccuacaagaagaugcuggaagggaggcgggaacgga

SEQ ID NO: 30896 - RNA, 74 nt, Mus musculus
uucuuguaggcuuuuucagggacaucauccucugggaaagugccugagaaccaggguggcagucagggugcuga

SEQ ID NO: 30897 - RNA, 48 nt, Mus musculus
gaucacuuuguagaggcgcuuccuguucugagaaggggugcucugucu

SEQ ID NO: 30898 - RNA, 61 nt, Mus musculus
ucuccucgucaucccacgccuguuccuugucugccucagggccagcccuaugugcggugcc

SEQ ID NO: 30899 - RNA, 45 nt, Mus musculus
accgcacauagggcuggcccugaggcagacaaggaacaggcgugg

SEQ ID NO: 30900 - RNA, 24 nt, Mus musculus
gagcugugugcucagaacugugcc

SEQ ID NO: 30901 - RNA, 46 nt, Mus musculus
aggggcauggcagggcagggcugaggggcacagaggaaaggugacu

SEQ ID NO: 30902 - RNA, 47 nt, Mus musculus
caccaccgucaccgucugacacgucaccaucaucaucgucugcccca

SEQ ID NO: 30903 - RNA, 71 nt, Mus musculus
auguggcagacagugaugauagugauggggcagacgaugaugauggugacgugucagacggugacgguggu

SEQ ID NO: 30904 - RNA, 65 nt, Mus musculus
agauggugaugauggagaagcaucagacgaugaugauggugaagcgucagaugguggugauggug

SEQ ID NO: 30905 - RNA, 60 nt, Mus musculus
gaagauacaaaaggccuaugaguauucuaguauauucagugguauauuuguggccaagag

SEQ ID NO: 30906 - RNA, 61 nt, Mus musculus
uucuaaguagugagggucgggcagcagagcaccucacuggccauauuuccacaugugucuu

SEQ ID NO: 30907 - RNA, 43 nt, Mus musculus
gaccguuugcuggagccguccaggaguuccuuaggcagcacau

SEQ ID NO: 30908 - RNA, 45 nt, Mus musculus
acacagggauuuuuuuuuuucuuuuucuuuuguuuugcuugggug

SEQ ID NO: 30909 - RNA, 45 nt, Mus musculus
gaaccccagggcaguggaagcugcagccacagaagucaaggugag

SEQ ID NO: 30910 - RNA, 41 nt, Mus musculus
uccuaagugagucacugaaggcugugaaagcccggggaugg

SEQ ID NO: 30911 - RNA, 62 nt, Mus musculus
auccugacaggaggaacuguuuuagaggguagcagcauuaggaggcuugaaaaccucuguac

SEQ ID NO: 30912 - RNA, 45 nt, Mus musculus
uguaaccuaccgugugguugcugggauuugaacucaggaccuuug

SEQ ID NO: 30913 - RNA, 39 nt, Mus musculus
augaguacacuguagcuagcuguacagaugguugugagc

SEQ ID NO: 30914 - RNA, 45 nt, Mus musculus
gugucgagaacacaccuuuaagaacacgggacaccaguaaaggcc

SEQ ID NO: 30915 - RNA, 46 nt, Mus musculus
gcuguuucccuuaaguagaaucccaugauugccuuuagauacuuca

SEQ ID NO: 30916 - RNA, 45 nt, Mus musculus
caaggcgcagaugguccagaagaagcgucaggguggccuguggag

SEQ ID NO: 30917 - RNA, 45 nt, Mus musculus
uuucuuauaccugcccucuucucacuaccacugucagccccagug

SEQ ID NO: 30918 - RNA, 46 nt, Mus musculus
cucaccagcaggcuccccacugcuagguguccuaggccccaaagag

SEQ ID NO: 30919 - RNA, 45 nt, Mus musculus
gagcagagguaccacccagccccgagacaccucgaagccccacuc

SEQ ID NO: 30920 - RNA, 45 nt, Mus musculus
uggggcuucgaggugucucggggcugggugguaccucugcuccag

SEQ ID NO: 30921 - RNA, 46 nt, Mus musculus
caggaaaaaugccuugcucaaggccacucaaugagaaggggcaggc

SEQ ID NO: 30922 - RNA, 45 nt, Mus musculus
uaaaguugcuucucacacugagcuccaagcuggaagggggucgag

SEQ ID NO: 30923 - RNA, 46 nt, Mus musculus
agagccaagauaaggggggcgggguaacggggcacugacuguagaa

SEQ ID NO: 30924 - RNA, 45 nt, Mus musculus
ggccggccgagugcgcgccccggggcugcggccgcccgccccgcc

SEQ ID NO: 30925 - RNA, 25 nt, Mus musculus
gaggcugcuggugcgggaugagucc

SEQ ID NO: 30926 - RNA, 45 nt, Mus musculus
acacaggccugcaugggaaggggggucaggaagacugacucgcag

SEQ ID NO: 30927 - RNA, 46 nt, Mus musculus
aagggcuccgagugcaguguggagguugggcacgcuggguggccag

SEQ ID NO: 30928 - RNA, 41 nt, Mus musculus
ggugcuccaucaacuaacacucaggccuucuuucccggaca

SEQ ID NO: 30929 - RNA, 46 nt, Mus musculus
uagaaacugacaagccaacuccaaaccguguacacggaaacucgaa

SEQ ID NO: 30930 - RNA, 42 nt, Mus musculus
cauaaacaaaaauaaaggggugugugugugugugugugugug

SEQ ID NO: 30931 - RNA, 45 nt, Mus musculus
gguacucauccaccccaaaagagaaacaagaagccuaaagcccag

SEQ ID NO: 30932 - RNA, 25 nt, Mus musculus
aucuccaagccucgagcccgaguag

SEQ ID NO: 30933 - RNA, 45 nt, Mus musculus
aaauuugggaucuccccaagguggcagcuucuuuaguccccagau

SEQ ID NO: 30934 - RNA, 88 nt, Mus musculus
uccuccuacucuagucccccuagugaccccaaaccuuggagacagccuuuguaggaaagucuauuucgcauccuccccuugcccagau

SEQ ID NO: 30935 - RNA, 45 nt, Mus musculus
aggggacagcuaucugcaccaagagccagccucauggaggcaccu

SEQ ID NO: 30936 - RNA, 42 nt, Mus musculus
accgaggagccaccuggaagagggcagggccaaccugcaccc

SEQ ID NO: 30937 - RNA, 47 nt, Mus musculus
ucugcccacaggcucaggaaggaagaugcaggaauauuccccagagc

SEQ ID NO: 30938 - RNA, 46 nt, Mus musculus
cagucccuggccuucacgccagccaccuccuggcccgcccccacca

SEQ ID NO: 30939 - RNA, 37 nt, Mus musculus
cuugucaugucaugcuagagucuguccuacacugucc

SEQ ID NO: 30940 - RNA, 43 nt, Mus musculus
caacaccaggaccucagccacgaugccuaggaagggccagagg

SEQ ID NO: 30941 - RNA, 71 nt, Mus musculus
ggguuuucuguaagguaaggcucugucuucacuuggguugggauagguuggguuggguagguucaaaucgg

SEQ ID NO: 30942 - RNA, 24 nt, Mus musculus
ugcugagcgaaggggaguuuguga

SEQ ID NO: 30943 - RNA, 46 nt, Mus musculus
guauuccaguguguagauggggccuccuguguauccaucaucuguu

SEQ ID NO: 30944 - RNA, 46 nt, Mus musculus
agaaaagcaaaauaaaaacaaggaaaggacagagcaguagacagga

SEQ ID NO: 30945 - RNA, 28 nt, Mus musculus
ugagagcuguguguccucaguuuguucc

SEQ ID NO: 30946 - RNA, 46 nt, Mus musculus
uggcuaccugcagccaagcaagaagggaacacccacgaacucagag

SEQ ID NO: 30947 - RNA, 43 nt, Mus musculus
gagggccuuggaacccagaugaaagccacugggaugggcagug

SEQ ID NO: 30948 - RNA, 45 nt, Mus musculus
ggugccaacuguaccuacuuccagaagggaaacugaggccuggga

SEQ ID NO: 30949 - RNA, 45 nt, Mus musculus
ccugauggaacccagcccucugcagugguugguaggaggcaagac

SEQ ID NO: 30950 - RNA, 46 nt, Mus musculus
agggaaauguguguuaucuggaaagcuauuuaaaauacaccuacuc

SEQ ID NO: 30951 - RNA, 33 nt, Mus musculus
uuaaccucacccuccaaauguucaacggcagaa

SEQ ID NO: 30952 - RNA, 78 nt, Mus musculus
acacagccaccaaucccccaggcuugaccgguguagguuucuccucguccucguccucauccuccuccagcucgccca

SEQ ID NO: 30953 - RNA, 46 nt, Mus musculus
gguacuuuuuccuccccguuuucaggauagguaaacugaggcccag

SEQ ID NO: 30954 - RNA, 42 nt, Mus musculus
cgggggcucggcuguccugggcacugucuagacagagggcag

SEQ ID NO: 30955 - RNA, 46 nt, Mus musculus
auccuuggccacauuaugaguucaaggccagccugggcuauauaag

SEQ ID NO: 30956 - RNA, 46 nt, Mus musculus
gcaggggagcuaugguagccuccccuacccuggaguucugccucac

SEQ ID NO: 30957 - RNA, 46 nt, Mus musculus
cucagcuugaagcuaggccaaacuacuuuucagaaucguguuaaaa

SEQ ID NO: 30958 - RNA, 41 nt, Mus musculus
cgggauacacccuagguuacugaucaaccccagccccucgu

SEQ ID NO: 30959 - RNA, 46 nt, Mus musculus
ucucugcucuuaucauuguuguacuugacauugagacuggugagcu

SEQ ID NO: 30960 - RNA, 42 nt, Mus musculus
ccgugcagucaguuggcaaagaaauuccggaucaggcaagaa

SEQ ID NO: 30961 - RNA, 48 nt, Mus musculus
gaugaaguugucaggauguuaauauucaagggcagguugguuuccgga

SEQ ID NO: 30962 - RNA, 45 nt, Mus musculus
gaauaaagaggcuuuggggugugacucucuuuagagacagcagag

SEQ ID NO: 30963 - RNA, 41 nt, Mus musculus
caauccgcaaaccggaagcaaaccacggaccgaggcagaag

SEQ ID NO: 30964 - RNA, 46 nt, Mus musculus
guuggcugugagccaccaugugguuuggacuugaacucaagaccuu

SEQ ID NO: 30965 - RNA, 46 nt, Mus musculus
agaauuaguacagaggaggaggaggcaggaaccagaagcagugcag

SEQ ID NO: 30966 - RNA, 46 nt, Mus musculus
gugguggcacacgccuuuaaucccaguccuugagaggcagaggcag

SEQ ID NO: 30967 - RNA, 45 nt, Mus musculus
auucccagcaaccacaugguggcucacaaccaucuguaauccaau

SEQ ID NO: 30968 - RNA, 25 nt, Mus musculus
ccguagacaaucacuguagacugga

SEQ ID NO: 30969 - RNA, 45 nt, Mus musculus
cacauggccuuagccucccaaguaguggaaggacaccgcccccau

SEQ ID NO: 30970 - RNA, 45 nt, Mus musculus
ucacaucguguccuggggcuaccucaaauacccaaauaccaacag

SEQ ID NO: 30971 - RNA, 56 nt, Mus musculus
auggauguuuuuuugguuugguuuuuugcuuugcagggagagugagguuuuggggg

SEQ ID NO: 30972 - RNA, 45 nt, Mus musculus
acaagugaaccggguucugagucaguugaguugggggaccuggac

SEQ ID NO: 30973 - RNA, 46 nt, Mus musculus
ggguccccagccucccagacgccacagcuucccacagcaccccaga

SEQ ID NO: 30974 - RNA, 45 nt, Mus musculus
caucuguaaugggaucugaugcccucuucuggugugccuaaagac

SEQ ID NO: 30975 - RNA, 41 nt, Mus musculus
ggugggucaauccugggaaggaagcgaggcaugguggguga

SEQ ID NO: 30976 - RNA, 41 nt, Mus musculus
gggucacaucuggcuugccucaguuuccccacggggcacag

SEQ ID NO: 30977 - RNA, 45 nt, Mus musculus
cuugccuaccaugaugugggaccucaggcaaagaccaaguuuagg

SEQ ID NO: 30978 - RNA, 42 nt, Mus musculus
gaguccuucgagaauggagaacucugaacagaacagugaccc

SEQ ID NO: 30979 - RNA, 46 nt, Mus musculus
cugcacaucuguggacuccuucucggugugagugucuccaggaaaa

SEQ ID NO: 30980 - RNA, 45 nt, Mus musculus
guggucuuggccucagagacagggaggagauggaggaaccaggga

SEQ ID NO: 30981 - RNA, 46 nt, Mus musculus
uggacauggccccgaaguaugugcuggaacaguuucuacagcagga

SEQ ID NO: 30982 - RNA, 42 nt, Mus musculus
guuccagcacauacuucggggccauguccaccagggacugcu

SEQ ID NO: 30983 - RNA, 42 nt, Mus musculus
aagcugacaguaccauaucccccaaaccccagagcugcugag

SEQ ID NO: 30984 - RNA, 47 nt, Mus musculus
gaccucacggugcugguggcccacaacgaugaccccacagaccagau

SEQ ID NO: 30985 - RNA, 46 nt, Mus musculus
uucauccugggucaccagguagccacggucaugacacagcugcaga

SEQ ID NO: 30986 - RNA, 46 nt, Mus musculus
ucugcacaguagauauuuacauuacaauucauaacagucacaaaau

SEQ ID NO: 30987 - RNA, 45 nt, Mus musculus
aagguuaagaugaucuggggugucagauacauucuugcccaaucc

SEQ ID NO: 30988 - RNA, 82 nt, Mus musculus
acccuggauacggugacccgacuccgaaccccgcccccacccgcgauccuccaaguucccaguagcccaccauggugccugc

SEQ ID NO: 30989 - RNA, 46 nt, Mus musculus; identical to SEQ ID NO: 29888

SEQ ID NO: 30990 - RNA, 42 nt, Mus musculus; identical to SEQ ID NO: 29889

SEQ ID NO: 30991 - RNA, 45 nt, Mus musculus
guggugcacaccuuuaaucccagcacuuuagcagggcaggcagau

SEQ ID NO: 30992 - RNA, 42 nt, Mus musculus
cacuggcuguccuuaaagagcacucaaacucagcccccaggc

SEQ ID NO: 30993 - RNA, 41 nt, Mus musculus
cugcgcaggauccccaauggagaggccaacgucaagaagua

SEQ ID NO: 30994 - RNA, 45 nt, Mus musculus
guuguuuuuuguuuuuguuuuguuuuguuguuuuuuucgagacag

SEQ ID NO: 30995 - RNA, 42 nt, Mus musculus
cugugaggccacccugugugcccacacccugagugcccacac

SEQ ID NO: 30996 - RNA, 46 nt, Mus musculus
aaccagaagagggcaucagaucuccugaaacuagaguucuggguag

SEQ ID NO: 30997 - RNA, 46 nt, Mus musculus
aaacucauaaucccccugcuuuagccuccuggguuuuggguugcag

SEQ ID NO: 30998 - RNA, 56 nt, Mus musculus
cuugucuucuugcugucaccuagcaccugacugaggccacugaggaaggaagcgau

SEQ ID NO: 30999 - RNA, 45 nt, Mus musculus
ugucagagcugucuaugcaguucagccccccagccuucguugcau

SEQ ID NO: 31000 - RNA, 45 nt, Mus musculus
guccaggcaucuuagaguugguuucccaagaaccccaagcccaag

SEQ ID NO: 31001 - RNA, 42 nt, Mus musculus
gccggccaagagguucuccauccgacagauuaggcagcacag

SEQ ID NO: 31002 - RNA, 23 nt, Mus musculus
cguaccuaucccaccaagcccag

SEQ ID NO: 31003 - RNA, 42 nt, Mus musculus
ggcaccgccaacccugcgcgcaaggugugcuccagcaacaag

SEQ ID NO: 31004 - RNA, 46 nt, Mus musculus
cucgcugucuuuggguugguuucuuuuuuuuuaauaaaacaggugg

SEQ ID NO: 31005 - RNA, 46 nt, Mus musculus
cagagcaaacaaauaugcagagacauuuaugauuaaccagacaaca

SEQ ID NO: 31006 - RNA, 45 nt, Mus musculus
ucccuacuucccacaccagcgugagcaugcaaaccccuuucccau

SEQ ID NO: 31007 - RNA, 42 nt, Mus musculus
ugugugugugugugugugugugcgcgcgcgcguguguaucug

SEQ ID NO: 31008 - RNA, 44 nt, Mus musculus
cgaagcuagaguccacugacuuuuccgccaccauguugcccgcc

SEQ ID NO: 31009 - RNA, 87 nt, Mus musculus
ccgccgccgggcccggacagauguccuucaccuuugccuccccgacgcagguacgaacucacaucccccagacucgucaagccccug

SEQ ID NO: 31010 - RNA, 42 nt, Mus musculus
uucggaagugcucuuacccacugagccaucucuccagcccug

SEQ ID NO: 31011 - RNA, 46 nt, Mus musculus
uaaguacuuuggugaguguggcccaggaugcauagacguucagguu

SEQ ID NO: 31012 - RNA, 70 nt, Mus musculus
gucaggugcggcggacgaggcagcacgggcugagauccagauccguauugaggccaaugaagcccuagug

SEQ ID NO: 31013 - RNA, 45 nt, Mus musculus
gguaccuacugucugacacccacggggaaacugagccagguccag

SEQ ID NO: 31014 - RNA, 49 nt, Mus musculus
ucuggagagauggccuugauugccccucaaagccaccugaaccgucguc

SEQ ID NO: 31015 - RNA, 42 nt, Mus musculus
ggaggguccguugagaaccuuuauacuuagcaaugcagagaa

SEQ ID NO: 31016 - RNA, 45 nt, Mus musculus
uaccccacguggcagcgagacccucccuuucucuccgccccgucc

SEQ ID NO: 31017 - RNA, 28 nt, Mus musculus
gaggccagcuuccaccgugggcacgagc

SEQ ID NO: 31018 - RNA, 71 nt, Mus musculus
acgacugugucacuguacuggaaaagcuagaggcugcuaaagaggagggcccuguuguggccaagaauccg

SEQ ID NO: 31019 - RNA, 28 nt, Mus musculus
gggugucgcugggggcugugggggggac

SEQ ID NO: 31020 - RNA, 41 nt, Mus musculus
cuguccuggcaguugggguguagugugccugcaggaagaga

SEQ ID NO: 31021 - RNA, 84 nt, Mus musculus
ccaugguaagggaauagagugggcaugugaccagggaugcgggguagacaaucggggagcuaaaaaagaaucagaaaggcuggu

SEQ ID NO: 31022 - RNA, 60 nt, Mus musculus
aucuacauugaguuaaaaaccugaauuggguuauggaaggggguggggagagcuaggcag

SEQ ID NO: 31023 - RNA, 46 nt, Mus musculus
uaugggugggcuccugccugaggccuccaaucucagcccaguggac

SEQ ID NO: 31024 - RNA, 42 nt, Mus musculus
gaggaaaugggcgggagggcacgugauucaggcugccgacug

SEQ ID NO: 31025 - RNA, 45 nt, Mus musculus
cccaagugcuaggauuaaaggcgugcgcuaccaccgcccggccga

SEQ ID NO: 31026 - RNA, 48 nt, Mus musculus
ccucucaggacagcgaggaagagacugucuuugaaaccaggaaucuga

SEQ ID NO: 31027 - RNA, 46 nt, Mus musculus
aggcccuagggggcagcauagagaccucauugagacuagcccacag

SEQ ID NO: 31028 - RNA, 44 nt, Mus musculus
gccaggaauuggggugauucccagaguuccugaagugacuccca

SEQ ID NO: 31029 - RNA, 33 nt, Mus musculus
ucuugucgaccccaugucccaugacccuggaag

SEQ ID NO: 31030 - RNA, 42 nt, Mus musculus
cauuguguuugggguuuuaacacaugguuaggaguucugugg

SEQ ID NO: 31031 - RNA, 45 nt, Mus musculus
guauggaagagacucagguccccuuacccucccuuugaccccaug

SEQ ID NO: 31032 - RNA, 24 nt, Mus musculus
cgagcuggcgcugcggggaccuug

SEQ ID NO: 31033 - RNA, 105 nt, Mus musculus
gcaaauguagaacaggcuguucagaagcagcugacuuggguccugggguagagaagugagacaugggagauagagggaaaggugacuuacaagggaaguuaggua

SEQ ID NO: 31034 - RNA, 46 nt, Mus musculus
caaaucccagcaaccacauggugucucacagccaucuguaugagau

SEQ ID NO: 31035 - RNA, 45 nt, Mus musculus
ucccuguggccuaugaccuucggccuggcgugcugugccguggag

SEQ ID NO: 31036 - RNA, 82 nt, Mus musculus
ccagcuacaaucaucacaucagccuggcgcggacuggcacggaacaccacaccgaagcgguccaugucauagcgcggcgcag

SEQ ID NO: 31037 - RNA, 46 nt, Mus musculus
cccauggacaccacauagcgggguucgggcaucuggucguacaccu

SEQ ID NO: 31038 - RNA, 46 nt, Mus musculus
aggaugaacaaguuacugcagcugaagagaaagacugaggagaggg

SEQ ID NO: 31039 - RNA, 45 nt, Mus musculus
guucguggcugugaccgcauugugccaguggacaucuaugugcca

SEQ ID NO: 31040 - RNA, 42 nt, Mus musculus
accuggcacauagauguccacuggcacaaugcggucacagcc

SEQ ID NO: 31041 - RNA, 46 nt, Mus musculus
gcccacggccgaagcacuccuuuauggcaucuugcagcugcaacgg

SEQ ID NO: 31042 - RNA, 50 nt, Mus musculus
uugcagcugcaagaugccauaaaggagugcuucggccgugggcgggcagc

SEQ ID NO: 31043 - RNA, 77 nt, Mus musculus
aacuccuacgcaccccuuacagaccugcgccgaggucccuaccccgucucgcuuucccuccucccggaaccucggag

SEQ ID NO: 31044 - RNA, 46 nt, Mus musculus
aucaucugccccuucccugucuccaagccauccauagccccauguc

SEQ ID NO: 31045 - RNA, 42 nt, Mus musculus
caggcuagauaccccagugcccaaaaccaugcaugcacagau

SEQ ID NO: 31046 - RNA, 47 nt, Mus musculus
ucugugcaugcaugguuuugggcacugggguaucuagccuggggcag

SEQ ID NO: 31047 - RNA, 42 nt, Mus musculus
aguagacgggcaauaguagguguacagcuauggggggagugu

SEQ ID NO: 31048 - RNA, 45 nt, Mus musculus
cacaccugauggccacgagcguggagcgcgugcccauggggcugg

SEQ ID NO: 31049 - RNA, 25 nt, Mus musculus
aggcggguuugggggggggcgggca

SEQ ID NO: 31050 - RNA, 45 nt, Mus musculus
cuguguggccaggucuuguggagugggacuugcuuggggacuggg

SEQ ID NO: 31051 - RNA, 42 nt, Mus musculus
ccgcaacacauacacaucuauagcgccagcuggggcccggag

SEQ ID NO: 31052 - RNA, 42 nt, Mus musculus
gggccucaggccuuggggugggagaggagggaccgggcagga

SEQ ID NO: 31053 - RNA, 46 nt, Mus musculus
ccagccacccaagccauucauaucuuuuccuaguguaccccuacuu

SEQ ID NO: 31054 - RNA, 42 nt, Mus musculus
cagcgaacuccucugcgucuaccgcagccccuggcccacccu

SEQ ID NO: 31055 - RNA, 46 nt, Mus musculus
cccaguacaacccuggcguccuccacccuagacacuguccccucgg

SEQ ID NO: 31056 - RNA, 45 nt, Mus musculus
aggggacagugucuaggguggaggacgccaggguuguacugggca

SEQ ID NO: 31057 - RNA, 45 nt, Mus musculus
ccgugcacgggaagagauugaggcucacaucacgcugcgcacagg

SEQ ID NO: 31058 - RNA, 44 nt, Mus musculus
accaaucaugaaucacuaaaaugccccauagucaugcccacagg

SEQ ID NO: 31059 - RNA, 45 nt, Mus musculus
caucccugggcaagguggcccuggguucucaaagaaagcaggcag

SEQ ID NO: 31060 - RNA, 71 nt, Mus musculus
accggcacacacucggucauguucacgcuuuucuugcgacucccgaucacguucaacugcucagccagcag

SEQ ID NO: 31061 - RNA, 41 nt, Mus musculus
gcgaagcuggcgaacacgucugggggugauggccgggggcu

SEQ ID NO: 31062 - RNA, 45 nt, Mus musculus
cuuggcagcucuccuugucagggaggguccccuuucaaagagagg

SEQ ID NO: 31063 - RNA, 44 nt, Mus musculus
agcucauaaaauacaguuccugagcuccaaaaauugcaggcaag

SEQ ID NO: 31064 - RNA, 46 nt, Mus musculus
cuggguuaccuggaaacugguauuuuaaaauaaauaaaagcugguu

SEQ ID NO: 31065 - RNA, 41 nt, Mus musculus
aaccauugaagggugaugaacgcagggcaggcaggacaagg

SEQ ID NO: 31066 - RNA, 78 nt, Mus musculus
ggugccuggggcuuagccuccuuacucccacuggguuagggucccugaguuuggccuuuguggcauugcgucucagac

SEQ ID NO: 31067 - RNA, 42 nt, Mus musculus
cccccacauccccgcucaccuuggguguggugcugggcagau

SEQ ID NO: 31068 - RNA, 45 nt, Mus musculus
acagccaggacagagaaacccugucucgaaaaacuaaaaugagag

SEQ ID NO: 31069 - RNA, 41 nt, Mus musculus
acugaaguguugccuuuaaucucaagggcgggguugucuca

SEQ ID NO: 31070 - RNA, 42 nt, Mus musculus
aaugaugguccccuaaaagccccaggcccuaggcgccgguug

SEQ ID NO: 31071 - RNA, 47 nt, Mus musculus
augucauccacaccuuuaugccuagugcuccgagguggaggcaggaa

SEQ ID NO: 31072 - RNA, 46 nt, Mus musculus
uugcagagcagggcagugauggccaugccuuugaucccagcacuug

SEQ ID NO: 31073 - RNA, 46 nt, Mus musculus
accuugucuugaaaaagaaaaaaacagggcugaagagauggcucag

SEQ ID NO: 31074 - RNA, 42 nt, Mus musculus
gcgucagaggucccucuucucuccucauggaagcaaagagaa

SEQ ID NO: 31075 - RNA, 46 nt, Mus musculus
guaccaggugagggcucugcuuuuagggcagcaguguuggggagug

SEQ ID NO: 31076 - RNA, 42 nt, Mus musculus
ccgggcgcuggaagauccaccugacggagcgugcugacuucc

SEQ ID NO: 31077 - RNA, 46 nt, Mus musculus
agcgagggccaagccuuugacacggaaugauagcggcggcugagau

SEQ ID NO: 31078 - RNA, 52 nt, Mus musculus
agaaauuacacaccugauaagauguguggcuaggcaugaggucugugacuag

SEQ ID NO: 31079 - RNA, 46 nt, Mus musculus
aucaggcccggugggcgggacaugucuaagcggggcgggaccagag

SEQ ID NO: 31080 - RNA, 41 nt, Mus musculus
gaggugaggagcgggguauggggaguggggagagggaugga

SEQ ID NO: 31081 - RNA, 45 nt, Mus musculus
cuguugacauucccaugugaagagagauauaucacgcugcugacg

SEQ ID NO: 31082 - RNA, 46 nt, Mus musculus
aagcccaagaagaaggagaagaagaccaaagagagagagagagaga

SEQ ID NO: 31083 - RNA, 45 nt, Mus musculus
ggucaagcauguccagaagcugcaagcaaaaggugugccgguggc

SEQ ID NO: 31084 - RNA, 29 nt, Mus musculus
cuuuugggaccaucuuugucuguucuaga

SEQ ID NO: 31085 - RNA, 83 nt, Mus musculus
agcagggacuggguguggaugggccugagagucuggguaggagguggugugggugggcagggcucuacugcuauguggaagag

SEQ ID NO: 31086 - RNA, 64 nt, Mus musculus
cccuuuguggaacucaugguucuuaguuucccacuugugcauaguaagagcaggugccccaggg

SEQ ID NO: 31087 - RNA, 42 nt, Mus musculus
ucaguguucuuaaccgcugagccaucucuccagcccugcuau

SEQ ID NO: 31088 - RNA, 42 nt, Mus musculus
gaucugcggggaguucucagagugagucggggcagcccuugg

SEQ ID NO: 31089 - RNA, 42 nt, Mus musculus
cuucacaccacaaucucucaggaaagcaucucugggccaucu

SEQ ID NO: 31090 - RNA, 46 nt, Mus musculus
uccccagagcaaaggcugcaguuaccugcccaaccuguccccagau

SEQ ID NO: 31091 - RNA, 46 nt, Mus musculus
cugguaggaaggauugccauggaggcaaugugcaacacaccuagag

SEQ ID NO: 31092 - RNA, 45 nt, Mus musculus
cuccuccagcagaacuaagcugagauagcuacgucaaccacagau

SEQ ID NO: 31093 - RNA, 45 nt, Mus musculus
ugugaacaccguaauugcuggugaguguacugacugcccugcuag

SEQ ID NO: 31094 - RNA, 35 nt, Mus musculus
uccacugggacucuccaugcgcauccaccccuuug

SEQ ID NO: 31095 - RNA, 41 nt, Mus musculus
cagaaaggcucucagaguggcugcuguguagcugggguaau

SEQ ID NO: 31096 - RNA, 91 nt, Mus musculus
ggugugagugugagggagggagugugugagaaagugugagggagggaguguaagggaggaaguguuggaguggaagugugagggagugaau

SEQ ID NO: 31097 - RNA, 46 nt, Mus musculus
ggcagggcuccaccccuaaggaacuuucucugaaccacauccaguu

SEQ ID NO: 31098 - RNA, 46 nt, Mus musculus
aggugugccuaucagacuugguuguugagucacuuuggguuguguu

SEQ ID NO: 31099 - RNA, 42 nt, Mus musculus
cagggaccgagccuggcacagcuccccuauccauugccagau

SEQ ID NO: 31100 - RNA, 45 nt, Mus musculus
ccagcuacgaauacaugcgacagagccucaucuucuacaggaaug

SEQ ID NO: 31101 - RNA, 44 nt, Mus musculus
uucgucgaagaccucagcaggaaauaucacuuugaaugcuguag

SEQ ID NO: 31102 - RNA, 41 nt, Mus musculus
uucccaacugagagaggugcagucugcgaacguggggugua

SEQ ID NO: 31103 - RNA, 42 nt, Mus musculus
gcgcagccccucggagcccuguugcuggagcgcugcagagug

SEQ ID NO: 31104 - RNA, 41 nt, Mus musculus
cccgaagccgcagccagcgccacaaaagucucagagagcga

SEQ ID NO: 31105 - RNA, 42 nt, Mus musculus
cugcuccgguggacaggagcaguggucgccagggccccgauu

SEQ ID NO: 31106 - RNA, 103 nt, Mus musculus
cccugaagcacccaggccugcaucauggacuuucagcacagaccuggaggcaagacugggagugggggcguagccuccuccucugagagcaaccgggaucgga

SEQ ID NO: 31107 - RNA, 46 nt, Mus musculus
ugaugccaauagugcugugcauguuuuacagauugacuacccugag

SEQ ID NO: 31108 - RNA, 46 nt, Mus musculus
gaauggacugccuccucgcccaccacucccugaugccuugccccca

SEQ ID NO: 31109 - RNA, 42 nt, Mus musculus
gaguccaucccccagcuccugggguacaccccccagcaccag

SEQ ID NO: 31110 - RNA, 45 nt, Mus musculus
augccccccaugcugaggcccccacuccccucagauggcccuggg

SEQ ID NO: 31111 - RNA, 42 nt, Mus musculus
ccacaccuuggaucagggucccucaggccuacauggccccag

SEQ ID NO: 31112 - RNA, 42 nt, Mus musculus
cagacugucccuggagccugaggcccugccacacagcgccga

SEQ ID NO: 31113 - RNA, 46 nt, Mus musculus
caaacacuucgccaccugacauuagaacuagcucacauauccgaga

SEQ ID NO: 31114 - RNA, 46 nt, Mus musculus
caugguauuuuuuuaaagaauauuuauuuuuuuacaucggucagua

SEQ ID NO: 31115 - RNA, 46 nt, Mus musculus
uccucuccuggaguugauggcaccugaaaccagggauggcccagcu

SEQ ID NO: 31116 - RNA, 46 nt, Mus musculus
ccuguguccuaagagccaccacauccugacaggcuagugggcccca

SEQ ID NO: 31117 - RNA, 46 nt, Mus musculus
uucaguuguuuucuuugaagccuuucaaaucaaaucaaauucagaa

SEQ ID NO: 31118 - RNA, 45 nt, Mus musculus
gucuauggccaggaggcacaagaccacgcugucggggucccugca

SEQ ID NO: 31119 - RNA, 42 nt, Mus musculus
gaccagccagcccagcuauguugacaaacacgggacccaggu

SEQ ID NO: 31120 - RNA, 46 nt, Mus musculus
uaugacaguucuguuggagggagaaaaagaaggguuuagugggagu

SEQ ID NO: 31121 - RNA, 45 nt, Mus musculus
ggucucagaggagggaaggagucuugagagaggggcuuggucacg

SEQ ID NO: 31122 - RNA, 42 nt, Mus musculus
cauguccacauucaggcaagaggauguugaggaccauuauga

SEQ ID NO: 31123 - RNA, 46 nt, Mus musculus
ccaagugagcaggcauggugggcauggcugcugucccagcaacgag

SEQ ID NO: 31124 - RNA, 44 nt, Mus musculus
ccuggccagacucuuugucucauucuaaaaacaaaagaaccaac

SEQ ID NO: 31125 - RNA, 45 nt, Mus musculus
ugcugagauguuugcuguuuucaggagcuuugcucuauaggguag

SEQ ID NO: 31126 - RNA, 41 nt, Mus musculus
gaggcuggcagcgaguucaagaacaucuuuggcacacccga

SEQ ID NO: 31127 - RNA, 45 nt, Mus musculus
acagccucaccugccccaacaauccugucucccacagcccccgag

SEQ ID NO: 31128 - RNA, 43 nt, Mus musculus
ggcauugucaccaagcuggaagaugagggcucugaguguggau

SEQ ID NO: 31129 - RNA, 42 nt, Mus musculus
cagggggcagggugugggguggggucccaggaggggcaggac

SEQ ID NO: 31130 - RNA, 46 nt, Mus musculus
cgggguugguuuggguaggacaggaucaggggugacggggucaggu

SEQ ID NO: 31131 - RNA, 42 nt, Mus musculus
cacugggcccuucacaguugagcaguguggcugugcggggga

SEQ ID NO: 31132 - RNA, 42 nt, Mus musculus
gggagcaggagcuggaguugcugcagcgggagaaggaggcag

SEQ ID NO: 31133 - RNA, 42 nt, Mus musculus
gagcuaagcccaucgaccuccuggccaaguacaucagcgcag

SEQ ID NO: 31134 - RNA, 45 nt, Mus musculus
ugagcgccgugagggagucaaugccucagucagcuccgaugugca

SEQ ID NO: 31135 - RNA, 46 nt, Mus musculus
caaccgcgugcacacgggcuucgaguggaacaaauauaaccagacg

SEQ ID NO: 31136 - RNA, 61 nt, Mus musculus
ugugugggagucuccaguccugggcccagccccuugccccaacgccacuccagaucccagg

SEQ ID NO: 31137 - RNA, 46 nt, Mus musculus
ccaaaugcugggacuaaagguguguaccaccacugccggcuucaac

SEQ ID NO: 31138 - RNA, 46 nt, Mus musculus
uugucaggagcuccucaggggaggauagccagacauguccccagac

SEQ ID NO: 31139 - RNA, 42 nt, Mus musculus
uggggcauaugggcggggccuagucuagugguaggucggcag

SEQ ID NO: 31140 - RNA, 44 nt, Mus musculus
ccacuacaaaggccccgugcuggcccggagucuugccucccgca

SEQ ID NO: 31141 - RNA, 41 nt, Mus musculus
ggguggggacggaggacgaggugaguugguccuggggccug

SEQ ID NO: 31142 - RNA, 46 nt, Mus musculus
gaggacuuccacagggcgacaaccacaggagaggacggacacaggg

SEQ ID NO: 31143 - RNA, 52 nt, Mus musculus
agagggaacaggacuggcccacggauggcagucagcggagaggauaggauau

SEQ ID NO: 31144 - RNA, 42 nt, Mus musculus
ggcugaggaauagaaaguugauugguaaugucugucccaguu

SEQ ID NO: 31145 - RNA, 46 nt, Mus musculus
ucugugugcccucaguguuugcugaauaaacgaacugcccaaagua

SEQ ID NO: 31146 - RNA, 41 nt, Mus musculus
aggccaugaaugggaagggcugguauacaggucagggugca

SEQ ID NO: 31147 - RNA, 35 nt, Mus musculus
ccugugucaaugcacugcaguggcugaccugucag

SEQ ID NO: 31148 - RNA, 42 nt, Mus musculus
gcucugucuuccuccuccuguggggaauggagcuggccccag

SEQ ID NO: 31149 - RNA, 46 nt, Mus musculus
ccagcaccuugaagggaaucuuagagaucuugcgugugggcuuccg

SEQ ID NO: 31150 - RNA, 46 nt, Mus musculus
cauaguccugguccauggcgagugggcaggcgggcaaggcccgcag

SEQ ID NO: 31151 - RNA, 46 nt, Mus musculus
ucaauucccagcaaccauaugguggcucacaaccauccguaacaag

SEQ ID NO: 31152 - RNA, 45 nt, Mus musculus
aucuggcgccuucuucuggagugucugaggacagcuacaguguac

SEQ ID NO: 31153 - RNA, 47 nt, Mus musculus
uucaaaacccagcaaccacaugguggcucacaaccacccauaaugag

SEQ ID NO: 31154 - RNA, 42 nt, Mus musculus
gugucaggcuuacagcuggagacaagugaaguugguggggug

SEQ ID NO: 31155 - RNA, 44 nt, Mus musculus
gaaggaccuggacuugcauuugaagacacagaguggagguucag

SEQ ID NO: 31156 - RNA, 46 nt, Mus musculus
caugagacagaaugcucuaaauuuaagggaacauagcucaaaagaa

SEQ ID NO: 31157 - RNA, 45 nt, Mus musculus
ucugacucaggaccucaccugaauugggugguuuugguggaagua

SEQ ID NO: 31158 - RNA, 42 nt, Mus musculus
cugggaugugggguucaggaucaggccgcacuggagccccag

SEQ ID NO: 31159 - RNA, 41 nt, Mus musculus
uggcugcauugcgagagcacauugaggacccugagcaggug

SEQ ID NO: 31160 - RNA, 24 nt, Mus musculus
gcagggaguacaagccagccccag

SEQ ID NO: 31161 - RNA, 41 nt, Mus musculus
cucuucagcaucucauuucccauuaggagaaacuaaggcaa

SEQ ID NO: 31162 - RNA, 45 nt, Mus musculus
uggaaaagggcaguggccuuagcuuacagcguugagaggggagaa

SEQ ID NO: 31163 - RNA, 42 nt, Mus musculus
uggaaauacagcugagcccugugaaccugagaggguccugag

SEQ ID NO: 31164 - RNA, 36 nt, Mus musculus
aaagaaaaagaaagaaaaaaagaaaaaaaaaaaaaa

SEQ ID NO: 31165 - RNA, 46 nt, Mus musculus
cuuggagugccacucccgcccccagaaucuagagagugagcuuggg

SEQ ID NO: 31166 - RNA, 42 nt, Mus musculus
uggcacugaguacuauuccaaaaccuuauacuuaccaggcau

SEQ ID NO: 31167 - RNA, 42 nt, Mus musculus
cccugccauccauguagcucuguaguguaugggauggcacag

SEQ ID NO: 31168 - RNA, 43 nt, Mus musculus
cuuaaucuccccaccccccacuucaccaacagcaggcccugcc

SEQ ID NO: 31169 - RNA, 45 nt, Mus musculus
gcccuaggggcuggugucccccuuccuggcagagagagagagaga

SEQ ID NO: 31170 - RNA, 45 nt, Mus musculus
aaaguaaccaaggcuccaugacccugagaaccacacaggccacag

SEQ ID NO: 31171 - RNA, 46 nt, Mus musculus
aaagccacccacuccaauguggaggaauucagaggaucuauggaaa

SEQ ID NO: 31172 - RNA, 41 nt, Mus musculus
agucaucgucgcgguccuccggcugccgccggcccggcccu

SEQ ID NO: 31173 - RNA, 42 nt, Mus musculus
ugaccaugcuuggcccagggaguagcacuauuuggaggugug

SEQ ID NO: 31174 - RNA, 42 nt, Mus musculus
ugggugcggggaggagcaggcaguagaauuuggggugcuaag

SEQ ID NO: 31175 - RNA, 42 nt, Mus musculus
guacugagaacuugaaaggcuggccagacugcagcggggucu

SEQ ID NO: 31176 - RNA, 42 nt, Mus musculus
uuuuugcuguucugccuuguucuuugaggcaaggucucaugu

SEQ ID NO: 31177 - RNA, 46 nt, Mus musculus
agcagcuguaaucagccuagcacagcacucuggcaauuagagaggu

SEQ ID NO: 31178 - RNA, 45 nt, Mus musculus
aagcccugaggcagggaugggccuggagugggaggagcagugagu

SEQ ID NO: 31179 - RNA, 57 nt, Mus musculus
gacaugguuugauuccagggaaguaggagcugcagagugauggggacagagucaggg

SEQ ID NO: 31180 - RNA, 42 nt, Mus musculus
gcuauguugggacucuugucuccaaaauagucucaaagaggu

SEQ ID NO: 31181 - RNA, 46 nt, Mus musculus
gguuggaggucaccacaacaugaggaacuguacuaaagggucgcag

SEQ ID NO: 31182 - RNA, 42 nt, Mus musculus
gaccgcagaccugucugucacccuggguaccucgcugcagau

SEQ ID NO: 31183 - RNA, 46 nt, Mus musculus
uggcagagcugcacggaaacauguuuguagaggaaugucccaagug

SEQ ID NO: 31184 - RNA, 45 nt, Mus musculus
ggauuaaaggggugugccgcggcuagccaacagguuuuuuguagu

SEQ ID NO: 31185 - RNA, 46 nt, Mus musculus
ggguucucucuuuguagcccaggcuggccccgaacucacaggaauc

SEQ ID NO: 31186 - RNA, 42 nt, Mus musculus
ccuguaccccacucuguacuccucccugaaucugggccagau

SEQ ID NO: 31187 - RNA, 41 nt, Mus musculus
ccacugcucaggcugggugacacggaggaaccugggucagg

SEQ ID NO: 31188 - RNA, 42 nt, Mus musculus
gaggggggggaggaagcaagagauccagagagccagagagag

SEQ ID NO: 31189 - RNA, 42 nt, Mus musculus
ugaaugaaaacauuagcaaagugcgaauaaugacuguuggag

SEQ ID NO: 31190 - RNA, 46 nt, Mus musculus
cacccagucucaaaaaaacuaagacaguaaaauaauugugaacgag

SEQ ID NO: 31191 - RNA, 46 nt, Mus musculus
gccaucaaaguagggcuauccggagggcuggaacauggguucucag

SEQ ID NO: 31192 - RNA, 45 nt, Mus musculus
gggucugcugugucucaggcuucauggagaauagaaaaugacaua

SEQ ID NO: 31193 - RNA, 45 nt, Mus musculus
ccggcuccugcaaaagaucaggggccuggaacagcacaaggaacg

SEQ ID NO: 31194 - RNA, 41 nt, Mus musculus
cgagagucacgcaugggcuugggccacaggugcagcgugag

SEQ ID NO: 31195 - RNA, 48 nt, Mus musculus
cacuccccauuugauauauugggaacccugauaugccaccuacaucac

SEQ ID NO: 31196 - RNA, 43 nt, Mus musculus
acauugauguggccaaagucaauacccugauaaggcccaacag

SEQ ID NO: 31197 - RNA, 42 nt, Mus musculus
aaagaagauccgaacgucacccaccuuccggcggcccaagac

SEQ ID NO: 31198 - RNA, 43 nt, Mus musculus; identical to SEQ ID NO: 31196

SEQ ID NO: 31199 - RNA, 42 nt, Mus musculus; identical to SEQ ID NO: 31197

SEQ ID NO: 31200 - RNA, 46 nt, Mus musculus
cuugacaaaguugucauugagagcaauaccagccccggcaucaaag

SEQ ID NO: 31201 - RNA, 46 nt, Mus musculus
agggagggcucccuaggccccuccuguuauuaugggggucuagggu

SEQ ID NO: 31202 - RNA, 46 nt, Mus musculus
ggcuuaauuucaaccugaaugugugggguauuauuucagcugugag

SEQ ID NO: 31203 - RNA, 46 nt, Mus musculus
gaaauaagaaaagaagaacaugacugguccugauuuuuggccccag

SEQ ID NO: 31204 - RNA, 32 nt, Mus musculus
cugccgguaguugagcggagagugaggcgaac

SEQ ID NO: 31205 - RNA, 42 nt, Mus musculus
gauuccaaguucgccucacucuccgcucaacuaccggcagau

SEQ ID NO: 31206 - RNA, 46 nt, Mus musculus
cucauguucugucggucucaaacagcacagucuuuauggcaggugu

SEQ ID NO: 31207 - RNA, 59 nt, Mus musculus
gagguacuguuugagacucggucuguuugacacaagcuagaguuagacuguccuguggg

SEQ ID NO: 31208 - RNA, 42 nt, Mus musculus
ggugauuugaacucugggugccugacucaagaaguuucagag

SEQ ID NO: 31209 - RNA, 46 nt, Mus musculus
auauuuuguugaagaauuuggcugcuuuuugccuaugucugaagag

SEQ ID NO: 31210 - RNA, 46 nt, Mus musculus
ccuggucuucagagcaaguuccagguaaagaaaagcuaagguccag

SEQ ID NO: 31211 - RNA, 45 nt, Mus musculus
gcacauucuauucuugauucuaacuuuauuacuucuuucuggcaa

SEQ ID NO: 31212 - RNA, 41 nt, Mus musculus
caaguuccaggacauccagggcuagacagagucugguugga

SEQ ID NO: 31213 - RNA, 42 nt, Mus musculus
caagcugcagguggcaaaaacuugcuuuuccaaagaggugua

SEQ ID NO: 31214 - RNA, 46 nt, Mus musculus
cacauuccaagcacaguucucuuuuugaagaaacuaaugucacaag

SEQ ID NO: 31215 - RNA, 45 nt, Mus musculus
gggucugggacacacacugugguaguuugaguaugcuuggccaau

SEQ ID NO: 31216 - RNA, 46 nt, Mus musculus
caacucaccgaagaagcaacugaaguggacacaacagcagcaccuu

SEQ ID NO: 31217 - RNA, 46 nt, Mus musculus
acauccuuuaaauggggaguuaccuguguuguaguaaggaaagcag

SEQ ID NO: 31218 - RNA, 39 nt, Mus musculus
aaguguuccccaccacuacccagaaucaaggaaaugucu

SEQ ID NO: 31219 - RNA, 46 nt, Mus musculus
ugguucacucucauuaagaaaccauuuugcaaaggagcaagaugag

SEQ ID NO: 31220 - RNA, 44 nt, Mus musculus
aggagacagaggcaugcaucucuuugaguucaaggacaguuugg

SEQ ID NO: 31221 - RNA, 42 nt, Mus musculus
gugguuacugaauaucccuuccugucuaaagaaagcccugag

SEQ ID NO: 31222 - RNA, 102 nt, Mus musculus
acaaaaaauguaugauacaugaagauuucacgucaguugcaggucccuggugucuacguaagugaaguggagcuggaaaauacuuacaauguaaacaguaug

SEQ ID NO: 31223 - RNA, 137 nt, Mus musculus
aaggaagaauucugggugccuugguacauuccagacuggccuaguagauaacguuuucuuagcacuuuuuaccaauagaauagaguuuauuuagggauugagaagggaguagagacagagagggaguagaggagaug

SEQ ID NO: 31224 - RNA, 68 nt, Mus musculus
cgugccaggaacacauuugggggggggagaggaaaaggagagagaaaaauaggggugauggaaaaaag

SEQ ID NO: 31225 - RNA, 92 nt, Mus musculus
gcaaaccaggccuaccugccuauugucagguaacugcugggcagaguguagaaggaaugccaauauuacucuguuuugguuuuauugaaaaa

SEQ ID NO: 31226 - RNA, 46 nt, Mus musculus
uagaguaucuguggguugcuucucuggagcuguccuggauguauau

SEQ ID NO: 31227 - RNA, 46 nt, Mus musculus
cagguguacuuaacuagauggagucuguuugguccaugaaagguag

SEQ ID NO: 31228 - RNA, 46 nt, Mus musculus
aagucgcaguuauauucaaauacaugaaagaauucauacuggggag

SEQ ID NO: 31229 - RNA, 45 nt, Mus musculus
acuuguucguaacacuuucuaagaaacacaaaugaacggccgaga

SEQ ID NO: 31230 - RNA, 45 nt, Mus musculus
cuggcuuccuuggacaucugguaugcaaagauuguaaaggcacac

SEQ ID NO: 31231 - RNA, 46 nt, Mus musculus
agugaguucuaggacagcaaagacuacuguuucaaaaagccaagag

SEQ ID NO: 31232 - RNA, 46 nt, Mus musculus
uacgaggaccuucauaacccagccgcagaggcaggugcauacauag

SEQ ID NO: 31233 - RNA, 46 nt, Mus musculus
agacauaaggaaguggccaaauaaggagauggaccccggugacuag

SEQ ID NO: 31234 - RNA, 45 nt, Mus musculus
aagcccguaguguccagcacaccucuaguggacuucuugaugcag

SEQ ID NO: 31235 - RNA, 42 nt, Mus musculus
uaauucggcucaucucacuagcugcccagaaauucaucucag

SEQ ID NO: 31236 - RNA, 47 nt, Mus musculus
caccugagccacgcaacccagauguauuugucuuucccucugucccc

SEQ ID NO: 31237 - RNA, 44 nt, Mus musculus
ccggcaguaaagagccccgaagaggccgaagggaagaggugagg

SEQ ID NO: 31238 - RNA, 45 nt, Mus musculus
acgaucaacucaccaaauauuagcucagaaaaagguuccugauag

SEQ ID NO: 31239 - RNA, 46 nt, Mus musculus
ucugccuccuugggaugucaaaggggcugcaggagcaccagcccuc

SEQ ID NO: 31240 - RNA, 45 nt, Mus musculus
ugcuuucauuuccccauauggggguuacccauaaaaccaaaccgg

SEQ ID NO: 31241 - RNA, 45 nt, Mus musculus
cauggucgcuuucuguuccuaugaucuuagccaggggacauugga

SEQ ID NO: 31242 - RNA, 54 nt, Mus musculus
gaacuguuugaaguguagaggucuuucugggaugaggcuuagagcugaugagca

SEQ ID NO: 31243 - RNA, 46 nt, Mus musculus
uaggauuguagaacuuugagcuguuaaaagcacuaaguguucagag

SEQ ID NO: 31244 - RNA, 47 nt, Mus musculus
acgcagacaucuucuucggacuccgagcuguccccagaacugucccg

SEQ ID NO: 31245 - RNA, 46 nt, Mus musculus
caccuggguucaugauucuuugugacacguaaggacaacagcugau

SEQ ID NO: 31246 - RNA, 42 nt, Mus musculus
gccaaaugcugacuucaggagaccagaauaccaaccugggcu

SEQ ID NO: 31247 - RNA, 29 nt, Mus musculus
cugaccacguuuuuuggaugcaccuagga

SEQ ID NO: 31248 - RNA, 48 nt, Mus musculus
guuuacuaacuuuaaaaaguaguaggaaaacuacaagaaaugcaguuu

SEQ ID NO: 31249 - RNA, 41 nt, Mus musculus
aggaguacacaucucagcugagaagaauugaggacgcccua

SEQ ID NO: 31250 - RNA, 46 nt, Mus musculus
augcuuguguguguguguguguguguguguguguguguguucguuc

SEQ ID NO: 31251 - RNA, 45 nt, Mus musculus
uuuuucucuuuaguguaaaagucuaguguauuuaguacuguguga

SEQ ID NO: 31252 - RNA, 46 nt, Mus musculus
cagauuccagcaugguggaaggugacugccaaauucaaauggggag

SEQ ID NO: 31253 - RNA, 64 nt, Mus musculus
auucauggcugagcuuuuaaaauuuuuucaucaaaauuacacauaauuuauaggcucuggaacc

SEQ ID NO: 31254 - RNA, 92 nt, Mus musculus
ugucuucugagagugaaccauuuacuuagcaugagguuacaguguaggagaucauaacucguaaaugaucuaugaggaauuuuuggggaaua

SEQ ID NO: 31255 - RNA, 50 nt, Mus musculus
uggauaguuuauaaucuuuuuuaaauguaaagaugauuuuuguggagacg

SEQ ID NO: 31256 - RNA, 46 nt, Mus musculus
cacccucaugguggcucacaacugucuauaacucgauuuccaagag

SEQ ID NO: 31257 - RNA, 47 nt, Mus musculus
ugcaugugcacgcaagcacagacacacacacagacacacacacagac

SEQ ID NO: 31258 - RNA, 45 nt, Mus musculus
cauuuccucaucuaggaacagaagaaaaaugguuauguuugugag

SEQ ID NO: 31259 - RNA, 46 nt, Mus musculus
uauauauauauguauuucuuuaaagaauuauuuauugucuguauau

SEQ ID NO: 31260 - RNA, 46 nt, Mus musculus
caguagacucagaaaauggugaaaucaugaaaugcaggagcagcag

SEQ ID NO: 31261 - RNA, 45 nt, Mus musculus
gguugcugaaaucuguccaucacaacccuucaaaauuugggauuc

SEQ ID NO: 31262 - RNA, 45 nt, Mus musculus
cuugaaacuuauuuucaguuugcaauguaaauuuuaauaaaggua

SEQ ID NO: 31263 - RNA, 46 nt, Mus musculus
cugcaugcauggcaaauucuaguucuaagcaucucuccagucccca

SEQ ID NO: 31264 - RNA, 33 nt, Mus musculus
acuauuuuguguguguauguguguuuggugugu

SEQ ID NO: 31265 - RNA, 46 nt, Mus musculus
aaucuaguaaguggagauugaauguuuucuuuuccaagaccccuua

SEQ ID NO: 31266 - RNA, 46 nt, Mus musculus
cagauuuaguuaaugugugacuuauacugugugacugaggcagggg

SEQ ID NO: 31267 - RNA, 48 nt, Mus musculus
aaccaaacaagugaaagacuuauacaauaaaaauguugagagugaaga

SEQ ID NO: 31268 - RNA, 45 nt, Mus musculus
gaugguuaaaauaauccugaauaauaaaagaacugccagacauau

SEQ ID NO: 31269 - RNA, 70 nt, Mus musculus
aacuacuuugggauuucaucuaaucccauucagaauggccaagauauaaaacagaagauggcuguugagg

SEQ ID NO: 31270 - RNA, 61 nt, Mus musculus
ggagugcaaacauguacagccaaucagugugguuccucaggaagucaggaaucagucaacc

SEQ ID NO: 31271 - RNA, 45 nt, Mus musculus
gguuuuugugggcuuuuguuuguuguuuuguauuuauuugaguag

SEQ ID NO: 31272 - RNA, 45 nt, Mus musculus
uugaacuucucaagguaagucagugcuguuuuccuuugccaccag

SEQ ID NO: 31273 - RNA, 42 nt, Mus musculus
cuucaaguagucaugaagaagcuggaucuuaucagcgagcuu

SEQ ID NO: 31274 - RNA, 46 nt, Mus musculus
uugugaguuccagucacugacccuuucucaagaaaacucaaaccag

SEQ ID NO: 31275 - RNA, 45 nt, Mus musculus
cagcguuaugguuugguuaugacagaggcacaucuuccuagccag

SEQ ID NO: 31276 - RNA, 46 nt, Mus musculus
uuuauguguguaucugcaccauguuaguaccuggugcaugcagagg

SEQ ID NO: 31277 - RNA, 46 nt, Mus musculus
uccaacaccagguucucuguaagaacaaguacucuuuacugcugag

SEQ ID NO: 31278 - RNA, 46 nt, Mus musculus
auuuuuuaaagaaagguuuuguuauauaaaccucauauuugucgag

SEQ ID NO: 31279 - RNA, 50 nt, Mus musculus
agacauauacaaagcuggauuugaaauggguuaguacguggaauuuacug

SEQ ID NO: 31280 - RNA, 47 nt, Mus musculus
gauguccuggaaauuaugagaaacauucacauauuugucucaagaua

SEQ ID NO: 31281 - RNA, 45 nt, Mus musculus
uaauauucgacacauugcuaauucgauucgaacacaugggacggg

SEQ ID NO: 31282 - RNA, 95 nt, Mus musculus
ugaguauuucagccauuuagaaaguauauaagagaauucuagaaauuucuaugacuugggagaucaaauaaacuauuugaacauuucagcuccag

SEQ ID NO: 31283 - RNA, 50 nt, Mus musculus
uucacguaccaguuuuugaaaaagaaguucuauauauuuagucaguuuau

SEQ ID NO: 31284 - RNA, 77 nt, Mus musculus
guaugaugagcauaucaaauccagauugauuaaagauauucgguuuuucagggagaucaaggaccaaaaugaccaca

SEQ ID NO: 31285 - RNA, 46 nt, Mus musculus
gcagaaaaauucaaucguggcauaagaaaacuuggaaucacaccag

SEQ ID NO: 31286 - RNA, 45 nt, Mus musculus
ucuuggaguaugugaauaccucuaccugacuccagcccacuuacu

SEQ ID NO: 31287 - RNA, 45 nt, Mus musculus
aacucagaggucauaugcaguggauccuuauuuuagcuggggaga

SEQ ID NO: 31288 - RNA, 74 nt, Mus musculus
gaagagcugguguaauuguccauugauucuguaugagaugugaaagagaggaaggagccagggugaagugaggg

SEQ ID NO: 31289 - RNA, 46 nt, Mus musculus
cuuaacaccaaacaagaccagaaggcacugaaaauauauauggcag

SEQ ID NO: 31290 - RNA, 62 nt, Mus musculus
cugaagguacagaauauuucaaaaugcuuguagauguuuuugcuccagaauuucgaaggcca

SEQ ID NO: 31291 - RNA, 42 nt, Mus musculus
augcaaacauuuauccauccauccauccauauauacacacau

SEQ ID NO: 31292 - RNA, 45 nt, Mus musculus
agagacuguuagguuguuauccacugccaccaccuuucucgucag

SEQ ID NO: 31293 - RNA, 55 nt, Mus musculus
gcaugaacuugaauucuccccacauuuccuuaacuuagagaucuuauauucaggc

SEQ ID NO: 31294 - RNA, 46 nt, Mus musculus
auggauguugauaaagaucucacagauugugacagauguuuugcag

SEQ ID NO: 31295 - RNA, 45 nt, Mus musculus
ucacuucauugguuccagucuguuagagaaaaauacauaaaggag

SEQ ID NO: 31296 - RNA, 45 nt, Mus musculus
ucagagcagacaagaccgcagcugaagagaaccaagaaaagaaag

SEQ ID NO: 31297 - RNA, 46 nt, Mus musculus
aaucuucuggaaaacaauacagcucuagaaaugugugggucccaug

SEQ ID NO: 31298 - RNA, 42 nt, Mus musculus
ugcugugccugaugguuguuuccaucugagccgcaaggacag

SEQ ID NO: 31299 - RNA, 68 nt, Mus musculus
uuuaauacucaaagaaaacucagauuaagccauagacgggacccacuugacauuucacuagguuugaa

SEQ ID NO: 31300 - RNA, 27 nt, Mus musculus
ccaguguaaggugagaaguagacaaga

SEQ ID NO: 31301 - RNA, 46 nt, Mus musculus
acaauggguguguuucaggccaugacucugacaacagggguggggg

SEQ ID NO: 31302 - RNA, 46 nt, Mus musculus
gcagggaugucuacagaccauuuaaaagcugccuacaguuucagga

SEQ ID NO: 31303 - RNA, 45 nt, Mus musculus
agacuccccuacagauguuaguucccucuccaaauuugcugucaa

SEQ ID NO: 31304 - RNA, 46 nt, Mus musculus
ugugucuguaucguuugauaucugcauaguauuccuccccacaacu

SEQ ID NO: 31305 - RNA, 45 nt, Mus musculus
gaauacccacaauacaacucauggaucacaugaagcucaagaaga

SEQ ID NO: 31306 - RNA, 42 nt, Mus musculus
acacacacacgugcucucucucucacacacacacacacacau

SEQ ID NO: 31307 - RNA, 46 nt, Mus musculus
cagagccugagagauggcucugucaguaaacagcuugcugcccaug

SEQ ID NO: 31308 - RNA, 42 nt, Mus musculus
ugguccugcugccacaacaccgugacagcgaugccuggaaag

SEQ ID NO: 31309 - RNA, 54 nt, Mus musculus
ggcaacccaggagauggaugucuuggggggaacguggcagauuuccucucugug

SEQ ID NO: 31310 - RNA, 45 nt, Mus musculus
ggcgguguccagucgguaucugcuacuuuccauggggugggggag

SEQ ID NO: 31311 - RNA, 34 nt, Mus musculus
cuugaggcucaccaguucccgcaccucuguguag

SEQ ID NO: 31312 - RNA, 26 nt, Mus musculus
cccucgacaucauggaggccuggacc

SEQ ID NO: 31313 - RNA, 50 nt, Mus musculus
ucaggcgcuccucgacuguguucuccagggacgugaagucccgcucccgg

SEQ ID NO: 31314 - RNA, 45 nt, Mus musculus
aguuucucaggagggacucgaaagucccaaauguggcuugcaggg

SEQ ID NO: 31315 - RNA, 46 nt, Mus musculus
ccuguucuaagcacagcacugaaaauagaagcaugggggugagccc

SEQ ID NO: 31316 - RNA, 45 nt, Mus musculus
ccuucugcucgacgcccugcaagcccuggcccagcucaucccucu

SEQ ID NO: 31317 - RNA, 45 nt, Mus musculus
ggcggccgccgccaccagggagagguagaagagaaaguugagcac

SEQ ID NO: 31318 - RNA, 45 nt, Mus musculus
ccuccugauccugauugucaccgaaaauaauucccaagacagcug

SEQ ID NO: 31319 - RNA, 46 nt, Mus musculus
ugguugugagccaccaugugguugcagggaauugaacucaagaccu

SEQ ID NO: 31320 - RNA, 45 nt, Mus musculus
uacucaaauguuuauuuucuuucaauauguaaacuuuuugaagau

SEQ ID NO: 31321 - RNA, 46 nt, Mus musculus
cacauguauaacauaagccggguacaugucuggugugaauagaggu

SEQ ID NO: 31322 - RNA, 63 nt, Mus musculus
uguuaggagagacaguucugcucguggaagcccgcugcgaagcccaacucuuccccaaggcug

SEQ ID NO: 31323 - RNA, 96 nt, Mus musculus
ccuccgggcgccgguugcugggggagcggugacgucgcggggugaaaguugaggggcggugacguagggccugcccgggcggaggcuggcggguug

SEQ ID NO: 31324 - RNA, 42 nt, Mus musculus
ccauugccuccacuauaaugcccacuccgauuucuggcccag

SEQ ID NO: 31325 - RNA, 46 nt, Mus musculus
ccuaaacgugcaaggcacacccccagaaucuguagaugcgcggcug

SEQ ID NO: 31326 - RNA, 44 nt, Mus musculus
uagaugaggaaaccgaggugcaaagaacugaaaucacgccccaa

SEQ ID NO: 31327 - RNA, 45 nt, Mus musculus
aagcccaggcucaaaaaauuaaaaguauuuaaaaaguguuggaaa

SEQ ID NO: 31328 - RNA, 46 nt, Mus musculus
acagaaccaccaaacgaugcuguuuuuucacacuuaaugcccccuu

SEQ ID NO: 31329 - RNA, 45 nt, Mus musculus
aaggcagugcugugcuagaaaaaucaaccaaacauccacccauag

SEQ ID NO: 31330 - RNA, 42 nt, Mus musculus
cuggauaggcaccuacacuaaugcaaguuaagaugaggggaa

SEQ ID NO: 31331 - RNA, 42 nt, Mus musculus
aagcaagauacaaaaguauauuucaggagugaucacggcuug

SEQ ID NO: 31332 - RNA, 44 nt, Mus musculus
acuuaaaaaguuuggguccauccugaacugcaugucucaaagag

SEQ ID NO: 31333 - RNA, 36 nt, Mus musculus
cuuguguguuugugugccacauguaugcuuguaugg

SEQ ID NO: 31334 - RNA, 46 nt, Mus musculus
cccuugacgucugguggagaacgugggcauaaccuugaacagccag

SEQ ID NO: 31335 - RNA, 46 nt, Mus musculus
gaaagauagcauuauuuuuaagacaggaauaauuuagcaaggugag

SEQ ID NO: 31336 - RNA, 46 nt, Mus musculus
ggacaacuuuccauuuuuaccuuagugccuaaugaugaaacucuag

SEQ ID NO: 31337 - RNA, 40 nt, Mus musculus
ucuguaaccuccuaaggaagugcaaggaccgaaaauuuau

SEQ ID NO: 31338 - RNA, 31 nt, Mus musculus
ugucagcaaaucgauguguaaugaaguugcg

SEQ ID NO: 31339 - RNA, 45 nt, Mus musculus
aaacaguaaauugucugaaccacugaaccaucucuuaagccccua

SEQ ID NO: 31340 - RNA, 41 nt, Mus musculus
gcauccaugguguuauguaccuacuggaagcucagggcuca

SEQ ID NO: 31341 - RNA, 46 nt, Mus musculus
uaguugucacaccaaccuuuugagguagauuuuuuuuucccaaaag

SEQ ID NO: 31342 - RNA, 45 nt, Mus musculus
uggcucuuuuuaaacuuaguuucuguaaauaaguuuuccagguaa

SEQ ID NO: 31343 - RNA, 45 nt, Mus musculus
ucaagaguuuaaggucauagucagcuaccuagcaaguuuaaggcc

SEQ ID NO: 31344 - RNA, 46 nt, Mus musculus
ccaggcuccuauacaauccagggaagucacaaggccugggacagag

SEQ ID NO: 31345 - RNA, 45 nt, Mus musculus
guccauuaacccaugaagaaacagcccaagaggcagcaacucuag

SEQ ID NO: 31346 - RNA, 45 nt, Mus musculus
acuggagugcuuucaggggcuugauaggaggaccucauguggguu

SEQ ID NO: 31347 - RNA, 46 nt, Mus musculus
guggguuggggagcagggaaaagugggaaggguaggggauuuucag

SEQ ID NO: 31348 - RNA, 45 nt, Mus musculus
aaguugugacauagcaauuuaagucauuuguucauuucucaucag

SEQ ID NO: 31349 - RNA, 46 nt, Mus musculus
gaggcagccuaaguuuacagagaaaacagguucuuuggucccagag

SEQ ID NO: 31350 - RNA, 46 nt, Mus musculus
auccuguaccuuguccaggagccucccuugccauagucacuuacag

SEQ ID NO: 31351 - RNA, 41 nt, Mus musculus
gagagacagagacagagagagagagagagacagacagacag

SEQ ID NO: 31352 - RNA, 41 nt, Mus musculus
gauugcugcugaguuccuuuuuguccuuugcaaagagagag

SEQ ID NO: 31353 - RNA, 45 nt, Mus musculus
ccaugcuggcaccgguuugaccuccccauggcaaagcacaugcag

SEQ ID NO: 31354 - RNA, 57 nt, Mus musculus
uucuuacacaggcaucuaggugucuggguuuggggugauuauaggucuaggugcuga

SEQ ID NO: 31355 - RNA, 45 nt, Mus musculus
gggaaugccugcuggugauggaggcugggaagcagugaugaguca

SEQ ID NO: 31356 - RNA, 45 nt, Mus musculus
gguguguugcugugccagagagguugagggacugggucuagggaa

SEQ ID NO: 31357 - RNA, 75 nt, Mus musculus
acaguguacuuauguauaauaauaaauaaaucuuagggccagagcgagaaggacugagcaggcggaggagaccag

SEQ ID NO: 31358 - RNA, 46 nt, Mus musculus
uggaauuuucucaguuccaagcugacacugaacucagagucccccu

SEQ ID NO: 31359 - RNA, 46 nt, Mus musculus
uggaacuaacguucuagccauuuagcaugugagacccaguggccau

SEQ ID NO: 31360 - RNA, 46 nt, Mus musculus
gugguuuguaugcacugugucucuccgcccguaccaccggccucuu

SEQ ID NO: 31361 - RNA, 42 nt, Mus musculus
cuguguggcuguggauuaaaguuugguggauucccgggggag

SEQ ID NO: 31362 - RNA, 59 nt, Mus musculus
ccccugaguaucauaaugggggaaaaaucuguuuaaagggagacaugaaccgguguuug

SEQ ID NO: 31363 - RNA, 71 nt, Mus musculus
cguccuguguuuaaagggaggugggugugugugugcagggguguuaugguguugucuccauggauggggag

SEQ ID NO: 31364 - RNA, 45 nt, Mus musculus
uucccaggggaaggaagugacuuguggacugcucaucauguugaa

SEQ ID NO: 31365 - RNA, 46 nt, Mus musculus
ucuccuucucaaacuuugaaagcaaaaauaaaaccccugcacucaa

SEQ ID NO: 31366 - RNA, 42 nt, Mus musculus
guuucuacuccucuugucccuuauuuccuuaguugacaccag

SEQ ID NO: 31367 - RNA, 25 nt, Mus musculus
guaaacaaugccaguucugccagca

SEQ ID NO: 31368 - RNA, 46 nt, Mus musculus
cccucauuaaaacaagaauuaaucagggugauuaaaggaggcagug

SEQ ID NO: 31369 - RNA, 47 nt, Mus musculus
ucuguaauucuuucaguauuggggugugugugugugugugugugugu

SEQ ID NO: 31370 - RNA, 46 nt, Mus musculus
aguaagacucagaggcaugcccaagaucacacagcugguaagugga

SEQ ID NO: 31371 - RNA, 46 nt, Mus musculus
uccuacucaccuucuccaggcccuuccacaccugccuuuccccugc

SEQ ID NO: 31372 - RNA, 46 nt, Mus musculus
cauaauuaaacugccacaaacaaaagcaaugguguuuuaaacaaag

SEQ ID NO: 31373 - RNA, 33 nt, Mus musculus
guugccgaagauucugcguguccuuccacccac

SEQ ID NO: 31374 - RNA, 60 nt, Mus musculus
uucaguuuuauacaaauguggaaacacacacacacgcacgcacacacacacauggcccca

SEQ ID NO: 31375 - RNA, 46 nt, Mus musculus
uuguagaauguuuagaaagugcggaaacaguaaaacuagcuauuga

SEQ ID NO: 31376 - RNA, 45 nt, Mus musculus
uggagacacagaaccacugguucaccuauaaugagacaaugacag

SEQ ID NO: 31377 - RNA, 42 nt, Mus musculus
gaggccaucaaguccucgcucaucaucuucaagcaagucaug

SEQ ID NO: 31378 - RNA, 69 nt, Mus musculus
ugaauacaaccaacaucgagcuagccacggugcagccuggucagaacuuccacauguucacaaaggaag

SEQ ID NO: 31379 - RNA, 46 nt, Mus musculus
ggacacuuucaguucuaauugcccuuagacuuuauuuccagcucuu

SEQ ID NO: 31380 - RNA, 45 nt, Mus musculus
gaguaugcucaguaacuagauggacccacuuugauguuacuagaa

SEQ ID NO: 31381 - RNA, 42 nt, Mus musculus
ccagcucccagggcuccaaccugcgccggguucaaaccgaag

SEQ ID NO: 31382 - RNA, 46 nt, Mus musculus
accugcguggccuggguccgccgcggcguggccaaagagacuccag

SEQ ID NO: 31383 - RNA, 56 nt, Mus musculus
gagaguggccuuaguuuugaacuucauuagaacaaaagauagccaaaugggaaaug

SEQ ID NO: 31384 - RNA, 45 nt, Mus musculus
aggggaaaaaaggcagaggacggauguucuaugguuugauagcca

SEQ ID NO: 31385 - RNA, 46 nt, Mus musculus
gaagaaggugggagugaagaagaggaggcaggcaacccuucagaag

SEQ ID NO: 31386 - RNA, 46 nt, Mus musculus
ggccuucugguauggucuccaggaaacauuugcuuggaaucugcag

SEQ ID NO: 31387 - RNA, 42 nt, Mus musculus
gucuucacacugggaagcaagcuuuccaaaaagaagaagaag

SEQ ID NO: 31388 - RNA, 41 nt, Mus musculus
cguggugaauucuauuuagauucuaaaagagguuuggggag

SEQ ID NO: 31389 - RNA, 45 nt, Mus musculus
agaauccgcuugccaguuucugcagauguuaaguaaguaagcuuu

SEQ ID NO: 31390 - RNA, 45 nt, Mus musculus
caguggcgguucagugggcagaucgagagagugaccuggaaccac

SEQ ID NO: 31391 - RNA, 42 nt, Mus musculus
uaguuugugaauuagcuaauuuucaacuauuccauugggcua

SEQ ID NO: 31392 - RNA, 45 nt, Mus musculus
cuggaugcacguucagacaagccaaucuuuacacuuaaugcacac

SEQ ID NO: 31393 - RNA, 46 nt, Mus musculus
gaucaaaggcugccuugugacugcuuccgcugacaaauuugugaag

SEQ ID NO: 31394 - RNA, 41 nt, Mus musculus
ggauauguugguuaauuuugagcuaguuaaguuugguggga

SEQ ID NO: 31395 - RNA, 42 nt, Mus musculus
ugcuguccugacuugccauuuguuuaugccuuuggaggacag

SEQ ID NO: 31396 - RNA, 42 nt, Mus musculus
cggcacgaaagguuuaucuguuagcggccccugugggagcag

SEQ ID NO: 31397 - RNA, 42 nt, Mus musculus
aaacugucaaaguaauacauaaccuuguaaguuuugguccca

SEQ ID NO: 31398 - RNA, 41 nt, Mus musculus
ucccaauuggaaggaaugagugagaauguuccucucgcgug

SEQ ID NO: 31399 - RNA, 42 nt, Mus musculus
cuugguuaagcaucuaccuccacuucuugguuggccccagcu

SEQ ID NO: 31400 - RNA, 42 nt, Mus musculus
aagaagcuuuccauugugucagggaaggcuuagcagccagag

SEQ ID NO: 31401 - RNA, 51 nt, Mus musculus
gagugggcuucuuuaucccaggcccuguuuguagcccagaagguaucaugg

SEQ ID NO: 31402 - RNA, 45 nt, Mus musculus
ggagaggcugcugucacaggguuggaaaauagccuuccaggagau

SEQ ID NO: 31403 - RNA, 46 nt, Mus musculus
aggccauuaaacugagaccaauugcuguuauuaaaggguagaucca

SEQ ID NO: 31404 - RNA, 42 nt, Mus musculus
uggauuuuacaguguucaauuccuucucuguaggcaccagag

SEQ ID NO: 31405 - RNA, 46 nt, Mus musculus
cuagggccgugcuuuguccagagcaaaaucacgucguaacuuagau

SEQ ID NO: 31406 - RNA, 44 nt, Mus musculus
aaguggagcagcacgugguggaugggaaggaacggacgcugcug

SEQ ID NO: 31407 - RNA, 45 nt, Mus musculus
cuggguuaaccgcuccucuaugaccuucuuaacccgucagguaaa

SEQ ID NO: 31408 - RNA, 50 nt, Mus musculus
acuggucccugagggaaggcuaugccugggcugaagacaaggagcacugu

SEQ ID NO: 31409 - RNA, 45 nt, Mus musculus
guccuuuacuaagaaaugacuuggauuuccuuacucaccccagag

SEQ ID NO: 31410 - RNA, 46 nt, Mus musculus
uuuaaaguaucugucccagcccauguucauuagaacagaccuugaa

SEQ ID NO: 31411 - RNA, 47 nt, Mus musculus
cggauuugauauuaacugugguguccgcuugcuaagaaccaauuuag

SEQ ID NO: 31412 - RNA, 80 nt, Mus musculus
gaacaacccaaauguugguuauggaaugaguagguagagguagugagaguggaauauuauucagcuugaagaaaggagag

SEQ ID NO: 31413 - RNA, 45 nt, Mus musculus
cuggaaaaacuaauguuugaggaauuaaggaacgccugucgaggu

SEQ ID NO: 31414 - RNA, 46 nt, Mus musculus
ggcugguugguagagucuugcuaauuuauuaagugacacaugaaaa

SEQ ID NO: 31415 - RNA, 46 nt, Mus musculus
auucuccaaacuuaacuggguuuuaacguaacgacaaucggcauga

SEQ ID NO: 31416 - RNA, 82 nt, Mus musculus
uaucgcuggccucgccgccaccaugagucguaacuacaacgaugagcuacaguucuuggacaagaucaauaaaaacugcugg

SEQ ID NO: 31417 - RNA, 44 nt, Mus musculus
cccuuggggaccuuccuuuuuguccucugggacuaggugugaug

SEQ ID NO: 31418 - RNA, 40 nt, Mus musculus
gaacacgaguccgcggagccaacgaguggccucccggaga

SEQ ID NO: 31419 - RNA, 45 nt, Mus musculus
uuuuucuucccccggaauguuugugaggagggagagagugaguau

SEQ ID NO: 31420 - RNA, 48 nt, Mus musculus
ggcaggggugggacaagaggcugcccuuagccaguguggagucaguaa

SEQ ID NO: 31421 - RNA, 44 nt, Mus musculus
uugguagugugaguagggagagaggguucucaucucuaaccuag

SEQ ID NO: 31422 - RNA, 45 nt, Mus musculus
cugucuccauucacaaggaguaauuaggcaguggcauugguggga

SEQ ID NO: 31423 - RNA, 46 nt, Mus musculus
uguuuugacagggaccacugccaggggcguguuccuucagcaucag

SEQ ID NO: 31424 - RNA, 46 nt, Mus musculus
aggaguugacuuuuaguagaaaugguguccuacagauagcagaaaa

SEQ ID NO: 31425 - RNA, 41 nt, Mus musculus
ggccguugugauaguaauugcaaccucaaugauaggucuga

SEQ ID NO: 31426 - RNA, 46 nt, Mus musculus
guguauaugugccuguguguauauguauguguauauguguguguga

SEQ ID NO: 31427 - RNA, 45 nt, Mus musculus
uaacccugucagaggaagaggagacaggaaauuaggaauggguaa

SEQ ID NO: 31428 - RNA, 46 nt, Mus musculus
cagcagauggcucauuacaggugcugauugcuucggggauuuccag

SEQ ID NO: 31429 - RNA, 46 nt, Mus musculus
uuuuuaugagccgagaggaucaggaaggcagaaaggaacuuuguuu

SEQ ID NO: 31430 - RNA, 45 nt, Mus musculus
caaggcuccuccaugaaaaaggagucaagaagacagaggucagau

SEQ ID NO: 31431 - RNA, 42 nt, Mus musculus
gacaagacacuugauccaucugagucccaacuuaccccaucu

SEQ ID NO: 31432 - RNA, 46 nt, Mus musculus
agcuugcuggcuggaaggugaucugcccuaaauggcccuguuagaa

SEQ ID NO: 31433 - RNA, 42 nt, Mus musculus
caccugaauacuagguucagugcuggcuuuagcagaggggag

SEQ ID NO: 31434 - RNA, 41 nt, Mus musculus
aaaccugccuuccaacaacauugugugugggugugggaagc

SEQ ID NO: 31435 - RNA, 46 nt, Mus musculus
aggucagaugcaucagaaaugaggaauuggaggagacugccaaggc

SEQ ID NO: 31436 - RNA, 98 nt, Mus musculus
gucaagaguccugguuccuaacagcuauuuagacaagaaacuagagggggaagaaggaagaggaggaggaaggaggaggaagagaaggacaaggagga

SEQ ID NO: 31437 - RNA, 45 nt, Mus musculus
guaaaaccuggagugucggcacucgacaucaagcguaccauguag

SEQ ID NO: 31438 - RNA, 45 nt, Mus musculus
uggggauuuuucuucuaugaugaguucuuuggcacugagcagcau

SEQ ID NO: 31439 - RNA, 24 nt, Mus musculus
uuggguggggagguuuuaauggcc

SEQ ID NO: 31440 - RNA, 46 nt, Mus musculus
ccugaauuauuauaacuucauuuacuuuaguuuguccugugcaacu

SEQ ID NO: 31441 - RNA, 72 nt, Mus musculus
ucaucugcuuaauaguguagaccagagugccaaagggccccuccuucaccagcuucuuucccaccacuuugg

SEQ ID NO: 31442 - RNA, 46 nt, Mus musculus
ugaaggaggggcccuuuggcacucuggucuacacuauuaagcagau

SEQ ID NO: 31443 - RNA, 42 nt, Mus musculus
guguguggugugugugugugugugugugugugugugugacag

SEQ ID NO: 31444 - RNA, 46 nt, Mus musculus
gauaucauuauuacuagguuaaacuauguaaaauucaucugcaaca

SEQ ID NO: 31445 - RNA, 42 nt, Mus musculus
guggccucaagcuagaagucaacaaauaccaguaccugcuga

SEQ ID NO: 31446 - RNA, 85 nt, Mus musculus
acccaggugguagcgguaauugaggcccuugcgcugggacagugugagguggucccaccucuccacaaaguugcacaguccugug

SEQ ID NO: 31447 - RNA, 49 nt, Mus musculus
caccucacacugucccagcgcaagggccucaauuaccgcuaccaccugg

SEQ ID NO: 31448 - RNA, 46 nt, Mus musculus
gaugcaggcguaguguuuggacugauagccaggguacccaaaauug

SEQ ID NO: 31449 - RNA, 89 nt, Mus musculus
accgaggaugggcucccccagacaagagcaucagcaacgccacagaccccugaacccagaccuuccccaccucaccuccuucccauccc

SEQ ID NO: 31450 - RNA, 38 nt, Mus musculus
ugucaucaucugggaagaguuagugucugggacgcucg

SEQ ID NO: 31451 - RNA, 45 nt, Mus musculus
ucugcugucuauggaguugauuuggaaauaccuuccuggccccgc

SEQ ID NO: 31452 - RNA, 46 nt, Mus musculus
aagagguguauacaugccucguucuuucuggcuuggcaccagagau

SEQ ID NO: 31453 - RNA, 46 nt, Mus musculus
uggggcauuuaaagcuacucuucuuucuucuuccucucuugaccac

SEQ ID NO: 31454 - RNA, 49 nt, Mus musculus
guauugggaugaagaaguguauauggaacugggucuaggauguggucaa

SEQ ID NO: 31455 - RNA, 39 nt, Mus musculus
cagaaguccaacuguuucccaaucagucaaaggcagcaa

SEQ ID NO: 31456 - RNA, 48 nt, Mus musculus
cuguaugucugggucagacagucugucuaugugugcaugucagaggga

SEQ ID NO: 31457 - RNA, 46 nt, Mus musculus
agcauccaagaguaacagaacuuucugagcuggcaaaggcuuaaac

SEQ ID NO: 31458 - RNA, 41 nt, Mus musculus
uuuuucuuuuguuguuugaugggaaauugugacauuccaag

SEQ ID NO: 31459 - RNA, 46 nt, Mus musculus
uaacugggguuaucugaccauccaucucccuucuuuguucugcuuu

SEQ ID NO: 31460 - RNA, 62 nt, Mus musculus
gugaguguuagguuagggccuucucaugaaaggggcaguugcacaguggaaugacuccucuc

SEQ ID NO: 31461 - RNA, 47 nt, Mus musculus
auaagauuauuuuaaguuuuagugucaacauugcaaugccaauagua

SEQ ID NO: 31462 - RNA, 48 nt, Mus musculus
aucguuuucauuccacuuuagaaacacaguuaccaguugagagagaga

SEQ ID NO: 31463 - RNA, 48 nt, Mus musculus
ucuagucuguccccaccccacacauaccacugcuuuguccagguguuu

SEQ ID NO: 31464 - RNA, 45 nt, Mus musculus
ccugaucuaucuuacucaagugcccucccauauguauaccccaac

SEQ ID NO: 31465 - RNA, 46 nt, Mus musculus
gaggugauuaccagggauugagaauggcccgaugcuggauuaagau

SEQ ID NO: 31466 - RNA, 54 nt, Mus musculus
uggugagaaguacuggccacgaaagggucuuguguaaaguuacaucaucggaga

SEQ ID NO: 31467 - RNA, 59 nt, Mus musculus
agcuauagcuuuguuuauuucaccuguucacuuacuguauaauuuaaaaucauuuaugu

SEQ ID NO: 31468 - RNA, 51 nt, Mus musculus
aaacccacaugccauuuuuuuuuucugauucaaauucuacaguagaaugga

SEQ ID NO: 31469 - RNA, 46 nt, Mus musculus
cauagaauccuaagggugggaagaagaagaagaaaaaaagcaaaag

SEQ ID NO: 31470 - RNA, 46 nt, Mus musculus
uaucaaauaucccuaggucaucugccacccacuuuccaagaccuuu

SEQ ID NO: 31471 - RNA, 46 nt, Mus musculus
aacuuuucugucucccaaccaaggaauuccucugcucaggcuccug

SEQ ID NO: 31472 - RNA, 36 nt, Mus musculus
gaaagugauauuuuuaucguuaaguagcugggagcc

SEQ ID NO: 31473 - RNA, 46 nt, Mus musculus
aaauaaagucugaugguagaaauccaaugaaaugggagaaggcagg

SEQ ID NO: 31474 - RNA, 46 nt, Mus musculus
uagaggaaaaauagacagagaaucuaagguaccccuguccccagag

SEQ ID NO: 31475 - RNA, 45 nt, Mus musculus
caccucuacacaggcuuuuggcucagagggucacuucagaacaug

SEQ ID NO: 31476 - RNA, 46 nt, Mus musculus
cugcuguuuuauuauggccagcagaguagugguucugacugcagau

SEQ ID NO: 31477 - RNA, 82 nt, Mus musculus
cauuccuccugaauguaaauuuguacuauuuaacugacuauugguguaaaaucuugucauguguauaaaaauaaaaaaagau

SEQ ID NO: 31478 - RNA, 85 nt, Mus musculus
ccaagccuccuucuccccugcacuguaaaauguugggauuaugggucacaggaagaagugguuuuuuuaguugaauuuuuuuuaa

SEQ ID NO: 31479 - RNA, 48 nt, Mus musculus
aggaugaauuguaaauuauacucucgcuaugaaucccguguggagagg

SEQ ID NO: 31480 - RNA, 42 nt, Mus musculus
aguuggcauuugauaccagccuuggaaucuuugugggugggg

SEQ ID NO: 31481 - RNA, 50 nt, Mus musculus
acucagagcaggaugagggagaagagauggaugcagggacagaagaagaa

SEQ ID NO: 31482 - RNA, 46 nt, Mus musculus
gaaugcuucgccucaguuuaaacauugacccugaagcacagguuug

SEQ ID NO: 31483 - RNA, 74 nt, Mus musculus
cuaucuccauacgccuuggugucugguagaagauauccugaccgaaguguugccguuucaaacaaaacuacagc

SEQ ID NO: 31484 - RNA, 46 nt, Mus musculus
cucaccuuaauccgccgcaacaugucucugaucagugggugucuag

SEQ ID NO: 31485 - RNA, 46 nt, Mus musculus
gaaaucaauccuagacacccacugaucagagacauguugcggcgga

SEQ ID NO: 31486 - RNA, 49 nt, Mus musculus
gcaacauggagaggaucaugaaggcacaagcauaccagacgggcaagga

SEQ ID NO: 31487 - RNA, 46 nt, Mus musculus
ccgucugguaugcuugugccuucaugauccucuccauguugccaga

SEQ ID NO: 31488 - RNA, 61 nt, Mus musculus
gaauguugccaaagaaggggugaaguuugaugagagugagaaaacuaaagaaagucgggaa

SEQ ID NO: 31489 - RNA, 58 nt, Mus musculus
aaucuucuccauuuguugagagacuucugaagaagggcuaugaagucauuuaucucac

SEQ ID NO: 31490 - RNA, 105 nt, Mus musculus
gguuccagucuucucaccauucaacugacauuacuaguuuagaccaguauguggaaagaaugaaggaaaaacaggacaaaaucuacuucauggcugggucaagca

SEQ ID NO: 31491 - RNA, 53 nt, Mus musculus
aagauugcugaugagaaguauaacgacacuuucuggaaggaguucggcacgaa

SEQ ID NO: 31492 - RNA, 45 nt, Mus musculus
uguuucccgugagacucuucagcaacauaaauugcucaaggugag

SEQ ID NO: 31493 - RNA, 44 nt, Mus musculus
auuuauguugcugaagagucucacgggaaacauugagggggaga

SEQ ID NO: 31494 - RNA, 42 nt, Mus musculus
acuuacaacaccuuugacaaaauuaagguauuugggcaucau

SEQ ID NO: 31495 - RNA, 45 nt, Mus musculus
ccgcguauucaucacagaugacuuccaugauaugaugcccaaaua

SEQ ID NO: 31496 - RNA, 50 nt, Mus musculus
guuuguacccacaucugcaccucgaggucuguuugaugaauauggaucua

SEQ ID NO: 31497 - RNA, 46 nt, Mus musculus
uaaaaugaaccuuugagauuauugucacguauacauacguacauac

SEQ ID NO: 31498 - RNA, 47 nt, Mus musculus
uaugaaugauaucaaaccaauauggcagagaccauccaaagaaguag

SEQ ID NO: 31499 - RNA, 45 nt, Mus musculus
ugcaaauuuuauaugcccuaguacaggggaacgccagggccaaaa

SEQ ID NO: 31500 - RNA, 46 nt, Mus musculus
cuuagcagucauggccaguauuuaacaaaaaaguaaaguagccaac

SEQ ID NO: 31501 - RNA, 41 nt, Mus musculus
ugggaucaauuaucagaacauuaacugauuuggguagcaga

SEQ ID NO: 31502 - RNA, 50 nt, Mus musculus
agcaaaagaagagaaagaagaaucugaugaugaagcugcaguagaggagg

SEQ ID NO: 31503 - RNA, 56 nt, Mus musculus
gaagaagcaucugauuaccuugaauuggacacaauuaaaaaucuugucaggaagua

SEQ ID NO: 31504 - RNA, 41 nt, Mus musculus
cacaggaaagagccugcuuuuccugcccuauguguuguaga

SEQ ID NO: 31505 - RNA, 59 nt, Mus musculus
caucugggaaucagacuccaaugaauucucuguaauugcugacccaagaggaaacacac

SEQ ID NO: 31506 - RNA, 73 nt, Mus musculus
gagaggaguugguuaaaaaucucggcaccauagccaaaucuggaacaagcgaguuuuuaaacaaaaugacaga

SEQ ID NO: 31507 - RNA, 53 nt, Mus musculus
ugacaaagagaaaaaccugcugcaugucacagacacggguguaggaaugacua

SEQ ID NO: 31508 - RNA, 50 nt, Mus musculus
cccuaacugaugaaaaugcacucgcuggaaaugaggaguuaacggucaag

SEQ ID NO: 31509 - RNA, 46 nt, Mus musculus
uuauacaaagaauugaugauaaguuucaucauccuguucacuucag

SEQ ID NO: 31510 - RNA, 79 nt, Mus musculus
aaaaaucugaaaaguucgccuuccaagcugaagugaacaggaugaugaaacuuaucaucaauucuuuguauaaaaauaa

SEQ ID NO: 31511 - RNA, 46 nt, Mus musculus
ccagugcccaaaauguugcuaaugauacaaaauaaccagagaagau

SEQ ID NO: 31512 - RNA, 47 nt, Mus musculus
gguaaaagccgagaaggcucaaggacagaugaugaaguugugcagag

SEQ ID NO: 31513 - RNA, 59 nt, Mus musculus
guuaacucuugcccccguugauauggcuuuuuaugcgaaggagaggaagcaauagugug

SEQ ID NO: 31514 - RNA, 46 nt, Mus musculus
uaugaaugcucaagacccccguugacucuggaaggccaggcagcca

SEQ ID NO: 31515 - RNA, 45 nt, Mus musculus
cucccuaaggacuuuugugaucagguccgaccuuuggccaccaga

SEQ ID NO: 31516 - RNA, 41 nt, Mus musculus
aggacuugcgacucgccggccacgcaccaugaggguccugu

SEQ ID NO: 31517 - RNA, 60 nt, Mus musculus
gugcguggccggcgagucgcaaguccuuuucggucucaggagccgccuccacccccccaa

SEQ ID NO: 31518 - RNA, 48 nt, Mus musculus
ucccgagucuaagcuccucacaccuccagcagcgcgguccgcccacua

SEQ ID NO: 31519 - RNA, 46 nt, Mus musculus
cugacauuuuguauaaacauucuuggguugggauuuuucuggagau

SEQ ID NO: 31520 - RNA, 46 nt, Mus musculus
acaaaguaccuucaagaacacagagaucaacuuucagcugggaaua

SEQ ID NO: 31521 - RNA, 43 nt, Mus musculus
uuuauggugauaguauccccguucuucucgaugaugguaguag

SEQ ID NO: 31522 - RNA, 44 nt, Mus musculus
ugcucaaaaguagauuuggggcuuuuugcuuguuuugccugagg

SEQ ID NO: 31523 - RNA, 45 nt, Mus musculus
gcagagccuuucuugacuaggucccuuuuucuuuuucggugugga

SEQ ID NO: 31524 - RNA, 42 nt, Mus musculus
gcaccgcagccgcccagcagucucucacuucuggccagggaa

SEQ ID NO: 31525 - RNA, 76 nt, Mus musculus
uaucaaccaaagagagcuuuagggagaauaacaccuagaauacacagaaauauuaagugcuuacagaaauucaugg

SEQ ID NO: 31526 - RNA, 41 nt, Mus musculus
uaccuuuuauuacuuguagaaaccaucauuucagagagaga

SEQ ID NO: 31527 - RNA, 43 nt, Mus musculus
ggacccucugggcuagaucaacagauguugucucagggcugau

SEQ ID NO: 31528 - RNA, 54 nt, Mus musculus
uccaagugucuggacugcaauauuggagcccuauggccagcagacauguagauc

SEQ ID NO: 31529 - RNA, 42 nt, Mus musculus
cccauacugagaugagcugcugaggccucaugugugacccag

SEQ ID NO: 31530 - RNA, 46 nt, Mus musculus
acgauacagaguaccauucuguccacaucauaccugccagccccac

SEQ ID NO: 31531 - RNA, 46 nt, Mus musculus
auuauccuuuaauucucuuguauaaguccauuugggaagaccucuu

SEQ ID NO: 31532 - RNA, 46 nt, Mus musculus
aagucugucuagaaaaauagaauggucacacugagugaaaguugag

SEQ ID NO: 31533 - RNA, 41 nt, Mus musculus
uggaggcuggccaggacuuuggacguuggcauauuggacca

SEQ ID NO: 31534 - RNA, 45 nt, Mus musculus
uguagacuugacugaucugaaucaacuuuggggugugugaagaga

SEQ ID NO: 31535 - RNA, 48 nt, Mus musculus
gauuuggaaagguucuggguccagggcagcuccaaggauggagauagg

SEQ ID NO: 31536 - RNA, 45 nt, Mus musculus
agaacccugugcagcagcuucugucuuuaaucccagggcugggaa

SEQ ID NO: 31537 - RNA, 46 nt, Mus musculus
aggguauuaacugcacuuuaaaaaguaacagaaaggcgguuggaag

SEQ ID NO: 31538 - RNA, 42 nt, Mus musculus
aguguacuuacauauaauaacaaauaaaucuuugagccagag

SEQ ID NO: 31539 - RNA, 46 nt, Mus musculus
gccgugaacugcguuggagguggcugcugggggagcaggcugucag

SEQ ID NO: 31540 - RNA, 42 nt, Mus musculus
ugucauggagggagguauguggaugggaggagguggcucgga

SEQ ID NO: 31541 - RNA, 45 nt, Mus musculus
aggaaggagagccccacagcagcacucggucuuccaugcuguaag

SEQ ID NO: 31542 - RNA, 46 nt, Mus musculus
gaaaagucacuuccugaagcaugauauuacgugauugguaagcauu

SEQ ID NO: 31543 - RNA, 46 nt, Mus musculus
cuccugagugcugggauuaaaggugugcaccaccaugucuggccaa

SEQ ID NO: 31544 - RNA, 46 nt, Mus musculus
auuuuaagauuacguuuguuuauugugugcaugcaugucugugugc

SEQ ID NO: 31545 - RNA, 44 nt, Mus musculus
aagcacuucagaaguguagcugauaaucagcagccauuguguaa

SEQ ID NO: 31546 - RNA, 55 nt, Mus musculus
uagauugauccuuggcuguaucaccagguggcaaaugggagagagcaauggcagg

SEQ ID NO: 31547 - RNA, 45 nt, Mus musculus
gguggggcaggaacaggaucagugcggccauuggauaaagaucua

SEQ ID NO: 31548 - RNA, 46 nt, Mus musculus
cucaguuucaguucuggauuuuccagguucuagaagacucaguaga

SEQ ID NO: 31549 - RNA, 58 nt, Mus musculus
ugcagacgcuucuuaaaugauuaacuugccugugugcagauuugagcaggaaucucag

SEQ ID NO: 31550 - RNA, 46 nt, Mus musculus
gcagaaggauaaagaguucagggucaccuuuggcuaccuauuugag

SEQ ID NO: 31551 - RNA, 45 nt, Mus musculus
uguaguuauacuugcuuuuuuauuauuacuuacugcugccucuug

SEQ ID NO: 31552 - RNA, 45 nt, Mus musculus
agucuuggaacauuaauguuucucugcaucucauuuccuaggcau

SEQ ID NO: 31553 - RNA, 46 nt, Mus musculus
uaaguacacuguagcugucuucagacauaccagaagaaggcgugag

SEQ ID NO: 31554 - RNA, 42 nt, Mus musculus
gaccugagauuuacucggauucaggauccgcagagaggagag

SEQ ID NO: 31555 - RNA, 45 nt, Mus musculus
cacguggaugcccacgcauauguacacauauccacgcaugcacac

SEQ ID NO: 31556 - RNA, 57 nt, Mus musculus
ggcccugaguucaguccucagaugcagcuaggaaaaaaaaagaugaagaaguugagg

SEQ ID NO: 31557 - RNA, 51 nt, Mus musculus
aaggcuauggugcaauaugcaaagucucuuagugaagcaauagagaaauca

SEQ ID NO: 31558 - RNA, 44 nt, Mus musculus
cugagccauuguugggauccgaguuuggacccgcagcacccaca

SEQ ID NO: 31559 - RNA, 46 nt, Mus musculus
uucacacagcugaccauagacuauuauccuuaucauaaagcaggug

SEQ ID NO: 31560 - RNA, 46 nt, Mus musculus
caacuaaaacaaaaaacggaugggcuaaugaguuguuacaugaauu

SEQ ID NO: 31561 - RNA, 41 nt, Mus musculus
uuuauguauggguuugugcacaugagugcaaugccugugga

SEQ ID NO: 31562 - RNA, 42 nt, Mus musculus
ugucagcuaucuauauagaauucacagaauauuauuauccag

SEQ ID NO: 31563 - RNA, 46 nt, Mus musculus
uaaguacacuguagcuguuuucagacacaccagaagaggacaucag

SEQ ID NO: 31564 - RNA, 41 nt, Mus musculus
cuuguguugguguuucccaucuauuauccucuguagugcug

SEQ ID NO: 31565 - RNA, 46 nt, Mus musculus
guguugggguauccaggauuugcuauggugggagaaauggguucug

SEQ ID NO: 31566 - RNA, 46 nt, Mus musculus
agguaggguuaagauagucugaaguauauucccagggucucauaag

SEQ ID NO: 31567 - RNA, 42 nt, Mus musculus
ugucuuacucuggcuggcuggcuggccugcucuauugaccag

SEQ ID NO: 31568 - RNA, 46 nt, Mus musculus
cuaaugcuggguuuaaagugcacaccauugugcauccaucagccau

SEQ ID NO: 31569 - RNA, 44 nt, Mus musculus
uugcuuuuaugaauggaaugaagagaugagugcagguacccaaa

SEQ ID NO: 31570 - RNA, 45 nt, Mus musculus
agguagguagguagguagguagguagguagguagauagauaaaua

SEQ ID NO: 31571 - RNA, 46 nt, Mus musculus
agguagguagauaaauagauaaguagguagguagauagguagguag

SEQ ID NO: 31572 - RNA, 46 nt, Mus musculus
agauagauagaugaguagguagguagauaaguagguagguagguag

SEQ ID NO: 31573 - RNA, 51 nt, Mus musculus
ugggcgguguacuuuucccaguuuuggauagacuaugaagggaugaaaagc

SEQ ID NO: 31574 - RNA, 60 nt, Mus musculus
gggaaggggcggccaguaagcuuuguagaugcuuucccucugucuaucuggauuugccag

SEQ ID NO: 31575 - RNA, 45 nt, Mus musculus
uguucaugucuugguccguguucauaaacaugucaguaugcagau

SEQ ID NO: 31576 - RNA, 41 nt, Mus musculus
guauacaccgaauuagaaaugcuacucucaaucacauguca

SEQ ID NO: 31577 - RNA, 48 nt, Mus musculus
gccucacaggucucccuggauacccuuucccuggacagcaugguauug

SEQ ID NO: 31578 - RNA, 100 nt, Mus musculus
agcaguggaucuggggagaggggagauggagaggggaccugggaggaggagaaggaugggggcacugcagucaggauguauuugugagagaagaguaagu

SEQ ID NO: 31579 - RNA, 46 nt, Mus musculus
uguuuaucuccauucucaaccaacucaaauucuuucuuggaacaag

SEQ ID NO: 31580 - RNA, 46 nt, Mus musculus
ccuaaauccucgccugagauuucucugagguuugaaagugggccag

SEQ ID NO: 31581 - RNA, 46 nt, Mus musculus
cacccagcugcaaacccugugaauuacaauaaugacauucucgaag

SEQ ID NO: 31582 - RNA, 46 nt, Mus musculus
uugcaugagauggagccuauacgugguacuguuaaugaggcgaaga

SEQ ID NO: 31583 - RNA, 46 nt, Mus musculus
gcaauggcuuagaccuucuagggcaguauugagguugugagaacag

SEQ ID NO: 31584 - RNA, 46 nt, Mus musculus
agccagggcuacacagagaaacccugucucaaaaaaccacaaaaaa

SEQ ID NO: 31585 - RNA, 45 nt, Mus musculus
accuaagagagugacuuagguaaaagagaaagugggaaaccguga

SEQ ID NO: 31586 - RNA, 52 nt, Mus musculus
aaagaaacucauauuuuuguacaaacuuauguuuccaaguaaggaagaaaua

SEQ ID NO: 31587 - RNA, 45 nt, Mus musculus
cgcccuucaggagagaacuucauagcacaaugucuuucuaggaga

SEQ ID NO: 31588 - RNA, 40 nt, Mus musculus
uaaaguguaccagguugagacaguaaugcacaguaggauu

SEQ ID NO: 31589 - RNA, 77 nt, Mus musculus
uuuaaguauuaugcagagguaaaagaaacacagaauguaagaggaagacaaguacccagaugucuagugccccuuug

SEQ ID NO: 31590 - RNA, 45 nt, Mus musculus
acguuuucaccccaaacuuagcuuuuucuuuauaguauucgagau

SEQ ID NO: 31591 - RNA, 49 nt, Mus musculus
gucgaaaaccaaagacuuccaccgaucgccauagccugagccuugacga

SEQ ID NO: 31592 - RNA, 42 nt, Mus musculus
cgcaagaugaggaaauagagaugcugguggaugaccccaggg

SEQ ID NO: 31593 - RNA, 42 nt, Mus musculus
caaaaggaaacugcaccacggagacuacuuugagccagaggc

SEQ ID NO: 31594 - RNA, 46 nt, Mus musculus
uacuacguggagaaugggaagcugaucagugaccgaauugcaagau

SEQ ID NO: 31595 - RNA, 46 nt, Mus musculus
ucaguuaacccaagcuucuucuucagagacucuggcaucucagggg

SEQ ID NO: 31596 - RNA, 45 nt, Mus musculus
ugugugguauauuccuguguauaugcuucugugagcauguaugug

SEQ ID NO: 31597 - RNA, 46 nt, Mus musculus
cagcuaauaauuccuccgaggccacagaggagaaagaaucugccag

SEQ ID NO: 31598 - RNA, 45 nt, Mus musculus
uauguuccacuaggauuuaaaacauacaguuauugagucacccag

SEQ ID NO: 31599 - RNA, 46 nt, Mus musculus
gaagaccaacugccgacaguuacauguacauacuuaagaugguaag

SEQ ID NO: 31600 - RNA, 48 nt, Mus musculus
auguaaugugaagcuacacauuaaauacuuggaauucuuacggaaaag

SEQ ID NO: 31601 - RNA, 57 nt, Mus musculus
aacuuuuuuguaggcuuuauuuuuuuaauguggacaucuuauuucacuuuuggggaa

SEQ ID NO: 31602 - RNA, 45 nt, Mus musculus
aaacacggccacaagggcaaacagcaacauuuuuauccacauggg

SEQ ID NO: 31603 - RNA, 42 nt, Mus musculus
uuggaggcugaguaguguacugugugccuguaaucgcagcac

SEQ ID NO: 31604 - RNA, 46 nt, Mus musculus
gauugaccaucccaaguacagagagguuacucagcuucaaggugac

SEQ ID NO: 31605 - RNA, 46 nt, Mus musculus
guggcggacgcgccgaggcgccucaggcucaggccuccccccaccc

SEQ ID NO: 31606 - RNA, 23 nt, Mus musculus
ggggaccuuugugucucgggggg

SEQ ID NO: 31607 - RNA, 42 nt, Mus musculus
ucuucaaaaauggcaaaagccuuuagcugaaauccguggcgc

SEQ ID NO: 31608 - RNA, 56 nt, Mus musculus
caaauuuuguuuugcgucuuggccauuccuugggccagcaaaguguauuucuggua

SEQ ID NO: 31609 - RNA, 41 nt, Mus musculus
ucgggcgcuccuacccacugagccaucgcaccagcccuugc

SEQ ID NO: 31610 - RNA, 44 nt, Mus musculus
gcucacaaccauccguaacaagaucugacucccucuuccggugu

SEQ ID NO: 31611 - RNA, 32 nt, Mus musculus
uccuuccuuggugaaauggagcuacagacuga

SEQ ID NO: 31612 - RNA, 46 nt, Mus musculus
gccugucucaacugugguuuucuggccuuuuguuuggugccugcag

SEQ ID NO: 31613 - RNA, 23 nt, Mus musculus
gugaucugggcgaucugacuaga

SEQ ID NO: 31614 - RNA, 45 nt, Mus musculus
ggcuagggagcugguucagucaguacauugccuugcaugcaugua

SEQ ID NO: 31615 - RNA, 41 nt, Mus musculus
aggccagaugaagaagcugagagaauauaccuucagccaca

SEQ ID NO: 31616 - RNA, 29 nt, Mus musculus
ugugcgugccugugugugugugugagaga

SEQ ID NO: 31617 - RNA, 46 nt, Mus musculus
ggcaucuuacaguaccagugugugagaaauauuuaaacacccugag

SEQ ID NO: 31618 - RNA, 23 nt, Mus musculus
auagcauuuacucuuguuggaua

SEQ ID NO: 31619 - RNA, 41 nt, Mus musculus
aaagaaagcaggcugagugagccaggggaagcaagccagag

SEQ ID NO: 31620 - RNA, 45 nt, Mus musculus
ccuuuaaaaacaagaacuaacaaccaccucagaagaacgugagau

SEQ ID NO: 31621 - RNA, 46 nt, Mus musculus
caaaucccagcaaccacaugguggcucacaaucauuauaacgagau

SEQ ID NO: 31622 - RNA, 54 nt, Mus musculus
aauaaauauauauauuaauauaaaaagaaagagagagaguauauaaaaagaaag

SEQ ID NO: 31623 - RNA, 45 nt, Mus musculus
uuguuuacagcuugacaacgagagaacuuuacucagauggcccuu

SEQ ID NO: 31624 - RNA, 45 nt, Mus musculus
agcaagcaauaaugagggaucugaaauaaacucaguccuaucaga

SEQ ID NO: 31625 - RNA, 45 nt, Mus musculus
uuuucaugcuccuccaggucugauaggacugaguuuauuucagau

SEQ ID NO: 31626 - RNA, 46 nt, Mus musculus
uuuuuagaaacagaaagguuaugaagugggaggagguagguaggau

SEQ ID NO: 31627 - RNA, 45 nt, Mus musculus
gcauuagcgcccacuuauuugggauuccagcugagacauccagcu

SEQ ID NO: 31628 - RNA, 99 nt, Mus musculus
gucuuccuaaacagcagccuguaaggcauccuaauaaaucccuuuucuauauguagagagagagauuaugucuguaaguucaguuuuucuagagacccc

SEQ ID NO: 31629 - RNA, 48 nt, Mus musculus
uacuaagcagugacuacucugugugucuugcuuacaaguuacuucagg

SEQ ID NO: 31630 - RNA, 46 nt, Mus musculus
cuaaguaaaaauaaacuuggaaaaaaagcaaagaaaccagcuggug

SEQ ID NO: 31631 - RNA, 45 nt, Mus musculus
aaaggcaaacaaucaggagaacugacucagcagacaucccuaagg

SEQ ID NO: 31632 - RNA, 45 nt, Mus musculus
cacagaguuggaugcuuggucccuaguuaguuguacuguuuggga

SEQ ID NO: 31633 - RNA, 42 nt, Mus musculus
caaggcaacuuauaaaggaaagcauuuaauuaggggcuugcu

SEQ ID NO: 31634 - RNA, 46 nt, Mus musculus
uaagcucugauguuaaaauuuuauuauaaaacugaugugaggagga

SEQ ID NO: 31635 - RNA, 39 nt, Mus musculus
auaacaaggaacgccccugaggaagacagugguaaugga

SEQ ID NO: 31636 - RNA, 45 nt, Mus musculus
ccugccaacaggccaaacagcuccuuugggccugcaguggggcac

SEQ ID NO: 31637 - RNA, 46 nt, Mus musculus
guguguguguguauauggugucuguguguguguguguggugugugu

SEQ ID NO: 31638 - RNA, 46 nt, Mus musculus
uuucuucuuuuucucuaaauauguccuucaagagacaagcacagau

SEQ ID NO: 31639 - RNA, 46 nt, Mus musculus
ugaaguuauaguaguuaaucagcaguggagugcauuugauccucag

SEQ ID NO: 31640 - RNA, 45 nt, Mus musculus
uaaaaaaggaaagccauguuuucagucuguuuuguggucuugagg

SEQ ID NO: 31641 - RNA, 46 nt, Mus musculus
uugugcagcugugaugugugcacggugucugauggaucaaauccag

SEQ ID NO: 31642 - RNA, 44 nt, Mus musculus
auuccuuccuccaucaguacacaggcuccuucaagaagcccccg

SEQ ID NO: 31643 - RNA, 45 nt, Mus musculus
gccucugucauugucagauuuccucuagucauguagagaccaggu

SEQ ID NO: 31644 - RNA, 42 nt, Mus musculus
uggagucgucuuaagcugguucaugagagauguggguuacag

SEQ ID NO: 31645 - RNA, 46 nt, Mus musculus
acagugaagcucugacaugggccuucacuuucucaccucgcuguau

SEQ ID NO: 31646 - RNA, 42 nt, Mus musculus
uaaacccgcugccucauuaaggcuugcuucagaagugcugag

SEQ ID NO: 31647 - RNA, 46 nt, Mus musculus
uccaggcaggucuugaacuugugcacuggcucucagcaggguugug

SEQ ID NO: 31648 - RNA, 46 nt, Mus musculus
guugacacaucuaaugagagaauagucauaagaagcaaaagaccag

SEQ ID NO: 31649 - RNA, 46 nt, Mus musculus
uuuuguucuuguuuuuugacuuaaacauuccugucacaguccauca

SEQ ID NO: 31650 - RNA, 45 nt, Mus musculus
ggcaaaacauguguugaccuuuuuugguuaauaauugcuauguga

SEQ ID NO: 31651 - RNA, 46 nt, Mus musculus
cuugucccaagagggaaaaggcauggcacaguuccaauaagaucag

SEQ ID NO: 31652 - RNA, 46 nt, Mus musculus
ucaacaaacacaaaucacaguguugaaagucgucuaugcucgagau

SEQ ID NO: 31653 - RNA, 47 nt, Mus musculus
aauuggguuugggaaaauggaaaccuacaucaaauuggaaaagcucg

SEQ ID NO: 31654 - RNA, 46 nt, Mus musculus
auuaccuaaaagauuauauaccugacucugaaaugaccgcugugag

SEQ ID NO: 31655 - RNA, 45 nt, Mus musculus
auagagaccaagagaagaaggaggacccugcacauggccccaccc

SEQ ID NO: 31656 - RNA, 46 nt, Mus musculus
agcgacucuguccuauaaucauggaauucaagagacuggggcagga

SEQ ID NO: 31657 - RNA, 45 nt, Mus musculus
cuugccuaucuuacucaagucucucacugugaucccagcaccauc

SEQ ID NO: 31658 - RNA, 46 nt, Mus musculus
uuaccauauauuuuguuucaaguaauaaggguacuuaugcuaagau

SEQ ID NO: 31659 - RNA, 45 nt, Mus musculus
cgaccaccugaugugcuucuugguuccucagaauacucaacacag

SEQ ID NO: 31660 - RNA, 41 nt, Mus musculus
cugauugcuguggcuagggacuguguaagggcgggaagagg

SEQ ID NO: 31661 - RNA, 50 nt, Mus musculus
acuaguaagugguguuuuauucuuuaagaaucuuacaaaaaagaaagcua

SEQ ID NO: 31662 - RNA, 72 nt, Mus musculus
aaaugaugaauucaagaacuacaacuucccaaaauacaagccacaaccucuaauuaaucaugcacccaggua

SEQ ID NO: 31663 - RNA, 42 nt, Mus musculus
uacuuccgcagccuggggccgaggauccaugcuuugcccgag

SEQ ID NO: 31664 - RNA, 63 nt, Mus musculus
cucuguucguuugucuaggguugaggaucagcaggcuuaugauuuaauaauuuuuguaaucag

SEQ ID NO: 31665 - RNA, 46 nt, Mus musculus
uuuugauaauagacucacuaauuucuuaggaauaguacagucagag

SEQ ID NO: 31666 - RNA, 59 nt, Mus musculus
auauucaguuugaaagagauucaguugcaaaaggacccggguuuucgaaacucuucuua

SEQ ID NO: 31667 - RNA, 72 nt, Mus musculus
uugcguggaaccaagcuuuggguugauaaauugaucaguaaaauuauugauguaacaaacaaacaaacaaac

SEQ ID NO: 31668 - RNA, 46 nt, Mus musculus
aaaugugauucagucaagucagggauccugaaagcuacagauggca

SEQ ID NO: 31669 - RNA, 45 nt, Mus musculus
ucacuuggaagccuagacgcuguagacugaccccgucaacacaga

SEQ ID NO: 31670 - RNA, 47 nt, Mus musculus
ugaacugccucauaaaaugacuuuauauuuuaggacaugggaagaac

SEQ ID NO: 31671 - RNA, 45 nt, Mus musculus
agcacuguccucuucccaguggagucuuuuuauuucagaccuaca

SEQ ID NO: 31672 - RNA, 43 nt, Mus musculus
uuuuuguacaguugguuuuaaggucuucuccgccaguagagcc

SEQ ID NO: 31673 - RNA, 46 nt, Mus musculus
aauaacuacugucuguuuauuuaacacaacaguugaaugccugaag

SEQ ID NO: 31674 - RNA, 47 nt, Mus musculus
aacugcaguguuuccuggaauguauauuuuagcuuugcuuagcagua

SEQ ID NO: 31675 - RNA, 46 nt, Mus musculus
aauaauauauuacaaauauuauuuugaguuugugugguuuuaagag

SEQ ID NO: 31676 - RNA, 45 nt, Mus musculus
ugagggaagaguaagagagccucagaacguaaggaaacguaaggu

SEQ ID NO: 31677 - RNA, 45 nt, Mus musculus
accgcuuucgguaguaaugaugaugagaauaaagggacucugaga

SEQ ID NO: 31678 - RNA, 46 nt, Mus musculus
ucauucuuauauaaaaacccaucacuuggacauuacuggauuucag

SEQ ID NO: 31679 - RNA, 45 nt, Mus musculus
guuccccacacugcucaacggucacaugccggugccgcuccccag

SEQ ID NO: 31680 - RNA, 47 nt, Mus musculus
gaccguugagcaguguggggaacuggaaggaacagggagcauuuagu

SEQ ID NO: 31681 - RNA, 46 nt, Mus musculus
aaagguucuaagcuaguuugcugauuuucuaacuaucaagggguaa

SEQ ID NO: 31682 - RNA, 44 nt, Mus musculus
ccucugugcauuuuucuaaaagaaagaugaucuuauucuuuccu

SEQ ID NO: 31683 - RNA, 46 nt, Mus musculus
aggguagaggagacucgguuuccaacugagaaugugcucgauagaa

SEQ ID NO: 31684 - RNA, 45 nt, Mus musculus
caugcuuauagcagacuagagcagauauggcagaauuucagcaga

SEQ ID NO: 31685 - RNA, 45 nt, Mus musculus
aaaaaggaucaucuugggcaucaugccccauuaucaacagcccug

SEQ ID NO: 31686 - RNA, 44 nt, Mus musculus
cuugcagcaacccugcaauagcauacauuuuccuuucccccagu

SEQ ID NO: 31687 - RNA, 42 nt, Mus musculus
ucugcccgucagaaaugccaccaccuggaagcagacccccag

SEQ ID NO: 31688 - RNA, 46 nt, Mus musculus
augcuaaaucccauagacuuacaacacaucgucacuucccucugag

SEQ ID NO: 31689 - RNA, 45 nt, Mus musculus
caacuuccuucuucuucuguugaccuuuccccagacaggccucca

SEQ ID NO: 31690 - RNA, 46 nt, Mus musculus
uucuguuucugagccccgccccccagaagggaacacuaagggugag

SEQ ID NO: 31691 - RNA, 45 nt, Mus musculus
agagacagagagagagagacagagagacagagacagagacagaga

SEQ ID NO: 31692 - RNA, 45 nt, Mus musculus
ucugugucuccccccucucucucucucucucucucucucucucuc

SEQ ID NO: 31693 - RNA, 42 nt, Mus musculus
aggcaaaaaacccaaaggcuuggaaaucucugcaccccaacu

SEQ ID NO: 31694 - RNA, 56 nt, Mus musculus
aggggcuccagagaauccgagucauggcaggcugccuccaggaagaggcuucugug

SEQ ID NO: 31695 - RNA, 45 nt, Mus musculus
cggcagcggcauccgcuuuccuggccucgucugucucagccaaga

SEQ ID NO: 31696 - RNA, 38 nt, Mus musculus
ggagaagcuggaggagcccugugaugacagucccccug

SEQ ID NO: 31697 - RNA, 113 nt, Mus musculus
uuuguguacaaguucgucucuuucccggauauccugaaaauggauccucacgcgguagagaucagccgggagagccuccugcugcaggacggcgacuguaagguguccccgga

SEQ ID NO: 31698 - RNA, 46 nt, Mus musculus
uguuccauguguggguguccaaggaagucagaagagggcaucagau

SEQ ID NO: 31699 - RNA, 23 nt, Mus musculus
uccugcuuuuuggggguugcgua

SEQ ID NO: 31700 - RNA, 42 nt, Mus musculus
agccccgaguguuagguaaggugcucugugcuagcugugaau

SEQ ID NO: 31701 - RNA, 24 nt, Mus musculus
uuaccccagaugguaaggccagga

SEQ ID NO: 31702 - RNA, 42 nt, Mus musculus
gcaaccagcauaagguggcaggccgugggagugcgaaggggu

SEQ ID NO: 31703 - RNA, 27 nt, Mus musculus
uuuccaagugcagaauauuuauuuagg

SEQ ID NO: 31704 - RNA, 54 nt, Mus musculus
gcaagaacaagaccaacaugaacuacgacaagcugagcagagcgcugagauacu

SEQ ID NO: 31705 - RNA, 89 nt, Mus musculus
guggcaguuccucuugcacuugcugcuggaccagaaacaugagcaccucaucugcuggacaucgaacgauggcgaguucaagcuccuca

SEQ ID NO: 31706 - RNA, 42 nt, Mus musculus
guagaacuuugugugacucagucgucaaaacuguggcaugga

SEQ ID NO: 31707 - RNA, 45 nt, Mus musculus
caucuuggcauaagauagauaugagagagagagagagagagagag

SEQ ID NO: 31708 - RNA, 42 nt, Mus musculus
auaagauagggcuggguugugcccugcuggggugggguggga

SEQ ID NO: 31709 - RNA, 46 nt, Mus musculus
gaaaucaucuugaauuuucacuggaggcuugauuggauucauggga

SEQ ID NO: 31710 - RNA, 23 nt, Mus musculus
acggaagcucagcucaaagaccg

SEQ ID NO: 31711 - RNA, 45 nt, Mus musculus
ugucugagauggacuucugguuauucuaugaugguggugguggug

SEQ ID NO: 31712 - RNA, 46 nt, Mus musculus
auauaagcacuauguauugggauuuaguuuuagaaaugaaggagcu

SEQ ID NO: 31713 - RNA, 46 nt, Mus musculus
uuggcaaaucuguccuaaaaaacaacccagccagcccacccuaggu

SEQ ID NO: 31714 - RNA, 46 nt, Mus musculus
aagagagagcccuuuagucauugcuaaguaaugucugcacacacac

SEQ ID NO: 31715 - RNA, 24 nt, Mus musculus
gugcucugccggagguggggaggg

SEQ ID NO: 31716 - RNA, 41 nt, Mus musculus
acuccuguaucccugcagcgaggcuccggggcucugggauu

SEQ ID NO: 31717 - RNA, 54 nt, Mus musculus
gggggggagaaaaaaaaaaagaggagcgagagaaagaaaaaaaaaagagggggg

SEQ ID NO: 31718 - RNA, 46 nt, Mus musculus
aaguaaaauuaaaacagcauauaugguauaauauuuuuaaaaggag

SEQ ID NO: 31719 - RNA, 46 nt, Mus musculus
gaauuauuaaugaaaucauauauugugaauaugcaagugugaaaag

SEQ ID NO: 31720 - RNA, 46 nt, Mus musculus
guugggguaccacaaaaaguaauuugaaagaaacaauuguccucag

SEQ ID NO: 31721 - RNA, 46 nt, Mus musculus
ucuaacugcaggguuaggaccaaugauggugguggugaauggaaag

SEQ ID NO: 31722 - RNA, 41 nt, Mus musculus
ccagaauagaucuuguaggccaaggagacuugugggccaag

SEQ ID NO: 31723 - RNA, 45 nt, Mus musculus
uuaguaaguggauggacagagcagagucuucacaguacugugaga

SEQ ID NO: 31724 - RNA, 25 nt, Mus musculus
ucugccucugccccagaggcuggcc

SEQ ID NO: 31725 - RNA, 45 nt, Mus musculus
uuuccuuuccuuuccuuuccuuuccuuuccuuuccuuuccuggca

SEQ ID NO: 31726 - RNA, 45 nt, Mus musculus
gcauaauuaaugaggacuuaaguuugacuucccagaacccaugug

SEQ ID NO: 31727 - RNA, 45 nt, Mus musculus
gcccaggccaaugagagauacugucucaaaauccaaggagggcag

SEQ ID NO: 31728 - RNA, 46 nt, Mus musculus
aggccaggucugagaugucgucagcugcagccugucgaucgaucug

SEQ ID NO: 31729 - RNA, 42 nt, Mus musculus
ucauagcuggacaggaaaccuagugacuaacaagacguggga

SEQ ID NO: 31730 - RNA, 47 nt, Mus musculus
uggacgguuguuuggggaaaaguucagacauuuccaugcuuugggag

SEQ ID NO: 31731 - RNA, 46 nt, Mus musculus
uuuuacauuucugguucauucugcuagagacgucuauugcugucag

SEQ ID NO: 31732 - RNA, 46 nt, Mus musculus
aggcuuauguuaagaaguuuuccuaccaaaguguaacgacugauga

SEQ ID NO: 31733 - RNA, 25 nt, Mus musculus
ucuugguugcccucccuuccuucag

SEQ ID NO: 31734 - RNA, 45 nt, Mus musculus
agauagauauagaugauggauagaugauugauaagauagaugaua

SEQ ID NO: 31735 - RNA, 46 nt, Mus musculus
ccuagacuccugaauugggaacugcaaguucagcaagaaaacacac

SEQ ID NO: 31736 - RNA, 46 nt, Mus musculus
gcugccuucgacaaaucccaugaucaagcuguccacaccuaccaag

SEQ ID NO: 31737 - RNA, 43 nt, Mus musculus
uuggccaugucugcacgguaacccgcggcucccgcagcaccug

SEQ ID NO: 31738 - RNA, 45 nt, Mus musculus
augaaugggaaccagaaauuggaugcuuauaaccaagaaaagcag

SEQ ID NO: 31739 - RNA, 45 nt, Mus musculus
gaugcugagagucuucagcaggcccugacagugggcuggugugua

SEQ ID NO: 31740 - RNA, 29 nt, Mus musculus
ugauaccagcagaucuguccccggcgagu

SEQ ID NO: 31741 - RNA, 44 nt, Mus musculus
cccugcaguagaacuucagcaaacgauagauggaggcuuccaga

SEQ ID NO: 31742 - RNA, 46 nt, Mus musculus
ucuugguagauacacugaaaagagguacaaaucgauugucaaguac

SEQ ID NO: 31743 - RNA, 49 nt, Mus musculus
uuucagguccaggacgacuaccuugaucucuuuggagaccccaguguga

SEQ ID NO: 31744 - RNA, 59 nt, Mus musculus
gugguucagugucugcuacgagccucuccucaacagugccagaucuuagaggagaauua

SEQ ID NO: 31745 - RNA, 42 nt, Mus musculus
uguaacugucuuccucauacuugaagaaagcagacugcagau

SEQ ID NO: 31746 - RNA, 57 nt, Mus musculus
cccauccaucuucauggaacuugcaaacaagaucuacaaacggagaaagugaccccg

SEQ ID NO: 31747 - RNA, 46 nt, Mus musculus
uuauuuauuuauggggucucucucugucucugucucucuugaucua

SEQ ID NO: 31748 - RNA, 44 nt, Mus musculus
aguagguuuggcaucucaugccaugugcaugccugguacccuca

SEQ ID NO: 31749 - RNA, 46 nt, Mus musculus
uggcugguagcaugguccacauggagcuuaaagugggguaguagaa

SEQ ID NO: 31750 - RNA, 46 nt, Mus musculus
uuguuuuaauucuuuugagauugggucucaccauguaaccugaggu

SEQ ID NO: 31751 - RNA, 42 nt, Mus musculus
uuucaugaaaauaugauuuugaaauuagguugagguuuagug

SEQ ID NO: 31752 - RNA, 46 nt, Mus musculus
uauaauuaacucuacuagugaaaaaauucugaccuggggcuuagau

SEQ ID NO: 31753 - RNA, 45 nt, Mus musculus
ucaaucugagcccuuuggcaacaggaaccguuuggaaagcgcaga

SEQ ID NO: 31754 - RNA, 47 nt, Mus musculus
ugggcaacgguuuggaugcagagggcauggcgucggagggucaagac

SEQ ID NO: 31755 - RNA, 51 nt, Mus musculus
caccuuccucgauucccuccaggaauuucccuggguaagagagaagcugga

SEQ ID NO: 31756 - RNA, 46 nt, Mus musculus
ucaguaccuuuaccaggaaggaauuuugacagaaaaccacauucaa

SEQ ID NO: 31757 - RNA, 45 nt, Mus musculus
aaauuaguuaugaaguagcaacaaaaauaauuuuaugguuggggg

SEQ ID NO: 31758 - RNA, 41 nt, Mus musculus
ccuguaagcuggcuuauguccuccccucgcguucaccauuc

SEQ ID NO: 31759 - RNA, 46 nt, Mus musculus
gucaccaugauaugaggaacuguauuaaacggucgcugcauuaggg

SEQ ID NO: 31760 - RNA, 44 nt, Mus musculus
gcaagcacuucaagucuaagauuguugugaaaccucgaguggaa

SEQ ID NO: 31761 - RNA, 46 nt, Mus musculus
cccccaaauaaaacaucaaaacagugaauagcguuagugccuagaa

SEQ ID NO: 31762 - RNA, 46 nt, Mus musculus
guaagacaagcuucuccauacugagcacaaccaaacucucugagag

SEQ ID NO: 31763 - RNA, 28 nt, Mus musculus
cagagccccaacgaagccaaaaagagag

SEQ ID NO: 31764 - RNA, 46 nt, Mus musculus
acagacaaauuugccuaucuuaagcaugagcuuuuaaaugggagug

SEQ ID NO: 31765 - RNA, 41 nt, Mus musculus
gaagggaccgaggaauuuccauuggucggagaacagcccag

SEQ ID NO: 31766 - RNA, 46 nt, Mus musculus
uauucacggagucuucccagucuuccaauauuucagugacagucag

SEQ ID NO: 31767 - RNA, 45 nt, Mus musculus
aucuuaaguuaagaaagaaagaaagaaagaaagaaagaaagaaag

SEQ ID NO: 31768 - RNA, 45 nt, Mus musculus
cugccucugccucuuaagugcugggauugaaggcgcgcacgccac

SEQ ID NO: 31769 - RNA, 46 nt, Mus musculus
cucugaggugcuguuuucccuggaggcuuugugugugguaggcaag

SEQ ID NO: 31770 - RNA, 77 nt, Mus musculus
ccuuucccauuuacugaaguuccaagugacacacacugggcuccuaaaccaaagcacacagagaagaaagcacucca

SEQ ID NO: 31771 - RNA, 24 nt, Mus musculus
acgacaguguauguuccuugccag

SEQ ID NO: 31772 - RNA, 46 nt, Mus musculus
accacuacuauaagaaaaaccuguucgggcuggugagauggcucag

SEQ ID NO: 31773 - RNA, 42 nt, Mus musculus
accucguccuccugcucgcugcggaagcacaggcaggccgcc

SEQ ID NO: 31774 - RNA, 45 nt, Mus musculus
ggaagagcgcggcucguggcucgugccacgcggagacaguuggaa

SEQ ID NO: 31775 - RNA, 41 nt, Mus musculus
cagaggacaaggagaggauaguucaaucccuaggcaggaaa

SEQ ID NO: 31776 - RNA, 47 nt, Mus musculus
cauguaagugcaggguuaagucgaaaggucaaggaaacagccaugag

SEQ ID NO: 31777 - RNA, 46 nt, Mus musculus
gaguuugaacgcaggcugucuagccagaucccacacuugcagcuga

SEQ ID NO: 31778 - RNA, 42 nt, Mus musculus
gggaugcaugggggcggcggccggggguggcccggggcggcc

SEQ ID NO: 31779 - RNA, 45 nt, Mus musculus
aagaaagaaauaaaaaaauuauuaccacucuaucuugugccagau

SEQ ID NO: 31780 - RNA, 45 nt, Mus musculus
auuggagguuuuuugguuuuguuuuguuuuguuuuuuaauuugua

SEQ ID NO: 31781 - RNA, 46 nt, Mus musculus
uuaagaguacgaauggaauucauauauuuuugucaguaggcuauuu

SEQ ID NO: 31782 - RNA, 47 nt, Mus musculus
gcucaggcuggcccccccacucuagaucuuccugcuuuagcccccag

SEQ ID NO: 31783 - RNA, 46 nt, Mus musculus
guuaauuacaucgcagcuuugagggcuccuguggcaaauacccgga

SEQ ID NO: 31784 - RNA, 51 nt, Mus musculus
uggcauaaucccuuaugacccugacaauccccugauaucuaugugccccua

SEQ ID NO: 31785 - RNA, 42 nt, Mus musculus
gugaugcucaggauggggugguggugcucaggaugggguggu

SEQ ID NO: 31786 - RNA, 42 nt, Mus musculus
guggugcucaggauggggugguggugcucaggaugggguggu

SEQ ID NO: 31787 - RNA, 47 nt, Mus musculus
cccgacacaaccuugcuagaccugcaaaacaacaaaauuacagagau

SEQ ID NO: 31788 - RNA, 48 nt, Mus musculus
caacaagaucagcaaaaucaguccagaggcauucaaaccucucgugaa

SEQ ID NO: 31789 - RNA, 54 nt, Mus musculus
aaugcccagaacucuccaggaacuucguguccaugagaaugagaucaccaagcu

SEQ ID NO: 31790 - RNA, 46 nt, Mus musculus
ucauacauucgcaucucagacaccaacauaacugcgaucccucaag

SEQ ID NO: 31791 - RNA, 63 nt, Mus musculus
aggucugccuacuucucucacugaagugcaucuagauggcaacaagaucaccaagguugaugc

SEQ ID NO: 31792 - RNA, 45 nt, Mus musculus
cuccucagggugccugcugggcuggcacagcauaaguauauccag

SEQ ID NO: 31793 - RNA, 45 nt, Mus musculus
gucucucucugucucucugucucucucucucugucucuccugugu

SEQ ID NO: 31794 - RNA, 41 nt, Mus musculus
caggucgucuaccuucacaacaacaacaucuccgcaguugg

SEQ ID NO: 31795 - RNA, 93 nt, Mus musculus
agacggccuaauucuuauaaucuggaaaaacaccccaauaugucaauaucauugcuaaaaagaaaaaauacuaaaaaagaaagaaagaaugcu

SEQ ID NO: 31796 - RNA, 57 nt, Mus musculus
augccuuuuccacaugacuuauuaugcaagcugaauauacagauugaauaauugccu

SEQ ID NO: 31797 - RNA, 73 nt, Mus musculus
uugucuguaguugugaacugaguuaucaaagucugauguaaucauaaaugucaaccacuuaguaaagcguuaa

SEQ ID NO: 31798 - RNA, 47 nt, Mus musculus
auagagcuaaauuaacucuuuugacauaaagucaaaugccgccgaac

SEQ ID NO: 31799 - RNA, 46 nt, Mus musculus
cccucucuucauguaugggcaaauaucacccaacugugcaccagaa

SEQ ID NO: 31800 - RNA, 64 nt, Mus musculus
ggcucauucuugaccacaaccuucuagaaaacuccaagaucaaaggaaagguuuucucuaagcu

SEQ ID NO: 31801 - RNA, 45 nt, Mus musculus
aaucagcaagcucggcuccuucgacgggcuggucaacuugaccuu

SEQ ID NO: 31802 - RNA, 76 nt, Mus musculus
aacucucuaccuagacaauaauaagaucagcaacauuccggaugaguacuucaagcgcuucacugggcugcaauac

SEQ ID NO: 31803 - RNA, 66 nt, Mus musculus
ugaucucuccuauaauaagcuuaagaguauaccaacaguuaaugaaaaucuugaaaauuauuaccu

SEQ ID NO: 31804 - RNA, 45 nt, Mus musculus
uuuuacugauugcauggaaaucagccaaguuuuuuaugguuccca

SEQ ID NO: 31805 - RNA, 42 nt, Mus musculus
agucuguuuugcagacauuuauacucugcauuuugaagccag

SEQ ID NO: 31806 - RNA, 45 nt, Mus musculus
ccaaaaagcucacgaguaauauguagaauaggauuuaagggauua

SEQ ID NO: 31807 - RNA, 46 nt, Mus musculus
ugggaacuugagacccaauauucagcagugaaguagcaucacugag

SEQ ID NO: 31808 - RNA, 46 nt, Mus musculus
auugacguuuuagaucaucuccucugauauucucugaauuuuguag

SEQ ID NO: 31809 - RNA, 53 nt, Mus musculus
cgggagcagcugcgcugccagcguggagcgggaggcguggagguguggagaag

SEQ ID NO: 31810 - RNA, 46 nt, Mus musculus
uacaaagcgcgcauagggcaucccuuuggauaguggcccauuugag

SEQ ID NO: 31811 - RNA, 25 nt, Mus musculus
gugugcccccuuagaaguaagggag

SEQ ID NO: 31812 - RNA, 46 nt, Mus musculus
gucgucucucagaagccugucucugguaacuugguaagcacuauag

SEQ ID NO: 31813 - RNA, 46 nt, Mus musculus
uggcucuuaggaucacuaaggguuugaugugaggaagagggcagaa

SEQ ID NO: 31814 - RNA, 46 nt, Mus musculus
ucccaaagaaugaauaaaaaguuuaaaaagagaaagaacaagucau

SEQ ID NO: 31815 - RNA, 42 nt, Mus musculus
cuuccugggucucuauauaauucauugauaaauugcauggug

SEQ ID NO: 31816 - RNA, 46 nt, Mus musculus
auuauggguuauaguuuaauugucgucuugccguuccuugcguugg

SEQ ID NO: 31817 - RNA, 45 nt, Mus musculus
ccuuacaaauucagagaaaagaaauccauaccaaaaugucgggaa

SEQ ID NO: 31818 - RNA, 87 nt, Mus musculus
ucacaugcuagcaguccagguugguaaccagccuuuaauacaugcaguuugggggacagggaaaguggagggcaggguaccucagau

SEQ ID NO: 31819 - RNA, 45 nt, Mus musculus
uggaucuuugcccuaaagaaacuuaggcauguagaauuucaucag

SEQ ID NO: 31820 - RNA, 42 nt, Mus musculus
ggagaugggugaguacagugguaggcacauaaguguaaggac

SEQ ID NO: 31821 - RNA, 41 nt, Mus musculus
cgugggugugcucaagccuguuguuuugcugggaaggcggg

SEQ ID NO: 31822 - RNA, 42 nt, Mus musculus
aggcaugguagcuaagaauucuacaucuggauuggcaggcag

SEQ ID NO: 31823 - RNA, 46 nt, Mus musculus
aauuaaucuuauuuacaaaaugcugguuuaaaagggaccuguuuag

SEQ ID NO: 31824 - RNA, 46 nt, Mus musculus
cugugugaugugcccgcaguguguacacgggaaagguaagacauag

SEQ ID NO: 31825 - RNA, 62 nt, Mus musculus
agaaaaagaagccauggauuuuaaagggaguaacagaggaaaugggaggcuuuggagggaga

SEQ ID NO: 31826 - RNA, 58 nt, Mus musculus
aaauuuuuaaaauaaaauuuacuauuuuaauagagguaggacuauauauuuuuuuuuc

SEQ ID NO: 31827 - RNA, 45 nt, Mus musculus
caaaauggugccauguguugaugaagcaugguggacacacagaag

SEQ ID NO: 31828 - RNA, 44 nt, Mus musculus
cuuauuaaaauagugaaguuuagaaacaauagauaaugguggua

SEQ ID NO: 31829 - RNA, 45 nt, Mus musculus
ugaggccuuguuuuaaguuuuucugcuaagaaugcauuacaccag

SEQ ID NO: 31830 - RNA, 46 nt, Mus musculus
cugcauuuuauccacauugcuuauuuaccuauuuaaaagcccccag

SEQ ID NO: 31831 - RNA, 42 nt, Mus musculus
aaaguccuaaguggguacugaccuuggacuguacugagguag

SEQ ID NO: 31832 - RNA, 46 nt, Mus musculus
gaagagguaacagaugaugguggccacgugucucaucuugggaggg

SEQ ID NO: 31833 - RNA, 46 nt, Mus musculus
cugugucuagccuuaagaaguguuuuaguuuguuuuucagugggua

SEQ ID NO: 31834 - RNA, 42 nt, Mus musculus
uuacggucagaacaaaggaaggccagcaauuggugggggugg

SEQ ID NO: 31835 - RNA, 46 nt, Mus musculus
gggggggaaaaguauaguuuaucuuagagguaugaauagaagguag

SEQ ID NO: 31836 - RNA, 41 nt, Mus musculus
gguggagggauuaaaacagcagcaacgucaagaguggggca

SEQ ID NO: 31837 - RNA, 68 nt, Mus musculus
uaguuucuccugcauaggagaagcuggaauggagggaguugaucagggagagagagggaagaaaaccg

SEQ ID NO: 31838 - RNA, 46 nt, Mus musculus
ccaaaauccacaacaguuucuguuuaauauugauuugcuuguauag

SEQ ID NO: 31839 - RNA, 46 nt, Mus musculus
gucuuacacggucagcuuuaaacggaacaugcauaucacaaggaga

SEQ ID NO: 31840 - RNA, 46 nt, Mus musculus
cugggaaacauuuuccuccuaauaaauuauccuugugaugggcgac

SEQ ID NO: 31841 - RNA, 38 nt, Mus musculus
cucucauggagcucagauccacggaugcauuacggaaa

SEQ ID NO: 31842 - RNA, 41 nt, Mus musculus
acaucucccaaugaagguaagucuuguguugauuggccacu

SEQ ID NO: 31843 - RNA, 23 nt, Mus musculus
cgugcucccugcucgcucugaca

SEQ ID NO: 31844 - RNA, 46 nt, Mus musculus
ucauugggccuuucuuuuuaucaaccuccggaaggggauaaugcac

SEQ ID NO: 31845 - RNA, 46 nt, Mus musculus
ugaugucauuggugagagcgguugcacaaaaccguuucuaguacag

SEQ ID NO: 31846 - RNA, 46 nt, Mus musculus
gugcucacucgucacuggcaaccuggaccgccuuauauauccugag

SEQ ID NO: 31847 - RNA, 51 nt, Mus musculus
cuguuggggaagaagaaggugaaggagaaacgggguggauugaaggagcug

SEQ ID NO: 31848 - RNA, 27 nt, Mus musculus
auacugauucaaggcaaugaccugaag

SEQ ID NO: 31849 - RNA, 42 nt, Mus musculus
agauugguuggucucaagaccagcuugcuucaguaggcagug

SEQ ID NO: 31850 - RNA, 60 nt, Mus musculus
acucaugugauggaagguucuggaagaaugguggucacugcuguaggugugaauucucaa

SEQ ID NO: 31851 - RNA, 57 nt, Mus musculus
acaggaaucaucuucaccuuacuuggagcugggggugaagaagaggaaaagaaagau

SEQ ID NO: 31852 - RNA, 42 nt, Mus musculus
gcccaggacggcgcggccauggagaugcaaccucugaagagu

SEQ ID NO: 31853 - RNA, 45 nt, Mus musculus
ugcugaugucugccaucacaguuaucauccuaguguuguauuuug

SEQ ID NO: 31854 - RNA, 46 nt, Mus musculus
auaaaugaaaagcauuauaaaaagguuccggaaccagaagccaucc

SEQ ID NO: 31855 - RNA, 41 nt, Mus musculus
gugugccuuguugggguuucucuuggauuuaaaacgggauu

SEQ ID NO: 31856 - RNA, 46 nt, Mus musculus
cagguaagggguugauggaauuuaaaauguuuauuuaaaaggagaa

SEQ ID NO: 31857 - RNA, 50 nt, Mus musculus
cuaaagagaaacuuuagaggugacccgagguggcugguuaagaaccggaa

SEQ ID NO: 31858 - RNA, 41 nt, Mus musculus
ggguaucaaccuaaucuuugcucugauuuuacagagggcaa

SEQ ID NO: 31859 - RNA, 46 nt, Mus musculus
ucugagucuuagagcuaaggaaggggcgcaagaacguagagagcac

SEQ ID NO: 31860 - RNA, 46 nt, Mus musculus
ugugugugugugucuguauguauauaugugugggugugugggugug

SEQ ID NO: 31861 - RNA, 53 nt, Mus musculus
gaccuuaaauaguauugagaagguaguauacaaagcaaggguagcagcuaaaa

SEQ ID NO: 31862 - RNA, 76 nt, Mus musculus
auggucacuggugauaauauuaacacugcucgggccauugcuaccaaaugugguauuuuacacccaggggaagauu

SEQ ID NO: 31863 - RNA, 55 nt, Mus musculus
uccuaugcuuagaagguaaagauuuuaaccgaagaauacgaaaugaaaaaggaga

SEQ ID NO: 31864 - RNA, 46 nt, Mus musculus
cgacagguuguagcuguaacgggugaugguacaaaugacgggccug

SEQ ID NO: 31865 - RNA, 42 nt, Mus musculus
acucacccgacccuacccuacccuacccuaccuuaccucuag

SEQ ID NO: 31866 - RNA, 42 nt, Mus musculus
ccucucaucucacgcacgaugaugaagaacaucuugggccau

SEQ ID NO: 31867 - RNA, 41 nt, Mus musculus
ucaguagaugggaagggaguuuagguggguuauucugugag

SEQ ID NO: 31868 - RNA, 54 nt, Mus musculus
ugcaguuuggcgggaagccuuucagcugcucagaacuuucaauagagcaauggc

SEQ ID NO: 31869 - RNA, 51 nt, Mus musculus
gaagcuggucauggaacccagaaggaggagauaccugaggaggaauuagca

SEQ ID NO: 31870 - RNA, 88 nt, Mus musculus
guugcggcguggccagaucuugugguuuagaggccugaacagaauccaaacacagguaugggucugguagagagguaggagagcugac

SEQ ID NO: 31871 - RNA, 47 nt, Mus musculus
ugaaugcauuucguaguucuuuauacgaaggguuagagaagccagaa

SEQ ID NO: 31872 - RNA, 47 nt, Mus musculus
aagauucagagccgcacaucccccuuauugaugacacugaugcugaa

SEQ ID NO: 31873 - RNA, 46 nt, Mus musculus
aaaacaaaagcaaagcuuucugccagacugagggugcuuuuuuggg

SEQ ID NO: 31874 - RNA, 46 nt, Mus musculus
agauaacacuaaugcuuuguuuaaaaaacaaaaaagaaaaaagaaa

SEQ ID NO: 31875 - RNA, 43 nt, Mus musculus
aauaaccuuuuguucagaauuuaguagauuguuuauugcggga

SEQ ID NO: 31876 - RNA, 41 nt, Mus musculus
uaggagucuuggcuguguacguggaaaauguugcucuaaua

SEQ ID NO: 31877 - RNA, 46 nt, Mus musculus
gguugggacuuggagagagagagagaugugaucggugguggcgaag

SEQ ID NO: 31878 - RNA, 44 nt, Mus musculus
ucuggcacucagggauacuguagccucggaaacggaugcccuca

SEQ ID NO: 31879 - RNA, 33 nt, Mus musculus
cagcagaaggagcagcaacagcaacagcagcag

SEQ ID NO: 31880 - RNA, 42 nt, Mus musculus
ugaggccggggcgguggccgaacccggagguggucgcuguag

SEQ ID NO: 31881 - RNA, 65 nt, Mus musculus
aguugauccagaugaccugccacggcaagaagaguuagcagauaaauuauugauaucuuuaucca

SEQ ID NO: 31882 - RNA, 45 nt, Mus musculus
acuaaaaaaugaagaccaagaaaacaugauacaucuauucagaau

SEQ ID NO: 31883 - RNA, 42 nt, Mus musculus
uuacauuaagguaaaagcauauagaaaaauauuuggggccag

SEQ ID NO: 31884 - RNA, 31 nt, Mus musculus
cucgcuuuggaagaaguugaaaaggcuggag

SEQ ID NO: 31885 - RNA, 46 nt, Mus musculus
gggcugucagucuggagaagcauauagaaagcuuaguagcagcuga

SEQ ID NO: 31886 - RNA, 65 nt, Mus musculus
gugggaaguaaccacaccgagauucugagaagcugagaggggaugcaguaggaaaggaccagacu

SEQ ID NO: 31887 - RNA, 52 nt, Mus musculus
aaauucgccaacuugagaagcagcuggaacaaaaagauagagaauuagagga

SEQ ID NO: 31888 - RNA, 46 nt, Mus musculus
cagaagcuaaugagaagauugaaguucagaaccaagaaaugaggaa

SEQ ID NO: 31889 - RNA, 44 nt, Mus musculus
aggaugaaagcgcuugugcaucagucggaugcugucauggacca

SEQ ID NO: 31890 - RNA, 46 nt, Mus musculus
ggaugaagaggacgauccagucaugauggcuguuaacgcaaaagug

SEQ ID NO: 31891 - RNA, 42 nt, Mus musculus
gcuccuuggauacuuucucuagcuccuccaugggggcccugu

SEQ ID NO: 31892 - RNA, 45 nt, Mus musculus
gcuguuaucgaaauaaagaauuguaaagcccaaauuaaaauaaga

SEQ ID NO: 31893 - RNA, 36 nt, Mus musculus
acaguacagagcugagaaccagguucuuuugaaaga

SEQ ID NO: 31894 - RNA, 46 nt, Mus musculus
gcaauauuccaggcagacacaggcgcucacgaguuucuccgugcca

SEQ ID NO: 31895 - RNA, 64 nt, Mus musculus
aagaugcuuggauggagcuccagacucaggcuggauccugggaugggaggaggaacggcggugg

SEQ ID NO: 31896 - RNA, 45 nt, Mus musculus
cgccguuccuccucccaucccaggauccagccugagucuggagcu

SEQ ID NO: 31897 - RNA, 42 nt, Mus musculus
uuggcaagaagacuuaggaaauugcaagucauucagggugac

SEQ ID NO: 31898 - RNA, 45 nt, Mus musculus
uuguauuaacucaagagucuuugccuuugaguauauuacguaggu

SEQ ID NO: 31899 - RNA, 43 nt, Mus musculus
agguauggggauccccucuugcgugcgugugugccggccggug

SEQ ID NO: 31900 - RNA, 101 nt, Mus musculus
ccgucugaguuuauugaacuugugccuugguuuuccgguugcgagaucguggguucgagucccaccucgugcuuugguuuuacaccuggcagagugagaaa

SEQ ID NO: 31901 - RNA, 56 nt, Mus musculus
caagugagauucucugguuuugguugucuagguagaaguggacgacgguguuugua

SEQ ID NO: 31902 - RNA, 47 nt, Mus musculus
acacacacacacacacacacacggucggggagagggaaaagagggag

SEQ ID NO: 31903 - RNA, 46 nt, Mus musculus
caggggaagcccuuguuccagaggaagaggagguggagauugccaa

SEQ ID NO: 31904 - RNA, 29 nt, Mus musculus
gugugugggggggggggggaugcaugcac

SEQ ID NO: 31905 - RNA, 45 nt, Mus musculus
agaaggaagccacacuaauucggggagagaaugcuuucccagggc

SEQ ID NO: 31906 - RNA, 46 nt, Mus musculus
gacagaucuggaauuuagaauggcaccaaaggaaaauauagggugg

SEQ ID NO: 31907 - RNA, 50 nt, Mus musculus
aguagaagugugaaguuuauucccuuuggagaauuguacuggcuuagagg

SEQ ID NO: 31908 - RNA, 45 nt, Mus musculus
uagguuuaaaacuccccgucauuagcuuaugcuucauggcugugg

SEQ ID NO: 31909 - RNA, 46 nt, Mus musculus
aaguuucaugguuauuuguauacauauuugaagacugcacguccag

SEQ ID NO: 31910 - RNA, 46 nt, Mus musculus
uuccuuuagaaaagcugugauacuucaugcuaauaauggcucauag

SEQ ID NO: 31911 - RNA, 46 nt, Mus musculus
gacuaguggguuucuagauugauugccaucauugcaaaacaaagag

SEQ ID NO: 31912 - RNA, 42 nt, Mus musculus
uggggggcagguguucugagggaugugaggagcgacauacag

SEQ ID NO: 31913 - RNA, 45 nt, Mus musculus
auguuuucucuuuuccacuuaucuugauguuuaaucuucuuuggg

SEQ ID NO: 31914 - RNA, 46 nt, Mus musculus
guaguaguaauaauaauaauaauguguuguauuauaccauguggag

SEQ ID NO: 31915 - RNA, 46 nt, Mus musculus
uuacccuucuguuucaugaggauaggauuggcaguuugauaggcaa

SEQ ID NO: 31916 - RNA, 61 nt, Mus musculus
gaugaacucagaaaguucaaagacaaguugauuacuaaaaaggcagauaauuuucagagga

SEQ ID NO: 31917 - RNA, 50 nt, Mus musculus
uacugaauuuaaaagauaucauuugauguuagaauuuuggacaauacuag

SEQ ID NO: 31918 - RNA, 46 nt, Mus musculus
uuauaaaauugccagguaauuuuuaaaaguuauaaauuagaagaag

SEQ ID NO: 31919 - RNA, 46 nt, Mus musculus
uuuaccaaaagacauuuuaauuuuccuuuguauauauuucuggcag

SEQ ID NO: 31920 - RNA, 46 nt, Mus musculus
uauaauauagauagauagauagauagauagauagauagauagguau

SEQ ID NO: 31921 - RNA, 46 nt, Mus musculus
uagcucacguguggcugaggcaggaggaugcuuagucugggcugua

SEQ ID NO: 31922 - RNA, 42 nt, Mus musculus
guugucauuaucaguauaaugacaacuaaagaagggcccuug

SEQ ID NO: 31923 - RNA, 46 nt, Mus musculus
cuucuagccuagucagaagcgcuguggaaagguugguguuuguuug

SEQ ID NO: 31924 - RNA, 46 nt, Mus musculus
cauauuuuucuguagccuguuuuauuuuuucuuuugauugcuugag

SEQ ID NO: 31925 - RNA, 46 nt, Mus musculus
guguacuugcauauaauaaauaaauaaaucuuaaaaaaaaaaaaaa

SEQ ID NO: 31926 - RNA, 46 nt, Mus musculus
caggcuugcauugaugacaauguugauauggugaaguuucugguag

SEQ ID NO: 31927 - RNA, 45 nt, Mus musculus
cagggggaaauuccugaacagaaugccaauggcuuaugcucuaag

SEQ ID NO: 31928 - RNA, 45 nt, Mus musculus
ucaaauccuacacagauuuaaucuagauggagucauagcccugag

SEQ ID NO: 31929 - RNA, 46 nt, Mus musculus
guauuuaguccaauuuguuagggauacugucuuugacagacuaggg

SEQ ID NO: 31930 - RNA, 42 nt, Mus musculus
uuucuuaguuuucaguuacauucuuuaaagauauggaacuaa

SEQ ID NO: 31931 - RNA, 49 nt, Mus musculus
ggagcugucaacagugaaggagacacaccuuuagauauugcagaggagg

SEQ ID NO: 31932 - RNA, 46 nt, Mus musculus
uuauaguguuuuuaaaaugaguguauaucauaaaacaugggccaua

SEQ ID NO: 31933 - RNA, 44 nt, Mus musculus
aggguagaaaaugagccaugaucuggcaagagagaauucuuggu

SEQ ID NO: 31934 - RNA, 46 nt, Mus musculus
gauuuucuaagaauacugaacuguauacaaaaugaugugucucgug

SEQ ID NO: 31935 - RNA, 42 nt, Mus musculus
uuguuuuaaagaguuggcuuaugcugaaguaugcuucaucag

SEQ ID NO: 31936 - RNA, 45 nt, Mus musculus
aaaucuaagcagauuaaggaacuccacauaaaaccaaagacacug

SEQ ID NO: 31937 - RNA, 46 nt, Mus musculus
ccagucagaauggcuaagaugaaaaauucaggugacagcagauacu

SEQ ID NO: 31938 - RNA, 45 nt, Mus musculus
ucuuacaaguuggguccccaaugaaagagguagaguaagugccca

SEQ ID NO: 31939 - RNA, 45 nt, Mus musculus
uaauucuuuaaauaaaguaagucuuuucauguuguuguuuguuua

SEQ ID NO: 31940 - RNA, 45 nt, Mus musculus
uauuaucgguuuccuuuggcauccacuagguuuguaguacgcucc

SEQ ID NO: 31941 - RNA, 42 nt, Mus musculus
aggagcuggauaacagugacacuggaaauggaagacaggcag

SEQ ID NO: 31942 - RNA, 72 nt, Mus musculus
cuuauacauauaaaauuaacuuacaaaaugacuaaaauagaaccaggucuuuaaaaauaaaucucccccacg

SEQ ID NO: 31943 - RNA, 47 nt, Mus musculus
gucuucauuauagaaagucuggcuuccaugugaacagagccuccugu

SEQ ID NO: 31944 - RNA, 46 nt, Mus musculus
ccugaugcauucacgagagcaagcaagaggagagagagagagagag

SEQ ID NO: 31945 - RNA, 45 nt, Mus musculus
agauuaugauggcuggacaccucuucaugcugcagcucauugggg

SEQ ID NO: 31946 - RNA, 46 nt, Mus musculus
uagguuaggaccuccacacacgccaacaugcauguucaaaccauac

SEQ ID NO: 31947 - RNA, 41 nt, Mus musculus
ucauuuaaaacagcugagaaaaaacugcagcgagggggaag

SEQ ID NO: 31948 - RNA, 46 nt, Mus musculus
cagcugcucuaccugacugagcugcuuuccugugcuugcgucccag

SEQ ID NO: 31949 - RNA, 46 nt, Mus musculus
uugcaugacagucgugguuaugugauugguacguguggcugggugg

SEQ ID NO: 31950 - RNA, 45 nt, Mus musculus
uauaacaggauuuuuuuuuaacucaauuuaauucuuagcuuuuaa

SEQ ID NO: 31951 - RNA, 46 nt, Mus musculus
cuacuucucauuuccugucuagggccaaacagccuuugauguagca

SEQ ID NO: 31952 - RNA, 48 nt, Mus musculus
aaugcaucucgcaucgagucucuggagcaugagaaggcugaugaggag

SEQ ID NO: 31953 - RNA, 46 nt, Mus musculus
gggaagggugcauugauuguaguuguacugagcuuguaguugggag

SEQ ID NO: 31954 - RNA, 46 nt, Mus musculus
ucucuauugguaaccuguaaauuuguugcuguggacuugucaggag

SEQ ID NO: 31955 - RNA, 26 nt, Mus musculus
gcuggcucuguaaacgucucacauuu

SEQ ID NO: 31956 - RNA, 61 nt, Mus musculus
ugcagcuguuacagcaccuacucugucuuccaaccaggggaccccuacaucaccuguuaaa

SEQ ID NO: 31957 - RNA, 46 nt, Mus musculus
guucucaauguuuauaguuguugucaaaacauaccauauuuuucug

SEQ ID NO: 31958 - RNA, 48 nt, Mus musculus
ugguauuauaaugaauaguuaauaaauguuaguuacuaaaguauggca

SEQ ID NO: 31959 - RNA, 45 nt, Mus musculus
uauacugauaauuucucaccccagaaaguacagcauagaaaguca

SEQ ID NO: 31960 - RNA, 45 nt, Mus musculus
ggauucaauccccuauacuagcaaaaaaauaaagcucaaccuaag

SEQ ID NO: 31961 - RNA, 118 nt, Mus musculus
aaagaagaggaaagaaaagaugagucuccugcauccuggagguuagggcuucgaaagacuggcaguuacggugcccuggcugaaaucagugcgucuaaagaagcccagaaggagaaag

SEQ ID NO: 31962 - RNA, 46 nt, Mus musculus
uuccaguccgagacucucguccucuuuggauaauaaagaaaaggua

SEQ ID NO: 31963 - RNA, 67 nt, Mus musculus
gaacgagacuugcguaugucaccccuacaaucccgagacgacuagccaguacaucugacauugaaga

SEQ ID NO: 31964 - RNA, 48 nt, Mus musculus
agucuucaaguuugcgaacaaguaguucuuacacaagaagaaaauggg

SEQ ID NO: 31965 - RNA, 49 nt, Mus musculus
aagcacugcugcaaagacucccccggguuccuccuccgcaggcacacag

SEQ ID NO: 31966 - RNA, 45 nt, Mus musculus
augcugcagcuccuuccaccaccacccugacuacaacuacugcug

SEQ ID NO: 31967 - RNA, 61 nt, Mus musculus
agcuagcaguuauuagcaguuaggcguuuuagucaucucugaaagaauugaugucuggguc

SEQ ID NO: 31968 - RNA, 58 nt, Mus musculus
gcgcauucgagagcacauguguugugaagacuugggagaaaauauauuacaacauacc

SEQ ID NO: 31969 - RNA, 45 nt, Mus musculus
guguagcuuagugguaaagccauugcuucagguaucagucccagg

SEQ ID NO: 31970 - RNA, 46 nt, Mus musculus
cguccuuccuuuugcuuccuuccucuuuuucuucacugggggucaa

SEQ ID NO: 31971 - RNA, 46 nt, Mus musculus
aucucagagaaagugcuuguuacuuaccaucauuugaaaugcacag

SEQ ID NO: 31972 - RNA, 46 nt, Mus musculus
gcccucccagagggacccaauggucauguaagcaucaggcaggcaa

SEQ ID NO: 31973 - RNA, 46 nt, Mus musculus
agugaugauggagaagaggccuagugcucaguauagaaaacagcag

SEQ ID NO: 31974 - RNA, 96 nt, Mus musculus
ggaagcugaaaaaacaauaggaagaagucguucuacgagaaccagagaacaagaaaaugaagagaaagaaaaagaagaaaaggaaaagcaggauaa

SEQ ID NO: 31975 - RNA, 50 nt, Mus musculus
agucuuguagguauaaccucugccuacucccggggauuagccaaagaaaa

SEQ ID NO: 31976 - RNA, 46 nt, Mus musculus
aaaguccucauaauccugcagugcagaggccauuuacagaugagaa

SEQ ID NO: 31977 - RNA, 41 nt, Mus musculus
aacuuuucagaagaaagcaucugcccuuaggauagcaguga

SEQ ID NO: 31978 - RNA, 41 nt, Mus musculus
gggggcauauguguguguaagugcgaugacacaccugcaga

SEQ ID NO: 31979 - RNA, 54 nt, Mus musculus
ccguuuguguaauccauaaauagagggagagaaaaaagaagaggagaaagaagg

SEQ ID NO: 31980 - RNA, 87 nt, Mus musculus
ggaagauaagucacagccuaagucaaucagagaacgacggcgacccagagaaaagcgacggucuacuggagucuccuucuggacaca

SEQ ID NO: 31981 - RNA, 42 nt, Mus musculus
uuauaucaaaaguauaacuuccagcuuccaaaguacaggcag

SEQ ID NO: 31982 - RNA, 42 nt, Mus musculus
gagaggggucacccucuucuggagugucugaggacagcuaug

SEQ ID NO: 31983 - RNA, 46 nt, Mus musculus
agcggcaaucggacacugaggacggcuccagcaagagagagacgca

SEQ ID NO: 31984 - RNA, 23 nt, Mus musculus
acauaauugugguugcacuugcg

SEQ ID NO: 31985 - RNA, 46 nt, Mus musculus
cugaaugguuauuuuauggaaaauuauacauuaagugauaagggag

SEQ ID NO: 31986 - RNA, 46 nt, Mus musculus
aauaaaguuuaauaugcuuuuuugguuuuuguuuuuuacuuucuag

SEQ ID NO: 31987 - RNA, 46 nt, Mus musculus
ggucauuaugauaaguuccugugaacaaagcuuguucccgaaugag

SEQ ID NO: 31988 - RNA, 45 nt, Mus musculus
cauacaguuacuuagaagacagaaaaccuuacaguagcaggcuag

SEQ ID NO: 31989 - RNA, 55 nt, Mus musculus
uacaugauacaaauauggaacuaacggaucuaaaguugcaguuggaaaaggcuac

SEQ ID NO: 31990 - RNA, 46 nt, Mus musculus
caagaacgauuugcugacaggucacaauuggagauggaaaaaaggg

SEQ ID NO: 31991 - RNA, 46 nt, Mus musculus
cuacaauauuuugguugguuguggucugcacuuguacuucucucag

SEQ ID NO: 31992 - RNA, 46 nt, Mus musculus
uuauauguguauggaugugcacgccaugcgugaguguugagucaga

SEQ ID NO: 31993 - RNA, 46 nt, Mus musculus
uuguaguucaauauuucuuugaggguaaaccauagagggggacaag

SEQ ID NO: 31994 - RNA, 46 nt, Mus musculus
acuguuaucacuuugugugugugugugugugugugugugugugugu

SEQ ID NO: 31995 - RNA, 46 nt, Mus musculus
cuuaaaggcagacaaccagaggcuaaaggaugaaaauggagccuug

SEQ ID NO: 31996 - RNA, 46 nt, Mus musculus
cuuguuuacagcuccagcaaauaaagaaaguguucaaggccagaua

SEQ ID NO: 31997 - RNA, 46 nt, Mus musculus
uuuuuuuuucuuuuucuuuuucuuuuuucuuuuugaugugccacag

SEQ ID NO: 31998 - RNA, 47 nt, Mus musculus
uuccauuuuaaaaggucauuguguucuacugccuauuuuagauuacu

SEQ ID NO: 31999 - RNA, 45 nt, Mus musculus
acuaccaagcucaggauucuuuuaaagguacaaggauagguguga

SEQ ID NO: 32000 - RNA, 44 nt, Mus musculus
acagaguauuucacggucuagugaggagguaaacuaugcggcua

SEQ ID NO: 32001 - RNA, 45 nt, Mus musculus
guuaggcaugcugugguuuguaucugugaagucuggaugccugag

SEQ ID NO: 32002 - RNA, 45 nt, Mus musculus
aauggagcugcuggcagugguggagcauuccuuuaaugccagcag

SEQ ID NO: 32003 - RNA, 45 nt, Mus musculus
aauguggauuuaacccagaaaaucugaguuauuuuuuucccuucc

SEQ ID NO: 32004 - RNA, 46 nt, Mus musculus
uuucccaggcucugcaaacguuucagacacaaacccuagguuguau

SEQ ID NO: 32005 - RNA, 45 nt, Mus musculus
cucuucuguaccuuuucccacuuuguuuccuugaacuuucuguau

SEQ ID NO: 32006 - RNA, 25 nt, Mus musculus
cauaagaagaaagcugccaagcaga

SEQ ID NO: 32007 - RNA, 45 nt, Mus musculus
ugguauggaaauuuaaagcacggcacaaauuauguauggggacag

SEQ ID NO: 32008 - RNA, 46 nt, Mus musculus
gugugauuuuggacuuaguacuugauguuuucaguaucaugcggag

SEQ ID NO: 32009 - RNA, 46 nt, Mus musculus
ugccauuuagauugaagaaagcuuaagcaguuacuuggguguuuag

SEQ ID NO: 32010 - RNA, 45 nt, Mus musculus
gcccugguccugggggcaccgaaagucgaucucuuugcccuccgu

SEQ ID NO: 32011 - RNA, 45 nt, Mus musculus
guuucuuuuuuuuuuuucuuuuuuucuuuuucuuuuuggcgagga

SEQ ID NO: 32012 - RNA, 45 nt, Mus musculus; identical to SEQ ID NO: 28197

SEQ ID NO: 32013 - RNA, 45 nt, Mus musculus
cuaauagccauuauggcuuauaaaguuggaggaggaauguugaga

SEQ ID NO: 32014 - RNA, 42 nt, Mus musculus
cuuaguguagaaaaguaacuuuuuuuuuaaugcagggcagcu

SEQ ID NO: 32015 - RNA, 45 nt, Mus musculus
uuguacauaaaauuuaguucuguccaaagucaccauaguucaagg

SEQ ID NO: 32016 - RNA, 46 nt, Mus musculus
ccccuucaagaucuuagcauuaaaauacaaaaaaaaaaaaaaccga

SEQ ID NO: 32017 - RNA, 42 nt, Mus musculus
guaaagccagcgcccuccgcacggucgcuugccgguuaagau

SEQ ID NO: 32018 - RNA, 42 nt, Mus musculus
caaauaggugcucacagggcuugaagggaccugagcagggaa

SEQ ID NO: 32019 - RNA, 69 nt, Mus musculus
cggaugcuaagguugagcgagcugacggauaugaaccgccaguccaagaaucaguguaaaauccagauu

SEQ ID NO: 32020 - RNA, 82 nt, Mus musculus
aagaaacccaaguuugaauugggcaagcucauggagcugcauggggaaggcggcagcucuggcaaagcagcuggagacgagu

SEQ ID NO: 32021 - RNA, 67 nt, Mus musculus
cuucacuaagaaacgcaacaaccagauaagaaagacauccuaugcgcagcaccagcaaguccgccag

SEQ ID NO: 32022 - RNA, 73 nt, Mus musculus
ggcagaccaugauugaagcucacguugaugucaagacgaccgauggguauuugcuccgacuuuucuguguugg

SEQ ID NO: 32023 - RNA, 60 nt, Mus musculus
uuaggaacaucaggaagacacuagucacgaggacucaaggaaccaaaauugccucugaug

SEQ ID NO: 32024 - RNA, 63 nt, Mus musculus
aaguggucgauccauuuucuaagaaagacugguacgaugugaaagcuccagccauguucaaua

SEQ ID NO: 32025 - RNA, 44 nt, Mus musculus
ugacgaaagguagcaagaagggagcuaagaagaaaguggucgcu

SEQ ID NO: 32026 - RNA, 44 nt, Mus musculus
ugaacugagacaauucacucuggcuguuugaacagcagcguuuc

SEQ ID NO: 32027 - RNA, 45 nt, Mus musculus
agugagauuucagaauagcuugugcuaguuagauucgggucagaa

SEQ ID NO: 32028 - RNA, 45 nt, Mus musculus
caguuuguuaccaagcacaguauuauuuaaucuucaguagccagu

SEQ ID NO: 32029 - RNA, 45 nt, Mus musculus
aacuauagcuuuuucuuuaguuuucuucauacuaggcgggcaagu

SEQ ID NO: 32030 - RNA, 91 nt, Mus musculus
guaaaagacaugucauugacauguaaaagaugcuauagauaaucgaguuagauggaagacuuuaagaauaaaaauauguggaaggcagaag

SEQ ID NO: 32031 - RNA, 46 nt, Mus musculus
cauggagaaagaugagcccaauagaaaauacagaagagggugacaa

SEQ ID NO: 32032 - RNA, 46 nt, Mus musculus
gggcaccaggcauggagccaacaaugaaaaccaacacguaugagcg

SEQ ID NO: 32033 - RNA, 38 nt, Mus musculus
cgacuucaaguacagauggacccaaauucccuggagau

SEQ ID NO: 32034 - RNA, 46 nt, Mus musculus
ccaaacucuuguuucuugugggugagaucucauauagacugguauc

SEQ ID NO: 32035 - RNA, 44 nt, Mus musculus
gcacgcccacugucauguaccuaccacaccacucugcacuagga

SEQ ID NO: 32036 - RNA, 42 nt, Mus musculus
guauuaguguuacugggcgcucuguaugugagguggugguga

SEQ ID NO: 32037 - RNA, 46 nt, Mus musculus
agguugcaaagagaagacuugcacugaaaagcaagcuuuauaaguc

SEQ ID NO: 32038 - RNA, 41 nt, Mus musculus
auuguuuugcuucgguuuauacaaaagaaaaagggggguug

SEQ ID NO: 32039 - RNA, 42 nt, Mus musculus
ucauaguugucccaguaguucucuuuuaugauggcaccuuuu

SEQ ID NO: 32040 - RNA, 79 nt, Mus musculus
ugagggggaugagcaacaauaccccucaguuaaaucgcagcuuaucacaaggcacucaguuaccgagccacgucacgcc

SEQ ID NO: 32041 - RNA, 46 nt, Mus musculus
aauaaauuucucuaaaaugcguuuacaaaggauaauauaugaaaga

SEQ ID NO: 32042 - RNA, 47 nt, Mus musculus
gaaguuuucaucuagaacgacuuuaagacacuguguagagguagaga

SEQ ID NO: 32043 - RNA, 37 nt, Mus musculus
uuugagggccuacuaauuucuuuaaaagggcaaaaag

SEQ ID NO: 32044 - RNA, 46 nt, Mus musculus
uuaaaguaguucaaaaauuagacacuuuucuuacacagucagaaaa

SEQ ID NO: 32045 - RNA, 46 nt, Mus musculus
ggguaaaagaauaaaugucuuccuuauaaaauuuguuuagggaaaa

SEQ ID NO: 32046 - RNA, 46 nt, Mus musculus
aaaagaggauccaugaagaauuuaauucauuacucagcaucauguc

SEQ ID NO: 32047 - RNA, 46 nt, Mus musculus
aguuggaguuagagguuguuguaagcuccugauugugugugcaugc

SEQ ID NO: 32048 - RNA, 45 nt, Mus musculus
uccagggaagggaaggcauucuuagucagagaaugcucaguagug

SEQ ID NO: 32049 - RNA, 45 nt, Mus musculus
aagcaguuugcuuuauccauuuucccaucugauacauccuuaauu

SEQ ID NO: 32050 - RNA, 44 nt, Mus musculus
uaugugacuggguacuaauuaauaaucuauacuggacauuuagg

SEQ ID NO: 32051 - RNA, 23 nt, Mus musculus
aggagcagggaauugggcuagag

SEQ ID NO: 32052 - RNA, 42 nt, Mus musculus
gaaugaguggucgugacugagccuuuugaguauaggaaagcu

SEQ ID NO: 32053 - RNA, 45 nt, Mus musculus
caugcuaggcaaagcacuuuaacacuuaccuguauacccccaacu

SEQ ID NO: 32054 - RNA, 44 nt, Mus musculus
ggcuaacuuuagugagugauagaaagacuuaacaaaggacugga

SEQ ID NO: 32055 - RNA, 46 nt, Mus musculus
guagucugaugugcuguugggaaaggggaaaaauaaccggggccac

SEQ ID NO: 32056 - RNA, 46 nt, Mus musculus
uaaauacauuaugugagaaggcuccccuuugaucacugucucauac

SEQ ID NO: 32057 - RNA, 46 nt, Mus musculus
aucucugauuauuucuuccccucccucucuccucuugccccauucc

SEQ ID NO: 32058 - RNA, 46 nt, Mus musculus
uuuucauuccagucuuaaggagggcuugugugugugugugcagggu

SEQ ID NO: 32059 - RNA, 46 nt, Mus musculus
cuguuguggacaauauuugaagcagccccauaucccacaccuagca

SEQ ID NO: 32060 - RNA, 41 nt, Mus musculus
ggaaauaauagggcuaauuaagaaguaguauaguaggcaga

SEQ ID NO: 32061 - RNA, 45 nt, Mus musculus
uaauaaaagcaacauuuucuagaaaaguguaauggauaugcugau

SEQ ID NO: 32062 - RNA, 63 nt, Mus musculus
gacagcgacuaccaugaugagaacauguacuacagccagucuucuauguucccacaucgguca

SEQ ID NO: 32063 - RNA, 42 nt, Mus musculus
uacaaaguaagccgagcaaugguagcgcagaggcaggcagau

SEQ ID NO: 32064 - RNA, 47 nt, Mus musculus
uagaaagcccugguaccauaaaagcaagacaugcuggaugugaagag

SEQ ID NO: 32065 - RNA, 46 nt, Mus musculus
uuguucaggcauugcacucauucacguuuccuuagacaggcuuaug

SEQ ID NO: 32066 - RNA, 42 nt, Mus musculus
ugcugcaacaccugcaggaaucgaaagcuguguuucccaggu

SEQ ID NO: 32067 - RNA, 46 nt, Mus musculus
ggaguuugaguaguguagacuaguugcugagaucacagaggcagga

SEQ ID NO: 32068 - RNA, 46 nt, Mus musculus
uccauccucucccccaucucuucccuuguccauucuguccccuguc

SEQ ID NO: 32069 - RNA, 46 nt, Mus musculus
ccugccuccuccugccuccuccugcugccccccgcugcccccugcc

SEQ ID NO: 32070 - RNA, 46 nt, Mus musculus
agucucccuccauuucccaacuuaguacucuucucccuugccuuuu

SEQ ID NO: 32071 - RNA, 46 nt, Mus musculus
uauuuaauguaugguuuugguucugacauaauucaugacuccagug

SEQ ID NO: 32072 - RNA, 46 nt, Mus musculus
aaaagugguugguguauaucuuucucucuuuggauacuauuaagga

SEQ ID NO: 32073 - RNA, 46 nt, Mus musculus
cauuucuggugaugaugaaauauguuaggguucauccuguguguga

SEQ ID NO: 32074 - RNA, 47 nt, Mus musculus
acuuuggcuucuuucuuuuuccucuauuuucuaccuuucuugucuau

SEQ ID NO: 32075 - RNA, 46 nt, Mus musculus
ggguugacuacaagcucacgguuaaguaacuaccuugcccuugcau

SEQ ID NO: 32076 - RNA, 129 nt, Mus musculus
ucguuaccuuccuuccaguuuuccugcagucccuuuguugcuaggacguacguauaguuaguaugaugccaguuacugguuuauaaguucaaaauguuuugggguucucuauuuuucuauuucccuucc

SEQ ID NO: 32077 - RNA, 46 nt, Mus musculus
ggguauuucauugguuuccccugcuuccugcccaccuggacaguua

SEQ ID NO: 32078 - RNA, 54 nt, Mus musculus
uucauuuugugacuagcauugugaauugcccgguucuucugauaacucacugag

SEQ ID NO: 32079 - RNA, 64 nt, Mus musculus
uacuauuaaucagaauagccgauuuuuuaaaauuagguuuuauauccaucacgguugcaaaacu

SEQ ID NO: 32080 - RNA, 65 nt, Mus musculus
uuacacuuaaauacuuugauuucugguuguaaaugguauagcaaaagagucuauuguauagaugu

SEQ ID NO: 32081 - RNA, 46 nt, Mus musculus
gauguuguuugugguuacucugauaacuuuguccaugccuguaaau

SEQ ID NO: 32082 - RNA, 46 nt, Mus musculus
gugaggaaaggacacgacucuauggugaggacugauggacauacau

SEQ ID NO: 32083 - RNA, 42 nt, Mus musculus
ugaacuuuuugaauuuuaauuuuuauuuuugaaacagcauga

SEQ ID NO: 32084 - RNA, 46 nt, Mus musculus
uaauuuuagauuuuaaacacaucuuuugauuaaaauuugcacagua

SEQ ID NO: 32085 - RNA, 48 nt, Mus musculus
gcaguggcauccugcuccugguuguccccuuucacagacagucuuagg

SEQ ID NO: 32086 - RNA, 57 nt, Mus musculus
uuuucguggaagauaaucucugcuuaauagaaaauuucccuguaguuuggcaaacac

SEQ ID NO: 32087 - RNA, 46 nt, Mus musculus
ugucaaaguggccguuucauauauuuuguuugguuuaaaguagaug

SEQ ID NO: 32088 - RNA, 45 nt, Mus musculus
cagugaaucuuguuuucuaucuguuuugguuugucugugccauuu

SEQ ID NO: 32089 - RNA, 41 nt, Mus musculus
uccacucuaucagacuuuugugucuuacaaacuccacuuua

SEQ ID NO: 32090 - RNA, 46 nt, Mus musculus
gaauagaagaaaggaacaacaguaguauucacaaggucaacgagau

SEQ ID NO: 32091 - RNA, 45 nt, Mus musculus
uuugagccagaaaucucuugauucuauuuuaccuggcugccacua

SEQ ID NO: 32092 - RNA, 46 nt, Mus musculus
gugugaucagaauuucugccccaccucccacuccccacacccagcu

SEQ ID NO: 32093 - RNA, 41 nt, Mus musculus
gggaaguacuuuguacacaggggagugaaaagagaguuagu

SEQ ID NO: 32094 - RNA, 46 nt, Mus musculus
ggaguguauguaaagacaugccucuucauguaugucaaggcuauuc

SEQ ID NO: 32095 - RNA, 84 nt, Mus musculus
acugaccuugaguucuaguccuuuaaguugccaccaugcucuguguuuuugaguguacuguaggcuugaauuucccccacacuu

SEQ ID NO: 32096 - RNA, 46 nt, Mus musculus
gguguuugaacccaagaaggcucuuacuagcuaucugucccccuaa

SEQ ID NO: 32097 - RNA, 58 nt, Mus musculus
aagaugacagugauuucuuuuaacagugaaaucugugugucuuucacuuguaggucug

SEQ ID NO: 32098 - RNA, 98 nt, Mus musculus
uuugcugugcuauuucgaugaaauuguauauauuuugcauuggaaagaauuugaugucauacucuggaggauaaagccuuggagauauuggcguggcu

SEQ ID NO: 32099 - RNA, 46 nt, Mus musculus
ugacuuaagaucuuuuugaaagauaauuauuugaugggguguuguc

SEQ ID NO: 32100 - RNA, 45 nt, Mus musculus
ugaaagggcaaggaggggggaugugggaauguuggagggaugaaa

SEQ ID NO: 32101 - RNA, 46 nt, Mus musculus
caauaccagauggucagccgugaaaacauacaugugaguaguguua

SEQ ID NO: 32102 - RNA, 47 nt, Mus musculus
gucugccagacacagaacuacaagucaccaaggaaugccgagagaga

SEQ ID NO: 32103 - RNA, 45 nt, Mus musculus
ucaaagcacucccugaccuaaggcucagggaacauuuuagaagau

SEQ ID NO: 32104 - RNA, 46 nt, Mus musculus
aaaaaaguguacaagguuuauagcauagauguauucacacaaagau

SEQ ID NO: 32105 - RNA, 45 nt, Mus musculus
caaagcccagcaaccacaugguggcucacaaccauccguaaggag

SEQ ID NO: 32106 - RNA, 46 nt, Mus musculus
gacagcaacgaagaacagauaaccguaccacaggaguagucuagau

SEQ ID NO: 32107 - RNA, 26 nt, Mus musculus
uccccuuauuccagaaugccgggguu

SEQ ID NO: 32108 - RNA, 46 nt, Mus musculus
uaaagagaaguuuguaauuccucugucucauaagguuagaaguuua

SEQ ID NO: 32109 - RNA, 92 nt, Mus musculus
uuaauuguauaugccagccuaggauaaauaaucucuauguuaaagcguuaagacauaaaauguuauuuuaaaaaauuguauuuuuugugagu

SEQ ID NO: 32110 - RNA, 71 nt, Mus musculus
auauuaacuagaaauuaauucuuuggauaguuuaaggcccacaguauauuauuaacaaugagguuuaauuu

SEQ ID NO: 32111 - RNA, 73 nt, Mus musculus
auuaaguuggucucagggacaugaugcuugccuagguucugaagggugaguuggcuuucauaaaaugggggag

SEQ ID NO: 32112 - RNA, 49 nt, Mus musculus
ucaugggucuuguggugcaugcuuuagagacacuguaggauggagagaa

SEQ ID NO: 32113 - RNA, 94 nt, Mus musculus
gucuagaucugacagaacuggcaucagucuguguuagagaaaauuauauuggaggacaaauauaaaaugaccugauuugcaucuccugagagua

SEQ ID NO: 32114 - RNA, 132 nt, Mus musculus
cucaccaggaaagagugcccaagauaugauccuguuguaagagauguaaaguagagccuguaagccuuaguaaguuuuagcaggauguaugaggagugggcaguguuuuccaugaagaggccuuggaaaaau

SEQ ID NO: 32115 - RNA, 93 nt, Mus musculus
uagaaugucuuccagugggaucaaguugucaggcuuugacaagaacaggacauuucaugagcaguaaugcuuuuugcauaaaugaggugaauu

SEQ ID NO: 32116 - RNA, 45 nt, Mus musculus
uagugcgcuuggagagggacaguugggugugugucaugucugcca

SEQ ID NO: 32117 - RNA, 45 nt, Mus musculus
acuuagcuggggguggugauaaaaaacaccuuugaggcaggcaga

SEQ ID NO: 32118 - RNA, 46 nt, Mus musculus
uagcuuuuugagaagugucuguagagucugugugaagccuugagaa

SEQ ID NO: 32119 - RNA, 45 nt, Mus musculus
cucccccaacccccaauacucauuacugaguaugucaccauggau

SEQ ID NO: 32120 - RNA, 46 nt, Mus musculus
uuauuuauuuauuuuauggaugugacuacaguguagccguacagau

SEQ ID NO: 32121 - RNA, 82 nt, Mus musculus
aagcaggcuguagauccuguauguuuguuugagcagacauuggaggaaggcuuaugugaauggugauaguuuuaggaggaga

SEQ ID NO: 32122 - RNA, 23 nt, Mus musculus
gaggcggcggaagcccgggaagg

SEQ ID NO: 32123 - RNA, 46 nt, Mus musculus
aucguuauaaaccaucugaauuucguuuucaccucagccccguaga

SEQ ID NO: 32124 - RNA, 45 nt, Mus musculus
aguuaccagaguauacauuauacuugugaaaaaaaauuggaggga

SEQ ID NO: 32125 - RNA, 46 nt, Mus musculus
uuaaauuaauaguuaccuuuauuugugugugugugugugugugugu

SEQ ID NO: 32126 - RNA, 45 nt, Mus musculus
ugaaauccaaggccaggaucugcagguucugcagcugugccaggu

SEQ ID NO: 32127 - RNA, 42 nt, Mus musculus
ucauagaugaccagcuucagauuugucaagugggccaggcug

SEQ ID NO: 32128 - RNA, 29 nt, Mus musculus
aguucucgggaaggaaagaggcaugagag

SEQ ID NO: 32129 - RNA, 45 nt, Mus musculus
gcagcaguuucuacauaugugaccgguuuccuccauggcuguuga

SEQ ID NO: 32130 - RNA, 45 nt, Mus musculus
cuuuuuucuuuuuuaagauuuauuuuuaaauguggggugggcauu

SEQ ID NO: 32131 - RNA, 45 nt, Mus musculus
ccaccgauggaguaaaagguaggcacgaggucugugcugacugca

SEQ ID NO: 32132 - RNA, 46 nt, Mus musculus
cucauauaguuacuagggaguggaacucccagauaggaauagaagg

SEQ ID NO: 32133 - RNA, 46 nt, Mus musculus
uuuguuucugugcuaccgugugugugugugugugugugugugugug

SEQ ID NO: 32134 - RNA, 42 nt, Mus musculus
cucuucacugaggucaaacaacuggcccuucaggucccaggc

SEQ ID NO: 32135 - RNA, 42 nt, Mus musculus
gguccagcagggccaggaagaaacacgaggaagccaggagau

SEQ ID NO: 32136 - RNA, 46 nt, Mus musculus
aagaacaagaacacuccucccacgugacagcauuugaauaggaggc

SEQ ID NO: 32137 - RNA, 46 nt, Mus musculus
gaagggucacgucuaaguauagaaaacauaaaacuguaagguagag

SEQ ID NO: 32138 - RNA, 46 nt, Mus musculus
acacgcgcgcgugcgcacacacacacacacacacacacacacacac

SEQ ID NO: 32139 - RNA, 46 nt, Mus musculus
acuucuguagcccuugaugaggaagguccaccaucaucugcaggag

SEQ ID NO: 32140 - RNA, 46 nt, Mus musculus
ggacuuuggaaguguaugugagaaguccuuuccaucuccugcagau

SEQ ID NO: 32141 - RNA, 90 nt, Mus musculus
aauuagacaacauggguauuauuuuuauacauuaaagccagaaaacugucuuaguccacauaaaauucacuuauaauuuauccuggagag

SEQ ID NO: 32142 - RNA, 74 nt, Mus musculus
ccaggggcggccuaaaaauggcugcauuguucacggcaagacuggacaccucaugucauguuucacgugugcaa

SEQ ID NO: 32143 - RNA, 46 nt, Mus musculus
ucccaaccaucgacuuccagcagcauuguuuauagcagccaagaaa

SEQ ID NO: 32144 - RNA, 56 nt, Mus musculus
ucgugagaacuggcuuccagacgauaaggggaaagauaaaguggaaaucucugaaa

SEQ ID NO: 32145 - RNA, 57 nt, Mus musculus
cucaugcaaugaaaugaauccuccccuuccaucacacugcaaaagaugcuggacccu

SEQ ID NO: 32146 - RNA, 75 nt, Mus musculus
ggucacagucuaucagacaggagaaagcgauacagacucuuuugaaggagauccugagauuuccuuagcuguaag

SEQ ID NO: 32147 - RNA, 45 nt, Mus musculus
guaucgcuuucuccugucugauagacugugacccgauagaccuag

SEQ ID NO: 32148 - RNA, 91 nt, Mus musculus
gcuugauuuauuauagucucacauuacuaaauaaaaaacuuagaggagaguuugaacaauguuuuuaaacuuuuuuugaguugauggggug

SEQ ID NO: 32149 - RNA, 45 nt, Mus musculus
gcauucugccugcauguaugucugcaggccagaagagggcacuag

SEQ ID NO: 32150 - RNA, 37 nt, Mus musculus
auacaugcaggcagaaugcuguauacauaacaaauaa

SEQ ID NO: 32151 - RNA, 53 nt, Mus musculus
ucagagucucuggaaagucuugcuuuuucauuuguucaagauagaauauugcu

SEQ ID NO: 32152 - RNA, 60 nt, Mus musculus
gccuggaucaggauucaguuucugaucaguuuagcguggaauuugaaguugagucucugg

SEQ ID NO: 32153 - RNA, 46 nt, Mus musculus
uaagcagcaucuugguagcaaauugagaaugccuguguccugaauu

SEQ ID NO: 32154 - RNA, 68 nt, Mus musculus
uguccuuugauccgagccugggucugugugagcugagggagaugugcagcggcggcagcagcagcagu

SEQ ID NO: 32155 - RNA, 50 nt, Mus musculus
cugauuuaauuucuagacugucuaccucaucuagaaggagauccauuagu

SEQ ID NO: 32156 - RNA, 46 nt, Mus musculus
agaaaaguguguuagaguaagaacuuuaugcaaguauuaccuucag

SEQ ID NO: 32157 - RNA, 46 nt, Mus musculus
ccucccccacgucuacuaaacauuuuuguuuccccugcuaguauau

SEQ ID NO: 32158 - RNA, 46 nt, Mus musculus
aggcaguaagcauggcagcaugcaggcagauguggugcuggaggag

SEQ ID NO: 32159 - RNA, 33 nt, Mus musculus
cggcagugcccagcuguggucucacgguugaug

SEQ ID NO: 32160 - RNA, 46 nt, Mus musculus
aggauuuucaaaauuacuuuuaacuaaacugaaacacagcaucaag

SEQ ID NO: 32161 - RNA, 42 nt, Mus musculus
guauuugaauacuaguagcugugggcucugaaaccccguaau

SEQ ID NO: 32162 - RNA, 45 nt, Mus musculus
uagaacucauuauguagaucaggcagaccuuuaacucccagagau

SEQ ID NO: 32163 - RNA, 41 nt, Mus musculus
agcugugguaucuaggaacuaagaguaauccagccccauga

SEQ ID NO: 32164 - RNA, 46 nt, Mus musculus
aaaaccacaaaccuuugaguagcuuuuuguuguguauguaucugua

SEQ ID NO: 32165 - RNA, 45 nt, Mus musculus
ugacagaggugagaaacagugaccgcccagcugguacuucuuuaa

SEQ ID NO: 32166 - RNA, 44 nt, Mus musculus
auauuaugacuaagagguuauaugacgagaagcagcagcacauu

SEQ ID NO: 32167 - RNA, 46 nt, Mus musculus
aguguucuuaaccacugggccaucucuccagugucccccccccccc

SEQ ID NO: 32168 - RNA, 47 nt, Mus musculus
aagguugugaguucaaaucccagcaaccacaugguggcucuguaaug

SEQ ID NO: 32169 - RNA, 46 nt, Mus musculus
gacaccccagaagagggcaucagaucucauuacagagccaccaugu

SEQ ID NO: 32170 - RNA, 46 nt, Mus musculus
agugacaugucacaaacguauacuucuacagcucugaggucaucac

SEQ ID NO: 32171 - RNA, 46 nt, Mus musculus
agagaacucaggaggcagaggcagguggaucucucuugagucugag

SEQ ID NO: 32172 - RNA, 45 nt, Mus musculus
uaaugagaucugaugcccucuucuggagugucugaagacagguac

SEQ ID NO: 32173 - RNA, 45 nt, Mus musculus
guuagaccaaaaccauugcuuuugaaguuguuaaaguccguugga

SEQ ID NO: 32174 - RNA, 46 nt, Mus musculus
ugugcacuuguacuuaguguaaaacccaacuuucugaagugcagcu

SEQ ID NO: 32175 - RNA, 46 nt, Mus musculus
aucucucagccaucucuccagcaucuugauaccguuuugaucagaa

SEQ ID NO: 32176 - RNA, 46 nt, Mus musculus
cuauucuccuacauucuauaagcucccuuucaguagacugacggau

SEQ ID NO: 32177 - RNA, 50 nt, Mus musculus
aaagaucauuugucauuagugagugugugugugugugugugugugugugu

SEQ ID NO: 32178 - RNA, 41 nt, Mus musculus
cacucacuaaugacaaaugaucuuuaaagagcaugccagua

SEQ ID NO: 32179 - RNA, 46 nt, Mus musculus
ucuuauaguuuauguaguacuuuugcuuuuaaguuggcuagacaua

SEQ ID NO: 32180 - RNA, 48 nt, Mus musculus
uuuugaucuaucauauagguucugagaacuaaauucagggucucuaua

SEQ ID NO: 32181 - RNA, 53 nt, Mus musculus
gcauguguauauguguaccauguggaugucugguggcuauagaaaccagaaga

SEQ ID NO: 32182 - RNA, 49 nt, Mus musculus
cucagggacauuuaucaugguguuccuugguauccguugucaggcugcc

SEQ ID NO: 32183 - RNA, 42 nt, Mus musculus
ccacgucagucugauaucaaaguauguuaccaucggccacag

SEQ ID NO: 32184 - RNA, 62 nt, Mus musculus
aagcugacgugcaggagugucuuuagaguaucuguggccgaugguaacauacuuugauauca

SEQ ID NO: 32185 - RNA, 46 nt, Mus musculus
gaggccacauucuagccauguagacagaggccuggcacagugagau

SEQ ID NO: 32186 - RNA, 46 nt, Mus musculus
gcaccgugugcaaacaguguccuuggaggccaaaagaggccaucag

SEQ ID NO: 32187 - RNA, 60 nt, Mus musculus
auguacugggcauguaacaauuaaugaaaaaagucaugaaagagagaagggguauacugg

SEQ ID NO: 32188 - RNA, 46 nt, Mus musculus
augacuucuauaugaguuacauaagaaaauuaagcauuaguaaguc

SEQ ID NO: 32189 - RNA, 46 nt, Mus musculus
ccucguuuucccuuucugauguaauuucauacauauuuguggagaa

SEQ ID NO: 32190 - RNA, 45 nt, Mus musculus
uugaauagguaggugggugggguaugauaaguggcuggugucagu

SEQ ID NO: 32191 - RNA, 44 nt, Mus musculus
caguguuuucugauguggccucccuccuguacucccugccuccc

SEQ ID NO: 32192 - RNA, 46 nt, Mus musculus
ccccuuuggagaggucaccaggaacgcuugaggcagucuccuguca

SEQ ID NO: 32193 - RNA, 46 nt, Mus musculus
aggggacaguccuagggcacugcaccuccagaguucauagagagua

SEQ ID NO: 32194 - RNA, 45 nt, Mus musculus
guuugagccacuuuucaguguagucagcuuauguaauggacgaua

SEQ ID NO: 32195 - RNA, 42 nt, Mus musculus
ugagcuaccguaugggugcugggaaucucacccugguccuuu

SEQ ID NO: 32196 - RNA, 42 nt, Mus musculus
cuggggcacuaucacuuggccuugguuacguaggcugguugg

SEQ ID NO: 32197 - RNA, 43 nt, Mus musculus
caggugaacuccaugcagcuacuuuacuaccaggcccccaugu

SEQ ID NO: 32198 - RNA, 41 nt, Mus musculus
ggugugcuuacauagggugugggaaaaaaugguggccagaa

SEQ ID NO: 32199 - RNA, 45 nt, Mus musculus
uagacagaaggagcuuggucugaagccuggcccugcagacuaagc

SEQ ID NO: 32200 - RNA, 45 nt, Mus musculus
auuuguauuuaaggaaaaucuaggggugguggagggugcagaaga

SEQ ID NO: 32201 - RNA, 45 nt, Mus musculus
cucagagugacaaggcuagacuagaggggagugacaaggcuagac

SEQ ID NO: 32202 - RNA, 44 nt, Mus musculus
uuuguuuuguuuuguuuucugcugcugggaacaauaagacaagg

SEQ ID NO: 32203 - RNA, 44 nt, Mus musculus
uauuacuguagguguaauccuaaauucuuauuacgaugugaagu

SEQ ID NO: 32204 - RNA, 24 nt, Mus musculus
uucuugggccuuucaagaacacuc

SEQ ID NO: 32205 - RNA, 31 nt, Mus musculus
agggcaugugucugggaagggaguaaaguaa

SEQ ID NO: 32206 - RNA, 42 nt, Mus musculus
uaccgguguguguacuguuuuuauagcagugaccccguggag

SEQ ID NO: 32207 - RNA, 45 nt, Mus musculus
aaaacgggaacacugaagcauguggcugaagagggccaguggaca

SEQ ID NO: 32208 - RNA, 41 nt, Mus musculus
auguugaagucaggcggaaugcucuguugucccagggagga

SEQ ID NO: 32209 - RNA, 46 nt, Mus musculus
aaccagauuaugucggacagcaacugcuguugggacgucuccucag

SEQ ID NO: 32210 - RNA, 81 nt, Mus musculus
uuuugaaaugcagagaccuuacaaaccacaggaccccccagaaacacccuccuaccaaacuagaagaaagaaaaguugccu

SEQ ID NO: 32211 - RNA, 42 nt, Mus musculus
gagagcacgaaggaagacacccaggaggagcccagggcggag

SEQ ID NO: 32212 - RNA, 61 nt, Mus musculus
ucauguguucuugugucaggaacagagacuugucugggugauggguuuugagacguagugc

SEQ ID NO: 32213 - RNA, 67 nt, Mus musculus
ugugcuaaauuguguagggcuucguagagcaugggaacagcacacauguuuuucccagugagacggg

SEQ ID NO: 32214 - RNA, 42 nt, Mus musculus
ucccagccuccagauacaagucauucaagaucucuguccaag

SEQ ID NO: 32215 - RNA, 32 nt, Mus musculus
gagaggagaaagaagaggaggaggaggaaaag

SEQ ID NO: 32216 - RNA, 42 nt, Mus musculus
aguucccuucccugcccgccagccccacacagcaaccgucca

SEQ ID NO: 32217 - RNA, 46 nt, Mus musculus
uccaaagaagaucugaaaaaggcccaggaugcucugguacaagaga

SEQ ID NO: 32218 - RNA, 46 nt, Mus musculus
uaaaugaaacuauuuuaagaccuuucgauguagaaccaccucuaac

SEQ ID NO: 32219 - RNA, 45 nt, Mus musculus
ugaagaugcugcugauguggaugcucgaaagcaggccacccgaga

SEQ ID NO: 32220 - RNA, 46 nt, Mus musculus
gacuccuucuaauggagcugaagggcugacuccccgaaguggaaca

SEQ ID NO: 32221 - RNA, 45 nt, Mus musculus
caggaucuugauggggagcuaagaucugaaaaagaaggaagagau

SEQ ID NO: 32222 - RNA, 46 nt, Mus musculus
aagaggaaacaacagaugacccccgaaagcuuaagccuggagagau

SEQ ID NO: 32223 - RNA, 87 nt, Mus musculus
gauuaugaucaaaggaggaguguggaggaacacggaggaugaaauucugaaagcagcgguaaugaaauaugggaaaaaccagugguc

SEQ ID NO: 32224 - RNA, 55 nt, Mus musculus
guggaggaacacggaggaugaaauucugaaagcagcgguaaugaaauaugggaaa

SEQ ID NO: 32225 - RNA, 48 nt, Mus musculus
cauaggaaaucggcaaagcagugcaaagccagaugguacgaauggcug

SEQ ID NO: 32226 - RNA, 46 nt, Mus musculus
ugaagaggaaacaacagaugacccccgaaagcuuaagccuggagag

SEQ ID NO: 32227 - RNA, 45 nt, Mus musculus
agcaggaucuugauggggagcuaagaucugaaaaagaaggaagag

SEQ ID NO: 32228 - RNA, 46 nt, Mus musculus
aggacuccuucuaauggagcugaagggcugacuccccgaaguggaa

SEQ ID NO: 32229 - RNA, 45 nt, Mus musculus
auugaagaugcugcugauguggaugcucgaaagcaggccacccga

SEQ ID NO: 32230 - RNA, 46 nt, Mus musculus
aguaaaugaaacuauuuuaagaccuuucgauguagaaccaccucua

SEQ ID NO: 32231 - RNA, 46 nt, Mus musculus
ucuccaaagaagaucugaaaaaggcccaggaugcucugguacaaga

SEQ ID NO: 32232 - RNA, 46 nt, Mus musculus
uuacuaaggaaaguguaugugugugugugugugugugugugugugu

SEQ ID NO: 32233 - RNA, 45 nt, Mus musculus
ucaccuaaaacucucuuggaggauuggcauuacuguggggggggc

SEQ ID NO: 32234 - RNA, 46 nt, Mus musculus
uguuguggccagagauaauuucagaauaaaauuuuaauguccuacc

SEQ ID NO: 32235 - RNA, 45 nt, Mus musculus
caacaguuuagaaguggacuaagaugguuugccuuucccccacca

SEQ ID NO: 32236 - RNA, 46 nt, Mus musculus
uuguucgcuccucuuccaccacacacaucuguugccugcguuuagu

SEQ ID NO: 32237 - RNA, 45 nt, Mus musculus
acgggggccgaucccggagagggaaacuaagggguccgccagaga

SEQ ID NO: 32238 - RNA, 49 nt, Mus musculus
acaggcaggcggccgaggagauccggaucuuggaacaccuacggaagca

SEQ ID NO: 32239 - RNA, 42 nt, Mus musculus
uaugacgacgaccagggaucguacgugcaggugccccaugau

SEQ ID NO: 32240 - RNA, 45 nt, Mus musculus
ccugaaauauacuucuuggguccaaaugcaaagaaacgccaaggc

SEQ ID NO: 32241 - RNA, 46 nt, Mus musculus
uggggaagguaaaagccucccccaugacgcccgaacaagcgaugaa

SEQ ID NO: 32242 - RNA, 25 nt, Mus musculus
gacaaaugugauucccuguccucgu

SEQ ID NO: 32243 - RNA, 51 nt, Mus musculus
augccagcugugcucagcacugccuaggaaauuauuggagugaaacggcaa

SEQ ID NO: 32244 - RNA, 44 nt, Mus musculus
cagguguacacugucagggacucccagggauucagccagaguga

SEQ ID NO: 32245 - RNA, 26 nt, Mus musculus
caucucugggggagggggguggggaa

SEQ ID NO: 32246 - RNA, 42 nt, Mus musculus
agggcaccugacaagggcugucccuugagucccuggggagga

SEQ ID NO: 32247 - RNA, 45 nt, Mus musculus
ggagucgcaguuuuccugggagcggagggcggcucugcggaagau

SEQ ID NO: 32248 - RNA, 46 nt, Mus musculus
ucguucccacacgcagucuauaccuucagagcaguauacaaguaau

SEQ ID NO: 32249 - RNA, 42 nt, Mus musculus
uuuguuacuuuguagugggaucuagcacacgcugcuggccag

SEQ ID NO: 32250 - RNA, 46 nt, Mus musculus
caauaaacaccacauuguuuugugcuugcuugcuugcucugcugcg

SEQ ID NO: 32251 - RNA, 46 nt, Mus musculus
ucacuuuguguccagacguuuacacuuccugcacaaaaucacgcac

SEQ ID NO: 32252 - RNA, 77 nt, Mus musculus
cauaucuuguuaugcuuuguccuuaugacaugaaauucagauggaggaauuuugaacagcaaucaaggcaggaaaga

SEQ ID NO: 32253 - RNA, 45 nt, Mus musculus
augcucugucguaaagcgccauaaugaauaauuaaaaccgaacca

SEQ ID NO: 32254 - RNA, 45 nt, Mus musculus
uguacuuugccaggaagcacaggaaagucgugaagaagacacgga

SEQ ID NO: 32255 - RNA, 46 nt, Mus musculus
gugcaggagaagcugagaguucuacaucuucaucugaaggccgcua

SEQ ID NO: 32256 - RNA, 46 nt, Mus musculus
augcuuuuguuauuucgggugcccugggacugaucugcagcauuuc

SEQ ID NO: 32257 - RNA, 45 nt, Mus musculus
uuucagccucuguccucgugagaacaguugacaggggacacaguu

SEQ ID NO: 32258 - RNA, 46 nt, Mus musculus
uccucuguguuucagaauaugagguugaauacucucacucccagac

SEQ ID NO: 32259 - RNA, 48 nt, Mus musculus
aaggaaguuaccuugaccucagugugacggauggcgauuagggagaaa

SEQ ID NO: 32260 - RNA, 42 nt, Mus musculus
ucauguccacuacccaaagaaggugugggaccugcagcaggu

SEQ ID NO: 32261 - RNA, 67 nt, Mus musculus
uuguuugaggaaauacaaucuuccucccuuccuccagcaggcaguaaugggcgcuacacuuagagau

SEQ ID NO: 32262 - RNA, 45 nt, Mus musculus
ccuugggcuucuauaguuuggagauguuuaacuguccacugagug

SEQ ID NO: 32263 - RNA, 55 nt, Mus musculus
acacccagccuccagcgucacaccucuguagaaccccagacaacaaagccacugc

SEQ ID NO: 32264 - RNA, 28 nt, Mus musculus
acggcagugacccggggccgcuccagag

SEQ ID NO: 32265 - RNA, 88 nt, Mus musculus
uuggaagugacuguggacuuuagcaaacuaauggcaaacugucagaucaagcaugccugggcaaggaccauucauacuuuucagguaa

SEQ ID NO: 32266 - RNA, 46 nt, Mus musculus
ucucaauuugauggauaauguuuguacuuaauacugcaccggagac

SEQ ID NO: 32267 - RNA, 46 nt, Mus musculus
ccuggggucgcucucugcuguagacacccuugcaacugugaaagau

SEQ ID NO: 32268 - RNA, 46 nt, Mus musculus
uaauugugugaaugaagcugcagaaacagaagucucccaaaggguu

SEQ ID NO: 32269 - RNA, 45 nt, Mus musculus
uauuuucuggagaguaucuuuauugaagaaaugaagugcccugug

SEQ ID NO: 32270 - RNA, 48 nt, Mus musculus
uuucaagcugacuuugaaccccuaauucuucugucuccaccucccuag

SEQ ID NO: 32271 - RNA, 46 nt, Mus musculus
gauaagacauuuaucuuugugagacucccugaagaagacagcagau

SEQ ID NO: 32272 - RNA, 45 nt, Mus musculus
uguuagacaguugcccaguauugaaccugguaacaugcugcagga

SEQ ID NO: 32273 - RNA, 46 nt, Mus musculus
uguuugaagcuuucacaguuugaaaaauuuaaaauucaucucugcg

SEQ ID NO: 32274 - RNA, 42 nt, Mus musculus
agaccggaaagaaauagaucauuuuucugguuugcagcagug

SEQ ID NO: 32275 - RNA, 31 nt, Mus musculus
uuuuuaagcacauggaacaucuggaagaaac

SEQ ID NO: 32276 - RNA, 64 nt, Mus musculus
uccuggcgucaauuagaggcgcaaagcccaacgauccaggaagugcugaggcaguggaagggag

SEQ ID NO: 32277 - RNA, 36 nt, Mus musculus
gaaugcauuggucauauauucuaagcugaggcagac

SEQ ID NO: 32278 - RNA, 45 nt, Mus musculus
ugggaaucuuacauauuacauguuaaacugauuucacuggacuga

SEQ ID NO: 32279 - RNA, 66 nt, Mus musculus
ucauggccacuaugccucaagaucuccauaccaagauccaggucagaaauuuguaucucccagccu

SEQ ID NO: 32280 - RNA, 45 nt, Mus musculus
cuccccaacaauggucugcagcagcugugaaugggaguccaagga

SEQ ID NO: 32281 - RNA, 68 nt, Mus musculus
gauccaggagcuaucaaguucaaggcuuuccggcauacuuucuacagguugauaugucgccaccagau

SEQ ID NO: 32282 - RNA, 45 nt, Mus musculus
guagcggguagaugucuguaugggugcugccuguguguaugugug

SEQ ID NO: 32283 - RNA, 42 nt, Mus musculus
cuuugagaaaaagagcaagcgcgcggaaacacacggccacac

SEQ ID NO: 32284 - RNA, 45 nt, Mus musculus
uggaugccgaggaacucugcagcgggggcaucaaggcgggcagcc

SEQ ID NO: 32285 - RNA, 46 nt, Mus musculus
ccaccaucauuaccaccggcacuuaaugcuagucuuucugcuaggg

SEQ ID NO: 32286 - RNA, 45 nt, Mus musculus
ccuugcucagaggcagccuuuuguauacauucccugaccccaccc

SEQ ID NO: 32287 - RNA, 46 nt, Mus musculus
accuuccagaaccagaaccaccuuuuccccaagccagcagucaguc

SEQ ID NO: 32288 - RNA, 45 nt, Mus musculus
gcagugagcaugaacaguccaaaaagcagugaauccaccagaaga

SEQ ID NO: 32289 - RNA, 85 nt, Mus musculus
accagaauaaccauucaguaccucccaaggaaguuuuggggacagauagagugacucagaaaacccccuuugaaugcagccaguc

SEQ ID NO: 32290 - RNA, 45 nt, Mus musculus
ucuccacuguucuuggauaaugucccaaguauuccaguagaagau

SEQ ID NO: 32291 - RNA, 45 nt, Mus musculus
ugaugucuacagcuucggaaucgugagugucgccugcuggcuagc

SEQ ID NO: 32292 - RNA, 42 nt, Mus musculus
cuagagcagcagaguucuaccauaaauaugaccggcgguggc

SEQ ID NO: 32293 - RNA, 46 nt, Mus musculus
ucucccaaauuaugaaagcauaaggguagguccagaagccccagau

SEQ ID NO: 32294 - RNA, 45 nt, Mus musculus
augagcgcgcacaugugugugugugugugagagagagaggggggg

SEQ ID NO: 32295 - RNA, 23 nt, Mus musculus
agcugacagauaagcaaccagua

SEQ ID NO: 32296 - RNA, 46 nt, Mus musculus
uugugauccaccaugugguugcugggauuugaacuccagaccuuag

SEQ ID NO: 32297 - RNA, 42 nt, Mus musculus
gccagccauuagcauguggagagaggggaugagagggcagag

SEQ ID NO: 32298 - RNA, 46 nt, Mus musculus
ucaguucaucacuuaguucccuuucuugaaagcagcguuugcagaa

SEQ ID NO: 32299 - RNA, 46 nt, Mus musculus
cuuuaacaugagccgaaggaguggauggcucacuuuuucuggagaa

SEQ ID NO: 32300 - RNA, 45 nt, Mus musculus
auccccugaugauuuccuccuuguguccuuauguugagcucaucc

SEQ ID NO: 32301 - RNA, 46 nt, Mus musculus
aaugaauaauuauguguauuuuauuaauuguacuggauagccagau

SEQ ID NO: 32302 - RNA, 45 nt, Mus musculus
accuuugggccacagucuauccucugucuauucaggggcaguccu

SEQ ID NO: 32303 - RNA, 46 nt, Mus musculus
auucuuuuuccuagugcuuuugauaugugauguacggguggagagg

SEQ ID NO: 32304 - RNA, 45 nt, Mus musculus
ugugugcaaaugagccgacucuugagugcuaagauggugguaguu

SEQ ID NO: 32305 - RNA, 45 nt, Mus musculus
auuauuauuauuauuaguaguaguaguaguaguaguaguagcagu

SEQ ID NO: 32306 - RNA, 82 nt, Mus musculus
agguuuggaucuguguuuaaaauacaacuuugguuagagcguagacgguggaggagacguuagcaggagacuuggcaaaaga

SEQ ID NO: 32307 - RNA, 46 nt, Mus musculus
uggugagcagugaaggaacggaagcccacgugcuagagaaacagac

SEQ ID NO: 32308 - RNA, 47 nt, Mus musculus
cagaggcuuguacaaaaggccccaggaguauaugacacguagcaucu

SEQ ID NO: 32309 - RNA, 42 nt, Mus musculus
uaaaagaagugcccuucauuuucacaccauuagucggcaauc

SEQ ID NO: 32310 - RNA, 46 nt, Mus musculus
aaggcuaugcagugugaccucaaacgaaucagaacaccaagaagau

SEQ ID NO: 32311 - RNA, 46 nt, Mus musculus
aaacacaauacuaguguauuaauuaaaggaaaauaagaagugaguu

SEQ ID NO: 32312 - RNA, 46 nt, Mus musculus
uggcuguuuguuuugauuuuauuuucaucguguggauucuggagau

SEQ ID NO: 32313 - RNA, 46 nt, Mus musculus
ggcugaccuugaacucagaaauccuccugccucugccuccugagua

SEQ ID NO: 32314 - RNA, 41 nt, Mus musculus
ccaccgugugguuguugggaauugaacucaggaccuuugga

SEQ ID NO: 32315 - RNA, 45 nt, Mus musculus
caacucugcucgcucagugccugcuuauuuacuccagccccaaga

SEQ ID NO: 32316 - RNA, 46 nt, Mus musculus
uaaaaccucucuuucuccuccucuuuccacauugucucuuucagaa

SEQ ID NO: 32317 - RNA, 41 nt, Mus musculus
ucagugcucuuuaaccacugagccaucucuccagccccgau

SEQ ID NO: 32318 - RNA, 42 nt, Mus musculus
gcgcaccacgcgugggacgccaaccggaaguacaggcgcuuc

SEQ ID NO: 32319 - RNA, 47 nt, Mus musculus
ggagcuaccguccccgucugcggacugcggggcugagccggaucccc

SEQ ID NO: 32320 - RNA, 46 nt, Mus musculus
gcagagcaugaaaggacuaaguccggacacgucaggccccuuuaag

SEQ ID NO: 32321 - RNA, 41 nt, Mus musculus
gggguuggaaggacagggagagaaacuccuaggggggcgca

SEQ ID NO: 32322 - RNA, 46 nt, Mus musculus
aaagcgccaagugcugagccaccucuccagcccugaaaguuaacau

SEQ ID NO: 32323 - RNA, 42 nt, Mus musculus
auccacacuggguacuggccaugcuggucuagaagagucuuu

SEQ ID NO: 32324 - RNA, 45 nt, Mus musculus
ccugucucccuugccagucuuuaaggucuaccaggccaggcccuu

SEQ ID NO: 32325 - RNA, 50 nt, Mus musculus
uggaauugcucuguagaccaggcuggccuugaacucacagagauccaccu

SEQ ID NO: 32326 - RNA, 42 nt, Mus musculus
gagugguauacuguagugaccugggaaaggaagcgggguaua

SEQ ID NO: 32327 - RNA, 46 nt, Mus musculus
cacguaucuaaauaauugucugcgcuugucaacccacguuaaguau

SEQ ID NO: 32328 - RNA, 46 nt, Mus musculus
aaaucagaggaauuguauagcaauugcuaaauccuguaauugagau

SEQ ID NO: 32329 - RNA, 46 nt, Mus musculus
guauauauauguauauauauauauagagagagagagagaaaauaau

SEQ ID NO: 32330 - RNA, 75 nt, Mus musculus
uuuguuggaugagcaaaugaccacagaaugucaaugcagauguaaagucaggaguaagggaaaguagagacaugu

SEQ ID NO: 32331 - RNA, 45 nt, Mus musculus
caccuggaaacagagagagagagagagagagagagagagagagac

SEQ ID NO: 32332 - RNA, 45 nt, Mus musculus
cagccuucgagaaugugugugcauucgaaacggucugggaggaga

SEQ ID NO: 32333 - RNA, 46 nt, Mus musculus
agcuggcaguuuacuuccuuucuguuuuuaugaauggcggucauau

SEQ ID NO: 32334 - RNA, 45 nt, Mus musculus
uaugugauggcagccauacaugagccucugugaaugaaugcagac

SEQ ID NO: 32335 - RNA, 26 nt, Mus musculus
aaagucacgaaugcacagaacaguag

SEQ ID NO: 32336 - RNA, 45 nt, Mus musculus
uaguagggagccaugggagugaggggagaacagugggaagauaga

SEQ ID NO: 32337 - RNA, 45 nt, Mus musculus
gcuggaacugguccaguuaccugacagggaaauuugcucagcaug

SEQ ID NO: 32338 - RNA, 46 nt, Mus musculus
ccaucucaccguaagguaaagcagguaaugccuguacauuguagaa

SEQ ID NO: 32339 - RNA, 49 nt, Mus musculus
cccccacuaugugugagugagugugugugagugagugugugugugugug

SEQ ID NO: 32340 - RNA, 45 nt, Mus musculus
uuaucagaagagaauaaauuuuaaauucucaaucuaugucucaga

SEQ ID NO: 32341 - RNA, 46 nt, Mus musculus
gagaguucugcaaaucuucagguuccgaaggcuuuggcagugaggc

SEQ ID NO: 32342 - RNA, 46 nt, Mus musculus
agagcuggaacaaccugcagcauagagcuacacagacggacuggac

SEQ ID NO: 32343 - RNA, 38 nt, Mus musculus
cuuggcauauaguguuuauuaagaaauaaguuacaauu

SEQ ID NO: 32344 - RNA, 46 nt, Mus musculus
gucuugugacaagacauuaguuauacccucuaaaguauggcaaggu

SEQ ID NO: 32345 - RNA, 46 nt, Mus musculus
gacauggugguaaagauuauagguauggaguuucuaaagcccuaaa

SEQ ID NO: 32346 - RNA, 46 nt, Mus musculus
ugugcguugcucuccgguacaugagauaccgcuggacuaaggagga

SEQ ID NO: 32347 - RNA, 69 nt, Mus musculus
uuaguaauugggauuuaaacacucaacuguuaaugcaauggaagaauuguuuucgagaggggugaaauu

SEQ ID NO: 32348 - RNA, 45 nt, Mus musculus
gagagaaaaguuugucaugaacaugucauagaaggagcauguuua

SEQ ID NO: 32349 - RNA, 46 nt, Mus musculus
uguauuuaauacuucauugcuguggauuuuuaaaaaugggaaagau

SEQ ID NO: 32350 - RNA, 81 nt, Mus musculus
gaucccuggcagugagcggugcuuuguagaauuugguauguuugcagaucagauguauuaaagcaaaauugccggugaauu

SEQ ID NO: 32351 - RNA, 46 nt, Mus musculus
cauuucaaaaguagauaauacuguuuuauguaaaagacccggcuuc

SEQ ID NO: 32352 - RNA, 41 nt, Mus musculus
gggcauggggagaggaguuaagaggguaguagaggcagaga

SEQ ID NO: 32353 - RNA, 43 nt, Mus musculus
uuucaaaacccgauggacuucugacacaaugcacaauaccuaa

SEQ ID NO: 32354 - RNA, 46 nt, Mus musculus
acuuccuaaucuagaaugacaguuugagcguagccuagccccaguu

SEQ ID NO: 32355 - RNA, 46 nt, Mus musculus
ugagccaccaugugguugcugggauuugaacucaggacauaagaac

SEQ ID NO: 32356 - RNA, 44 nt, Mus musculus
uuguuguugagacaggguuucucuguaucccuggccgcccaguc

SEQ ID NO: 32357 - RNA, 46 nt, Mus musculus
auugucuucuucaauggucuccuccuuucucuaaaaaucccaagcu

SEQ ID NO: 32358 - RNA, 46 nt, Mus musculus
caggcaguuuuuagaaggagagggcgugcguuuagaggggcguuug

SEQ ID NO: 32359 - RNA, 43 nt, Mus musculus
agugggcccccacuuucuugucuuugcguucucccuguuagau

SEQ ID NO: 32360 - RNA, 46 nt, Mus musculus
cacucuaaggaggagauggagauagaauuaagaugggugggcagca

SEQ ID NO: 32361 - RNA, 47 nt, Mus musculus
guggcaguucuagucaaaggaugcuuucuguccaagaagcagcugca

SEQ ID NO: 32362 - RNA, 42 nt, Mus musculus
gugcuggugcccacagaggccagaggcaucaaauccugugaa

SEQ ID NO: 32363 - RNA, 45 nt, Mus musculus
agaaagacaagaauagucuguguugaacacagcauguaugaauga

SEQ ID NO: 32364 - RNA, 45 nt, Mus musculus
augugauagagucagaguaaaacaaaccaugaggggcuggaggau

SEQ ID NO: 32365 - RNA, 45 nt, Mus musculus
aauuaaguauauugguguuuuaaaaauacuaaagugauuugagga

SEQ ID NO: 32366 - RNA, 46 nt, Mus musculus
gagagagagagagagagagagagagagagagagagaguucggcugu

SEQ ID NO: 32367 - RNA, 38 nt, Mus musculus
ugaaagaagagaccaacuaagaaaaaaagaaagagaga

SEQ ID NO: 32368 - RNA, 46 nt, Mus musculus
aucugaaacuugaaaugacccggagagguccacgguuauagaagag

SEQ ID NO: 32369 - RNA, 46 nt, Mus musculus
guaccaucuuaaauuuauaagcuaaaauuuaggaaaccacugggag

SEQ ID NO: 32370 - RNA, 46 nt, Mus musculus
uugaaagcuuugacaaaacuaauuauauuuuugaaauugguaacgg

SEQ ID NO: 32371 - RNA, 46 nt, Mus musculus
agacugucugguugugaagguacuaagacuacucagggucagagac

SEQ ID NO: 32372 - RNA, 38 nt, Mus musculus
accuaguuuaaggucauagagugguguggguuuugucg

SEQ ID NO: 32373 - RNA, 46 nt, Mus musculus
augugcuauuucuuuuaaaaagagaaaaauuccucuaggcauaguu

SEQ ID NO: 32374 - RNA, 46 nt, Mus musculus
uccuguuaaaacuugcaacaccaaauuacaugucaccugugcucac

SEQ ID NO: 32375 - RNA, 46 nt, Mus musculus
agauucuuggcuguucaaaacagugcauguugagcuuuaaccagau

SEQ ID NO: 32376 - RNA, 46 nt, Mus musculus
cugcguguguauauguguaccacaugcaugccuggugcccaggaag

SEQ ID NO: 32377 - RNA, 46 nt, Mus musculus
uccguagcaguacuugaagcuugucuccuaccuugucugaguagaa

SEQ ID NO: 32378 - RNA, 57 nt, Mus musculus
uuuguggucaugagcccaaaugacuuaggaauauugauaccguggagaagaauuaga

SEQ ID NO: 32379 - RNA, 42 nt, Mus musculus
acauuuauauuugguuguuuacauaguauucugcauuaaaag

SEQ ID NO: 32380 - RNA, 42 nt, Mus musculus
uuaaaugagauaauuuauuaaauguuuaguguucuugaagau

SEQ ID NO: 32381 - RNA, 46 nt, Mus musculus
aauuguauauguuuuaaguuuuacuucaaguaauucaccggaagau

SEQ ID NO: 32382 - RNA, 45 nt, Mus musculus
ucuuaauuguuuuuaaaucuauuuagcauuuaauuaucaucaguu

SEQ ID NO: 32383 - RNA, 46 nt, Mus musculus
guuuuuccuaauacugggacugacuuaccuaggaaugagagggacg

SEQ ID NO: 32384 - RNA, 42 nt, Mus musculus
gccgaagcucugcgagcccgaagaggaacuucuccagcaguu

SEQ ID NO: 32385 - RNA, 46 nt, Mus musculus
ucccucccggggccaccgccgcggccgccccuggcacacucaggau

SEQ ID NO: 32386 - RNA, 42 nt, Mus musculus
cgagccgggaggaggaggaggaggagggugcgggugcgaucc

SEQ ID NO: 32387 - RNA, 119 nt, Mus musculus
gccguucucggcgcugacugcuaaaucuggcggcagccggcaggagacuucgguucagggagggggagcacucgcgaugaaugacagggcggcggccgcggggagucuagacaggagcc

SEQ ID NO: 32388 - RNA, 42 nt, Mus musculus
ccggccagacagguauuaaaggacgacucccucgcccggcau

SEQ ID NO: 32389 - RNA, 46 nt, Mus musculus
gggcucuuuuuuuaaaauauauauaaaguauuuguaguagccagag

SEQ ID NO: 32390 - RNA, 45 nt, Mus musculus
uaccuuuccaaaccuuaggggaugcacaaaagauggcgagugcag

SEQ ID NO: 32391 - RNA, 64 nt, Mus musculus
cagaagauccaggagccguacaccuucccggccauccucaagucggugugcggcuaucagaccu

SEQ ID NO: 32392 - RNA, 52 nt, Mus musculus
cuaaauacuauaacuacacccucuccaucaacgggaaggcacggaagcacgg

SEQ ID NO: 32393 - RNA, 44 nt, Mus musculus
gcuccgcaguaccagaaggcuuuccagaaugucaucgcaccaag

SEQ ID NO: 32394 - RNA, 45 nt, Mus musculus
uguggguaucuuaacaggcagcguggaaacugguguguguggggg

SEQ ID NO: 32395 - RNA, 46 nt, Mus musculus
augaguuugauaucaaaguuccacuguugguucgagggcccggcau

SEQ ID NO: 32396 - RNA, 45 nt, Mus musculus
gggcggggaucaccacaacuugacaaacaguauugaaaggucaca

SEQ ID NO: 32397 - RNA, 63 nt, Mus musculus
caccauccuggaccucgcuggcuaugaccugaacaagacacagauggaugggaugucccugcu

SEQ ID NO: 32398 - RNA, 29 nt, Mus musculus
ccagggggggaaaaaaaaaugggucugag

SEQ ID NO: 32399 - RNA, 33 nt, Mus musculus
gacgcguacaacaauaccuacgccugcgugcgg

SEQ ID NO: 32400 - RNA, 51 nt, Mus musculus
cuagguauuugucgaagucuacaauaucacugcagauccagaccagaucac

SEQ ID NO: 32401 - RNA, 42 nt, Mus musculus
gaacuaucgucugaugaugcugcaguccuguucugggccgac

SEQ ID NO: 32402 - RNA, 45 nt, Mus musculus
aaauaauccagucagcugacuuccaguacugugaauccgccccug

SEQ ID NO: 32403 - RNA, 96 nt, Mus musculus
acuuuagggcagagauaaaaccuuuugguauuuuagcuagcccccaaaucaaaagcacuguauagcauuucacaccgagccccucaccaaaacuca

SEQ ID NO: 32404 - RNA, 45 nt, Mus musculus
ggaccggcugccucaccccacucccugaucucacaaaagugcgag

SEQ ID NO: 32405 - RNA, 42 nt, Mus musculus
aguagaguggacaccucggccguggccacuuuagagggggaa

SEQ ID NO: 32406 - RNA, 112 nt, Mus musculus
uguuagagucuucaguuuuauagccggcuccugaaagcaggcgacaucagagugguaacagucaguaggcugcaguagguguccuaccucgaggcccucagauggagguaac

SEQ ID NO: 32407 - RNA, 129 nt, Mus musculus
acauuaggauugugggacacaagauccucucugaaccuccugguuaaggaacguuccugcaaacauucaaguagaccuucuauaacagacugcagcgugcauggccucuacccacaagagaugcacugc

SEQ ID NO: 32408 - RNA, 54 nt, Mus musculus
augcagggacuucgccuuauaagauuuccaguuuuaaaacugccccucagauac

SEQ ID NO: 32409 - RNA, 48 nt, Mus musculus
aacaaguugguacuguugcaaacaccuucugaauugccagcgcccggg

SEQ ID NO: 32410 - RNA, 46 nt, Mus musculus
aguauucucaaacguagggguaucuuuaucuuauguuuucuaaugg

SEQ ID NO: 32411 - RNA, 42 nt, Mus musculus
gcguauguguuugugugagcauguguguguauguguguguac

SEQ ID NO: 32412 - RNA, 47 nt, Mus musculus
accgcguccgaaaugaaagcgcugacggccaaggccaacccggaccu

SEQ ID NO: 32413 - RNA, 57 nt, Mus musculus
gcucagagagcuuucagggucauggcuaccaccacccacauuccuaccgagaggccc

SEQ ID NO: 32414 - RNA, 46 nt, Mus musculus
ucucaauaacaacuuugucaagcucauuuccugguaugacaaugac

SEQ ID NO: 32415 - RNA, 41 nt, Mus musculus
aaacccuggaccaccuaccccagcaaggacacugagagcaa

SEQ ID NO: 32416 - RNA, 45 nt, Mus musculus
ccuguuucauucagagucuguugauugaaugauuauuauugauag

SEQ ID NO: 32417 - RNA, 46 nt, Mus musculus
auagauagauagauagauagauagauaugauagaugauagauauga

SEQ ID NO: 32418 - RNA, 44 nt, Mus musculus
gagaaaacagccuuuaucaccagaggcugguauuuggggucuca

SEQ ID NO: 32419 - RNA, 46 nt, Mus musculus
ccggggaggggaaugguguuuuuauugauccaucugugagccagag

SEQ ID NO: 32420 - RNA, 42 nt, Mus musculus
aaucaugccugucugacuuccagcuggacuugcuugcccuaa

SEQ ID NO: 32421 - RNA, 46 nt, Mus musculus
ugaagauggagaaccuggguccuccaucucuccucucucucauuag

SEQ ID NO: 32422 - RNA, 45 nt, Mus musculus
agagcuaaauauauuaaauuuuuauaagggacaugguuuccaaaa

SEQ ID NO: 32423 - RNA, 45 nt, Mus musculus
gauacccgaauguaaauccuuuaucagauuuuaacuugugcagua

SEQ ID NO: 32424 - RNA, 77 nt, Mus musculus
caaugauaaugacaaugaccuagaaaaugaaaacuguaugcacacuaauuaacgaaagugcaagaagccauaggaga

SEQ ID NO: 32425 - RNA, 93 nt, Mus musculus
cacuuucagugggacuggcuucuucccucuugaccgagaaacuaaaggugcuucagcugccacagguaucccccuggaaagugacgaagacag

SEQ ID NO: 32426 - RNA, 42 nt, Mus musculus
auuaugacauuccccugcccuucauaccccugagccccauag

SEQ ID NO: 32427 - RNA, 46 nt, Mus musculus
gacucuggcagcccaguggagcagaggagagguuguaagauuggaa

SEQ ID NO: 32428 - RNA, 45 nt, Mus musculus
caggcucuuuugaaaugccaagugagggacacaagcugagacaga

SEQ ID NO: 32429 - RNA, 49 nt, Mus musculus
agugguacuauuucgaugacaguagcgucuccacugcaucugaagacca

SEQ ID NO: 32430 - RNA, 45 nt, Mus musculus
gaagauguucacggcugguuacugugaaucugugugguugcaagg

SEQ ID NO: 32431 - RNA, 46 nt, Mus musculus
gcugucugucuaagguccugucccucccacccaucagccucgcucc

SEQ ID NO: 32432 - RNA, 46 nt, Mus musculus
uuaggugaaugaaucaccuguauagcuuguauuuuaaaagccaguu

SEQ ID NO: 32433 - RNA, 49 nt, Mus musculus
ccuugccgcuauaauuugauugcuguuuccaaccacuauggagggaugg

SEQ ID NO: 32434 - RNA, 45 nt, Mus musculus
cugagccauaauguuucaagaguauaucauuuuaacagugugagu

SEQ ID NO: 32435 - RNA, 44 nt, Mus musculus
aaguaguaggcaugccaauggcauguauauuagcaaagacaguc

SEQ ID NO: 32436 - RNA, 49 nt, Mus musculus
caccaucagaugcuaucuuuggcauccuucucagauggugaugcgugaa

SEQ ID NO: 32437 - RNA, 92 nt, Mus musculus
acguuacaguaccauuuauaagauacuuuguuggcuuaguggcucuauguuuuccuaauaauuauuuuauuauccaucagucacuccuaaau

SEQ ID NO: 32438 - RNA, 46 nt, Mus musculus
ucacaauauuuuuucauaagagauuuuauuuuucauggaccaaagg

SEQ ID NO: 32439 - RNA, 86 nt, Mus musculus
ucuccuauagucgcuacaugagagacaagcuagauacauuagucgauuuucccaucagguaaguucaacuacucaguaaacaagag

SEQ ID NO: 32440 - RNA, 90 nt, Mus musculus
auuguccaaauuguaaagagcaucagcaagccacaaagaaauuagaucuguggucccugccuccaguucuuguggugcaucucaagagau

SEQ ID NO: 32441 - RNA, 46 nt, Mus musculus
uuagucguuaagguguaguuggucuugaacaugcuuucccugaggu

SEQ ID NO: 32442 - RNA, 46 nt, Mus musculus
gacccugacuugaagaagagauacuuugaugagaaugcugcagagg

SEQ ID NO: 32443 - RNA, 45 nt, Mus musculus
aaaagcgcuuguuuacauuccaguucaacaacuuaggcaacaaug

SEQ ID NO: 32444 - RNA, 36 nt, Mus musculus
cuucccucagagaacgagaacagucagucugaagau

SEQ ID NO: 32445 - RNA, 41 nt, Mus musculus
gccguggaugaaaaccugaguaguauuauggagcgggauga

SEQ ID NO: 32446 - RNA, 45 nt, Mus musculus
agcccagccagcaaagcuguccugggggacguugucacgcaggug

SEQ ID NO: 32447 - RNA, 42 nt, Mus musculus
caacaaggccccaccuccuaauccuuucaaauagugccacuc

SEQ ID NO: 32448 - RNA, 30 nt, Mus musculus
cuguagggugaacaagugagcgacacagag

SEQ ID NO: 32449 - RNA, 46 nt, Mus musculus
uuuauuugguuuuuguuuucuuaaugucuagaaauggguuggagag

SEQ ID NO: 32450 - RNA, 48 nt, Mus musculus
gcaacacaccuccacuuacugaauauuuccucaaugauaaguaccaag

SEQ ID NO: 32451 - RNA, 45 nt, Mus musculus
ugaucuggacuguuuggugguugugggucccugucugccccugua

SEQ ID NO: 32452 - RNA, 45 nt, Mus musculus
uucaacuuuaacauacaauguaaagugcguauuugugccaagaga

SEQ ID NO: 32453 - RNA, 45 nt, Mus musculus
ugaugugcauaauguuuugagaaagaagaaaagaaagccaucaga

SEQ ID NO: 32454 - RNA, 46 nt, Mus musculus
aguauaggucaaaaaccuugauagaggaaggaaaauguguguagau

SEQ ID NO: 32455 - RNA, 48 nt, Mus musculus
uuguguacuauaguacugaauauuaacauuguugaguucauaguggaa

SEQ ID NO: 32456 - RNA, 50 nt, Mus musculus
agaagcagggagagggaggaugggauagggagauuccggggaggcgggag

SEQ ID NO: 32457 - RNA, 46 nt, Mus musculus
aguaugcauggagggaaccauggcuccagcagcauauguagcagag

SEQ ID NO: 32458 - RNA, 65 nt, Mus musculus
guccccaauggaggaguuggagaagggccugaagggucugaggcuuacaauccauaggaagaaca

SEQ ID NO: 32459 - RNA, 76 nt, Mus musculus
ccucauauagcugucuccugagaggcucugccagagcugacagaugcuugcaggcaaccacuggacugaacauggg

SEQ ID NO: 32460 - RNA, 41 nt, Mus musculus
caccuggggauccaucccauauacagaugccaaacccagac

SEQ ID NO: 32461 - RNA, 45 nt, Mus musculus
aucuuucucugagugucugcaucuuuacccuuuaacuuugguagg

SEQ ID NO: 32462 - RNA, 41 nt, Mus musculus
guggggggggggguggaaugugguuguaacaagaguccaga

SEQ ID NO: 32463 - RNA, 85 nt, Mus musculus
auaguaauuucauaauauagcauaauauaguuuuaagucaucagagcaguuuccuuaaaaguuauaugcgcacauaaugguuuga

SEQ ID NO: 32464 - RNA, 46 nt, Mus musculus
uaagcccuuacuucucuccccucccacccucaccccacccccacac

SEQ ID NO: 32465 - RNA, 50 nt, Mus musculus
agaucacauugguaaacucuuggaagaaugagaaguguacugagcccauc

SEQ ID NO: 32466 - RNA, 46 nt, Mus musculus
cugcucucagucuuuucucccccucuccugcagucagcccuguagu

SEQ ID NO: 32467 - RNA, 34 nt, Mus musculus
ucuguugcuuuaaaaccuuaacuagggcuugaua

SEQ ID NO: 32468 - RNA, 45 nt, Mus musculus
uugucuacucuuaggcugacuuguucugacuuuuguauuaccugu

SEQ ID NO: 32469 - RNA, 42 nt, Mus musculus
caggagaggagcgagagaagggaggggaagaccugaacagag

SEQ ID NO: 32470 - RNA, 45 nt, Mus musculus
gcugggaggaugggagugaggaaugggccagagaaagcagcagaa

SEQ ID NO: 32471 - RNA, 45 nt, Mus musculus
guaaacauucagaccagcacaaacgacuguccaacccggcuuagg

SEQ ID NO: 32472 - RNA, 74 nt, Mus musculus
gcauggcuucucuguagaacuuccaauccaagauuaaucaagcauuuaaagaagggaaagaaauaaaaacagaa

SEQ ID NO: 32473 - RNA, 37 nt, Mus musculus
uuuauuagugggugugauguaugcccuguggucacau

SEQ ID NO: 32474 - RNA, 46 nt, Mus musculus
uaucucagaaagcaaacaaacaaaagacuuuaucaaaggcaaagau

SEQ ID NO: 32475 - RNA, 47 nt, Mus musculus
gugugcaguuacugacacacugucuggcagaguccaugcagacaggu

SEQ ID NO: 32476 - RNA, 41 nt, Mus musculus
uaaauuuuccuuuaaguacuuguuuuagaagaaucgguaga

SEQ ID NO: 32477 - RNA, 46 nt, Mus musculus
acuuccuugaacauuuaagacaagaagccgcauuguauaaccagaa

SEQ ID NO: 32478 - RNA, 28 nt, Mus musculus
cggaaagaccauuuuaagucagggcagu

SEQ ID NO: 32479 - RNA, 46 nt, Mus musculus
gaagcugugacucugaaggaagauaggggguacaugacaagguuga

SEQ ID NO: 32480 - RNA, 45 nt, Mus musculus
cuucaggaacuacagaagggcuucuuuauucaucuagaauguaaa

SEQ ID NO: 32481 - RNA, 46 nt, Mus musculus
ucauuuuaucuguuguguuuuaugacuagcgucaacaagcccauuu

SEQ ID NO: 32482 - RNA, 46 nt, Mus musculus
caggaaaaugugugaaccauuccaauggucaugguagccaucucau

SEQ ID NO: 32483 - RNA, 48 nt, Mus musculus
ugagaaggaaauaagaaaaaucuucaauauuccagaugagaaggaggc

SEQ ID NO: 32484 - RNA, 46 nt, Mus musculus
cucugugagaacgggaacaugaacaauguuguaacucggagguuua

SEQ ID NO: 32485 - RNA, 42 nt, Mus musculus
augaagagauauuugauaacccccaacuaccagcggagagac

SEQ ID NO: 32486 - RNA, 46 nt, Mus musculus
ucugaccuguugaaagacagccuauacccaugaaauggcgcuggaa

SEQ ID NO: 32487 - RNA, 46 nt, Mus musculus
ucagcugguacacacugauggagggccaggagccaauagcaagaaa

SEQ ID NO: 32488 - RNA, 42 nt, Mus musculus
cuggucaagucgcagaggaguaaguuguuagugugugcagau

SEQ ID NO: 32489 - RNA, 45 nt, Mus musculus
guggaaaaaauauguuggcuuugacagcugggacaaauaccagau

SEQ ID NO: 32490 - RNA, 46 nt, Mus musculus
aagguaauuaaaacacaauagaauugggauaauaauaaauguagau

SEQ ID NO: 32491 - RNA, 45 nt, Mus musculus
uucuuaugggaagaaaaucuuucuauuaauuuuagugcacucuaa

SEQ ID NO: 32492 - RNA, 46 nt, Mus musculus
ugcucuucccauaagacaggguaaagcccuguaaccagcagcagac

SEQ ID NO: 32493 - RNA, 44 nt, Mus musculus
cgggggaaauaauuuauuugaaugauaauaaaaauuaguaaaga

SEQ ID NO: 32494 - RNA, 46 nt, Mus musculus
gggacaagguaaaaacuuguaauaaauaguaauucuagcugcagaa

SEQ ID NO: 32495 - RNA, 45 nt, Mus musculus
ggugcagagcagaaaauagguuagaaaugccugaaaucugaggga

SEQ ID NO: 32496 - RNA, 45 nt, Mus musculus
agauagauagauagauagauagauagauagauagauggguacaug

SEQ ID NO: 32497 - RNA, 45 nt, Mus musculus
cagugaggagacauagagggaugcauggagagaugauagguaggu

SEQ ID NO: 32498 - RNA, 46 nt, Mus musculus
agacauuccauauaguuagcagucaccucccguuucggcccagacu

SEQ ID NO: 32499 - RNA, 46 nt, Mus musculus
guuuuucuauucuguuuuuacauauugacaaaguaacagauaaguc

SEQ ID NO: 32500 - RNA, 46 nt, Mus musculus
acuacauccuuacauuuuaucaucuaguucagacagacagacagac

SEQ ID NO: 32501 - RNA, 46 nt, Mus musculus
uaagucauuauugcuuauagucugcuuuuguuuuucuuacggaguu

SEQ ID NO: 32502 - RNA, 46 nt, Mus musculus
uuaacuuacagaauuauuuaaauaaagggaaaguucuguuuuaggg

SEQ ID NO: 32503 - RNA, 42 nt, Mus musculus
agggaacggggucgcggggcccgcgggggcccgaggcuggcg

SEQ ID NO: 32504 - RNA, 45 nt, Mus musculus
cuugguccuguggaggcuugaugucccagcauaggggaaugguag

SEQ ID NO: 32505 - RNA, 42 nt, Mus musculus
cucaugaggaaaaaguacgugugccagcuagucgguccagcg

SEQ ID NO: 32506 - RNA, 44 nt, Mus musculus
uucgcucugagguguaacuuaggacugugcuugaagcugggggu

SEQ ID NO: 32507 - RNA, 42 nt, Mus musculus
cauacauagugagaaagcaaucaagaaacaggguagggaggg

SEQ ID NO: 32508 - RNA, 42 nt, Mus musculus
aaguaguugagaguucuacauccagaccugaaggcagcagga

SEQ ID NO: 32509 - RNA, 59 nt, Mus musculus
agagagagagagagagguaggggaguagagggguagaggcuggccaugagcauguggag

SEQ ID NO: 32510 - RNA, 46 nt, Mus musculus
aauagaguuuauucagggcauggggaggggaguugagagaguagaa

SEQ ID NO: 32511 - RNA, 45 nt, Mus musculus
uguaugugaguguacaaauguguguguguauguguggguauguuu

SEQ ID NO: 32512 - RNA, 46 nt, Mus musculus
gguugugagccaccaugugguugcugggauuugaacuccauaccuu

SEQ ID NO: 32513 - RNA, 42 nt, Mus musculus
cguucuucauguccuguguaagagaggaacacagacacagau

SEQ ID NO: 32514 - RNA, 46 nt, Mus musculus
ggaguguguggucacucuagugcuuuggggauugcaggguguaguu

SEQ ID NO: 32515 - RNA, 41 nt, Mus musculus
ggcgugacuguaguggacuucgugcgcuucgaauguggaga

SEQ ID NO: 32516 - RNA, 46 nt, Mus musculus
uggggaaguacggggcccuggucaucugugagacucccgagcagau

SEQ ID NO: 32517 - RNA, 42 nt, Mus musculus
gaaaggugggucauaucaacuccauugaauagagggggaaac

SEQ ID NO: 32518 - RNA, 25 nt, Mus musculus
ucacagaaucuuugcaccucugaag

SEQ ID NO: 32519 - RNA, 46 nt, Mus musculus
uguuucuaggaaauccuaagaagguagggcuagaagaugagcgucu

SEQ ID NO: 32520 - RNA, 45 nt, Mus musculus
uggcacacugucagaaccugacggaucggcucuccacguacagua

SEQ ID NO: 32521 - RNA, 51 nt, Mus musculus
acaaacaggcccagaaggaaggauggagcaaagccgccaagcuccacggga

SEQ ID NO: 32522 - RNA, 42 nt, Mus musculus
cccagcaaccacauaguggcucacaaccaucugcaguggggu

SEQ ID NO: 32523 - RNA, 46 nt, Mus musculus
aauuccauguuccuuauggcuaugagauuugcugcugccuggagau

SEQ ID NO: 32524 - RNA, 46 nt, Mus musculus
ccggcaaagggauguacugucgcuucauacacaguaaacccugcag

SEQ ID NO: 32525 - RNA, 43 nt, Mus musculus
ucagugccucuccugaucauuccucaggauccaaugccuucag

SEQ ID NO: 32526 - RNA, 44 nt, Mus musculus
gaaaugugguuucugucagaagcggcacagaacuuugguguuuu

SEQ ID NO: 32527 - RNA, 45 nt, Mus musculus
ccucagcacggguuggguugcacuucccagaggugcguauggagu

SEQ ID NO: 32528 - RNA, 45 nt, Mus musculus
ccuccucuuccagauuugcuauggcauguacggcuucauggaugu

SEQ ID NO: 32529 - RNA, 42 nt, Mus musculus
cuucuuacuuuugugcuguagccuuagcaucuugcccuacuc

SEQ ID NO: 32530 - RNA, 25 nt, Mus musculus
ggcugggcggggagggugggggcgc

SEQ ID NO: 32531 - RNA, 23 nt, Mus musculus
auccggcagucggagcgggacug

SEQ ID NO: 32532 - RNA, 46 nt, Mus musculus
gggaaguggggccuuuguggucgcgggcaagggugugauuuuggag

SEQ ID NO: 32533 - RNA, 87 nt, Mus musculus
ccguggcugaaauuggugucggugccuaugggacgguguacaaagcccgagauccccacaguggccacuuuguggcccucaagagug

SEQ ID NO: 32534 - RNA, 44 nt, Mus musculus
cuggaggccuuugaacaucccaauguuguacggugagaagguug

SEQ ID NO: 32535 - RNA, 48 nt, Mus musculus
ccgggaccugaagccagagaacauucuagugacaaguaaugggaccgu

SEQ ID NO: 32536 - RNA, 46 nt, Mus musculus
ggccuagcuagaaucuacagcuaccagauggcccucacgccugugg

SEQ ID NO: 32537 - RNA, 67 nt, Mus musculus
cccccagagggccucggccagugcagucaguggugccagagauggaggagucuggagcgcagcugcu

SEQ ID NO: 32538 - RNA, 46 nt, Mus musculus
uuacagaugguuguaagccaccaugugguugcugggaauugacuca

SEQ ID NO: 32539 - RNA, 45 nt, Mus musculus
uggacagaucccugguaauacagcgcugacagagucuccaaugag

SEQ ID NO: 32540 - RNA, 45 nt, Mus musculus
cacucugcgucgcuuuccuccuugugcagguaggagugcugcagg

SEQ ID NO: 32541 - RNA, 46 nt, Mus musculus
uuuauacugggaucuuuuuuauacaggaaaacaagacaagacaaag

SEQ ID NO: 32542 - RNA, 45 nt, Mus musculus
gcaaagccaauuggaaaaaacauuaaagaaaaauaaagaccauac

SEQ ID NO: 32543 - RNA, 46 nt, Mus musculus
acccagggccucacaagugcucggcaagcauuucuaccaaucaguu

SEQ ID NO: 32544 - RNA, 46 nt, Mus musculus
augguuuuguuuuagagaaaagaggucccuuaccucacccccaaga

SEQ ID NO: 32545 - RNA, 46 nt, Mus musculus
gccucagccuccugcuggcaucaccacacucagccagccccuggau

SEQ ID NO: 32546 - RNA, 45 nt, Mus musculus
ugauuccggaaucucauugcuagccaaacaccaaggaucuacggg

SEQ ID NO: 32547 - RNA, 45 nt, Mus musculus
uguguggggagagguuccuuaaacauucagacaaagcccucaaga

SEQ ID NO: 32548 - RNA, 36 nt, Mus musculus
ucuuaguuuugcacaccugguaacagacauauauag

SEQ ID NO: 32549 - RNA, 45 nt, Mus musculus
aaucucuugcucaugucuggcuauuaacagaaacacacagguaag

SEQ ID NO: 32550 - RNA, 46 nt, Mus musculus
cccaguuucugucuuuaaaaucucaccacuguaauucuaacugcga

SEQ ID NO: 32551 - RNA, 45 nt, Mus musculus
acuugauggugguucgcggcgcccaccaguccugccaccgcgaug

SEQ ID NO: 32552 - RNA, 49 nt, Mus musculus
ucgguguggugucuagcauucacaucauuggaggagucauugcuguggg

SEQ ID NO: 32553 - RNA, 42 nt, Mus musculus
augaugugaaugcuagacaccacaccgaggcccuugccccag

SEQ ID NO: 32554 - RNA, 46 nt, Mus musculus
uucccucuucgccggaaguuucugggaagcuucccagaacccccag

SEQ ID NO: 32555 - RNA, 83 nt, Mus musculus
ccuguuccaggaaugcgcugugcgcucucaacgugguuuauauggugagguuuuggaaauggauaaaucuccggggcggaaag

SEQ ID NO: 32556 - RNA, 61 nt, Mus musculus
gacucccaaccgcgucuaucgcuuuaaauccaagccacccaaaccaauucucugcgccugc

SEQ ID NO: 32557 - RNA, 46 nt, Mus musculus
ucuuggauuccugaguacggaauuucgagacuaggaacccgaggag

SEQ ID NO: 32558 - RNA, 46 nt, Mus musculus
ugcgccggccucaagucacuguuuccaccugaauuucuggcguguc

SEQ ID NO: 32559 - RNA, 44 nt, Mus musculus
cacgccagaaauucagguggaaacagugacuugaggccggcgca

SEQ ID NO: 32560 - RNA, 42 nt, Mus musculus
acaaucccagcaaaaaggguuggagauggagcacccccuugu

SEQ ID NO: 32561 - RNA, 29 nt, Mus musculus
guacagggagccgaagaggccaauaaaga

SEQ ID NO: 32562 - RNA, 50 nt, Mus musculus
aggcaagauugagaucaagauugugcgacccggggcugaagguaaggaag

SEQ ID NO: 32563 - RNA, 42 nt, Mus musculus
ugaaacagaucgaggggcuggugacagaagugcuggagaggg

SEQ ID NO: 32564 - RNA, 45 nt, Mus musculus
caguggagggaggagcugacacugcacagugcucccagaggaggg

SEQ ID NO: 32565 - RNA, 75 nt, Mus musculus
acauccacucuggacaaacucaucaagaggcugcaggagaaccagaguccagagcuugugcaaaaauacaaaaaa

SEQ ID NO: 32566 - RNA, 45 nt, Mus musculus
uuaaggcuggcauggagcgggagcuggagaacaucauccaggagg

SEQ ID NO: 32567 - RNA, 45 nt, Mus musculus
ggcagcaacauccccuccagcuccuucucgaacucucccaggagc

SEQ ID NO: 32568 - RNA, 70 nt, Mus musculus
gugagcccccgggucuuauggaagaggaggauggugacgacgaagaggaggaggaggaggaggaagagga

SEQ ID NO: 32569 - RNA, 65 nt, Mus musculus
uggagacgauaccacggaggccccccagagggaagcagagggaacgaaggcgaagggaaaggaug

SEQ ID NO: 32570 - RNA, 57 nt, Mus musculus
ucccuucgccuucguucccucugcuucccucuggggggccuccgugguaucgucucc

SEQ ID NO: 32571 - RNA, 73 nt, Mus musculus
aacgugcaggugaaacucauccggagucccgcagacuugauucgacugauugaggagcugaaagcugcagaaa

SEQ ID NO: 32572 - RNA, 68 nt, Mus musculus
uccucaaucagucgaaucaagucugcgggacuccggaugaguuucaccugcacguuauucugaaaauc

SEQ ID NO: 32573 - RNA, 42 nt, Mus musculus
gggagggcuuggagcuggaucugcugcggccucgugguucag

SEQ ID NO: 32574 - RNA, 43 nt, Mus musculus
cucuggaagcuucaggggccagaggagcaggcagcagcaagag

SEQ ID NO: 32575 - RNA, 50 nt, Mus musculus
ccugcgccuccucucuugcugcugccugcuccucuggccccugaagcuuc

SEQ ID NO: 32576 - RNA, 42 nt, Mus musculus
ucugggguacggagaacagaggagaaugugggaaggggggag

SEQ ID NO: 32577 - RNA, 74 nt, Mus musculus
ugcccgcauccucuccuccggccaccagccagcgcugccccacaggccauucuuugucacccagcccugcagcc

SEQ ID NO: 32578 - RNA, 45 nt, Mus musculus
ugacaaagaauggccuguggggcagcgcuggcugguggccggagg

SEQ ID NO: 32579 - RNA, 49 nt, Mus musculus
agcaggagacggguucaucuacucggucaauguaguccccagauaugcc

SEQ ID NO: 32580 - RNA, 46 nt, Mus musculus
gugugacgagggugcgggcauaucuggggacuacauugaccgagua

SEQ ID NO: 32581 - RNA, 46 nt, Mus musculus
uuaguguacauguaaacacauuuacuuuugcugucuuugguuugau

SEQ ID NO: 32582 - RNA, 45 nt, Mus musculus
ugugugugagugugugugugagugugagugugugugugugugagu

SEQ ID NO: 32583 - RNA, 44 nt, Mus musculus
aaagggucacagccuugaaucauagcuaaggagugagaaugaga

SEQ ID NO: 32584 - RNA, 76 nt, Mus musculus
ugcucuggguguagcagggagacauuggucuugacucuuccggcagaacggggagugaacaggaagcuccugcgug

SEQ ID NO: 32585 - RNA, 46 nt, Mus musculus
cuacggcaacggguccaaaugugaucucaacgggaagccccgagaa

SEQ ID NO: 32586 - RNA, 65 nt, Mus musculus
uaccaggggcccgggaucccugaauuguugagcccaaugagagaugccccuuguuugcugaaggu

SEQ ID NO: 32587 - RNA, 62 nt, Mus musculus
agugccgccuaccagcuggagcuauucacuuccaacgugaaagagaggaggagacgccugcu

SEQ ID NO: 32588 - RNA, 42 nt, Mus musculus
ggugaggguccugugcaagaggaaggggcgcacgguggagga

SEQ ID NO: 32589 - RNA, 45 nt, Mus musculus
gcgucugacgggcggugucgggagccugaauuuggaggagcugag

SEQ ID NO: 32590 - RNA, 41 nt, Mus musculus
ggaagauggcggcggaggugcugcuguccagucuguuggga

SEQ ID NO: 32591 - RNA, 41 nt, Mus musculus
uucacuuuucuaggggaucacagggaguugagagguaggua

SEQ ID NO: 32592 - RNA, 46 nt, Mus musculus
uccaaaggaccuggguucaauucccagcacccacauggcagcuuac

SEQ ID NO: 32593 - RNA, 46 nt, Mus musculus
ugaauagaaaaauagguaaaacauaaugaaaaaugugucugggggu

SEQ ID NO: 32594 - RNA, 42 nt, Mus musculus
acuggagugugggaggauguacaggcaaaagagcacccggag

SEQ ID NO: 32595 - RNA, 42 nt, Mus musculus
ggcuagcagguggagaucucugacaaagagauauggaggcag

SEQ ID NO: 32596 - RNA, 46 nt, Mus musculus
gaagccauaggaggaggagagaaauuucaaggguagccuaggcuac

SEQ ID NO: 32597 - RNA, 46 nt, Mus musculus
uucagccgaguacaacaucagugcucugguuaccauugccaccaag

SEQ ID NO: 32598 - RNA, 45 nt, Mus musculus
aauccuggaaaugugccagaauccauccuccaugauguauagagg

SEQ ID NO: 32599 - RNA, 42 nt, Mus musculus
ugagcuguaaccccaaaagugcagugcuauuggcgcaggcau

SEQ ID NO: 32600 - RNA, 42 nt, Mus musculus
ucucuucuguaauacaucucuguuccuucccuuggcccagca

SEQ ID NO: 32601 - RNA, 46 nt, Mus musculus
ccacccgaaacccucuaaaguuccaagcaccuuacauuggccaaau

SEQ ID NO: 32602 - RNA, 45 nt, Mus musculus
cagugcagcgaaucaugaaauaccaguugcugcugaaggucagga

SEQ ID NO: 32603 - RNA, 46 nt, Mus musculus
cagcaguguuugaaagaucccgauugguuggcucagcuguucauca

SEQ ID NO: 32604 - RNA, 46 nt, Mus musculus
gucuccgaggucgugacaggauuguguuugggaacauucagcagau

SEQ ID NO: 32605 - RNA, 45 nt, Mus musculus
agcugguggaaacagaaagaacauauguggacgacuugggacaga

SEQ ID NO: 32606 - RNA, 43 nt, Mus musculus
cagccagcugaagaggaaacuuugucccaagcucccaagaaug

SEQ ID NO: 32607 - RNA, 42 nt, Mus musculus
guucuccgauucccccuggaccaguaacuggccugaggagau

SEQ ID NO: 32608 - RNA, 45 nt, Mus musculus
caugucguuuuccucccaucagaauccuauucuauugccgucagu

SEQ ID NO: 32609 - RNA, 55 nt, Mus musculus
uuuguucucaccccucuccgggagaauggucuguaccuauugcaagggggagugu

SEQ ID NO: 32610 - RNA, 42 nt, Mus musculus
cuuaauuggugauuaguuuuagcuggaguucuggggccugga

SEQ ID NO: 32611 - RNA, 46 nt, Mus musculus
auguacacggagugaggggacgggagccuuggaaaacagccucugc

SEQ ID NO: 32612 - RNA, 42 nt, Mus musculus
acauauccccucaaggauggugugggggcagagagaggcggg

SEQ ID NO: 32613 - RNA, 42 nt, Mus musculus
cuagucagguagguuggguccggauacccaaaccuggggcaa

SEQ ID NO: 32614 - RNA, 25 nt, Mus musculus
gccauggagagggagaugaggagga

SEQ ID NO: 32615 - RNA, 42 nt, Mus musculus
uccuggccagguagagcccauugggaggggcugggggaggac

SEQ ID NO: 32616 - RNA, 45 nt, Mus musculus
cuuucauuucuccccugagcacaacaaccugccccuucuccccaa

SEQ ID NO: 32617 - RNA, 36 nt, Mus musculus
agauagauagauagauaaauaaaucuuuaaaaaaaa

SEQ ID NO: 32618 - RNA, 46 nt, Mus musculus
gaauaguucaagucccuguuguugacagagaccuuuccuugagagc

SEQ ID NO: 32619 - RNA, 46 nt, Mus musculus
ggaaaguuuggaagccgucagugugcggcgggagcgauggugaggu

SEQ ID NO: 32620 - RNA, 46 nt, Mus musculus
acaugauauaaucgacguguuaggcucaagauaacugaccucaaga

SEQ ID NO: 32621 - RNA, 69 nt, Mus musculus
auaucauguugaagaugagcggguggcagcgacagagccagaauaacagccggaaccugaggagagagg

SEQ ID NO: 32622 - RNA, 45 nt, Mus musculus
uacuggcuccgucuaacccuuaccuucccauccuggccagcauag

SEQ ID NO: 32623 - RNA, 42 nt, Mus musculus
aacaguugucuccaacuuuauaaaauagcuaugcuggccagg

SEQ ID NO: 32624 - RNA, 45 nt, Mus musculus
gcuucucccagggcugauugaucucugcuucuuuccucagucccg

SEQ ID NO: 32625 - RNA, 68 nt, Mus musculus
cucuagauccuuucuaacuccuccuagccccucucuagauccuuucuaacuccuccuagccccucucu

SEQ ID NO: 32626 - RNA, 45 nt, Mus musculus
gaaggccuugucuaacucucccccagcaaagcaacaugagcagca

SEQ ID NO: 32627 - RNA, 46 nt, Mus musculus
cacuugggaggcagaggaagguaaaugucugagucaaagccagccu

SEQ ID NO: 32628 - RNA, 73 nt, Mus musculus
ccacgugcagucauggcagcugagucccugccuuucaccuuggagacgguguccagcugggagcuggaagccu

SEQ ID NO: 32629 - RNA, 74 nt, Mus musculus
gguaugaggaucugcaggagguccuguccucagaugaaauugggggcaccuauaucucauccccaggaaacgaa

SEQ ID NO: 32630 - RNA, 45 nt, Mus musculus
cucaccucuucguuuccuggggaugagauauaggugcccccaauu

SEQ ID NO: 32631 - RNA, 44 nt, Mus musculus
gcucuuccuccucuuccuccugggccauagaacucugacuggaa

SEQ ID NO: 32632 - RNA, 47 nt, Mus musculus
ccucgcucuccagauuccagucagaguucuauggcccaggaggaaga

SEQ ID NO: 32633 - RNA, 51 nt, Mus musculus
guggucagugcccagcccggccugggaagcaacgcaugaaggagaaggagc

SEQ ID NO: 32634 - RNA, 46 nt, Mus musculus
uccugcuccuucuccuucaugcguugcuucccaggccgggcugggc

SEQ ID NO: 32635 - RNA, 47 nt, Mus musculus
aguuggcuuuggcugaggggaaacccauugaaacuccuaaaggcaag

SEQ ID NO: 32636 - RNA, 45 nt, Mus musculus
ucugggaucucugaaugcagaaagccggggcgggggucggggggu

SEQ ID NO: 32637 - RNA, 46 nt, Mus musculus
ggcugccuugcugucugucaugcugcagccauacaugcccacaguc

SEQ ID NO: 32638 - RNA, 42 nt, Mus musculus
aacagguaggaggaacuggggagagguccacccggcagggag

SEQ ID NO: 32639 - RNA, 42 nt, Mus musculus
gggagagccuggagacgugcggguucucgguuaggagcugag

SEQ ID NO: 32640 - RNA, 56 nt, Mus musculus
guguccaucacagccaacuacacagaccaaugggagaaaugguggaagaacccaga

SEQ ID NO: 32641 - RNA, 46 nt, Mus musculus
uccugucuggguccucuguccuguuggucuuuucuucaucucaguu

SEQ ID NO: 32642 - RNA, 45 nt, Mus musculus
cuuguauuuuaaaaaauagcaaacacauuguucugaugaaacaga

SEQ ID NO: 32643 - RNA, 45 nt, Mus musculus
uucaaucccagcauucucagcacuaaagaggcugaagcaccagau

SEQ ID NO: 32644 - RNA, 46 nt, Mus musculus
uugcuuugcuaaguauggagugccugcagacuuguaaagaacaguc

SEQ ID NO: 32645 - RNA, 42 nt, Mus musculus
agugguagaauacuuggcuaacaggaguaacacacaguagga

SEQ ID NO: 32646 - RNA, 46 nt, Mus musculus
ggcugaccgcuuuguggagggugugugucccuucuguggcuaugaa

SEQ ID NO: 32647 - RNA, 45 nt, Mus musculus
ggacaucuuccagagguugcugacccggggguuugugcugcgaga

SEQ ID NO: 32648 - RNA, 46 nt, Mus musculus
cccaugaaacaaaccaaaacaccauguaaauauagagucagcagaa

SEQ ID NO: 32649 - RNA, 46 nt, Mus musculus
ccugugccuggagagaggaauguucucaucaccagugcccuccccu

SEQ ID NO: 32650 - RNA, 46 nt, Mus musculus
uugugacuacagaccuaucaacacugaacuggguaagaagagguca

SEQ ID NO: 32651 - RNA, 46 nt, Mus musculus
ugagccaccaugugguugcugggaauugaacucaggaccugcggaa

SEQ ID NO: 32652 - RNA, 46 nt, Mus musculus
gcuaccuugucugaggaggacaucguuacagcuguugccgcguggg

SEQ ID NO: 32653 - RNA, 59 nt, Mus musculus
cagaaacagccacagccucagcccccgccuccugaggggagaacugucagcaacgagcu

SEQ ID NO: 32654 - RNA, 90 nt, Mus musculus
uuccagacacugaguacccaggaaccgugucagcgagcugcagagacggugcuaaaacagcaggguguccuggcacuucgucuguaccuc

SEQ ID NO: 32655 - RNA, 46 nt, Mus musculus
agcccuggcuguccuggaacucacucuguagaucaggcuggaccaa

SEQ ID NO: 32656 - RNA, 49 nt, Mus musculus
acugucuagugguucaaggcaagaaaggggaagauauacuuggcccacu

SEQ ID NO: 32657 - RNA, 42 nt, Mus musculus
uggcugggaacaagaugaucucaccaaccaguggcuggaaug

SEQ ID NO: 32658 - RNA, 46 nt, Mus musculus
aaaggaguuggguguggugggacacucccuuaauuccaggacucag

SEQ ID NO: 32659 - RNA, 24 nt, Mus musculus
gagggguaagggaagggaaggcuc

SEQ ID NO: 32660 - RNA, 45 nt, Mus musculus
gcagacagagauuagaacucauagcggggcccaaucucuuguaag

SEQ ID NO: 32661 - RNA, 42 nt, Mus musculus
gaggcggugggggcugggggugggcccaucuacuauaucuau

SEQ ID NO: 32662 - RNA, 39 nt, Mus musculus
aauuuuuuuuuccuguuccucaauccuuuaaaccccuag

SEQ ID NO: 32663 - RNA, 41 nt, Mus musculus
ccggcagauaaaaagacacccuggggugaguucaguccuca

SEQ ID NO: 32664 - RNA, 42 nt, Mus musculus
aggggagaacauuuccuagagacugacagagaagggggagug

SEQ ID NO: 32665 - RNA, 31 nt, Mus musculus
agcugggacagaaagaacaacccagagcccu

SEQ ID NO: 32666 - RNA, 43 nt, Mus musculus
ccguuucaaccgacuacaagaagcugaagaaggaccggccaga

SEQ ID NO: 32667 - RNA, 42 nt, Mus musculus
gacugaugcugcuagacagacgcccaagggucuggggcaggg

SEQ ID NO: 32668 - RNA, 78 nt, Mus musculus
ccgcucuuucuuggggaagaggggguggguaagcgcccuccuuccuguuuuuaucuaauaaaaugcuaaccugcccag

SEQ ID NO: 32669 - RNA, 46 nt, Mus musculus
ggcagguuagcauuuuauuagauaaaaacaggaaggagggcgcuua

SEQ ID NO: 32670 - RNA, 46 nt, Mus musculus
gguuauagguuugcaccaugacacccgacuucgcccucagcuuucc

SEQ ID NO: 32671 - RNA, 47 nt, Mus musculus
uagggcaagagccaggcauaaacucccuuccagaauuuguagcugag

SEQ ID NO: 32672 - RNA, 42 nt, Mus musculus
gacaguugaggacaccuggcggucggucagaagcccacagac

SEQ ID NO: 32673 - RNA, 48 nt, Mus musculus
caggauuucaaauccuuccugcucaaagacccagagacaagccagcgu

SEQ ID NO: 32674 - RNA, 41 nt, Mus musculus
ucuuugagcaggaaggauuugaaauccuggagcuuggcuga

SEQ ID NO: 32675 - RNA, 50 nt, Mus musculus
gccaaggugauccccuccccuuucaaguacgcggauguuguuaccaccac

SEQ ID NO: 32676 - RNA, 42 nt, Mus musculus
gccuuggaagccuuugaccuggauccggcacaguggggaguc

SEQ ID NO: 32677 - RNA, 45 nt, Mus musculus
ggguccugucucaacaacaaguacucggaggguuacccuggcaag

SEQ ID NO: 32678 - RNA, 42 nt, Mus musculus
aguacuuguuguugagacaggaccccagggccuccagcgcag

SEQ ID NO: 32679 - RNA, 42 nt, Mus musculus
uccccuggauucccacggccccgccccugccagagcccacag

SEQ ID NO: 32680 - RNA, 46 nt, Mus musculus
gaagcagcuggagguuggacgggccaggagaguuuaucagacagug

SEQ ID NO: 32681 - RNA, 51 nt, Mus musculus
uagccagagggcucgaucuguacccaugacugagggcagcugggagaagag

SEQ ID NO: 32682 - RNA, 42 nt, Mus musculus
uuugacucuagaacuugcuauucaagaugaaaguggggguag

SEQ ID NO: 32683 - RNA, 65 nt, Mus musculus
ucucaccugaauuggagggacaugggcuucuggggcacaagcuuugcucugugacuuugcagagu

SEQ ID NO: 32684 - RNA, 45 nt, Mus musculus
ucacgggggcaauuuucucgcgcacgcguucuaagagcagcuggu

SEQ ID NO: 32685 - RNA, 46 nt, Mus musculus
gggucagggacccauggucagagaguggcaagauaaaccuugauaa

SEQ ID NO: 32686 - RNA, 41 nt, Mus musculus
gagacaaggacagagauagacagggaaggggacgggaugag

SEQ ID NO: 32687 - RNA, 59 nt, Mus musculus
auaacacagauauuguuauaaauaaaauuguaaaaaaggaaaaaaaaaagaaaagaaaa

SEQ ID NO: 32688 - RNA, 45 nt, Mus musculus
cccaagccucccaucccccugagggccaggaagagucggggcaca

SEQ ID NO: 32689 - RNA, 42 nt, Mus musculus
aaagaauguguucagcccuaggagccacagagggggcgcuag

SEQ ID NO: 32690 - RNA, 68 nt, Mus musculus
ccugucuggaagauuuggcucuagcugaggaaggagucuuuuaguugagggaagucaccccaaacccc

SEQ ID NO: 32691 - RNA, 46 nt, Mus musculus
agacagggucagcagaggacuccaccuccccugaacuaaccccaga

SEQ ID NO: 32692 - RNA, 46 nt, Mus musculus
gccccguugagugucuugcacaggcgugguggggaggccgugccgc

SEQ ID NO: 32693 - RNA, 43 nt, Mus musculus
ccuggaagcuggcggcacggccuccccaccacgccugugcaag

SEQ ID NO: 32694 - RNA, 47 nt, Mus musculus
gaaggaauuacuuuuuauaugugagcgagcaagcgagcaagcacagu

SEQ ID NO: 32695 - RNA, 45 nt, Mus musculus
ccugccacaugagucuuucaaugaacccccuccccagccggcccu

SEQ ID NO: 32696 - RNA, 57 nt, Mus musculus
gccgccauucccuggccagcacggacgagaagcgagaacugcugggccggggaccug

SEQ ID NO: 32697 - RNA, 54 nt, Mus musculus
accagcggaugaccaauggggccaugaauguggaaauuggaaacccuaccuaca

SEQ ID NO: 32698 - RNA, 46 nt, Mus musculus
uccacauucauggccccauuggucauccgcuggugcuggaagcccu

SEQ ID NO: 32699 - RNA, 46 nt, Mus musculus
gcugcuucugguggcuggcgugguguucugguauaagcggcgaguc

SEQ ID NO: 32700 - RNA, 46 nt, Mus musculus
aguguagucgcugucuccaaggcgccuguguggucaauaagcagac

SEQ ID NO: 32701 - RNA, 81 nt, Mus musculus
cugcagugcuucaauggugguaguuguuuccucaaugcucggaggcagcccaagugccguugccagccccguuacacaggc

SEQ ID NO: 32702 - RNA, 104 nt, Mus musculus
ggcugugucugcugagccccagcgggccugucugcaccugucccaauggaaagaggcuggauaauggcaccugugugccugugcccucuccaacacccccucca

SEQ ID NO: 32703 - RNA, 48 nt, Mus musculus
aucaauaaucgugucuucaagauccacaaguuuggacacagccccuug

SEQ ID NO: 32704 - RNA, 46 nt, Mus musculus
acggcucuacugggcagaugccaagcuuucggucaucggcagcauc

SEQ ID NO: 32705 - RNA, 53 nt, Mus musculus
ccaagauugaaacagcagcgauggauggcacccuucgggagacucucgugcaa

SEQ ID NO: 32706 - RNA, 44 nt, Mus musculus
gaaaugagaguggguuggaucccagggccaaggagacagaguga

SEQ ID NO: 32707 - RNA, 44 nt, Mus musculus
gagacgugauugagguggcgcaaaugaagggcgagaaccgcaag

SEQ ID NO: 32708 - RNA, 42 nt, Mus musculus
uacacauucccggccacccagucgauagcgauaccccucggc

SEQ ID NO: 32709 - RNA, 88 nt, Mus musculus
ggacuaacuggcacacgggcacaaucuccuacaggagccugcccccugccgccccuccuaccacuuccaaccgccaccggaggcagau

SEQ ID NO: 32710 - RNA, 42 nt, Mus musculus
augacaacgagauccgcagcuuguucccgggccacccccacu

SEQ ID NO: 32711 - RNA, 46 nt, Mus musculus
caccggaaacauccccuucugucuaaaacaaauggucugguuagau

SEQ ID NO: 32712 - RNA, 46 nt, Mus musculus
cuguaacauguucgaugacugcggcgauggcuccgaugaagaagau

SEQ ID NO: 32713 - RNA, 42 nt, Mus musculus
ccuaaagccucuccccuccccagagccccccacggcccagaa

SEQ ID NO: 32714 - RNA, 46 nt, Mus musculus
cagccccggcucauugcccucagcucaccacaguccuccucgucag

SEQ ID NO: 32715 - RNA, 94 nt, Mus musculus
ugcccucccaaccggccuuuccgcugcaagaaugaccgagucugccuguggauugggcgccagugugauggcguggacaacuguggagauggga

SEQ ID NO: 32716 - RNA, 45 nt, Mus musculus
gggaucuggugcccucuucugguguaucugaagacagcaacagug

SEQ ID NO: 32717 - RNA, 93 nt, Mus musculus
augaguuucaauguaacaacaccuugugcaagccgcuggccuggaagugugauggagaggacgacuguggggacaacucagaugagaaccccg

SEQ ID NO: 32718 - RNA, 46 nt, Mus musculus
gugucccaccucaccuacucaaggagaacauccuaaaccccuguca

SEQ ID NO: 32719 - RNA, 47 nt, Mus musculus
cccugcgcuggcgcugugacgcggaugcugacuguauggacggcagu

SEQ ID NO: 32720 - RNA, 46 nt, Mus musculus
ggccguuggcaaugugacuacgacaacgacugcggagauaacucgg

SEQ ID NO: 32721 - RNA, 54 nt, Mus musculus
cuggaagugugacggagaagaugacuguggggaugguucagaugagcccaagga

SEQ ID NO: 32722 - RNA, 44 nt, Mus musculus
ucuucuccgucacacuuccagcgcgcggggaugcagcggccaga

SEQ ID NO: 32723 - RNA, 63 nt, Mus musculus
ccaaaugaccuguggaguggaugaguuccgcugcaaggauucuggccgcugcauccccgcgcg

SEQ ID NO: 32724 - RNA, 50 nt, Mus musculus
ugucacagacccagacgcgagggaugcagcgcuuggugauggagcacugg

SEQ ID NO: 32725 - RNA, 47 nt, Mus musculus
aucccgcucauccucgccguccccgcaguuguccugcccauugcaac

SEQ ID NO: 32726 - RNA, 42 nt, Mus musculus
ccguugcaaugggcaggacaacugcggggacggcgaggauga

SEQ ID NO: 32727 - RNA, 49 nt, Mus musculus
cugcaccaacccugccuucaucugugauggggacaaugacugccaagac

SEQ ID NO: 32728 - RNA, 46 nt, Mus musculus
gaacccaucuccuacuccuaacacugagucuccuuucucggcagcc

SEQ ID NO: 32729 - RNA, 42 nt, Mus musculus
ugugugcaaaaaugacaagugcauccccuucugguggaagug

SEQ ID NO: 32730 - RNA, 94 nt, Mus musculus
aaccugugccugcuguccccuggggguggucauaaaugcgccugccccaccaacuucuaucuggguggcgauggccguaccuguguguccaacu

SEQ ID NO: 32731 - RNA, 46 nt, Mus musculus
gccggauuggcauggauggaucuggccgcagcaucaucguggacac

SEQ ID NO: 32732 - RNA, 46 nt, Mus musculus
caugccaauccggccgaucagugaguggucaccccagucuguccag

SEQ ID NO: 32733 - RNA, 80 nt, Mus musculus
guggacuggguggguggcaaccuguacuggugugacaagggcagagauaccauugagguguccaagcuuaacggggccua

SEQ ID NO: 32734 - RNA, 44 nt, Mus musculus
cccagggcagcaugauucgcaggaugcaccucaacggcagcaac

SEQ ID NO: 32735 - RNA, 45 nt, Mus musculus
cacauguguaucuggggaaggaugucuggagucaggauguggcug

SEQ ID NO: 32736 - RNA, 45 nt, Mus musculus
accaccuuccccugcagccagcucugcaucaacacccacggaagu

SEQ ID NO: 32737 - RNA, 46 nt, Mus musculus
acuaggaggcuagggaagccaccaagacagaaugacagccacauga

SEQ ID NO: 32738 - RNA, 45 nt, Mus musculus
gccgcaagcucaguggcugcagucaggacugcgaggaccucaaga

SEQ ID NO: 32739 - RNA, 57 nt, Mus musculus
gcgcugcguggcugaggcguugcucugcaacggccaggacgacuguggggacgguuc

SEQ ID NO: 32740 - RNA, 23 nt, Mus musculus
agaggccaacauggaggguggug

SEQ ID NO: 32741 - RNA, 46 nt, Mus musculus
gaccacagcgaugaggcucccaagaacccacacugcaccagcccag

SEQ ID NO: 32742 - RNA, 42 nt, Mus musculus
gcucagacaacgcccauuggcacagcggaauucauuggggcc

SEQ ID NO: 32743 - RNA, 75 nt, Mus musculus
aaccgcuuguguauucccaagcauuucgugugcgaccaugaccgugacugugcugauggcucugaugaauccccu

SEQ ID NO: 32744 - RNA, 46 nt, Mus musculus
gcgcuggcucugugauggcgacaaggacuguaccgauggcgcggau

SEQ ID NO: 32745 - RNA, 41 nt, Mus musculus
aagcaguggcugugugacgguagcgaugauugcggggaugg

SEQ ID NO: 32746 - RNA, 68 nt, Mus musculus
uaagaagacaaggaaaggcagggcaggugagcgacucaucacaaacugaagaagugacucuauucugg

SEQ ID NO: 32747 - RNA, 62 nt, Mus musculus
agcgggcgcuguauccccaugagcuggacgugugacaaggaggaugacugugagaacggcga

SEQ ID NO: 32748 - RNA, 72 nt, Mus musculus
gcuacgcaccuagcugggugugugauggcgccaacgacuguggagacuacagcgaugaacgugacuguccag

SEQ ID NO: 32749 - RNA, 41 nt, Mus musculus
gguaccacagacugcagcagcuauuuccgccugggcgugaa

SEQ ID NO: 32750 - RNA, 79 nt, Mus musculus
ggauggguccugcaucgggaacuccagucgcugcaaccaguuuguggauugugaggaugccucggaugagaugaauugc

SEQ ID NO: 32751 - RNA, 42 nt, Mus musculus
aggcaggaggcuaggaugaagcugggaugaggcaggggugag

SEQ ID NO: 32752 - RNA, 42 nt, Mus musculus
uguggugaggcaggaggcuagggugaggcagauggcuguggu

SEQ ID NO: 32753 - RNA, 46 nt, Mus musculus
ggucgcuguguauccaacaugcuguggugcaaugggguggaugacu

SEQ ID NO: 32754 - RNA, 60 nt, Mus musculus
ugccaggaucugugucugcucacccaccaaggccacgucaacuguuccugucgagggggc

SEQ ID NO: 32755 - RNA, 45 nt, Mus musculus
ucucuugugugugugugugugugugugugugugugugcagugucc

SEQ ID NO: 32756 - RNA, 45 nt, Mus musculus
ugcacacacacacacacacacacacacacacacaagagagggcca

SEQ ID NO: 32757 - RNA, 48 nt, Mus musculus
uggacugacugggugcggcgggcugugcagcgagccaacaaguaugug

SEQ ID NO: 32758 - RNA, 45 nt, Mus musculus
accgggcggagaagcuguacuucucggaugccaccuuggacaaga

SEQ ID NO: 32759 - RNA, 27 nt, Mus musculus
uccauccaagcaucaugcgggcagccc

SEQ ID NO: 32760 - RNA, 46 nt, Mus musculus
ugcugcaucucaaaggaacaugugcaaaggguucaccaccccaggu

SEQ ID NO: 32761 - RNA, 60 nt, Mus musculus
agacaaguuacaaguucaucagugaggucagagaagggaggggcugaggcacgguggcca

SEQ ID NO: 32762 - RNA, 55 nt, Mus musculus
uggaccagacucgcccaggggccuucgagagggagacagucaucaccauguccgg

SEQ ID NO: 32763 - RNA, 50 nt, Mus musculus
uguggaaggccuggccuaucaccguggcugggacacacuguacuggacaa

SEQ ID NO: 32764 - RNA, 46 nt, Mus musculus
aggaggaggaggagaaggaggaagaggagaagaaaaacaagaggga

SEQ ID NO: 32765 - RNA, 41 nt, Mus musculus
gagggaggaggaggaggaggaggaggaggaggaagcggcag

SEQ ID NO: 32766 - RNA, 45 nt, Mus musculus
ccgcaucuucuucagugacauccacuuugggaacauccagcagau

SEQ ID NO: 32767 - RNA, 46 nt, Mus musculus
gccaucgucauugaucugcuggauguucccaaaguggaugucacug

SEQ ID NO: 32768 - RNA, 46 nt, Mus musculus
accugcucuacucagagcggaccauccucaagagcauccaccuguc

SEQ ID NO: 32769 - RNA, 46 nt, Mus musculus
uggcggacagcgagccugugccugugcccacgggaugcuggcagaa

SEQ ID NO: 32770 - RNA, 47 nt, Mus musculus
ugguguucagcuuaaagacaucaaggucuucaacagggacaggcaga

SEQ ID NO: 32771 - RNA, 42 nt, Mus musculus
uugcagccgcgcuugauggagccauuggcgugaguucuggag

SEQ ID NO: 32772 - RNA, 47 nt, Mus musculus
uguucuccguguccguguuugaggacuucaucuacuggagugacagg

SEQ ID NO: 32773 - RNA, 54 nt, Mus musculus
agcucuacuggugugaugcucggauggacaagaucgagcgcaucgaccuggaaa

SEQ ID NO: 32774 - RNA, 48 nt, Mus musculus
ggaccgaguggggucauuacccacguauugagcggucucgccuugaug

SEQ ID NO: 32775 - RNA, 100 nt, Mus musculus
ccuaagcaccaucagcagggccaagcgugaccagacauggcgagaggauguggugaccaacgguauuggccguguggagggcaucgcgguggacuggauc

SEQ ID NO: 32776 - RNA, 45 nt, Mus musculus
guuggucaccacauccucucgccaugucuggucacgcuuggcccu

SEQ ID NO: 32777 - RNA, 51 nt, Mus musculus
cuguacaugagggaauucgggggauuccacuagaucccaaugacaagucgg

SEQ ID NO: 32778 - RNA, 45 nt, Mus musculus
aaaacaggaaaacuggaaagaagacugacccaggggcaagcagga

SEQ ID NO: 32779 - RNA, 44 nt, Mus musculus
augguggcucacaaccaucuguaacaagaucugacgcacucuuc

SEQ ID NO: 32780 - RNA, 56 nt, Mus musculus
cuccuguauguguacagccgguuacagccuccggagcggacagcaggccugugagg

SEQ ID NO: 32781 - RNA, 54 nt, Mus musculus
ugucaacaacggagacuguucccagcucugccugccaacaucagagacgacucg

SEQ ID NO: 32782 - RNA, 46 nt, Mus musculus
gguccguggugcugcggaacaguaccacguugguuaugcacaugaa

SEQ ID NO: 32783 - RNA, 43 nt, Mus musculus
ucccagcaaccacaugguggcucacaaccaucugcaauuagau

SEQ ID NO: 32784 - RNA, 45 nt, Mus musculus
ggagccagcugggcaaggccacugcccuggccaucaugggugagg

SEQ ID NO: 32785 - RNA, 49 nt, Mus musculus
cuacuggaucagcucugggaaccacacaaucaaccguugcaaucuggau

SEQ ID NO: 32786 - RNA, 67 nt, Mus musculus
ugggucucccgaaaucuguuuuggacaaguuacgacaccaacaagaagcagauuaacguggcccggc

SEQ ID NO: 32787 - RNA, 46 nt, Mus musculus
uccaaaucuuaucucuagccuacuucuugacccucacuccccaggu

SEQ ID NO: 32788 - RNA, 47 nt, Mus musculus
gucacggugcuggacuaugaugcccgagagcagcgaguuuacugguc

SEQ ID NO: 32789 - RNA, 57 nt, Mus musculus
uacaaccggaccgucuccugcgccuguccccaccucaugaagcugcacaaggacaac

SEQ ID NO: 32790 - RNA, 46 nt, Mus musculus
cgaacaaauacacuggcuaaggccaacaaguggacuggccacaacg

SEQ ID NO: 32791 - RNA, 46 nt, Mus musculus
ccacauggaggugcuucggggacacgaguuccugucacacccauuu

SEQ ID NO: 32792 - RNA, 44 nt, Mus musculus
gcguccaugaguggggcuggccgccgaaccauccaccgggagac

SEQ ID NO: 32793 - RNA, 59 nt, Mus musculus
gggccuggcuguagauuggauugcaggcaacaucuacuggguggagagcaaccuggacc

SEQ ID NO: 32794 - RNA, 42 nt, Mus musculus
uugccugcaauccaaucuacagccaggcccucugguguggcc

SEQ ID NO: 32795 - RNA, 86 nt, Mus musculus
ccugcgcaacacuauugcccuggacuuccaccucagccagagugcccucuacuggaccgacgugguagaggacaagaucuaccgug

SEQ ID NO: 32796 - RNA, 82 nt, Mus musculus
aaccguucaucaucuucuccaaccgccacgagaucaggcgcauugaccuucacaagggggacuacagcguccuagugccugg

SEQ ID NO: 32797 - RNA, 75 nt, Mus musculus
augcagccagaagugugaccagaacaaguucagugugaagugcuccugcuacgagggcugggucuuggagccuga

SEQ ID NO: 32798 - RNA, 86 nt, Mus musculus
aucgugugcucuugcccucugggcauggagcugggcucugacaaccacaccugccagauccagagcuacugugccaagcaccucaa

SEQ ID NO: 32799 - RNA, 46 nt, Mus musculus
acaaaguggcccagguagacagccacugucugccaccaacugagga

SEQ ID NO: 32800 - RNA, 45 nt, Mus musculus
gcaggcagacagagguguuguuggcgcagggaugggaggguggcc

SEQ ID NO: 32801 - RNA, 45 nt, Mus musculus
gcgugggugugugauggcgacagcgacugugaagauaacuccgac

SEQ ID NO: 32802 - RNA, 46 nt, Mus musculus
ccagagucuguaugaaagaccccgggaacccaaacccuggccagaa

SEQ ID NO: 32803 - RNA, 47 nt, Mus musculus
cugagguggcgcugcgacggggacaccgacugcauggauuccagcga

SEQ ID NO: 32804 - RNA, 45 nt, Mus musculus
accucagggggaugcacaggccaucuaggcggcacuggaacucau

SEQ ID NO: 32805 - RNA, 57 nt, Mus musculus
aagccggcugcagucacuccugcuccaguacccaguucaagugcaacaguggcagau

SEQ ID NO: 32806 - RNA, 46 nt, Mus musculus
ccacuguugcacuugaacuggguacuggagcaggagugacugcagc

SEQ ID NO: 32807 - RNA, 42 nt, Mus musculus
aggguguucagaggagagaggugacagagguggccccgagga

SEQ ID NO: 32808 - RNA, 46 nt, Mus musculus
aauuuaccugcaacaauggcagauguauuaacaucaacuggcggug

SEQ ID NO: 32809 - RNA, 42 nt, Mus musculus
gaccgguccccacagucaucauccagaucacagguccaugag

SEQ ID NO: 32810 - RNA, 48 nt, Mus musculus
uucuccugugccaguggccgaugcauuccuaucucauggaccugugau

SEQ ID NO: 32811 - RNA, 46 nt, Mus musculus
accgcuggcucugugauggggauaaugauuguggcaacagcgagga

SEQ ID NO: 32812 - RNA, 46 nt, Mus musculus
uuaccguauugaaccgaauaaucugcucacggagaaaacaguaaau

SEQ ID NO: 32813 - RNA, 46 nt, Mus musculus
guuuaggagaucaaggcuauuuaaaucaugaucuuagggccuggag

SEQ ID NO: 32814 - RNA, 42 nt, Mus musculus
cugcagcagccugugccucgccacccccgggagccgccagug

SEQ ID NO: 32815 - RNA, 71 nt, Mus musculus
ucaccauggcaacuaccucuuuuggaccgaguaccggagcggcagcgucuaccgcuuggaacggggcgugg

SEQ ID NO: 32816 - RNA, 45 nt, Mus musculus
ugccuucuaugaccgaauugagaccauacugcucaauggcacaga

SEQ ID NO: 32817 - RNA, 45 nt, Mus musculus
ggacagucggcgagggcggcucgagagggcuuggauggacggcuc

SEQ ID NO: 32818 - RNA, 58 nt, Mus musculus
agccgcucagacccggaagacucuaauugagggcaagaugacacaccccagggccauu

SEQ ID NO: 32819 - RNA, 84 nt, Mus musculus
cguagccguggacuggaugggagacaaucuuuacuggacugaugauggccccaagaagaccauuaguguggccaggcuggagaa

SEQ ID NO: 32820 - RNA, 50 nt, Mus musculus
cuggccacacuaauggucuucuuggggccaucaucaguccaguaaagauu

SEQ ID NO: 32821 - RNA, 54 nt, Mus musculus
uugcugacaccaccagcuaccucauuggccgccagaaaauugauggcacggaga

SEQ ID NO: 32822 - RNA, 49 nt, Mus musculus
guagcugguggugucagcaaaguagaugaagccggucucggcguggaag

SEQ ID NO: 32823 - RNA, 58 nt, Mus musculus
caggcaucauuagaggcauggacaugggggccaaggucccagaugagcacaugauccc

SEQ ID NO: 32824 - RNA, 46 nt, Mus musculus
ccccauguccaugccucuaaugaugccuggucggcccuugccauac

SEQ ID NO: 32825 - RNA, 45 nt, Mus musculus
guguguaugcgugugugucuguauccaugugugugugugugagug

SEQ ID NO: 32826 - RNA, 44 nt, Mus musculus
ggaccugcaggugcaggucuggcuucagccugggaagugauggg

SEQ ID NO: 32827 - RNA, 47 nt, Mus musculus
accuggcuucccguacuggucauucucacaggcgugacuccgcacug

SEQ ID NO: 32828 - RNA, 45 nt, Mus musculus
ccucggggcuggcgucgcuggugguagauaugcagggcaccaccc

SEQ ID NO: 32829 - RNA, 51 nt, Mus musculus
uguggacaaggguggugcccugcauaucuaccaccagcgacgccagccccg

SEQ ID NO: 32830 - RNA, 45 nt, Mus musculus
cuaucucuacgccaccaacucggacaaugccaacacgcagcagaa

SEQ ID NO: 32831 - RNA, 31 nt, Mus musculus
ugcugcguguuggcauuguccgaguuggugg

SEQ ID NO: 32832 - RNA, 44 nt, Mus musculus
cuacgaagggaagggucggcagaccaucauccaaggcauccugg

SEQ ID NO: 32833 - RNA, 46 nt, Mus musculus
cccuucccuucguagucuaccaccucgauguagucuagguaggcgu

SEQ ID NO: 32834 - RNA, 66 nt, Mus musculus
gguggagcgcugugacauggauggacagaaccgcaccaagcugguggauagcaagaucguguuucc

SEQ ID NO: 32835 - RNA, 42 nt, Mus musculus
ccauccaugucacagcgcuccaccuuugggaucugcccguag

SEQ ID NO: 32836 - RNA, 45 nt, Mus musculus
aaccgaaacggggacaccugugucacucugcuggaccuggaacuc

SEQ ID NO: 32837 - RNA, 46 nt, Mus musculus
guccagcagagugacacagguguccccguuucgguuacagacaaag

SEQ ID NO: 32838 - RNA, 41 nt, Mus musculus
ccauguuaguacuuaauucccucacaccccgaggaagcaca

SEQ ID NO: 32839 - RNA, 45 nt, Mus musculus
gguuucauuuuaaucugguuucucuauggugacucgugugugugu

SEQ ID NO: 32840 - RNA, 23 nt, Mus musculus
cuagcagagcgggggaggggucu

SEQ ID NO: 32841 - RNA, 46 nt, Mus musculus
gcucagaacccagcuggacccagggcagagcacagcauuggaagua

SEQ ID NO: 32842 - RNA, 42 nt, Mus musculus
agccaaucaauacgugugcguagugugcgucuggcaccgggg

SEQ ID NO: 32843 - RNA, 45 nt, Mus musculus
uagccugggcuauagaguuuuaaaaaaauuaacuaauuagggaug

SEQ ID NO: 32844 - RNA, 45 nt, Mus musculus
ugccuagugcccaaggaggccagaaaaggguagcagaucccucag

SEQ ID NO: 32845 - RNA, 42 nt, Mus musculus
uggugcacguuauguguguguacuuguguguagauggcgugu

SEQ ID NO: 32846 - RNA, 24 nt, Mus musculus
aaccagaagacaacauaugagagc

SEQ ID NO: 32847 - RNA, 44 nt, Mus musculus
cagaggucucucugaggcaggcuucccccaucuccccgcaccag

SEQ ID NO: 32848 - RNA, 44 nt, Mus musculus
ggugguuugcucacaucccacaaacuaauuaugggcccuggcuu

SEQ ID NO: 32849 - RNA, 27 nt, Mus musculus
ccaccauccucagggugacagccagac

SEQ ID NO: 32850 - RNA, 27 nt, Mus musculus
aaagaagcaggaaguaaccuuggguag

SEQ ID NO: 32851 - RNA, 26 nt, Mus musculus
guugucuccagucucagcacacaggg

SEQ ID NO: 32852 - RNA, 54 nt, Mus musculus
gacagugcugcccagacacagcucaagugugcccggaugccuggccugaagggc

SEQ ID NO: 32853 - RNA, 48 nt, Mus musculus
gggcccaagugucuaccaucacacccaccagcacccgacaaaccacgg

SEQ ID NO: 32854 - RNA, 46 nt, Mus musculus
aaggcuaccugcugcaaccggacaaccgcuccugcaaggccaagaa

SEQ ID NO: 32855 - RNA, 46 nt, Mus musculus
acggaagguugguguuaugaugaagggaaagcuuaaguuagaggag

SEQ ID NO: 32856 - RNA, 45 nt, Mus musculus
aacagcagcuuccagcugcaggcagauggcaagacgugcaaaggu

SEQ ID NO: 32857 - RNA, 50 nt, Mus musculus
gcccugggcucugggccuggagcaagcaacgucugacagaccuugaggaa

SEQ ID NO: 32858 - RNA, 46 nt, Mus musculus
ccaggacugcauggauggcucagacgagggugcucacugccgaggu

SEQ ID NO: 32859 - RNA, 45 nt, Mus musculus
auagcugcucacaagaguagccacgcaucuggggacggcugugca

SEQ ID NO: 32860 - RNA, 46 nt, Mus musculus
uugggaguaggcccuagcucuccccucugcacagccguccccagau

SEQ ID NO: 32861 - RNA, 45 nt, Mus musculus
aagugaaagauuuugaugagcguuaaggaaacauagucccuggca

SEQ ID NO: 32862 - RNA, 50 nt, Mus musculus
gugugacggugaaagagauugccccgacggcucugaugaagccccugaga

SEQ ID NO: 32863 - RNA, 42 nt, Mus musculus
ucagagccgucggggcaaucucuuucaccgucacaccgccag

SEQ ID NO: 32864 - RNA, 64 nt, Mus musculus
aaacuugcagcccuaagcaguuugccugcagagaccaaaucaccuguaucucaaagggcuggcg

SEQ ID NO: 32865 - RNA, 46 nt, Mus musculus
gugauauaggucaagaggccaguaguguccugaggucagaagcaga

SEQ ID NO: 32866 - RNA, 46 nt, Mus musculus
auaaucacuccauaggugaggggcaucccaguuaguuccuagagau

SEQ ID NO: 32867 - RNA, 41 nt, Mus musculus
acugggagugucagggcaugggcucagccccaggugggaga

SEQ ID NO: 32868 - RNA, 45 nt, Mus musculus
ucucuuagcuuagccaugcgguuucucuuacagaauguccccaga

SEQ ID NO: 32869 - RNA, 46 nt, Mus musculus
accuccgcaggcauuccaguggaucuggauuuuauuugugggggaa

SEQ ID NO: 32870 - RNA, 45 nt, Mus musculus
aggaggguuaggagagaggaaguuggaggggaccaucugggucca

SEQ ID NO: 32871 - RNA, 45 nt, Mus musculus
aaacucauacccucuucaaaccccuuccugggguugggcacagcu

SEQ ID NO: 32872 - RNA, 46 nt, Mus musculus
aucucuggcaagaaauacaguccgagagaaaggacuaccuccuggg

SEQ ID NO: 32873 - RNA, 42 nt, Mus musculus
ucuucuuggucucagagcugggaugggagaagaagggaaacu

SEQ ID NO: 32874 - RNA, 42 nt, Mus musculus
cagucaugucaugucggggacugucuugucuagcugccaccc

SEQ ID NO: 32875 - RNA, 43 nt, Mus musculus
ugcugcugccgcugcuuucagcucuggucuccggggccacuau

SEQ ID NO: 32876 - RNA, 42 nt, Mus musculus
gcccccacccucugguccuguuacuucuuguccucgcccccc

SEQ ID NO: 32877 - RNA, 79 nt, Mus musculus
ucccagggggcucggaacuguaccauuucaccuaugccccugguucgcuuugcuuaaggaaaggauaagaauagaagag

SEQ ID NO: 32878 - RNA, 54 nt, Mus musculus
gaagggccugcugacgcgggugcgcccccugcccccaaauucgaacccuucacc

SEQ ID NO: 32879 - RNA, 90 nt, Mus musculus
cgcccugggagggggagaggagcgaggaguaaagcaggggugaaggguucgaauuugggggcagggggcgcacccgcgucagcaggcccu

SEQ ID NO: 32880 - RNA, 31 nt, Mus musculus
uuuaaaauaggccuggagagaugguucagug

SEQ ID NO: 32881 - RNA, 42 nt, Mus musculus
agugcugggcacugaacuuacaguuucacaaauacuaggcag

SEQ ID NO: 32882 - RNA, 35 nt, Mus musculus
uaggcucuaaugccagugaaggaauggacuggcau

SEQ ID NO: 32883 - RNA, 45 nt, Mus musculus
ggccuuucagcaccgcuguguguccuggucacaguucaauaaggu

SEQ ID NO: 32884 - RNA, 46 nt, Mus musculus
aaaaaaaucuuuaaaaaaaaugaauauacaggaaagccugaaggag

SEQ ID NO: 32885 - RNA, 46 nt, Mus musculus
caaugagccagaugggaccuuccuccuccgcuuuagcgacucugag

SEQ ID NO: 32886 - RNA, 45 nt, Mus musculus
ccuuucugucgguugucucucuucucucccauuuuguagccccgc

SEQ ID NO: 32887 - RNA, 46 nt, Mus musculus
gcaaaugccccccaacaugagccagauaaccaugcccuuugaccag

SEQ ID NO: 32888 - RNA, 46 nt, Mus musculus
ucccaggaacaugcuguguccagcccugaacccaugcuuugcucag

SEQ ID NO: 32889 - RNA, 46 nt, Mus musculus
uccgucucaacuguuccuuggucaagagaaaagaacuggcugggag

SEQ ID NO: 32890 - RNA, 45 nt, Mus musculus
aaaaggaaaaaguggguauacagucacuggugugaguucuaccca

SEQ ID NO: 32891 - RNA, 46 nt, Mus musculus
gacauguuaaccuauagaagucacacaucacuguaugaccgcacag

SEQ ID NO: 32892 - RNA, 49 nt, Mus musculus
cucuguguaaacucccugggcguugaggcccucaacugcugucucuugu

SEQ ID NO: 32893 - RNA, 41 nt, Mus musculus
cccgcagcuccugacagaaccagaaauuccagcagagcaga

SEQ ID NO: 32894 - RNA, 46 nt, Mus musculus
ccacccaagcuccuuccccacacucacacauacccaaccccugcug

SEQ ID NO: 32895 - RNA, 42 nt, Mus musculus
agaaucugauguuggagcagggggagaagaggaggccggguc

SEQ ID NO: 32896 - RNA, 45 nt, Mus musculus
agauggguggaguuggacuccggaauggggucuaaaggguggagg

SEQ ID NO: 32897 - RNA, 46 nt, Mus musculus
cuaacagguuuacccuaaggauacauccuaggggagccgagcagga

SEQ ID NO: 32898 - RNA, 42 nt, Mus musculus
uccuucccuccuggucccaaacacgggagccaaggccucaga

SEQ ID NO: 32899 - RNA, 43 nt, Mus musculus
ggauuuauugaggagacucaugguguagguuucgcucgcagau

SEQ ID NO: 32900 - RNA, 45 nt, Mus musculus
gaaugcaccgcgcggagagcggcucccucaacccgggagagaagg

SEQ ID NO: 32901 - RNA, 45 nt, Mus musculus
ucucugcccggucgcggccucuccucgcuccucuuaggcgacggc

SEQ ID NO: 32902 - RNA, 41 nt, Mus musculus
aacaggaacaaggaugcaggcccucccaccccacggcaggg

SEQ ID NO: 32903 - RNA, 42 nt, Mus musculus
uggugcacgccuuuauucccagcacucagggggcaggcggau

SEQ ID NO: 32904 - RNA, 45 nt, Mus musculus
ugguacauaucuuuuaucccaacacuggggaggcagagcugggga

SEQ ID NO: 32905 - RNA, 45 nt, Mus musculus
caggacagccagggcuacacagagaaacccuggggggggggggga

SEQ ID NO: 32906 - RNA, 46 nt, Mus musculus
uuuuuuguuaaggucuguguguaugaggguuuugccugcauaaguc

SEQ ID NO: 32907 - RNA, 46 nt, Mus musculus
ugagaucugacgcccucuucuggagugucggaagacagcuacagug

SEQ ID NO: 32908 - RNA, 42 nt, Mus musculus
uaugccacaaccaccugacaaaguuuuuauagccaggcagug

SEQ ID NO: 32909 - RNA, 46 nt, Mus musculus
uagccaagcucuacuacuugagguggccccugagaugcacccaguu

SEQ ID NO: 32910 - RNA, 46 nt, Mus musculus
guagcccacauuggccuugaauaccugaucguuccuugcccuaccc

SEQ ID NO: 32911 - RNA, 41 nt, Mus musculus
cuuugcccuuuccuuuguuaaccuaggccaugacuggccgg

SEQ ID NO: 32912 - RNA, 45 nt, Mus musculus
cuuauucaggacauagggaggggaguuaagagaauagcagaagca

SEQ ID NO: 32913 - RNA, 46 nt, Mus musculus
aaaaaaaagguugacaacuggguuagaggaggcaaguacagcauau

SEQ ID NO: 32914 - RNA, 45 nt, Mus musculus
aaggugcugggaagggcgcaguguguguguccuguagugcuuaag

SEQ ID NO: 32915 - RNA, 46 nt, Mus musculus
cauuuucugaagccuucugggcaggcuuggaucugccaaacguuag

SEQ ID NO: 32916 - RNA, 46 nt, Mus musculus
acaagcagugcagauugaguguagaaagcugccaagaguacuugag

SEQ ID NO: 32917 - RNA, 46 nt, Mus musculus
aaaucaucggagcaaauaagcuuguggagaaaaggauacuuaugag

SEQ ID NO: 32918 - RNA, 46 nt, Mus musculus
uauguaccaguucuagaggaucugacacccucacacaggccuacag

SEQ ID NO: 32919 - RNA, 45 nt, Mus musculus
uuuauuuuauguauucacauucagacacaccagaagagagcauca

SEQ ID NO: 32920 - RNA, 46 nt, Mus musculus
auagugugugaucuugucugugugugaagugagacaguaaagugag

SEQ ID NO: 32921 - RNA, 46 nt, Mus musculus
uuaguuggucugauucugaguuccaaaagaaguuugaguagguuag

SEQ ID NO: 32922 - RNA, 46 nt, Mus musculus
uauacuguuccgaguagauugauaugugacggccuaaaacuggggg

SEQ ID NO: 32923 - RNA, 45 nt, Mus musculus
ggccaccgcacaacucuuuggcagguagugaccagaagcaaucca

SEQ ID NO: 32924 - RNA, 42 nt, Mus musculus
agaaaaggaggaagcuacuacugcuaaagaugaggguggugg

SEQ ID NO: 32925 - RNA, 42 nt, Mus musculus
uccugaucagaauuuugaggugaugcccaauggacccccaag

SEQ ID NO: 32926 - RNA, 46 nt, Mus musculus
ucugcagaaaucucuccagcugucucuccaguagcauccucgccug

SEQ ID NO: 32927 - RNA, 42 nt, Mus musculus
gacuugguacuauggccccugugggaagagaaugaagcaauu

SEQ ID NO: 32928 - RNA, 54 nt, Mus musculus
caagcaaucacuggcaaacgaggccgaccucgaaacaaugagaaggcuaagaac

SEQ ID NO: 32929 - RNA, 46 nt, Mus musculus
gugaggacgauaaagcaaagaugacuaaaaacaaaaagaagaugag

SEQ ID NO: 32930 - RNA, 56 nt, Mus musculus
cugggugggcaggcugagaaagagaagaugaagacaaagcaggaaaagcugaagga

SEQ ID NO: 32931 - RNA, 80 nt, Mus musculus
aaagguaaagcgagaaaagaaagaaaagguaaaagcgaaggggaaggaagggcccagagccaggccauccuguagagcag

SEQ ID NO: 32932 - RNA, 45 nt, Mus musculus
ccacagaggauaugugucugucugaccaccagguauuaaggguca

SEQ ID NO: 32933 - RNA, 45 nt, Mus musculus
cuuccuugugcaugagcuuaacagcuccaccauuaucaucaagug

SEQ ID NO: 32934 - RNA, 44 nt, Mus musculus
cagugagauugacaagacucuggaaagugugucuagcugcagga

SEQ ID NO: 32935 - RNA, 49 nt, Mus musculus
acggaggcgcaguucucggaucauggaggaaaccaguggcauagaagag

SEQ ID NO: 32936 - RNA, 52 nt, Mus musculus
uugauguugcagcaucuagcauuccagagcuagagcgccauauagaaaaacu

SEQ ID NO: 32937 - RNA, 118 nt, Mus musculus
agcugcuucacucaucccagaugcuucgggcaguguccuugggucaagaccgcuauagacgccauuacuggguauuaccguaucuugcugguaucuuuguggaaggaucggaagggag

SEQ ID NO: 32938 - RNA, 41 nt, Mus musculus
gugauguagacauacguccuaggagagugagaauggggcua

SEQ ID NO: 32939 - RNA, 55 nt, Mus musculus
cccaguuacugaagaugaaauaaagcaagaaacugaguccuugauggaaguaguc

SEQ ID NO: 32940 - RNA, 83 nt, Mus musculus
uuagggaaugugauucagagcaagcccagacucaaguucacccagaaccccagccucagcuucaggccccuacccagccccau

SEQ ID NO: 32941 - RNA, 57 nt, Mus musculus
ccugaugaggcucaguccugcccugguccucaaggucccugguuuaacuucucagcc

SEQ ID NO: 32942 - RNA, 42 nt, Mus musculus
uggaggggucggggcagggaaggaacaguaccucagcggcag

SEQ ID NO: 32943 - RNA, 42 nt, Mus musculus
agauccuaugagaucaccccucguguccgaguuuggcggcag

SEQ ID NO: 32944 - RNA, 41 nt, Mus musculus
auggagagagacaaagaaguccuccuuccccuucccagcuu

SEQ ID NO: 32945 - RNA, 46 nt, Mus musculus
uccccacauguguuuauucccgccuucccauuguuucacaccauca

SEQ ID NO: 32946 - RNA, 46 nt, Mus musculus
cccuuucuuccccagcagcagagacccuggagcacagaaugggcag

SEQ ID NO: 32947 - RNA, 45 nt, Mus musculus
cuuuccugcucagccaagccccucccaucagaaauuacggguacu

SEQ ID NO: 32948 - RNA, 63 nt, Mus musculus
agauguuuggaacuguuuccccuggcauaaaguguacuggagucauucgcuacuggaggugcg

SEQ ID NO: 32949 - RNA, 45 nt, Mus musculus
uuccucauccucacugccccucaagcuagguggauuuuucucuug

SEQ ID NO: 32950 - RNA, 46 nt, Mus musculus
gacagcccuucccugcccuuuguguccccuuccuggugacagcaag

SEQ ID NO: 32951 - RNA, 45 nt, Mus musculus
aaucucauuuuuaauaagguuuaaaaaaaggaaaaaaagucuaga

SEQ ID NO: 32952 - RNA, 47 nt, Mus musculus
aaaggauggugggaggcaaguaggugcuugugugccuugaguuguca

SEQ ID NO: 32953 - RNA, 46 nt, Mus musculus
agagcgguggucacaagggugaugagggcaucacugccacauggag

SEQ ID NO: 32954 - RNA, 46 nt, Mus musculus
auagguugugagcaaccaugugguugcugggaauugaacuccaaac

SEQ ID NO: 32955 - RNA, 42 nt, Mus musculus
gagagggggugguccaucccuggugucagaacugagcccuag

SEQ ID NO: 32956 - RNA, 46 nt, Mus musculus
aagggcuucagcauccccuccaguuccugcucguccauugacagag

SEQ ID NO: 32957 - RNA, 42 nt, Mus musculus
ugcuauuccuuggacuuggaggugccauuugcugagccacau

SEQ ID NO: 32958 - RNA, 42 nt, Mus musculus
uggaauaucucacaaugccuucugauuuguguggugcugcgg

SEQ ID NO: 32959 - RNA, 42 nt, Mus musculus
uagugaagcucagggggacacauagaauagaaagggggacag

SEQ ID NO: 32960 - RNA, 45 nt, Mus musculus
ugcaaacuuuauaugccccaguacaggggaaaugccagggccaag

SEQ ID NO: 32961 - RNA, 41 nt, Mus musculus
gguaagagagccaaggguuaugacuguugaccuaggagcca

SEQ ID NO: 32962 - RNA, 42 nt, Mus musculus
ugaggugucugaagacagcaacagcaagugagucacagcgag

SEQ ID NO: 32963 - RNA, 46 nt, Mus musculus
uauaaaauuuuuccuuauaagaaacacaucuuucggggcuggugag

SEQ ID NO: 32964 - RNA, 110 nt, Mus musculus
acugauagcagcauuuuuucuuuacuguuacggagcugagagagagaaagaagagagugaaggaaagggagggagaaagagggagggaggaggggagggggaaaggagag

SEQ ID NO: 32965 - RNA, 44 nt, Mus musculus
gagaagggagggggaggagaaagaggagaaaaggagcacgcaag

SEQ ID NO: 32966 - RNA, 46 nt, Mus musculus
guuuuuguuguuguuuuguuuugauuugaagcuuucuuucccugag

SEQ ID NO: 32967 - RNA, 42 nt, Mus musculus
ucauuuccaacaggacaggaagugccugcucaacucaaggga

SEQ ID NO: 32968 - RNA, 45 nt, Mus musculus
aaacgcuggaccauccugagugccucuaaucacuguccccggaag

SEQ ID NO: 32969 - RNA, 44 nt, Mus musculus
ugucucgaaccccuggcaacaggauuguuuaccucuacaccaug

SEQ ID NO: 32970 - RNA, 45 nt, Mus musculus
cugugacgggaucaagcgggcuuuccuuauugaggagcagaaaau

SEQ ID NO: 32971 - RNA, 45 nt, Mus musculus
cacagagaaaagccucaauggauaccugagcagagcuagcuacag

SEQ ID NO: 32972 - RNA, 45 nt, Mus musculus
gaggcucuccaaggaaguugcuuguuggcaugaugauuucuucag

SEQ ID NO: 32973 - RNA, 46 nt, Mus musculus
ggagagccucuagcuacaugcauauguaucugccgcagaguaagag

SEQ ID NO: 32974 - RNA, 42 nt, Mus musculus
acucguaaaccuagggcuguguuugaucugaaagcuguccag

SEQ ID NO: 32975 - RNA, 44 nt, Mus musculus
agcagacccuggcaugguggagcacaccuuuaucacagcaggag

SEQ ID NO: 32976 - RNA, 42 nt, Mus musculus
accaguggucucccuggaaaagcugagugucuuugagcagag

SEQ ID NO: 32977 - RNA, 44 nt, Mus musculus; identical to SEQ ID NO: 32975

SEQ ID NO: 32978 - RNA, 42 nt, Mus musculus; identical to SEQ ID NO: 32976

SEQ ID NO: 32979 - RNA, 46 nt, Mus musculus
uuugugccaccugcugagaacgcagggaucuggauaauuggggaag

SEQ ID NO: 32980 - RNA, 42 nt, Mus musculus
ggagggaguggaacauuugcagucaggacaacuugcgggggu

SEQ ID NO: 32981 - RNA, 46 nt, Mus musculus
aaagaggugagaagccuuucugcagagguccuggguugguguuugg

SEQ ID NO: 32982 - RNA, 46 nt, Mus musculus
gccuuagccacagagugagcugcuggggacucuggaggcuguccug

SEQ ID NO: 32983 - RNA, 46 nt, Mus musculus
uggcagaauuggaggugcugcgccaacgggagauggcggagaagag

SEQ ID NO: 32984 - RNA, 45 nt, Mus musculus
gugguugugagucaccaugugguugcugggauuugaacucugaac

SEQ ID NO: 32985 - RNA, 41 nt, Mus musculus
ggauuauuauuagcaagacuaaauauaaaaggucugggugg

SEQ ID NO: 32986 - RNA, 45 nt, Mus musculus
acgagacuuacuacaugugggcaauggcuuucuucauggccuuca

SEQ ID NO: 32987 - RNA, 80 nt, Mus musculus
agacccucaguauccguaccuuucacuuuguggagcagaaccucaccaacuacuacgagaugaugcugacagaccgcaag

SEQ ID NO: 32988 - RNA, 46 nt, Mus musculus
aaaccacccaccucuuccucaaaauguuggagcgcuuuugccggag

SEQ ID NO: 32989 - RNA, 87 nt, Mus musculus
agccagaagaaggagaugcagaggaggaagaggaagaggaggaggaagaggaguuacaggugguccaggugucagagaaggaguuua

SEQ ID NO: 32990 - RNA, 44 nt, Mus musculus
ccagcagaauggagaaaaguccccgagagaccccuggcaggaag

SEQ ID NO: 32991 - RNA, 46 nt, Mus musculus
cugaaaaccucggugagagccuucgucaggaagguaaggacuugag

SEQ ID NO: 32992 - RNA, 45 nt, Mus musculus
uggaacucagcgcccaagaagcggcaacugcuggacagcgacgaa

SEQ ID NO: 32993 - RNA, 45 nt, Mus musculus
aaucccaucgugugggagacagaggcaagagaauugccaugaggg

SEQ ID NO: 32994 - RNA, 45 nt, Mus musculus
gcgggccuuacagugcagggaccuuaaaaagagacugggagacaa

SEQ ID NO: 32995 - RNA, 46 nt, Mus musculus
gcuuggcuucaaagucuaaaguuaauuuugcuuaacaaagccugag

SEQ ID NO: 32996 - RNA, 46 nt, Mus musculus
gcugacggcgcuuucucuacccccuacucguuugaauuccacgcgc

SEQ ID NO: 32997 - RNA, 42 nt, Mus musculus
cggauauuuuggagcgcguggaauucaaacgaguagggggua

SEQ ID NO: 32998 - RNA, 46 nt, Mus musculus
uccuggacaguguucaggucaaucuccaguacgugguucugcagcc

SEQ ID NO: 32999 - RNA, 71 nt, Mus musculus
cgugcacuugaagaggugugauggcacgcaucaugcgcagaucguacacuuugaggaaacggucacaggcc

SEQ ID NO: 33000 - RNA, 45 nt, Mus musculus
uuuuggggguccugcugggaacugccugggcucgaaggagccaag

SEQ ID NO: 33001 - RNA, 45 nt, Mus musculus
augguauuugcaugccuguaauccuaguacacaaacagcagagca

SEQ ID NO: 33002 - RNA, 45 nt, Mus musculus
ucauuauaguugaucaaagugguuuuugccuauaauucggagcua

SEQ ID NO: 33003 - RNA, 47 nt, Mus musculus
uauaaucaggcaaaauaggauuguacauuugccuggagugcagguug

SEQ ID NO: 33004 - RNA, 56 nt, Mus musculus
acaaaaugugcacauuugaaaguaacuugagaggaagaaagaaugggcagaugucg

SEQ ID NO: 33005 - RNA, 50 nt, Mus musculus
aaugaaggaguacggggaacagauugacccuucuacccaccgcaagaacu

SEQ ID NO: 33006 - RNA, 46 nt, Mus musculus
agagaggcugacaacguuaaagacaaacuuugcaguaagcggacag

SEQ ID NO: 33007 - RNA, 41 nt, Mus musculus
ucugccuaauaguucucagaguaugugucucuguuacccug

SEQ ID NO: 33008 - RNA, 44 nt, Mus musculus
ccaaaggcagccuuuguaccaggcuugaagguugggggcuacag

SEQ ID NO: 33009 - RNA, 45 nt, Mus musculus
aagugagacagaagaaagugucagguacauucugaaagccucaca

SEQ ID NO: 33010 - RNA, 44 nt, Mus musculus
cuggagcucacuuuguagacaaggcuggcuuugaacucagaaau

SEQ ID NO: 33011 - RNA, 46 nt, Mus musculus
gcacaugaaccaaguauuaccagcuccacugugguauaggcaagau

SEQ ID NO: 33012 - RNA, 88 nt, Mus musculus
auguggugcuggggacugagccuaaggcuucccauaugccaaguaagaucuaccauugaugcuaagcuccaucuccaguccaugcaca

SEQ ID NO: 33013 - RNA, 42 nt, Mus musculus
ggagcacugcaaauucaaggccugaauugucuugucucgaau

SEQ ID NO: 33014 - RNA, 60 nt, Mus musculus
cuuagggccugguucgugguccucaaagccccuuuccggaaggucguagaugucauagag

SEQ ID NO: 33015 - RNA, 46 nt, Mus musculus
caauagauuaaaaaaaucucuucuuaauggagaauucagcuucuag

SEQ ID NO: 33016 - RNA, 27 nt, Mus musculus
guuuuucuacuugcagaacucuggaga

SEQ ID NO: 33017 - RNA, 25 nt, Mus musculus
ggcuguaguaacucauguuuggcac

SEQ ID NO: 33018 - RNA, 46 nt, Mus musculus
ggguggaacaggggacgugcauucauucaggagcuacaagucuggg

SEQ ID NO: 33019 - RNA, 45 nt, Mus musculus
ucucuccaucaaucacaugcugcuucaauuggugugacagcauac

SEQ ID NO: 33020 - RNA, 46 nt, Mus musculus
acacaagcucagcacagacacaccugagcuggaagccuccaccaaa

SEQ ID NO: 33021 - RNA, 42 nt, Mus musculus
guuucucauacucccaacacuguucauuguccuaagguagag

SEQ ID NO: 33022 - RNA, 42 nt, Mus musculus
ucugucuccccacacaugugcuggcacugaaggugagcccac

SEQ ID NO: 33023 - RNA, 44 nt, Mus musculus
cauggccaucgugcccucugcuggcacgacuccagaugaggacu

SEQ ID NO: 33024 - RNA, 50 nt, Mus musculus
ucaguucugugcuggguaccgaagaggaagaugaagaugaggaguaugaa

SEQ ID NO: 33025 - RNA, 42 nt, Mus musculus
cugaugcccccccaucugggccuuauuuugcauugcuuagau

SEQ ID NO: 33026 - RNA, 41 nt, Mus musculus
auuugcaaagcuguagaugacaguuacaaugugcagccaga

SEQ ID NO: 33027 - RNA, 45 nt, Mus musculus
ugguggcagggcugugauucgaguggaugugucuguggauggggg

SEQ ID NO: 33028 - RNA, 46 nt, Mus musculus
gaguguggaaucagaggagaguuauagucacuggcagaggcgggau

SEQ ID NO: 33029 - RNA, 45 nt, Mus musculus
gcacaaccagccccauguacgugaguuacuggccgaguauaagau

SEQ ID NO: 33030 - RNA, 44 nt, Mus musculus
ggacucggagauggaaagucauggggacccuguuaggccugggu

SEQ ID NO: 33031 - RNA, 30 nt, Mus musculus
aacuuucuucggagacagacccagaggacc

SEQ ID NO: 33032 - RNA, 75 nt, Mus musculus
accuguucaucugcaaaauauccaggcacauccuuuuuacaaguggagacucgagggaagcucuccaagucucuu

SEQ ID NO: 33033 - RNA, 76 nt, Mus musculus
gaggaaacuugguauuuuagccagaguuugggagaaacaugcagaagaaaggaaaagaccacgguaaccucgaguu

SEQ ID NO: 33034 - RNA, 41 nt, Mus musculus
cuacguccuauauuagguguuugagggugucugugggaagc

SEQ ID NO: 33035 - RNA, 43 nt, Mus musculus
gccuauguauacauaggcauuuccccuacccuggccuugagau

SEQ ID NO: 33036 - RNA, 44 nt, Mus musculus
uuaucugguaagaguuucuugucuaugaaacacugcggcaccaa

SEQ ID NO: 33037 - RNA, 46 nt, Mus musculus
acugagggguggcucgaagcaaauauguauggaguuagcacgagag

SEQ ID NO: 33038 - RNA, 46 nt, Mus musculus
cggcaggccgaagucgggguguggaucuucaugagcagucccagca

SEQ ID NO: 33039 - RNA, 42 nt, Mus musculus
uguacccauauacauaaaauaaauaaauaaaucuuaaaaaaa

SEQ ID NO: 33040 - RNA, 46 nt, Mus musculus
uacaaacaauaaauugaaaagaaaaaaaaaagaaaacaaauaagau

SEQ ID NO: 33041 - RNA, 41 nt, Mus musculus
ggcagggaacaaagcugaccuugccaacaagcgcauggugg

SEQ ID NO: 33042 - RNA, 45 nt, Mus musculus
guuugcucgggcaaagacauggguaaaggaacuacagcggcaagc

SEQ ID NO: 33043 - RNA, 45 nt, Mus musculus
uguguuuagaugacacaacagucaaguuugagaucugggacacug

SEQ ID NO: 33044 - RNA, 45 nt, Mus musculus
ucucaggauggguuuuuaaucccagacaugaaaaaugcaggaaga

SEQ ID NO: 33045 - RNA, 32 nt, Mus musculus
aguacagccaggcccaaugggcaaccccaggc

SEQ ID NO: 33046 - RNA, 47 nt, Mus musculus
guguguauauauucggguccagugagggucagagagagagagagaag

SEQ ID NO: 33047 - RNA, 43 nt, Mus musculus
gugggguuugcugcugcuguuguuauuuaaacuuuagauucag

SEQ ID NO: 33048 - RNA, 42 nt, Mus musculus
acugggacugaagguguucacuaacuacuacugccuggcaag

SEQ ID NO: 33049 - RNA, 46 nt, Mus musculus
gccugaucuuugcauuuucuuuuauagaagauuuacaucucguggg

SEQ ID NO: 33050 - RNA, 45 nt, Mus musculus
acaucucucuggaugugugguguuugucuaugugugugagguuag

SEQ ID NO: 33051 - RNA, 33 nt, Mus musculus
cggcggcugagccgcggcaggagaguacugaga

SEQ ID NO: 33052 - RNA, 46 nt, Mus musculus
caggcccaacagccauggcgguggaaggaggaaugaagugugucaa

SEQ ID NO: 33053 - RNA, 46 nt, Mus musculus
uucugggagagacucuagcugggaguccauagaaaguaacccauau

SEQ ID NO: 33054 - RNA, 51 nt, Mus musculus
auugaucgccauugguguagcgguucagguugucuugaagcaggccauuac

SEQ ID NO: 33055 - RNA, 43 nt, Mus musculus
uccucuuccugguggccuuugugggcugcuguggggccugcaa

SEQ ID NO: 33056 - RNA, 50 nt, Mus musculus
caugcuuguggagguggcuguggccauugcuggcuauguguuuagagacc

SEQ ID NO: 33057 - RNA, 47 nt, Mus musculus
uuaggugaagucagaguuuaauaaaagcuuccagcagcagaugcaga

SEQ ID NO: 33058 - RNA, 90 nt, Mus musculus
cuaacuacacagacugggaaaacauccccggcauggccaaggacagaguccccgauucuugcugcaucaacauaacugugggcuguggga

SEQ ID NO: 33059 - RNA, 56 nt, Mus musculus
ucuccugcugucuggugaagaguauucgaaguggcuaugaaguaauguaggggugg

SEQ ID NO: 33060 - RNA, 57 nt, Mus musculus
ggggcguuuggucuuuucauggaguggauucuccagguuuuucaauuaaacggauua

SEQ ID NO: 33061 - RNA, 46 nt, Mus musculus
ucacaaaaaaaguagcgaugucuuauuugaaaaguaguggagccag

SEQ ID NO: 33062 - RNA, 46 nt, Mus musculus
cuuuuuccagcccugaaaaauaaguuugaaggaaugauugguaguu

SEQ ID NO: 33063 - RNA, 46 nt, Mus musculus
uaacauauggaaguuguaucuucauguauauuaaaccaucugcaag

SEQ ID NO: 33064 - RNA, 44 nt, Mus musculus
ccggagcugccaccgggggaucggggcugggggcaccggggaag

SEQ ID NO: 33065 - RNA, 48 nt, Mus musculus
uaccaguuuuaucagaucccugggaccugccugcuccccgaggugaca

SEQ ID NO: 33066 - RNA, 47 nt, Mus musculus
aaggaacugugcacaagggucucauccaggucaaugaccacgcagau

SEQ ID NO: 33067 - RNA, 45 nt, Mus musculus
uuccuuuaagccgaucaacaaugcugacuucauagugccuguaga

SEQ ID NO: 33068 - RNA, 46 nt, Mus musculus
caucaaaccaggacugcacaggcacugcauuuucuggguggaagau

SEQ ID NO: 33069 - RNA, 66 nt, Mus musculus
aaaaugcagugccugugcaguccugguuugaugacauggcagauacagaguugcugaaccugauuc

SEQ ID NO: 33070 - RNA, 45 nt, Mus musculus
acaaaagcaggucacacgcagagcaggaaaucagaccaagaccca

SEQ ID NO: 33071 - RNA, 46 nt, Mus musculus
ggaggcugcuuuggaugcccagacacacaucuuucagaaaacacag

SEQ ID NO: 33072 - RNA, 46 nt, Mus musculus
aaaaaaaagaagaggauuaagaaugcagagauaugaaacuaaggag

SEQ ID NO: 33073 - RNA, 46 nt, Mus musculus
aagugcaggagaugcugccuacccacaaggcucugguccaugcgug

SEQ ID NO: 33074 - RNA, 46 nt, Mus musculus
cugagaagcgggucacuaguuacaacuccugcaugggaccggugug

SEQ ID NO: 33075 - RNA, 42 nt, Mus musculus
augaaguuucauacuaagaacagugaaaacuagugggugggu

SEQ ID NO: 33076 - RNA, 43 nt, Mus musculus
aaaaauuuugaguaugaauguuuugcuugcauauaggucaaac

SEQ ID NO: 33077 - RNA, 42 nt, Mus musculus
cgggcggcaagggcuaauaagcaagcuucuggcuuggggaag

SEQ ID NO: 33078 - RNA, 41 nt, Mus musculus
agcggaggggcggcuguagcugguuugcuggcucggcgcuc

SEQ ID NO: 33079 - RNA, 44 nt, Mus musculus
ggaggcgggcaggcggagagggagugcuacgcggguccggcgga

SEQ ID NO: 33080 - RNA, 71 nt, Mus musculus
uccgcugcaaaaggcgucucgcugccuaagggaagggaccagggacuggcgggugcccggcccggcgagug

SEQ ID NO: 33081 - RNA, 47 nt, Mus musculus
augugaggucccaugaugggucagugggcaaaccguacaucugccag

SEQ ID NO: 33082 - RNA, 45 nt, Mus musculus
agcagcggccugccgccccuggaaccucuuccuagcgaccugcca

SEQ ID NO: 33083 - RNA, 45 nt, Mus musculus
augugucugcccagcuguaaauugaucaauaccaagagcccccug

SEQ ID NO: 33084 - RNA, 46 nt, Mus musculus
uaacucaauuauggccagugcuccuaaaguaagugcuuugugguua

SEQ ID NO: 33085 - RNA, 45 nt, Mus musculus
cuaguauaaauguuuaaagagauuccaaguggauuguggcccugc

SEQ ID NO: 33086 - RNA, 41 nt, Mus musculus
ucuguccggcaugucugaggaucugcuggguugagucggcu

SEQ ID NO: 33087 - RNA, 46 nt, Mus musculus
acaagacagcuuuccagggaggcuagaaagcuagcaccugauccag

SEQ ID NO: 33088 - RNA, 44 nt, Mus musculus
gaacugauagaaugugaaaaaguagauacaugaaaaggggauuu

SEQ ID NO: 33089 - RNA, 46 nt, Mus musculus
gggcgacccacaugaaaauuguaucuucccaccucaaaagacccag

SEQ ID NO: 33090 - RNA, 64 nt, Mus musculus
aaacaaacggaagugcaagugccugaggaaugugcuggacagaucuagaguggacuaaaggaac

SEQ ID NO: 33091 - RNA, 46 nt, Mus musculus
uggagcucuccguucugaaccucauggccucaugugaugauugcag

SEQ ID NO: 33092 - RNA, 46 nt, Mus musculus
ugaaugggggagcagcguuccacugcgccaggaccuauggcaacaa

SEQ ID NO: 33093 - RNA, 37 nt, Mus musculus
gcuccgacuccuacggugaccucuccgacgccagcga

SEQ ID NO: 33094 - RNA, 46 nt, Mus musculus
gguaguuuuggucccucccacuucuuucauuccucaccccccugcc

SEQ ID NO: 33095 - RNA, 46 nt, Mus musculus
ucacugacugaacuaucuuccagccccacagaggcuuaaugggaac

SEQ ID NO: 33096 - RNA, 45 nt, Mus musculus
agaaauagucuuucaucuccaaacagaaaaaaaagaaacaaucac

SEQ ID NO: 33097 - RNA, 42 nt, Mus musculus
ccaugccauagacagaagcuguggagaucaugaugcagagag

SEQ ID NO: 33098 - RNA, 46 nt, Mus musculus
aggcccauaucugauugcugcugucuacaguuuucccugcccccac

SEQ ID NO: 33099 - RNA, 46 nt, Mus musculus
ggaagcacuccuguuagaaggauuuaacagaauaagauaugcccag

SEQ ID NO: 33100 - RNA, 45 nt, Mus musculus
agagagagagagagagagagagaacaaacagcacagagaggaagg

SEQ ID NO: 33101 - RNA, 42 nt, Mus musculus
gagaaaaagcuagauuagaacagauugcuaggggcuggagag

SEQ ID NO: 33102 - RNA, 45 nt, Mus musculus
ugcuccagccuucucagcaggucccagcucuacacagggaagaga

SEQ ID NO: 33103 - RNA, 46 nt, Mus musculus
agacacaccaaggaguuggaacucaaaaccaaaggaacccccaauu

SEQ ID NO: 33104 - RNA, 44 nt, Mus musculus
gucaguucccccucucccuugacaugugauuucugggcccuggu

SEQ ID NO: 33105 - RNA, 45 nt, Mus musculus
uauggaacccuggaaaaugaucuaacauuguauauaaacccugag

SEQ ID NO: 33106 - RNA, 46 nt, Mus musculus
cugggaaagacaauggguaggaacauauuuggggagaaaccaaggu

SEQ ID NO: 33107 - RNA, 45 nt, Mus musculus
ugguggcugagggcacuccucuggauccuaagcaccggcagcugc

SEQ ID NO: 33108 - RNA, 46 nt, Mus musculus
ucucaccagcccauagcacccauucuuauucaaaccgcuaccaaau

SEQ ID NO: 33109 - RNA, 46 nt, Mus musculus
uguauuagugugagcuucaggagaugauguaauuuggguuuuagag

SEQ ID NO: 33110 - RNA, 46 nt, Mus musculus
ugugaccagucacagccagguaguauuuccaugggugccagaagua

SEQ ID NO: 33111 - RNA, 42 nt, Mus musculus
cugucucugagaacuuagguggauguggaguaguggggaguu

SEQ ID NO: 33112 - RNA, 45 nt, Mus musculus
agcgaugcugcucaucucucuuugcacaugggguuggggaggagg

SEQ ID NO: 33113 - RNA, 46 nt, Mus musculus
acaaccauccguaaugagaucugacucccucuucugcugugucuga

SEQ ID NO: 33114 - RNA, 42 nt, Mus musculus
guccuuuguugaaauaugaagauauagaacuugggggcugga

SEQ ID NO: 33115 - RNA, 43 nt, Mus musculus
ucacaaccauccauaaugagaucugacucccuauucuggagua

SEQ ID NO: 33116 - RNA, 46 nt, Mus musculus
uacuuucuuuggaaaauuuagaaaaguaucccucuuacccacccug

SEQ ID NO: 33117 - RNA, 41 nt, Mus musculus
ccccgaaaacaguaucaucgaagaugugguuagagcgugug

SEQ ID NO: 33118 - RNA, 46 nt, Mus musculus
cauugagccaucuucccauccuggcuucacauuucuaaauggagau

SEQ ID NO: 33119 - RNA, 77 nt, Mus musculus
ucccaguccucagugcuaagguuacagauaugugcugcagggcccaacauuuaccugugugcugggaaucugaacuc

SEQ ID NO: 33120 - RNA, 74 nt, Mus musculus
agagcuaagaaucacagcacacacccccaacuccuauccccccacaccccuaccucauucccacuccccaucca

SEQ ID NO: 33121 - RNA, 68 nt, Mus musculus
cuggaacucuuuguagaccagacuagccucaaacccaucaagaucuguuuaucucugucucaccaaca

SEQ ID NO: 33122 - RNA, 47 nt, Mus musculus
gguuauuuuuauguuuuguuguguuuugcuuugcuuuguuucgugug

SEQ ID NO: 33123 - RNA, 45 nt, Mus musculus
ucgggggcgggaccgccucucucguggguggcgauuugguggagu

SEQ ID NO: 33124 - RNA, 49 nt, Mus musculus
aggucagacuggcauccguggguacagauugggcaaacuaaggccccag

SEQ ID NO: 33125 - RNA, 45 nt, Mus musculus
caaaucaagaauuccagauaaaguguuucagccuaaaccugaaga

SEQ ID NO: 33126 - RNA, 41 nt, Mus musculus
ccaugggggugggaauucucucuucagaggcuccaccagaa

SEQ ID NO: 33127 - RNA, 42 nt, Mus musculus
cugaaacgaaauccugccaacguucacuaucugugcucaguc

SEQ ID NO: 33128 - RNA, 71 nt, Mus musculus
cgagaagcugaacagcaggccgcccucgcacgauuggcagggagacuggaguccaugaaugaugucgagga

SEQ ID NO: 33129 - RNA, 48 nt, Mus musculus
augcaugcaugccaggcauguguagaugcaaggauggauggauagaug

SEQ ID NO: 33130 - RNA, 51 nt, Mus musculus
aggaggcucuggcguccaaacguuuccgugcugagcggcaagacaacaagg

SEQ ID NO: 33131 - RNA, 42 nt, Mus musculus
gccagcagagugaggcccagccacccccuuccacuuagagaa

SEQ ID NO: 33132 - RNA, 42 nt, Mus musculus
aggcuagaagaaccuguagagagauagaauguggguccuaau

SEQ ID NO: 33133 - RNA, 42 nt, Mus musculus
uucccagcaaccacaugguggcucaaccaucuguaaugggau

SEQ ID NO: 33134 - RNA, 45 nt, Mus musculus
ugugagccaccaugugguugcugggauuugaacuucagaaaagca

SEQ ID NO: 33135 - RNA, 46 nt, Mus musculus
uugguauggagggacaaaauacugggcuugaucccuagccugagau

SEQ ID NO: 33136 - RNA, 45 nt, Mus musculus
guaauaauuacaggggcaaggaaucaucuguuaacaauaccaggu

SEQ ID NO: 33137 - RNA, 44 nt, Mus musculus
aagauccucauccggggaucaauauagaguacagcagcauaggc

SEQ ID NO: 33138 - RNA, 46 nt, Mus musculus
gagcaaacccaaguaucaggguaaucuguuucuacugaacucagcu

SEQ ID NO: 33139 - RNA, 45 nt, Mus musculus
uguuccugaugucaaucacagcaagagaaaguaaacuaccacagg

SEQ ID NO: 33140 - RNA, 45 nt, Mus musculus
cuuguagucacuucuaagggcaauuucuucaggucagcuugugag

SEQ ID NO: 33141 - RNA, 87 nt, Mus musculus
aggacgcugaggucuccguacagguuccuaaaaagagcccacagacagaacacugaaccgagcuuagacaccagaagagacccgccu

SEQ ID NO: 33142 - RNA, 46 nt, Mus musculus
gcugauaacagacgucuuucggagcuggguacuuggucugggaguc

SEQ ID NO: 33143 - RNA, 45 nt, Mus musculus
uagucaaacuucacuuuccaucgaaccgcauucuugcccaccucc

SEQ ID NO: 33144 - RNA, 45 nt, Mus musculus
auuauaucuaaguacacuguagcugucuucagccacaccagaaga

SEQ ID NO: 33145 - RNA, 23 nt, Mus musculus
cagggaaaacuuagggaucaggu

SEQ ID NO: 33146 - RNA, 44 nt, Mus musculus
auacaacaugcuuccucucgugaguguagcaggaaggggcuggu

SEQ ID NO: 33147 - RNA, 47 nt, Mus musculus
aaaucuuuggggaaaaaacaguuggaagguagagguaaaagaugagu

SEQ ID NO: 33148 - RNA, 42 nt, Mus musculus
guggaaagacacgcggucgcagagcaacuaucuacacuggag

SEQ ID NO: 33149 - RNA, 46 nt, Mus musculus
caugcucauaacauuucuguguucacaucuuuaaaaacugggcuag

SEQ ID NO: 33150 - RNA, 46 nt, Mus musculus
cagaauuccagcacaauuacuguuugucguaaagauugccagcuag

SEQ ID NO: 33151 - RNA, 45 nt, Mus musculus
ugugugucuuugugugugucuaugugugugugagagagagacaga

SEQ ID NO: 33152 - RNA, 46 nt, Mus musculus
gacugguggaguggggagagacuuaaccaugacucugagaugccca

SEQ ID NO: 33153 - RNA, 42 nt, Mus musculus
uuucagacuucuaaacaaucuauuacucuacuccgcccccag

SEQ ID NO: 33154 - RNA, 44 nt, Mus musculus
gcagggccauccaauacaauuaaagccuugauuuaccugacaug

SEQ ID NO: 33155 - RNA, 46 nt, Mus musculus
ggcccugccugaucccacaggucuuucaugaagacugccccauagc

SEQ ID NO: 33156 - RNA, 46 nt, Mus musculus
uuucccuuccugcucccagguggggaguggcuuagauccucuuugg

SEQ ID NO: 33157 - RNA, 47 nt, Mus musculus
cacacccugcugccaccucaagugcacuuggaacaaugccccccaga

SEQ ID NO: 33158 - RNA, 47 nt, Mus musculus
ugacuacaaaccccaggacggggaaaccauugagcugcggcuaguua

SEQ ID NO: 33159 - RNA, 57 nt, Mus musculus
gcagcaggggugugucaggggcucggaggagcugccaauauucucgguccccagcau

SEQ ID NO: 33160 - RNA, 44 nt, Mus musculus
augcuggggaccgagaauauuggcagcuccuccgagccccugac

SEQ ID NO: 33161 - RNA, 46 nt, Mus musculus
cuuuucauuuuuuaacgugugugugugugugugugugugugugugu

SEQ ID NO: 33162 - RNA, 42 nt, Mus musculus
gggagacuacaugggaggcaccagauuucacagcagacagac

SEQ ID NO: 33163 - RNA, 45 nt, Mus musculus
ggcagcuccacucuaacagaacucagagcuucucagacugacacc

SEQ ID NO: 33164 - RNA, 46 nt, Mus musculus
gggggaaagagaagaggaggaggagaugaaggagaagaagggaggg

SEQ ID NO: 33165 - RNA, 45 nt, Mus musculus
ucuugauuaucagcuuacugggauuuugagucagcaugcaaacag

SEQ ID NO: 33166 - RNA, 42 nt, Mus musculus
auacccagaaaucuguuugcaugcugacucaaaaucccagua

SEQ ID NO: 33167 - RNA, 46 nt, Mus musculus
gaucuuccuuggaagauguccugaaguuggcacaagauggcggagg

SEQ ID NO: 33168 - RNA, 46 nt, Mus musculus
ucugagauguggacaggguccucaacagcuggcaccaacaugacua

SEQ ID NO: 33169 - RNA, 46 nt, Mus musculus
cucccgguccucaugacagcugcuucuuccuuucuuccuggcauag

SEQ ID NO: 33170 - RNA, 47 nt, Mus musculus
gaacagaugcagacaggguccucugaggugcggugugucagauagga

SEQ ID NO: 33171 - RNA, 42 nt, Mus musculus
cacugcgugauacccaccguggaaauguuugggcgagggaau

SEQ ID NO: 33172 - RNA, 49 nt, Mus musculus
auccugaaccacaagaccuacuuggaucuuaucuucccagacugccagg

SEQ ID NO: 33173 - RNA, 45 nt, Mus musculus
cugccuugaugcacgcugugcccagcccuaccccggaugcaggag

SEQ ID NO: 33174 - RNA, 41 nt, Mus musculus
cucucgcacugucucgauagccauggugauucguggucuca

SEQ ID NO: 33175 - RNA, 46 nt, Mus musculus
cgauucaauuucaacucugaucugagaccacgaaucaccauggcua

SEQ ID NO: 33176 - RNA, 95 nt, Mus musculus
accaauggccuucuucucauccuccaagaaccacuugagcugugagaucaaccugucacccuuucggcucccgaagaauucgcaguuggcccuga

SEQ ID NO: 33177 - RNA, 45 nt, Mus musculus
ugcaggcugggaccaaagaggaccucuaccuucacagccucaaga

SEQ ID NO: 33178 - RNA, 41 nt, Mus musculus
aagguagagguccucuuuggucccagccugcaugcuggaaa

SEQ ID NO: 33179 - RNA, 46 nt, Mus musculus
gccggggguggggucucugggcucccucacuaauuccaaagaagag

SEQ ID NO: 33180 - RNA, 44 nt, Mus musculus
gcaaaagaagacauggagucgaggagauguguauucaggggauu

SEQ ID NO: 33181 - RNA, 28 nt, Mus musculus
uggcuauucuaagucacuuugugguagu

SEQ ID NO: 33182 - RNA, 80 nt, Mus musculus
cgggcccaccuucugauggaaaaguuaguuccucccauggaagagaagaauacuaaggcccagagagggcagggaauacu

SEQ ID NO: 33183 - RNA, 45 nt, Mus musculus
uacuaugacccacuggcccccgacuguccgcaaauggaccaccac

SEQ ID NO: 33184 - RNA, 42 nt, Mus musculus
gugccugggaggugcucaggcccaggagcagguaggcccaau

SEQ ID NO: 33185 - RNA, 46 nt, Mus musculus
ggacgggaagcauuuggugaagggcagagggauagguuacaucugg

SEQ ID NO: 33186 - RNA, 42 nt, Mus musculus
ugaauagcugagaagguacugccagccaagauggggguggcu

SEQ ID NO: 33187 - RNA, 46 nt, Mus musculus
aaaaaagaccugagcccaaccuugggcucagacuagaugccaccac

SEQ ID NO: 33188 - RNA, 45 nt, Mus musculus
acucccaccagcuuugucuguggcuucaggugaccaucagcuuag

SEQ ID NO: 33189 - RNA, 42 nt, Mus musculus
ccacuacucagaugacuaacugccccaguggaaagucugcag

SEQ ID NO: 33190 - RNA, 72 nt, Mus musculus
acggccauuacaccuguccccagcacuccggagcgucaguguugaguuuuaugcuaucuauugggggauaga

SEQ ID NO: 33191 - RNA, 46 nt, Mus musculus
ggugcaucugcaagggcaucauuaaaaggaaaaaacaaaaacacaa

SEQ ID NO: 33192 - RNA, 46 nt, Mus musculus
cucuaggcugaaagucuucccaccccuucccuccuccuaggugcaa

SEQ ID NO: 33193 - RNA, 42 nt, Mus musculus
cgggagcaggaccugucuguggugauccacacacuggcccag

SEQ ID NO: 33194 - RNA, 24 nt, Mus musculus
gaggucccuugcggggggaggggg

SEQ ID NO: 33195 - RNA, 45 nt, Mus musculus
ccgggccgggcucugaccuccagccugcacugcuuuccuagccag

SEQ ID NO: 33196 - RNA, 45 nt, Mus musculus
ggaagugucccguggguuaaaguucacaggauggguaaagggcag

SEQ ID NO: 33197 - RNA, 42 nt, Mus musculus
uccuacugccuugauuagauccagucauugacgccgggggug

SEQ ID NO: 33198 - RNA, 25 nt, Mus musculus
cacagagauggagaacaaugcucuc

SEQ ID NO: 33199 - RNA, 44 nt, Mus musculus
cugagggucagcucugugggcugcuauuuccuuugcuguuucua

SEQ ID NO: 33200 - RNA, 46 nt, Mus musculus
caccugucaccagcuagggccuugagaagcauccuccagcccccag

SEQ ID NO: 33201 - RNA, 42 nt, Mus musculus
augagggccgauucagaccuggugugcucugaguaguucugg

SEQ ID NO: 33202 - RNA, 46 nt, Mus musculus
cuccaggucuagaaggacccaauggcucgggauagcauggcccuag

SEQ ID NO: 33203 - RNA, 42 nt, Mus musculus
uaugagguuguaucgucuaucugggaacuaucugggcaagaa

SEQ ID NO: 33204 - RNA, 45 nt, Mus musculus
gcaucucaucucgcgccaaucacagcuuuccagggacuagcagac

SEQ ID NO: 33205 - RNA, 41 nt, Mus musculus
accugcagaacaaacagguggaaaguucucuauagggccuc

SEQ ID NO: 33206 - RNA, 45 nt, Mus musculus
accugugccauacgccacccaugccacggcaaccucaugaaccag

SEQ ID NO: 33207 - RNA, 41 nt, Mus musculus
aagcaguguguguggggggcccaggaagaggcuggggugac

SEQ ID NO: 33208 - RNA, 46 nt, Mus musculus
cagcuccaccaacuuggucuucucugucccguugccauggaaagau

SEQ ID NO: 33209 - RNA, 46 nt, Mus musculus
cacccgggaccagaagguccugaaccccacugccgugagccuccag

SEQ ID NO: 33210 - RNA, 42 nt, Mus musculus
aauggugcaccgcauagcaggaaucuagggggugccagagag

SEQ ID NO: 33211 - RNA, 42 nt, Mus musculus
aacugggccugaacagcugcccagugcgccagagaaggggag

SEQ ID NO: 33212 - RNA, 32 nt, Mus musculus
ugccuggccucagcacaaaggagagaucagau

SEQ ID NO: 33213 - RNA, 44 nt, Mus musculus
gggagcaggguagggaggaaggcagccaagcuggggcaguggcu

SEQ ID NO: 33214 - RNA, 46 nt, Mus musculus
uuugcaccuuucucugucacucucuaagcacuuuaccuggacggca

SEQ ID NO: 33215 - RNA, 49 nt, Mus musculus
ggacuggcugcccuucuccaagcugagagucaauuugucuaaaagccaa

SEQ ID NO: 33216 - RNA, 89 nt, Mus musculus
ggcucagggaccaauggacucucuccgugcacgcccccguccccccaacgcaaccaccuaccugcgucuuacuccaucaguugcccagc

SEQ ID NO: 33217 - RNA, 42 nt, Mus musculus
agacgcagguaggugguugcguuggggggacgggggcgugca

SEQ ID NO: 33218 - RNA, 47 nt, Mus musculus
ccugacaucuuucaccuggaagcauugacuuccaccgagcauaguag

SEQ ID NO: 33219 - RNA, 45 nt, Mus musculus
gggccuuuauuuauuauuuaaaacuucaaaccugaaagcacugag

SEQ ID NO: 33220 - RNA, 42 nt, Mus musculus
uuccauggguuucuuauagagcagugaaagggauuugaaggu

SEQ ID NO: 33221 - RNA, 30 nt, Mus musculus
aguuaaugacggcccugguaggggcuggga

SEQ ID NO: 33222 - RNA, 46 nt, Mus musculus
cuuacuaaagauuuuaauguaaauuuaagcaugagcguuaagagag

SEQ ID NO: 33223 - RNA, 46 nt, Mus musculus
uucuucaaguaaaggguuuuucuuuacauaauuaaauucuccaggu

SEQ ID NO: 33224 - RNA, 53 nt, Mus musculus
ggcccuagguucacuucuccagaaggaaccuggaucgcagagcugccuuggga

SEQ ID NO: 33225 - RNA, 42 nt, Mus musculus
aucucuccugacccgugcuugcuccuuguuggccccacaccu

SEQ ID NO: 33226 - RNA, 48 nt, Mus musculus
uauacuuccaguuauucauucaguugagccaaaauaagucccaagauc

SEQ ID NO: 33227 - RNA, 90 nt, Mus musculus
uaaagggaguuugugguuucugagaugagagauucagcccucuuauaaaaucacugcccggcaaauuccuccuuucuaguggccgaauaa

SEQ ID NO: 33228 - RNA, 46 nt, Mus musculus
gaaaauaccuauuuuuuaaaaaaaaaaaaagagauauuaaggagaa

SEQ ID NO: 33229 - RNA, 36 nt, Mus musculus
uuauaaagaaaagaccuuccauaauaccauccacac

SEQ ID NO: 33230 - RNA, 45 nt, Mus musculus
aagggagaggagugggaagagggaaagaaagagaaagagagaaua

SEQ ID NO: 33231 - RNA, 47 nt, Mus musculus
aacuguggggcucuuagcuuaugaaauguaauugauucuuaggagau

SEQ ID NO: 33232 - RNA, 46 nt, Mus musculus
auauauauguguguguauauuccuaaauauauaaauacaaccugcu

SEQ ID NO: 33233 - RNA, 48 nt, Mus musculus
ucagaaagaccaaagauuugaauuucugugacaugcccugaggcagga

SEQ ID NO: 33234 - RNA, 46 nt, Mus musculus
cuacacucaccagguucaaaacccacauuguucuuuggccaagaga

SEQ ID NO: 33235 - RNA, 46 nt, Mus musculus
uagggcagcccaucccuugcuuccccacacagcccaaccuccugau

SEQ ID NO: 33236 - RNA, 46 nt, Mus musculus
ugucuuugaagccuugcaugucuccugaagaaaacuggcucauauc

SEQ ID NO: 33237 - RNA, 28 nt, Mus musculus
agcaggaggagcaggaggaggagggagg

SEQ ID NO: 33238 - RNA, 25 nt, Mus musculus
aauagcaaguucuagucaagacuac

SEQ ID NO: 33239 - RNA, 46 nt, Mus musculus
uggaugcccaugcagucagaugauacucuauaguauauugugcagc

SEQ ID NO: 33240 - RNA, 45 nt, Mus musculus
aggccgauuuccagggagauggaaguaggcugaaggugauguaac

SEQ ID NO: 33241 - RNA, 71 nt, Mus musculus
aagaaguucugcugguucacagggaguuacaaaggaaugcggaugggcuagaaagaaagacugaaaggggg

SEQ ID NO: 33242 - RNA, 46 nt, Mus musculus
ucauuuuugcccucucaggugucacuaauuuuuauuucggacagau

SEQ ID NO: 33243 - RNA, 43 nt, Mus musculus
uuuucuggaugaccuaucuacugcaaagagucagguauuaaaa

SEQ ID NO: 33244 - RNA, 46 nt, Mus musculus
agucuuggaguagguuccaaucgcuucucugccuuuugccuaagau

SEQ ID NO: 33245 - RNA, 46 nt, Mus musculus
auaauuuuacuuuugguugggucuuuucaugguuuuaguaugagag

SEQ ID NO: 33246 - RNA, 46 nt, Mus musculus
auguugucuaugguuuugcuguaaauugccuuuauuguguugaggu

SEQ ID NO: 33247 - RNA, 46 nt, Mus musculus
cuaagacuucaaguacuauauugaauaguuaugaaaagcgugagau

SEQ ID NO: 33248 - RNA, 42 nt, Mus musculus
ugguggaaucuuugagggccuuuuauauauaaacucacauca

SEQ ID NO: 33249 - RNA, 46 nt, Mus musculus
caaaucuguugugagagcaugcacaaguucugaacaagcucaagcu

SEQ ID NO: 33250 - RNA, 46 nt, Mus musculus
gcauuguucuaaaggggaaugaugggccauugaaggcuaaggaugg

SEQ ID NO: 33251 - RNA, 47 nt, Mus musculus
ugaaucuuuuaauauuuguguuucauuuggaauacucacagagguca

SEQ ID NO: 33252 - RNA, 45 nt, Mus musculus
ugagccaccaugugguugcugggauuugaacucuggaccugcgga

SEQ ID NO: 33253 - RNA, 46 nt, Mus musculus
augauuuaauagugucuauguuucugcuaccacugugucccuagaa

SEQ ID NO: 33254 - RNA, 41 nt, Mus musculus
acuuacugagcuaagggguucacuaaugcuagggaggugcu

SEQ ID NO: 33255 - RNA, 45 nt, Mus musculus
gcuuucguuugugucgggaacuuugauaugauauugagugugagu

SEQ ID NO: 33256 - RNA, 46 nt, Mus musculus
gcuggcaggucucugccuccugagaguuggggagagagagaaagag

SEQ ID NO: 33257 - RNA, 46 nt, Mus musculus
aauguggcuguguucugaaagcacagcugcauugcagugcgcaucc

SEQ ID NO: 33258 - RNA, 41 nt, Mus musculus
cccacagaaucaaaacucaaaaggucagcugcagugcaguc

SEQ ID NO: 33259 - RNA, 42 nt, Mus musculus
cuauuuugacuugagugauucucgucguucuccggcuguagg

SEQ ID NO: 33260 - RNA, 46 nt, Mus musculus
gucacauagcagauauccugcauagcagauauccugcauagcagau

SEQ ID NO: 33261 - RNA, 42 nt, Mus musculus
cccuguaauuguuuacuagcuacuugcauucugcccugacaa

SEQ ID NO: 33262 - RNA, 45 nt, Mus musculus
uggcacagugcuuuugacaccucacuuacucaucacagagcaguc

SEQ ID NO: 33263 - RNA, 57 nt, Mus musculus
aggaggaggaggaggaagaagaggaaggaggaggaggaggaggaagaagaggaagga

SEQ ID NO: 33264 - RNA, 46 nt, Mus musculus
uucuucugugucuacuucucugcuuucuguuguuuuuagcccaguu

SEQ ID NO: 33265 - RNA, 46 nt, Mus musculus
uacauuucuaaaaaaauacuucaaaaaauaguuagaggaccuagaa

SEQ ID NO: 33266 - RNA, 45 nt, Mus musculus
aaugcuguuguauuuuacuugcuuauaauucuguugccuuuaguu

SEQ ID NO: 33267 - RNA, 54 nt, Mus musculus
aaaaaccuuugcuaacuguucauuguucacuggcugcugcuucuuuuucaccug

SEQ ID NO: 33268 - RNA, 46 nt, Mus musculus
uguugccccuugucuuuauuuauuuuccuauauauauuuccacaga

SEQ ID NO: 33269 - RNA, 42 nt, Mus musculus
uaccugagcuaugagugacagagaaaguccccacccccaccc

SEQ ID NO: 33270 - RNA, 50 nt, Mus musculus
acuacuguucuccuccuuccacccccuucaucuuccugcucccucucucc

SEQ ID NO: 33271 - RNA, 45 nt, Mus musculus
ggauggccacucuggagaagacccaggcaacugcucagcuggaga

SEQ ID NO: 33272 - RNA, 41 nt, Mus musculus
ggguucuaagacaugggagcagugggaagaaggaacagaga

SEQ ID NO: 33273 - RNA, 42 nt, Mus musculus
acaggagaaguaagggcuaccuucuuuggaguagagcaaggc

SEQ ID NO: 33274 - RNA, 46 nt, Mus musculus
ggggaagaagacauauacuguaaugaaagccacccaccucucugau

SEQ ID NO: 33275 - RNA, 41 nt, Mus musculus
ucaagaguucaaggccagucuuaguuauauaauguggucau

SEQ ID NO: 33276 - RNA, 45 nt, Mus musculus
uggauuuaaaugggauaaucuuuucuaagaguauuggacccaaug

SEQ ID NO: 33277 - RNA, 46 nt, Mus musculus
uuuugaguaaagucuaauagccaauuuccccuuauuagguaccagg

SEQ ID NO: 33278 - RNA, 55 nt, Mus musculus
cuagcagggacauugacagccuaaguaaaaggcauuuguaagaggcauucaguac

SEQ ID NO: 33279 - RNA, 86 nt, Mus musculus
ggaaaugccaggcacaauguaguuuauaauuaaccccaaggguuugggaaagguugcauuuucaacaaaagaaagccacuuaucac

SEQ ID NO: 33280 - RNA, 48 nt, Mus musculus
ucuucaaacaaaaaguggugguuaaaaagagccuucuguacagcaucu

SEQ ID NO: 33281 - RNA, 41 nt, Mus musculus
guucugggauuaaaggcgugugccaccacgcccggcaagau

SEQ ID NO: 33282 - RNA, 48 nt, Mus musculus
uaggacuugagauaugguagaacacuuaccuagaugcacagacccuga

SEQ ID NO: 33283 - RNA, 48 nt, Mus musculus
ggugaucagaaauaaaauugagauguagagaccuaauuuucaggcagu

SEQ ID NO: 33284 - RNA, 46 nt, Mus musculus
aacucuuguaaaaagaaagcauuuaaauggggacuugcuuacaguu

SEQ ID NO: 33285 - RNA, 29 nt, Mus musculus
acucuguguccuucucuaaagggacagua

SEQ ID NO: 33286 - RNA, 45 nt, Mus musculus
aagaacuggaaaggaaugagucaggguaaagaaaaaauguacagg

SEQ ID NO: 33287 - RNA, 42 nt, Mus musculus
uaagcagacccuccuauugggaauaguauuuugccugcagua

SEQ ID NO: 33288 - RNA, 46 nt, Mus musculus
agccauuguagcguguccuugaagacacucaaaugugagacuaauu

SEQ ID NO: 33289 - RNA, 45 nt, Mus musculus
uucaaauacacaaaaaaaggaaccacuauggacuuugacagguag

SEQ ID NO: 33290 - RNA, 42 nt, Mus musculus
gugugugugcaugugcacgugcacgcuuguacaugugcaguu

SEQ ID NO: 33291 - RNA, 46 nt, Mus musculus
uggcacauaccuauaguugcagcacucaggagaggcaggaggauca

SEQ ID NO: 33292 - RNA, 46 nt, Mus musculus
uaugagaggugaucacacaauuuuaacuuccuguuucacugaacaa

SEQ ID NO: 33293 - RNA, 46 nt, Mus musculus
gucugaggcuaguuuggucuauagagcaaguuccagggcagccagg

SEQ ID NO: 33294 - RNA, 42 nt, Mus musculus
gugauaaaccguuaagaauuacaguuaggaguuggggcagua

SEQ ID NO: 33295 - RNA, 42 nt, Mus musculus
guagcugagaauccccuugaauuucagaucccgcugccuuca

SEQ ID NO: 33296 - RNA, 23 nt, Mus musculus
cuaaggagaugaggauuuggagu

SEQ ID NO: 33297 - RNA, 120 nt, Mus musculus
aaaugaaacaagucuuuuauuaugaaaauauuuuuagaaacuagauuuuuuuguuuuuagaaacacccaaaaaccaaaaaaaaagcaguuuagaacugaggcuauugggccgggccggca

SEQ ID NO: 33298 - RNA, 67 nt, Mus musculus
uauuuaaguauauuuaucugaaaugaggcuaucaauuauguuacuagacuaccacauaaacagagca

SEQ ID NO: 33299 - RNA, 65 nt, Mus musculus
uucccuuaaacagcuuuacacaaaucccaaggaaccugagguaagaggguaguguauguauacua

SEQ ID NO: 33300 - RNA, 48 nt, Mus musculus
aguuagcacaguacaaauuaaacucuucacaaagacagugcauucagu

SEQ ID NO: 33301 - RNA, 45 nt, Mus musculus
ucuugaaacaaacaaacaaacaaacaaacaaacaaacaaaugaau

SEQ ID NO: 33302 - RNA, 41 nt, Mus musculus
uuuuuuugauaauccuucuuuugucccaguaaagccagugu

SEQ ID NO: 33303 - RNA, 62 nt, Mus musculus
uggguugagaaagagacauugcaggaugaauuuggcuucucggcagcgcagcgggauggauu

SEQ ID NO: 33304 - RNA, 46 nt, Mus musculus
uuccauuuugacccaggggacagagggauacaaagauaagacagau

SEQ ID NO: 33305 - RNA, 46 nt, Mus musculus
aaguuuuacucuauuuuauuuuguuaauuauaacuccuguguauaa

SEQ ID NO: 33306 - RNA, 46 nt, Mus musculus
uagcacguugaacauguucuaaauagcggugacucgguuugcagau

SEQ ID NO: 33307 - RNA, 42 nt, Mus musculus
uuaaaaauucuccgggaagacaaaaaguguccggggucauua

SEQ ID NO: 33308 - RNA, 46 nt, Mus musculus
gccaugcaguggcgguguacaccuuugaucccagcacucaggaggc

SEQ ID NO: 33309 - RNA, 47 nt, Mus musculus
aguugagauggucucagugacaucuuagauuauuuagagagaauggg

SEQ ID NO: 33310 - RNA, 46 nt, Mus musculus
cuuuauauacuaugucuuucuuccuucauauggggaagugggagau

SEQ ID NO: 33311 - RNA, 53 nt, Mus musculus
ugcacauacauguacgccaacccauaaauuuauaaacaccugaugauuuaaga

SEQ ID NO: 33312 - RNA, 42 nt, Mus musculus
auauaguuuguuuccccuccuguuuggaacauggagcuauaa

SEQ ID NO: 33313 - RNA, 45 nt, Mus musculus
agacuauaacugaagaugugaggacagacaagagaacugugaaga

SEQ ID NO: 33314 - RNA, 45 nt, Mus musculus
ugguuagcuuuaaaucaacuugacacaaguuggagucagcagaga

SEQ ID NO: 33315 - RNA, 46 nt, Mus musculus
uuuuaggagcgugugugugugugugugugugugugugugugugugu

SEQ ID NO: 33316 - RNA, 42 nt, Mus musculus
ucugucuguaguaaagcugugaagcugucauguuggccagga

SEQ ID NO: 33317 - RNA, 45 nt, Mus musculus
augagaucagaugcccucuucuggugugucugaaggcagcuacag

SEQ ID NO: 33318 - RNA, 46 nt, Mus musculus
uucauucucacgauggcuacugcgcagcucucucacaacaccagaa

SEQ ID NO: 33319 - RNA, 46 nt, Mus musculus
ugugagucagacucaacaguuauacucuaaaagaaaacagccuuua

SEQ ID NO: 33320 - RNA, 80 nt, Mus musculus
acuacuaggacagaaacuugaggaaucccaagaaggcaggaggaaaagaggcaggaggaaaaggcaggagaaaaaggcug

SEQ ID NO: 33321 - RNA, 45 nt, Mus musculus
gaaagaauuagcauuuggacaugcuaagaccaucaaagugggaau

SEQ ID NO: 33322 - RNA, 46 nt, Mus musculus
aacaaugguaaagaguuuuuauuuuauuuuuuuccugaggguaguu

SEQ ID NO: 33323 - RNA, 41 nt, Mus musculus
guggcucacaaccauccauaaugagaucugacgccaucuuc

SEQ ID NO: 33324 - RNA, 23 nt, Mus musculus
augguuuuuguucguguuuuuuu

SEQ ID NO: 33325 - RNA, 46 nt, Mus musculus
aauagcugaaugauuuaggccuuuuuuaaaaguuggaacuggagau

SEQ ID NO: 33326 - RNA, 46 nt, Mus musculus
caccuacacguagcuuacaaccaucuguaccccccaguugcaggag

SEQ ID NO: 33327 - RNA, 46 nt, Mus musculus
ucaaaucccagcaaccacgugguggcucacaaccauccguaacgaa

SEQ ID NO: 33328 - RNA, 42 nt, Mus musculus
aggcgggcccaaggucaggauggcccaggcccucacccccuc

SEQ ID NO: 33329 - RNA, 74 nt, Mus musculus
gcucccuggacaccaguccagaaaggugacagcacugguuagaaauaagaguagggagagaggggagaaagaag

SEQ ID NO: 33330 - RNA, 56 nt, Mus musculus
ccuacuucacagccgaggcaucagagauucagagggaaauaagugucuugcccagg

SEQ ID NO: 33331 - RNA, 46 nt, Mus musculus
aggcccugccagcccauuuccaggccagacauccccaugccaagau

SEQ ID NO: 33332 - RNA, 45 nt, Mus musculus
cagggcugggugcagagcggcuguccuucauacagaugccacuuu

SEQ ID NO: 33333 - RNA, 42 nt, Mus musculus
accaacauaggaaaggauacuagugggagcccaggggaagcc

SEQ ID NO: 33334 - RNA, 46 nt, Mus musculus
ggauagaagaguugggacgcgugcccuucacuuccgugcuggguaa

SEQ ID NO: 33335 - RNA, 44 nt, Mus musculus
gugcaugacuucaauucaagcacucaaggcaaucagaucuugga

SEQ ID NO: 33336 - RNA, 46 nt, Mus musculus
cccugucucaaaaaccaaaaggaaaaaaaaauuauuuugggccagg

SEQ ID NO: 33337 - RNA, 45 nt, Mus musculus
aaccauccacaacaagauccucuucuggagugucugaagacagcu

SEQ ID NO: 33338 - RNA, 46 nt, Mus musculus
auaugauuacugagcugugucucagaggcauuguguuaguucucgu

SEQ ID NO: 33339 - RNA, 72 nt, Mus musculus
gguggguacuaggaaccaaacucaggucuacuccaauagcaguaauuacuauuagccacugagccaucucca

SEQ ID NO: 33340 - RNA, 41 nt, Mus musculus
uauauacuguagauguuuacaaacacaccagaagagggcau

SEQ ID NO: 33341 - RNA, 46 nt, Mus musculus
auguguguagguguguaucugaguggauuuguguaugugcguguag

SEQ ID NO: 33342 - RNA, 46 nt, Mus musculus
gugucuguuuuguuuggggaugggguuuccucuauguagccccugc

SEQ ID NO: 33343 - RNA, 62 nt, Mus musculus
gcacucuaggaaacaaaauacuuuacaaaaguuaaggagcagauuaaggagagggggaaaug

SEQ ID NO: 33344 - RNA, 46 nt, Mus musculus
auuuaaaccaccacaucacccuagugaagaauccggcguggggugg

SEQ ID NO: 33345 - RNA, 46 nt, Mus musculus
gguuuaggucuagggcuuugcauguucccacagaaugaaacaaggg

SEQ ID NO: 33346 - RNA, 46 nt, Mus musculus
ggucuuguguacauuggcaucucuguauguauccuccuaccccuaa

SEQ ID NO: 33347 - RNA, 41 nt, Mus musculus
gggccaucaaguaccgucaggagaaccaggaggcgguggga

SEQ ID NO: 33348 - RNA, 74 nt, Mus musculus
ugcccuucucacagccuacaaagauuugcaaucucgggaggagacucgaaaugcggccuggagaaagaggggcu

SEQ ID NO: 33349 - RNA, 45 nt, Mus musculus
uacagaggugacauauaacccugggucaguucuguaccucucaga

SEQ ID NO: 33350 - RNA, 45 nt, Mus musculus
acacuaaucagcauacaccuaaccacagaaccgcagcccugcccg

SEQ ID NO: 33351 - RNA, 103 nt, Mus musculus
gaagcaggaacccuucacaagugggcacauaggauucagaauuuaaaauacagaauugggaagacaggacagaggugacagaggaucuuaagggagcacccug

SEQ ID NO: 33352 - RNA, 45 nt, Mus musculus
ucccccaaacccucauuuugcagaaacacuaggucuguggaguag

SEQ ID NO: 33353 - RNA, 46 nt, Mus musculus
gggcguguggcaaacgcuccuggguggcgguuggcuuucccggguu

SEQ ID NO: 33354 - RNA, 44 nt, Mus musculus
uaaaauguaggcuuuggucuuuacuuauuuuugcuucuuuugag

SEQ ID NO: 33355 - RNA, 46 nt, Mus musculus
uuauuucuucuaaucuuaugugccuugguguuuuucuugcauucau

SEQ ID NO: 33356 - RNA, 57 nt, Mus musculus
gugugcacuucaugacucuaaagaagcuuaaccgauuagcccacaucagauuaaaga

SEQ ID NO: 33357 - RNA, 46 nt, Mus musculus
caggucuucagagugggaucccaucucauaaucacacaggggggag

SEQ ID NO: 33358 - RNA, 46 nt, Mus musculus
caccacgccuggcugcccauugguauuuuuaaaauuuaucuguguu

SEQ ID NO: 33359 - RNA, 29 nt, Mus musculus
uacgggcaggccuguggugaguauggggg

SEQ ID NO: 33360 - RNA, 45 nt, Mus musculus
cguugccaucaucagcucauaugaaauccuccucccagcccccua

SEQ ID NO: 33361 - RNA, 42 nt, Mus musculus
gugacauauugagauguuucaguguuccccuuuugcccccaa

SEQ ID NO: 33362 - RNA, 45 nt, Mus musculus
gggcugaauacgugucugcugggacaaggaccuggcagcagggua

SEQ ID NO: 33363 - RNA, 45 nt, Mus musculus
agcgcaaggagaugcuaaaaaggcacccacugucuguccugcugg

SEQ ID NO: 33364 - RNA, 45 nt, Mus musculus
auauagagagauuguauacaccaaggaccuguacucaauggccag

SEQ ID NO: 33365 - RNA, 49 nt, Mus musculus
uuccugcucuuacauugaaggcaaagggaugccaugggaagaugaaagc

SEQ ID NO: 33366 - RNA, 43 nt, Mus musculus
ccagggagcgaucuuaugcagcuugugaggcugggugcaggga

SEQ ID NO: 33367 - RNA, 46 nt, Mus musculus
aacagacacacagacagcugcaguccagugucugacucggcuggag

SEQ ID NO: 33368 - RNA, 46 nt, Mus musculus
gcugugguggacacuuuguguccacaccaucaacaucuacacacag

SEQ ID NO: 33369 - RNA, 45 nt, Mus musculus
gaaaaauccucuagcacagaccagaaagaaagccagcccccagag

SEQ ID NO: 33370 - RNA, 40 nt, Mus musculus
accaaggccaaagaaccuagcaaacccacagagacggaaa

SEQ ID NO: 33371 - RNA, 42 nt, Mus musculus
aaggaaacucccacggaaaagcccaaggacucuacagcagaa

SEQ ID NO: 33372 - RNA, 46 nt, Mus musculus
cugagaaggaagaagccaagacuucugaaaagguggcucccaagaa

SEQ ID NO: 33373 - RNA, 45 nt, Mus musculus
cgugaaggaagauaucaagcccccagcugaggcgaaauccccuga

SEQ ID NO: 33374 - RNA, 46 nt, Mus musculus
guccccaggugaggccaaguccccaggugaggccaagucaccagcu

SEQ ID NO: 33375 - RNA, 104 nt, Mus musculus
ccccaggugaggccaaguccccaggugaggccaaguccccagcugaggccaaguccccaggugaggccaaguccccaggugaggccaaguccccaggugaggcc

SEQ ID NO: 33376 - RNA, 42 nt, Mus musculus
aagaggcugcaucuccagaaaaagaaaccaagucucguguga

SEQ ID NO: 33377 - RNA, 58 nt, Mus musculus
acggaaggagugacagaagaggaggacaaagaggcccaaggucaggaaggagaagaag

SEQ ID NO: 33378 - RNA, 40 nt, Mus musculus
agggaauuuuugggaguccuucaguaagagagaagggacu

SEQ ID NO: 33379 - RNA, 46 nt, Mus musculus
ccgucagaaggauaagaagucacuccugagucaaugauuuuggaug

SEQ ID NO: 33380 - RNA, 45 nt, Mus musculus
cuauucagcagcuggacagugagcugagaaacaccaagugggaga

SEQ ID NO: 33381 - RNA, 45 nt, Mus musculus
caugcaccucgcagcgggucuagcuacuucugagaggaguccucu

SEQ ID NO: 33382 - RNA, 42 nt, Mus musculus
gcagcgcaucggcgcugccgaagcucaucauggccggagcag

SEQ ID NO: 33383 - RNA, 42 nt, Mus musculus
ucucccacugcuucaacccgaaggcgcccugacccaucaguu

SEQ ID NO: 33384 - RNA, 41 nt, Mus musculus
agccuuguccccuccugggguucugugguccuugcccgcau

SEQ ID NO: 33385 - RNA, 42 nt, Mus musculus
ggaugaauucuaaucagcucucuagcaaaacguauggcccag

SEQ ID NO: 33386 - RNA, 30 nt, Mus musculus
aucccuccaucccuuaauugcaucccugac

SEQ ID NO: 33387 - RNA, 38 nt, Mus musculus
agagagaaagagagggagggauggagggagggggagag

SEQ ID NO: 33388 - RNA, 42 nt, Mus musculus
uguguugcccaggcuggucuugaacuccugaucccccugcag

SEQ ID NO: 33389 - RNA, 53 nt, Mus musculus
guccaagaucagucugggcuauauggcaaguuucaggccagcuuagacuacag

SEQ ID NO: 33390 - RNA, 41 nt, Mus musculus
acaaacacccauucacccuaaauuuagcuccgacagcagac

SEQ ID NO: 33391 - RNA, 46 nt, Mus musculus
aaugccaggcagugguggugcaugccuuuaaucccagcacucggga

SEQ ID NO: 33392 - RNA, 46 nt, Mus musculus
ccuguggguuauauccuugaguaacaguguguggcaggacccugaa

SEQ ID NO: 33393 - RNA, 46 nt, Mus musculus
acaggccucugccugguggcugcagcgguucaccuugccagcagau

SEQ ID NO: 33394 - RNA, 42 nt, Mus musculus
gacuugagcuccucaggaaaggagccauugcugcccccuuua

SEQ ID NO: 33395 - RNA, 48 nt, Mus musculus
ugcuuuggagcaugagaccuugcuccuuuaguagaucugagguuggua

SEQ ID NO: 33396 - RNA, 45 nt, Mus musculus
ugucuguguuugaguaucagguaugauaccugagagaggcauaug

SEQ ID NO: 33397 - RNA, 46 nt, Mus musculus
guggcauugucuccuguuuugcagaugagaaugccagagcuuaggg

SEQ ID NO: 33398 - RNA, 46 nt, Mus musculus
uguaauacaaacacauaaucauagacacacacccacacacaaguug

SEQ ID NO: 33399 - RNA, 45 nt, Mus musculus
accaauaggaggacaugguaaaagggagcaggcuguugaguuugg

SEQ ID NO: 33400 - RNA, 45 nt, Mus musculus
uguuugaagacugagaggccaccugcauguguguaagccccuucc

SEQ ID NO: 33401 - RNA, 45 nt, Mus musculus
gagagagagcgagagagagagagagagagagagagagagcgagcg

SEQ ID NO: 33402 - RNA, 46 nt, Mus musculus
cucacuugucucugggaggaaucuuuuuuucuccuugggugguugg

SEQ ID NO: 33403 - RNA, 46 nt, Mus musculus
aaaaaaaaaaacauacaaagaaaggauuucauagugggagcugaaa

SEQ ID NO: 33404 - RNA, 46 nt, Mus musculus
ccuuugaaaucuccuucuucuaugcauuccuucccagcugcuagac

SEQ ID NO: 33405 - RNA, 45 nt, Mus musculus
aagccugaugccuucuguugaauucucaggguacacaugguggaa

SEQ ID NO: 33406 - RNA, 46 nt, Mus musculus
aagaacagcauucacauggucaaaugucaucaguuucagaauaguu

SEQ ID NO: 33407 - RNA, 46 nt, Mus musculus
uuguggacuguuuuuucuucaguccacucaagaauguaaaugagau

SEQ ID NO: 33408 - RNA, 41 nt, Mus musculus
ugagcuuguccuagaagagaauguagagaaaagggaccaag

SEQ ID NO: 33409 - RNA, 52 nt, Mus musculus
uuauguacauaggguugagcaggcuagauguagaaaggaagaacgggggcug

SEQ ID NO: 33410 - RNA, 41 nt, Mus musculus
aauacgcauggggucagcacuagcaugugcagggggugaga

SEQ ID NO: 33411 - RNA, 44 nt, Mus musculus
gacuuuagggccaaguggcaugcagcaugcuuuuauccaaaaga

SEQ ID NO: 33412 - RNA, 46 nt, Mus musculus
uugaugaacauugauuuaaggacacgggagaacuuaggaugcagcu

SEQ ID NO: 33413 - RNA, 46 nt, Mus musculus
guuuuuaggcaacaucuucacaucagugagugugguguggcaagag

SEQ ID NO: 33414 - RNA, 42 nt, Mus musculus
ugagggggggugugugugugugugugugugugugugugugug

SEQ ID NO: 33415 - RNA, 46 nt, Mus musculus
uugcaguggugaagcuggaacccaguacuuuacacaucagguagac

SEQ ID NO: 33416 - RNA, 42 nt, Mus musculus
uaguaugaggacaauuuuaaauuuaaaagaaaaacccaaggc

SEQ ID NO: 33417 - RNA, 46 nt, Mus musculus
gauauuucuaacacacacacacacacacacacacacacacacacac

SEQ ID NO: 33418 - RNA, 46 nt, Mus musculus
uccaaugcauuaugucuucauacuauauaaagugcagcuaccaggu

SEQ ID NO: 33419 - RNA, 46 nt, Mus musculus
augaaguggaauucuaaaaaauuuuaauuaaaaagcagcagcagca

SEQ ID NO: 33420 - RNA, 47 nt, Mus musculus
cugaaccucacuuaggcaacacaguagagcuaguccugguggcauag

SEQ ID NO: 33421 - RNA, 55 nt, Mus musculus
cuguacauugacccauugugggucucuuuguuaauugccagcuauuauaagaagc

SEQ ID NO: 33422 - RNA, 47 nt, Mus musculus
uagucagcuccccccaccccccauacuauaugagcacucaaccacca

SEQ ID NO: 33423 - RNA, 44 nt, Mus musculus
uuucuguugcuaugauaauacacuggcaaaaaacagcuuggaga

SEQ ID NO: 33424 - RNA, 42 nt, Mus musculus
gcagaauucacuuggacugaauuccgaaauuccaggcuagau

SEQ ID NO: 33425 - RNA, 46 nt, Mus musculus
uugauuggcaaggagaagcacaaaggcaaagggauugggcugggaa

SEQ ID NO: 33426 - RNA, 45 nt, Mus musculus
uuucagucuuuuucucucagauagucaacucucaaguaaggaggc

SEQ ID NO: 33427 - RNA, 46 nt, Mus musculus
gguacauuauagaaucauuuucaaacagcugaucaaacaucaugau

SEQ ID NO: 33428 - RNA, 42 nt, Mus musculus
gaguuagagaugguuaugaaucacuaaggguaauggaaaugg

SEQ ID NO: 33429 - RNA, 45 nt, Mus musculus
ggguccuguccugcuauuccauugugacagauccugggaagcagu

SEQ ID NO: 33430 - RNA, 46 nt, Mus musculus
uuagcucaaaauuuguaucuucauaaguaaaacucuaagcugaaca

SEQ ID NO: 33431 - RNA, 46 nt, Mus musculus
ggagugcaaggacagucugggcaggaaccugucucacugggaugag

SEQ ID NO: 33432 - RNA, 46 nt, Mus musculus
aaauacugcuagcagcuaugaaugagacuagauagaugcauuagaa

SEQ ID NO: 33433 - RNA, 45 nt, Mus musculus
uacagggcucaucugccauuacaagcacccuagcaggggaggagg

SEQ ID NO: 33434 - RNA, 46 nt, Mus musculus
gugugugugguguguguguguguguguguguguguguguaaguaau

SEQ ID NO: 33435 - RNA, 46 nt, Mus musculus
auguaggagggaccagcauguugcacaacuccaguggccccauuca

SEQ ID NO: 33436 - RNA, 42 nt, Mus musculus
uuugggaaaguauucccauucacaguuuugagccccaaacac

SEQ ID NO: 33437 - RNA, 48 nt, Mus musculus
uguaaaacuuuuaugaagauguuguuguacuuacaugggagguuggag

SEQ ID NO: 33438 - RNA, 46 nt, Mus musculus
caaacaagcaaaaccaaaaaaugaagaagaaaacaaaaccccagau

SEQ ID NO: 33439 - RNA, 42 nt, Mus musculus
uuguuuucuuuuauucuuuccaaggucugcaugcuggcagua

SEQ ID NO: 33440 - RNA, 45 nt, Mus musculus
ucccucaguauggauuuuuuucugucuaaaauuggagguuuggga

SEQ ID NO: 33441 - RNA, 46 nt, Mus musculus
augcugggagauuacuauaaagaaacuugcugaagaugggguaggu

SEQ ID NO: 33442 - RNA, 45 nt, Mus musculus
acucauguuggauggcuuauaaucaucuguaacuccggccucagc

SEQ ID NO: 33443 - RNA, 45 nt, Mus musculus
gucuuuauguagucuuggcuguccuggaacucucuguagaccaga

SEQ ID NO: 33444 - RNA, 46 nt, Mus musculus
ccuugaaguauuucuuaggugucucuguucauugaugcugccagac

SEQ ID NO: 33445 - RNA, 47 nt, Mus musculus
ggaaucugaacuggagcccccaccugccaucuuuucuggugcuaucu

SEQ ID NO: 33446 - RNA, 44 nt, Mus musculus
ucagcauuugcaaagcgacuccucacacaacugcuaaguaccca

SEQ ID NO: 33447 - RNA, 46 nt, Mus musculus
cuggccucaaaccucuccucccaagcacuggcauugaaggcaugaa

SEQ ID NO: 33448 - RNA, 46 nt, Mus musculus
caugaaguauucaaacugcuaacaccaacacuccauguccuucaag

SEQ ID NO: 33449 - RNA, 46 nt, Mus musculus
aacaacaacagaagggagggagaggagaaggaaaaugucccaaguc

SEQ ID NO: 33450 - RNA, 45 nt, Mus musculus
agcuucccuucaccuugaauuccauauacauuaauccagcaguca

SEQ ID NO: 33451 - RNA, 46 nt, Mus musculus
acuauugaagaauuugaguuuuguuaagaacaccaagaauccagcg

SEQ ID NO: 33452 - RNA, 42 nt, Mus musculus
auauauauauauaaaaaaguaaaaauuuuaagccgggcaggu

SEQ ID NO: 33453 - RNA, 46 nt, Mus musculus
cuuagucuggaaccagaguuugcacguuuuucaaggggguuuagag

SEQ ID NO: 33454 - RNA, 48 nt, Mus musculus
auggugguaagauuucauucugugcuccagacuuguucaggaguuguu

SEQ ID NO: 33455 - RNA, 76 nt, Mus musculus
ucaccaugcccagcuuucccaaaguuuuaauuucuacugugcagggguuggcuuuacaacuucacuucuuuggguu

SEQ ID NO: 33456 - RNA, 42 nt, Mus musculus
uggcuuccuauggcucucagacaaggaauaaggcacacagau

SEQ ID NO: 33457 - RNA, 46 nt, Mus musculus
cccugaguauuugcagccgaagagggguugggcaagagcaggagga

SEQ ID NO: 33458 - RNA, 49 nt, Mus musculus
gccaggcauuuucucuaauguaggccugcuaaggagcagaaauggcauu

SEQ ID NO: 33459 - RNA, 45 nt, Mus musculus
ucucacuuuuaccuuggauuucccuuugguaaaauggagucagau

SEQ ID NO: 33460 - RNA, 46 nt, Mus musculus
uagaaggcuguugaagcuguauugccuuauugaugucauaccagau

SEQ ID NO: 33461 - RNA, 45 nt, Mus musculus
gacaggaguauaauuuuccccuggucuguccucuaacugugcaga

SEQ ID NO: 33462 - RNA, 46 nt, Mus musculus
gcucggcuagguuagauauucauuccucuugaggcucaaaggagau

SEQ ID NO: 33463 - RNA, 64 nt, Mus musculus
aaaaaaucuguuuaaucugacauuacucaaauauacuugaucacaaaacuuuuucuaaaaggac

SEQ ID NO: 33464 - RNA, 81 nt, Mus musculus
uagccagaacugaagcacgugucagcuuuuuuauuuagggcaagaggugcagaaugaaccaggccagugcaggcaggguuu

SEQ ID NO: 33465 - RNA, 46 nt, Mus musculus
cuucagcaacuguggaauguuuaaaguagaaacacguaaccaaggu

SEQ ID NO: 33466 - RNA, 45 nt, Mus musculus
auaaacucuguuuguuuacaaauuauguaagagaagggcccgcca

SEQ ID NO: 33467 - RNA, 49 nt, Mus musculus
ggauuuuuuuuuucuuuuuucuuuuuuucuuuuaauacagcuagugagc

SEQ ID NO: 33468 - RNA, 46 nt, Mus musculus
gcaugucccaccccuagccuuaguauuaggcaauagagugauaggu

SEQ ID NO: 33469 - RNA, 46 nt, Mus musculus
agagugucuagaaaccagaggaugguccugggcuaugccccauuua

SEQ ID NO: 33470 - RNA, 46 nt, Mus musculus
ugugaaaauccucaaaccaaaccaaaacucacccuagcagguauag

SEQ ID NO: 33471 - RNA, 46 nt, Mus musculus
gcucuacuaaaggcuuuugugcucuuaacucuuugucguuugggga

SEQ ID NO: 33472 - RNA, 46 nt, Mus musculus
auaauauggcuaucacuaacuaguaacauuugaguaaaaaauagau

SEQ ID NO: 33473 - RNA, 46 nt, Mus musculus
cugcucuaaaggaaagcagagugguugauuuuacccuuuagagcac

SEQ ID NO: 33474 - RNA, 45 nt, Mus musculus
ccuggugaaccaaugaguuuaauugaacacuuauagagcaugaga

SEQ ID NO: 33475 - RNA, 46 nt, Mus musculus
caccacgccuggugaaaauacuuauucuuaaucauuacuugcaaau

SEQ ID NO: 33476 - RNA, 44 nt, Mus musculus
uucaugucagagagagauugaucaggccuaggaagccagauaga

SEQ ID NO: 33477 - RNA, 46 nt, Mus musculus
agucuuauauuucauuuugauuguuuuuacucuauggggccucuau

SEQ ID NO: 33478 - RNA, 46 nt, Mus musculus
agauaauuacugaacuaaaauaugucuagauauaguacuuuggaaa

SEQ ID NO: 33479 - RNA, 46 nt, Mus musculus
uuacccucucccaacucauaugaaaccaaaacuuccgguccauccc

SEQ ID NO: 33480 - RNA, 42 nt, Mus musculus
ucagcuuuauggaugccccccacuaucaauggguacccagaa

SEQ ID NO: 33481 - RNA, 46 nt, Mus musculus
cccaugaacugauugagauuuuaaagaaaauuggaaagacguagug

SEQ ID NO: 33482 - RNA, 46 nt, Mus musculus
uauaacauguacauacacaaagaaguagcuaagaaugaagccagac

SEQ ID NO: 33483 - RNA, 46 nt, Mus musculus
ggaagguagaggcaagccaggcuaacugaaucaacaaacucuaggu

SEQ ID NO: 33484 - RNA, 46 nt, Mus musculus
gcaagaguagccccugccuucuggugaacccaaauuucagggagac

SEQ ID NO: 33485 - RNA, 46 nt, Mus musculus
ucuacauuuaguaguggaggaaguggaaguacaaugacuuggagga

SEQ ID NO: 33486 - RNA, 45 nt, Mus musculus
gcugugaacaugaacuaaggaaguucuuuuagcuguuaaagagug

SEQ ID NO: 33487 - RNA, 45 nt, Mus musculus
gccuggcugugugugcuuguugaggagugggauuaguaguucaga

SEQ ID NO: 33488 - RNA, 42 nt, Mus musculus
ccuauaguuuggaucuccggugcuuugcucuugggugaauua

SEQ ID NO: 33489 - RNA, 42 nt, Mus musculus
aagguagauggccacauccgggaagcgcaccaccgagggcgg

SEQ ID NO: 33490 - RNA, 46 nt, Mus musculus
agcacaggaagccgcagaacgaaggaaggcagggucaugaaagaag

SEQ ID NO: 33491 - RNA, 45 nt, Mus musculus
cgcgaggaacgugggcgucaaggguauccagaaagcggugggaaa

SEQ ID NO: 33492 - RNA, 46 nt, Mus musculus
ccaccgcuuucuggauacccuugacgcccacguuccucgcgcccuu

SEQ ID NO: 33493 - RNA, 46 nt, Mus musculus
cagaugccuaggcuugaagcuugccacuaagagacuagggccaguu

SEQ ID NO: 33494 - RNA, 41 nt, Mus musculus
ccuuucuucucuuugucuuuguuuuuuucuggagggacugu

SEQ ID NO: 33495 - RNA, 98 nt, Mus musculus
gacaaagagaagaaaggaaagaaggacaaaggccccaaagccacaaaaccccuggagggcucuaccaggcccaccaagaaaccaaaggagaagccacc

SEQ ID NO: 33496 - RNA, 59 nt, Mus musculus
caaggccaccaagaagcccaaggagaaaccacccaaggccaccaagaagcccaaggaga

SEQ ID NO: 33497 - RNA, 25 nt, Mus musculus
gcgguagcuccugggcgcugggguu

SEQ ID NO: 33498 - RNA, 23 nt, Mus musculus
guagcaggaucccuggggcucug

SEQ ID NO: 33499 - RNA, 46 nt, Mus musculus
uaguuggggaucaaauagcuagcaacaggggcuucagagguggauc

SEQ ID NO: 33500 - RNA, 42 nt, Mus musculus
uuguagacacacccuucccaaaugccuggcaaggucaaggag

SEQ ID NO: 33501 - RNA, 48 nt, Mus musculus
agaggaggagacugagaugcccacacuggacuacaaugaccagauaga

SEQ ID NO: 33502 - RNA, 72 nt, Mus musculus
ucuucagucuucuccucagggcgcucuggccagagccuccuccugcuggguguuggccugggcugcuucugg

SEQ ID NO: 33503 - RNA, 46 nt, Mus musculus
aacacccagcaggaggaggcucuggccagagcgcccugaggagaag

SEQ ID NO: 33504 - RNA, 45 nt, Mus musculus
ccaggguauggagagcagggcccacauaggguaacagggccaaga

SEQ ID NO: 33505 - RNA, 30 nt, Mus musculus
gcgguggagggugggggaaauaauagucca

SEQ ID NO: 33506 - RNA, 45 nt, Mus musculus
ccgcagaagccugauguuggacaagagguggaugaggaaaaggaa

SEQ ID NO: 33507 - RNA, 47 nt, Mus musculus
aagcccaaaaaggaggguaguagccccaaggaggacacagaggacaa

SEQ ID NO: 33508 - RNA, 46 nt, Mus musculus
gccccggaagggugaggagcuggaggaggagugggcgccaguggag

SEQ ID NO: 33509 - RNA, 46 nt, Mus musculus
gugcccaccuauugggauggagucacaccgcauugaggacaaccag

SEQ ID NO: 33510 - RNA, 68 nt, Mus musculus
uucgugacuaccuucuuugugggcuucagcaaugacagccagaccugggugauguacaccaauggcua

SEQ ID NO: 33511 - RNA, 52 nt, Mus musculus
cccugagccaguuguggcccguuucauccgcaucuauccacucaccuggaac

SEQ ID NO: 33512 - RNA, 41 nt, Mus musculus
gcaccuccaggcgcaugcacaggcuaccguuccaggugagu

SEQ ID NO: 33513 - RNA, 57 nt, Mus musculus
ugaggugguaacuacugacagccuggacuuccggcaccacagcuacaaggacaugcg

SEQ ID NO: 33514 - RNA, 47 nt, Mus musculus
ccacaaucacucgcacauacagccugggcaagaguucacgagggcuc

SEQ ID NO: 33515 - RNA, 63 nt, Mus musculus
ucaugauccccaggguugucugagauuuccauugcguagaucuugagcccucgugaacucuug

SEQ ID NO: 33516 - RNA, 42 nt, Mus musculus
gguacuccuggcauagguauugcaugagcaggagcaggagcu

SEQ ID NO: 33517 - RNA, 44 nt, Mus musculus
caauaccuaugccaggaguaccgcgaugggaacccgagagugcg

SEQ ID NO: 33518 - RNA, 45 nt, Mus musculus
ccaccuggugcccucgcugaacccugauggcuaugagguggcagc

SEQ ID NO: 33519 - RNA, 46 nt, Mus musculus
gggacccauuucuucuccucagcugcccagagcacagaguugagau

SEQ ID NO: 33520 - RNA, 46 nt, Mus musculus
gucccaaacaauaacuugccaaucccugaacguuaccuguccccag

SEQ ID NO: 33521 - RNA, 46 nt, Mus musculus
gguucuucuccauccaggaaauaauggcccggacuucuguggagac

SEQ ID NO: 33522 - RNA, 46 nt, Mus musculus
ccauuauuuccuggauggagaagaaccccuuugugcugggugcaaa

SEQ ID NO: 33523 - RNA, 46 nt, Mus musculus
gccaugucauagggauaagacacaagccgcucaccaccguucagau

SEQ ID NO: 33524 - RNA, 59 nt, Mus musculus
ccgcggagaagaugaugacggggugucugaggcccaggagacuccagaucacgcuauuu

SEQ ID NO: 33525 - RNA, 42 nt, Mus musculus
uaccggggagggugccaggcccaggacuacaccagcggcaug

SEQ ID NO: 33526 - RNA, 46 nt, Mus musculus
uggaauccucgcucugggaguaagccugggaagaguuugggaaagg

SEQ ID NO: 33527 - RNA, 44 nt, Mus musculus
ucgggguagcucacucucgugggggaacuugucacagcccaggu

SEQ ID NO: 33528 - RNA, 47 nt, Mus musculus
ccugggcugugacaaguucccccacgagagugagcuaccccgagaau

SEQ ID NO: 33529 - RNA, 104 nt, Mus musculus
gaaggugcaccguggcauuaaggguguggugacagaugagcaaggcauccccauugccaaugccaccaucucugugaguggcaucaaccauggugugaagacag

SEQ ID NO: 33530 - RNA, 73 nt, Mus musculus
gcaaguggaggugacuacuggcgcauucugaacccgggugaguaccgugugacagcucacgcagagggcuaca

SEQ ID NO: 33531 - RNA, 62 nt, Mus musculus
ucucccgaaugcgcuuccaguuggaucgagccaggaugaaguugcacugaguggccccaaua

SEQ ID NO: 33532 - RNA, 91 nt, Mus musculus
ccucaagugccaagaucugcaauguggacuacgauauuggggccacucagugcaacuucauccuggcucgauccaacuggaagcgcauucg

SEQ ID NO: 33533 - RNA, 63 nt, Mus musculus
uggcuaugaacgggaaccgucccauucuccgaguugaccccucacgacccaugaccccccagc

SEQ ID NO: 33534 - RNA, 31 nt, Mus musculus
gcgcugcugcaugcgccgcugcugggggguc

SEQ ID NO: 33535 - RNA, 44 nt, Mus musculus
ucagucucugacuccucccagccugcagugguaguggguagaac

SEQ ID NO: 33536 - RNA, 106 nt, Mus musculus
uacccacuaccacugcaggcugggaggagucagagacugagaccuauacagaaguagugacagaguuugagacagaguaugggacugaccuagagguggaagagau

SEQ ID NO: 33537 - RNA, 62 nt, Mus musculus
acugggaucucaaagcccugcccaauucaaacuaaggcagcaccucccaagccugugccagc

SEQ ID NO: 33538 - RNA, 52 nt, Mus musculus
uuuggggaggggcaggcaaggaagccaacgucacaucaauaaaacaagcuca

SEQ ID NO: 33539 - RNA, 45 nt, Mus musculus
uaaguugccacagguacccgggcaaagguggcauugcuggcagag

SEQ ID NO: 33540 - RNA, 44 nt, Mus musculus
cacuccaacagguuccaaggauuuuuggagucugcaugccuaga

SEQ ID NO: 33541 - RNA, 47 nt, Mus musculus
ggcucaugaagcagcacagggguggacacugaagccccaaacuaccc

SEQ ID NO: 33542 - RNA, 45 nt, Mus musculus
gcauaucagauacuuacauuucaguucacaaccacagcaagauua

SEQ ID NO: 33543 - RNA, 46 nt, Mus musculus
gucaucagaaaggaaggugaaaaaaagaggacgacaccugcuaacu

SEQ ID NO: 33544 - RNA, 46 nt, Mus musculus
acauacuugaacccucaguguugguucuucuuucuauccuccaguc

SEQ ID NO: 33545 - RNA, 45 nt, Mus musculus
gaggucugaggaaagcagggugacucuguccccuuugcccagaga

SEQ ID NO: 33546 - RNA, 45 nt, Mus musculus
agucuucucccucucggcccucauccuguggguagucuugcagaa

SEQ ID NO: 33547 - RNA, 45 nt, Mus musculus
caagaggucaccguccaggagcagaaucugucguagucacaagau

SEQ ID NO: 33548 - RNA, 45 nt, Mus musculus
cuuacacaauuguguagaaaggagcugguucauuguaggcauuua

SEQ ID NO: 33549 - RNA, 45 nt, Mus musculus
accuccaagaagagaucacagccuguugguaguucauuggcagau

SEQ ID NO: 33550 - RNA, 46 nt, Mus musculus
ccucaguuuuaugggcagagcagcaggaacugggucuguuugagau

SEQ ID NO: 33551 - RNA, 46 nt, Mus musculus
ccugaucaguccuagccauuuuuuucuuucaugaugaaccaggccu

SEQ ID NO: 33552 - RNA, 46 nt, Mus musculus
uccucuggccagucggccuaacaggcaaguccacaagccccgagga

SEQ ID NO: 33553 - RNA, 46 nt, Mus musculus
aacuuggacagaccuauugggaaaggaaccgaagaugaacuaagau

SEQ ID NO: 33554 - RNA, 52 nt, Mus musculus
uuagcaggugacugccagggaaagagccugccuugaccagagaagugaacgc

SEQ ID NO: 33555 - RNA, 54 nt, Mus musculus
agaucaacaaggagcgcuccauggcuacuguggaugaggaggagcaggcagucc

SEQ ID NO: 33556 - RNA, 66 nt, Mus musculus
ugagcaagguuggcgaguacugguggagugccauccuggagggggaagagcccaucgacaucgaca

SEQ ID NO: 33557 - RNA, 46 nt, Mus musculus
uccauuucuggaagccuccacuguguguucuuuaccaccagcuuaa

SEQ ID NO: 33558 - RNA, 46 nt, Mus musculus
ugggaucugaugcccucuucugguaugucugaaggcagcuacagua

SEQ ID NO: 33559 - RNA, 46 nt, Mus musculus
guaagguuucacuugugugaaauccaaugagacaaaagcaucagua

SEQ ID NO: 33560 - RNA, 42 nt, Mus musculus
uuggaaaugacagaaccuuugguauggucuccugccccagau

SEQ ID NO: 33561 - RNA, 46 nt, Mus musculus
guucaggggaagacauccuggaccuggacaagcuggauggcaagau

SEQ ID NO: 33562 - RNA, 46 nt, Mus musculus
aucaugggauagucuugccaagcaucauagcccacaggauccagaa

SEQ ID NO: 33563 - RNA, 46 nt, Mus musculus
gcaauguguaaauuugaaguuuuuugcaaauaagaaaugaguagug

SEQ ID NO: 33564 - RNA, 59 nt, Mus musculus
uccucaggagacacuagacaggguccuuagcgaaguagagaggaccagggaagcaggcc

SEQ ID NO: 33565 - RNA, 54 nt, Mus musculus
cagaaggugcugucuuuagcagugcccaugcccugucaguaaggagaggucagu

SEQ ID NO: 33566 - RNA, 65 nt, Mus musculus
ggaaauuauuguguucugggaccaggcagguaaaggaggaccuggaaaaugagagugcauccagg

SEQ ID NO: 33567 - RNA, 50 nt, Mus musculus
uuacuaaggaaggaaagggauagaaaugcuggugagucaucggcacagau

SEQ ID NO: 33568 - RNA, 46 nt, Mus musculus
gaacgucccacaacauucccguuggcccaaacucaaucccacgggc

SEQ ID NO: 33569 - RNA, 42 nt, Mus musculus
acaaauuaaauuauuuuagcauuuuggcaagcgccccaaacc

SEQ ID NO: 33570 - RNA, 45 nt, Mus musculus
guggcccuuagcaguggcaccauccgaguggccaugguggaagag

SEQ ID NO: 33571 - RNA, 45 nt, Mus musculus
ggccagagagagggcucuugucacugguugucugugugcccauug

SEQ ID NO: 33572 - RNA, 42 nt, Mus musculus
gcacuucccaguccauuguggagacauacauucagggcagga

SEQ ID NO: 33573 - RNA, 46 nt, Mus musculus
uaacuucauacaccuauuagaaaaagaauuugaauuguccccaaag

SEQ ID NO: 33574 - RNA, 45 nt, Mus musculus
ggagcaauguugugugguguguguggggugguggugguggugaug

SEQ ID NO: 33575 - RNA, 46 nt, Mus musculus
uauugaggcaugauggcucccagcacuagacgggcagaggcagguu

SEQ ID NO: 33576 - RNA, 51 nt, Mus musculus
auacauaaaaucauacacaugcacaugugacaugaaagugacuaauggagg

SEQ ID NO: 33577 - RNA, 43 nt, Mus musculus
caguggcuaacacguggaccuaagcaaggaguugcaaaagcag

SEQ ID NO: 33578 - RNA, 34 nt, Mus musculus
aacccauugagguucucuuuccuugcagccagaa

SEQ ID NO: 33579 - RNA, 42 nt, Mus musculus
ugcccaucucagugacucaauccuuuagcccaccacacagaa

SEQ ID NO: 33580 - RNA, 42 nt, Mus musculus
aauaaaaggauacugaggauuuaccaguuagccagcguagcu

SEQ ID NO: 33581 - RNA, 46 nt, Mus musculus
caagagccaugucagguauguauagcugugacauuaccaacuuaag

SEQ ID NO: 33582 - RNA, 46 nt, Mus musculus
uacuugagguaccuaccucgucagugcucaggcucaucggccaggc

SEQ ID NO: 33583 - RNA, 24 nt, Mus musculus
ucuguggagagugcgugugucuag

SEQ ID NO: 33584 - RNA, 46 nt, Mus musculus
uugauggacuggcaaugugagcagucugugguagguggugggacug

SEQ ID NO: 33585 - RNA, 46 nt, Mus musculus
cugucugauuuucaggcucuuggacacgcaggcaucgcuggaagca

SEQ ID NO: 33586 - RNA, 46 nt, Mus musculus
agauucgucuagauaauagaauuuucuuuacuuuuaaugccaaauc

SEQ ID NO: 33587 - RNA, 46 nt, Mus musculus
auucuuuuuuuaaauguaaagcauaaauaaaaagccuuuguggacu

SEQ ID NO: 33588 - RNA, 46 nt, Mus musculus
aagaccuagagaaauggcagaacaaccugcucccuucacgucaguu

SEQ ID NO: 33589 - RNA, 71 nt, Mus musculus
augaugaagcacggauacauuggugaauucgagaucauugauggucacagagcugggaagauuguugugaa

SEQ ID NO: 33590 - RNA, 46 nt, Mus musculus
uucccagcacauacauggcugcucacaccugucuguuccaggagau

SEQ ID NO: 33591 - RNA, 90 nt, Mus musculus
gaggccuaugcguccuugcuuccggagugccugagugacgggcgugaagccggacagagccgggcuggcggagggcggcgauggugggcg

SEQ ID NO: 33592 - RNA, 45 nt, Mus musculus
uggcguggcaggguccuccaggcgggcggagauuggcggacgcgg

SEQ ID NO: 33593 - RNA, 46 nt, Mus musculus
agccgcgaagguggcgggcuagggaguagguggccuggcggcccgg

SEQ ID NO: 33594 - RNA, 45 nt, Mus musculus
gugacagguucggcaagaauccucacguggauaccauguaaagac

SEQ ID NO: 33595 - RNA, 82 nt, Mus musculus
uagguguugugcgcaugcguaacucaacuuccugacuguaagaucagaaaauggcggcguuaagcaucauuggaggguggag

SEQ ID NO: 33596 - RNA, 46 nt, Mus musculus
caccguuggaguuccucuguuugucugauccucuagccuugcccuu

SEQ ID NO: 33597 - RNA, 42 nt, Mus musculus
uuuucacaaaacaaaccagcagcaauuaggacguuucaacag

SEQ ID NO: 33598 - RNA, 41 nt, Mus musculus
gcuuuaggaugaagcucucugaagaaagaaaaucuguggga

SEQ ID NO: 33599 - RNA, 30 nt, Mus musculus
aguacugaagaaagucugucauaacacuaa

SEQ ID NO: 33600 - RNA, 46 nt, Mus musculus
cuuagugccccagcgcuugucuugaagaugcuagugacugguccug

SEQ ID NO: 33601 - RNA, 45 nt, Mus musculus
gugagaacuauguuaacuagccgugcaugugaguuggcucagcag

SEQ ID NO: 33602 - RNA, 42 nt, Mus musculus
gggacuuagcaagggcuuagaaccucagcaaguggcagguug

SEQ ID NO: 33603 - RNA, 31 nt, Mus musculus
gagaggcagggaauguguauggauggaagau

SEQ ID NO: 33604 - RNA, 45 nt, Mus musculus
cucugguuuucacuggcuuauugcaguggguaccaguaugcaugg

SEQ ID NO: 33605 - RNA, 46 nt, Mus musculus
ccucucugggggugcguuguuuuacuucucuuucaaaugccagcag

SEQ ID NO: 33606 - RNA, 47 nt, Mus musculus
ugagcaaauaaaucucucacuuuaauguucugucucagaauagcuca

SEQ ID NO: 33607 - RNA, 49 nt, Mus musculus
augugggugaaauaagggggccauaccuaaauucugccaguaagcagcc

SEQ ID NO: 33608 - RNA, 46 nt, Mus musculus
gcugaucuggacuccuccgugcccgcugacauuaucucauccacag

SEQ ID NO: 33609 - RNA, 44 nt, Mus musculus
ugcaaggccacaugaacaugugaugccagcauuguagacagugg

SEQ ID NO: 33610 - RNA, 44 nt, Mus musculus
aguucaaaucccagcaaccacaugguggcucacaaccguaauga

SEQ ID NO: 33611 - RNA, 46 nt, Mus musculus
aacucaguguaaacccuguuugucuagcauuuuuuuugagcugcag

SEQ ID NO: 33612 - RNA, 46 nt, Mus musculus
uuggucucaaaaccaugugcucaaacgacccuccuccuucagccuu

SEQ ID NO: 33613 - RNA, 45 nt, Mus musculus
uaugcugggagagagacaguugugcuuucuauaaugacaacacag

SEQ ID NO: 33614 - RNA, 46 nt, Mus musculus
agcucuucuaugaacaaguccuacauuuaccaaaaccggucacagc

SEQ ID NO: 33615 - RNA, 46 nt, Mus musculus
cuguggaguguuuguuuuguuaguucuuaaaaaucuauucuaccaa

SEQ ID NO: 33616 - RNA, 42 nt, Mus musculus
cauaacaagcuagguucagcuacucauccuuaaaaaggccaa

SEQ ID NO: 33617 - RNA, 45 nt, Mus musculus
aagaucugaggacaacuuauggacugcguucuccccuuccaccuu

SEQ ID NO: 33618 - RNA, 45 nt, Mus musculus
uccuccuauuugccuccaaauguagaauuaaaagcaugcaccacc

SEQ ID NO: 33619 - RNA, 46 nt, Mus musculus
auuaccuuuuuuauuuauuuuuuuaagcaaagucuaaaguuuguag

SEQ ID NO: 33620 - RNA, 42 nt, Mus musculus
gcauggugguguaugucuuuaaucccagcacucaggaggcag

SEQ ID NO: 33621 - RNA, 47 nt, Mus musculus
agagagagagaggagagagagaauaagaauguaauuucccaaccuag

SEQ ID NO: 33622 - RNA, 45 nt, Mus musculus
agaacagagccuccuacuguccuuuccaguuugaaacagcuuuca

SEQ ID NO: 33623 - RNA, 42 nt, Mus musculus
acuuucaucgggggacaggagccagcacuuccucuucgggag

SEQ ID NO: 33624 - RNA, 45 nt, Mus musculus
uuuauuauauguuaaguacacuuuagcugucuucagacacaccag

SEQ ID NO: 33625 - RNA, 45 nt, Mus musculus
acugaaccaaggaucaaggggacaaaaacacuaucuacuguccag

SEQ ID NO: 33626 - RNA, 42 nt, Mus musculus
cugcuccuggcuugcuuucacaccuauggucugggccuccaa

SEQ ID NO: 33627 - RNA, 48 nt, Mus musculus
uuugagaccccuggaaucaugcaguucaccaaugaggagaagcggacc

SEQ ID NO: 33628 - RNA, 46 nt, Mus musculus
aggacggcugaacgugcuugcaaaugucaucaggaaggagcuggag

SEQ ID NO: 33629 - RNA, 45 nt, Mus musculus
cuaaaguggguaggugugccaacaccuuuucuuacuggggaucag

SEQ ID NO: 33630 - RNA, 25 nt, Mus musculus
acauacaugaaucuuguuaucaagu

SEQ ID NO: 33631 - RNA, 47 nt, Mus musculus
uggcuucaccacagacccucggauggcccgcuccucucccuacccca

SEQ ID NO: 33632 - RNA, 45 nt, Mus musculus
agauggacgaaccuauguuuacacagccacucauguacaagcaga

SEQ ID NO: 33633 - RNA, 45 nt, Mus musculus
agagacauccugagaccucucugccucguguugccuccuguccca

SEQ ID NO: 33634 - RNA, 46 nt, Mus musculus
cuguguuaacacacaggaaggccugcccugcugucuuuugcuuuag

SEQ ID NO: 33635 - RNA, 42 nt, Mus musculus
agcccucagcucacucguaacagcugugggauaggccuggag

SEQ ID NO: 33636 - RNA, 61 nt, Mus musculus
uacuaugaccucacccgagagcgcaaagccaggaacauggaggaggagguggcuauuacaa

SEQ ID NO: 33637 - RNA, 51 nt, Mus musculus
uugaccuccugcugaaagaggcacagaaguaucccaaugcugagcuggccu

SEQ ID NO: 33638 - RNA, 45 nt, Mus musculus
gugcuaagccugucugguaagacccaaguccuugauggccuggaa

SEQ ID NO: 33639 - RNA, 42 nt, Mus musculus
aaagggccccucucaggacauccuagagaaggaaggcagcuc

SEQ ID NO: 33640 - RNA, 42 nt, Mus musculus
cccucgucacccaucaagucgcagauucaaggccaggaguag

SEQ ID NO: 33641 - RNA, 45 nt, Mus musculus
ggauuugggagucaucaggauguugugugaauagagauugucaug

SEQ ID NO: 33642 - RNA, 46 nt, Mus musculus
ugcuacccuucuuggguuugggcuguaugugggaaacuuaccccag

SEQ ID NO: 33643 - RNA, 45 nt, Mus musculus
ugcauugcaucggcuugacccauaaacuaaguuaucauggccagc

SEQ ID NO: 33644 - RNA, 42 nt, Mus musculus
uauaauaauaaauaaaucuuugggccggagcaaguggggcug

SEQ ID NO: 33645 - RNA, 46 nt, Mus musculus
gcaggucuuaggcacguucaccauguucgcaggagagcuagcagcu

SEQ ID NO: 33646 - RNA, 44 nt, Mus musculus
cacuguucaaaaaggaaugccccauaagugcuaccggcaaaacc

SEQ ID NO: 33647 - RNA, 45 nt, Mus musculus
cgccccucccccagacgcgcagaggaccccaggcuccggccagcg

SEQ ID NO: 33648 - RNA, 45 nt, Mus musculus
cgccccucccccagacgcgcagagggccccaggcuccggccagcg

SEQ ID NO: 33649 - RNA, 46 nt, Mus musculus
ccccccuccccagaaagccucugaggaagaagagaagcccccagcc

SEQ ID NO: 33650 - RNA, 44 nt, Mus musculus
aucuuccagguggaggcuguggaggugacaccauugccccaaga

SEQ ID NO: 33651 - RNA, 42 nt, Mus musculus
gaccgggagggugggcacccugcccugcacccaccuccagag

SEQ ID NO: 33652 - RNA, 45 nt, Mus musculus
uaaguggauacuucagagagauguguuuuuggccuugguccaggu

SEQ ID NO: 33653 - RNA, 31 nt, Mus musculus
ucuacguuucccacgaccaggaucucacuac

SEQ ID NO: 33654 - RNA, 48 nt, Mus musculus
aaguguagugagauccuggucgugggaaacguagacgggaaggagagg

SEQ ID NO: 33655 - RNA, 54 nt, Mus musculus
guugacuuugggguucggggcgggaaggcauugccaggugucggguaauuacag

SEQ ID NO: 33656 - RNA, 41 nt, Mus musculus
cuggagaaggcccugccuuagcgcacggcaggacugaggag

SEQ ID NO: 33657 - RNA, 46 nt, Mus musculus
gaucacaggaaaacuuggggaaauuuguuucuuccaaucauguggg

SEQ ID NO: 33658 - RNA, 44 nt, Mus musculus
uaggggccacuugacugugaguucaauucccagaucccacauga

SEQ ID NO: 33659 - RNA, 46 nt, Mus musculus
uuuuggaacucgcuguguagaccaggcuggucuugaacucacagag

SEQ ID NO: 33660 - RNA, 46 nt, Mus musculus
uaagagucucaugcugaauucaaaauuuagcucaaaaaggucagag

SEQ ID NO: 33661 - RNA, 46 nt, Mus musculus
ucugagccagucguuuuaacagaaagaaaauaaaucuaaccugcag

SEQ ID NO: 33662 - RNA, 89 nt, Mus musculus
uuuccuugagagcacaaaggaaucucaagacauucugccugccuaucagcuuuucuuuauuuuuuuaauuaaguuuuuuggggaaaaau

SEQ ID NO: 33663 - RNA, 46 nt, Mus musculus
gugucuggaggcugggcugcucucccccaggccgaggcggaggagg

SEQ ID NO: 33664 - RNA, 89 nt, Mus musculus
aguacguucuuaauuguuaacauuguauacaacguagcccagauauaauagaaucuguacuagauaauccuagaugaaguguuagagau

SEQ ID NO: 33665 - RNA, 48 nt, Mus musculus
gggguccuucucaaacucucuuuauaauucacgcauauaugcagacaa

SEQ ID NO: 33666 - RNA, 46 nt, Mus musculus
cccagcagaaagccccaagugggaggagcagcaucggacuccacgu

SEQ ID NO: 33667 - RNA, 45 nt, Mus musculus
ggaugcugcacugugugcucggccacacaagguugaugggcgugu

SEQ ID NO: 33668 - RNA, 45 nt, Mus musculus
uacuuugaaaaguauggcaagauugaaaccauagagguuauagaa

SEQ ID NO: 33669 - RNA, 43 nt, Mus musculus
ugguggcaacuaugguggugguccugguuacagcaguagagga

SEQ ID NO: 33670 - RNA, 44 nt, Mus musculus
cagaagguuuuaaaauaaaacagaaacgguuacaguucuuagca

SEQ ID NO: 33671 - RNA, 46 nt, Mus musculus
gugcugcuaauaugguaacaaaccagugggauguugguguccaugg

SEQ ID NO: 33672 - RNA, 45 nt, Mus musculus
uggaauuauguggugacacacuccaguucugugcuuuugugugga

SEQ ID NO: 33673 - RNA, 41 nt, Mus musculus
auagaguuuuuguuguuuuguuuucuucuggugccggagau

SEQ ID NO: 33674 - RNA, 46 nt, Mus musculus
ugcacauugacauaaagaaacuccuccaguuucuugccggacagca

SEQ ID NO: 33675 - RNA, 44 nt, Mus musculus
uacagauauacuuggugacacuuuucaucucauaaaggccagaa

SEQ ID NO: 33676 - RNA, 45 nt, Mus musculus
caguuagcacccggcaaggggccagguugccagacagaaggugca

SEQ ID NO: 33677 - RNA, 42 nt, Mus musculus
uguccuucucccuccacuucaccuucugauguggcugcauaa

SEQ ID NO: 33678 - RNA, 46 nt, Mus musculus
gcucacaggagucuccuuucuucuuaaguuccaaccaugcccauuc

SEQ ID NO: 33679 - RNA, 49 nt, Mus musculus
augccucugggagaggcggcaugucuuaauaguuaguagaauaguuugc

SEQ ID NO: 33680 - RNA, 46 nt, Mus musculus
auccuugacccaucuggcuccuucaaugauuucuaacgguugugau

SEQ ID NO: 33681 - RNA, 40 nt, Mus musculus
guuagaggaaagagauugauccacaggcaggcagcagcgu

SEQ ID NO: 33682 - RNA, 59 nt, Mus musculus
auuacauuacagcuucaccucccucuucuccugccagucccucccuguuaccucccguc

SEQ ID NO: 33683 - RNA, 48 nt, Mus musculus
gaaagcuuucaaacuugccuuuaaucccucauguuuauaguauaucag

SEQ ID NO: 33684 - RNA, 45 nt, Mus musculus
auggugacagaaaguggaucucuugaaugacagacagcuuguuac

SEQ ID NO: 33685 - RNA, 46 nt, Mus musculus
ucucugaagaaaacaacgagauuuauuuagaauuaacgucggaaaa

SEQ ID NO: 33686 - RNA, 45 nt, Mus musculus
gacagggcugagaggacaaugguuucagggcgcagugagccacac

SEQ ID NO: 33687 - RNA, 46 nt, Mus musculus
gcuugccguuggggucauagggagccugcgacucauccucauccag

SEQ ID NO: 33688 - RNA, 25 nt, Mus musculus
uccacagaacacucagggcagaacu

SEQ ID NO: 33689 - RNA, 42 nt, Mus musculus
guagucgauggcuauuaugggcaccucugcgaugaagacccu

SEQ ID NO: 33690 - RNA, 46 nt, Mus musculus
guggaauuuucagcuccaucaucaaaaugaggagggcauuugccca

SEQ ID NO: 33691 - RNA, 45 nt, Mus musculus
gacccgucaucuaaagugucuaccuccuaauaccaccaccaagac

SEQ ID NO: 33692 - RNA, 46 nt, Mus musculus
acuuuuuagaggaagauuuagagggacauaguugacaaagugagau

SEQ ID NO: 33693 - RNA, 42 nt, Mus musculus
accuccucaacaucuuuaggugagucagccacugcagcauuu

SEQ ID NO: 33694 - RNA, 41 nt, Mus musculus
guggagacgacuaggucugugcagguggacgaauggcagaa

SEQ ID NO: 33695 - RNA, 46 nt, Mus musculus
cauauuauuuuuuuuaaaaaagauuuauuuauuauuauacauaaac

SEQ ID NO: 33696 - RNA, 46 nt, Mus musculus
gucuuagugaagugcuugcuguacaagcauaaaaaugaaaguuuga

SEQ ID NO: 33697 - RNA, 45 nt, Mus musculus
ugugcuaaugaguguguacauuguggccaaaagaaggugucagau

SEQ ID NO: 33698 - RNA, 63 nt, Mus musculus
gcaaguauuuauuagcuguauuucuuuugagaacugguuaguucauuagcacaguuuuugauu

SEQ ID NO: 33699 - RNA, 57 nt, Mus musculus
aaucucaaggcaguuuuaauuugcauuuccccaugacuaagaauguugaacacuugu

SEQ ID NO: 33700 - RNA, 63 nt, Mus musculus
uacccaagaguacaauauucaguuuuuuuugagcagcauuuacauugauuuuucuaguggcca

SEQ ID NO: 33701 - RNA, 43 nt, Mus musculus
cauugauguacauugaaguuguuuuguuuuauggcugcuguaa

SEQ ID NO: 33702 - RNA, 46 nt, Mus musculus
uccuacccaccuacccuuucccuuguuccuucccucacuagccccu

SEQ ID NO: 33703 - RNA, 23 nt, Mus musculus
ccaucuuucuguuccaugcagcu

SEQ ID NO: 33704 - RNA, 42 nt, Mus musculus
uuccuucagguucuuauuucugguguuguauaauggagagua

SEQ ID NO: 33705 - RNA, 45 nt, Mus musculus
aggaaggaaaacuuggucgauaacuucuaaauacaaagauggugg

SEQ ID NO: 33706 - RNA, 46 nt, Mus musculus
uaagaagcaccauggaggaaggcugcugagaugacuuuugcaggau

SEQ ID NO: 33707 - RNA, 46 nt, Mus musculus
uuuguuuuguuuuguuuuguuucguuuuguuuuguuuuguauuguu

SEQ ID NO: 33708 - RNA, 45 nt, Mus musculus
cugguucugccuuggggcacaguuuguauaggcugauuguagagg

SEQ ID NO: 33709 - RNA, 46 nt, Mus musculus
acauccacacugaucucugcuguagggccugcuccuuugcccagac

SEQ ID NO: 33710 - RNA, 45 nt, Mus musculus
agcccugucaauagcuucugguacagagugggcacugggucgaga

SEQ ID NO: 33711 - RNA, 46 nt, Mus musculus
cacucuauggggacuucuuguugcauaaauuacaucaaugggagau

SEQ ID NO: 33712 - RNA, 69 nt, Mus musculus
agcccccccacucuccaaaagaauccacccugacuagcuauauuaucuuacagacagaggaaaagccca

SEQ ID NO: 33713 - RNA, 53 nt, Mus musculus
ugacucugggaggauacugaugaauggcucugcacgaaccccaggaaauugug

SEQ ID NO: 33714 - RNA, 45 nt, Mus musculus
auccugcugcuguccacagaaacuccuauuuccucccaggcagau

SEQ ID NO: 33715 - RNA, 46 nt, Mus musculus
ggccaggccuuagggggaagcuauggacucaaguauggccucacga

SEQ ID NO: 33716 - RNA, 45 nt, Mus musculus
ggcaaagugcaugguucuagucacagugagaagacacaggcaggu

SEQ ID NO: 33717 - RNA, 47 nt, Mus musculus
gacaaguagaaaagagccugaucccuccccuccuucccaagauaaca

SEQ ID NO: 33718 - RNA, 51 nt, Mus musculus
cacggggagcauugcuagccaaagaucucaucuguccccaucucagacuga

SEQ ID NO: 33719 - RNA, 69 nt, Mus musculus
aaaauuaugaaacagauacuagcucucuaaccaacucugucaaugguguauccaaccacagucugcaag

SEQ ID NO: 33720 - RNA, 50 nt, Mus musculus
ucacuggccacuuacaucagacccuggcagaacuugaugaagaccuggaa

SEQ ID NO: 33721 - RNA, 41 nt, Mus musculus
aguccauaugagauagugagaggaaacggacuggucaggaa

SEQ ID NO: 33722 - RNA, 23 nt, Mus musculus
auguugugucccucuucaucacc

SEQ ID NO: 33723 - RNA, 45 nt, Mus musculus
acagagagagggagggaaguagagggaaaagggggaagggagaga

SEQ ID NO: 33724 - RNA, 42 nt, Mus musculus
uuaugguucaaauaaaccauagaagguaacuucucagcagaa

SEQ ID NO: 33725 - RNA, 45 nt, Mus musculus
ugcaaacuuuauaugccucaguauaggggaacgccagagccaaga

SEQ ID NO: 33726 - RNA, 55 nt, Mus musculus
gggguugaaaccucauguccugugucuggcagggggugagacgaagggcaucagg

SEQ ID NO: 33727 - RNA, 46 nt, Mus musculus
agaaauaaaaaacuauagguuggagaagguuaaauauuuugcagaa

SEQ ID NO: 33728 - RNA, 55 nt, Mus musculus
caucucccuggacucacaacaagacagcaugagauccaaggacaaaugguccaca

SEQ ID NO: 33729 - RNA, 46 nt, Mus musculus
agcaauggacucacccagcaauugaaaaauaggcugcccgugagau

SEQ ID NO: 33730 - RNA, 45 nt, Mus musculus
uagauacauaaauauguagaugcauagauaugugauacauuagau

SEQ ID NO: 33731 - RNA, 65 nt, Mus musculus
ggaaauaaaaucuaccuuuuccuaacaugucuaucaauaagccaggagaacucaaaguauaugua

SEQ ID NO: 33732 - RNA, 46 nt, Mus musculus
uguaagagaguaguuugacuccuuuuucuuuuuauauuggaaagau

SEQ ID NO: 33733 - RNA, 46 nt, Mus musculus
uuaauuuacugacuguguagucuguugauuuuggauagggcuagaa

SEQ ID NO: 33734 - RNA, 46 nt, Mus musculus
cugcugcugcugaggugacuaguauguggucacauuaugacuguga

SEQ ID NO: 33735 - RNA, 45 nt, Mus musculus
uuucaggauuaugaacauuggauaguuguaaauugagugaaagga

SEQ ID NO: 33736 - RNA, 45 nt, Mus musculus
aauaaaggacuuuugucuggucaauagcagucauuuaaccucaga

SEQ ID NO: 33737 - RNA, 46 nt, Mus musculus
aacagagagccugaagcuugugagaugaggcagcauuuuggcagau

SEQ ID NO: 33738 - RNA, 45 nt, Mus musculus
auggucaaaacaucuugcagauucugcacaaaugaaugccauaga

SEQ ID NO: 33739 - RNA, 46 nt, Mus musculus
gagacuagagaaucuggcuucuagauaaucuugguaauaagaagau

SEQ ID NO: 33740 - RNA, 46 nt, Mus musculus
cugacaugagugacauuaccuuaagugaaccaggccuauccagaca

SEQ ID NO: 33741 - RNA, 66 nt, Mus musculus
uuugauguuguauacauaugcuuuguuguaggauuugguauuggauauggcugguuuggugcagag

SEQ ID NO: 33742 - RNA, 46 nt, Mus musculus
gacccauacucauguguguaaauacauauacacuaaauagccagac

SEQ ID NO: 33743 - RNA, 53 nt, Mus musculus
uagagucuuugacaccucuaagcaaggaguaaccuguaagaucauuauacccc

SEQ ID NO: 33744 - RNA, 57 nt, Mus musculus
acagcagccaccaccaaguccugugguccccaaccgcaaggaagauaaggaagagaa

SEQ ID NO: 33745 - RNA, 46 nt, Mus musculus
gaacuaacucccuaucuuuuggagcagcacgucagaacucacaaau

SEQ ID NO: 33746 - RNA, 46 nt, Mus musculus
aaccuguugaugagaaugcacuccugaggggacugauaguggauga

SEQ ID NO: 33747 - RNA, 45 nt, Mus musculus
cacagauauuuuaagacagguuaaaaucagauuaucagagauagg

SEQ ID NO: 33748 - RNA, 76 nt, Mus musculus
cuuuacucaagaaacuaaaauaaauggacuuaauaaauucugaagaggaaaggaaaagauaaauguuggggagaga

SEQ ID NO: 33749 - RNA, 46 nt, Mus musculus
uacauagugagauuuugauuguuauuucuccagauaagccacuauc

SEQ ID NO: 33750 - RNA, 41 nt, Mus musculus
aaguauucaguguauagcaaggugcaguuccugguuccaga

SEQ ID NO: 33751 - RNA, 42 nt, Mus musculus
cacaaugagauaaagaaacuaaguaaccaaauaggcccaagg

SEQ ID NO: 33752 - RNA, 41 nt, Mus musculus
caugcaugugugugugugugugugugugugugucugugucu

SEQ ID NO: 33753 - RNA, 45 nt, Mus musculus
uagcuguaguguagauguauccauuggggcuuauggacugggaaa

SEQ ID NO: 33754 - RNA, 46 nt, Mus musculus
cucccuagcagucauuaguugcuuguaguucuugccuagagaaccu

SEQ ID NO: 33755 - RNA, 46 nt, Mus musculus
ggggugagugcuaucaugaucccacuuaaaaugaggaaaccaagac

SEQ ID NO: 33756 - RNA, 46 nt, Mus musculus
auagauugcuuuuggcacauauguaguagaugugcagcuuggucuu

SEQ ID NO: 33757 - RNA, 46 nt, Mus musculus
aaaauucuaaauggacaaucuuaguguuagauuuuagguagcagag

SEQ ID NO: 33758 - RNA, 55 nt, Mus musculus
uuucaaauguuauccccuuucccgguuuccucacucccagaaauccccuauccca

SEQ ID NO: 33759 - RNA, 101 nt, Mus musculus
caguugcuuuugccagagcaauuaucauagcagcuggaaacuuagaaauuaauuugaaugauuguuucccucagcaucuaucuuucuuuuuaauuggacau

SEQ ID NO: 33760 - RNA, 127 nt, Mus musculus
guccugccuaacaucuggcucuuucaguguuuuccaccucuucugcucuugacuagauguauguaguuuguuccugcagauaccugccacuguggcuuccccgccaugauggacuguacccugguag

SEQ ID NO: 33761 - RNA, 46 nt, Mus musculus
guuaaauacaagagccacauuaaggcaaaugagggaggagcaagug

SEQ ID NO: 33762 - RNA, 45 nt, Mus musculus
agaagaugcccagaaaguaaguggugacuguuguauauugggaga

SEQ ID NO: 33763 - RNA, 46 nt, Mus musculus
cacuauacucacuguagacaacagauucagugacccauugguagau

SEQ ID NO: 33764 - RNA, 45 nt, Mus musculus
aaccuaauuuuauggcugaggucacauaacugaaagggcagcaga

SEQ ID NO: 33765 - RNA, 46 nt, Mus musculus
agguaucaugcauaucagauauuuacaauucaugacaguagcaaaa

SEQ ID NO: 33766 - RNA, 46 nt, Mus musculus
ugggaaaacaggccacagaggaaguuccuugguggaaacagcagag

SEQ ID NO: 33767 - RNA, 46 nt, Mus musculus
gcaggaauagaaacccugacuaagacaaucccucucugcuccugau

SEQ ID NO: 33768 - RNA, 46 nt, Mus musculus
aaauguuauugaaaguauagaugucuauggaaacacagaguaucgg

SEQ ID NO: 33769 - RNA, 65 nt, Mus musculus
gugugugugugugccugugcaugugugugugugugugugugccugugcaugugugugugugugug

SEQ ID NO: 33770 - RNA, 46 nt, Mus musculus
ugagcuauagauaaagaucaaugugagugaugguacagcuugaggc

SEQ ID NO: 33771 - RNA, 45 nt, Mus musculus
guucuugagguuuuccaaggacaagauggagacaacuuguagagg

SEQ ID NO: 33772 - RNA, 46 nt, Mus musculus
caaaacaccuuuaaaaagacccuccaaaaaauuacuacaugaggaa

SEQ ID NO: 33773 - RNA, 46 nt, Mus musculus
cuagcuagguuauuguccugugaaaacucuuaaaaaggcagacuag

SEQ ID NO: 33774 - RNA, 46 nt, Mus musculus
gugcugugcacagacguaauacaaugaguuauuucuuccugaagau

SEQ ID NO: 33775 - RNA, 45 nt, Mus musculus
uggugcuccugcaaacuuccggggcacauuugcuugcgccuugau

SEQ ID NO: 33776 - RNA, 41 nt, Mus musculus
ucauugucuaugcaaaugaauccagcuuuccagcuugaagu

SEQ ID NO: 33777 - RNA, 46 nt, Mus musculus
uuuauucaugucuagagucuagugauagugcaccuuacagauagau

SEQ ID NO: 33778 - RNA, 42 nt, Mus musculus
cgggugagcccugaggugccacuacagaauauucugccaguc

SEQ ID NO: 33779 - RNA, 46 nt, Mus musculus
auuucauagcuuuucgaauaaaugaccuaguaacauaguaagagau

SEQ ID NO: 33780 - RNA, 46 nt, Mus musculus
gcucuuuguucauaggcaacaaaaggcaaguugggaucugauagau

SEQ ID NO: 33781 - RNA, 46 nt, Mus musculus
ucuccagcaacccucugagcuggacccuagccuaaugccaccacag

SEQ ID NO: 33782 - RNA, 40 nt, Mus musculus
uucuguuaagcuugugaguuuacgguaauggugauuagau

SEQ ID NO: 33783 - RNA, 46 nt, Mus musculus
ugguauagacccuacauuuccuguugcucaguagcacuaugaagac

SEQ ID NO: 33784 - RNA, 41 nt, Mus musculus
aauuagucacauccacauugguucacacagcuacggcacau

SEQ ID NO: 33785 - RNA, 45 nt, Mus musculus
ucaauuauucagauaacauucucuuucuaagcaggaaagcuuaga

SEQ ID NO: 33786 - RNA, 46 nt, Mus musculus
agacucucuguagucuuuaugggaucuaagccuaucccgguagagu

SEQ ID NO: 33787 - RNA, 46 nt, Mus musculus
cuuauauugaauuugacccagauuagaaugcaugcuauagauuggu

SEQ ID NO: 33788 - RNA, 42 nt, Mus musculus
ugcugcccagaauguccacagcgaacagaaacugccccauga

SEQ ID NO: 33789 - RNA, 46 nt, Mus musculus
acccucaucuuaguguuucuguguuaucauuuuccagaaggaagau

SEQ ID NO: 33790 - RNA, 42 nt, Mus musculus
uucauacaugcuuacucuaggccuugcuuaucuggaucuuga

SEQ ID NO: 33791 - RNA, 46 nt, Mus musculus
gaugucguagacaacaccucuaaauagcuucuugcaggccauaguu

SEQ ID NO: 33792 - RNA, 42 nt, Mus musculus
cucacuucccaaauaacaccuucaagaagucuaagccaagau

SEQ ID NO: 33793 - RNA, 46 nt, Mus musculus
ucugugauauggggccaaucaaguagugcauagaaccugcccagau

SEQ ID NO: 33794 - RNA, 46 nt, Mus musculus
agcccuaaccaagucuguggcucaccuacuugauaacuggggagug

SEQ ID NO: 33795 - RNA, 46 nt, Mus musculus
cagcccacagaagugcucuaucagaagaguugagggaguagaagau

SEQ ID NO: 33796 - RNA, 53 nt, Mus musculus
uucaacauuauuaccaauuaccuuucaaauaaguucuaguaugucuugcugag

SEQ ID NO: 33797 - RNA, 45 nt, Mus musculus
guauacuguaucugucuucagacacuccagaagagggcaucagau

SEQ ID NO: 33798 - RNA, 46 nt, Mus musculus
cucacaugcuuguuuuguccuuuuaaauuuuuuaaugaauguagau

SEQ ID NO: 33799 - RNA, 45 nt, Mus musculus
acucacccaacuaacuguauucuuucucucuuucugcccgucuuu

SEQ ID NO: 33800 - RNA, 76 nt, Mus musculus
uuaaaaaaauaacaauuguuuuauuuauucccugauaaucucauauaguauauuuuaaucauaucuaccaccucca

SEQ ID NO: 33801 - RNA, 45 nt, Mus musculus
cacaucuaccuuagucaucccgaauagcuucuauaaaguucacaa

SEQ ID NO: 33802 - RNA, 42 nt, Mus musculus
caaggguaugugagguuugaaguaggccacacgggagcagaa

SEQ ID NO: 33803 - RNA, 47 nt, Mus musculus
ugaggagggcaugggguuagagcuuaggaaaggaucuuggcagaacu

SEQ ID NO: 33804 - RNA, 49 nt, Mus musculus
ugggagggaacaauguaugcaaccaugagaauuuucuauagauugguca

SEQ ID NO: 33805 - RNA, 45 nt, Mus musculus
gaaggauugcagaaauggcuucccauucucacaggucugggugga

SEQ ID NO: 33806 - RNA, 45 nt, Mus musculus
aauugagcuuucauuuguaaguucucuauagcuuuggccagaaaa

SEQ ID NO: 33807 - RNA, 45 nt, Mus musculus
ucauaaucaacccaguuuauuguagcguauauuagaaauaucaga

SEQ ID NO: 33808 - RNA, 42 nt, Mus musculus
aacuggauauguacagaggcagacuuagauaagcaggcagau

SEQ ID NO: 33809 - RNA, 46 nt, Mus musculus
uucuuuucucuagcaaagauuccauugcagguuacagggcccaugu

SEQ ID NO: 33810 - RNA, 46 nt, Mus musculus
agaaaauucaaauaucuguugugucuauugcauuuugugggaggcu

SEQ ID NO: 33811 - RNA, 48 nt, Mus musculus
ucaaaugcccugggguacaguugaguuuggcaggucuaacuaagagua

SEQ ID NO: 33812 - RNA, 46 nt, Mus musculus
uuaacaccuggaaaaacagccauagauauacaucaaagucucacca

SEQ ID NO: 33813 - RNA, 42 nt, Mus musculus
gaggggcccugccuuuucucugccagacaagaaguguuagag

SEQ ID NO: 33814 - RNA, 45 nt, Mus musculus
ggaccaucuccuuucucaaauuuuguaccaacucuacucugaagu

SEQ ID NO: 33815 - RNA, 45 nt, Mus musculus
acauagacuauauuagucuauggaaaauuugagcuugagguugaa

SEQ ID NO: 33816 - RNA, 46 nt, Mus musculus
ccauggguagacugaaucccacauguuccugguuuuuauuaaagau

SEQ ID NO: 33817 - RNA, 45 nt, Mus musculus
ugucuugugacuauaaaaugcuaaauacuauauuaacucaagaag

SEQ ID NO: 33818 - RNA, 46 nt, Mus musculus
aaggaauagugaugauuguuaucaugaugguaacuuuauggcagaa

SEQ ID NO: 33819 - RNA, 46 nt, Mus musculus
auggcugcaucucauuccuucucuuccuaaaccgugaccagcaguu

SEQ ID NO: 33820 - RNA, 46 nt, Mus musculus
aaaagcauauuaguaacaacacagguacauuaauacaagucuacgu

SEQ ID NO: 33821 - RNA, 46 nt, Mus musculus
agcucaucaccugugcuaagcuagcugacuggccaagcccagagau

SEQ ID NO: 33822 - RNA, 46 nt, Mus musculus
uaaauguaaugaaaauuaaguaaaaauaaaauuaaaacccagguua

SEQ ID NO: 33823 - RNA, 46 nt, Mus musculus
gagcguagaagaacaguuuuuugucuuuaaguggaggcccguagaa

SEQ ID NO: 33824 - RNA, 46 nt, Mus musculus
aggaaaccaaagcauaaauguguaggcaggaaccgagagaccaugg

SEQ ID NO: 33825 - RNA, 48 nt, Mus musculus
uuucaggcaaaguggguucuucaaggagaggagaggaaugcccagauc

SEQ ID NO: 33826 - RNA, 47 nt, Mus musculus
acagucagggaguugagggguguauuuauuuggucugacagaagaua

SEQ ID NO: 33827 - RNA, 41 nt, Mus musculus
gaagaggaggaagaggaggaggagggagggagggagggaga

SEQ ID NO: 33828 - RNA, 41 nt, Mus musculus
auaugcuugggugucuuuuucucucuguguuuccuacaugg

SEQ ID NO: 33829 - RNA, 46 nt, Mus musculus
gcaggccacaaagggaaauuagcuauggcuacagaaucuuauuacg

SEQ ID NO: 33830 - RNA, 46 nt, Mus musculus
uuuuaacaauguguggcugugacagguugugcugguagugggaaug

SEQ ID NO: 33831 - RNA, 45 nt, Mus musculus
aagacaauggaguuaguaaaaacgaucagugggggccaggaauua

SEQ ID NO: 33832 - RNA, 46 nt, Mus musculus
caaaucuuuguuuugacaggcauuuauuucucucugacacucagac

SEQ ID NO: 33833 - RNA, 46 nt, Mus musculus
gcucucaagauguuuauauuugucuucaguuuuaagcggcuuagau

SEQ ID NO: 33834 - RNA, 45 nt, Mus musculus
gaccgggugccuaugaguccacacuucugaauggaacguggagau

SEQ ID NO: 33835 - RNA, 45 nt, Mus musculus
gcuuagacagaagauaaagcagauucugaguugccucgggaagga

SEQ ID NO: 33836 - RNA, 46 nt, Mus musculus
ucacacagcuguauagcccaccaggagcccuggcuagaggaggcau

SEQ ID NO: 33837 - RNA, 41 nt, Mus musculus
auggcaagaaaucagcauugcauaaagggaggccaacggag

SEQ ID NO: 33838 - RNA, 41 nt, Mus musculus
ugagccaccacgugguugcuggagauuugaacuuaggaccu

SEQ ID NO: 33839 - RNA, 46 nt, Mus musculus
uggaaagagcauaguuggaaguguuaaaaucuuaucaauggcagau

SEQ ID NO: 33840 - RNA, 46 nt, Mus musculus
uagaggaaugccaggaccaggaaugggaguagguggguuggggagc

SEQ ID NO: 33841 - RNA, 45 nt, Mus musculus
uagaggacaugagguagguaacaggucauguagaugccaggauga

SEQ ID NO: 33842 - RNA, 42 nt, Mus musculus
uggaguggaauauaugagaggggaggcugagauaguuaagau

SEQ ID NO: 33843 - RNA, 42 nt, Mus musculus
aucuguggcauuugguuccaacaauagaaaguggucuaagac

SEQ ID NO: 33844 - RNA, 40 nt, Mus musculus
cugcuuccagugagugaauaaaagagcauuaaucugagau

SEQ ID NO: 33845 - RNA, 24 nt, Mus musculus
gcuccucugcuaacagaagugucu

SEQ ID NO: 33846 - RNA, 46 nt, Mus musculus
uuuagauuguccuaugacuuucuagccuggcauauagcccccaacu

SEQ ID NO: 33847 - RNA, 46 nt, Mus musculus
agucuccagaucagucccuagugugcagacccuuacaaccccuucu

SEQ ID NO: 33848 - RNA, 37 nt, Mus musculus
ucauuguuaaaguguguguggugugugugugugugug

SEQ ID NO: 33849 - RNA, 54 nt, Mus musculus
agaacaccucagucauccucgagcauuguagacugguugcaauggacaagagaa

SEQ ID NO: 33850 - RNA, 45 nt, Mus musculus
aaugugcuugagggauguuuguuuuuuaucugauaccacagaggu

SEQ ID NO: 33851 - RNA, 119 nt, Mus musculus
guuucucauuuguuauaccuugaauaaagaaacacccccaaauauaaauaugcuuauauauuuuuaacaaagauuacaaguuuaguaugacguauuuugaguuagaaugcaaagaaaga

SEQ ID NO: 33852 - RNA, 59 nt, Mus musculus
ccucugaaccuucagcauguuauaugauuguuuccaccucuuuguccaagaaauguaga

SEQ ID NO: 33853 - RNA, 72 nt, Mus musculus
cacugggugucacaagggaaaaccaaggugcuaugcuaugggugagagaguaaagcuuuacaaggcuugaug

SEQ ID NO: 33854 - RNA, 44 nt, Mus musculus
uuagcaguuaugucccacugacucacccgaucccuugcccacug

SEQ ID NO: 33855 - RNA, 46 nt, Mus musculus
cggacagagauucccugucacacugaggauuuuacuugcccaagag

SEQ ID NO: 33856 - RNA, 46 nt, Mus musculus
aguggcaauuacgggcggagggggacaaggaaaauccaggccugaa

SEQ ID NO: 33857 - RNA, 42 nt, Mus musculus
agauccaucacucuucagaaggaaguaccguggccuccaggu

SEQ ID NO: 33858 - RNA, 45 nt, Mus musculus
ucaucagcuggcauucugcuacagagaaauuguuggggggggggg

SEQ ID NO: 33859 - RNA, 45 nt, Mus musculus
ggcaggcggccacacaucaucucauacaugaccacacacagcccc

SEQ ID NO: 33860 - RNA, 46 nt, Mus musculus
gaccuccgccgagccucugcuuuggguccuucuucagcagcccagc

SEQ ID NO: 33861 - RNA, 51 nt, Mus musculus
gaccugagguuugaaggguggcaggagcuuuuucuguaccacguccugcca

SEQ ID NO: 33862 - RNA, 33 nt, Mus musculus
uuuugucuccuuguauaaucagcugccugaguc

SEQ ID NO: 33863 - RNA, 44 nt, Mus musculus
aaagcagaaaagcauaagacaaaacucauuuccaaagucacaag

SEQ ID NO: 33864 - RNA, 46 nt, Mus musculus
auaaagacaaggaacuggugaagcucacucaguaccucaaggagau

SEQ ID NO: 33865 - RNA, 44 nt, Mus musculus
gacauuguuauuuggucugcaacaaauaugaaguggauugaagc

SEQ ID NO: 33866 - RNA, 46 nt, Mus musculus
ggcgcucugggagcacucccguaagggucuugaggaacuguuuaag

SEQ ID NO: 33867 - RNA, 46 nt, Mus musculus
agguguuuuguuccgacagaaaguccugcuucauaugcgugaagaa

SEQ ID NO: 33868 - RNA, 46 nt, Mus musculus
ggcaauucaugggaaaauauauggagcuaacguuuacugggcacaa

SEQ ID NO: 33869 - RNA, 46 nt, Mus musculus
uggcaauccaccaaccugugccaacccaugaaccuccgacucccag

SEQ ID NO: 33870 - RNA, 46 nt, Mus musculus
ucuuaccugaauuaccagcaaaauuguugucauuaccucacagcag

SEQ ID NO: 33871 - RNA, 55 nt, Mus musculus
caagacugaggauuuauacugaauugucaucaaucaauccuaccagauggauuuc

SEQ ID NO: 33872 - RNA, 42 nt, Mus musculus
cuucucacaagacuuuccgaaucaagcgauuccuggccaaga

SEQ ID NO: 33873 - RNA, 48 nt, Mus musculus
ggggguacaaguagcuaauucacauuucucaaaaaucagugcuaagag

SEQ ID NO: 33874 - RNA, 42 nt, Mus musculus
gguuuuauucguagcaaauguugccaauuucuucggccagau

SEQ ID NO: 33875 - RNA, 46 nt, Mus musculus
aggcuugaauguagaaucauuugaaggaacuuuccuugggggauua

SEQ ID NO: 33876 - RNA, 45 nt, Mus musculus
gggcauucaggcggucaauagguccuguaggucaugugcucggug

SEQ ID NO: 33877 - RNA, 45 nt, Mus musculus
uaguucugagcacuauuaguaucuaucugacaaguauugggaaga

SEQ ID NO: 33878 - RNA, 44 nt, Mus musculus
uuccuauccuaaggugaaauaaugaauuuaguaauuugggaguu

SEQ ID NO: 33879 - RNA, 45 nt, Mus musculus
uggcuuuaaacaaaggggugaaaacaagaaagaauaggauggaau

SEQ ID NO: 33880 - RNA, 46 nt, Mus musculus
ggauuuuuuaagauaacuuuaauuaguuuauaugaaaucagcagca

SEQ ID NO: 33881 - RNA, 46 nt, Mus musculus
acgagaagcuguaucacagaaaauacaaaaugaugauucugagaga

SEQ ID NO: 33882 - RNA, 48 nt, Mus musculus
gucuguacaguuauggaggcuacuucccagcccucuuugguucuugca

SEQ ID NO: 33883 - RNA, 112 nt, Mus musculus
uguacagagaaguaauucauggcuguggguuaauuauaauuguuguaguaacauucacauugggacuuggugccaguuguuuuguuuuguuuuuucaugagacuugggacua

SEQ ID NO: 33884 - RNA, 97 nt, Mus musculus
ugcuuuuucuaggucaaauuacagauagaaaauugcucaagggccagcauuuucuaaugcuguuguuuuuccuggaagcacuaaggaaaugaaccaa

SEQ ID NO: 33885 - RNA, 49 nt, Mus musculus
cgucugccuggaacuguucccauaugacaggaaaaaagcaagcccagug

SEQ ID NO: 33886 - RNA, 85 nt, Mus musculus
uauauagcaggcagguggacuuguagacaggcugacagauggaagcagagccaugagggcagggagaggagauggggaagggggc

SEQ ID NO: 33887 - RNA, 58 nt, Mus musculus
gagggcaucagauccuauuacagauguuugugagccaccaugugguugcuggaaauug

SEQ ID NO: 33888 - RNA, 42 nt, Mus musculus
uaauauuauccugauugauuagacaggucuugggccagaugc

SEQ ID NO: 33889 - RNA, 45 nt, Mus musculus
cgagagcuuaaacagcuuuacuuagaacgaguucugaaaggagau

SEQ ID NO: 33890 - RNA, 45 nt, Mus musculus
ucucaaagacuugguucuaaugccagugaaaggcuuguuagugag

SEQ ID NO: 33891 - RNA, 42 nt, Mus musculus
gagaagaggcuggccaggaacaugggggagggggugucagag

SEQ ID NO: 33892 - RNA, 47 nt, Mus musculus
ugaacugcuuuuuaacacaauccaggcagccgacauugauaccaggu

SEQ ID NO: 33893 - RNA, 46 nt, Mus musculus
cuagccaaggguacauaguaagacccagucucaaaagucaaaaaaa

SEQ ID NO: 33894 - RNA, 45 nt, Mus musculus
ggaaguauucaugcuuugauuuuuuuuuuucccucagacagaguc

SEQ ID NO: 33895 - RNA, 46 nt, Mus musculus
ugcccaguauaugaaggcuuuucucucccucaccuuacaaggaggc

SEQ ID NO: 33896 - RNA, 41 nt, Mus musculus
uuaggaagggguuucuaucugcauggucuaguuugggugga

SEQ ID NO: 33897 - RNA, 45 nt, Mus musculus
auuuugggaaguuuaaaaggucuaagcuugaaccuguaaugagag

SEQ ID NO: 33898 - RNA, 46 nt, Mus musculus
auguauuuguguauauucgcauguuugugccagugucugcagaggu

SEQ ID NO: 33899 - RNA, 49 nt, Mus musculus
ugaggaaaagcugagaauagcagaaugggauuuaaggcagugaucagga

SEQ ID NO: 33900 - RNA, 45 nt, Mus musculus
ugacaguauguacaugaaagaucaugauggguaggaucaggagug

SEQ ID NO: 33901 - RNA, 45 nt, Mus musculus
uaguuuauuagaaagcaguugaucuaguggaaaaauagugaaguu

SEQ ID NO: 33902 - RNA, 42 nt, Mus musculus
uggaguaagggaacucaacugguaaauguaaaugggcaaaua

SEQ ID NO: 33903 - RNA, 46 nt, Mus musculus
ggaugacaugaagcaccugugggacuacacauuuggaccagagaaa

SEQ ID NO: 33904 - RNA, 46 nt, Mus musculus
ugaggcaagugagcugcguuccauguuggaagugaacuaccccaug

SEQ ID NO: 33905 - RNA, 46 nt, Mus musculus
ccacagguugagaaccauggguuuaaaauuaauuuuagcaacagau

SEQ ID NO: 33906 - RNA, 45 nt, Mus musculus
gauguuugaggugaucuuugaacuaaguaauguaaaguacaaggu

SEQ ID NO: 33907 - RNA, 45 nt, Mus musculus
aacucugugcuggcuaguuuuaugucaacuugacacaagcuuaga

SEQ ID NO: 33908 - RNA, 46 nt, Mus musculus
uuuccuauagagaauugauucauuccauuccccugugcacccacgc

SEQ ID NO: 33909 - RNA, 46 nt, Mus musculus
ucaugaaagaagugaaacucugagccaacagaaggcauuagcagaa

SEQ ID NO: 33910 - RNA, 45 nt, Mus musculus
ccucugagccaucuuacugacuaggacauuaauaauacccacauu

SEQ ID NO: 33911 - RNA, 46 nt, Mus musculus
cauuuuugaaguucuguucaaaaagacagaauucuggauagcagaa

SEQ ID NO: 33912 - RNA, 45 nt, Mus musculus
aauauuauuggaucuuaaugcauucagauuuguaauagugugaga

SEQ ID NO: 33913 - RNA, 46 nt, Mus musculus
agugagggagcucagucaccagccuuaagaugauugacgugcagga

SEQ ID NO: 33914 - RNA, 46 nt, Mus musculus
gucuuauuuaaggaaaauguugcauugauauugaauauagacaggu

SEQ ID NO: 33915 - RNA, 46 nt, Mus musculus
ugcugcuggucgcacaggaacucaacagugacaacguguacaagac

SEQ ID NO: 33916 - RNA, 46 nt, Mus musculus
uucugucuccagagguucagugaucauugcacacaagguaguagaa

SEQ ID NO: 33917 - RNA, 42 nt, Mus musculus
uccuauuauccauaacuagacucuugucucaguagcccagag

SEQ ID NO: 33918 - RNA, 44 nt, Mus musculus
guauacuuuagauuuuaaaaugugagcuauuuaagaagguagau

SEQ ID NO: 33919 - RNA, 46 nt, Mus musculus
ucuuaggauaaaaagaucagcuacuauggcauaagugaaaggagau

SEQ ID NO: 33920 - RNA, 57 nt, Mus musculus
uucaugaagggauacauaaaaugcaucucauuuuuugagauaaaggauaaagcagug

SEQ ID NO: 33921 - RNA, 46 nt, Mus musculus
ugacaauuauuguacuagcuucauuuaagcuaaaucugggcuagaa

SEQ ID NO: 33922 - RNA, 46 nt, Mus musculus
cuugcuuugcaugccgcccuauuauagaccuaggaccucucaagua

SEQ ID NO: 33923 - RNA, 42 nt, Mus musculus
gcggcggcucaccaggacgaaccauggacagccagggcagga

SEQ ID NO: 33924 - RNA, 47 nt, Mus musculus
gucuuuaauuuggggguuguguguauaaaggguauaaauggcugcag

SEQ ID NO: 33925 - RNA, 59 nt, Mus musculus
gaacgcaacgaauguagaacagucuuucaugacgauggcagcugagauuaaaaagcgaa

SEQ ID NO: 33926 - RNA, 53 nt, Mus musculus
uggguccuggagcuacagcugguggugccgagaaguccaauguuaaaauccag

SEQ ID NO: 33927 - RNA, 46 nt, Mus musculus
augaauucgcaaucugaacccaagugaaaaaacaaaauugccugaa

SEQ ID NO: 33928 - RNA, 46 nt, Mus musculus
uuuauaaaauaauguguguaauccuuguugcuuuccugauaccaga

SEQ ID NO: 33929 - RNA, 54 nt, Mus musculus
guuuagugagacguuauauguaagaucugauuugcuaguucuuccugguagagu

SEQ ID NO: 33930 - RNA, 46 nt, Mus musculus
cugauuaauaguuucuucauacucugcauauaauuuguggcugcag

SEQ ID NO: 33931 - RNA, 46 nt, Mus musculus
ucuaucuccccccccccccaaauuaaaugaaaacaugaacgcuaga

SEQ ID NO: 33932 - RNA, 55 nt, Mus musculus
gugacaaaggucagagauuguuuccuuugguuuaaggagcagccaagcauucuuc

SEQ ID NO: 33933 - RNA, 83 nt, Mus musculus
aauugggggcuaggguaggguauggcuguugauaacacauuuuaucauggggucuuuaaugauaaaauauuaaacuaaaaaua

SEQ ID NO: 33934 - RNA, 46 nt, Mus musculus
ggcuucauuugguguaauucccacgagucccagucacaugacucau

SEQ ID NO: 33935 - RNA, 45 nt, Mus musculus
agaagcaggaugguauggcgugugugcugacaggaugcuucuggg

SEQ ID NO: 33936 - RNA, 42 nt, Mus musculus
ucauaaucaccuguaaugagaucuggugcccucuucgggccu

SEQ ID NO: 33937 - RNA, 45 nt, Mus musculus
cuuaagacaugacucucuggcuccagaaaauggcagaguaggcac

SEQ ID NO: 33938 - RNA, 82 nt, Mus musculus
uugggagcugaggcccaggccucaguggguaaguguagucaagcagaucuucauacucuuuauuugggucccagagugcgga

SEQ ID NO: 33939 - RNA, 46 nt, Mus musculus
uagaaagcugaggagcaccugggcucaccguggacuuccacugugg

SEQ ID NO: 33940 - RNA, 46 nt, Mus musculus
aaagcuguuccugcgcugagguaggcugaauauaaucgguugccag

SEQ ID NO: 33941 - RNA, 45 nt, Mus musculus
gugugugucgucaccucuuuaccucaaccucauuaagauguccag

SEQ ID NO: 33942 - RNA, 46 nt, Mus musculus
cguagaaagccgggugauaauggggugaguucaugugagaaagcag

SEQ ID NO: 33943 - RNA, 46 nt, Mus musculus
uaguauuccaaaccuugucucuccccaccucaaaagaagccccccc

SEQ ID NO: 33944 - RNA, 46 nt, Mus musculus
agggagguggggaacggauauucaggguucuaauuggucguaacau

SEQ ID NO: 33945 - RNA, 42 nt, Mus musculus
agccuuuauggccauguuuucaugauuuaccuauccccuggu

SEQ ID NO: 33946 - RNA, 47 nt, Mus musculus
caaggacacugagcaagagaggcccuaucccaacucggcccccaaca

SEQ ID NO: 33947 - RNA, 45 nt, Mus musculus
gugugugugguaggaggugugggggucuuugugugugagugugug

SEQ ID NO: 33948 - RNA, 42 nt, Mus musculus
agaccuagaucagauuaaccuguggacauguaugugggggau

SEQ ID NO: 33949 - RNA, 42 nt, Mus musculus
cuaaaguggcuuuucaacccaugagaaauugcucacaggcuu

SEQ ID NO: 33950 - RNA, 46 nt, Mus musculus
aaaccuggagcuacaaaacagcucuccuggcugccugagaagccau

SEQ ID NO: 33951 - RNA, 46 nt, Mus musculus
acuguacaaacaaaaccgaaauuauauauaaauacaccccacccag

SEQ ID NO: 33952 - RNA, 45 nt, Mus musculus
gacagugaagucugucuuuguuuuuguuuucuuuuuaagucucca

SEQ ID NO: 33953 - RNA, 41 nt, Mus musculus
uuuagccuaaucagugcgauccaggcuagugagggaggcag

SEQ ID NO: 33954 - RNA, 46 nt, Mus musculus
gucucaugccaccuuuaaugugcccacaaaauggaacuaucugcaa

SEQ ID NO: 33955 - RNA, 41 nt, Mus musculus
uucccgcggcaccgcggguccguaguccuugccccggcccu

SEQ ID NO: 33956 - RNA, 53 nt, Mus musculus
ggaagguucacuaaaaacucacagaacagacaggguguuugagagagagagag

SEQ ID NO: 33957 - RNA, 41 nt, Mus musculus
gagaagggcugcauccuccacccccaaccaaguggcacaca

SEQ ID NO: 33958 - RNA, 45 nt, Mus musculus
cgagggguuucaccgagucggcuccuggagacuggaguuggucag

SEQ ID NO: 33959 - RNA, 46 nt, Mus musculus
cucgagugucaacaggaaggaaaaguuaaagcgugaucaggcugag

SEQ ID NO: 33960 - RNA, 45 nt, Mus musculus
guucuuacuggcagaccccaguuuccagccgaauaaacuugcuga

SEQ ID NO: 33961 - RNA, 46 nt, Mus musculus
cuuuauaaagcauguucgcugacauuaaaguugaaccugaucagaa

SEQ ID NO: 33962 - RNA, 46 nt, Mus musculus
ggacaccaaaggagauguaggaggagaaggagcuguggguugaggc

SEQ ID NO: 33963 - RNA, 45 nt, Mus musculus
uccuggaaaaggaaaagaagccagguuaggcuagguggggagaga

SEQ ID NO: 33964 - RNA, 71 nt, Mus musculus
aaaugauguguuggagccaguagguuggguggcuaggaaggaggagaggucuugcugauaagcuugggguc

SEQ ID NO: 33965 - RNA, 46 nt, Mus musculus
agcaagaguagauacugagcuugguaaaccagguaggguccuguaa

SEQ ID NO: 33966 - RNA, 45 nt, Mus musculus
auagguuccacgugcuuuguaacugcauacauaggaguguuaaag

SEQ ID NO: 33967 - RNA, 49 nt, Mus musculus
ggaucuuaaaauggugagacucuauagccccagcuggauaagaaauuua

SEQ ID NO: 33968 - RNA, 46 nt, Mus musculus
auagucagagaagggaccaguuaggucugagagguguagggcaggg

SEQ ID NO: 33969 - RNA, 45 nt, Mus musculus
acaucucuagcuaccucuuuggcucaguuauuucucuuugaaaug

SEQ ID NO: 33970 - RNA, 45 nt, Mus musculus
gaguaggagaaggggggcuucaauaacuggaguugggggucugac

SEQ ID NO: 33971 - RNA, 44 nt, Mus musculus
auuaaucagcuccuguuacaggauuagcagccgcugcccaaaga

SEQ ID NO: 33972 - RNA, 46 nt, Mus musculus
cuacagucagacauaaagaacuucagagacugugagaccuccaguu

SEQ ID NO: 33973 - RNA, 46 nt, Mus musculus
aaaagugaucuucaggaaaugacuaaaacugugcuuacuauccagg

SEQ ID NO: 33974 - RNA, 42 nt, Mus musculus
cuccugacucucuccuucucuccucagguccuccugcaagau

SEQ ID NO: 33975 - RNA, 46 nt, Mus musculus
aggugugucaaguugacacaaaacuagccaguacaggcagguaucg

SEQ ID NO: 33976 - RNA, 47 nt, Mus musculus
aaaaaagaaaagauaaaacagaaugaaugaaugaaauaacaaaguga

SEQ ID NO: 33977 - RNA, 82 nt, Mus musculus
acucaagcacagccugagccucaaaacaaaaaguaagaaaugugggagggucuggucugauucccaguaucacaaaaagaua

SEQ ID NO: 33978 - RNA, 46 nt, Mus musculus
guuccuuugucucucuggaucauaaaggacagcauagagccaaguc

SEQ ID NO: 33979 - RNA, 50 nt, Mus musculus
gucgagcaggugagaaggucaggaaggagguggaggccgggagacugggg

SEQ ID NO: 33980 - RNA, 42 nt, Mus musculus
gauauccgggaggugaggaggccagggaaaugaugugcggag

SEQ ID NO: 33981 - RNA, 24 nt, Mus musculus
augcgcagacaacgcaggagccac

SEQ ID NO: 33982 - RNA, 46 nt, Mus musculus
gucugcugagucaauaaucauugauaggaagacucuaaguggggag

SEQ ID NO: 33983 - RNA, 42 nt, Mus musculus
cucaggcugccuucgaacucggagcaacccuccugccugcau

SEQ ID NO: 33984 - RNA, 46 nt, Mus musculus
auguuuuaaaaaugaugguacuggagagacuagagggauggcuuag

SEQ ID NO: 33985 - RNA, 56 nt, Mus musculus
aaaaaaaaaagguuuuuaaagcaauauuauuggggcccaguaagauugcucagcca

SEQ ID NO: 33986 - RNA, 45 nt, Mus musculus
caacaacaacaacaaaaacaaccaaagaaaaaccaacaacagaau

SEQ ID NO: 33987 - RNA, 42 nt, Mus musculus
uuuucaccuguauuccuagcaccuggaggguggaugcaguag

SEQ ID NO: 33988 - RNA, 42 nt, Mus musculus
cauuuguucagaaagagaaagcuaggaguggugaugguguag

SEQ ID NO: 33989 - RNA, 46 nt, Mus musculus
uguggguacugagaauugaacccuguuuuuugggagaagcagccag

SEQ ID NO: 33990 - RNA, 46 nt, Mus musculus
gauguuaaaucugauaauuugguuuugauuuuuggaacccacaugg

SEQ ID NO: 33991 - RNA, 46 nt, Mus musculus
ccucacauagaaaaaaacccaccaccaaauaaacaaacaccccccc

SEQ ID NO: 33992 - RNA, 42 nt, Mus musculus
gggcaugguagugcgugacaugucuuuaaucccagugcuagg

SEQ ID NO: 33993 - RNA, 42 nt, Mus musculus
cauacucucaaaauauuugcuuauaucaauuccuggacucag

SEQ ID NO: 33994 - RNA, 46 nt, Mus musculus
agucaccacacucaacagguuuucuucuguugagaguaggcagccu

SEQ ID NO: 33995 - RNA, 45 nt, Mus musculus
aaaggauuggcagaugguaggaaagguuugagugauacagagcaa

SEQ ID NO: 33996 - RNA, 45 nt, Mus musculus
caugguugaguuuuaugccuugacuucucucauugauagagugua

SEQ ID NO: 33997 - RNA, 48 nt, Mus musculus
uaccagaaaauuguuguagugacagacaugaucauguuguuugggagg

SEQ ID NO: 33998 - RNA, 46 nt, Mus musculus
ggcuugaaaaguuauuagugcucaaaacuuaauggccuuuucuggg

SEQ ID NO: 33999 - RNA, 46 nt, Mus musculus
gacggauaguacaguaccauugaaaugaaaccuuuauuuugcugag

SEQ ID NO: 34000 - RNA, 46 nt, Mus musculus
aguuccugccuugucuuuccuccggugaggaauuuuuagcccuggg

SEQ ID NO: 34001 - RNA, 48 nt, Mus musculus
uuuguaaacauuguacuaccauuaacauagauuccacguggcaagaug

SEQ ID NO: 34002 - RNA, 46 nt, Mus musculus
aucuucaaagaguucugauccuuuuaguuuauggaauacagaugag

SEQ ID NO: 34003 - RNA, 42 nt, Mus musculus
auuaagucugguaguuugcucuuaaagucaguuuaagcagug

SEQ ID NO: 34004 - RNA, 44 nt, Mus musculus
caucuaggacucuaacucaagcaaaagaaaauuuguagagcgga

SEQ ID NO: 34005 - RNA, 46 nt, Mus musculus
aaguugucagucuuggcagcaagcaccuucugagaaaucauuuaag

SEQ ID NO: 34006 - RNA, 46 nt, Mus musculus
ugauuuuaaaggaaagcuuauguuguuuaaguuguuuuuauuugag

SEQ ID NO: 34007 - RNA, 42 nt, Mus musculus
uguguugaaauuaaccuuugucuaggauuuuguccugggaaa

SEQ ID NO: 34008 - RNA, 45 nt, Mus musculus
gccauauaaagacccagguauggcagcaaaugcuuguagguggca

SEQ ID NO: 34009 - RNA, 44 nt, Mus musculus
gguugugagccaccauguggaugcuggguauuuaacucaggacu

SEQ ID NO: 34010 - RNA, 62 nt, Mus musculus
cuaagggacuggcuuaaaaguucagugccauguuguagauagaaauuauauuaauuauaccc

SEQ ID NO: 34011 - RNA, 46 nt, Mus musculus
gugcaugggcuuuaacuagcauaguuggccaguacauccugggcau

SEQ ID NO: 34012 - RNA, 41 nt, Mus musculus
cagugccaagugauuuugaauuucuuggcagcagagggacg

SEQ ID NO: 34013 - RNA, 45 nt, Mus musculus
ucucuggcucuguguguguguguguguguguguguguguauguau

SEQ ID NO: 34014 - RNA, 42 nt, Mus musculus
ugucucugucugucuauucugucauuguauauuuuucaagag

SEQ ID NO: 34015 - RNA, 46 nt, Mus musculus
uaaguacacuuuugcugucuucagacacuccagaagagggcgccag

SEQ ID NO: 34016 - RNA, 46 nt, Mus musculus
guguguguguguguguguguguguguguuuacuaaaagaggugagg

SEQ ID NO: 34017 - RNA, 46 nt, Mus musculus
agaguggagccagugacauugaaauggaugagcagcuuauuaauag

SEQ ID NO: 34018 - RNA, 50 nt, Mus musculus
gacauugcagacaucgaggcccuuaaagaagaagaggaagaggaggagga

SEQ ID NO: 34019 - RNA, 43 nt, Mus musculus
augcucuugagauuauugaagcacuaggaaaaccuaacagaag

SEQ ID NO: 34020 - RNA, 42 nt, Mus musculus
gcggcagagaguuaguugcucaguggggaaugguagcgcgug

SEQ ID NO: 34021 - RNA, 46 nt, Mus musculus
gugugugugugugugugugugaaugacugaacauaauacaaggcag

SEQ ID NO: 34022 - RNA, 42 nt, Mus musculus
uauauguacacacgugugugugugugugugugugugugaugg

SEQ ID NO: 34023 - RNA, 58 nt, Mus musculus
ugcauauuggucauuuucuuaguuaggguuuuacuacugugaacagauaccaugcagu

SEQ ID NO: 34024 - RNA, 42 nt, Mus musculus
ugguagagagauauaaguaccacuuaccacuggaaucaggag

SEQ ID NO: 34025 - RNA, 45 nt, Mus musculus
caggacagccagggcuacacagagaagcccugucuugaaaaaaca

SEQ ID NO: 34026 - RNA, 46 nt, Mus musculus
gcuugcuugcugaaauuaaucugccaguuugcaguagauccgucag

SEQ ID NO: 34027 - RNA, 46 nt, Mus musculus
gaacgagaaaugaauugguacagauaaaggaauuugguaaacguag

SEQ ID NO: 34028 - RNA, 46 nt, Mus musculus
gaucagucagugcucuuaaccaucugagccaucucuccagccccuc

SEQ ID NO: 34029 - RNA, 45 nt, Mus musculus
ccaauuuguacuugcuguugaaacguuugguuaccagugcagcug

SEQ ID NO: 34030 - RNA, 72 nt, Mus musculus
aucuagaaaguaugauuuacaauauuuggaaguaguaaaauagaucuggagaaaacauccuagugguaaaca

SEQ ID NO: 34031 - RNA, 50 nt, Mus musculus
uucaagauuccuaaaacauguuuagcauaaacuacaugcgguuugauaca

SEQ ID NO: 34032 - RNA, 46 nt, Mus musculus
uaauguuugggauguguaagagauaacuagguaaaauguaagggag

SEQ ID NO: 34033 - RNA, 45 nt, Mus musculus
ccuuagcugaggagcugucagcaguucacaguaacuggggagggg

SEQ ID NO: 34034 - RNA, 46 nt, Mus musculus
acaugagcuuggaaagggcacauguugcaagauaaauggacauuag

SEQ ID NO: 34035 - RNA, 45 nt, Mus musculus
agagacgaaagguagagaguagaggccggccauggccuuguggag

SEQ ID NO: 34036 - RNA, 50 nt, Mus musculus
augacagaguucuuuacagaucucauuacuaaaguggaagaaaugucgcc

SEQ ID NO: 34037 - RNA, 46 nt, Mus musculus
ugcugaagaauuuuauacugugaggugccagguggcagauaugaag

SEQ ID NO: 34038 - RNA, 53 nt, Mus musculus
ugaguuucaauacuaugagauauacauuuaauauggucacgaugaugaaagag

SEQ ID NO: 34039 - RNA, 63 nt, Mus musculus
aaagugaauacacacuuuucuuucccuuuacguuuggauaugacgcccuauacagaagauuuu

SEQ ID NO: 34040 - RNA, 93 nt, Mus musculus
uuuuagguuucaaagauguuggugaucguucgaaagacacagagagcuaugaguaugacuugauuggagugacuguucacacaggaacagcag

SEQ ID NO: 34041 - RNA, 54 nt, Mus musculus
acauagugcauauaugcuguuuuacaaacgcauggaaccagaagaagaaaaugg

SEQ ID NO: 34042 - RNA, 46 nt, Mus musculus
agcuacccugaaauacaccuuaauacagcagacuagaaaggcaagu

SEQ ID NO: 34043 - RNA, 45 nt, Mus musculus
uccagguuuauguggcagcugugcaguuguauuccaaguacauua

SEQ ID NO: 34044 - RNA, 41 nt, Mus musculus
acacacacacacacacacacacacacagagagagagaauga

SEQ ID NO: 34045 - RNA, 45 nt, Mus musculus
gugguuuuuagaccgcauggcugaugaugacugguggccaaugca

SEQ ID NO: 34046 - RNA, 41 nt, Mus musculus
agagacugagaccugugcacgcucaucucuaucuacaacca

SEQ ID NO: 34047 - RNA, 46 nt, Mus musculus
guuuggucugugcaacacauguaauccugauauccacugaggucag

SEQ ID NO: 34048 - RNA, 41 nt, Mus musculus
aacuguuuaacuugaugcagcuauuuauagcucaaaggcca

SEQ ID NO: 34049 - RNA, 45 nt, Mus musculus
auuuugcuaccauuuaagaacuuguauuucaaaugagaggccuca

SEQ ID NO: 34050 - RNA, 46 nt, Mus musculus
cugugauuauuugaaagccuauuuauauaugccuuuauauuugcag

SEQ ID NO: 34051 - RNA, 46 nt, Mus musculus
acauugcuguuugacuagacuaugucuacauggaagcaaggagaau

SEQ ID NO: 34052 - RNA, 46 nt, Mus musculus
uugagcaauuuuccuaugauaaaaauauaaaaaauaauuagcauag

SEQ ID NO: 34053 - RNA, 46 nt, Mus musculus
ggauucauuucagaguguggggaaugauaccuaggaaacugcuuag

SEQ ID NO: 34054 - RNA, 44 nt, Mus musculus
acuaaauuuaaauagccagaaucugacuguuaggaaagcacuag

SEQ ID NO: 34055 - RNA, 46 nt, Mus musculus
gaaguugccucauuaauaaaaaaauaaaugaugauuuaaccugaga

SEQ ID NO: 34056 - RNA, 46 nt, Mus musculus
ugcccaugggacagaucccaauuuggacccauuacuguucggacau

SEQ ID NO: 34057 - RNA, 42 nt, Mus musculus
gauuuauuuauugcauugauguguaugaguauuugucugcgu

SEQ ID NO: 34058 - RNA, 42 nt, Mus musculus
caaggagagcugcaguagguuacuuaguggguaugaaguuag

SEQ ID NO: 34059 - RNA, 24 nt, Mus musculus
auuugaacucuuccuaucuggguu

SEQ ID NO: 34060 - RNA, 45 nt, Mus musculus
cuugucugcagcagagaaacucacuccaagagcaagaagccaaag

SEQ ID NO: 34061 - RNA, 44 nt, Mus musculus
ggaggaugaagacaagcuuggagguguggcauguugcucuugcc

SEQ ID NO: 34062 - RNA, 45 nt, Mus musculus
cagugcccucuguuucagguuauuuuauuguauuuuccccccaca

SEQ ID NO: 34063 - RNA, 63 nt, Mus musculus
gaccagggagguccugacccccacuagcaccucagacaaugagacaagagacucaucgauuau

SEQ ID NO: 34064 - RNA, 45 nt, Mus musculus
cugcuugaauggcaagauagauuuauaggcuucaauucuugguca

SEQ ID NO: 34065 - RNA, 42 nt, Mus musculus
aaaaaaugugcaucuucuguauacuuucuaaagggcaaucag

SEQ ID NO: 34066 - RNA, 46 nt, Mus musculus
augguguccucugugccaguuuuguaccuuaaaauaagagaggcag

SEQ ID NO: 34067 - RNA, 26 nt, Mus musculus
uuggaucgacugaggguacugggucg

SEQ ID NO: 34068 - RNA, 45 nt, Mus musculus
cuucacagcaccugguugugacucuaggaagccagcacggugaga

SEQ ID NO: 34069 - RNA, 45 nt, Mus musculus
guguagaaagacaggaacagacucaggcccacaaccacaggauca

SEQ ID NO: 34070 - RNA, 41 nt, Mus musculus
cuuuuuaaguucagacucaaaaaguaaacuuugggccuuga

SEQ ID NO: 34071 - RNA, 42 nt, Mus musculus
agcaugugccagugucuguauaguuuuuugaaggaggaggaa

SEQ ID NO: 34072 - RNA, 46 nt, Mus musculus
auuaucccccuuuucuaauaaauagcuacuauuuauacagcaccag

SEQ ID NO: 34073 - RNA, 46 nt, Mus musculus
cuuaacugacuaccauccgcugaaggucuguaauauaggagcagag

SEQ ID NO: 34074 - RNA, 46 nt, Mus musculus
aaacuaaagacagagauggaaggugaaggagcgagcgagaggugag

SEQ ID NO: 34075 - RNA, 41 nt, Mus musculus
uuaugcaaaggaagcaagaacuaacuggugacauggggaca

SEQ ID NO: 34076 - RNA, 45 nt, Mus musculus
ccugccccaucaccucuccuguucuugcguuugcucuggacuaga

SEQ ID NO: 34077 - RNA, 93 nt, Mus musculus
gccguagccccugcuagggcagcccguacgaaccugcuggaagaggaagagaaaggcagagagucggguuacaagauggcggaucuguaguag

SEQ ID NO: 34078 - RNA, 25 nt, Mus musculus
gcuccgggacgcaaaaggaagggag

SEQ ID NO: 34079 - RNA, 25 nt, Mus musculus
cgcugccgccacuaccggcucucaa

SEQ ID NO: 34080 - RNA, 81 nt, Mus musculus
ggcggcuggaacgguggggccagaagccaccaugucggauacacggaggcgagugaaggucuauacccuuaacgaagaccg

SEQ ID NO: 34081 - RNA, 46 nt, Mus musculus
gucuaucagggagacauauuuuauaaauaaaguuuauauuugguag

SEQ ID NO: 34082 - RNA, 42 nt, Mus musculus
cugcagccacagugcagcuccauguaaaccuacaggccaaac

SEQ ID NO: 34083 - RNA, 44 nt, Mus musculus
ucuccaaguuuaaaaaguuugagguacagagggaaggccagauu

SEQ ID NO: 34084 - RNA, 46 nt, Mus musculus
ugucccgcccuucucuuaccuuuaguaagaguccagcaugcaaguu

SEQ ID NO: 34085 - RNA, 54 nt, Mus musculus
ugccagcacccagaguacgccagcauccagucgggcgcagaccuuacccaccag

SEQ ID NO: 34086 - RNA, 42 nt, Mus musculus
agacuaagugauggaaacgaguaccucuuccaagccaaagau

SEQ ID NO: 34087 - RNA, 43 nt, Mus musculus
ucuuuuuuuuuauugucaguuggguaacucuagaaauugcaga

SEQ ID NO: 34088 - RNA, 98 nt, Mus musculus
agugcugcuucuggcauccccuaccacagugaggucccugugaguuugaaagaggccaucugcgaaguggcccuugauuacaaaaagaagaagcacgu

SEQ ID NO: 34089 - RNA, 48 nt, Mus musculus
agcaugagugggaggcccacaauaagaaagccucgagcagguaaaggc

SEQ ID NO: 34090 - RNA, 46 nt, Mus musculus
cacaguugaugguacacaggccgaaaacgauaaugaaucaagaccc

SEQ ID NO: 34091 - RNA, 46 nt, Mus musculus
uguuuccauauaugugcuguguguuuaaguuuuguaucauccagac

SEQ ID NO: 34092 - RNA, 46 nt, Mus musculus
ucauauauauguguguguguauguauauguauguguguguguguau

SEQ ID NO: 34093 - RNA, 46 nt, Mus musculus
agauagguaucuagauagauaccaagcuuuuaagcucugggcuacu

SEQ ID NO: 34094 - RNA, 46 nt, Mus musculus
uaccgcucucaaacguaccaaaacuacaaaaacuuuaauagcagac

SEQ ID NO: 34095 - RNA, 48 nt, Mus musculus
guuggagcuacuggaagugcgcagacagcaagaggaagaagaaagaaa

SEQ ID NO: 34096 - RNA, 46 nt, Mus musculus
ccccccagcaacuuuucccucucaacaaaguuaagaagaugcagag

SEQ ID NO: 34097 - RNA, 45 nt, Mus musculus
cugggaugagagauucucugcucuggaaaggcugacaacgguaag

SEQ ID NO: 34098 - RNA, 41 nt, Mus musculus
ggacaggaaccauaccuauccagccgugaaauuggccagag

SEQ ID NO: 34099 - RNA, 41 nt, Mus musculus
uagagagaaacccugucucaaaaaaccaaaaaaaaagaaga

SEQ ID NO: 34100 - RNA, 49 nt, Mus musculus
ggaaaaguuacugcagcugacagagaaaagaaaagaaaugauugacaag

SEQ ID NO: 34101 - RNA, 61 nt, Mus musculus
acagccugcauugagcuugggaaaucccugcuggcacggaaacacuaugcuucugaggagg

SEQ ID NO: 34102 - RNA, 50 nt, Mus musculus
auggugcgugaccucaugcucuggauggaagaugucauccggcagaucga

SEQ ID NO: 34103 - RNA, 44 nt, Mus musculus
gccuaugcaggggacaaggcugaugacauccagaagcgugagaa

SEQ ID NO: 34104 - RNA, 80 nt, Mus musculus
aggccagccugguuacagagugacuuccaagacagccaggguuagauagugagacccugucucaaaagagagagagagag

SEQ ID NO: 34105 - RNA, 46 nt, Mus musculus
ugcaaauaauguuagaugaacacacucguguuuaaauuaggcagau

SEQ ID NO: 34106 - RNA, 73 nt, Mus musculus
aucuuuggccgaauccaggacaaacacaagaaacucccugaggagcuuggaagagaucaaaacacuguggaaa

SEQ ID NO: 34107 - RNA, 48 nt, Mus musculus
cucaucaacucuggacauucagaugcugccaccauugcugaguggaaa

SEQ ID NO: 34108 - RNA, 46 nt, Mus musculus
ucucagugguuucuuugugugcaucccauuucagauguuacaagaa

SEQ ID NO: 34109 - RNA, 46 nt, Mus musculus
agcucaacagagagguggaugaccuggaacaguggaucgcugagag

SEQ ID NO: 34110 - RNA, 45 nt, Mus musculus
aggucgacaagcuguaugcuggccugaaggaccuugcugaggaga

SEQ ID NO: 34111 - RNA, 50 nt, Mus musculus
gaugagcagagugcugucucuauguugaaaaagcaccagauuuuagagca

SEQ ID NO: 34112 - RNA, 45 nt, Mus musculus
uuucuggaauucuaaagacacaccaggauuuuaaugccacuagaa

SEQ ID NO: 34113 - RNA, 46 nt, Mus musculus
aagagaucgaggaacugcagagccaagcccaggcgcugagucagga

SEQ ID NO: 34114 - RNA, 46 nt, Mus musculus
acauggccuggagagccagauucaaucugacgacuauggcaaagac

SEQ ID NO: 34115 - RNA, 46 nt, Mus musculus
uggcggaacuugcauccaacaaagaauggcuugacaaaauugagaa

SEQ ID NO: 34116 - RNA, 42 nt, Mus musculus
uguguggcuuucuaguauauaugguuggucucggaguccagu

SEQ ID NO: 34117 - RNA, 46 nt, Mus musculus
uaauuauuuuuaaauuauuuaauucuuuugacagacacaggaagaa

SEQ ID NO: 34118 - RNA, 44 nt, Mus musculus
ugaggaagggaaucaaaucuuuuucuuuuuacaaagccccugau

SEQ ID NO: 34119 - RNA, 46 nt, Mus musculus
uccauuuugagggugcacacuaugaauguagacagaacuugcagga

SEQ ID NO: 34120 - RNA, 46 nt, Mus musculus
aagcaggaggacuucaugaccaccauggaugccaacgaggagaaga

SEQ ID NO: 34121 - RNA, 46 nt, Mus musculus
agaacaggcaaaaccuccucucccagucccaugccuaccagcaguu

SEQ ID NO: 34122 - RNA, 47 nt, Mus musculus
cagagaagcuucucacacagcacgagaauaucaaaaaugagaucgac

SEQ ID NO: 34123 - RNA, 45 nt, Mus musculus
uuccagucuuggcucuccaggacccagacugcuaucgccucagag

SEQ ID NO: 34124 - RNA, 41 nt, Mus musculus
cccugaccaggcucaagcuauccugucucggcuggccgaga

SEQ ID NO: 34125 - RNA, 46 nt, Mus musculus
aacgagacuugguagccauugaggcgaagcugagugaccugcagaa

SEQ ID NO: 34126 - RNA, 85 nt, Mus musculus
agaagagaucaccaacuacaggcccacuauugacacacugcaugagcaagccagugcccuuccacaagcacaugcagagucucca

SEQ ID NO: 34127 - RNA, 46 nt, Mus musculus
cugaugcugaugauauugaugcuuggauguuagauauacucaagau

SEQ ID NO: 34128 - RNA, 117 nt, Mus musculus
agacuugaccagugucaugcgccugcugagcaagcaccgggcauuugaggaugagaugaguggccguaguggccauuuugagcaggccauuaaagaaggugaagacaugauugcaga

SEQ ID NO: 34129 - RNA, 46 nt, Mus musculus
ggaagagucccgucgccucuggaaguucuucugggagauggcagaa

SEQ ID NO: 34130 - RNA, 50 nt, Mus musculus
ugugacccccagguaauucgagaccguguugcccacauggaguucugcua

SEQ ID NO: 34131 - RNA, 69 nt, Mus musculus
gcagacauugcaauccaagcagagcguguaagaggugugaaugccucugcccagaaguuugcaacagau

SEQ ID NO: 34132 - RNA, 67 nt, Mus musculus
gucucaagacuauggcaaacacuuacuugguguugaagaccuguuacagaagcaugcccugguugaa

SEQ ID NO: 34133 - RNA, 46 nt, Mus musculus
gguggccagugacaaaccagaggggugguacggcaaggcugcuaag

SEQ ID NO: 34134 - RNA, 46 nt, Mus musculus
aagagugaaauagaaauuuuaucugaggugauguuggaugguagcc

SEQ ID NO: 34135 - RNA, 45 nt, Mus musculus
cuccaaacacgguguuucuuacguaagagaacucugccccuagau

SEQ ID NO: 34136 - RNA, 46 nt, Mus musculus
gagcaccauggaaaaguuguaaacgaaaccauuuuauaucccagau

SEQ ID NO: 34137 - RNA, 48 nt, Mus musculus
ggauugcaaaagauauuccaggaaaugcuuuauauuauggacuggaug

SEQ ID NO: 34138 - RNA, 47 nt, Mus musculus
guucaggccgugguggcuguggccagggaacuugaagccgagaacua

SEQ ID NO: 34139 - RNA, 41 nt, Mus musculus
cagcuuacgcacuguauugugcuccccccacccggcucagu

SEQ ID NO: 34140 - RNA, 88 nt, Mus musculus
ugagagagaacuggcucugcggaaugagcucauacggcaggaaaaacuggaacaacucgcccgaagauuugaucgcaaggcagcuaug

SEQ ID NO: 34141 - RNA, 83 nt, Mus musculus
agguccagcaaagaguuguaauaggucaguucacuggagcucugcaggcagugucagacuuugucaacagccuuggcccacag

SEQ ID NO: 34142 - RNA, 48 nt, Mus musculus
gagaaggggaauuuggaggugcuccuuuucacaauucagagcaagaug

SEQ ID NO: 34143 - RNA, 46 nt, Mus musculus
uggaguggauugaacaaaccaucaucauccuaaacaaccgcaaauu

SEQ ID NO: 34144 - RNA, 46 nt, Mus musculus
ugugugugugugugugugugugugagagagagagagagauagagag

SEQ ID NO: 34145 - RNA, 54 nt, Mus musculus
uacuaccacuacuucuccaagaugaaggccuuggcugucgaaggaaagcgcauu

SEQ ID NO: 34146 - RNA, 48 nt, Mus musculus
ucuaaugcacacuacaaucugcagaaugcauuuaaccuggcagagcag

SEQ ID NO: 34147 - RNA, 58 nt, Mus musculus
ucaacauucacaauuucaccacuagcuggagggauggcauggccuucaaugcacugau

SEQ ID NO: 34148 - RNA, 45 nt, Mus musculus
uacagcaguugggugauugccuaauauuucuucuuaaacuuuaga

SEQ ID NO: 34149 - RNA, 45 nt, Mus musculus
uuggugacuaugugauggaguuaucucuguauagaagcgaguaug

SEQ ID NO: 34150 - RNA, 46 nt, Mus musculus
guuuuauuagaggacugacuguacagcucaaguguccuguuuaguu

SEQ ID NO: 34151 - RNA, 45 nt, Mus musculus
auccaguggccucugccaguuuuauuuuuuuauuucccucuuucc

SEQ ID NO: 34152 - RNA, 46 nt, Mus musculus
aauguagccuccuuucugggaugccuguguauuuuguaaggaagac

SEQ ID NO: 34153 - RNA, 41 nt, Mus musculus
uuacacgcuagcuuauugagaaauauuuuaaccuaagcaga

SEQ ID NO: 34154 - RNA, 46 nt, Mus musculus
cugggucucuagagacaguucccucccucuacugggccaagaggua

SEQ ID NO: 34155 - RNA, 24 nt, Mus musculus
gcaccuggugaauaugguugcagu

SEQ ID NO: 34156 - RNA, 45 nt, Mus musculus
ggaagaugccuuuguagugagagcagcaguucaaaggucggggaa

SEQ ID NO: 34157 - RNA, 46 nt, Mus musculus
ccuccccuccauggauuugauccuuaaaaucauaaacuggcuggag

SEQ ID NO: 34158 - RNA, 46 nt, Mus musculus
ugugccauccaccucauuuuugagaccuuuuauuugaccccagcac

SEQ ID NO: 34159 - RNA, 99 nt, Mus musculus
ugaaguuuacugacaccuauguuaacuugauacuuuaagguuuucguguguaauuuguucuuuuguguauguagauagauacaacaugugugaacauug

SEQ ID NO: 34160 - RNA, 46 nt, Mus musculus
ggaugcugaacauuuuuucaggagcuucucugccauucgguauuuc

SEQ ID NO: 34161 - RNA, 45 nt, Mus musculus
aacaaaucccaaauuuaaacaguguagauguccuguucucugaga

SEQ ID NO: 34162 - RNA, 39 nt, Mus musculus
uuguuagcuuuuuuuuuuuuuaaaucuugacacaggauc

SEQ ID NO: 34163 - RNA, 46 nt, Mus musculus
augauugugagccacuauguggaugcugagaaucaaacucaggacc

SEQ ID NO: 34164 - RNA, 45 nt, Mus musculus
uaaauucuagagugcagagugagaaaggggacagacagagacagg

SEQ ID NO: 34165 - RNA, 46 nt, Mus musculus
ugaaaguggaauuugcuuucuugaaaauuuaggugagugagcuugc

SEQ ID NO: 34166 - RNA, 46 nt, Mus musculus
gccuacaccgggcaggugccuuacaacuacaaccaacuggaaggaa

SEQ ID NO: 34167 - RNA, 45 nt, Mus musculus
ggagaaagugcugguguuaaugguguggugggcagggcuggugga

SEQ ID NO: 34168 - RNA, 46 nt, Mus musculus
aguugcugaguaggcuggaggaggguaggcugugagaagggcaggc

SEQ ID NO: 34169 - RNA, 42 nt, Mus musculus
agacccgaauauccacaccagcaaacugcuccuugcccagaa

SEQ ID NO: 34170 - RNA, 46 nt, Mus musculus
auaggauauguugauggcuugugagagaacuauaaugguaaaagag

SEQ ID NO: 34171 - RNA, 24 nt, Mus musculus
gugagagcagggaagggguucagu

SEQ ID NO: 34172 - RNA, 42 nt, Mus musculus
ggagaagaggcccuugguucccugaaggcuccuugccccaga

SEQ ID NO: 34173 - RNA, 46 nt, Mus musculus
uauacaaggcaagauaauuacugaauaguuucacuaugggugagag

SEQ ID NO: 34174 - RNA, 42 nt, Mus musculus
uaucacaggaauuaccuugguuugcuucgugaaugcuaagau

SEQ ID NO: 34175 - RNA, 42 nt, Mus musculus
gugacaugaaggucuuguaguuuuggaucuguagccccagca

SEQ ID NO: 34176 - RNA, 46 nt, Mus musculus
ccaucuguaauuggaucugacgcccucuucuggugugucugaagaa

SEQ ID NO: 34177 - RNA, 44 nt, Mus musculus
cccuaagauaauggaaugguugggugggggaguagguggggaca

SEQ ID NO: 34178 - RNA, 42 nt, Mus musculus
gugagagugagugugagugugugugugugugugugugugugu

SEQ ID NO: 34179 - RNA, 42 nt, Mus musculus
ugaguguguguauguaagugagugagugugugagugugugag

SEQ ID NO: 34180 - RNA, 47 nt, Mus musculus
gagugugugugagugugucugugugugugagugugucugugugugug

SEQ ID NO: 34181 - RNA, 45 nt, Mus musculus
uguauguugugugugguuuuguguguuguauauauguguggugug

SEQ ID NO: 34182 - RNA, 41 nt, Mus musculus
ugugauaugucuguaguauguguuaugugugugugccugua

SEQ ID NO: 34183 - RNA, 99 nt, Mus musculus
augugugaugcgugucuguggugugucuguaguauguggugucugguaugugugugugguauguaugugguguauagugugugugguauguaugugugu

SEQ ID NO: 34184 - RNA, 43 nt, Mus musculus
uuugugugugccugugguaugucuauaguguuugguaucuggu

SEQ ID NO: 34185 - RNA, 42 nt, Mus musculus
ugagccugcuuuuguuuuuuguuuguaauauccggugaaucu

SEQ ID NO: 34186 - RNA, 45 nt, Mus musculus
gaaagcauugcccuuuauuuuugcagucaagccggggcacuuagu

SEQ ID NO: 34187 - RNA, 42 nt, Mus musculus
caaucgugugaaaccaugccaauuccucccccagccccaggc

SEQ ID NO: 34188 - RNA, 45 nt, Mus musculus
augguuguguagcuuggugaucucaugggacuccuaacacugaga

SEQ ID NO: 34189 - RNA, 45 nt, Mus musculus
auguaccagucccaccauugaaaacuuugccugguuacagaagau

SEQ ID NO: 34190 - RNA, 26 nt, Mus musculus
accucuccacgcucaguauccucucu

SEQ ID NO: 34191 - RNA, 46 nt, Mus musculus
aucgccaucgcugccgccuccgcgcaucccgggagccuaggcgagc

SEQ ID NO: 34192 - RNA, 41 nt, Mus musculus
caggccaccgggcacagauagggucacuacugcgacacgga

SEQ ID NO: 34193 - RNA, 60 nt, Mus musculus
cgucaacuuuuagaaugggaauaaaacaaacaaacaaacagcacaguauuagagacccau

SEQ ID NO: 34194 - RNA, 35 nt, Mus musculus
ccugagggaaggagggagggggucaugaguaggug

SEQ ID NO: 34195 - RNA, 46 nt, Mus musculus
uguuugcucaucuguuuucuuauaguacucagaaccacugacccag

SEQ ID NO: 34196 - RNA, 45 nt, Mus musculus
acucaccaaauaaauauaguacaauacaaauauguuuaaggcuag

SEQ ID NO: 34197 - RNA, 45 nt, Mus musculus
cccuuuagcucagaaaucacugacaaauccaauuuuuuucuagag

SEQ ID NO: 34198 - RNA, 45 nt, Mus musculus
cuuugguguggagaagacagcugggugaaagaugaggggcaagga

SEQ ID NO: 34199 - RNA, 25 nt, Mus musculus
aaggguaaggagcaagaugcaggaa

SEQ ID NO: 34200 - RNA, 46 nt, Mus musculus
uucucugggcgaccagcuuuacacuugccaccuuggcuacacugag

SEQ ID NO: 34201 - RNA, 46 nt, Mus musculus
acugcagcacagucaaacucauggauacacuaagaauaucaaccag

SEQ ID NO: 34202 - RNA, 45 nt, Mus musculus
gcaucaguagccuuaagguuguugugaccuuccugugcuugggaa

SEQ ID NO: 34203 - RNA, 46 nt, Mus musculus
ugaugucaagauuuuggccuugacugcggugguguccacaucagau

SEQ ID NO: 34204 - RNA, 44 nt, Mus musculus
ccaagugguagaccccaaacuaaaccacaucuucaggccacaga

SEQ ID NO: 34205 - RNA, 47 nt, Mus musculus
ggaauggaauccugcaaugaacaagaaccaguugcgaaaugggcuga

SEQ ID NO: 34206 - RNA, 42 nt, Mus musculus
ggggcccggcgcgggcgcggggugcggccauggcggacggug

SEQ ID NO: 34207 - RNA, 42 nt, Mus musculus
uaaaggugggugccccgggcaucacgugcucuggcccgagcu

SEQ ID NO: 34208 - RNA, 42 nt, Mus musculus
cuccucccuucugagugucucaaggaauccuggugcccuaga

SEQ ID NO: 34209 - RNA, 104 nt, Mus musculus
uuuuguguauucuguagguccugggaaggacagcaguagaugccaagguguuguucaguggaucguucugaggguauggaagaugggacugugcugugucugau

SEQ ID NO: 34210 - RNA, 40 nt, Mus musculus
ucggccggaggugccggaggacgacgaggaugaugaggag

SEQ ID NO: 34211 - RNA, 42 nt, Mus musculus
caugagacugaaggcuuuugaaaccucaaagcuuacccccag

SEQ ID NO: 34212 - RNA, 23 nt, Mus musculus
uuaagauguguccagagccuccu

SEQ ID NO: 34213 - RNA, 48 nt, Mus musculus
guauggcggacauaccaucugaccucagcuggggagaagcucacagag

SEQ ID NO: 34214 - RNA, 45 nt, Mus musculus
gaugagguuuccuuuaucaagaagcuuaggcaaaagugaacacca

SEQ ID NO: 34215 - RNA, 45 nt, Mus musculus
cgugagcccugggacccucggauuguggaaaauuccucugcccuu

SEQ ID NO: 34216 - RNA, 45 nt, Mus musculus
caucagcuuuggcaaguucgaccuguaccgcaagcgcugccagau

SEQ ID NO: 34217 - RNA, 46 nt, Mus musculus
ugaccaguucuaccgccuguggcugucccucuuccugcacgcuggg

SEQ ID NO: 34218 - RNA, 42 nt, Mus musculus
ugugagcaaguagucagggcaagagaacuaggugaagacaug

SEQ ID NO: 34219 - RNA, 46 nt, Mus musculus
caugcgucaggacccacaggugcacagcuucauccuggcugcccgg

SEQ ID NO: 34220 - RNA, 44 nt, Mus musculus
gcacguaccggaaacgcaucgacagcuaugucaagcggcagauc

SEQ ID NO: 34221 - RNA, 45 nt, Mus musculus
ggagggcaggagagacacugagcagugcucugguucugcccaaga

SEQ ID NO: 34222 - RNA, 41 nt, Mus musculus
ccccccaccccccgcuaaagcuugcccugucccaugcaaaa

SEQ ID NO: 34223 - RNA, 24 nt, Mus musculus
uugcuggccacacguuccugagag

SEQ ID NO: 34224 - RNA, 45 nt, Mus musculus
ucugacuugugaugguuugacccucagcauucugacuuugcaggc

SEQ ID NO: 34225 - RNA, 46 nt, Mus musculus
gggugcuccccuuaggcucugccugugagaggcauccacggcagau

SEQ ID NO: 34226 - RNA, 41 nt, Mus musculus
ggaaggagggagggaggggaggaggagagauuucacccagu

SEQ ID NO: 34227 - RNA, 42 nt, Mus musculus
guuaaacuuagaagugucagaaaagaucacagggaaagagau

SEQ ID NO: 34228 - RNA, 46 nt, Mus musculus
aagggaaaaaagauggaaagaaaauaaaguugcuaaaagcugaaga

SEQ ID NO: 34229 - RNA, 46 nt, Mus musculus
aauggaccgcaccagcuccugaguucacugcugcucagccugaggu

SEQ ID NO: 34230 - RNA, 44 nt, Mus musculus
uaugccugaucuuuacuucuacagagacccagaggagacugaga

SEQ ID NO: 34231 - RNA, 67 nt, Mus musculus
ggugaccgaucccagggcugaccaccagccacucacagaggccucuuaugucaaccugcccaccauu

SEQ ID NO: 34232 - RNA, 39 nt, Mus musculus
ucgcuggccgcuucacaccugggaccuucacuaaccaga

SEQ ID NO: 34233 - RNA, 73 nt, Mus musculus
ugcugcgggaacccacuuagguggcaccaaccuugacuuucagauggagcaguacaucuacaaaaggaaaagu

SEQ ID NO: 34234 - RNA, 44 nt, Mus musculus
ggaccuuggaacuguccuccucccagggcugcagauucugcaga

SEQ ID NO: 34235 - RNA, 42 nt, Mus musculus
aauaaaucuuguuuugugugugugugugugugugugugugug

SEQ ID NO: 34236 - RNA, 24 nt, Mus musculus
ucuaaaugagauuuaagcauccuu

SEQ ID NO: 34237 - RNA, 43 nt, Mus musculus
uuauauauuuauucauuuuaaaucccaauugcagccccugguu

SEQ ID NO: 34238 - RNA, 70 nt, Mus musculus
uuuggugguagagacuuguccuugaggaggcagggucugcccagaguucacauugccuucuaggcuucca

SEQ ID NO: 34239 - RNA, 41 nt, Mus musculus
guugagcaugucaggcauggaguuucagccucuccagagag

SEQ ID NO: 34240 - RNA, 46 nt, Mus musculus
acucucagugggaggaaaaucauuauuucccaugaaauguucagug

SEQ ID NO: 34241 - RNA, 46 nt, Mus musculus
aauccugcugcauugcucaggcaauugugugggguggggugcuuug

SEQ ID NO: 34242 - RNA, 46 nt, Mus musculus
gauggcuugauauagccagguauuuuaaauuuaauguaauguagau

SEQ ID NO: 34243 - RNA, 45 nt, Mus musculus
guaugugucugugugaauuugagacuuagcaaaggggaggcagca

SEQ ID NO: 34244 - RNA, 45 nt, Mus musculus
aagucauuuacacagagguagcaguauaguccugagcagguuguu

SEQ ID NO: 34245 - RNA, 46 nt, Mus musculus
accccucucucccgacaggucaaacugcuccuucucuauagcagau

SEQ ID NO: 34246 - RNA, 46 nt, Mus musculus
agugguucauacuguaccacagccagagagauuaccguugucuugu

SEQ ID NO: 34247 - RNA, 42 nt, Mus musculus
uugggagaaaugagauagcccagaugucccacaggcugagaa

SEQ ID NO: 34248 - RNA, 46 nt, Mus musculus
ucccagcaaccacaugguggcucacaugaugcccucuucugguguu

SEQ ID NO: 34249 - RNA, 46 nt, Mus musculus
cuuuccaagaauccuuaaaaggagaaaaggggaaggaaagggauag

SEQ ID NO: 34250 - RNA, 46 nt, Mus musculus
cacaccaaauaacaaggaugaaaugcauguauggaagcaaacaagg

SEQ ID NO: 34251 - RNA, 54 nt, Mus musculus
acagagcuaauagccuggagggcuggaccuggaaaggagggagugggccaguug

SEQ ID NO: 34252 - RNA, 45 nt, Mus musculus
acagucagugcuuuuaaucacugagccaucucuccagcccaacag

SEQ ID NO: 34253 - RNA, 24 nt, Mus musculus
aaagaugaaauuaaucaaccaguu

SEQ ID NO: 34254 - RNA, 46 nt, Mus musculus
auacuuugagaaacuagacaagcgcuaauuacugcaggcccauuau

SEQ ID NO: 34255 - RNA, 46 nt, Mus musculus
caacgucaucuuagucugcacacuaaaucacugcacacggacauga

SEQ ID NO: 34256 - RNA, 92 nt, Mus musculus
cuacuucuacagaauuuaggaaaugucugguacacuguuuucagcuuucuuuugucacagguauauccauaauagucugauuugcagaagua

SEQ ID NO: 34257 - RNA, 61 nt, Mus musculus
caaucugagaaacuacauacagaagaaaugaaaugccaagaauauuccaaaaagaauaaag

SEQ ID NO: 34258 - RNA, 43 nt, Mus musculus
uccuugcagacagccugcuaggagguguccaguccugagagug

SEQ ID NO: 34259 - RNA, 42 nt, Mus musculus
guuacauuuuaugcaacaaaacccagauguucugcagcaggu

SEQ ID NO: 34260 - RNA, 45 nt, Mus musculus
uccuugcuaaguauuacuaaacacgggcccuaccuucccuggagu

SEQ ID NO: 34261 - RNA, 46 nt, Mus musculus
gggauuguacaucaguuuuucccuucacaaauaguugaugcuaaag

SEQ ID NO: 34262 - RNA, 46 nt, Mus musculus
ggaagcagagggaugggggaggugauaggggauuuucggaggggaa

SEQ ID NO: 34263 - RNA, 46 nt, Mus musculus
uccaaauggaucaaggaacuccgcauaaaauuagagacacugaaac

SEQ ID NO: 34264 - RNA, 45 nt, Mus musculus
uaguacuugaaguucuacccagaguaauuagacaacaaaaggaga

SEQ ID NO: 34265 - RNA, 46 nt, Mus musculus
ugauaacuccaacuugugucaaguugacacacaaagccagccagua

SEQ ID NO: 34266 - RNA, 46 nt, Mus musculus
gaacucagaucugcuuaccucuaccugagauuaaaggacaguggau

SEQ ID NO: 34267 - RNA, 46 nt, Mus musculus
uugaggauuucauuacauacacuaauuucuauauccacccccuacu

SEQ ID NO: 34268 - RNA, 46 nt, Mus musculus
ggggcuguuuacuguuuacuagcguucuccaguucaaccaucagac

SEQ ID NO: 34269 - RNA, 45 nt, Mus musculus
auuuguaauucauuuuuuacacuccauauucacuuccccgcccuu

SEQ ID NO: 34270 - RNA, 42 nt, Mus musculus
guucuaaugucagcaaaagaauguuccaguuccacguuagau

SEQ ID NO: 34271 - RNA, 41 nt, Mus musculus
ucauuagcagaauuggugguucugagcaagaaacaggaaga

SEQ ID NO: 34272 - RNA, 46 nt, Mus musculus
gcagcugucuuucacaguugcucugcuccaucguuuugaugcaguc

SEQ ID NO: 34273 - RNA, 45 nt, Mus musculus
caaacuuuauaugccccaguacaggggaaugccagggccuagaag

SEQ ID NO: 34274 - RNA, 46 nt, Mus musculus
cugaugauaaugaucuaauagcaaaagggaaaugauugcugcagag

SEQ ID NO: 34275 - RNA, 45 nt, Mus musculus
aauauaaacauagaaaccuuagauuuaaacccuaguauaggaggu

SEQ ID NO: 34276 - RNA, 46 nt, Mus musculus
uuaaaagaagaagaaaaaagaaagagagaaagaaaaaaaagaagga

SEQ ID NO: 34277 - RNA, 44 nt, Mus musculus
gguaacugcccagauguuucuuguaacuccagugauagcaaagu

SEQ ID NO: 34278 - RNA, 45 nt, Mus musculus
agggaugccaggccccucucuuucguuuaauaguguggcgcagua

SEQ ID NO: 34279 - RNA, 41 nt, Mus musculus
caaguguucagagaauagauuguuuuagaggcugcaggaag

SEQ ID NO: 34280 - RNA, 46 nt, Mus musculus
aaguucucucaaaccaaaacacugugaggaaagaaugcugagaggc

SEQ ID NO: 34281 - RNA, 46 nt, Mus musculus
uugaaacaguguuacaaauauucaacaauaacuuuaaacaggaaga

SEQ ID NO: 34282 - RNA, 41 nt, Mus musculus
uucuuugcggccauggcuccaaagagagagagagagagaga

SEQ ID NO: 34283 - RNA, 89 nt, Mus musculus
ugcaagccuuaaaaauacaaacuuaugugacaagcuguuuuggcgaugaggaguaauauggucacauaauaucuugacaaagcauagau

SEQ ID NO: 34284 - RNA, 56 nt, Mus musculus
gacuacaguacuggugcuguuuugagauuugugcucuaaagugaagggggaugcaa

SEQ ID NO: 34285 - RNA, 82 nt, Mus musculus
ugggcgcaacccaguaggaggaccaagaucccacgaguagucagcagagucagggacagcccccuccccacaacccccaccc

SEQ ID NO: 34286 - RNA, 46 nt, Mus musculus
aaaaugaaggugcaggaagacuuuugugacaacauugccagcagca

SEQ ID NO: 34287 - RNA, 44 nt, Mus musculus
gugacagugaauaaaagucauagccagucauagcaacuccagga

SEQ ID NO: 34288 - RNA, 42 nt, Mus musculus
uuagguggcuuuuguuugguuguuuggauauuagagccaggu

SEQ ID NO: 34289 - RNA, 46 nt, Mus musculus
aauacuugcaggguuguauaaccagcaccauuguaucuccagagau

SEQ ID NO: 34290 - RNA, 46 nt, Mus musculus
uugcuguguuaaauucuuauuacuuagguaacaaauugccacaacu

SEQ ID NO: 34291 - RNA, 46 nt, Mus musculus
cuccuugcgcuguucuuuuauuaguugccccuaguuuggaccagaa

SEQ ID NO: 34292 - RNA, 29 nt, Mus musculus
uguguguguguguaugcaggagugcucac

SEQ ID NO: 34293 - RNA, 46 nt, Mus musculus
uucaguggugcuuauggaugguaagauaguucugucuuuaggagug

SEQ ID NO: 34294 - RNA, 46 nt, Mus musculus
cacaaacuggugagugaggccaaugcaguacaugaccugugaggaa

SEQ ID NO: 34295 - RNA, 46 nt, Mus musculus
guuccaggacagccagggcugcacagagaaacccugucuagaaaac

SEQ ID NO: 34296 - RNA, 46 nt, Mus musculus
caguuagagcugguggugguuaagaaaagaccaguauccuugaggu

SEQ ID NO: 34297 - RNA, 41 nt, Mus musculus
aagcuaugaugagacuguucaagugucuggaguagggaagc

SEQ ID NO: 34298 - RNA, 46 nt, Mus musculus
cugaagccucguccuuagucaugcgcgaacugagacacacaaagga

SEQ ID NO: 34299 - RNA, 42 nt, Mus musculus
augagcucuggacucauucccuguuucaguauggauguagau

SEQ ID NO: 34300 - RNA, 46 nt, Mus musculus
ucccacaguccacagucagaguugucucugucucagcucgagagug

SEQ ID NO: 34301 - RNA, 45 nt, Mus musculus
uggcagggagaaccugcagucccagcagagcauagggauguagag

SEQ ID NO: 34302 - RNA, 42 nt, Mus musculus
aagcaauugccacacagcaugaagaauuuggaguccccuaaa

SEQ ID NO: 34303 - RNA, 74 nt, Mus musculus
agaacugguguugcgcaggcugugcggagagcaguggcagaggcucacucagccugcgugaggugcaccacagc

SEQ ID NO: 34304 - RNA, 42 nt, Mus musculus
cuguaagagcacaaguaacaucccccauuagaugaggucaga

SEQ ID NO: 34305 - RNA, 46 nt, Mus musculus
uuucugguugucuaauuugacuccuuugaaaaauuguauauaagau

SEQ ID NO: 34306 - RNA, 42 nt, Mus musculus
uguguauauauagaucuguguguauguauuuuaagugcaaga

SEQ ID NO: 34307 - RNA, 46 nt, Mus musculus
uuacaaaguaaaguuuucauggugguguuuguggauaugugcacau

SEQ ID NO: 34308 - RNA, 47 nt, Mus musculus
uccugagaguggaguauaaaaauauucccaaacugauuuguauacag

SEQ ID NO: 34309 - RNA, 62 nt, Mus musculus
ugucauauaugagugugaguuugugugugugugugugugugugugugagagagagagagaga

SEQ ID NO: 34310 - RNA, 53 nt, Mus musculus
ucuugguuaauaauauucagguaaacuaauucauuguuaguucuuugagcugg

SEQ ID NO: 34311 - RNA, 45 nt, Mus musculus
ggaugcucacagucauccauuagauggagcacagaguccccaaug

SEQ ID NO: 34312 - RNA, 46 nt, Mus musculus
agguagaucaauggaauagagucgagacgcagaaaugaacccacac

SEQ ID NO: 34313 - RNA, 45 nt, Mus musculus
aaacuguauuugaacuugucuuaaggauaaagauggugcagaguu

SEQ ID NO: 34314 - RNA, 42 nt, Mus musculus
ggcaggacagggaagcaggaguggguggguuagugcacaggg

SEQ ID NO: 34315 - RNA, 46 nt, Mus musculus
ucuucauccucuaaauaaugauuaaaaauagaaauugccaggaggu

SEQ ID NO: 34316 - RNA, 46 nt, Mus musculus; identical to SEQ ID NO: 34315

SEQ ID NO: 34317 - RNA, 46 nt, Mus musculus
auagaaagcaagcccaaguggcuuucauagacaaagaugcugauau

SEQ ID NO: 34318 - RNA, 45 nt, Mus musculus
auuauaguuuguguauuucuguucuagagcauucuugguuccagu

SEQ ID NO: 34319 - RNA, 46 nt, Mus musculus
caaauaugagucuauuuucauuuuucuacauaucaacagccaguuu

SEQ ID NO: 34320 - RNA, 48 nt, Mus musculus
cgcaagacaccaugccuccgguucccugcagggccagacuucacucag

SEQ ID NO: 34321 - RNA, 50 nt, Mus musculus
ccuguccacuucaccccuguggaugcgugugugcaugagagagagagaga

SEQ ID NO: 34322 - RNA, 41 nt, Mus musculus
aagcauaagacuccuuguggcuaguuccaaaccaaggaaga

SEQ ID NO: 34323 - RNA, 45 nt, Mus musculus
cagcccagggauggccccacccacaaggggccuuucccccuugau

SEQ ID NO: 34324 - RNA, 90 nt, Mus musculus
gaagggggguguuuaaaguguggaggggaaggcacagcaguacaguaagaaaaggaaaagaggguuaaguaacacuauagaucuuggaaa

SEQ ID NO: 34325 - RNA, 45 nt, Mus musculus
uaguagguagucagauuugaugaaagauaccuuuaaaggccaagg

SEQ ID NO: 34326 - RNA, 45 nt, Mus musculus
caaugguuguccuucacuagaaggccuuagcaugacucagccaga

SEQ ID NO: 34327 - RNA, 46 nt, Mus musculus
gaauaucagcguaaaucuauuuuauuuucuaaauuagcagauagua

SEQ ID NO: 34328 - RNA, 46 nt, Mus musculus
accaaacuuaauuagucuauccuagauugauauuacuuggggaguc

SEQ ID NO: 34329 - RNA, 46 nt, Mus musculus
uagguauaugucagagauccccuggaaguggaauuauaggcaguug

SEQ ID NO: 34330 - RNA, 69 nt, Mus musculus
cucaagagccuagaccuguuuaacuguuuucugucucaaaauuaacaagaauauuuuuaaugggcaugg

SEQ ID NO: 34331 - RNA, 62 nt, Mus musculus
aagaagcuugaauuaagcgaaaacagaaucucaggggaccuggaaguauuggcagagaaaug

SEQ ID NO: 34332 - RNA, 57 nt, Mus musculus
ccuggauagcuguaagucaauugaaggcaaaaucgaaggccucacggaugaguuuga

SEQ ID NO: 34333 - RNA, 47 nt, Mus musculus
guuuauugauugaauucugcuggcgcaggauccucugcagaaagagg

SEQ ID NO: 34334 - RNA, 51 nt, Mus musculus
aaauuaggcuccagacaaucaaauaacccuauuaaaaaguggaguacaggg

SEQ ID NO: 34335 - RNA, 61 nt, Mus musculus
uuuaugaauucacugucuuuaauaugaguaguacucucagaucaagaauugacaaauggga

SEQ ID NO: 34336 - RNA, 46 nt, Mus musculus
cccauacuuuggucuuccuucuucugggaacuucauguggucagug

SEQ ID NO: 34337 - RNA, 46 nt, Mus musculus
ggaggauuugaauaaauaacuuuaaaaauagauuaguugggcagau

SEQ ID NO: 34338 - RNA, 50 nt, Mus musculus
aacaccuucucacacagcuacuuccacgcuaucaccuaucuuucugggca

SEQ ID NO: 34339 - RNA, 77 nt, Mus musculus
ugugacugugaaaaccuuaauucuauguuaagacaaccaugagcuucuaucauccagaagcuaguaaugucaucaga

SEQ ID NO: 34340 - RNA, 49 nt, Mus musculus
cauguaaccugaaguuaccagaaagaagaaaagucauauauaccaagag

SEQ ID NO: 34341 - RNA, 46 nt, Mus musculus
cuuuuaguucuacagauguaaaaaagagggauuaaagacagcaggu

SEQ ID NO: 34342 - RNA, 49 nt, Mus musculus
gaagauagacacagcucauuaguacucccucaccccacuccgccccacc

SEQ ID NO: 34343 - RNA, 45 nt, Mus musculus
uauaugcuucaaaauuaccacuagaggaaaaaugcaaaggcaaug

SEQ ID NO: 34344 - RNA, 46 nt, Mus musculus
aaguaggcaggcagaccuagugguuccuaguuauguagaaugggau

SEQ ID NO: 34345 - RNA, 25 nt, Mus musculus
cuuuagauuacccaacgccugugag

SEQ ID NO: 34346 - RNA, 46 nt, Mus musculus
gcuccugucaguaggcucuuguuggcauuugccauagugucuaggu

SEQ ID NO: 34347 - RNA, 42 nt, Mus musculus
cacuucuuacccgucuccucccauaucugaacuggccucccu

SEQ ID NO: 34348 - RNA, 46 nt, Mus musculus
cacagcucucgaaauugagaagcaucguggaaaugaagaucuucag

SEQ ID NO: 34349 - RNA, 45 nt, Mus musculus
cucagugcaacuagaauaggaaaauuuuugaugugacagggcagg

SEQ ID NO: 34350 - RNA, 42 nt, Mus musculus
ccucucugcucuuuauaugaauucugaauuuuguaaggagaa

SEQ ID NO: 34351 - RNA, 46 nt, Mus musculus
gcuuagaaaaauacaaacguuuucaauaugauugaaauuguaacuu

SEQ ID NO: 34352 - RNA, 26 nt, Mus musculus
gggauuuaaagaauauugaugcuaga

SEQ ID NO: 34353 - RNA, 45 nt, Mus musculus
uagcauagauccaguaaugauuccuuuuaaccugauggcccaaca

SEQ ID NO: 34354 - RNA, 57 nt, Mus musculus
gagaauuacuagacgaaaauuaaggaagacaauguuugcagaauuugaggcugaggg

SEQ ID NO: 34355 - RNA, 45 nt, Mus musculus
aagcaaaagugguugucauaaagucaguuagcaguuauuuggagu

SEQ ID NO: 34356 - RNA, 44 nt, Mus musculus
uuacuagaucugaaucaugccugaaauuaauuuuuucugaaaga

SEQ ID NO: 34357 - RNA, 46 nt, Mus musculus
guuucauauugcccaguagaauguauuguauaagaaucggguugga

SEQ ID NO: 34358 - RNA, 46 nt, Mus musculus
cuaguuuuagauuuauguauuuuacuuaauguauaaccugcaugua

SEQ ID NO: 34359 - RNA, 46 nt, Mus musculus
gguuuuuguuuguuuuuuguuuuguuuuuuagaaagaacauaaagu

SEQ ID NO: 34360 - RNA, 42 nt, Mus musculus
cuacuggcccugggggcagccucugaggucuuucggggaggg

SEQ ID NO: 34361 - RNA, 45 nt, Mus musculus
cagucugcccuacccacaguaccuggcugucaucaaagcccagau

SEQ ID NO: 34362 - RNA, 61 nt, Mus musculus
gaaggagagucuccagacuuugaugaagguugcagcccagaaucugauucagaacacuaac

SEQ ID NO: 34363 - RNA, 48 nt, Mus musculus
gcuccaguacauagucucaugauuugauucguauuuaauuggcaagau

SEQ ID NO: 34364 - RNA, 47 nt, Mus musculus
ggauuuguucuuuuucagcgauccauaaccuuaaaaaauguucagga

SEQ ID NO: 34365 - RNA, 45 nt, Mus musculus
acuuauguauccaaucccagcacuuuggaggcagaggcuggcaga

SEQ ID NO: 34366 - RNA, 45 nt, Mus musculus
auggugugguuuaugccuauaauuccagcauuuaggaguuuaaga

SEQ ID NO: 34367 - RNA, 44 nt, Mus musculus
acagagcuaaaggaaaaccugaugcagugaaaaagggggugguc

SEQ ID NO: 34368 - RNA, 46 nt, Mus musculus
uccccauauauaacuauuuugugcuguguaccaauaagaaccugcu

SEQ ID NO: 34369 - RNA, 45 nt, Mus musculus
auuuucuaagugucugagguccacccuugucuccugccuccuccu

SEQ ID NO: 34370 - RNA, 42 nt, Mus musculus
gcacguucuagugcaggaggaguucaccuacuacccccauuc

SEQ ID NO: 34371 - RNA, 49 nt, Mus musculus
uuuucccuuuucccuuuucccuuuccccuuuccccuuuccccuuucccc

SEQ ID NO: 34372 - RNA, 45 nt, Mus musculus
ugugcucauuccucuggguggaugcacacgugugugggugcaagu

SEQ ID NO: 34373 - RNA, 46 nt, Mus musculus
cagaugagcaugaugcuauggauggagaacuauccugccggugagu

SEQ ID NO: 34374 - RNA, 46 nt, Mus musculus
aggccuguugucaugcacuguagucugcuagaguuagcaggcagua

SEQ ID NO: 34375 - RNA, 46 nt, Mus musculus
auauaauuauaguuuauguuuauucuuaguguguauuucaagagau

SEQ ID NO: 34376 - RNA, 24 nt, Mus musculus
auucccauucacaaacaggaagca

SEQ ID NO: 34377 - RNA, 46 nt, Mus musculus
uugugagugucuuuacuacugaggcauguuucuuggacacacagau

SEQ ID NO: 34378 - RNA, 46 nt, Mus musculus
ugaaugggauuuuuaaccuccugauuuuucccuuuagcaagugcau

SEQ ID NO: 34379 - RNA, 92 nt, Mus musculus
uuuguauucuagaaauaugaaugaccuuaagacauaucauaugaaaaugcaugaaauuaaaaggcuuaugcaggcaucuggaauagucagca

SEQ ID NO: 34380 - RNA, 45 nt, Mus musculus
ggucuuggguauggcaguaacugucuguaauagcagcacucagaa

SEQ ID NO: 34381 - RNA, 46 nt, Mus musculus
uaaagacaaacuaucagcugggagaguuaguuuuggugaaggagua

SEQ ID NO: 34382 - RNA, 46 nt, Mus musculus
uuuucauuuuauuuuuuuacaauauuuuuuauuuacuccaacaauu

SEQ ID NO: 34383 - RNA, 46 nt, Mus musculus
guuuuaggugacugugauagaagucacguguugugcuccgcgucug

SEQ ID NO: 34384 - RNA, 46 nt, Mus musculus
uuuguugauuuuauauauaugagcacaccagaagagggcagcagau

SEQ ID NO: 34385 - RNA, 70 nt, Mus musculus
cggaagagcacaugugagggaauuagaaggugaagccauaugguugggauuugauuacuggaaguucuag

SEQ ID NO: 34386 - RNA, 138 nt, Mus musculus
cccuagagagagaaacaagguaaagcacuccugagacaagaauagaacauuugccacauaauuuaacaauucaguaaauaacuuggaagagaaaguuaaugaaauuuacaaaauagaauuuaaaaagcaagauauaga

SEQ ID NO: 34387 - RNA, 41 nt, Mus musculus
gcaagaggaacuaggcuuccucaggguagaugugggguaag

SEQ ID NO: 34388 - RNA, 46 nt, Mus musculus
cuuuaaaucuucaggaucaagaucaacagagucugguaaugcaggu

SEQ ID NO: 34389 - RNA, 31 nt, Mus musculus
gguguucuguaggggacauuugagaguuagg

SEQ ID NO: 34390 - RNA, 46 nt, Mus musculus
gauaacucuaguuugugucaaguugacauaaaacuauccaucauac

SEQ ID NO: 34391 - RNA, 46 nt, Mus musculus
gccuccucauaucaaucaugaguuagaaaaugccauacagccagau

SEQ ID NO: 34392 - RNA, 44 nt, Mus musculus
uauuuauucaguuccauguaaagguucaucaucaaaugcaguga

SEQ ID NO: 34393 - RNA, 46 nt, Mus musculus
gaugauugugggaacaaggauagacuugcaggaaauguuugcuagc

SEQ ID NO: 34394 - RNA, 45 nt, Mus musculus
uguggugaaaggcuggaaucccaggacuugggaaguagaggcaag

SEQ ID NO: 34395 - RNA, 45 nt, Mus musculus
agugccacuucucaugggccaagcauauucaaaccaccaccaaac

SEQ ID NO: 34396 - RNA, 46 nt, Mus musculus
aagccuucccacacagugacacacuuccuccaaaaaggccacacuu

SEQ ID NO: 34397 - RNA, 45 nt, Mus musculus
gaauugaauuuuaaaagauggacguguauuuauagaguucgagaa

SEQ ID NO: 34398 - RNA, 46 nt, Mus musculus
uuuuuugccaacuuguaaucuagagggaaaaauauuuuggcaagaa

SEQ ID NO: 34399 - RNA, 42 nt, Mus musculus
ugaguggaaggcaggagucuguaacauuaaccgcaggaacaa

SEQ ID NO: 34400 - RNA, 46 nt, Mus musculus
guggcuuggcagugugugacacacaguguucauuguugcuggagug

SEQ ID NO: 34401 - RNA, 56 nt, Mus musculus
ugccuaucauuauugcaaauuaauaauacucuucaauuaaaaauuagguggaaggu

SEQ ID NO: 34402 - RNA, 45 nt, Mus musculus
gucucuucacaaaccugggugcugucagauggcaugccagcaguu

SEQ ID NO: 34403 - RNA, 46 nt, Mus musculus
auuagacuugagugcagauauucauaguuaauauauccaugcagau

SEQ ID NO: 34404 - RNA, 42 nt, Mus musculus
ccaaauccauuccaugcaccgaaagcugcagugcccucagca

SEQ ID NO: 34405 - RNA, 45 nt, Mus musculus
gguagucugcuaccuagcacacuaucaguugaauccugccuaguc

SEQ ID NO: 34406 - RNA, 45 nt, Mus musculus
aaauuuucuuucuaaaaacuuuagugaauucauuucuugaucaga

SEQ ID NO: 34407 - RNA, 45 nt, Mus musculus
guggcauuacaucuguuuauuuuagauuuauauuacggaaaugau

SEQ ID NO: 34408 - RNA, 46 nt, Mus musculus
uagacauacaagaggaaguuaaaaguaggcauuggacauuguuggc

SEQ ID NO: 34409 - RNA, 87 nt, Mus musculus
uaaucuaugaagguucuaaaauguagcuucucuuugccacaggguaggaugcucuccuggcuccauaugugugugccacugcaagac

SEQ ID NO: 34410 - RNA, 46 nt, Mus musculus
ugauuuggggaagguaggugucagugugaaguguguggcagucacu

SEQ ID NO: 34411 - RNA, 46 nt, Mus musculus
uuuuauuuacuguuuuguuuuguuuuauuuuuaaggguuccccagc

SEQ ID NO: 34412 - RNA, 46 nt, Mus musculus
uucuuacuucuaaaguaauuuagaaccaggaaauagacccacauuu

SEQ ID NO: 34413 - RNA, 50 nt, Mus musculus
gugugggcaaagcaaagaauuguggaagaccguugcauacugugaaaauc

SEQ ID NO: 34414 - RNA, 48 nt, Mus musculus
gacucuagcgggaauuguaggaacuguauguagauacccagguaguga

SEQ ID NO: 34415 - RNA, 48 nt, Mus musculus
ggcucaguauacuucugugggaugaagaccggcagagugcgggagcca

SEQ ID NO: 34416 - RNA, 42 nt, Mus musculus
cgggcugggcguaagggccggauggcggccccuccgccccag

SEQ ID NO: 34417 - RNA, 44 nt, Mus musculus
guauaugugauaaggacauaaaaaauaaucacuggugccugaga

SEQ ID NO: 34418 - RNA, 46 nt, Mus musculus
uggaaaaaaaaguaaguugauaaauuauauuaaauuacuacaguag

SEQ ID NO: 34419 - RNA, 46 nt, Mus musculus
uuauugcauucuaaggacugagacuuugaaugccacugcaucugag

SEQ ID NO: 34420 - RNA, 46 nt, Mus musculus
ugguuccuucacuugguuuucaacucagugucucaaacacccggga

SEQ ID NO: 34421 - RNA, 46 nt, Mus musculus
cagucuuggguucuguguauguguguggaggggguguucuguccaa

SEQ ID NO: 34422 - RNA, 45 nt, Mus musculus
caugcuaaugauaugaauuguuccuuugugagacgaagggggaag

SEQ ID NO: 34423 - RNA, 66 nt, Mus musculus
uggucaacagaaguguucauggcagccuuagcuacagcggccagaugugagaacaacccaagagcc

SEQ ID NO: 34424 - RNA, 45 nt, Mus musculus
gugcagagugcugagguuuccuggagaaucuugccccugggauuu

SEQ ID NO: 34425 - RNA, 86 nt, Mus musculus
accccuaccaggcucccauagcaacauuaccuuucccgguuaucacucagucuuucagaauuauuuuaaguccugugcucucugua

SEQ ID NO: 34426 - RNA, 58 nt, Mus musculus
caggcgaacaguuguugaauggauggacuaacagaagauaggcagaugggacucaauc

SEQ ID NO: 34427 - RNA, 72 nt, Mus musculus
guauuagacagagucaaaauauuuuccuuaagacccagaggaaaagaaaacacuggccuucauccuaagaaa

SEQ ID NO: 34428 - RNA, 45 nt, Mus musculus
acguugugguucaaucugauagucacguuguaguucugucugaua

SEQ ID NO: 34429 - RNA, 45 nt, Mus musculus
uuuuuuuuaaagauuuauuaauuuauuauaugcaaguacacugua

SEQ ID NO: 34430 - RNA, 45 nt, Mus musculus
uucugcuucucgaguuccuuuagaaaaaugauaaauugugacgag

SEQ ID NO: 34431 - RNA, 45 nt, Mus musculus
uauggaucaaagacaggucauugacauaggauacuuuacaaaaaa

SEQ ID NO: 34432 - RNA, 45 nt, Mus musculus
uagcugcagcuugcaggucuguguguccaugggguauuuagacag

SEQ ID NO: 34433 - RNA, 46 nt, Mus musculus
acaacaugacagaacacacucacucuccagcagaauauauuaguag

SEQ ID NO: 34434 - RNA, 51 nt, Mus musculus
aacaaaaacccucucaaacaaacaaacaccccaaauccaaaccaaaaugac

SEQ ID NO: 34435 - RNA, 46 nt, Mus musculus
gagcccagacaggaguccuggucuccuggauccuugguggcaucga

SEQ ID NO: 34436 - RNA, 44 nt, Mus musculus
uuuaccagauuuauuaaguacagugcuggguacucuagaggcag

SEQ ID NO: 34437 - RNA, 45 nt, Mus musculus
cuuugugugcaaacagguucccauggaagcuuggaaaaaaggcag

SEQ ID NO: 34438 - RNA, 45 nt, Mus musculus
cuauauaugcauauauuauacuggugcgguacucaucggcagcaa

SEQ ID NO: 34439 - RNA, 45 nt, Mus musculus
ucuggcaucugccacucuguuucugauuuacuugaaaggacauua

SEQ ID NO: 34440 - RNA, 74 nt, Mus musculus
gcgauguccagagucagugcuauccgaacugggucaccugagaaggaagaaaaaaaaaacagaaagacuuacau

SEQ ID NO: 34441 - RNA, 49 nt, Mus musculus
acuccgcagccgguguaucuacauuaguggguuggaaacaaaacucgag

SEQ ID NO: 34442 - RNA, 49 nt, Mus musculus
gguaugaaaaauauaaagaguuauacagggacaucaugauucauaaggg

SEQ ID NO: 34443 - RNA, 46 nt, Mus musculus
uuaaggcagggucucucucuuauuggugcuacacagcaagcccaag

SEQ ID NO: 34444 - RNA, 46 nt, Mus musculus
agagagagggggagagggagagggagagggagaggagaggagagga

SEQ ID NO: 34445 - RNA, 45 nt, Mus musculus
cagaagccaggagaguaaggaugcugguggguguuuuaguggcau

SEQ ID NO: 34446 - RNA, 64 nt, Mus musculus
cucaauuuucuuugccaggcuggaagacagaaacccccagagauccucuuaucuucuucugacu

SEQ ID NO: 34447 - RNA, 88 nt, Mus musculus
cuggaaccuggacuccaguccucuugauuacacaguaagcacccuuagccacugagccaucuccccuauuucuuucaccaagggccuu

SEQ ID NO: 34448 - RNA, 45 nt, Mus musculus
uggggaacagccucguugcaacuguuuaguuuagcaccugcccac

SEQ ID NO: 34449 - RNA, 48 nt, Mus musculus
gaugguugugagcuaucaugugguuguugggauuugaacuuaggaccu

SEQ ID NO: 34450 - RNA, 45 nt, Mus musculus
gcgcagucaaugcucuuaaccacugagccaucucuacagccccag

SEQ ID NO: 34451 - RNA, 46 nt, Mus musculus
ugcuggcaugugugucuaugcaccauaugcaugcaaugcccaugga

SEQ ID NO: 34452 - RNA, 46 nt, Mus musculus
gaaacaaaggaaaugcuuagucccucugucauuucucauaccccag

SEQ ID NO: 34453 - RNA, 46 nt, Mus musculus
uuuggguguuaaguaugcacccagucuccgauggaguggcgcgcuc

SEQ ID NO: 34454 - RNA, 46 nt, Mus musculus
gggaagagauguagacaggacuggaggagagcugagaaagggcugg

SEQ ID NO: 34455 - RNA, 46 nt, Mus musculus
ccagccucucuccucauaagaaccugcaucuggauacacagccgaa

SEQ ID NO: 34456 - RNA, 42 nt, Mus musculus
guugaaaaugaaagggcacauugaugugucggugggaggaag

SEQ ID NO: 34457 - RNA, 46 nt, Mus musculus
ccugagaaacuauaaaccaacuugucauuaugucucuaguacagug

SEQ ID NO: 34458 - RNA, 46 nt, Mus musculus
cgcagacugaguuugaacagcaggagcgguuguuugccaugauaga

SEQ ID NO: 34459 - RNA, 45 nt, Mus musculus
ggcggcggaccccaauagcaaagggaacucgcuguucgcagaggu

SEQ ID NO: 34460 - RNA, 46 nt, Mus musculus
agagcagcuagaaugucucaauacuuccuuacugcaccagguagac

SEQ ID NO: 34461 - RNA, 46 nt, Mus musculus
uggguugggaaccaauaauaaauacugaaucaacugcugagugaga

SEQ ID NO: 34462 - RNA, 41 nt, Mus musculus
aaagagagaaagagagaaagagagaaagaaaagaaaauuaa

SEQ ID NO: 34463 - RNA, 46 nt, Mus musculus
ggagcagcuagaggugcagcuacauaggagccaccggcaggaagug

SEQ ID NO: 34464 - RNA, 46 nt, Mus musculus
uucuaaaccucugagugcuccauggccuuucaccaagccuuuagug

SEQ ID NO: 34465 - RNA, 46 nt, Mus musculus
cuucacaaguuuuguagaguuccgccauuucucacuaccuacugug

SEQ ID NO: 34466 - RNA, 46 nt, Mus musculus
ccaguggugcagucugaauuaacuuacaauuauguagcagacacac

SEQ ID NO: 34467 - RNA, 46 nt, Mus musculus
uccggacaggccuccgguugcagcagccaggaagcgugaggagaga

SEQ ID NO: 34468 - RNA, 46 nt, Mus musculus
aacacuuaaaugugagugcuuagaacuguaauccuuugggucagac

SEQ ID NO: 34469 - RNA, 46 nt, Mus musculus
accuugcaaaccagauggugagaguuaguuaguuugacauagaguc

SEQ ID NO: 34470 - RNA, 42 nt, Mus musculus
cucuccuggaggaucccaggaucaaagcaauugcagccaagu

SEQ ID NO: 34471 - RNA, 45 nt, Mus musculus
cuugaacaaaccuggcuuaaaauauaagccugcggugaaccagau

SEQ ID NO: 34472 - RNA, 42 nt, Mus musculus
guggacacuuggacggcuauggaacaacuaguggaugaaggu

SEQ ID NO: 34473 - RNA, 42 nt, Mus musculus
gacugaggccgugaagguugcuauugacuugggguaccgcca

SEQ ID NO: 34474 - RNA, 46 nt, Mus musculus
cugaagcuaucaauauacaagagccaacaaacaaaacaacagcaag

SEQ ID NO: 34475 - RNA, 45 nt, Mus musculus
auggggaaguugaaaagcuugaagaaagugcugugacuguuaugu

SEQ ID NO: 34476 - RNA, 46 nt, Mus musculus
uuucaacuuccccauacagaacaggaauucucaacacagcagcccc

SEQ ID NO: 34477 - RNA, 46 nt, Mus musculus
uauauggaaaaacaaaauuagauggagaaaaagcaguccuggagaa

SEQ ID NO: 34478 - RNA, 46 nt, Mus musculus
aggaugcagaucuucuaaagaaaaggcuuuuuuaaugcaagaacag

SEQ ID NO: 34479 - RNA, 46 nt, Mus musculus
aacacauacauguaguaccuguggaagucagaaaagggugccugau

SEQ ID NO: 34480 - RNA, 46 nt, Mus musculus
ggggaaucugggauguuucaaauacaauauccuaggcccgccccag

SEQ ID NO: 34481 - RNA, 45 nt, Mus musculus
gucuggggcgggccuaggauauuguauuugaaacaucccagauuc

SEQ ID NO: 34482 - RNA, 90 nt, Mus musculus
uuucagcuuugguucucucuaagugugauucuggaagcaugaguauuagaaacacacagaagccugauugcagacugcaugcccagagug

SEQ ID NO: 34483 - RNA, 46 nt, Mus musculus
auuuuccucuaacuuuugucagguuacagcaaacagguuacugaag

SEQ ID NO: 34484 - RNA, 45 nt, Mus musculus
cuuaggacuugccuggcuuauacagaaagugugugcuugguuugg

SEQ ID NO: 34485 - RNA, 46 nt, Mus musculus
uuugcucuguaugcauauguguguacuaccugcauugccuggggag

SEQ ID NO: 34486 - RNA, 45 nt, Mus musculus
uucuggucauacgugugugugugugugugugugugugugugugug

SEQ ID NO: 34487 - RNA, 45 nt, Mus musculus
aaaaaaucaucugaugcaggagggucucaaugaauucaagaccag

SEQ ID NO: 34488 - RNA, 26 nt, Mus musculus
augugaccaaaggugugugcguauga

SEQ ID NO: 34489 - RNA, 46 nt, Mus musculus
uuuuaauuugggggaggguccugugcuugcuagaguuacuagagau

SEQ ID NO: 34490 - RNA, 45 nt, Mus musculus
gcccguuaaguacuuacugaccuacagaauguauccagcacaguc

SEQ ID NO: 34491 - RNA, 46 nt, Mus musculus
caauuucuuucagcagucuuccaccacgcaaaauacagcgguucag

SEQ ID NO: 34492 - RNA, 45 nt, Mus musculus
auaagaaaaggcucuguuuacagccaaugucugacuuccgauggg

SEQ ID NO: 34493 - RNA, 46 nt, Mus musculus
aacuauuuuggggaaacgcagcgagagggaucugggcgucuggcuc

SEQ ID NO: 34494 - RNA, 46 nt, Mus musculus
guguguaauauaaaauaaaguaauauaaaaacucauacacccaauc

SEQ ID NO: 34495 - RNA, 46 nt, Mus musculus
cagaaaacacuucccuccuaugacuaggcaggccuuuuacucagau

SEQ ID NO: 34496 - RNA, 65 nt, Mus musculus
gccaagccucagcugcucuuuaugucuucaaaaccaguaugacucuuaaacauaaccaaguccag

SEQ ID NO: 34497 - RNA, 52 nt, Mus musculus
guagucauuuaugguacuggcaucuccaaaacacuguugucuuugcuguaac

SEQ ID NO: 34498 - RNA, 46 nt, Mus musculus
cauuacuauuaagccucaacccuuacuuucuuauuaauccccauga

SEQ ID NO: 34499 - RNA, 46 nt, Mus musculus
uugcucagcuugcuuucuuacagaacccaagucuaccagccuagag

SEQ ID NO: 34500 - RNA, 45 nt, Mus musculus
guuucuguuccugcauaaacaucagaccaagaaacaagcugggga

SEQ ID NO: 34501 - RNA, 42 nt, Mus musculus
uuguuaaaaggaaacaaaaugagcucagacuucagggagaau

SEQ ID NO: 34502 - RNA, 74 nt, Mus musculus
uacuucauauuugaucagaaaagugcacacauaacuguggaaggacaagaaauuuuaaaauucuuuauuuugcc

SEQ ID NO: 34503 - RNA, 46 nt, Mus musculus
aaaucaaacauguugugaaauugaaagaugaaaauagccaacucaa

SEQ ID NO: 34504 - RNA, 51 nt, Mus musculus
ugaaaaaucaacucagacaacaagaugaagacuuuaggaagcagcuggaag

SEQ ID NO: 34505 - RNA, 45 nt, Mus musculus
uacccgcgcaaaaucugcucugugggugcagugcuccguggagac

SEQ ID NO: 34506 - RNA, 46 nt, Mus musculus
uuugcugcaucucucuugguuuuugucaggacaaugcggaccauuu

SEQ ID NO: 34507 - RNA, 43 nt, Mus musculus
guuaggguuaggguuaggguuaggguuaggguuaggaggccga

SEQ ID NO: 34508 - RNA, 46 nt, Mus musculus
cugcuccauccuucuccucaucaacugcauuaaguugccagcaccu

SEQ ID NO: 34509 - RNA, 46 nt, Mus musculus
auccaguuauuaagacaguaaagacaauucucucaaaugggauuag

SEQ ID NO: 34510 - RNA, 46 nt, Mus musculus
gugaauucaaaucuaagcguagcucucccaagcuuagaaucaggag

SEQ ID NO: 34511 - RNA, 97 nt, Mus musculus
aaacugcgagcugcuaaaggugaacuggugauaucucagacgcaugaucauguauuuccugcgggggguggugagguaugugcauaugugagagaac

SEQ ID NO: 34512 - RNA, 46 nt, Mus musculus
ugucuuggaacucacuguguagaccagccuggcuuugaacucagag

SEQ ID NO: 34513 - RNA, 42 nt, Mus musculus
agguauggggauccccucuugcgugcgugugugccggccagu

SEQ ID NO: 34514 - RNA, 46 nt, Mus musculus
uguuggguuguuugugucuuguccuauguuucugaaguacggcgaa

SEQ ID NO: 34515 - RNA, 49 nt, Mus musculus
cccaccucgugcuuugguuuuacaccuggcagagugagaaacaagugag

SEQ ID NO: 34516 - RNA, 41 nt, Mus musculus
guggguagucgaagcauuucugcggggcggcggcaggagag

SEQ ID NO: 34517 - RNA, 46 nt, Mus musculus
uuuuguuacuuugggacuuccccaacucuguucaauaaucacaguu

SEQ ID NO: 34518 - RNA, 47 nt, Mus musculus
uuagccccuuugcugaucuucucaaagcccuccuuggcaauagaucg

SEQ ID NO: 34519 - RNA, 46 nt, Mus musculus
aggaacucaagggcuggaaccuggaggcaggaacugaagcagaggc

SEQ ID NO: 34520 - RNA, 82 nt, Mus musculus
uggagggaguguggcugguaccccagugagggcaagaugaagaugagaagagaagaugaagagaagaugaagaugaagagag

SEQ ID NO: 34521 - RNA, 46 nt, Mus musculus
cuccacucuggauguugaauugccgccuguuuguuacgaugcagau

SEQ ID NO: 34522 - RNA, 46 nt, Mus musculus
aggaugaaaguuagcagcuaauguuuguuauggaugauggcuagaa

SEQ ID NO: 34523 - RNA, 46 nt, Mus musculus
aucucacuucuccccuugaauggcgugccucucaugacccugaaug

SEQ ID NO: 34524 - RNA, 46 nt, Mus musculus
uugugugaguucaaggccaaccugauuuacagagcaaguuccagga

SEQ ID NO: 34525 - RNA, 46 nt, Mus musculus
gcaaaccccuccaaccaaaacagccgaccuugacugggaaaaaggu

SEQ ID NO: 34526 - RNA, 46 nt, Mus musculus
ccagcggucucucuucccaucauagucaaacaucagcuggggcugg

SEQ ID NO: 34527 - RNA, 45 nt, Mus musculus
acucuucuugcaguuucugugcuuucaauguccguuuugccuaaa

SEQ ID NO: 34528 - RNA, 46 nt, Mus musculus
agaguuggguuccucuucuccccacugguguuucggagaguucugc

SEQ ID NO: 34529 - RNA, 45 nt, Mus musculus
cccaauauucuuugccucacaacuuuacuguuuccccaucaagag

SEQ ID NO: 34530 - RNA, 54 nt, Mus musculus
accaugcacagaggucugguuguaguuugcaguaccacagaaaguggaaagggc

SEQ ID NO: 34531 - RNA, 45 nt, Mus musculus
agaagaagaaggagaaggagaaggagaaggagaaggagaaaaaga

SEQ ID NO: 34532 - RNA, 45 nt, Mus musculus
agaagacagacaacuggcaugcuaaauugacuguaguccuuagau

SEQ ID NO: 34533 - RNA, 45 nt, Mus musculus
acuuacaacaguaaaacaagacgccccaguucucuuucccauggc

SEQ ID NO: 34534 - RNA, 42 nt, Mus musculus
gccgggggcaggcaauggcaggggaugugugauugcggacag

SEQ ID NO: 34535 - RNA, 46 nt, Mus musculus
ucugcagcuacauuggccgcuggcggcgugcgagccgggauggacc

SEQ ID NO: 34536 - RNA, 94 nt, Mus musculus
gagaggcagagcggagacgagcaaccucaagaaaaacagcaaagauaggaagagcagcggaaagagaagcccaaaguaagaaaacacggggaga

SEQ ID NO: 34537 - RNA, 46 nt, Mus musculus
aaguggccaaagcagcugcuaaagcuggucaaaagcaucaacauaa

SEQ ID NO: 34538 - RNA, 45 nt, Mus musculus
uuaucucuggcucacuuguuugcuuucggugggauggccuguauu

SEQ ID NO: 34539 - RNA, 42 nt, Mus musculus
uugcugccuaccucuaucagucccacuaugucaacucgggau

SEQ ID NO: 34540 - RNA, 46 nt, Mus musculus
cauccuggaaggugaugauguggugaggugcugaggagaugcagaa

SEQ ID NO: 34541 - RNA, 45 nt, Mus musculus
uugguuuuguuuuuguuuugaaaggugacccugccugcugggaga

SEQ ID NO: 34542 - RNA, 46 nt, Mus musculus
ccagcaggcagggucaccuuucaaaacaaaaacaaaaccaauacag

SEQ ID NO: 34543 - RNA, 42 nt, Mus musculus
aucucuuaggggccaaauggccugugguuuauugggcaacag

SEQ ID NO: 34544 - RNA, 45 nt, Mus musculus
gaaauauacaagaccuuacacuuaaaaaaaauaaucugccugaga

SEQ ID NO: 34545 - RNA, 46 nt, Mus musculus
uuggauguugggcauccucaggaaggauccgagaaacaaagcggag

SEQ ID NO: 34546 - RNA, 45 nt, Mus musculus
cacacacacacacacacacacacacacacacacacauucggcccc

SEQ ID NO: 34547 - RNA, 45 nt, Mus musculus
aaccauucagcaaaccaauaaaaggcugguuuugcucugggagag

SEQ ID NO: 34548 - RNA, 41 nt, Mus musculus
cucuguguguauuuguaucugugugugugugugugugugug

SEQ ID NO: 34549 - RNA, 46 nt, Mus musculus
aaaaaaaacaaccaaccaaccaaccaaacaaacaaaaaaccaaaag

SEQ ID NO: 34550 - RNA, 45 nt, Mus musculus
aacaauaacaauaaaggccaggcaggugcuugucaucgcaaagau

SEQ ID NO: 34551 - RNA, 118 nt, Mus musculus
guauguguauguauguguguguauguguauguauguguguauguguguguguauauguguauguauguguguguauguauguguguauguguguuauguguguauguguguuaugugu

SEQ ID NO: 34552 - RNA, 59 nt, Mus musculus
uguauauguguguguauguguguguguguauauguguguauaugugguaugugugugug

SEQ ID NO: 34553 - RNA, 42 nt, Mus musculus
gauaauggcacuaaccagcuauguaaaggcugcagaccagac

SEQ ID NO: 34554 - RNA, 46 nt, Mus musculus
auucuuuauaaauggagacacaggaguccauggugauuaagaugga

SEQ ID NO: 34555 - RNA, 42 nt, Mus musculus
uuugaguuggguucucuuguuuggggccaagcauacagccag

SEQ ID NO: 34556 - RNA, 45 nt, Mus musculus
gauggauggauggauggauggauggauggauauacauuugggcag

SEQ ID NO: 34557 - RNA, 45 nt, Mus musculus
ccugauuacuaaauacuaaaugaauagguucuagguuggggguga

SEQ ID NO: 34558 - RNA, 46 nt, Mus musculus
guggagaagacacagacaauuacaguagagcaaggugagcugcuag

SEQ ID NO: 34559 - RNA, 42 nt, Mus musculus
auuauuaugguagaugccuugcuuuggacuggauccggggau

SEQ ID NO: 34560 - RNA, 60 nt, Mus musculus
cccagcacuugggaggcagaggcagaggcagagaggcagagagagaggcagaggcagaga

SEQ ID NO: 34561 - RNA, 46 nt, Mus musculus
cccugucucaaaaaacaaacaaacaaaacaaaacaaaaaaacccag

SEQ ID NO: 34562 - RNA, 46 nt, Mus musculus
uucguucucaaagccuuuccuggugugauugggccagagucuauga

SEQ ID NO: 34563 - RNA, 45 nt, Mus musculus
cuggcaugcauuaggguuuucaggaaaugauuuguguguggagau

SEQ ID NO: 34564 - RNA, 41 nt, Mus musculus
uccagcugugacccacaucuccacaaagcuucuugccccac

SEQ ID NO: 34565 - RNA, 45 nt, Mus musculus
agacccauucuugaguuguggguauggaaguaggaggggcugagc

SEQ ID NO: 34566 - RNA, 41 nt, Mus musculus
ccucacuggcugaagcacauccuuacugaacccugggccaa

SEQ ID NO: 34567 - RNA, 45 nt, Mus musculus
cuagcucuuuuguguacaggucucucauggcccucagagguugga

SEQ ID NO: 34568 - RNA, 46 nt, Mus musculus
gagcuagggacccaggaaggaaggugcagguguggagggauucggg

SEQ ID NO: 34569 - RNA, 42 nt, Mus musculus
acagaggcaaaaccuggaaugauguaacgcagucaaggagca

SEQ ID NO: 34570 - RNA, 46 nt, Mus musculus
cuuacauccuuuguguccuuucauccaggaaacauaugggccguua

SEQ ID NO: 34571 - RNA, 46 nt, Mus musculus
cuagcacaggaaaggagugaaugaguucgaagggcagacugaggag

SEQ ID NO: 34572 - RNA, 46 nt, Mus musculus
ucucucacugcuuucauuucuagaagcucaauucaaugguccugga

SEQ ID NO: 34573 - RNA, 46 nt, Mus musculus
gccauggugcauucaagucuccagcuuucaagucauccuggcuaca

SEQ ID NO: 34574 - RNA, 46 nt, Mus musculus
aguuaugaaguagcaacaggaggaacuguauugaagggcggcagca

SEQ ID NO: 34575 - RNA, 46 nt, Mus musculus
agguacuguuucuguaaugauaaacugaccuauagaguacucugga

SEQ ID NO: 34576 - RNA, 46 nt, Mus musculus
auaagaaacugguaguuuauggcugcauccagaaacgggguaagau

SEQ ID NO: 34577 - RNA, 46 nt, Mus musculus
cuaggucgguuuugugauguguuuccaacuuagaacuaagccuuag

SEQ ID NO: 34578 - RNA, 41 nt, Mus musculus
gaucaguggaggcccuuaggauaaaugauggagcaggggga

SEQ ID NO: 34579 - RNA, 45 nt, Mus musculus
gucguuaggccuggggugaguccccaagggcuauagugacgggag

SEQ ID NO: 34580 - RNA, 47 nt, Mus musculus
accuagccugucuguggaauccaaguucccugguagauggcagagga

SEQ ID NO: 34581 - RNA, 47 nt, Mus musculus
guucacugggcuuggggucugaggagaaccaugaggggagaagaugg

SEQ ID NO: 34582 - RNA, 23 nt, Mus musculus
agcugcuggcauggggcaguuga

SEQ ID NO: 34583 - RNA, 58 nt, Mus musculus
caucgagcccgucccuaacagcgacagccaacaccguauuuacagauccgaacaucuc

SEQ ID NO: 34584 - RNA, 46 nt, Mus musculus
acugggcccuucaguuuacacaucagaccaaaaagcaaccucgcag

SEQ ID NO: 34585 - RNA, 39 nt, Mus musculus
uuccuuacuguuuaaaauggcuagaagagggcuggagag

SEQ ID NO: 34586 - RNA, 41 nt, Mus musculus
augagauccagucuaagcaaagcccgugcuuccguggcugu

SEQ ID NO: 34587 - RNA, 46 nt, Mus musculus
cauggauugugggacccccacccugaugaucugggguucgagagau

SEQ ID NO: 34588 - RNA, 25 nt, Mus musculus
uaucauggucuccuguccucucuac

SEQ ID NO: 34589 - RNA, 45 nt, Mus musculus
agggaguucuagcccagguuugagagcuuauuuucagagcuagag

SEQ ID NO: 34590 - RNA, 42 nt, Mus musculus
ggucuguugcuggguagcuagacucccagcaaaccaggcaag

SEQ ID NO: 34591 - RNA, 42 nt, Mus musculus
ucugagcaugcaggaagaugaaucaagggaaggauguaguau

SEQ ID NO: 34592 - RNA, 42 nt, Mus musculus
cgaagcaucccucuggcugcugugaguuccgagcccggagau

SEQ ID NO: 34593 - RNA, 24 nt, Mus musculus
gcaguggcucucugccugggccaa

SEQ ID NO: 34594 - RNA, 49 nt, Mus musculus
ggguggauccuggcacauucccucauuuauuaagugaaauagaaugcaa

SEQ ID NO: 34595 - RNA, 44 nt, Mus musculus
acauagggcuguaaagaacuuuggugguaccagcaggauguaag

SEQ ID NO: 34596 - RNA, 44 nt, Mus musculus
ucagaaaggguaacacugaagcacauauuuuuuaagacuggagg

SEQ ID NO: 34597 - RNA, 41 nt, Mus musculus
cccuugccaaaccaauacucuagggcaccucauuuggguau

SEQ ID NO: 34598 - RNA, 46 nt, Mus musculus
gaagaagauaaucacaucugcucugguugcuuccuugcccugggag

SEQ ID NO: 34599 - RNA, 57 nt, Mus musculus
uaugucaguaaacacaucaaacaaauaaacaauaauaacuacagaaaaagcaaagau

SEQ ID NO: 34600 - RNA, 41 nt, Mus musculus
cagccccgcagcugcauccagcauccuugcuuuugccccca

SEQ ID NO: 34601 - RNA, 45 nt, Mus musculus
uuugggcacuuucugagggggaaagugaccuuuuuuugcuacuau

SEQ ID NO: 34602 - RNA, 45 nt, Mus musculus
aacaaaugagcagagagacgaggcuuccuuuauaucucguccagg

SEQ ID NO: 34603 - RNA, 34 nt, Mus musculus
aagacggugaagaaugugacuguggagaagagga

SEQ ID NO: 34604 - RNA, 42 nt, Mus musculus
ggaguguuggaaguacugucaggucaggggagaucugccgag

SEQ ID NO: 34605 - RNA, 46 nt, Mus musculus
ucugucaucuuuauuagaaggauguuuuucugaaaaagaagaagaa

SEQ ID NO: 34606 - RNA, 42 nt, Mus musculus
cgccacccacuaggcugucaccucaaagccugaggcagagga

SEQ ID NO: 34607 - RNA, 42 nt, Mus musculus
caugcucagggcucuggauucaaccccaucacugggaggaag

SEQ ID NO: 34608 - RNA, 46 nt, Mus musculus
cauguggguacaaguuugaaggaacucagucacuguuuaugcgaag

SEQ ID NO: 34609 - RNA, 42 nt, Mus musculus
uuuaauguuuggggcaugaauuacuaaucuuuuacgguccag

SEQ ID NO: 34610 - RNA, 45 nt, Mus musculus
gaguugcacuaguguguaaaacaguguuuuaggcugagauauuag

SEQ ID NO: 34611 - RNA, 46 nt, Mus musculus
cuuuuuaaaaaggggggauaagaauguaagucagggaagcugugua

SEQ ID NO: 34612 - RNA, 46 nt, Mus musculus
auccaacgcaguaucuauugacaccaccaucaccuugaacgggagg

SEQ ID NO: 34613 - RNA, 42 nt, Mus musculus
gggguccugaggaggaggaaggggaaggugacaugcuggacc

SEQ ID NO: 34614 - RNA, 24 nt, Mus musculus
ucuaugaggauaguaaaugacaug

SEQ ID NO: 34615 - RNA, 46 nt, Mus musculus
ggguguuacagaaagguggagaccagccagggaagcaaugacaguu

SEQ ID NO: 34616 - RNA, 46 nt, Mus musculus
cauugcuucccuggcuggucuccaccuuucuguaacaccccgggag

SEQ ID NO: 34617 - RNA, 45 nt, Mus musculus
aacuuugaggccagucugggcuguaacaaaaugaaaacagacaag

SEQ ID NO: 34618 - RNA, 52 nt, Mus musculus
gaggccuccuggcugacuccuuucuuucuauucgagccccagcuucugggga

SEQ ID NO: 34619 - RNA, 46 nt, Mus musculus
aagaaaggagucagccaggaggccucccccaagccgacccaugccc

SEQ ID NO: 34620 - RNA, 45 nt, Mus musculus
ggcaggggugugugugugugugugugugugugugugugguguguu

SEQ ID NO: 34621 - RNA, 41 nt, Mus musculus
gugugugugugcgugugugugcgugugugugugugaaagag

SEQ ID NO: 34622 - RNA, 62 nt, Mus musculus
gaggaccagaaguagggggcugaagcagggaggugccuccugaccugggaccgguccuuugg

SEQ ID NO: 34623 - RNA, 46 nt, Mus musculus
cuucucgacacuucuagaucuuggagcuaauuauugcuccaacccu

SEQ ID NO: 34624 - RNA, 59 nt, Mus musculus
cgaguaccgaucacagaggguuggagcaauaauuagcuccaagaucuagaagugucgag

SEQ ID NO: 34625 - RNA, 45 nt, Mus musculus
agggggacucauauccaauggcuccuaaguguuuguccugugcaa

SEQ ID NO: 34626 - RNA, 46 nt, Mus musculus
ugugaagaaaggcaggggaggggagcauggcuuaucacaugcagcc

SEQ ID NO: 34627 - RNA, 46 nt, Mus musculus
ggggauucuaaauguccuuagugaccuuuggcauaacggcucagag

SEQ ID NO: 34628 - RNA, 68 nt, Mus musculus
ccauccauccauccauccauccauccauucauccauccccaguguuccaugugucaccuucuccuuuu

SEQ ID NO: 34629 - RNA, 45 nt, Mus musculus
ugauaaaacucugguugaauagaguuuggggaacccugcccagau

SEQ ID NO: 34630 - RNA, 46 nt, Mus musculus
cagaguuuuaucacgcaccucaucgggucucuccugguugcugccc

SEQ ID NO: 34631 - RNA, 44 nt, Mus musculus
uuccaaauagcggagcaccaagcaagagaagguccaccccaucc

SEQ ID NO: 34632 - RNA, 46 nt, Mus musculus
cacauuugcugggccuggccucugagaggccaucuuccacccccag

SEQ ID NO: 34633 - RNA, 46 nt, Mus musculus
uuguagacaugugggagcuaugacagacguggccugggguagaaag

SEQ ID NO: 34634 - RNA, 41 nt, Mus musculus
caaaagagaaacugauauaggacauggacugaggccucaga

SEQ ID NO: 34635 - RNA, 46 nt, Mus musculus
ccuugaagucuagauacaccuguaugggacccuucacaaagcagau

SEQ ID NO: 34636 - RNA, 70 nt, Mus musculus
uagacuucaaggacaggguuugucucacaggauugucacuuaggagaugaaagaauauuaccacaugagg

SEQ ID NO: 34637 - RNA, 42 nt, Mus musculus
gcaagaacaagaacuguuuaaggcaccucuguucccagccac

SEQ ID NO: 34638 - RNA, 45 nt, Mus musculus
uccuucuagccuuggugacuuccaccaggaagagaauacccccuc

SEQ ID NO: 34639 - RNA, 42 nt, Mus musculus
ucuguagaauccgagccuagcaccccaaagucaugcacccag

SEQ ID NO: 34640 - RNA, 41 nt, Mus musculus
cgggaaggcagccuucuugcagcugauacagaggaaguaga

SEQ ID NO: 34641 - RNA, 43 nt, Mus musculus
aucccauuuuuaaacucagcagagauaagccgagaugacuaug

SEQ ID NO: 34642 - RNA, 45 nt, Mus musculus
ggauauuucaacuuaaugauuuguuuuuaaaaguugcacacagaa

SEQ ID NO: 34643 - RNA, 47 nt, Mus musculus
agagcagccugagccacaccauccccggauccugccccagcaccccc

SEQ ID NO: 34644 - RNA, 48 nt, Mus musculus
ugcuggggcaggauccggggaugguguggcucaggcugcucucuggcc

SEQ ID NO: 34645 - RNA, 38 nt, Mus musculus
ugaagacucugugucccaggaguccuggaagauggggu

SEQ ID NO: 34646 - RNA, 45 nt, Mus musculus
agcgagcgccuccgccccagaaaaaggagaagaaauggcagugau

SEQ ID NO: 34647 - RNA, 45 nt, Mus musculus
guguggggaaagguaggacuggagguuagucuuccaauagguaga

SEQ ID NO: 34648 - RNA, 45 nt, Mus musculus
aacucaaggaaggagagaaccccacaaaacugaauaaagcuggag

SEQ ID NO: 34649 - RNA, 40 nt, Mus musculus
cuaagucaaugcugcaaauagaguugagaauuuuagaugu

SEQ ID NO: 34650 - RNA, 46 nt, Mus musculus
auuucugagauagcaccagaagucugaguuuaaaaugaacccuucc

SEQ ID NO: 34651 - RNA, 46 nt, Mus musculus
uuccuaguauuuagauuaucgccaugcuccaccaagcccugcuauc

SEQ ID NO: 34652 - RNA, 50 nt, Mus musculus
cuaucuugcuagauaagcucgcugccagggagcuacauccuaagacgccu

SEQ ID NO: 34653 - RNA, 45 nt, Mus musculus
agcuguugguuaucagggacccaugcagaccugucagacaaagua

SEQ ID NO: 34654 - RNA, 42 nt, Mus musculus
cucgccucccacccaccucuaccucccaguagugccggccag

SEQ ID NO: 34655 - RNA, 46 nt, Mus musculus
ggggugggagcaugauauucccagagugaagaaugauagcuaaggg

SEQ ID NO: 34656 - RNA, 46 nt, Mus musculus
acaggcaguucugcaguagcuggagagaaacugccuaauggaacag

SEQ ID NO: 34657 - RNA, 46 nt, Mus musculus
aacuugguccuagggaucaaauucagguuagcaagcuuggugacag

SEQ ID NO: 34658 - RNA, 42 nt, Mus musculus
cuggccucaaacucauagacaucugucuguaucugcccccaa

SEQ ID NO: 34659 - RNA, 46 nt, Mus musculus
cugugcuggcuguuucauagauaaacguccuucacauauguccaaa

SEQ ID NO: 34660 - RNA, 42 nt, Mus musculus
gaaaggucaaacuaaaauauccaaguaggauguaggccccaa

SEQ ID NO: 34661 - RNA, 45 nt, Mus musculus
uccucguccucaucuuccccucucagguccgccacaucccccaag

SEQ ID NO: 34662 - RNA, 46 nt, Mus musculus
cuccaugucacccucauaaucuucuucccgcauaggggugucccag

SEQ ID NO: 34663 - RNA, 46 nt, Mus musculus
ugacugccauuuugcacaaagccucucaucuccacgggguagugag

SEQ ID NO: 34664 - RNA, 48 nt, Mus musculus
uagcgauggaggcccauagucacucagcagcuggcgauauugggagga

SEQ ID NO: 34665 - RNA, 62 nt, Mus musculus
ggccaagaccguuuguguacgccugaagcuuuugucugucuggggugugugugugugugugu

SEQ ID NO: 34666 - RNA, 61 nt, Mus musculus
gugugugugugcgcuuuugucugggguguguguguguguguguguguguguguguguuuga

SEQ ID NO: 34667 - RNA, 45 nt, Mus musculus
uaguguuuuuugccaaaugguauuauguggaaugauucuguauua

SEQ ID NO: 34668 - RNA, 25 nt, Mus musculus
agcuuaaguuacagaagcccuguac

SEQ ID NO: 34669 - RNA, 46 nt, Mus musculus
uaaaaucagccuuaaaggaugcuuugcaugcaaaugagagaagaag

SEQ ID NO: 34670 - RNA, 46 nt, Mus musculus
gauagaggucauauauagacagagcugucuguccagaggggaguag

SEQ ID NO: 34671 - RNA, 46 nt, Mus musculus
ugaagguaaauuaaauauuaauuuuuaaagaaaaaaacugaaccau

SEQ ID NO: 34672 - RNA, 46 nt, Mus musculus
aaacgcagcaaauauaaaacuagagcaggaugaugagacaucugag

SEQ ID NO: 34673 - RNA, 58 nt, Mus musculus
uacucuagccuuauaaaccacaaaagcacucauucuggggagaagaacugcaaaugug

SEQ ID NO: 34674 - RNA, 55 nt, Mus musculus
aaggccuucagaaacaguucugguuugagaguccacaaaaggauccacacagggg

SEQ ID NO: 34675 - RNA, 46 nt, Mus musculus
uucauacuggagaaagaccuuauguaugugauguguguggcaaaac

SEQ ID NO: 34676 - RNA, 45 nt, Mus musculus
ucuaaaccacaaaaaaauucaucuuggagaaaagcccuauaaaug

SEQ ID NO: 34677 - RNA, 46 nt, Mus musculus
gaacagcucaggccucacaguacauaaaaggauccacacaggagag

SEQ ID NO: 34678 - RNA, 46 nt, Mus musculus
uucagucaguggaaaaaagauccaagaagggccuccaacaggcaaa

SEQ ID NO: 34679 - RNA, 45 nt, Mus musculus
cuaauccauacacacaucuaaguguucggagaaacuuaaccauag

SEQ ID NO: 34680 - RNA, 45 nt, Mus musculus
gugcaaauaucugcaucugauucuuucagcuguuuguugggucuu

SEQ ID NO: 34681 - RNA, 46 nt, Mus musculus
agaacuaggaggacccugggguugcaccaagagucauagucuccag

SEQ ID NO: 34682 - RNA, 41 nt, Mus musculus
cuacuuccggaggacaggcggaaguggcugcggugucuggu

SEQ ID NO: 34683 - RNA, 41 nt, Mus musculus
guuuggaagggaagggugggaggaguuaaguucuugggggg

SEQ ID NO: 34684 - RNA, 44 nt, Mus musculus
uacuuugggggaucugauucucaguuuuggaaaugaaguauuag

SEQ ID NO: 34685 - RNA, 24 nt, Mus musculus
cuuguuuauuguaacacauggaaa

SEQ ID NO: 34686 - RNA, 92 nt, Mus musculus
auccaaauucuauguuguagccuauuuuuuuucggaggcaggguagccuuuuugcuggggaucauucugugagccuuggaauuuaaacaaag

SEQ ID NO: 34687 - RNA, 41 nt, Mus musculus
gagggccaggcacagcaggaugugggagccagugggggcug

SEQ ID NO: 34688 - RNA, 41 nt, Mus musculus
gcuguugugaaacucggcaggagggcaccuugggugcgggg

SEQ ID NO: 34689 - RNA, 50 nt, Mus musculus
ggcuauuguauuggauccacgucguuugugguuggaaaugagauugcauc

SEQ ID NO: 34690 - RNA, 46 nt, Mus musculus
ggaggagggacgagaggaagcgggugguaggguggaaaugggagga

SEQ ID NO: 34691 - RNA, 45 nt, Mus musculus
aaggcugaauugcugaaaaauaaguguguguguguguccuaggga

SEQ ID NO: 34692 - RNA, 46 nt, Mus musculus
agaggaaguaguacaugggggugugcaguugaagguccauucggga

SEQ ID NO: 34693 - RNA, 46 nt, Mus musculus
auuggugcacacgaaaggcuaugggaaguuucaauacgaguuuuag

SEQ ID NO: 34694 - RNA, 42 nt, Mus musculus
aggccauugccaccaaaaucaaacauucuguggaggccagag

SEQ ID NO: 34695 - RNA, 46 nt, Mus musculus
acuuccacagagcccccuucacauccuuguuccucagcguauagau

SEQ ID NO: 34696 - RNA, 42 nt, Mus musculus
ccagggcuggcccuugaagaugucaucagacuagugggugag

SEQ ID NO: 34697 - RNA, 86 nt, Mus musculus
uggagucuucccaguuuuguuaggauauggcuugcuggagcagaucaggaagcaaggcucucucucucucucucuuucugaugugg

SEQ ID NO: 34698 - RNA, 46 nt, Mus musculus
auguuuugugaaaacaucccucaucagcaguuacccuguguuggau

SEQ ID NO: 34699 - RNA, 42 nt, Mus musculus
gcacuauggaggagagaugaaguagugagacuagugaccagc

SEQ ID NO: 34700 - RNA, 44 nt, Mus musculus
gcccuguggguccuuccugugaggggucuagagagcuuggcccu

SEQ ID NO: 34701 - RNA, 44 nt, Mus musculus
caaauguguccagucaucgucuccuccugagcaguuucccgacu

SEQ ID NO: 34702 - RNA, 42 nt, Mus musculus
ugugccugugcuggaacuuucugggguagugggugucaggcg

SEQ ID NO: 34703 - RNA, 42 nt, Mus musculus
uaaggauguaguagcuggggcuggcgagauggcucagugguu

SEQ ID NO: 34704 - RNA, 45 nt, Mus musculus
cuguagggcaagggcggccauccccugcacgaggaggacgugggc

SEQ ID NO: 34705 - RNA, 45 nt, Mus musculus
caggucguagucugggcacacacugcacuuauagcgaguucccac

SEQ ID NO: 34706 - RNA, 43 nt, Mus musculus
ucauacguggauggcacugucgugccauagacaccaugcagag

SEQ ID NO: 34707 - RNA, 45 nt, Mus musculus
uugggagugcaauacagugacuaguggaauagcuaugggcuuagg

SEQ ID NO: 34708 - RNA, 46 nt, Mus musculus
ucgugggaguucuguugcaaggugggcuggcuccugucugggaggu

SEQ ID NO: 34709 - RNA, 41 nt, Mus musculus
acccgccgccgcgcccgagcccgcuccacagcccggccgga

SEQ ID NO: 34710 - RNA, 42 nt, Mus musculus
cggcggcagcggcgcggaaaacaauggggcagggguauagcg

SEQ ID NO: 34711 - RNA, 46 nt, Mus musculus
acgagucagguauuuaaggaggcuggagcuucaauggaaccuugag

SEQ ID NO: 34712 - RNA, 45 nt, Mus musculus
uaucaccaucuguuguuuguggucacagugaccauagcuauguag

SEQ ID NO: 34713 - RNA, 48 nt, Mus musculus
auauuggggaaauacugggaaagaaauauauuuguuaaggaugaaggc

SEQ ID NO: 34714 - RNA, 47 nt, Mus musculus
cuguguagacuuuagaaagucuaaucaauccagagaugggccaauuc

SEQ ID NO: 34715 - RNA, 46 nt, Mus musculus
gcuuuacugugaugacauguuucuucuuuuuuagcuggcccacacc

SEQ ID NO: 34716 - RNA, 45 nt, Mus musculus
ucuacccaggcaccaccagcauuccuuaaaaagccuugugcucca

SEQ ID NO: 34717 - RNA, 45 nt, Mus musculus
ggagcacaaggcuuuuuaaggaaugcugguggugccuggguagau

SEQ ID NO: 34718 - RNA, 46 nt, Mus musculus
aaaaagaacuaaaaggagacuuugacuuggucauuucacaucagau

SEQ ID NO: 34719 - RNA, 45 nt, Mus musculus
auaaaucuuguuuugugugcuuccauuaguuaauuccucuuaaag

SEQ ID NO: 34720 - RNA, 57 nt, Mus musculus
aauuuaauauauucauuuguucaugcagaaauaacaccaacauuaggaaugcuaggg

SEQ ID NO: 34721 - RNA, 90 nt, Mus musculus
aacagguuccagugaauacuagccuguaauuuuaaacaucuagcaguaaauaauugcaguuguaauguaaaggacccuguuucuguagaa

SEQ ID NO: 34722 - RNA, 59 nt, Mus musculus
auuuccucucccuccccuuccccugcaaaugugguccuaggagagggccugguguaccu

SEQ ID NO: 34723 - RNA, 45 nt, Mus musculus
gaugaaauuuugaacagaucgccaagaaacagaaagccacgaaga

SEQ ID NO: 34724 - RNA, 46 nt, Mus musculus
uaguuuaaaaugcagugguauucaagaaauaccuuugaggggacag

SEQ ID NO: 34725 - RNA, 56 nt, Mus musculus
ugcugaagaagaugguguuacuggcagucaagaugaggaagauagcaagccuaaag

SEQ ID NO: 34726 - RNA, 65 nt, Mus musculus
ccccagccagaugugaaggaugaagaagggaaggaagaagagaagaacaagagggaugaagagga

SEQ ID NO: 34727 - RNA, 42 nt, Mus musculus
cuucuuccuucccuucuucauccuucacaucuggcuggggag

SEQ ID NO: 34728 - RNA, 41 nt, Mus musculus
gaaccuaaaagcacaguuugaggauguuuuguuugagagag

SEQ ID NO: 34729 - RNA, 47 nt, Mus musculus
accucagcagccccaucagcagcuuucuucaggccccacccaucauu

SEQ ID NO: 34730 - RNA, 76 nt, Mus musculus
caucuuuuuugacaacuuuaucauuaguggugaccgaagaguaguugaugauugggccaaugauggguggggccug

SEQ ID NO: 34731 - RNA, 45 nt, Mus musculus
cuaaugauaaaguugucaaaaaagaugucggaugucauggaccag

SEQ ID NO: 34732 - RNA, 61 nt, Mus musculus
caaggaaaauaccaaauccagauuucuuugaagaccuagaaccuuuuaagaugacuccuuu

SEQ ID NO: 34733 - RNA, 45 nt, Mus musculus
aaaucuggauuugguauuuuccuugguuuccagauucccuaguuu

SEQ ID NO: 34734 - RNA, 45 nt, Mus musculus
gaaaugauguuuugaaacuucuuuugucucugccucacccccaac

SEQ ID NO: 34735 - RNA, 46 nt, Mus musculus
gaggaccaggaguugaaaugucaacuucagcuauaacuaagaagau

SEQ ID NO: 34736 - RNA, 109 nt, Mus musculus
cggagaaugggaggcuccucagauugccaaccccaagugugagucagccccuggguguggugucuggcagcgaccuaugauugacaaccccaauuauaagggcaaaugg

SEQ ID NO: 34737 - RNA, 47 nt, Mus musculus
gacgacgaaccugaguauauuccagacccugaugcagagaagccaga

SEQ ID NO: 34738 - RNA, 46 nt, Mus musculus
uucgucgucuagccagccuucaggcuugguggccucuucaucuggg

SEQ ID NO: 34739 - RNA, 41 nt, Mus musculus
agagaaagaaaagaaaagaacuuaacuaagaacagcagcua

SEQ ID NO: 34740 - RNA, 44 nt, Mus musculus
cuugucccuguacuguuuguuccugguucuugaggaggccagcg

SEQ ID NO: 34741 - RNA, 46 nt, Mus musculus
caccuuuuuaaaaauaggaugaagagaguuuuaagcuuuaaaagau

SEQ ID NO: 34742 - RNA, 54 nt, Mus musculus
aagauugggaugaaaggcccaaaauagcagauccagaugcugucaagccagaug

SEQ ID NO: 34743 - RNA, 48 nt, Mus musculus
ucuucaauuucacgugaaggguuuacaggaggagucaugucauuuagc

SEQ ID NO: 34744 - RNA, 58 nt, Mus musculus
augacuccuccuguaaacccuucacgugaaauugaagacccagaagaccggaagccug

SEQ ID NO: 34745 - RNA, 44 nt, Mus musculus
auuccaacauucccaucaaucuaacacaacagaucaugccuucu

SEQ ID NO: 34746 - RNA, 44 nt, Mus musculus
gugagccaccaugugggugguaggaauugagccugggucuauug

SEQ ID NO: 34747 - RNA, 45 nt, Mus musculus
uugaugaagaggagaaaacuuaugauaacugaaacagccccauac

SEQ ID NO: 34748 - RNA, 46 nt, Mus musculus
uuaauguauaaagaugcguuuucuugucagugaaauaggucuucag

SEQ ID NO: 34749 - RNA, 65 nt, Mus musculus
cgacacaaaaaucccaagacagguguauaugaagaaaaacaugcuaagaggccagaugcagaucu

SEQ ID NO: 34750 - RNA, 77 nt, Mus musculus
uccacgacaagacucccuauacuauuauguuugguccagauaaguguggagaggacuacaaacugcauuucaucuuu

SEQ ID NO: 34751 - RNA, 116 nt, Mus musculus
uuuuucuucauauacaccugucuugggauuuuugugucgaaagaugaaaugcaguuuguaguccucuccacacuuaucuggaccaaacauaauaguauagggagucuugucgugga

SEQ ID NO: 34752 - RNA, 28 nt, Mus musculus
ucuuggaaagcagcuucacauaggcacc

SEQ ID NO: 34753 - RNA, 47 nt, Mus musculus
agaauggaauagaaugugguggugccuaugugaagcugcuuuccaag

SEQ ID NO: 34754 - RNA, 46 nt, Mus musculus
aaugucuggcuuuugcauuaaggauuacuuuuauuuuguuuuuuug

SEQ ID NO: 34755 - RNA, 46 nt, Mus musculus
caggaagggcuuauucaguuuagcagagauggcaugaugcuuggcc

SEQ ID NO: 34756 - RNA, 71 nt, Mus musculus
ggaaguagaugagaugaaggaaacaaagcuuccaggggauaaaggacuuguacugaugucucgggccaagc

SEQ ID NO: 34757 - RNA, 47 nt, Mus musculus
aaagccaaaaaagaugacacugaugaugaaauugccaaauaugaugg

SEQ ID NO: 34758 - RNA, 49 nt, Mus musculus
auuuggcaauuucaucaucagugucaucuuuuuuggcuuuagauaaaau

SEQ ID NO: 34759 - RNA, 64 nt, Mus musculus
gagacccucugucaaaggagucagcaaaauaaaccuccccuguuggaacuggagcuuuguaggu

SEQ ID NO: 34760 - RNA, 42 nt, Mus musculus
aacacaggucaccuacaaagcuccaguuccaacaggggaggu

SEQ ID NO: 34761 - RNA, 67 nt, Mus musculus
gaugauguuauugaagagguagaagauucaaaaucuaaaucagaugccagcacuccuccaucuccaa

SEQ ID NO: 34762 - RNA, 62 nt, Mus musculus
cugcagcuguugaggcucaugauggacaugaugaugacgcgauugauauugaagaugaucuu

SEQ ID NO: 34763 - RNA, 45 nt, Mus musculus
cugugauuugaaacccugauuaacaaggaacagacuaagguuagu

SEQ ID NO: 34764 - RNA, 47 nt, Mus musculus
gcaguagaaggaaagacuccuuaaaauugucuuuucacagcucguag

SEQ ID NO: 34765 - RNA, 45 nt, Mus musculus
aagaggaaaugaauaaugaacaugaauguguauaaagaggcagaa

SEQ ID NO: 34766 - RNA, 45 nt, Mus musculus
uuuauugaaaagaaaaacauauuaacauagaauuaggggaagagu

SEQ ID NO: 34767 - RNA, 45 nt, Mus musculus
cuauguuaauauguuuuucuuuucaauaaacuacaaaugcagaga

SEQ ID NO: 34768 - RNA, 46 nt, Mus musculus
aaauugugggcuuauauugcuuugagaaggugagaaguguucaaga

SEQ ID NO: 34769 - RNA, 46 nt, Mus musculus
aagaagccgggcggugguggugcaugucuuuaaucccagcacuugg

SEQ ID NO: 34770 - RNA, 45 nt, Mus musculus
agauuccacuauagauccugguugcugugcucuuaacugcugagc

SEQ ID NO: 34771 - RNA, 45 nt, Mus musculus
uguuauagauuacuuucugacaauuuuuagaaacuauggggaaca

SEQ ID NO: 34772 - RNA, 46 nt, Mus musculus
aaccauccguaacgagaucugacucccucuucuggagugucuaaag

SEQ ID NO: 34773 - RNA, 46 nt, Mus musculus
uugcaaaccauuugaguguaaucaggcucacugcuaggcaccagau

SEQ ID NO: 34774 - RNA, 45 nt, Mus musculus
caguugggugcucuuacccacugagccaucuugccagcccgaaaa

SEQ ID NO: 34775 - RNA, 24 nt, Mus musculus
acacagguccucucuagccccagu

SEQ ID NO: 34776 - RNA, 46 nt, Mus musculus
uggcuuuguauuugucuaugcuuuauguuugauugcaggcggauga

SEQ ID NO: 34777 - RNA, 45 nt, Mus musculus
uuagguucucucagacccugugucaaagaauaaggugaagggaga

SEQ ID NO: 34778 - RNA, 42 nt, Mus musculus
guuuuacagcaugcgcucaaugugacugucuacaguuacuag

SEQ ID NO: 34779 - RNA, 46 nt, Mus musculus
aaaaucugaaggcgcgcgcacauacacacaaaaauaguggaaagau

SEQ ID NO: 34780 - RNA, 42 nt, Mus musculus
ucauguguacauacacauagaaaugcaugauuagaggccaga

SEQ ID NO: 34781 - RNA, 41 nt, Mus musculus
ccucaucccccaaauacugaggauggacucuagagccuuga

SEQ ID NO: 34782 - RNA, 46 nt, Mus musculus
uguuggugugaauauauaugcaauauauuauucaugggggccagua

SEQ ID NO: 34783 - RNA, 80 nt, Mus musculus
agacagaaugacugaugggccuuguauugaauuccgagggaaugggaaugagaaauuggauguguaguaaagguucagug

SEQ ID NO: 34784 - RNA, 46 nt, Mus musculus
guuaaaaguccugguucaagcaccuaacugcaauuaaucgggggag

SEQ ID NO: 34785 - RNA, 71 nt, Mus musculus
ucacaggaccuuaagagcaggagauacaagcgaaaguucaguuagugaggggaggaaacugaggccuagaa

SEQ ID NO: 34786 - RNA, 46 nt, Mus musculus
gugcuuuaauaguuaagccuuaaguuucucaagcgguacacguucu

SEQ ID NO: 34787 - RNA, 45 nt, Mus musculus
auagcagggaaaggugaaguaaauccagagauaagcguuacagau

SEQ ID NO: 34788 - RNA, 45 nt, Mus musculus
ggccgaauucuaauaccacaccuguaccggauuacucagcccacc

SEQ ID NO: 34789 - RNA, 43 nt, Mus musculus
acccggccgcucuccucacugcccugcgcguccgcccaggccu

SEQ ID NO: 34790 - RNA, 42 nt, Mus musculus
gcuuucgaauggcgcaggccugggcggacgcgcagggcagug

SEQ ID NO: 34791 - RNA, 45 nt, Mus musculus
gauccccgcacacgcuucccgucucaccucgagccucccggggac

SEQ ID NO: 34792 - RNA, 43 nt, Mus musculus
ggugagggagccgccagugguccccgggaggcucgaggugaga

SEQ ID NO: 34793 - RNA, 85 nt, Mus musculus
ucucccacccgcacacccggccccgugcugcaguggagacagcggcagaggcggcccgaccgucacgugccgcagaacuaagagg

SEQ ID NO: 34794 - RNA, 46 nt, Mus musculus
cgucagaucccgccccuuugcgcaagaucuaagaauuuauugguag

SEQ ID NO: 34795 - RNA, 50 nt, Mus musculus
agcguggugauuggucaauagcgaggcaggaagugguugcugauugggua

SEQ ID NO: 34796 - RNA, 42 nt, Mus musculus
accccgccugggaccuauggccuucaucacaaauggugagag

SEQ ID NO: 34797 - RNA, 45 nt, Mus musculus
cagaacugcccucgaauccccccauuacagaaucucaucaauuuc

SEQ ID NO: 34798 - RNA, 46 nt, Mus musculus
gucagauccuagcaaaucacagaagccccacaugggacagccccag

SEQ ID NO: 34799 - RNA, 46 nt, Mus musculus
gguguccucugaaggcagguagguguccucugaagguuuccggcac

SEQ ID NO: 34800 - RNA, 45 nt, Mus musculus
auuacuaacucuuaaaauguaagcuaguugcuacuggguggcaga

SEQ ID NO: 34801 - RNA, 42 nt, Mus musculus
cgcuccucccucacugugcaucagaggacucacacgggagaa

SEQ ID NO: 34802 - RNA, 46 nt, Mus musculus
aaacuucaagaauguuuguacaaaagaaaguauauggcugugauga

SEQ ID NO: 34803 - RNA, 46 nt, Mus musculus
accuuaugguccaucuuuaucucaaucuuguaagcucuccccagca

SEQ ID NO: 34804 - RNA, 45 nt, Mus musculus
uuaagaguuggagcuucaaauauguucuguuuuuguguuguagau

SEQ ID NO: 34805 - RNA, 37 nt, Mus musculus
aguucaacagcuucucuucaccuuccucugcucagca

SEQ ID NO: 34806 - RNA, 46 nt, Mus musculus
acagaagcaagcgcagccugacauuucaucaaggcuagacagaagg

SEQ ID NO: 34807 - RNA, 45 nt, Mus musculus
ucagugagugggugggaagagaaagcagccuagagucagguuaga

SEQ ID NO: 34808 - RNA, 41 nt, Mus musculus
uauuuaagaagaucauacagagaagggugagacguggcaga

SEQ ID NO: 34809 - RNA, 44 nt, Mus musculus
ugccauuaucccuaccaugugacuuguuggaaaauguccucagg

SEQ ID NO: 34810 - RNA, 46 nt, Mus musculus
uguguguguguguguguuuagauguacaugcccauguuugcagaag

SEQ ID NO: 34811 - RNA, 46 nt, Mus musculus
ugccugguaacuaacgacccucugugccugccuacccuucucagug

SEQ ID NO: 34812 - RNA, 45 nt, Mus musculus
ucucuauauauccacaaacacaugugaacauacauaccacacaua

SEQ ID NO: 34813 - RNA, 42 nt, Mus musculus
cagcuaccgugaccagguacaugcacagaaaagcccagaaga

SEQ ID NO: 34814 - RNA, 25 nt, Mus musculus
gacguggccgugcucuuuacccggg

SEQ ID NO: 34815 - RNA, 46 nt, Mus musculus
cacuuugcacagcaggccuggaacugcccaugugcaguggagcggg

SEQ ID NO: 34816 - RNA, 46 nt, Mus musculus
gguaugaagcaaagguucauagucugggcaucuucccaaccagcag

SEQ ID NO: 34817 - RNA, 42 nt, Mus musculus
uugcuauggugauagaaacuaagggcugaugaguuggggaag

SEQ ID NO: 34818 - RNA, 67 nt, Mus musculus
gacucuucauuucgggaacugauuaugagaaaaucuaaaagaaaagaaccuuggaacaugaagucag

SEQ ID NO: 34819 - RNA, 48 nt, Mus musculus
aaugccucgacuauagaaagaagcuauaaaagcaaugaacugagccca

SEQ ID NO: 34820 - RNA, 46 nt, Mus musculus
gaaaagcaaauaucauauuuaucuaauccauuaggaaucaccccag

SEQ ID NO: 34821 - RNA, 46 nt, Mus musculus
cucagagagcuaugagaacagauucacccuugggaucgagccagau

SEQ ID NO: 34822 - RNA, 42 nt, Mus musculus
gaggagggaggagagggaggagagggaggagagggaggagag

SEQ ID NO: 34823 - RNA, 49 nt, Mus musculus
augugggcagcaaaguuuaugucuccuuucacagagagagggagacgga

SEQ ID NO: 34824 - RNA, 45 nt, Mus musculus
uuuuucuccaccuguguaugugugugugugugugugugugugugu

SEQ ID NO: 34825 - RNA, 46 nt, Mus musculus
gggcaguaaauacgcaaacuucacuugagcuaguguagacccagca

SEQ ID NO: 34826 - RNA, 45 nt, Mus musculus
ucugcauugcccaguaaugaaccaaguagaaaagaacaugcaaag

SEQ ID NO: 34827 - RNA, 44 nt, Mus musculus
cucuucucauggugucccaaaugucuugaaaacacagcccgaau

SEQ ID NO: 34828 - RNA, 45 nt, Mus musculus
uuaauaugguggcaguuacuccuuaaccaguuaguacccccaagu

SEQ ID NO: 34829 - RNA, 45 nt, Mus musculus
uggagcccacguuagacagaauuugaguauccuguaggccuguua

SEQ ID NO: 34830 - RNA, 45 nt, Mus musculus
cgaugacucuucauaacuucuucaagcugaauaugggcguugaga

SEQ ID NO: 34831 - RNA, 46 nt, Mus musculus
aagccauugaccacacauggaacugcagaggaggugguggugagac

SEQ ID NO: 34832 - RNA, 46 nt, Mus musculus
uuucuauccuacugaacuuagcccgugacaugugacacaugaaggu

SEQ ID NO: 34833 - RNA, 46 nt, Mus musculus
cacaugcacauauauguauagaacaugacuaaggggacugugagag

SEQ ID NO: 34834 - RNA, 46 nt, Mus musculus
augcccucagcaggguagggccuugcuggaggaggugggcggagcc

SEQ ID NO: 34835 - RNA, 50 nt, Mus musculus
ugcucauggaaagaaauacuggacuaauggccaaauugaaagcagacuac

SEQ ID NO: 34836 - RNA, 50 nt, Mus musculus
gaagcugucccugcacguggcugcagaggacauccagaacagcagcuucc

SEQ ID NO: 34837 - RNA, 46 nt, Mus musculus
ucuuuccuugccucugcugccagagaugcucugggugccgguggag

SEQ ID NO: 34838 - RNA, 42 nt, Mus musculus
gagugguguguguaugugugugugugugugugugugagagag

SEQ ID NO: 34839 - RNA, 53 nt, Mus musculus
uuaaccagguugacauugagaauuguaaacgaacaggcagaaugggaguugag

SEQ ID NO: 34840 - RNA, 41 nt, Mus musculus
agcagaaaaaccagauccacuaucagagccucggggcagag

SEQ ID NO: 34841 - RNA, 41 nt, Mus musculus
accaaggagacucuauugaggguagagggcaugugggagug

SEQ ID NO: 34842 - RNA, 45 nt, Mus musculus
aucaugguccauacugccgcauuugaucauauuaugaaccccaag

SEQ ID NO: 34843 - RNA, 44 nt, Mus musculus
acggcgcggacgccauuuugucggugucugucgcagcggcugga

SEQ ID NO: 34844 - RNA, 45 nt, Mus musculus
cacuuaggaggcagaggcaagucagucucaagaguucaaggccag

SEQ ID NO: 34845 - RNA, 88 nt, Mus musculus
ggggaaaaagaaacgaucugugaucauuuuccagacauggaagaaaaaguaagaaguugugaaacccugaggaucaagcaccccccag

SEQ ID NO: 34846 - RNA, 63 nt, Mus musculus
uugguacauaauuguguucacuccgcguccaaacaaagcgugugcggucgucacucggccgcu

SEQ ID NO: 34847 - RNA, 46 nt, Mus musculus
aaggcuaagcuagagcuucauucaguagcuccagugccugugccag

SEQ ID NO: 34848 - RNA, 55 nt, Mus musculus
ccacugccucgguucccucgauugcgauuuccucugcccccagagccauacugcu

SEQ ID NO: 34849 - RNA, 75 nt, Mus musculus
uccgcgccguucugguucccgcucggugcggucguggucccgcccccagacccggccgaggccgcgggggccgcg

SEQ ID NO: 34850 - RNA, 45 nt, Mus musculus
gcagaaggcgacgcgcgggcuuggccgcggucacgcucgcacccc

SEQ ID NO: 34851 - RNA, 42 nt, Mus musculus
cagcagacugugaugccucucagaccagcauuaccaagagac

SEQ ID NO: 34852 - RNA, 44 nt, Mus musculus
ggcuaaagugucccuacugucccauggaacagaauccagcagau

SEQ ID NO: 34853 - RNA, 45 nt, Mus musculus
cacggcucagacaagaacuuaacucagccucugcugcccccagau

SEQ ID NO: 34854 - RNA, 45 nt, Mus musculus
gagucacaaaccgcucucuccucuguuagaacuucgacucugaga

SEQ ID NO: 34855 - RNA, 46 nt, Mus musculus
agggcaccccucucucagccacgcugucccuugugaugucccagug

SEQ ID NO: 34856 - RNA, 46 nt, Mus musculus
cucucuauguagaccaggccagccuagaacuccacuugccucagcc

SEQ ID NO: 34857 - RNA, 44 nt, Mus musculus
gagaaacccugucucgaaaaaccaaaaaaaaaaaagcagaacaa

SEQ ID NO: 34858 - RNA, 41 nt, Mus musculus
gaugucucagugaguacagauauuuguuacauaguccuggu

SEQ ID NO: 34859 - RNA, 46 nt, Mus musculus
uuggugaccuuuugggagccuggguuuaacuugaguuggcagaggu

SEQ ID NO: 34860 - RNA, 33 nt, Mus musculus
guacccuggaacagaaaggcugguggugguaga

SEQ ID NO: 34861 - RNA, 45 nt, Mus musculus
cuuagucacuauugaaaccacgggucaaauacaguucacagggaa

SEQ ID NO: 34862 - RNA, 45 nt, Mus musculus
gccugguaaaguagguuggagccguccaagcuucagccccacgau

SEQ ID NO: 34863 - RNA, 42 nt, Mus musculus
ccucccugggugugguucgcugcuagcaagacuuugccacag

SEQ ID NO: 34864 - RNA, 39 nt, Mus musculus
gcccacugucagcacacuuggcgagccucagaucuugga

SEQ ID NO: 34865 - RNA, 42 nt, Mus musculus
gcucugcgcuuugagcaggagaggcagacuuggcaggaggaa

SEQ ID NO: 34866 - RNA, 49 nt, Mus musculus
cugccaagucugccucuccugcucaaagcgcagagccugcuccuggccc

SEQ ID NO: 34867 - RNA, 42 nt, Mus musculus
ccucugcucuugcagucaucugucucgcagcugccuggggcu

SEQ ID NO: 34868 - RNA, 42 nt, Mus musculus
ccucccaucgggcuucuuccucuggccgagcauuggggucag

SEQ ID NO: 34869 - RNA, 65 nt, Mus musculus
accucuggcgguccugagcugccugcccgaaccaccuccccccuaugaguucuccugccccacua

SEQ ID NO: 34870 - RNA, 46 nt, Mus musculus
cgcuggaagaguccgacaggcugggcucagggccaccuucaucuag

SEQ ID NO: 34871 - RNA, 46 nt, Mus musculus
uugggccaacgagaguucuucagcuaccugcaucuccccaagaaag

SEQ ID NO: 34872 - RNA, 42 nt, Mus musculus
auugccaugggcagcguagguagccuguuggaacggcaagac

SEQ ID NO: 34873 - RNA, 44 nt, Mus musculus
caggcgggauacagugggagggauacaaacaggaagggcccaag

SEQ ID NO: 34874 - RNA, 42 nt, Mus musculus
cccgucaucucugucaggauaacugacaaagaggccgcggag

SEQ ID NO: 34875 - RNA, 46 nt, Mus musculus
gccgugcuccaccgacuaguguggagacgaugugacauugugaaau

SEQ ID NO: 34876 - RNA, 46 nt, Mus musculus
acaggauccuaaccccagugcuuggaaggcuacggcuacagcaggu

SEQ ID NO: 34877 - RNA, 45 nt, Mus musculus
acccacacgggcugacuguaacuccugggaagggaagcagcaggc

SEQ ID NO: 34878 - RNA, 46 nt, Mus musculus
gacuggcaaugauaauaggagcugguucuguugguucgcugagugg

SEQ ID NO: 34879 - RNA, 46 nt, Mus musculus
ugaaaacuaauuaggugguuuucugcuguuuuauucugccgugaau

SEQ ID NO: 34880 - RNA, 46 nt, Mus musculus
guguauguguguguauguauguauuugugugugugugugugugugu

SEQ ID NO: 34881 - RNA, 42 nt, Mus musculus
caaagcuauaccuccuaauaguaccauccccaugggccagac

SEQ ID NO: 34882 - RNA, 56 nt, Mus musculus
caaugacagaaccauaccucagccccccauucuucagcucucgguggagaaguuga

SEQ ID NO: 34883 - RNA, 45 nt, Mus musculus
cacauauaauaaauaaauaaaucuaaaaaaaagaaaaaccaaagu

SEQ ID NO: 34884 - RNA, 46 nt, Mus musculus
cauaauaaagaaagaaaucugggccagagcaagcaagacuggagag

SEQ ID NO: 34885 - RNA, 46 nt, Mus musculus
gcaauugacauuuacaaaacucuuuuucuaauguugggaggcgggg

SEQ ID NO: 34886 - RNA, 45 nt, Mus musculus
gcaguuaggccuagccuagcagugaggaaacagacaccaggagau

SEQ ID NO: 34887 - RNA, 45 nt, Mus musculus
uacagaaacuacagaaggaacuacacagguaccucacucggaaga

SEQ ID NO: 34888 - RNA, 42 nt, Mus musculus
uaguaguuacuauuuuagaggaguguauugagaggcugaggg

SEQ ID NO: 34889 - RNA, 46 nt, Mus musculus
auaacauaguuuccaugccauugugccaugccagacagcuuaaguu

SEQ ID NO: 34890 - RNA, 46 nt, Mus musculus
uccucucacuuaucaaaaaguaaggaauuuuaugaagguccuaaaa

SEQ ID NO: 34891 - RNA, 60 nt, Mus musculus
cucgauacuauuacaguggugcuuacgugugacaccgagagagagagagagagagagaga

SEQ ID NO: 34892 - RNA, 46 nt, Mus musculus
uuuccaccuuuauuauagaaguagcugauuuuaaacagcugcaguu

SEQ ID NO: 34893 - RNA, 44 nt, Mus musculus
ccucaagcauucuuuauaaaauaacuugaauuugggcccauuuu

SEQ ID NO: 34894 - RNA, 46 nt, Mus musculus
ucacaauuuuuuuuugaagcauccuuuuuccugugauguuggagac

SEQ ID NO: 34895 - RNA, 45 nt, Mus musculus
cuucuggagugucugaagacagcuacaguguacuuaaagcauaca

SEQ ID NO: 34896 - RNA, 46 nt, Mus musculus
guccuagcuguuugguagaguuguaggagaaccacuugacccagaa

SEQ ID NO: 34897 - RNA, 42 nt, Mus musculus
guguucucuguugacuggaacuuaaagagaaaagggggaggg

SEQ ID NO: 34898 - RNA, 45 nt, Mus musculus
auagguucugcacuucccuuacagaacccaccucugccccccacu

SEQ ID NO: 34899 - RNA, 48 nt, Mus musculus
ugggcaaagagacaccuuguuugugguguugaucuuauaucagucagg

SEQ ID NO: 34900 - RNA, 45 nt, Mus musculus
uuaucuuuacuugcccagugcuauacugaguaauccuggcuaaga

SEQ ID NO: 34901 - RNA, 46 nt, Mus musculus
ugguuagacauauuuuggugucaaacauucuuuuuauugcugaguu

SEQ ID NO: 34902 - RNA, 46 nt, Mus musculus
ugagccaccaugugguugcagggauuugaacucaggaccucuggaa

SEQ ID NO: 34903 - RNA, 27 nt, Mus musculus
aacugaguuugcuuuccagcacccuug

SEQ ID NO: 34904 - RNA, 37 nt, Mus musculus
guagguaggguagcauaagccuuaaucccagcacgug

SEQ ID NO: 34905 - RNA, 50 nt, Mus musculus
cacccuaggaaacaucucaagaaaacagucagccacagcacucaggaggc

SEQ ID NO: 34906 - RNA, 48 nt, Mus musculus
aaauguguacauacacaaacacaaguaguaauaaaaauaaaucuagaa

SEQ ID NO: 34907 - RNA, 46 nt, Mus musculus
uguagcuccaccaacucuaccugggaauccaaauuuaacagcggau

SEQ ID NO: 34908 - RNA, 45 nt, Mus musculus
augccuucugguagcuuucuuccuggagccaacccacccccaccu

SEQ ID NO: 34909 - RNA, 46 nt, Mus musculus
caguaauacuuuuaaggcuuauagcauuuauaaccuguuagcagca

SEQ ID NO: 34910 - RNA, 46 nt, Mus musculus
agccaucucaguacccaaauuucagaauauuacuacuuccaaagac

SEQ ID NO: 34911 - RNA, 45 nt, Mus musculus
guugugagccaccauguguuugcugggauuugaacucaggaucuc

SEQ ID NO: 34912 - RNA, 46 nt, Mus musculus
gaaacauuuauaaugaacauuauaaaguuuauaugagcagccagau

SEQ ID NO: 34913 - RNA, 46 nt, Mus musculus
ccugccucugcuuuccaaaugcuggcauuagagacuugugccauca

SEQ ID NO: 34914 - RNA, 46 nt, Mus musculus
cuggaacucagauauucaccugccucugccucccaaguggugagau

SEQ ID NO: 34915 - RNA, 46 nt, Mus musculus
gcuguaaaaacuccaauaaaaggaguagagauaagacuguaagaau

SEQ ID NO: 34916 - RNA, 45 nt, Mus musculus
cccauuugguaggaugagcgaauuaggggucauagacagcuggag

SEQ ID NO: 34917 - RNA, 46 nt, Mus musculus
uauuaauguugguaauguuuuauuacauauguauuaugaguguguc

SEQ ID NO: 34918 - RNA, 46 nt, Mus musculus
caagaagggaaguaauauguguuaauuuuggaaagguagccaagag

SEQ ID NO: 34919 - RNA, 46 nt, Mus musculus
guugaaggaagcguguuauauagguaugggcuuuaagaaccugucu

SEQ ID NO: 34920 - RNA, 45 nt, Mus musculus
gagagagagagagagaagccaauacccucagaggcagaagagauc

SEQ ID NO: 34921 - RNA, 46 nt, Mus musculus
gguaaauuuggguucuauuuagguuuuaauauagauuuaagcacag

SEQ ID NO: 34922 - RNA, 45 nt, Mus musculus
uaugguucagagcuuggaacugcguguucuucaaguaaggcagag

SEQ ID NO: 34923 - RNA, 42 nt, Mus musculus
augaacacaugauacuguuccccccaccccuaaaagcuccag

SEQ ID NO: 34924 - RNA, 46 nt, Mus musculus
guguauggguaccuugcauguacaucugcacuccaguacacagcau

SEQ ID NO: 34925 - RNA, 61 nt, Mus musculus
ggcuauauuugcuuguuuuuacauaaagaauuaaaugauagcugaauauuuuuacugugag

SEQ ID NO: 34926 - RNA, 46 nt, Mus musculus
gucuucagacacaccagaagaaggcaucagaucucauuaugggugg

SEQ ID NO: 34927 - RNA, 71 nt, Mus musculus
uaagcaacaguuuuuaaaauaagucauucaaaaacaguacaaugcagagcuauauuaguuugauacuuaca

SEQ ID NO: 34928 - RNA, 37 nt, Mus musculus
agaaagacauggggcccgcagagaucgcagcuaagag

SEQ ID NO: 34929 - RNA, 45 nt, Mus musculus
ucaaaccccaacaaccacaugguggcucacaaccacccauaauga

SEQ ID NO: 34930 - RNA, 41 nt, Mus musculus
gugcugcuccuucuccaucuucugagaagguaauugcccaa

SEQ ID NO: 34931 - RNA, 46 nt, Mus musculus
cucccuuagugauuugcauagugagcaucuccagagagcuuuagag

SEQ ID NO: 34932 - RNA, 62 nt, Mus musculus
gaugaaaccauugccaacgugccuauucuaauucuuggaaauaagaucgacagaccugaagc

SEQ ID NO: 34933 - RNA, 45 nt, Mus musculus
uuuauauuuauuuauuuauuuuauguaugugagugcacuguagcu

SEQ ID NO: 34934 - RNA, 42 nt, Mus musculus
gcccacacacuuccagcccucagagauccaucccccaacaug

SEQ ID NO: 34935 - RNA, 59 nt, Mus musculus
gaauaucacaauguuagcuuucuaauuccacacagauaguuuuuacaguuucuaacccc

SEQ ID NO: 34936 - RNA, 46 nt, Mus musculus
ccauugcuuugaguuuggcuagcauggagucagccacacugcagag

SEQ ID NO: 34937 - RNA, 45 nt, Mus musculus
gaugggauucccuuagaguugguucuuaaguucuuuuauggcuga

SEQ ID NO: 34938 - RNA, 45 nt, Mus musculus
cgucugacucaagucauuccuaguuaaagagaaaauaggcccaga

SEQ ID NO: 34939 - RNA, 43 nt, Mus musculus
ugcuuuguuccuuccacuuugcuguugcuucccacucucugag

SEQ ID NO: 34940 - RNA, 45 nt, Mus musculus
cucuguaggaacaguaggcacauuuuaaguaaaauuuugcuucag

SEQ ID NO: 34941 - RNA, 42 nt, Mus musculus
uagaggugugugauuuggaucaagcugcacaguuugggggug

SEQ ID NO: 34942 - RNA, 45 nt, Mus musculus
uaagugaucaguaucugaaaggagggaaauggggauuagcuucag

SEQ ID NO: 34943 - RNA, 46 nt, Mus musculus
cuacuuauuuauuuauuuauuaaucuauuuauuuuugagguaguaa

SEQ ID NO: 34944 - RNA, 46 nt, Mus musculus
uuuuaguuccucugaaaaauugaaacaaugaauucauuucugggag

SEQ ID NO: 34945 - RNA, 46 nt, Mus musculus
uauccuguugucuacuaauugucaucuccacacacucacucacaag

SEQ ID NO: 34946 - RNA, 46 nt, Mus musculus
aaaugucugaguuaaacaacuuaaaauagaaaauguuuuggggcau

SEQ ID NO: 34947 - RNA, 45 nt, Mus musculus
uguuuuaaagauuuauuuguuuauuuauuuauuuuauguaugugg

SEQ ID NO: 34948 - RNA, 46 nt, Mus musculus
agagagagaaagaaagagagaaagagagagagaaagaaagaaagag

SEQ ID NO: 34949 - RNA, 44 nt, Mus musculus
uuuuugggacuguggugaggaauuauaucauaguagagggucag

SEQ ID NO: 34950 - RNA, 46 nt, Mus musculus
aacucugguccucuggagaacagguaaccaucuccucaguccccaa

SEQ ID NO: 34951 - RNA, 78 nt, Mus musculus
accacgccuggcgaauagagugacuucuuugguuagucaaguaaagauuuuauguuuugucaacugaaagguuuuccu

SEQ ID NO: 34952 - RNA, 65 nt, Mus musculus
uguuuuuuguuuguuuguuuuugcucugucuuauauuaaaauuaacacuggagggauauuuggaa

SEQ ID NO: 34953 - RNA, 51 nt, Mus musculus
auuuuuauuuuguuuuguauuuuuaaauaguagcagagucaaaagaauguu

SEQ ID NO: 34954 - RNA, 45 nt, Mus musculus
uguacuaucuguccuuaaaaagguuuggugauucuugccuuagca

SEQ ID NO: 34955 - RNA, 46 nt, Mus musculus
cacaugcacuauuugcgcacauaauaugcaucacauaauguaguag

SEQ ID NO: 34956 - RNA, 46 nt, Mus musculus
uagcucagugauagauuacucuccgugugugugugugugugugugu

SEQ ID NO: 34957 - RNA, 80 nt, Mus musculus
agaaaguuaauuuuaauuaagaaaauagaaaugacaugcuaaggagauaacucagugggaaagucucccaggacucgggu

SEQ ID NO: 34958 - RNA, 45 nt, Mus musculus
aucuuuguuuuaauaauuuuuacuguauuuuacaucugaaguuua

SEQ ID NO: 34959 - RNA, 42 nt, Mus musculus
agccaccauaugguuucugggauuugaacucaggacccccga

SEQ ID NO: 34960 - RNA, 46 nt, Mus musculus
uuccugaugcauguggagucagauauauccccaguugagguccccu

SEQ ID NO: 34961 - RNA, 46 nt, Mus musculus
uccuguacucuaccaaauuauguucuguaagaaaucucacaucuag

SEQ ID NO: 34962 - RNA, 41 nt, Mus musculus
aagguagaugcaaaguagagaaaaaagcuggacauaggggu

SEQ ID NO: 34963 - RNA, 46 nt, Mus musculus
aguugcauugaagcaugucguuagagguguucaauaaagagccaag

SEQ ID NO: 34964 - RNA, 66 nt, Mus musculus
agagcaugcuuggaaacuacgaugaaaugaaggauuacauaggagacagaucgauaccaaagcuug

SEQ ID NO: 34965 - RNA, 54 nt, Mus musculus
uugcaauucccaagccugcaguaccaacgaccacagacgagaaagcaaacccaa

SEQ ID NO: 34966 - RNA, 46 nt, Mus musculus
agcuauuucaaaaauucuaacuaguguucugacuuaaaauaaugag

SEQ ID NO: 34967 - RNA, 41 nt, Mus musculus
cucaccuugcacugguaguagaggcuugcaauuucaccgua

SEQ ID NO: 34968 - RNA, 45 nt, Mus musculus
acaggaauuuuaaaagaauagagagcaauuauaugcaaguggcuu

SEQ ID NO: 34969 - RNA, 46 nt, Mus musculus
ucuaaacuuauuugagccuuuuuccuccucuuagacugggugccau

SEQ ID NO: 34970 - RNA, 45 nt, Mus musculus
uacaccaugcaaaacagaaccuuccaaauucccuuuuccaacuaa

SEQ ID NO: 34971 - RNA, 45 nt, Mus musculus
aacuacaauuacaugaguucaaaauugucuugccauucccugcug

SEQ ID NO: 34972 - RNA, 46 nt, Mus musculus
aauugagagcaucuuugacugagaguuacuuaagaaaaauuggaag

SEQ ID NO: 34973 - RNA, 46 nt, Mus musculus
caucauauauagguauguaauuuuucuuaaguugcuuuggucagag

SEQ ID NO: 34974 - RNA, 46 nt, Mus musculus
gcaugauguguuaaaaaagagaaaucaacugauacauggaaaggag

SEQ ID NO: 34975 - RNA, 49 nt, Mus musculus
aucccagaggacuagauaacagcuuccuauaauaauuccagaucugggg

SEQ ID NO: 34976 - RNA, 44 nt, Mus musculus
uggcuccuaggcauucaaauggucuauaaauauacaugcaggca

SEQ ID NO: 34977 - RNA, 42 nt, Mus musculus
aucuuguauacucugggguuuuccaccacaacuaggcuucac

SEQ ID NO: 34978 - RNA, 42 nt, Mus musculus
accaccugggugauucuuacacauuaccaaguacagcugcag

SEQ ID NO: 34979 - RNA, 46 nt, Mus musculus
aaugcuauuggauuauaggaaaccagggacagaaaguaggaaggga

SEQ ID NO: 34980 - RNA, 42 nt, Mus musculus
cugauuuuaugaucugguaaauaacaaacaaucugagcucag

SEQ ID NO: 34981 - RNA, 46 nt, Mus musculus
aaacaagaauuuaucuauguuuacuuauuuaccauguuuauaggag

SEQ ID NO: 34982 - RNA, 42 nt, Mus musculus
ucuggggcagccgagccagaaagauugcaaguucagggccag

SEQ ID NO: 34983 - RNA, 46 nt, Mus musculus
acuaucuuuaagauuuccuauuuuuauuauauuuuguagguagaau

SEQ ID NO: 34984 - RNA, 101 nt, Mus musculus
cucuauuuauauacuuuaaauucaauuugaauuuuguuaaagggagacuuagaaguugaaguuugaaaauuuguacaugguccuuucuuaccccaaacucu

SEQ ID NO: 34985 - RNA, 42 nt, Mus musculus
acacuaaauucuguuuucuuuaaaaguauuuuuuugggcuag

SEQ ID NO: 34986 - RNA, 47 nt, Mus musculus
ggagaacugucggcaaaaaacaacccaaaaaaccugagaagucagcu

SEQ ID NO: 34987 - RNA, 52 nt, Mus musculus
aucuucuccucgaccuacggcagagaagaagaaguacaagucagccaguaaa

SEQ ID NO: 34988 - RNA, 84 nt, Mus musculus
cucaaucuucugacucgaauacccgggaagccuuacaaagaaacagagccacccaagggggaaaagaaaaauguuccagagaaa

SEQ ID NO: 34989 - RNA, 45 nt, Mus musculus
agaguuugaaugucaaccauacaucuuuuuuugucuuagcuucag

SEQ ID NO: 34990 - RNA, 96 nt, Mus musculus
cagaaugaugaugauacccgagccagugagagcaaaaaacccaaaacagaggacaagaacucaucaggccacaagccauccagcagcagagaguau

SEQ ID NO: 34991 - RNA, 46 nt, Mus musculus
ccuuaaaguccagugggaccagcagcaaagagaacaguggcagcag

SEQ ID NO: 34992 - RNA, 45 nt, Mus musculus
uuuuccugagugguacugugguacagcccuuuacuucucugugug

SEQ ID NO: 34993 - RNA, 45 nt, Mus musculus
caauacagagaaacccugucucaaaaaaaccaaaauaaauaaaua

SEQ ID NO: 34994 - RNA, 46 nt, Mus musculus
aacuaaagaauuauuuggcaccagaugcuacagcugcagacaagag

SEQ ID NO: 34995 - RNA, 46 nt, Mus musculus
uugguggcaagcacccuuaccccugagccaucucacuagcccccca

SEQ ID NO: 34996 - RNA, 45 nt, Mus musculus
uuuccucugacucaacacaaguacacugugacacauccacagaca

SEQ ID NO: 34997 - RNA, 46 nt, Mus musculus
agacgauaucauucugcauaugaccauuucuuccucaugcugccau

SEQ ID NO: 34998 - RNA, 46 nt, Mus musculus
cauuaucaugcauucuguuuaaaauguauuacuuccugaaccugag

SEQ ID NO: 34999 - RNA, 49 nt, Mus musculus
gacaaagugaugggcccucucaucuuuaaugcaagcaucaugacagauc

SEQ ID NO: 35000 - RNA, 50 nt, Mus musculus
uuccacaacacugugucacaucacaaaggaaaacugccauaacacaccac

SEQ ID NO: 35001 - RNA, 34 nt, Mus musculus
gcauucugcaugggugcagaaauggagugggucu

SEQ ID NO: 35002 - RNA, 45 nt, Mus musculus
auugcaucuaaugcauuacaaaaaagcagauagauuugcugggga

SEQ ID NO: 35003 - RNA, 45 nt, Mus musculus
cacuugauugaaacagaguaaauuacuccuaaaaacagugaucca

SEQ ID NO: 35004 - RNA, 86 nt, Mus musculus
gucuguggauuuccccuaugguggagagauugugaugcucagaucugacaguucaggaacuggagcuugaaaggaggugucccaau

SEQ ID NO: 35005 - RNA, 47 nt, Mus musculus
uauaucuguaaucccaacacuggggagggauaucaggagggucagga

SEQ ID NO: 35006 - RNA, 46 nt, Mus musculus
gaguuuggggcuagccugagcuacacaaucccuugucacauuaaag

SEQ ID NO: 35007 - RNA, 42 nt, Mus musculus
cuuuacaagugaccaucccucccucucgguaggugcccucag

SEQ ID NO: 35008 - RNA, 45 nt, Mus musculus
ccugggagaggcugggcugugggagcacuccccuccaugcauuca

SEQ ID NO: 35009 - RNA, 46 nt, Mus musculus
uuaaaauuguucuucguuucuuuucauuaaugguuuaaucagcuag

SEQ ID NO: 35010 - RNA, 42 nt, Mus musculus
uugacgguuaucgagugagcuugcauuguguagccagggccu

SEQ ID NO: 35011 - RNA, 45 nt, Mus musculus
uuugagcccuucuguaguauaauagggcucuuacagggugggaaa

SEQ ID NO: 35012 - RNA, 42 nt, Mus musculus
uggaauacaaaucccauccagcuucacauuucaauuagagag

SEQ ID NO: 35013 - RNA, 46 nt, Mus musculus
aggcauucagcugcgacuuuucagacccuaaaaccaagccagggag

SEQ ID NO: 35014 - RNA, 46 nt, Mus musculus
cugucaguuugagaccagcaugcucuacacagagagacccugggag

SEQ ID NO: 35015 - RNA, 88 nt, Mus musculus
aaauuuuauauauggaggauggaaaugcuuauauauuuauugaagaucuuuuuauuugaaauuaaaaucauuugguaaauaaugguuu

SEQ ID NO: 35016 - RNA, 47 nt, Mus musculus
gauuuuuauuuguugcaauacguuaaauuucagagguacuuuggggc

SEQ ID NO: 35017 - RNA, 46 nt, Mus musculus
aaacaugcguuuaauguguauuuuuaaacaaauuuauggcaauuaa

SEQ ID NO: 35018 - RNA, 45 nt, Mus musculus
cugugucauuacaaugcuuuguauaaugccaaaccauagcuggag

SEQ ID NO: 35019 - RNA, 32 nt, Mus musculus
ccuuugcucuacaggucaauaguuccccagua

SEQ ID NO: 35020 - RNA, 45 nt, Mus musculus
uucuuccuuuucgacugcucaaacuccugguugccccauguguag

SEQ ID NO: 35021 - RNA, 42 nt, Mus musculus
gcggaaccucucugcacugcccccaccaauuaaaggcggaau

SEQ ID NO: 35022 - RNA, 45 nt, Mus musculus
uuugaaaaagcagccaguaacuucugagacuucagugcgguggca

SEQ ID NO: 35023 - RNA, 41 nt, Mus musculus
gcauccacaugguggcucacagccaucgguaaaggggucuu

SEQ ID NO: 35024 - RNA, 41 nt, Mus musculus
acaaccgucuguaaugggaucugaugcccucuucuggcagg

SEQ ID NO: 35025 - RNA, 23 nt, Mus musculus
uuaccgaugcgguccuggccgug

SEQ ID NO: 35026 - RNA, 42 nt, Mus musculus
gagacaggggacaagaaaugggaugaggaacuguuggcggug

SEQ ID NO: 35027 - RNA, 45 nt, Mus musculus
aauagagcauucucugugccuggagacuuucaaggacugaggcag

SEQ ID NO: 35028 - RNA, 45 nt, Mus musculus
cgaguuagccaugaugcagcaggcagggccgugguggaaaaggag

SEQ ID NO: 35029 - RNA, 24 nt, Mus musculus
gaagcuccagguguugguguuggu

SEQ ID NO: 35030 - RNA, 35 nt, Mus musculus
agcugggccagcaagauggaagcccugaccagcag

SEQ ID NO: 35031 - RNA, 24 nt, Mus musculus
ccacucccuccauugccaugugga

SEQ ID NO: 35032 - RNA, 42 nt, Mus musculus
uccucuuggucgcugcucaugcuacuccaucugugcccccug

SEQ ID NO: 35033 - RNA, 45 nt, Mus musculus
uggacgacugcuuugggcugggccgcucagcuuacaaugaaggag

SEQ ID NO: 35034 - RNA, 76 nt, Mus musculus
gagcuggagggaaucugcgguacuuugaacgguuguuagaggaagaaagagggaaaucacugucaaaucagacaga

SEQ ID NO: 35035 - RNA, 87 nt, Mus musculus
cgccggacuggccacccaggaaaacuuguacgagaggcccacggacuaccugccugagagggauguguacgagagccugugucgagg

SEQ ID NO: 35036 - RNA, 46 nt, Mus musculus
cggcguccccccaucaauaguccuucagacuuauucuaaucuccau

SEQ ID NO: 35037 - RNA, 49 nt, Mus musculus
cgucagguacuaugaugugauguccgacgaagaaaucgagaggaucaag

SEQ ID NO: 35038 - RNA, 26 nt, Mus musculus
ggggagggcugcagugaggggugaug

SEQ ID NO: 35039 - RNA, 26 nt, Mus musculus
ggggagggcugcagugaggggugaug

SEQ ID NO: 35040 - RNA, 46 nt, Mus musculus
ucucuugucaccuccuguuccaggccacugccaucucuugcccuga

SEQ ID NO: 35041 - RNA, 46 nt, Mus musculus
aaccggcggaugcaacauaucaccgggcuaacggugaagacugcag

SEQ ID NO: 35042 - RNA, 46 nt, Mus musculus
ugcagccugcccugugcuugugggcugcaaguggggugaguggcuu

SEQ ID NO: 35043 - RNA, 46 nt, Mus musculus
uguguguguguguguguguuuguguguguguguguuuguguaagug

SEQ ID NO: 35044 - RNA, 65 nt, Mus musculus
uugauugacguccuuuucucuccgcuccucccuggcccauaguccaaaucaucuucaaguucaac

SEQ ID NO: 35045 - RNA, 46 nt, Mus musculus
ucuauuuguuguggcuuuaaccaaaaaauaaaaauguuccugccag

SEQ ID NO: 35046 - RNA, 41 nt, Mus musculus
aaggcaauaaauaaauaaauacauaaauacauaaauaaaua

SEQ ID NO: 35047 - RNA, 36 nt, Mus musculus
agcuugggaguugagagccagggagaugagauccag

SEQ ID NO: 35048 - RNA, 25 nt, Mus musculus
gauugcaugcuuuguuucuuucuga

SEQ ID NO: 35049 - RNA, 46 nt, Mus musculus
guaggaugugugaggggcguacaugagccacaguguauuugugaag

SEQ ID NO: 35050 - RNA, 46 nt, Mus musculus
uaaacagaguccugugggcuugcuucaucuguuucuugaacuggag

SEQ ID NO: 35051 - RNA, 46 nt, Mus musculus
uucguccagaggaagggauuacagaccuaugccaccaugcccagag

SEQ ID NO: 35052 - RNA, 42 nt, Mus musculus
ucucacaccaaguguagcugagauaccaccuuuuacccccaa

SEQ ID NO: 35053 - RNA, 42 nt, Mus musculus
uaugauuaaacuuuuaagaagagaaagaaaauaucaaaggag

SEQ ID NO: 35054 - RNA, 45 nt, Mus musculus
auucuuucauuuugaacuguauguuaccguuauuuauuaaaggag

SEQ ID NO: 35055 - RNA, 41 nt, Mus musculus
gcucgcaaagaccaaaauuuuggacuaguaccagauauuag

SEQ ID NO: 35056 - RNA, 46 nt, Mus musculus
acuguggcuauaaauaccauucacuuguuuugugucuagaccuaag

SEQ ID NO: 35057 - RNA, 46 nt, Mus musculus
uaguuacaaacauuuuuguuagugcaaaguaaaacuucaagugcau

SEQ ID NO: 35058 - RNA, 44 nt, Mus musculus
auggauagcccugaguuauuaucuauuucguuucaucugggcug

SEQ ID NO: 35059 - RNA, 65 nt, Mus musculus
ggacucuucucucaucucuggggcaaccaggucucaggaguccacauuacaauauguagcaacag

SEQ ID NO: 35060 - RNA, 46 nt, Mus musculus
aguuuuaacauagaucuaaaugccagugguacagagaaaggugggg

SEQ ID NO: 35061 - RNA, 41 nt, Mus musculus
uaaauuuccaaacuaccauuaagaaucaguguugagccaag

SEQ ID NO: 35062 - RNA, 45 nt, Mus musculus
uugcuugcuuguuugcuuguuugcuugcuugcuugcuugcuugcc

SEQ ID NO: 35063 - RNA, 46 nt, Mus musculus
aguuguuuuaaaaugcauggagagaaaaauuuaaaugcuggcacuc

SEQ ID NO: 35064 - RNA, 41 nt, Mus musculus
uaccuaacccuugagagacuugaagccccagggagugggga

SEQ ID NO: 35065 - RNA, 46 nt, Mus musculus
aucugcuuagaauccuaaauacuuggugcccuucuucuuagcccuu

SEQ ID NO: 35066 - RNA, 42 nt, Mus musculus
ccuucacccaauguacuagaaucugauguguuuauaaaaaga

SEQ ID NO: 35067 - RNA, 46 nt, Mus musculus
uuauucagggcauggggaggggagcuaagaagguaguagaggcaaa

SEQ ID NO: 35068 - RNA, 46 nt, Mus musculus
ggagcauaccugacuguuaccagauaacuguggagguggaguuuag

SEQ ID NO: 35069 - RNA, 46 nt, Mus musculus
gguaucacuuaaaaaauauucuucaauaccaauuugugcuguccaa

SEQ ID NO: 35070 - RNA, 46 nt, Mus musculus
cauaacuuugauaguugugaacaacaaucaaaggguucagugggaa

SEQ ID NO: 35071 - RNA, 41 nt, Mus musculus
gucccauuccauugauuuguuuaucuuucuguuggccccau

SEQ ID NO: 35072 - RNA, 46 nt, Mus musculus
auuauagauucaucaucauaguuuauacuuacagucuuaaugguag

SEQ ID NO: 35073 - RNA, 46 nt, Mus musculus
ucuucuggugugucugaagacaguacaguguacucacauaacauaa

SEQ ID NO: 35074 - RNA, 45 nt, Mus musculus
agucucaaaaauaaacaaaaaaaugaagaagaaaagagaauugag

SEQ ID NO: 35075 - RNA, 46 nt, Mus musculus
aggaccaguugcucggcuaagaggaaaguacuuuuggaggaagcca

SEQ ID NO: 35076 - RNA, 46 nt, Mus musculus
acagcaaugagacccacaggaauaguuguugaaaagaaaccuccag

SEQ ID NO: 35077 - RNA, 41 nt, Mus musculus
gagaguccugugagcuuccuuguuggagucauucagaucca

SEQ ID NO: 35078 - RNA, 46 nt, Mus musculus
auugaaaccaggacuauugaugauguuccaguuaaaacaaguacag

SEQ ID NO: 35079 - RNA, 46 nt, Mus musculus
ucagauagugcccuuggagauagugagagugaagacacaggcccgg

SEQ ID NO: 35080 - RNA, 46 nt, Mus musculus
cuccccgacuggugcaugugugcuucaccaccucaaugcugcgauu

SEQ ID NO: 35081 - RNA, 44 nt, Mus musculus
ccagaagagggggucagaucucguuacagaugguugugagccac

SEQ ID NO: 35082 - RNA, 45 nt, Mus musculus
gagccaucucaccagcccccucuucccagauuuuuauauggccau

SEQ ID NO: 35083 - RNA, 45 nt, Mus musculus
auaaauggacuguucaaguggccagcagucagagacgaguaacag

SEQ ID NO: 35084 - RNA, 60 nt, Mus musculus
auguuuucuaguuauaaaguaauuuuuuuaucaggugcuuuuaguaguucauuuucauua

SEQ ID NO: 35085 - RNA, 46 nt, Mus musculus
guauuuuggguuuuacuauuuuagcuuagaaaucucaaucagcaag

SEQ ID NO: 35086 - RNA, 46 nt, Mus musculus
ccucauguccucuccccagcaaggaaagaaauuugauacuacucaa

SEQ ID NO: 35087 - RNA, 46 nt, Mus musculus
gaaaucuucaauucacugauuuuuaauuuuuaauucuaugguacag

SEQ ID NO: 35088 - RNA, 45 nt, Mus musculus
aaauacuguauuuuuuaaauaugcucagguggccacaaacuucag

SEQ ID NO: 35089 - RNA, 42 nt, Mus musculus
aaaaaaaaagagagaaagaaaggaaaaaagaaagaaaagaag

SEQ ID NO: 35090 - RNA, 45 nt, Mus musculus
uuguaauacuuuuaucaucauauucuuuacuuacucaaagcccaa

SEQ ID NO: 35091 - RNA, 46 nt, Mus musculus
ggcacgcagugcagaugaucacuaacaguuugcauaaugccuccau

SEQ ID NO: 35092 - RNA, 45 nt, Mus musculus
caauucucaccaaccacaugguggcucacaaccaucuauauugag

SEQ ID NO: 35093 - RNA, 42 nt, Mus musculus
aguuacuuuucucacugacaaaauacauaucaaaagcaacau

SEQ ID NO: 35094 - RNA, 46 nt, Mus musculus
aaaaaaaaaaaaaaaucguuuaagggguuaguguggauauaguaag

SEQ ID NO: 35095 - RNA, 45 nt, Mus musculus
uguguaggggaaggcaaacgaugugugccgcugugcacaugugga

SEQ ID NO: 35096 - RNA, 45 nt, Mus musculus
uuaugcugggcaauaggcaguuguuuuaauauuucccuggcccug

SEQ ID NO: 35097 - RNA, 46 nt, Mus musculus
gugccuguagaggccaaaagaggacaucagaugcuccuggaacgaa

SEQ ID NO: 35098 - RNA, 46 nt, Mus musculus
augguuggggugcuuaaaaagauuugagugaggaggaugggucaua

SEQ ID NO: 35099 - RNA, 52 nt, Mus musculus
acagaaaaaccuggucucaaaagaacaaaaaggagagagagagagagagaga

SEQ ID NO: 35100 - RNA, 45 nt, Mus musculus
ucuccaucauauaugcugcaguuuugucuucaauaaaauggggug

SEQ ID NO: 35101 - RNA, 102 nt, Mus musculus
uggaaguuuucuuuugguugcuucuauuuuuuagggguuaaggaagcugcagaucacucaaaauaaaaugaauaaggagaauuaagggaauucuggaaaagg

SEQ ID NO: 35102 - RNA, 54 nt, Mus musculus
cacgucuggcuccuguuguguuuuauuaaaaagaaaaagccaaggauguauuug

SEQ ID NO: 35103 - RNA, 90 nt, Mus musculus
guuuaguauagaauaguuuauuuagggcaugagaaagggaguagagacagacagaaagacagacagacagacaggaggagagccuggcca

SEQ ID NO: 35104 - RNA, 48 nt, Mus musculus
gaggaguggggaagcaggaagugggagaauggggucaggaugagaagg

SEQ ID NO: 35105 - RNA, 46 nt, Mus musculus
gacuguugccagguaacugggacagaaaggauuuguaucagccaag

SEQ ID NO: 35106 - RNA, 46 nt, Mus musculus
ugagguauaaggagaagacagccaucuuuaggcccagaggcaggag

SEQ ID NO: 35107 - RNA, 46 nt, Mus musculus
uuauaacauuuugaaaauuccuagaaaaugagugguaaauauggag

SEQ ID NO: 35108 - RNA, 45 nt, Mus musculus
uaguugaguaauguuaaauuuauuaaacuaaauaccaaggcacag

SEQ ID NO: 35109 - RNA, 46 nt, Mus musculus
cauagaaauacaaugagguucucuacuggggcagcuuaaccuaaag

SEQ ID NO: 35110 - RNA, 46 nt, Mus musculus
uacagucacaaagauuucuuuucccuuuaggaauuuuuagguugag

SEQ ID NO: 35111 - RNA, 62 nt, Mus musculus
ugaauugcuuaauucauugccuaaagcauauuuugugauagcagagagaugugauauuagua

SEQ ID NO: 35112 - RNA, 35 nt, Mus musculus
uuuuaauugguuuuuaguaguuuuggaaguuguag

SEQ ID NO: 35113 - RNA, 42 nt, Mus musculus
ggaaggugguguuggaugcccuggagcuagaguuagaggaag

SEQ ID NO: 35114 - RNA, 45 nt, Mus musculus
aagaggaguagaggucggccaugaacauguggagaaagaggaggu

SEQ ID NO: 35115 - RNA, 46 nt, Mus musculus
agcaaacaaaugaacagucaugaggaccugaauuuaauccccuaga

SEQ ID NO: 35116 - RNA, 45 nt, Mus musculus
ggcuuccugagcucaucuagugacgaguaucuccuagagaccuuc

SEQ ID NO: 35117 - RNA, 46 nt, Mus musculus
agauagauuuuaaguuuuucuuaccgaauacuuagaauaggugcag

SEQ ID NO: 35118 - RNA, 46 nt, Mus musculus
uauguacauugugguuuaaagauuuuaaguaaucuuguugcuguag

SEQ ID NO: 35119 - RNA, 46 nt, Mus musculus
uuguuuuucuauguaucuccuauuuuuuuuuuugaccaugccacau

SEQ ID NO: 35120 - RNA, 46 nt, Mus musculus
gagaucugaugccuuucaaggauaccaggcacaugcauacaucuag

SEQ ID NO: 35121 - RNA, 46 nt, Mus musculus
cucuggaaggcuauuacugaccucuuuuccuaauauuaaugcugag

SEQ ID NO: 35122 - RNA, 46 nt, Mus musculus
agcccaaagauuuauuuauuauuauauguaaguacagacacaccag

SEQ ID NO: 35123 - RNA, 47 nt, Mus musculus
guuuccuaaggauaaaacuaacucauguggauguguccagggaccca

SEQ ID NO: 35124 - RNA, 72 nt, Mus musculus
caauaauuguuuaacucaggucuuaauguaugucagcagucuaaggauaauuuuugacagcauuccagguag

SEQ ID NO: 35125 - RNA, 59 nt, Mus musculus
uagaaaaugauguguuuaaauuagagguaauagugugauccaguucagacaaaguauuc

SEQ ID NO: 35126 - RNA, 45 nt, Mus musculus
aguuaaccguguuugauagcuacagauugauuucucuaagcagag

SEQ ID NO: 35127 - RNA, 42 nt, Mus musculus
agaugaugucaucuuuucuuauaagccagccaaacuggggag

SEQ ID NO: 35128 - RNA, 46 nt, Mus musculus
uguacagaauuguaaaaacuauaaaauagauggguacauuagccag

SEQ ID NO: 35129 - RNA, 45 nt, Mus musculus
acuugcuuugacugauagauacgauauuagucucuuugcugccaa

SEQ ID NO: 35130 - RNA, 45 nt, Mus musculus
uuguuuguaaagaggguuggaggagcuacauuuauauagcaacaa

SEQ ID NO: 35131 - RNA, 46 nt, Mus musculus
auggcuuuucuuguucgauguuacgccaauugucuucagccauggg

SEQ ID NO: 35132 - RNA, 46 nt, Mus musculus
uauaaauccuugucucaaugucaugugauuuagagaaagccucuga

SEQ ID NO: 35133 - RNA, 46 nt, Mus musculus
cacaccuccuccccaucccaccccauauucacauggaugcccccac

SEQ ID NO: 35134 - RNA, 45 nt, Mus musculus
aggaaacagcuguaucaggcuccugucagcaaguacuucuuggca

SEQ ID NO: 35135 - RNA, 46 nt, Mus musculus
acugaagcaucaauucuuugaucuuccuuccucuugagcuucaugu

SEQ ID NO: 35136 - RNA, 45 nt, Mus musculus
ucugagguucugccagacugauuuccaaaugguuguaccggcuug

SEQ ID NO: 35137 - RNA, 46 nt, Mus musculus
aaagguuuucagauuauuuauagaaauaaagaaucaaguauggcag

SEQ ID NO: 35138 - RNA, 62 nt, Mus musculus
ccucaaaauuagggcgcagaauccuuggugggagucuuaacuauauaucagaaaggggguca

SEQ ID NO: 35139 - RNA, 45 nt, Mus musculus
ucuauaaaaaacacaugaucuucagcagaccacacgaguccagau

SEQ ID NO: 35140 - RNA, 46 nt, Mus musculus
uuuguuuagauuuuuuucauacuuaguuuagauuuacagcccaucu

SEQ ID NO: 35141 - RNA, 45 nt, Mus musculus
ccugagauccagcacugauuauagcuuccuugccuacuaguguua

SEQ ID NO: 35142 - RNA, 46 nt, Mus musculus
aaagugaggagggaugcgagagaaccugcacuugaaauccagagag

SEQ ID NO: 35143 - RNA, 46 nt, Mus musculus
gggauucagucuuucauauguugggauuguaagcgugagccaccac

SEQ ID NO: 35144 - RNA, 46 nt, Mus musculus
augguuuuugaaguaguagagcaggcuggggcuguuauucuugaag

SEQ ID NO: 35145 - RNA, 46 nt, Mus musculus
ggauaaaagaguaguguauccuuaguaguucuuuguguugcggggg

SEQ ID NO: 35146 - RNA, 51 nt, Mus musculus
guugaggaagagggagagauugucaugguacaugagcaccgugagcuagac

SEQ ID NO: 35147 - RNA, 46 nt, Mus musculus
ucagcuauaugaaauugucccccccacccccaaaaaaagagaaaag

SEQ ID NO: 35148 - RNA, 46 nt, Mus musculus
uagaaucugguagcaaagcugcugacgcaggacugaaaagggguga

SEQ ID NO: 35149 - RNA, 44 nt, Mus musculus
uaaauaaucuguuacuuuugucucuuuuggggaggguaguuuug

SEQ ID NO: 35150 - RNA, 42 nt, Mus musculus
aaacuggugggugggguauggggaaaccgugguaggccaggc

SEQ ID NO: 35151 - RNA, 45 nt, Mus musculus
cugucccuuuccucagucuacucauuaaaaauaucuaacaaccag

SEQ ID NO: 35152 - RNA, 49 nt, Mus musculus
uugaaauuuugagaaauaauacucaucuugcacuuacugugaagaccaa

SEQ ID NO: 35153 - RNA, 46 nt, Mus musculus
auugagugaaacauugaaauauauaaaugagauuucuaaacagcau

SEQ ID NO: 35154 - RNA, 45 nt, Mus musculus
ccacagucaucuucugucuuaagugacuuuaaacaaagaaggaaa

SEQ ID NO: 35155 - RNA, 75 nt, Mus musculus
aauucaagaugucccaggggauauggagcaggcaccacaggagaaaggaaauaagaaaauuaaagcaaauaccgu

SEQ ID NO: 35156 - RNA, 46 nt, Mus musculus
gccuccaaaacuauuuagguagguaauaccaauauaccaugugggg

SEQ ID NO: 35157 - RNA, 42 nt, Mus musculus
gccacucaggcaugcugaccuaaguucagaccccacacccac

SEQ ID NO: 35158 - RNA, 46 nt, Mus musculus
cuuuucuccucuuaacuaaucuuaaaauguuuaauugugacagcag

SEQ ID NO: 35159 - RNA, 47 nt, Mus musculus
cuggcuauaaugccaauucccggaacacuuucauccagcagcccaga

SEQ ID NO: 35160 - RNA, 46 nt, Mus musculus
ccagaaccacuugcugaggcuuagccuccaaaguucuaucagagag

SEQ ID NO: 35161 - RNA, 27 nt, Mus musculus
aguaagcauuguccuggagaugugagc

SEQ ID NO: 35162 - RNA, 44 nt, Mus musculus
cucuuuaaaauaaaguuaauauaaaacugagaaaauaggcugca

SEQ ID NO: 35163 - RNA, 46 nt, Mus musculus
ucuguaucaagauagaaaacaguaaucccauguugguuggcuccag

SEQ ID NO: 35164 - RNA, 42 nt, Mus musculus
ugaacucaugugaaacaguucauauuggaacguucuccccag

SEQ ID NO: 35165 - RNA, 46 nt, Mus musculus
uaccuaaaaaacaacauggaaacagaaacauuguguucugaugaag

SEQ ID NO: 35166 - RNA, 46 nt, Mus musculus
ugccucagagauuuuaagugagucaaaucagcugaaaagaaugaag

SEQ ID NO: 35167 - RNA, 46 nt, Mus musculus
acaaucugauggaaggugugugugugugugugugugugugugugug

SEQ ID NO: 35168 - RNA, 46 nt, Mus musculus
cugugaagaaugcuguuuauucucuguucauacucucuaggcagau

SEQ ID NO: 35169 - RNA, 47 nt, Mus musculus
uaauuggauuuaacucuauuuuauucuuguuaccucaaagcacugaa

SEQ ID NO: 35170 - RNA, 46 nt, Mus musculus
ucaaaucccagcaaccacaugguggcucacaaccaccuguaauugg

SEQ ID NO: 35171 - RNA, 45 nt, Mus musculus
accuggaggaggcuuguugucugucuuuguuuuuguugaaugucc

SEQ ID NO: 35172 - RNA, 45 nt, Mus musculus
uguuccauaaacugcuuaguaacaccauccuuuaauaguaggcag

SEQ ID NO: 35173 - RNA, 46 nt, Mus musculus
cuaggccuauaauaaaaagagaccuauaaccuauucuucuggccag

SEQ ID NO: 35174 - RNA, 42 nt, Mus musculus
aaggagggagggaaggaaggaaggaaggaaggaaggagggag

SEQ ID NO: 35175 - RNA, 46 nt, Mus musculus
aaguuugagaccagcuugaauuacauaucuguuaagagagugacag

SEQ ID NO: 35176 - RNA, 50 nt, Mus musculus
ugaggacacuaccaggagaaggaugacauccccguuuagaagauuuaggg

SEQ ID NO: 35177 - RNA, 46 nt, Mus musculus
aaagggaauugacaauaauauuaacagaaaauauacuugcuaucag

SEQ ID NO: 35178 - RNA, 42 nt, Mus musculus
uaaaauagagagugauccauccauuaagacaucagaugccaa

SEQ ID NO: 35179 - RNA, 45 nt, Mus musculus
augcacacacacaucuauacacacauauacucacacaugcacaca

SEQ ID NO: 35180 - RNA, 70 nt, Mus musculus
caguauauacauguguaccuguacacaugcacacgcacauacacacacacacaccaaaaaaaugaaacua

SEQ ID NO: 35181 - RNA, 44 nt, Mus musculus
cacaggggucucagcagucuuucggaaaggagaacaaagcgcaa

SEQ ID NO: 35182 - RNA, 45 nt, Mus musculus
aggguggcauguugguuaccuccaugaucucuaccaagcuggaag

SEQ ID NO: 35183 - RNA, 45 nt, Mus musculus
guacggugaaggagcgcacagcuguaauagcacuguuugccuggg

SEQ ID NO: 35184 - RNA, 45 nt, Mus musculus
gaaugcauccuaggaagcucugcuaugcaucuuucauugguagau

SEQ ID NO: 35185 - RNA, 25 nt, Mus musculus
cugagucagaggagaaaguagagaa

SEQ ID NO: 35186 - RNA, 46 nt, Mus musculus
ccccaccacucauugcgccaguaguccuuugucccugguaagagau

SEQ ID NO: 35187 - RNA, 44 nt, Mus musculus
ugcucguuagccagcuaauauugcugagucagagagcuaagguc

SEQ ID NO: 35188 - RNA, 24 nt, Mus musculus
aagguggaggaaagaucaaaaaca

SEQ ID NO: 35189 - RNA, 41 nt, Mus musculus
auaugcucagcccaggaaguggcacuauuagguguggcccu

SEQ ID NO: 35190 - RNA, 44 nt, Mus musculus
uccucauguuaauuacugcugugaacagacaccaugaccaaggc

SEQ ID NO: 35191 - RNA, 45 nt, Mus musculus
cuauaaauuacaacugcaagguagcuaagcuguaagaauacagga

SEQ ID NO: 35192 - RNA, 46 nt, Mus musculus
ugaagaggacugauugaaauguaguugugugauugagcccccaaau

SEQ ID NO: 35193 - RNA, 42 nt, Mus musculus
ccaccaggcaucagagcacgagaguuggcgaaucuucaaggg

SEQ ID NO: 35194 - RNA, 46 nt, Mus musculus
uuuauaguaaugaaacugaaauaauuacuuuuaaggggagccuuau

SEQ ID NO: 35195 - RNA, 42 nt, Mus musculus
cuugugcuguccauagaaugaaggagagaugggugaguucag

SEQ ID NO: 35196 - RNA, 47 nt, Mus musculus
gggcuucccuuccaaccaauuuggcaaacaggagccaggcgagaacu

SEQ ID NO: 35197 - RNA, 41 nt, Mus musculus
ggguacaggaaauaggaggcuguggguaacugucugggcag

SEQ ID NO: 35198 - RNA, 29 nt, Mus musculus
ucuuugagaaaggagaugugaacggggag

SEQ ID NO: 35199 - RNA, 47 nt, Mus musculus
caggcagcccugagcgccagggggaaguaacugaugcccccacccua

SEQ ID NO: 35200 - RNA, 45 nt, Mus musculus
uucaggaaggaagccacauucccagucauucuacccccaccccag

SEQ ID NO: 35201 - RNA, 49 nt, Mus musculus
acacccucauauuuuuuucagcuuucuguuccaaaugagcccaaaggaa

SEQ ID NO: 35202 - RNA, 47 nt, Mus musculus
accugaacaucauucuuggggccagcaucucccacaugcccacacua

SEQ ID NO: 35203 - RNA, 43 nt, Mus musculus
ugcuauccucucacucuguccacugguaucucaacacccccau

SEQ ID NO: 35204 - RNA, 46 nt, Mus musculus
ucuuucuuuuguaucaguagauuaucuugggugcccgggcccaggg

SEQ ID NO: 35205 - RNA, 48 nt, Mus musculus
gaccacucuagcaagaaccugucaguuuaguccacggccugagaccug

SEQ ID NO: 35206 - RNA, 45 nt, Mus musculus
cugccuugacuacugcugauugccuucagccagauuuacucuaag

SEQ ID NO: 35207 - RNA, 46 nt, Mus musculus
cugguuuacagagugaaugagugagugaguuccaggacaaccagag

SEQ ID NO: 35208 - RNA, 46 nt, Mus musculus
uaaccaaaacaaauuuuuaaaaaagcagcacagaacuuugcaagag

SEQ ID NO: 35209 - RNA, 45 nt, Mus musculus
ugaagucuaugcuguacuggagacuccaggaaguuaaaaaugcca

SEQ ID NO: 35210 - RNA, 42 nt, Mus musculus
gacucccuucugaaacagggauauuuacugugccuggcccaa

SEQ ID NO: 35211 - RNA, 46 nt, Mus musculus
cccaggcuaaccuuaaacuugcuauguagucaagggaugaccuggg

SEQ ID NO: 35212 - RNA, 42 nt, Mus musculus
ccgaaucccugcacaggguggacgccagguguacuccggcug

SEQ ID NO: 35213 - RNA, 29 nt, Mus musculus
gaagggacaggugacaacaacuaucgaga

SEQ ID NO: 35214 - RNA, 42 nt, Mus musculus
agcagaaagaccagagagaaaggaagaaagaaggcaggggga

SEQ ID NO: 35215 - RNA, 46 nt, Mus musculus
aaugaauucugaugcccucuucuggagugucugaagacagcuacag

SEQ ID NO: 35216 - RNA, 46 nt, Mus musculus
cucagauggcccccaacgccuucuggacucccaaaagcugcaggcg

SEQ ID NO: 35217 - RNA, 45 nt, Mus musculus
cucagcugguaguccuggaguguguaagaaaggcugagguagcca

SEQ ID NO: 35218 - RNA, 46 nt, Mus musculus
uaguggggccucagaggagggcacauguacaaagacuacaugggaa

SEQ ID NO: 35219 - RNA, 46 nt, Mus musculus
cuacucugaaaauuuaaccaauggaaauacugaaccaggggcugag

SEQ ID NO: 35220 - RNA, 46 nt, Mus musculus
cgggcaaugguggcacacaccuuuaaucuuagcacuugggaggcag

SEQ ID NO: 35221 - RNA, 23 nt, Mus musculus
ccugaucuaccccaaauguucac

SEQ ID NO: 35222 - RNA, 45 nt, Mus musculus
uuuauuugcucucucucucucucucucucucucucucucugugug

SEQ ID NO: 35223 - RNA, 45 nt, Mus musculus
uucccauucauguuuuccuccuggucccucaaggacacccuuugg

SEQ ID NO: 35224 - RNA, 46 nt, Mus musculus
cuucuuuuaggcggugcgcugcacuguggcucauuugcaauggcag

SEQ ID NO: 35225 - RNA, 79 nt, Mus musculus
aagagaguuaaucuauggagaaaccauagauucgggggcacugagaucccaauaucaucagcccucaguaaaaacugcu

SEQ ID NO: 35226 - RNA, 46 nt, Mus musculus
ugcauguuugucucugaugcauucuguugggugcccagcaacccag

SEQ ID NO: 35227 - RNA, 46 nt, Mus musculus
uagauauacaugauggcaauccacagcucccacaauacaggccaga

SEQ ID NO: 35228 - RNA, 45 nt, Mus musculus
accaguaauuaucuguagccacuuuuauucaaccaauagcuuuaa

SEQ ID NO: 35229 - RNA, 45 nt, Mus musculus
agaagauuggucagaacaaguacgagggagagagacagaggucag

SEQ ID NO: 35230 - RNA, 42 nt, Mus musculus
ucgcugcauuccgggcccucuucuuucccuguuuucugcuug

SEQ ID NO: 35231 - RNA, 45 nt, Mus musculus
gccggccuugugagguggagcccaguuagaggcaguaggccugca

SEQ ID NO: 35232 - RNA, 42 nt, Mus musculus
cggaugguuaugaauggguuaagauggaggccaggcuggcag

SEQ ID NO: 35233 - RNA, 45 nt, Mus musculus
gcuuguauauuauagcacuuagggagaaguacaggaaauucagga

SEQ ID NO: 35234 - RNA, 45 nt, Mus musculus
ggcuucuccuugcugaucuaguacauuuucuucagcuauuaucca

SEQ ID NO: 35235 - RNA, 46 nt, Mus musculus
caaguuuaagaccagccugagccacauacaagccuaucacaccaag

SEQ ID NO: 35236 - RNA, 42 nt, Mus musculus
aggcaugauggucuacauacucggaacccuaggucugaggag

SEQ ID NO: 35237 - RNA, 47 nt, Mus musculus
cugauagacgaauacauuccuccuggagagagcugcccagagccccu

SEQ ID NO: 35238 - RNA, 81 nt, Mus musculus
gcccaacaucugaugggcuguaagccaugcuccuuugcaccccuaccaacuuucuaagaauuucuuucguauccaaaacag

SEQ ID NO: 35239 - RNA, 53 nt, Mus musculus
ggcccaaccuggaccuccuggaguuaugcucaccccacuucuuuguuuuaguc

SEQ ID NO: 35240 - RNA, 46 nt, Mus musculus
ucuggaauggcauaucuaguucuaaagaggugcaguccccugcaag

SEQ ID NO: 35241 - RNA, 45 nt, Mus musculus
uggucucaacuguggucuaauaugggcagacacuaacagccccag

SEQ ID NO: 35242 - RNA, 45 nt, Mus musculus
ugacaagucuuucaaaauaaaaaguaacaacuuagaaacggcugu

SEQ ID NO: 35243 - RNA, 51 nt, Mus musculus
uugaaaccuucuacuaaucaagagaaacuuccaagccaacggaauggucag

SEQ ID NO: 35244 - RNA, 64 nt, Mus musculus
uaggcacugggaggcuguuucaggaaagugagacucaagaggaagacagaaaagguuguaacgu

SEQ ID NO: 35245 - RNA, 97 nt, Mus musculus
accagucagaacccacauggcaagucuuaguagccuaggucaaggaaagacagaauaauccagagcuguggcacacaugacagacucccagcagccc

SEQ ID NO: 35246 - RNA, 132 nt, Mus musculus
ucacccagacucugugcuuauuucauuuugggggaugugggcuuuuuccccuggugguuuggaguuaggcagagggaaguuacagacacagguacaaaauuuggguaaagaugcugugagaccugaggaccc

SEQ ID NO: 35247 - RNA, 90 nt, Mus musculus
guuggaaacggaguugcauaagcucaccguccacaagcacgaggagauaucucuagcuuucauuucuguuuugcauuugacucuuaacac

SEQ ID NO: 35248 - RNA, 95 nt, Mus musculus
aggugcuaacauagauuuaacugaauacauuaacggugcuaaaaaaaaaaaaaaaacaaaguaagaaagaaacuagaacccaagucacagcauuu

SEQ ID NO: 35249 - RNA, 49 nt, Mus musculus
uccugaacucucucccucugauguguccccccucccauuacccccuugu

SEQ ID NO: 35250 - RNA, 47 nt, Mus musculus
cauggaacauugcaccacacguuucuuugagaccugugaccuagaca

SEQ ID NO: 35251 - RNA, 41 nt, Mus musculus
gggggaagggaagggagaagggaagggaagggaagggaagg

SEQ ID NO: 35252 - RNA, 42 nt, Mus musculus
gacgccuccugugagcaggaggcugugaggaacacuggaguc

SEQ ID NO: 35253 - RNA, 45 nt, Mus musculus
ucacucuauguccgguugugugcugaccaacccccacccccaauu

SEQ ID NO: 35254 - RNA, 52 nt, Mus musculus
aaugagaagcgccuggaggcuggagaccaccccguggagcuguuggcccgag

SEQ ID NO: 35255 - RNA, 46 nt, Mus musculus
ccuuguacgagagagaugagggcaacaaccuccucacugagaagca

SEQ ID NO: 35256 - RNA, 46 nt, Mus musculus
uguguaaaaaggcuaggugugguagcacacacuuguagccccagug

SEQ ID NO: 35257 - RNA, 44 nt, Mus musculus
gagagagaggaguagaggccagccaugagcauguuggggggggg

SEQ ID NO: 35258 - RNA, 47 nt, Mus musculus
auagaguuuauucagggaauggggaggggaguugagaggguaguaga

SEQ ID NO: 35259 - RNA, 52 nt, Mus musculus
agugcacccuggagggcaccaagaagggccacaagcuccaccuggacuacau

SEQ ID NO: 35260 - RNA, 46 nt, Mus musculus
gagagauggcucaguuguuaagagcacuggcugcucuuccagaggu

SEQ ID NO: 35261 - RNA, 68 nt, Mus musculus
ggacgagagcaacacccccaugugugugugccaggaccccaccagcugcccugcucccauuggcgagu

SEQ ID NO: 35262 - RNA, 84 nt, Mus musculus
gguaccugugggugccaacccaguccagguggaaaugggagaauuugaggacggugcagaggaaacggucgaggaggugguggc

SEQ ID NO: 35263 - RNA, 41 nt, Mus musculus
gaggaagagggagaagggggaagagaaggaaaagcauggau

SEQ ID NO: 35264 - RNA, 42 nt, Mus musculus
ugugugugugugugugugugugugugcuugugugcuugugug

SEQ ID NO: 35265 - RNA, 46 nt, Mus musculus
gguagugggguuuaguggcacucgccuuuaaucucagcacuuagga

SEQ ID NO: 35266 - RNA, 56 nt, Mus musculus
guuguccaaaugggacuuugcaagaaggauaaacagaucuguaaacagccaaggca

SEQ ID NO: 35267 - RNA, 42 nt, Mus musculus
cuaaaccccuccacauuccugcagcccuucagaccgccagaa

SEQ ID NO: 35268 - RNA, 78 nt, Mus musculus
ccagcccagccauggaguuccugcccagacaggccuuccccgcuggcucccugcaagcuuccauguaauaaagucaag

SEQ ID NO: 35269 - RNA, 46 nt, Mus musculus
uagcuccauggguacuuucucuaguuccucaauugggggcccugug

SEQ ID NO: 35270 - RNA, 49 nt, Mus musculus
acccucaacaaaacaggaaaggcuguuuccuaccuuggccccaaguagc

SEQ ID NO: 35271 - RNA, 42 nt, Mus musculus
gugguagugauaguaggauuggggggcgggaagacggaaaga

SEQ ID NO: 35272 - RNA, 41 nt, Mus musculus
cagagugcuugcuggguguguuugaugcucuagguagcagu

SEQ ID NO: 35273 - RNA, 45 nt, Mus musculus
ggcaggaaguguuuagaguucaaugacucugcuggauucccagag

SEQ ID NO: 35274 - RNA, 42 nt, Mus musculus
cuuacacgggcauggaugccuuuguucugcaaaccccccccc

SEQ ID NO: 35275 - RNA, 45 nt, Mus musculus
cugucacuacaacaugaggaacuauauauauuaaagggucgcagc

SEQ ID NO: 35276 - RNA, 28 nt, Mus musculus
cgguuacagaugccuuuaacaaccgaag

SEQ ID NO: 35277 - RNA, 45 nt, Mus musculus
augagagaacauaaggaacuccgccaacccugugaggcguugggg

SEQ ID NO: 35278 - RNA, 46 nt, Mus musculus
cuauaaagccuccugaguggccuaguccauaaccuuccccuuaucc

SEQ ID NO: 35279 - RNA, 46 nt, Mus musculus
cuuguguuugugugcaggaacagacagccaaacuuuguagcaagua

SEQ ID NO: 35280 - RNA, 101 nt, Mus musculus
aaauuggauucaucaggugacaaggugcuccucuuuugaaauuacagcuagaaaaauuaagaauuuuguuugguuuaaaugagcaaauguauauggccauu

SEQ ID NO: 35281 - RNA, 65 nt, Mus musculus
aauaaacaguauuaauuggucuuuagaacccugcaccuguaguuaggaaucuaguguggcuagag

SEQ ID NO: 35282 - RNA, 46 nt, Mus musculus
auuuuauuuuauuuuauuuuuuuauuaccaaauuaucuccagauag

SEQ ID NO: 35283 - RNA, 43 nt, Mus musculus
gugcuuugguuuuacaccuggcagagugagaaacaagugagau

SEQ ID NO: 35284 - RNA, 77 nt, Mus musculus
gagguauggggauccccucuugugugugugccggccgguguaucuguuuugagugucuguuuucugaaacgaacauu

SEQ ID NO: 35285 - RNA, 32 nt, Mus musculus
ucucccagagggccaugcagugcagaugaguu

SEQ ID NO: 35286 - RNA, 46 nt, Mus musculus
guguguguguguguguguguguguguguguguguguuugggggcgg

SEQ ID NO: 35287 - RNA, 42 nt, Mus musculus
ucacccacaggaaccaccggagucgcaugauuacaggcgcag

SEQ ID NO: 35288 - RNA, 26 nt, Mus musculus
cagaggauagagucaaugcgcgcgcu

SEQ ID NO: 35289 - RNA, 47 nt, Mus musculus
ucuaaacaagugauccaucucucuccccaccucccacaucacccagu

SEQ ID NO: 35290 - RNA, 47 nt, Mus musculus
aggacucuccaaaugucucagagccacaggugucaaacacccccagg

SEQ ID NO: 35291 - RNA, 41 nt, Mus musculus
auuuaagaguugcuuacgggauuuucuugguccugugggaa

SEQ ID NO: 35292 - RNA, 46 nt, Mus musculus
cgcagcgcucgccguccgcgaugaggcagcagcucuggccguagcc

SEQ ID NO: 35293 - RNA, 46 nt, Mus musculus
cccccgcccccagccucaguuucugccacaucagaaguguaaagau

SEQ ID NO: 35294 - RNA, 42 nt, Mus musculus
agagaggcaguaguggagaggaagugaggaggaggaggaggu

SEQ ID NO: 35295 - RNA, 46 nt, Mus musculus
ugagaccugacgcccucuucuggcgugucugaagacagcuacagug

SEQ ID NO: 35296 - RNA, 46 nt, Mus musculus
uaguaggucugucauauaaagaauccugggcuugggcuggugagau

SEQ ID NO: 35297 - RNA, 45 nt, Mus musculus
auuuguguuguaaaaauuuucaagccccaaaugaauggcaggcua

SEQ ID NO: 35298 - RNA, 61 nt, Mus musculus
gaggaacuggauccuaggauacaggugagaaggcugauggaggaggucagaaguccagagg

SEQ ID NO: 35299 - RNA, 44 nt, Mus musculus
uaaaccagagagaugguuguguaagagacucagggaacugguau

SEQ ID NO: 35300 - RNA, 52 nt, Mus musculus
gugaauugcaaagaaaguaagucugguccuggggugugugugugugugugug

SEQ ID NO: 35301 - RNA, 45 nt, Mus musculus
gaaguauguagugagcaugugcugagugaguggcccuccuggccc

SEQ ID NO: 35302 - RNA, 45 nt, Mus musculus
ccaguacuguagccugugcucagaaugacccugcaggagugggag

SEQ ID NO: 35303 - RNA, 41 nt, Mus musculus
cgguggcccugcguaaucuggagcagaucagugagcagauu

SEQ ID NO: 35304 - RNA, 41 nt, Mus musculus
ugagggcauugaggauggggacagugggauugaaggggcag

SEQ ID NO: 35305 - RNA, 45 nt, Mus musculus
agccuuccuugggcaggaucagcugucucaguccuguguccccag

SEQ ID NO: 35306 - RNA, 79 nt, Mus musculus
cugaucugggugccuuggaggaguugaccuccugucccaucaggaggaugaggagagcgcgugcccagggcugggagaa

SEQ ID NO: 35307 - RNA, 83 nt, Mus musculus
augaaaaccuguggguuugagguggcuguucaggcagcacagaaacgaggaggacaugacugugcgagugcaugugcuggugc

SEQ ID NO: 35308 - RNA, 47 nt, Mus musculus
aaaaguacauggguguguggaggugggugucagagaguaucaacagg

SEQ ID NO: 35309 - RNA, 44 nt, Mus musculus
ugccuaugagagccacugcaaagaggauggagaugacugugaag

SEQ ID NO: 35310 - RNA, 42 nt, Mus musculus
uggagagcuggcugaggaagaaguacauggggguguggaguc

SEQ ID NO: 35311 - RNA, 44 nt, Mus musculus; identical to SEQ ID NO: 35309

SEQ ID NO: 35312 - RNA, 45 nt, Mus musculus
uuuucuuauggggcggagcuuaaccugcaguuuuggccuauagaa

SEQ ID NO: 35313 - RNA, 47 nt, Mus musculus
caagaaacaaaacccggcagaguggacagacacaggucaggggccaa

SEQ ID NO: 35314 - RNA, 46 nt, Mus musculus
ccucccagcuugugccccuuugggugucgcuggcauccccaaagug

SEQ ID NO: 35315 - RNA, 44 nt, Mus musculus
gcauaaagaaaaguaucuuaacaaagucuguguggcauccuuga

SEQ ID NO: 35316 - RNA, 42 nt, Mus musculus
gaaacuagcagguuggaaaaaagugauucauuugggcuaggc

SEQ ID NO: 35317 - RNA, 46 nt, Mus musculus
uaacaccauugccuggagguuucagcacagagauuuggggacacaa

SEQ ID NO: 35318 - RNA, 46 nt, Mus musculus
accccagcuguuaccaguagaacauucuguuuucuggcugccacac

SEQ ID NO: 35319 - RNA, 42 nt, Mus musculus
ggcgcauuacaacaagcgcucgaccaucacgucccgcgaggu

SEQ ID NO: 35320 - RNA, 44 nt, Mus musculus
agcccccaagaaaggcuccaaaaaggcggucaccaaggcgcaga

SEQ ID NO: 35321 - RNA, 43 nt, Mus musculus
agcagcuuguugagcuccucgucguugcggauggccaacugca

SEQ ID NO: 35322 - RNA, 46 nt, Mus musculus
uucaaagaucgugugugucuuuacaguaauuccuauuugggguccu

SEQ ID NO: 35323 - RNA, 41 nt, Mus musculus
gcccaucagaggacgcgggaaaccuucucuacaccccggug

SEQ ID NO: 35324 - RNA, 46 nt, Mus musculus
gaccauauuugugggaccaauaaauagaucaauagggcaaagagau

SEQ ID NO: 35325 - RNA, 46 nt, Mus musculus
gguggcucacaaccauccauaacgagaucucucuuuucuggagugu

SEQ ID NO: 35326 - RNA, 42 nt, Mus musculus
gaucuaaauaacaagauucuuuuaaaagggggcuggagagau

SEQ ID NO: 35327 - RNA, 28 nt, Mus musculus
auuccuagugucacgguauugagcagag

SEQ ID NO: 35328 - RNA, 46 nt, Mus musculus
agcauagagauauugaacaaagggaugccucccucccagcccaggu

SEQ ID NO: 35329 - RNA, 46 nt, Mus musculus
cucuaucuccaaauagagcaauaucagauccaacugcuagagagau

SEQ ID NO: 35330 - RNA, 48 nt, Mus musculus
guagacaaauauaguuuaaguugguaaaucgaaguuuuuaaggagaua

SEQ ID NO: 35331 - RNA, 64 nt, Mus musculus
aaagccccaaacuucugaaccgguaagguauuaaguuugaaaacaauaaaagaggaaagagacu

SEQ ID NO: 35332 - RNA, 41 nt, Mus musculus
guuagccaccguagacacuugcuggucuguggagccugcag

SEQ ID NO: 35333 - RNA, 53 nt, Mus musculus
cgaggagccgggggcgcccgagggccccggagaagacacggaggaggagcgag

SEQ ID NO: 35334 - RNA, 42 nt, Mus musculus
uauaugaauauugguguauaugaauaugugggugccagugug

SEQ ID NO: 35335 - RNA, 78 nt, Mus musculus
uaagugcuuccuucccaccuaccuucugugucuagggacugcagagagggagauaugaggaugggcagccaaaagggg

SEQ ID NO: 35336 - RNA, 45 nt, Mus musculus
gaggcugcuccuggggcagacuuggggguauuaacuggauguggg

SEQ ID NO: 35337 - RNA, 25 nt, Mus musculus
gaggggaagcaagaguacuguccag

SEQ ID NO: 35338 - RNA, 50 nt, Mus musculus
uugguguugaguugggugggcuggagcccggaaggaaagggcauagagug

SEQ ID NO: 35339 - RNA, 44 nt, Mus musculus
gugguuugcagcgcacacccuaaggccaggccacgguggaagca

SEQ ID NO: 35340 - RNA, 45 nt, Mus musculus
agcaccuuggggcacucucugccugagugccugauacagacagag

SEQ ID NO: 35341 - RNA, 42 nt, Mus musculus
gguacaggguuaggacaggugagggcuccuguagucccagag

SEQ ID NO: 35342 - RNA, 45 nt, Mus musculus
gaggaauaagauugaaaaugcuuuggcugcucuggcugcugcugu

SEQ ID NO: 35343 - RNA, 34 nt, Mus musculus
aggggaugugagaggaaagagcccaggcgacaaa

SEQ ID NO: 35344 - RNA, 46 nt, Mus musculus
cggacaagaccaguucaauugggaggacgugaagacugacaagcag

SEQ ID NO: 35345 - RNA, 45 nt, Mus musculus
gugaggaaacagcccaccggccugagcaaggaggugagucugaga

SEQ ID NO: 35346 - RNA, 32 nt, Mus musculus
gaagccucgcgcugaggacaaggucgaaccgg

SEQ ID NO: 35347 - RNA, 42 nt, Mus musculus
gcagggagagaagucagaaugucucuggugucugggccuaca

SEQ ID NO: 35348 - RNA, 46 nt, Mus musculus
ccagagacauucugacuucucucccugcucuaagaggaagcgggaa

SEQ ID NO: 35349 - RNA, 60 nt, Mus musculus
uacacaauuaguaaucaacuguuuuguauacuuguuuucaguuuucauuucgacaagcac

SEQ ID NO: 35350 - RNA, 45 nt, Mus musculus
gaccucuacuuuuuucuuuuguauuuugauaaacacugaagaagc

SEQ ID NO: 35351 - RNA, 103 nt, Mus musculus
cagugcauuuuuuaaaaauaguuaaaaauacaggacaagaacacuugaacacacagaacggagacuaugccuaguguagguuuugcaguuaauggccugaaug

SEQ ID NO: 35352 - RNA, 46 nt, Mus musculus
acuuagcuuuuuuauuguaaaaagagaaucaacucaacugucagua

SEQ ID NO: 35353 - RNA, 60 nt, Mus musculus
acagcuucuggcacucaggaccacagagucgcacguuugccacaugagaggaaagcugag

SEQ ID NO: 35354 - RNA, 45 nt, Mus musculus
augaaggacuagauuggcugucuaaucagcuccggaaccagaagu

SEQ ID NO: 35355 - RNA, 45 nt, Mus musculus
gagcugauuagacagccaaucuaguccuucauagagcccgucccc

SEQ ID NO: 35356 - RNA, 33 nt, Mus musculus
aggaccuccccaaugccaugaaugcggccgaaa

SEQ ID NO: 35357 - RNA, 36 nt, Mus musculus
cuuguuggcaaacaccaagagaacagcaucucggag

SEQ ID NO: 35358 - RNA, 36 nt, Mus musculus
uugaucuucguaguggacagcaaugacagagagcgu

SEQ ID NO: 35359 - RNA, 45 nt, Mus musculus
uaaccuacacuagcauggggcuugggugagugacaaccuccgguc

SEQ ID NO: 35360 - RNA, 45 nt, Mus musculus
uauguuauuuguacagugugcucuuguaggugauucaguuucagu

SEQ ID NO: 35361 - RNA, 45 nt, Mus musculus
agguuaauaugaaagaauacuuccaagaagggaggugggccauag

SEQ ID NO: 35362 - RNA, 45 nt, Mus musculus
auagagagguagagacaggaaagaaagggaagagaaggagggaga

SEQ ID NO: 35363 - RNA, 42 nt, Mus musculus
ucuaguucccuucgaaaacacgagagaacucacaccggagag

SEQ ID NO: 35364 - RNA, 45 nt, Mus musculus
gauacaaccuauaugaaagugaagaauccucugagaagccauaua

SEQ ID NO: 35365 - RNA, 46 nt, Mus musculus
gaacucugacaguacaguauuaacaacaucacuuugagaagcagac

SEQ ID NO: 35366 - RNA, 46 nt, Mus musculus
cacauuaaaggcagucagucgcucauuuaaaacauccuauuuagug

SEQ ID NO: 35367 - RNA, 39 nt, Mus musculus
ccugcaggccagaaaagggcagcagaucuuauuauagau

SEQ ID NO: 35368 - RNA, 46 nt, Mus musculus
uuuuuuuccuuguuuuuuaaauacuuauguauaugaguacccuauu

SEQ ID NO: 35369 - RNA, 42 nt, Mus musculus
aaaccucuucgaggagcagcuagaggaccuggagcuggagca

SEQ ID NO: 35370 - RNA, 46 nt, Mus musculus
acggcagccgggcggccucacagcuacaucuuccucaccccggcac

SEQ ID NO: 35371 - RNA, 45 nt, Mus musculus
cggggcacagcuggaguuggcaauggcucuccacauaguccuuaa

SEQ ID NO: 35372 - RNA, 42 nt, Mus musculus
cugcucccaacagcuuuggcaaaacugauguuggcaggccag

SEQ ID NO: 35373 - RNA, 29 nt, Mus musculus
cagcaaaguugcagaaacaguugcuuuuu

SEQ ID NO: 35374 - RNA, 46 nt, Mus musculus
cgcgaccucgcggccgcagagcccaggccggccggaccaggucaag

SEQ ID NO: 35375 - RNA, 46 nt, Mus musculus
cagaaauaguaaaugcaauaaaaccauuuggucacaccuuggagaa

SEQ ID NO: 35376 - RNA, 46 nt, Mus musculus
aaagcuagguccggugucagugggcugguucuuuccgaggcuagaa

SEQ ID NO: 35377 - RNA, 45 nt, Mus musculus
gaaaguuaaugaauuuauccccacaucuucuuugugccccaagac

SEQ ID NO: 35378 - RNA, 45 nt, Mus musculus
gccaaaacccagggaggugauccaaccucaagaccugcaucucug

SEQ ID NO: 35379 - RNA, 46 nt, Mus musculus
agugucgguacugugucaaaacuuuccgacagaauuaugaccuccu

SEQ ID NO: 35380 - RNA, 46 nt, Mus musculus
ucuuaagagguuucuuuucauuuuguaucuguguaugcaggugguu

SEQ ID NO: 35381 - RNA, 45 nt, Mus musculus
ucuaucugugugacuguguacaugugaaucuaguaccuucaaagg

SEQ ID NO: 35382 - RNA, 45 nt, Mus musculus
uaguucacuaagcucagaacacucaguggcuuuuccagcccaaag

SEQ ID NO: 35383 - RNA, 46 nt, Mus musculus
gucuguauuuuuagaaguagcuuguuuuggaaaaguguaggcaggu

SEQ ID NO: 35384 - RNA, 46 nt, Mus musculus
cagucuuccugccucgggcucccaggugccaguaggauuauauagu

SEQ ID NO: 35385 - RNA, 24 nt, Mus musculus
gcccuggaagucugggaggcguug

SEQ ID NO: 35386 - RNA, 42 nt, Mus musculus
uaucuuugugugagucuaugcccuugggugcggugcccaugg

SEQ ID NO: 35387 - RNA, 42 nt, Mus musculus
gcgggcggggcccggauuggguucuuaauacgggaguaagac

SEQ ID NO: 35388 - RNA, 25 nt, Mus musculus
gcgcaggaucccagggaaggaauga

SEQ ID NO: 35389 - RNA, 46 nt, Mus musculus
cggggaagcgaaccacugagaugaggagaccuccucgguccuagag

SEQ ID NO: 35390 - RNA, 41 nt, Mus musculus
gcagggaagggcuggucuggcggcgcuggcgaaaugccaga

SEQ ID NO: 35391 - RNA, 46 nt, Mus musculus
uggagccggacugucaaagggaggaagcaaagaaaaaucugccuag

SEQ ID NO: 35392 - RNA, 45 nt, Mus musculus
accuccuaaugucccaaaaccucgacccuuaacuccauaccuacu

SEQ ID NO: 35393 - RNA, 41 nt, Mus musculus
ggcggcuucugaacagcgagaggggaccuaaauccugagag

SEQ ID NO: 35394 - RNA, 46 nt, Mus musculus
uuaaaucacacccaucaaggcgcagucaggugaucuaaggccugcg

SEQ ID NO: 35395 - RNA, 45 nt, Mus musculus
caguguccuuacauauaauaaauaaaucuuuaaaaaaaaaaucaa

SEQ ID NO: 35396 - RNA, 46 nt, Mus musculus
cuuuuuauuccuuuugugauccuuggcaauuauuaacugucaggag

SEQ ID NO: 35397 - RNA, 42 nt, Mus musculus
cacagaggaaccuaagaagaaaacccaacuauaagcagcuag

SEQ ID NO: 35398 - RNA, 48 nt, Mus musculus
auuacucuaaaagauaaugaguucuaaaggaggcuggagggaagcaag

SEQ ID NO: 35399 - RNA, 45 nt, Mus musculus
gcucacuauauaggagaccaugaccugauccuccagcccccaguc

SEQ ID NO: 35400 - RNA, 46 nt, Mus musculus
aacaagaucugucucccucuucuggugugucugaagacagcuacag

SEQ ID NO: 35401 - RNA, 46 nt, Mus musculus
cucucagagguuacaagagagaaaaggauuguaagaaacucaagag

SEQ ID NO: 35402 - RNA, 46 nt, Mus musculus
guccaaugugguaacagguugauuuuagauuucuaagggaguggga

SEQ ID NO: 35403 - RNA, 46 nt, Mus musculus
cuuacuuuacccauauccaaugcuaauaucuugaaucccaccuuua

SEQ ID NO: 35404 - RNA, 46 nt, Mus musculus
aauugggaaguguuguguuucaucauaguuucaaucauaggcagau

SEQ ID NO: 35405 - RNA, 42 nt, Mus musculus
caggcugccaaauguggugguguaaggcgguuuaucccagca

SEQ ID NO: 35406 - RNA, 46 nt, Mus musculus
ugcccuccaucgccauccccagauggagagaacagaaaacugagaa

SEQ ID NO: 35407 - RNA, 45 nt, Mus musculus
gaaaacauuguccuagauugccaaagaccuccaaccccggagcag

SEQ ID NO: 35408 - RNA, 42 nt, Mus musculus
ccuccagggcacuggaacaguaguuccuaaaauacuggguag

SEQ ID NO: 35409 - RNA, 46 nt, Mus musculus
ggugugugugugugugugagagagagagagagagagagauugauug

SEQ ID NO: 35410 - RNA, 46 nt, Mus musculus
ugaugccuaggaagaucuucccauggcaauguuaagaacuggagag

SEQ ID NO: 35411 - RNA, 45 nt, Mus musculus
caguaaaggucugaguguucauuuggguguuugcugaaguuacag

SEQ ID NO: 35412 - RNA, 45 nt, Mus musculus
gggagggcaugcuauuggaccugugcagacccugaguaccccuac

SEQ ID NO: 35413 - RNA, 82 nt, Mus musculus
gggucaucccugagggccugagaggugauuugagaacugccccagaucuugagcuguuccaguuuccguaguugaagcagcu

SEQ ID NO: 35414 - RNA, 45 nt, Mus musculus
gacccaguguauuugacucugcaccuccuucaucgcugccccagc

SEQ ID NO: 35415 - RNA, 45 nt, Mus musculus
gugugagguuacugggggcugcuggaagggacucauguugccuag

SEQ ID NO: 35416 - RNA, 46 nt, Mus musculus
gacugagagacucuuuggaggagaggagcagguugcaggcugugag

SEQ ID NO: 35417 - RNA, 41 nt, Mus musculus
augcuccuuggaggucuuuccaaagaugacaagcauuuauu

SEQ ID NO: 35418 - RNA, 45 nt, Mus musculus
uuccuguuccacagugguucuagcaaguuaguucuccaggcagca

SEQ ID NO: 35419 - RNA, 46 nt, Mus musculus
gugaccuggaagggauuugauuuacaacgcuuguaaaauuggccag

SEQ ID NO: 35420 - RNA, 41 nt, Mus musculus
uuuauuuaaggggaggagaaagaagaggaggaggaggggaa

SEQ ID NO: 35421 - RNA, 42 nt, Mus musculus
agggaggauguaacaagaauugggguuagaaauguaccgcag

SEQ ID NO: 35422 - RNA, 46 nt, Mus musculus
uaagagcaggaggaaaggaaagcucuguaauuauggaucagcccag

SEQ ID NO: 35423 - RNA, 45 nt, Mus musculus
uguccuuauagucccacuuucucauuccauguccaccuguccucu

SEQ ID NO: 35424 - RNA, 34 nt, Mus musculus
uuuccuucagaugaacuuuuucuuucugggcuga

SEQ ID NO: 35425 - RNA, 33 nt, Mus musculus
ucuugggaagcugaggauggaagauugcagcau

SEQ ID NO: 35426 - RNA, 46 nt, Mus musculus
gacagugguauaucccuuggguuuuauaugauaaaaucacaggcaa

SEQ ID NO: 35427 - RNA, 45 nt, Mus musculus
cagcagcaggccucuagcuugacuauggaaaaggguagccgugag

SEQ ID NO: 35428 - RNA, 45 nt, Mus musculus
uguguguguguguagaagugccucucuggcacuuuuugugcuuag

SEQ ID NO: 35429 - RNA, 42 nt, Mus musculus
guggguuguagaaaagguauguuugaggaauaucaaggggag

SEQ ID NO: 35430 - RNA, 45 nt, Mus musculus
uaugggaccugggcuagaucuuguggguuguaguaaaggcauaga

SEQ ID NO: 35431 - RNA, 46 nt, Mus musculus
uugauugagguaaaauucauguaauuaaaguguuuaaaguauacag

SEQ ID NO: 35432 - RNA, 23 nt, Mus musculus
cugggugccuugggauucuggcu

SEQ ID NO: 35433 - RNA, 46 nt, Mus musculus
gcggggagaaggcaggaggaagugauggcugaacucucugcugaag

SEQ ID NO: 35434 - RNA, 46 nt, Mus musculus
cccuaaaagauguucaguaccaugguugcgaucuuugagaacuggg

SEQ ID NO: 35435 - RNA, 42 nt, Mus musculus
aggaggcaacucugggugccucacuggucuuacugaugugcu

SEQ ID NO: 35436 - RNA, 46 nt, Mus musculus
acuguuuaguauguagugacuuucagcuccuuucagcuccgggcca

SEQ ID NO: 35437 - RNA, 36 nt, Mus musculus
cuugcuugggaggcuuaucucaagaacgcauaguag

SEQ ID NO: 35438 - RNA, 42 nt, Mus musculus
uauugagcaaaaaagaaaaaugagauuaugaaauuucaagaa

SEQ ID NO: 35439 - RNA, 45 nt, Mus musculus
ucaccuggacaaaaguaagcuguugaaacuucagagugcggugaa

SEQ ID NO: 35440 - RNA, 48 nt, Mus musculus
gguuccguuuagauaaaguauuggaugggugaugaggcagagggauug

SEQ ID NO: 35441 - RNA, 46 nt, Mus musculus
uggcugucuuugccuuuuauugaccauucugaaacccuuucuaaag

SEQ ID NO: 35442 - RNA, 46 nt, Mus musculus
gcgauaguuuucugucucagaaauacgaugugucuuguccaugggu

SEQ ID NO: 35443 - RNA, 46 nt, Mus musculus
guagccugggcuacauagcaagacccugguuuguuuuaaauggggg

SEQ ID NO: 35444 - RNA, 45 nt, Mus musculus
ucagaugguugugagccaccaugugguugcugagauuugaauuca

SEQ ID NO: 35445 - RNA, 28 nt, Mus musculus
cugagaaaguucccaccaccaaauccac

SEQ ID NO: 35446 - RNA, 46 nt, Mus musculus
aggacucgggcccggagcccuggcagggaagagguggcccgucuau

SEQ ID NO: 35447 - RNA, 48 nt, Mus musculus
auuagagagaacuucuauucucugagaagacucagagcugcagauagg

SEQ ID NO: 35448 - RNA, 100 nt, Mus musculus
ucaugcugacaguucugcaguugucagagggcacugaagagauuccaagauacaggaaagugagggggcagcauagauccuucccaccaagaugcaagag

SEQ ID NO: 35449 - RNA, 45 nt, Mus musculus
cugcuggaaagauaaggcccuaccugcuuuucuuuugccccaaag

SEQ ID NO: 35450 - RNA, 46 nt, Mus musculus
guguccaggccagguuucuugcuuaacaccagacagguuucuaaag

SEQ ID NO: 35451 - RNA, 45 nt, Mus musculus
ggggccuugaaguacucuagccagauacagugcucucagcccgag

SEQ ID NO: 35452 - RNA, 44 nt, Mus musculus
uaccuggcagccagcagcugcuuagcucacugcuuucccagcca

SEQ ID NO: 35453 - RNA, 45 nt, Mus musculus
guaauugagaaauuugaggccuuggacauugaaaaagcagagcac

SEQ ID NO: 35454 - RNA, 45 nt, Mus musculus
acagaccagccagccaaguccuugaaaauucucccuuucccaucu

SEQ ID NO: 35455 - RNA, 45 nt, Mus musculus
cuauaguccaucacagagggaagucaggucagcagcugaagcaga

SEQ ID NO: 35456 - RNA, 45 nt, Mus musculus
gauccagaccauuaugaaacaugugcucccagcaucugccccaga

SEQ ID NO: 35457 - RNA, 52 nt, Mus musculus
agaccugcucaaggucaacugagaagcaagaagcugagccaggagagccaga

SEQ ID NO: 35458 - RNA, 45 nt, Mus musculus
agccaacagcuggguaccagugagcaagcccagcgucugauggag

SEQ ID NO: 35459 - RNA, 46 nt, Mus musculus
aggcccuccagaaagagaagcugagugaaacgugcaaaggcaguga

SEQ ID NO: 35460 - RNA, 24 nt, Mus musculus
cacagggucucuguccagcuacag

SEQ ID NO: 35461 - RNA, 46 nt, Mus musculus
gauugccuugggcagcagcuuagaggaaacagaaauuaagcugcag

SEQ ID NO: 35462 - RNA, 42 nt, Mus musculus
cuugggagccuaccaaaccccagacuuugaaagaguaauaca

SEQ ID NO: 35463 - RNA, 46 nt, Mus musculus
aggcuccucagcucccagaaaucagcccuguuuccccagcccacag

SEQ ID NO: 35464 - RNA, 47 nt, Mus musculus
agccauugaagccaugaagaaugcucaccgagaggagauggaacgag

SEQ ID NO: 35465 - RNA, 42 nt, Mus musculus
aggaacaguguaucuagaccuugacagcuacaucuccgggag

SEQ ID NO: 35466 - RNA, 45 nt, Mus musculus
ucuacuuccugcaucauguuuucuuuaguguucagucuuugccuc

SEQ ID NO: 35467 - RNA, 45 nt, Mus musculus
agacagauccuguguuacccggcaacucagaaacaucagguccaa

SEQ ID NO: 35468 - RNA, 45 nt, Mus musculus
acaggaaguuggaauugacagggagggacuggagcaagcacccca

SEQ ID NO: 35469 - RNA, 25 nt, Mus musculus
uagagugggacgguuuccccgcuga

SEQ ID NO: 35470 - RNA, 45 nt, Mus musculus
gccacuggcagguccccacaugugcacucugaggcagggcuagcu

SEQ ID NO: 35471 - RNA, 45 nt, Mus musculus
gccaggcuggacacuuuccuaggccccucagaaaucaggccagcc

SEQ ID NO: 35472 - RNA, 62 nt, Mus musculus
agcauuuuguaccuggccacugaugcagcuuagaaccauacccagauaauccggcaaauccu

SEQ ID NO: 35473 - RNA, 65 nt, Mus musculus
ucacaaccuggaaaauguugaaagcaaccauuccuauuuugguuuuuuauuaaaucuugcacaaa

SEQ ID NO: 35474 - RNA, 46 nt, Mus musculus
ugguauguucccuguaaugguaguuugcuuguagaugcugguagac

SEQ ID NO: 35475 - RNA, 46 nt, Mus musculus
aaacuaacccccaucuugagguaacagaaccuuggccuggcaagug

SEQ ID NO: 35476 - RNA, 45 nt, Mus musculus
gaggucuuuauuauuauuuuuuauuuaaaauaaaauaauuuagaa

SEQ ID NO: 35477 - RNA, 42 nt, Mus musculus
agagguuugagaaaaagcgugugaaguucaucagccugugag

SEQ ID NO: 35478 - RNA, 46 nt, Mus musculus
cucagccaagaagaacagcagcuuggaccagauguuccgugcgcuc

SEQ ID NO: 35479 - RNA, 47 nt, Mus musculus
cguuucccgccaugcggcgccucucuauccucacaggugagugggga

SEQ ID NO: 35480 - RNA, 46 nt, Mus musculus
cccauucacuggacaaggaagggcccuuugcuuccugcaaccagau

SEQ ID NO: 35481 - RNA, 26 nt, Mus musculus
uguccugucacaugcuaggccuggaa

SEQ ID NO: 35482 - RNA, 46 nt, Mus musculus
ccuuugcugcaggccaagaucacaccugacgcaagcaccaugagau

SEQ ID NO: 35483 - RNA, 46 nt, Mus musculus
ccucaggaguucagggccagccagggcuacauagacugccucagaa

SEQ ID NO: 35484 - RNA, 45 nt, Mus musculus
uucugguucccagucccuuuuccagucuuugauacuccgucagau

SEQ ID NO: 35485 - RNA, 42 nt, Mus musculus
ucggaccccgagcgcagcgacuacgaggagcaucaguugcag

SEQ ID NO: 35486 - RNA, 46 nt, Mus musculus
accagcccggcggcugcaucgugucccacguugaccccauccacau

SEQ ID NO: 35487 - RNA, 45 nt, Mus musculus
uaugaagugaaauuuuauuuggaggaugucuccauucagcccuaa

SEQ ID NO: 35488 - RNA, 46 nt, Mus musculus
augugcguggugcuuccagaugguugucuugacaaaacguuuuuag

SEQ ID NO: 35489 - RNA, 53 nt, Mus musculus
agaagcaugcuaaaggggcauucacugugagauauugggagaggaaggaagcu

SEQ ID NO: 35490 - RNA, 46 nt, Mus musculus
ccuugguaaagaugauugcugugaagcagaugguauucuguaucag

SEQ ID NO: 35491 - RNA, 49 nt, Mus musculus
cuguucuuguggguccuuaguacuaaauuaagguguagucagucuuggc

SEQ ID NO: 35492 - RNA, 48 nt, Mus musculus
uugccuucccuuuguauugccaggccuggcaggcagaaaguaguacag

SEQ ID NO: 35493 - RNA, 44 nt, Mus musculus
aagcaaagaauaaacaggcaauaaaaauggaaaaacuggcuggc

SEQ ID NO: 35494 - RNA, 84 nt, Mus musculus
acucauuuggcguaccuaauucccauauucuuugaggccagcaagauccuaugacaaauuaaaccuuguuaccaagaaacacag

SEQ ID NO: 35495 - RNA, 46 nt, Mus musculus
caauuagcuaccaaaaauuaaaagauuauagcaaacuugguggaag

SEQ ID NO: 35496 - RNA, 46 nt, Mus musculus
uucucuuuuucuaaaaaggaagccagugaugccuuccaguugucag

SEQ ID NO: 35497 - RNA, 45 nt, Mus musculus
aacacaauuuccguagucugaauauaguaaaguaagggauggugu

SEQ ID NO: 35498 - RNA, 42 nt, Mus musculus
guaguuuaucuuuugugggugcucauugagaacauggggggg

SEQ ID NO: 35499 - RNA, 42 nt, Mus musculus
caggacauuaaggaacgccgggcggucaucauucucaggaag

SEQ ID NO: 35500 - RNA, 41 nt, Mus musculus
agcagccuacuuuaaaaaugccuaggcuuucacuucuggaa

SEQ ID NO: 35501 - RNA, 46 nt, Mus musculus
aaggcgaaaggauugagucaggccugucauagaacaagaaagaaag

SEQ ID NO: 35502 - RNA, 46 nt, Mus musculus
uugguggauguguauuguuugcuucccccccuuaaagcuuaagcag

SEQ ID NO: 35503 - RNA, 46 nt, Mus musculus
gcuauacgcuguuuuuugauaguuuguuuuguaaaacauugugaga

SEQ ID NO: 35504 - RNA, 47 nt, Mus musculus
uucaauuuaauacaguauuuuguuacaguuaauguugaaguugaagc

SEQ ID NO: 35505 - RNA, 45 nt, Mus musculus
gugguugugagccaccauguuguugcugggauuugaacucaguau

SEQ ID NO: 35506 - RNA, 46 nt, Mus musculus
gguguucagacagaaguuacuccuaaucuucacuucuaggccugag

SEQ ID NO: 35507 - RNA, 54 nt, Mus musculus
ucccugagcagcuccacauugccacccagcuaugcuucagaucgccugucagga

SEQ ID NO: 35508 - RNA, 45 nt, Mus musculus
cacaccggcggagggggaguuuuagcucugagaacuauuggcgca

SEQ ID NO: 35509 - RNA, 42 nt, Mus musculus
gauugcccagaggcagccagcagccccacccgcaaggugaag

SEQ ID NO: 35510 - RNA, 45 nt, Mus musculus
ugaaacacacaaaauguuuugguuaugaaauucuaguuugggcuu

SEQ ID NO: 35511 - RNA, 41 nt, Mus musculus
caugcaaauacccuguuccccacuguucaaguuugcugcgu

SEQ ID NO: 35512 - RNA, 46 nt, Mus musculus
gguugcuccuguuaggcauaugugugugauuguauggaacuguuag

SEQ ID NO: 35513 - RNA, 46 nt, Mus musculus
auuuauugcccaccaguccucugaagauuggucacugacaccccuu

SEQ ID NO: 35514 - RNA, 47 nt, Mus musculus
ucuuggccucccuggguguagaacauugguagauaaagcagguagga

SEQ ID NO: 35515 - RNA, 63 nt, Mus musculus
cuggggucccuaauguggaucccaggguauugccaacugucagcagcucuccagcucugcucc

SEQ ID NO: 35516 - RNA, 47 nt, Mus musculus
cuguaugaacugugcaguggacugggaugacacuagaacugagagga

SEQ ID NO: 35517 - RNA, 94 nt, Mus musculus
aauccaugcuuggguggcucuuccuagggacaagggauggaagagauuuugauaccagugaucuaggcuucagucuguccugggauagugcccc

SEQ ID NO: 35518 - RNA, 77 nt, Mus musculus
aguaguuuucuaacagcaacuggauguaccagcccuacccaccuaagaucucauuccauuccuuuaaccuuguugug

SEQ ID NO: 35519 - RNA, 47 nt, Mus musculus
gaccuguauaugacaugcuuacaugcauguaaagguguucuauaaug

SEQ ID NO: 35520 - RNA, 44 nt, Mus musculus
uguacagugugcuuguaaaucucuguaguuaguuguugcccaca

SEQ ID NO: 35521 - RNA, 50 nt, Mus musculus
guuucucuuaguuuucuauggcugccaaaacauuaccacaaacuugagag

SEQ ID NO: 35522 - RNA, 42 nt, Mus musculus
uuucccccuuguggauucuggauguccuugcgacccggccag

SEQ ID NO: 35523 - RNA, 46 nt, Mus musculus
gccugugaugacuccuuucggaaaugagagggucuuuugguuggga

SEQ ID NO: 35524 - RNA, 42 nt, Mus musculus
ugugacuggggcaguuagggguggccugugagcccugaugag

SEQ ID NO: 35525 - RNA, 48 nt, Mus musculus
ggcugcgcccaccuggaggaaggccucagcuuccacccacccagcaga

SEQ ID NO: 35526 - RNA, 27 nt, Mus musculus
cguagcuggcaauacagcagcccuggg

SEQ ID NO: 35527 - RNA, 46 nt, Mus musculus
caggccccuuccccugcaaggccaucaacaagauucuguggcggag

SEQ ID NO: 35528 - RNA, 42 nt, Mus musculus
augugcuaugauuucuggguacccauugcuccucucugccaa

SEQ ID NO: 35529 - RNA, 42 nt, Mus musculus
cuguaggguguggugaaguagagggcaaccaaugugggcggu

SEQ ID NO: 35530 - RNA, 45 nt, Mus musculus
acccaaggugagugcuaagacuaaauucaagcuuacagcccauga

SEQ ID NO: 35531 - RNA, 46 nt, Mus musculus
ccaucggaauuugagcgcuucucacugagugcucgcaacaucacag

SEQ ID NO: 35532 - RNA, 46 nt, Mus musculus
cgugugugugcggcagugaggaugggcuucccuguagaugccaccu

SEQ ID NO: 35533 - RNA, 105 nt, Mus musculus
caccacuguuugaaucgcagguacuggguaccuguggaguacgaggaggaagagaagacagaagacaaggaggggaaggccucggcagaggccagagaaggggag

SEQ ID NO: 35534 - RNA, 45 nt, Mus musculus
gagggcuucgugcuggagggccgcaaguucacucgacugccagag

SEQ ID NO: 35535 - RNA, 45 nt, Mus musculus
gucggcagguaccgaaucagcuugguacauugguauugcuuugag

SEQ ID NO: 35536 - RNA, 43 nt, Mus musculus
gcucuuugcagagaaaauaaacaagaaugagcggaaagggaag

SEQ ID NO: 35537 - RNA, 46 nt, Mus musculus
uuacauauaauaaauaaaucuuuaaaaaaaaaaaaagaaggcaucc

SEQ ID NO: 35538 - RNA, 63 nt, Mus musculus
uguuucuccuggaccaagggcuggacauuuauguguggcggggggcccaggccacacugagua

SEQ ID NO: 35539 - RNA, 52 nt, Mus musculus
aggcggaacagccaguggcuucuauacuguggaagauacacacuauguuacc

SEQ ID NO: 35540 - RNA, 47 nt, Mus musculus
gcugagugccguacuguucgagaggagaugggugacgagagugagga

SEQ ID NO: 35541 - RNA, 46 nt, Mus musculus
ggaugacagcggcucccugaacugggagaucuacuacuggauuggu

SEQ ID NO: 35542 - RNA, 42 nt, Mus musculus
gugcucaagguggggcuggcuccuaguguucugcauggugug

SEQ ID NO: 35543 - RNA, 46 nt, Mus musculus
ucagcuuuggccagaauguaagaacaggugaaguucaggcugucaa

SEQ ID NO: 35544 - RNA, 41 nt, Mus musculus
gaguuucuuggagggaaucaggggaccugccagcccccucc

SEQ ID NO: 35545 - RNA, 42 nt, Mus musculus
gucuuggccuaggugaagccuaggaaaucaaaagccacaucu

SEQ ID NO: 35546 - RNA, 47 nt, Mus musculus
uucaaggccugaggacccaaucagaaaaacaaaugcaccaccaucag

SEQ ID NO: 35547 - RNA, 46 nt, Mus musculus
uaugggauugccuugcauagacagcacagaguucagccccccagug

SEQ ID NO: 35548 - RNA, 93 nt, Mus musculus
uagaggauacgcuccucucagaggccugugugcagaccuguccucugcagcgugccaaaauauucaugauagauguguguccucaccuugcac

SEQ ID NO: 35549 - RNA, 48 nt, Mus musculus
ccuuaaacacacugaaacaaagccaugccuugaagaugugaauaaaag

SEQ ID NO: 35550 - RNA, 41 nt, Mus musculus
caggucuuccuccaccacgaaguccagggcagccugggcca

SEQ ID NO: 35551 - RNA, 57 nt, Mus musculus
agaugccucaccaaaauaaaaguugcaguugcagaucacagccggagagauugugag

SEQ ID NO: 35552 - RNA, 44 nt, Mus musculus
ucucucuccuuuucuuuuugagaccuaauuacaaaugugcccca

SEQ ID NO: 35553 - RNA, 46 nt, Mus musculus
caugcacacuagguaagcauucuaccaguugaguuauagcgccagu

SEQ ID NO: 35554 - RNA, 41 nt, Mus musculus
uauaaucaugugucugagagcgcagaacaaagaaggggcug

SEQ ID NO: 35555 - RNA, 30 nt, Mus musculus
agcgcagagcugccacacugccuaccucag

SEQ ID NO: 35556 - RNA, 45 nt, Mus musculus
agggucaguagaugauugacuaauagcucccuuugcugagaugug

SEQ ID NO: 35557 - RNA, 46 nt, Mus musculus
gccacagugaacacacaggagcagaaacgucugcuuauggaccuag

SEQ ID NO: 35558 - RNA, 45 nt, Mus musculus
auagggucuguggguuccaucaaacauuucuauaugaguacaagg

SEQ ID NO: 35559 - RNA, 46 nt, Mus musculus
ucuguauccugugauuucagccuuuucucuagagccacugguguag

SEQ ID NO: 35560 - RNA, 45 nt, Mus musculus
guaaaaacaacagcuggauagguggcccuggauauugaagucugu

SEQ ID NO: 35561 - RNA, 46 nt, Mus musculus
cacaugccuguccaguggagacagcacgcugaggaccccaggacag

SEQ ID NO: 35562 - RNA, 45 nt, Mus musculus
agucacauugacagaaaacagcugcuguccuccuuagugccccaa

SEQ ID NO: 35563 - RNA, 46 nt, Mus musculus
cuccccuguucuggaugccccauucacuggagugucaaggaggcag

SEQ ID NO: 35564 - RNA, 42 nt, Mus musculus
gccaucugccuguucuaccaacagcaagaggaacggggccag

SEQ ID NO: 35565 - RNA, 28 nt, Mus musculus
caggggaaaagacacauauguggugauc

SEQ ID NO: 35566 - RNA, 43 nt, Mus musculus
aauggugauuuucuuuaacuuccagcaacacaaccugacucag

SEQ ID NO: 35567 - RNA, 70 nt, Mus musculus
augguaugaucuauguccauacacaauucucugggcugccagagauuaagagguggaaagagacuagccc

SEQ ID NO: 35568 - RNA, 46 nt, Mus musculus
cucugugcugugggugucaugguggaggacugggugaaggcaccag

SEQ ID NO: 35569 - RNA, 42 nt, Mus musculus
ucucaggguucaaguccauccuggccuacagaguucguggag

SEQ ID NO: 35570 - RNA, 41 nt, Mus musculus
ucaaauuggccugggaaggugguccugguguguauaagaaa

SEQ ID NO: 35571 - RNA, 46 nt, Mus musculus
ucccugcacacugacacaggcucacugaucaagggggacacaccag

SEQ ID NO: 35572 - RNA, 41 nt, Mus musculus
uggcaacuuuauuucccaaucagagccaacugggugcaggc

SEQ ID NO: 35573 - RNA, 46 nt, Mus musculus
cacaagaagcaguaaauaccuccguacaucaggucgauggcugcag

SEQ ID NO: 35574 - RNA, 46 nt, Mus musculus
uagacuuggggagaggguagacacagugcuaagcugcggugcugua

SEQ ID NO: 35575 - RNA, 45 nt, Mus musculus
ucaacucaccuccaauacuacccucuccuuccccucccucucccc

SEQ ID NO: 35576 - RNA, 46 nt, Mus musculus
cuuggcugugaagaucacuuaacaaagaacuuguagcacgguggag

SEQ ID NO: 35577 - RNA, 46 nt, Mus musculus
agaacgccaagggcuauagagagaaguccugccucgagaaacuaaa

SEQ ID NO: 35578 - RNA, 38 nt, Mus musculus
agacgucaacuucagccacguggggacgcuauggcggu

SEQ ID NO: 35579 - RNA, 56 nt, Mus musculus
caggcccuucccgggagcgugcaugugacccaugauggcggaggucuggcagcaaa

SEQ ID NO: 35580 - RNA, 42 nt, Mus musculus
ggauggcggggcagguaccccucucagcuucuucaggggcag

SEQ ID NO: 35581 - RNA, 46 nt, Mus musculus
auguucucccuccacgcuuuacccacaauuccugagcaccagccau

SEQ ID NO: 35582 - RNA, 46 nt, Mus musculus
agcacucacauagcucuccucagaauacuuccuaccuuggccucau

SEQ ID NO: 35583 - RNA, 46 nt, Mus musculus
gcagcagggaucaauauguggggcuggaaguggguggguagcagag

SEQ ID NO: 35584 - RNA, 45 nt, Mus musculus
agaaggcugaggggugagcccaggaucuggagguggugggccaga

SEQ ID NO: 35585 - RNA, 45 nt, Mus musculus
guuguccucacaccaugauguaaugaacagaccgacagagcgagc

SEQ ID NO: 35586 - RNA, 45 nt, Mus musculus
caacggggaguccauguccuaccuuuucagaaacauaggcuuaga

SEQ ID NO: 35587 - RNA, 45 nt, Mus musculus
uaacacgaucccacacgagauccagaagcugcagugccccaagau

SEQ ID NO: 35588 - RNA, 46 nt, Mus musculus
ugauggccacucacggcuuguuauccucugaugcuccccggcugau

SEQ ID NO: 35589 - RNA, 45 nt, Mus musculus
augacauuauugaugauguggauagcuuucuugcugcagcagaga

SEQ ID NO: 35590 - RNA, 48 nt, Mus musculus
auauugugagccaucugauauugguacuaggaaccaaacucagguccu

SEQ ID NO: 35591 - RNA, 45 nt, Mus musculus
aguagccacaaguaccucuuugccacuguucucugagcugcuuga

SEQ ID NO: 35592 - RNA, 46 nt, Mus musculus
ucuggaagugcuuuuaaccacugagccaucucuccagcccccaguc

SEQ ID NO: 35593 - RNA, 42 nt, Mus musculus
cagucugcauauacaccugcaugccagaagagggcaucagau

SEQ ID NO: 35594 - RNA, 42 nt, Mus musculus
auguauagauugggcugcaaugguuccccugaugccccucac

SEQ ID NO: 35595 - RNA, 52 nt, Mus musculus
gaucccagauuauaggaaugcagucaucguggccaagucuccagccucagcc

SEQ ID NO: 35596 - RNA, 46 nt, Mus musculus
gggaucugccugacucuaccuuuuauaaucaccccccacccccacc

SEQ ID NO: 35597 - RNA, 46 nt, Mus musculus
ucucuccucucucucuucucucucuucucucucuuuugccugagaa

SEQ ID NO: 35598 - RNA, 46 nt, Mus musculus
gugcaugaaauaguucagaaaaacuucuggcuaaaacaaggugccu

SEQ ID NO: 35599 - RNA, 46 nt, Mus musculus
gaguguucacauuguaccuggcuguaacuucuuauuuuugugagau

SEQ ID NO: 35600 - RNA, 46 nt, Mus musculus
uguugcaaaacaaacaaacaaacaagaaaacaaaacuauagaagau

SEQ ID NO: 35601 - RNA, 57 nt, Mus musculus
aaaaccaguaauuaaaaauaauaugcugggcugugaugaugcauaucuuuuauccca

SEQ ID NO: 35602 - RNA, 45 nt, Mus musculus
cacuuagguuuacagucaagauagccaggacaaccauccauagug

SEQ ID NO: 35603 - RNA, 91 nt, Mus musculus
uuuacaccagaaggaaauccagggcuucuucaauauuccaguggauaauuuaagagccuccccauuccuguuacaauauauucaagaagag

SEQ ID NO: 35604 - RNA, 46 nt, Mus musculus
acuguaaauccuaucuaguugacuuauuaaccacugaaccccuuug

SEQ ID NO: 35605 - RNA, 47 nt, Mus musculus
guagcugggccuuccauacugcacuuucagucaggaagggaggaagg

SEQ ID NO: 35606 - RNA, 46 nt, Mus musculus
cuguguugugugugcuuguaugugaguguacaugauuaagggaggc

SEQ ID NO: 35607 - RNA, 46 nt, Mus musculus
gugcaccuaauguaagcacagcugagaagcugccuuagaagcagaa

SEQ ID NO: 35608 - RNA, 44 nt, Mus musculus
cacagugccaaaagguuggcacucccagcauagugagaccuucu

SEQ ID NO: 35609 - RNA, 51 nt, Mus musculus
ucuauauuccuuacuguuuguagauacugaaauccugggucagggauagau

SEQ ID NO: 35610 - RNA, 41 nt, Mus musculus
ucuacucaguucagaaagcaggaagucaggcaggcaaggug

SEQ ID NO: 35611 - RNA, 46 nt, Mus musculus
agguuuugauguuuuguguggcgccuccugaauuagaaaccaagau

SEQ ID NO: 35612 - RNA, 46 nt, Mus musculus
uguacuugcccauacuauaucucccuuaagaucagagccaccauua

SEQ ID NO: 35613 - RNA, 46 nt, Mus musculus
cagagaauaacaggagguuguccauaauugacuuuaagcagcaaac

SEQ ID NO: 35614 - RNA, 45 nt, Mus musculus
ccugaagcaguauguuuguaaagugaaagaacccuaauugccaga

SEQ ID NO: 35615 - RNA, 46 nt, Mus musculus
auauaagagcccuuccuaccccuuaauacuuuaugcugccucggau

SEQ ID NO: 35616 - RNA, 46 nt, Mus musculus
uuaagauuuauuauuauauauaaguacacuguagcugucuucagac

SEQ ID NO: 35617 - RNA, 46 nt, Mus musculus
uuagccauaagaaagcaaaaugccaguaaccacagaauauggaaga

SEQ ID NO: 35618 - RNA, 45 nt, Mus musculus
ccaagaguaccaggcacacgcggugugcagagaaaacacccauac

SEQ ID NO: 35619 - RNA, 46 nt, Mus musculus
cccacgugacagccuacaaccaccucuaaugcuagacccacccaau

SEQ ID NO: 35620 - RNA, 41 nt, Mus musculus
guagaacugguguugacaucucugaugauggcuuccugugg

SEQ ID NO: 35621 - RNA, 99 nt, Mus musculus
gagggagcagcaggcacagagggagcagcaggcacagagggagcagcaggcacagggggaguagcaggcacagagggagcagcaggcacagagggagca

SEQ ID NO: 35622 - RNA, 93 nt, Mus musculus
gcaggcacagagggagcagcaggcacagggggaguagcaggcacagagggagcagcaggcacagagggagcagcaggcacagggggaguagca

SEQ ID NO: 35623 - RNA, 46 nt, Mus musculus
guguguguguguguguguguguguguguguguguguaucuuugcug

SEQ ID NO: 35624 - RNA, 45 nt, Mus musculus
gugcuggcucaugguugauaaauaguagcuucaaaauaaggagaa

SEQ ID NO: 35625 - RNA, 42 nt, Mus musculus
ucccgucacuccaguguaccuuuugucugaggaugggaccag

SEQ ID NO: 35626 - RNA, 45 nt, Mus musculus
cagugucacuuugguauauugcuuuccugcguuuuuaucuaagag

SEQ ID NO: 35627 - RNA, 46 nt, Mus musculus
guauuuauuuugaauugacaagaacuauauaugacaauacaaagug

SEQ ID NO: 35628 - RNA, 73 nt, Mus musculus
ccuuggaccuagucgaucgagaguccgucacuuuaaucucaucacccaguggaaggcguguuuaccagguaga

SEQ ID NO: 35629 - RNA, 48 nt, Mus musculus
gaggucucggguucagucuccaucaucacacacacaaaaccauaggac

SEQ ID NO: 35630 - RNA, 46 nt, Mus musculus
gggugugcuccuaaucccagcuccggccucacggcagcuuucagac

SEQ ID NO: 35631 - RNA, 43 nt, Mus musculus
aaaaaaaaucugaaauaaaugaacaagauguuaacacuuauuc

SEQ ID NO: 35632 - RNA, 49 nt, Mus musculus
cacauaagagaaaccuucuuaaaaauaaauuaauaaguagaaaauaggc

SEQ ID NO: 35633 - RNA, 45 nt, Mus musculus
agccugaccuauguaagaccuuggcucaaaaaacaaaccuaaguc

SEQ ID NO: 35634 - RNA, 45 nt, Mus musculus
cuuguuugaucuauaaaaagaguuacacaguuuuaagagccagau

SEQ ID NO: 35635 - RNA, 46 nt, Mus musculus
auucuuuaaauaaguaaauagauccuauuauugcuucaauggguug

SEQ ID NO: 35636 - RNA, 45 nt, Mus musculus
gucugucuggaaaguuauguuccacuuucauauuugcccccagug

SEQ ID NO: 35637 - RNA, 48 nt, Mus musculus
aguccuggcuguuuugaacucaauauguagaccucaaacucacagaga

SEQ ID NO: 35638 - RNA, 46 nt, Mus musculus
caucagucaucugccagagggagcgacagccacccacagcugagaa

SEQ ID NO: 35639 - RNA, 44 nt, Mus musculus
ggaggagggcugguucuugcaggagccacguugggaagagagca

SEQ ID NO: 35640 - RNA, 45 nt, Mus musculus
gguucaauuuuacuauuuggagacacgggguuaugaagaaggggg

SEQ ID NO: 35641 - RNA, 46 nt, Mus musculus
ccaaggagugggcgagggcugggaugcggaauggcagaugcguaga

SEQ ID NO: 35642 - RNA, 23 nt, Mus musculus
cuggguggaagguugggauccau

SEQ ID NO: 35643 - RNA, 46 nt, Mus musculus
gacugcagugugucauugacaugcugucucuauugcaaggccacag

SEQ ID NO: 35644 - RNA, 45 nt, Mus musculus
uagaggggagucuggguguuaggaaauauaauguggacauaguua

SEQ ID NO: 35645 - RNA, 45 nt, Mus musculus
ugcaguagaucuaguauaaagauguuuauuggggacgagauggga

SEQ ID NO: 35646 - RNA, 42 nt, Mus musculus
gcucuucuuagcuugcucaguuuguuuucuuauacacccagg

SEQ ID NO: 35647 - RNA, 45 nt, Mus musculus
ugcauuucaacucuagaggggaaaauugaaagagaaaaggaauua

SEQ ID NO: 35648 - RNA, 42 nt, Mus musculus
aauguuuccauugcuggauguuuauuaagggaaagagucuau

SEQ ID NO: 35649 - RNA, 48 nt, Mus musculus
agagcaaucaagacacuguauauuguauuaaauccuuagugccuggaa

SEQ ID NO: 35650 - RNA, 50 nt, Mus musculus
cugaaagaacaaguuggcaaagagcagugaguaaauacaauuuggagcag

SEQ ID NO: 35651 - RNA, 45 nt, Mus musculus
cuuaaggcacuccugccuaagccucuugauuagugugagccguag

SEQ ID NO: 35652 - RNA, 46 nt, Mus musculus
uuuaauaaauauugaguaguuguccuaugcugggcauuguuuuuag

SEQ ID NO: 35653 - RNA, 46 nt, Mus musculus
agccccuucuguuuucuuauuuaacucagaaauaccaagcacaugg

SEQ ID NO: 35654 - RNA, 57 nt, Mus musculus
agcuaugcccagcagaaagauucccagguaucggucauauucuuggaaguaaaugcg

SEQ ID NO: 35655 - RNA, 45 nt, Mus musculus
cucuauuacuguguucuggaaagugcugaauaugacaucaguuga

SEQ ID NO: 35656 - RNA, 45 nt, Mus musculus
ccuuguguuucuagggguggugcuggggagaggcugcugugcuca

SEQ ID NO: 35657 - RNA, 45 nt, Mus musculus
cuacacaggguugguccagauuaaaucacagugucucagucacac

SEQ ID NO: 35658 - RNA, 46 nt, Mus musculus
ugcuguucuuguacccugcaaaauaaugccuggcuauccucugcag

SEQ ID NO: 35659 - RNA, 46 nt, Mus musculus
uaaacaaauuagacugaacauggaauauuuaggacuaaaugcagag

SEQ ID NO: 35660 - RNA, 45 nt, Mus musculus
ccgagggucaccacaacuugaacuauuuuaaagggucacaacauu

SEQ ID NO: 35661 - RNA, 42 nt, Mus musculus
ugaacacagggcuuccuuuauaaccacaggcacagaguggag

SEQ ID NO: 35662 - RNA, 42 nt, Mus musculus
gaaaacacauuuuucugggugccacgaaggaacccugguggu

SEQ ID NO: 35663 - RNA, 46 nt, Mus musculus
uaauggccaaguuacuagacagacauacuaagguccaaguccucag

SEQ ID NO: 35664 - RNA, 46 nt, Mus musculus
cuaauaagaucuagacuuaugugacuauaacuuggcagggggacac

SEQ ID NO: 35665 - RNA, 45 nt, Mus musculus
ucuguaucuaaagaaaagcauguauacuaauuguuugaaaccuga

SEQ ID NO: 35666 - RNA, 46 nt, Mus musculus
uuccucauccauggcccuggcucuccugagaagucucugggcacaa

SEQ ID NO: 35667 - RNA, 45 nt, Mus musculus
gggccauguaaauauaaaauccuuuuuuccaacaacuagacccaa

SEQ ID NO: 35668 - RNA, 41 nt, Mus musculus
aaauaucugcuucccucuaucuaucuccaccaacagcccag

SEQ ID NO: 35669 - RNA, 46 nt, Mus musculus
cugauuuuaaagcacagaaauauacaagcaauaaaaauuagaccag

SEQ ID NO: 35670 - RNA, 45 nt, Mus musculus
ucaucgaauaguuaagaaucuuaccugaugugguaacugcuggca

SEQ ID NO: 35671 - RNA, 45 nt, Mus musculus
ccuagaaauuagcauuaguaauuggagcaguuugaaacugacaag

SEQ ID NO: 35672 - RNA, 45 nt, Mus musculus
aaugugacgauuuguuuauaaaugauaggaaagaaaagcaccuga

SEQ ID NO: 35673 - RNA, 45 nt, Mus musculus
caaccaagggccaggcuaaagaagaacuaacugcaaaugggaggu

SEQ ID NO: 35674 - RNA, 46 nt, Mus musculus
cauacaggcaaaggcauucauacacauaaaaugaaaauaaccccag

SEQ ID NO: 35675 - RNA, 46 nt, Mus musculus
gcuauugaggacaguguaaauacacuaucacaggaaaagcuaucag

SEQ ID NO: 35676 - RNA, 45 nt, Mus musculus
gcccagaguuucuuuugacagggucaggagacuagcaaaucauag

SEQ ID NO: 35677 - RNA, 46 nt, Mus musculus
caagaacaugugaagaauaauugaucaaacaggacuuagagauaag

SEQ ID NO: 35678 - RNA, 46 nt, Mus musculus
auagcaaaagccaaucacugguuggauccuagcaaaauagcugcag

SEQ ID NO: 35679 - RNA, 51 nt, Mus musculus
agcggcuugagguuuuaguucuuacagguguggaugacaaagcagauggug

SEQ ID NO: 35680 - RNA, 45 nt, Mus musculus
uucugcauucucuguguguuucauucugaguacaaaacagccuua

SEQ ID NO: 35681 - RNA, 67 nt, Mus musculus
ucagcaagugugaucagucgauggguccugggcaccugucccauucccucugacugggaagaugggg

SEQ ID NO: 35682 - RNA, 41 nt, Mus musculus
aaccaugucuggcugauaggccuguggcuuuuccuggggug

SEQ ID NO: 35683 - RNA, 46 nt, Mus musculus
cugggcuaacaucaucagaggagauuaguaaguaaguaagggguag

SEQ ID NO: 35684 - RNA, 45 nt, Mus musculus
gacugacuuacaaagaugccaacaagaagaaaggcaucaccugga

SEQ ID NO: 35685 - RNA, 46 nt, Mus musculus
cucucugaguuuggaccaggauguagcucucagcuacugccccagc

SEQ ID NO: 35686 - RNA, 46 nt, Mus musculus
ucuggucagccccacucgcucagucccugcucacuccagcccaaag

SEQ ID NO: 35687 - RNA, 44 nt, Mus musculus
cucauuacaguugguugugguugcugggaauugaacucaggacc

SEQ ID NO: 35688 - RNA, 44 nt, Mus musculus
aaaucccaguaaccacaugguggcucacaaccaucuguucugac

SEQ ID NO: 35689 - RNA, 46 nt, Mus musculus
cccgccucuaucuucuuacgugugugugugugugugugugugugug

SEQ ID NO: 35690 - RNA, 50 nt, Mus musculus
gacauccaaagcuacacaaagaaacccugucuagaaagaaaaaggaggaa

SEQ ID NO: 35691 - RNA, 45 nt, Mus musculus
ucuuuguaucaaccauccuuagauauacccucucccuugccccua

SEQ ID NO: 35692 - RNA, 42 nt, Mus musculus
cagauucucucccuccccagcaaucuacaaacaaaggaagga

SEQ ID NO: 35693 - RNA, 45 nt, Mus musculus
ugcgggcgcucgccuuagcgaaauacugauguuuccugcuugagg

SEQ ID NO: 35694 - RNA, 42 nt, Mus musculus
cuguuaacaaaugugaugaaagcacaaaccgcccagcgcguc

SEQ ID NO: 35695 - RNA, 79 nt, Mus musculus
uggccuucacguucucgauggugucacugggcuccaccucuagggugauggucuugccggucagggucuucacgaagau

SEQ ID NO: 35696 - RNA, 46 nt, Mus musculus
gcuugccggcaaagaucagccucugcuggucaggggggaugcccuc

SEQ ID NO: 35697 - RNA, 71 nt, Mus musculus
ucuugccggucagggucuucacgaagaucugcaugccaccucucaggcgaaggaccaggugcaggguugac

SEQ ID NO: 35698 - RNA, 46 nt, Mus musculus; identical to SEQ ID NO: 35696

SEQ ID NO: 35699 - RNA, 46 nt, Mus musculus
gucuugccagucagggucuucacgaagaucugcaugccaccccuca

SEQ ID NO: 35700 - RNA, 46 nt, Mus musculus; identical to SEQ ID NO: 35696

SEQ ID NO: 35701 - RNA, 62 nt, Mus musculus
ucagggucuucacgaagaucugcaugccaccucucaggcgaaggaccaggugcaggguugac

SEQ ID NO: 35702 - RNA, 46 nt, Mus musculus; identical to SEQ ID NO: 35696

SEQ ID NO: 35703 - RNA, 45 nt, Mus musculus
cccacugggaaugcagaccgaauaauuaauagccaccccucagac

SEQ ID NO: 35704 - RNA, 42 nt, Mus musculus
ccccagcgcccaccagcucccuugcagagaugcgagacccag

SEQ ID NO: 35705 - RNA, 82 nt, Mus musculus
gagccuugacuucuuagaacagagauccaaguauaggcccggaggaaguaggaaaggggcgggaugcuggaggguagcggaa

SEQ ID NO: 35706 - RNA, 41 nt, Mus musculus
gaagaugggagagugggagcgaagagaggaggguguguggg

SEQ ID NO: 35707 - RNA, 62 nt, Mus musculus
gaucugugcagcgcacaaggcggagcugagaggcugggcccgggcucagcaucgcuccagac

SEQ ID NO: 35708 - RNA, 46 nt, Mus musculus
augauacugcuccuauuccacguugucaacgucccgucugaaaggu

SEQ ID NO: 35709 - RNA, 64 nt, Mus musculus
accuggccccucacccagcucaaggaugguugguagguggcccuguuuuggagagcgcuuccgg

SEQ ID NO: 35710 - RNA, 44 nt, Mus musculus
uuccagugacucuucaagccuauguuuuuauaugaugccugcag

SEQ ID NO: 35711 - RNA, 41 nt, Mus musculus
ccgaguggucugggcuccagaacaaggccaggggcagcaga

SEQ ID NO: 35712 - RNA, 45 nt, Mus musculus
caaaagucacaggcagcuccccuugggcccucuugaagcugggag

SEQ ID NO: 35713 - RNA, 46 nt, Mus musculus
cagcugauuuuauuauuucccaagaggaaaugcaaaaugccaagaa

SEQ ID NO: 35714 - RNA, 41 nt, Mus musculus
gggugagcauaagagaggagaaaugguuuggaugggguagg

SEQ ID NO: 35715 - RNA, 32 nt, Mus musculus
agcaaaccacaagccgaacaaaccguggaggu

SEQ ID NO: 35716 - RNA, 46 nt, Mus musculus
aauauugucauggcacaaaaggucuaucagaacccuggccccgaug

SEQ ID NO: 35717 - RNA, 42 nt, Mus musculus
ggaagaagaggaggaggaaggagaagaggaagaggaagaaaa

SEQ ID NO: 35718 - RNA, 42 nt, Mus musculus
uaaggaggaggaggaggaggaggaggaagaggacaaggaaga

SEQ ID NO: 35719 - RNA, 43 nt, Mus musculus
gucggaggaggauaggaguuuagcccuugcugcaagaaggacg

SEQ ID NO: 35720 - RNA, 61 nt, Mus musculus
ggugacugaccugagcucgugccuggagcaugugugugugugugugugugugugugugugu

SEQ ID NO: 35721 - RNA, 41 nt, Mus musculus
cuguaggaacugcagguggguggguaggagggccagccccg

SEQ ID NO: 35722 - RNA, 26 nt, Mus musculus
aagaggagacaaccaauagaccaaga

SEQ ID NO: 35723 - RNA, 46 nt, Mus musculus
gaguaugaaguugaggguggccugagcuaccuagugagauccuauu

SEQ ID NO: 35724 - RNA, 52 nt, Mus musculus
cugcucucggcauggccauuuuuguuuaguucuuagucaggcuuggaaugua

SEQ ID NO: 35725 - RNA, 47 nt, Mus musculus
cagguagacuaauggucggccugcguugguggaaucauauugaugag

SEQ ID NO: 35726 - RNA, 45 nt, Mus musculus
guguaucucacuugcccuguuagcacgaagucagguagccaccaa

SEQ ID NO: 35727 - RNA, 46 nt, Mus musculus
gcuuuguugccuugcugggcaucgccuuggauguuucuguguucag

SEQ ID NO: 35728 - RNA, 46 nt, Mus musculus
aacuguggggaaccuguuuguuuugggucacccugcuuccuaacag

SEQ ID NO: 35729 - RNA, 45 nt, Mus musculus
ggcuguggacacuugccugagccucugauucugccauggcugcag

SEQ ID NO: 35730 - RNA, 46 nt, Mus musculus
ugcauagcauuccuguacaugguuuuugggguaaguuuugauucag

SEQ ID NO: 35731 - RNA, 61 nt, Mus musculus
ugggaccuuuguaguugugguggauauacaggggcugcuguugcuguguuucuuugugacc

SEQ ID NO: 35732 - RNA, 46 nt, Mus musculus
aagcaauauacuauagacuaaaccaaauguaaacuauuguaggcag

SEQ ID NO: 35733 - RNA, 42 nt, Mus musculus
uuuucaucuuucugauguuuugaggauuccuucccugaggag

SEQ ID NO: 35734 - RNA, 45 nt, Mus musculus
aaaucccaguaaccacaugguggcucacaaccaucuguaagugag

SEQ ID NO: 35735 - RNA, 46 nt, Mus musculus
cacauuagacuuucccagagacaugggcgaacacaaagagguuuag

SEQ ID NO: 35736 - RNA, 54 nt, Mus musculus
cuggaguaguagcugagaguuuuauauacugauucacaggcagagaaagaagag

SEQ ID NO: 35737 - RNA, 46 nt, Mus musculus
augggucaucuccaggaacagacacugagugaauguuuuugugcaa

SEQ ID NO: 35738 - RNA, 46 nt, Mus musculus
guggcuugcccaaagguccaugugcuagaagcuggguucuuggugu

SEQ ID NO: 35739 - RNA, 42 nt, Mus musculus
aggaggaggaaggggaggagaaggaggacagagugggggagg

SEQ ID NO: 35740 - RNA, 41 nt, Mus musculus
cagagcugaauauaauucuccuucgaagagagugggguggg

SEQ ID NO: 35741 - RNA, 45 nt, Mus musculus
agcugccagcauuucugcucugggugaacagggcgacaugguuga

SEQ ID NO: 35742 - RNA, 25 nt, Mus musculus
accgucagacuggguucugaagcaa

SEQ ID NO: 35743 - RNA, 41 nt, Mus musculus
gucacaguaaggggacaaugguggcuggaauagcugaggca

SEQ ID NO: 35744 - RNA, 42 nt, Mus musculus
guugcccuaacauucaccuuuaaugacuaugucuucggccag

SEQ ID NO: 35745 - RNA, 44 nt, Mus musculus
gguuucuuacuccuuggaggccauguaggccaugagguccauca

SEQ ID NO: 35746 - RNA, 46 nt, Mus musculus
uguguguguguuuauguguguguguauguguguguguauguguguu

SEQ ID NO: 35747 - RNA, 47 nt, Mus musculus
augaaacccauccacccuugucggugguguuucagagccccagacaa

SEQ ID NO: 35748 - RNA, 41 nt, Mus musculus
uugggaacaaaacuucagaagucucugggaugagaggggau

SEQ ID NO: 35749 - RNA, 42 nt, Mus musculus
aggcgcugucaaucugacagcgcccagagaccuaggggugga

SEQ ID NO: 35750 - RNA, 44 nt, Mus musculus
gagaagacauagagagcagcccccgcgucccggccgcccgccgc

SEQ ID NO: 35751 - RNA, 46 nt, Mus musculus
ggguucucauacugccuaguagguuuugagcccucuuugguuagug

SEQ ID NO: 35752 - RNA, 45 nt, Mus musculus
gcuguccucuggagggcacugcccauuuucagcugauccagaguc

SEQ ID NO: 35753 - RNA, 45 nt, Mus musculus
uuauuuuauguaugugaguacacuguagcugucuucaaacacauc

SEQ ID NO: 35754 - RNA, 53 nt, Mus musculus
ugauacucuucccguccuugacagcagcaaugaugggugcaauggcggccguc

SEQ ID NO: 35755 - RNA, 33 nt, Mus musculus
ucugaaucuuguggcugcgcagguuguggaccg

SEQ ID NO: 35756 - RNA, 85 nt, Mus musculus
acgcaccucugccacucucucuuggggcggagcugauacuugaggaggcauucaccccgaacuguuggcacgcugaggguggacc

SEQ ID NO: 35757 - RNA, 42 nt, Mus musculus
ggccucagcuaugaauucaucaguauugcagucgaguguggu

SEQ ID NO: 35758 - RNA, 41 nt, Mus musculus
ccuccuccuccugggcugggcuccucacgcccaucgucagc

SEQ ID NO: 35759 - RNA, 45 nt, Mus musculus
cauaauaaauuauaaaccaguaaaauuuaucuacaacucagagaa

SEQ ID NO: 35760 - RNA, 45 nt, Mus musculus
aggcacugcacgggcggacagacagagugcccgagaccaggagga

SEQ ID NO: 35761 - RNA, 58 nt, Mus musculus
agggcuucugaguggcuugugacuagaggcugggaagagguaggacgccuggagauag

SEQ ID NO: 35762 - RNA, 45 nt, Mus musculus
ucauggccuauuucugucuugaaaaggauacaacaaggaccuccu

SEQ ID NO: 35763 - RNA, 46 nt, Mus musculus
gaguacacuguagcugucuucagacacaccagagagggcaucagau

SEQ ID NO: 35764 - RNA, 45 nt, Mus musculus
guggcucuuucuuucucucucucucucucucucucucucucuccu

SEQ ID NO: 35765 - RNA, 48 nt, Mus musculus
gaauccaaguuagccgcuugcaggaacuuugcaaaagaccaagcaucc

SEQ ID NO: 35766 - RNA, 46 nt, Mus musculus
ugccuuuugaaauaugacacugguuauuucucuaucaguuuuuaau

SEQ ID NO: 35767 - RNA, 31 nt, Mus musculus
cuaggauaucagcacuaaacaucgugggaga

SEQ ID NO: 35768 - RNA, 45 nt, Mus musculus
cugguuuggcacaguauuucuuuuaugugugugugugugugugug

SEQ ID NO: 35769 - RNA, 46 nt, Mus musculus
aggcuucacucuccuugccugcaacgccuguugggaaaggcacaga

SEQ ID NO: 35770 - RNA, 46 nt, Mus musculus
acugcucaauuucuuuuuaccuuugggcauaauacuguucucugag

SEQ ID NO: 35771 - RNA, 45 nt, Mus musculus
aucuuuguuggucucaguacagagguuaaaggaugaagccagagg

SEQ ID NO: 35772 - RNA, 46 nt, Mus musculus
aauucaugggcuucaaauaauuuuuuuuuaaagggcaacaauaguu

SEQ ID NO: 35773 - RNA, 68 nt, Mus musculus
aguguuagaagaugauuuaagucagacccgggccauuaaggagcaacugcauaaguaugugagagagc

SEQ ID NO: 35774 - RNA, 50 nt, Mus musculus
acaaagaaauagagaccugcaggcugauaaccaaagacugaaguaugaag

SEQ ID NO: 35775 - RNA, 46 nt, Mus musculus
augagcuaguugaguuccaggaaggaagcagagaguuagaagcaga

SEQ ID NO: 35776 - RNA, 42 nt, Mus musculus
aagcaaagguaauguuugaaaacauaaaauaggggcgggauu

SEQ ID NO: 35777 - RNA, 46 nt, Mus musculus
gaagauauaccggauuuuucaaguuuaaaggaagaaacugcuuauu

SEQ ID NO: 35778 - RNA, 46 nt, Mus musculus
ccaucuccugucauaccuuauccacuguguugguugugcccaagug

SEQ ID NO: 35779 - RNA, 47 nt, Mus musculus
aaaaauagauuucaagguaugaguuaaaauuuuuauauguagaugga

SEQ ID NO: 35780 - RNA, 45 nt, Mus musculus
cuaucuaucuaucuauauguauauauauaugagcugccuggugug

SEQ ID NO: 35781 - RNA, 46 nt, Mus musculus
gauaaagcuggguacugccaggcgggaagcaacagauacagcgugu

SEQ ID NO: 35782 - RNA, 42 nt, Mus musculus
aaggguagcacauucguuacuugaaccugguucuuagaagga

SEQ ID NO: 35783 - RNA, 25 nt, Mus musculus
cgagagcaggagcagcccgcguugg

SEQ ID NO: 35784 - RNA, 60 nt, Mus musculus
cgcuuuaacuguccccuccuuacuggcggagguguggcccaccgggggcaccugcgggag

SEQ ID NO: 35785 - RNA, 36 nt, Mus musculus
cuuuacugauuuauuucccauggauuugguguaaug

SEQ ID NO: 35786 - RNA, 42 nt, Mus musculus
guggagaugaauaggagacaauagauaaacagguaagcagga

SEQ ID NO: 35787 - RNA, 41 nt, Mus musculus
ucuccauauaaugcuuuuaaucccaguaauugggagguaga

SEQ ID NO: 35788 - RNA, 46 nt, Mus musculus
gcagaaauggcaaagauuguacaggggauaaaacuaaaggucagau

SEQ ID NO: 35789 - RNA, 42 nt, Mus musculus
gauguacuuucaaguugugauuaauaaggaccgggacaggag

SEQ ID NO: 35790 - RNA, 46 nt, Mus musculus
gucaggguucucccaauauuuuaggcccuaugagaugguaccagcc

SEQ ID NO: 35791 - RNA, 45 nt, Mus musculus
auuuauccucuuauuuucuccaaaaaaagccauaugcccugagau

SEQ ID NO: 35792 - RNA, 42 nt, Mus musculus
cacaggagaacacgagaggaggaagcaucuucgccagcacca

SEQ ID NO: 35793 - RNA, 42 nt, Mus musculus
cacugucgcugucuuuagacacaccagaagagggcaucagau

SEQ ID NO: 35794 - RNA, 45 nt, Mus musculus
guaaauaugcagauuuauaguguaucuauccaguucuauuuuuua

SEQ ID NO: 35795 - RNA, 46 nt, Mus musculus
uauuaguuaugcaaccuuaaauggauucuuuuccugggucucagaa

SEQ ID NO: 35796 - RNA, 42 nt, Mus musculus
aucuauagauacccggguuugguccuugaugugggacgaggc

SEQ ID NO: 35797 - RNA, 45 nt, Mus musculus
acuuccccugacucaccuuccagcacaccgagucccagcccagug

SEQ ID NO: 35798 - RNA, 46 nt, Mus musculus
uccgaaagcacuuccucaaauauccaaugaugcaucggccucagug

SEQ ID NO: 35799 - RNA, 42 nt, Mus musculus
ugggguguucugcggaagucauccccugaggaggguggaaag

SEQ ID NO: 35800 - RNA, 41 nt, Mus musculus
cuuggggucccccgacucucugggcucauucuggagugggu

SEQ ID NO: 35801 - RNA, 49 nt, Mus musculus
caccucugccucuacuuccuaucacagugacugcugacagauugaccuc

SEQ ID NO: 35802 - RNA, 45 nt, Mus musculus
agcuuuaacuccccccccuuccaagaccaaagggaacugggagac

SEQ ID NO: 35803 - RNA, 46 nt, Mus musculus
ugcaccgaugcucuccaucuggucuaucuggugucugugaagguca

SEQ ID NO: 35804 - RNA, 42 nt, Mus musculus
gugucucuggcuggcaccacacucaagauccuccagauccag

SEQ ID NO: 35805 - RNA, 46 nt, Mus musculus
guggaauuuuuaaaagcaauccccccccccccaacuuagaaccaga

SEQ ID NO: 35806 - RNA, 44 nt, Mus musculus
gggagcagcugauacuuuuagggacacuaguagaccuauuggga

SEQ ID NO: 35807 - RNA, 42 nt, Mus musculus
gcaggcaaagaggaugaugggagaaaagacagaacuaaggag

SEQ ID NO: 35808 - RNA, 46 nt, Mus musculus
ugaaacagaacaaaacaaaacaauaacaaaauagccaaccagacaa

SEQ ID NO: 35809 - RNA, 46 nt, Mus musculus
guuuuuguuuuuuuuguuuuagaucacaguagcucaaacuggccuc

SEQ ID NO: 35810 - RNA, 30 nt, Mus musculus
cguccuccaaaguuuauggugccuccuugu

SEQ ID NO: 35811 - RNA, 56 nt, Mus musculus
uccaccuggcagccccaugcggcaugcguacagcgagauccuggaagaaccacaca

SEQ ID NO: 35812 - RNA, 28 nt, Mus musculus
acaguacacuccacugcagacucccuac

SEQ ID NO: 35813 - RNA, 46 nt, Mus musculus
aucuaggcugccuggugcggguagagaaguuccaguugguaguaga

SEQ ID NO: 35814 - RNA, 50 nt, Mus musculus
cagccuccuccugcccagagggaccccaccugggacagagccggcuguuc

SEQ ID NO: 35815 - RNA, 48 nt, Mus musculus
aauuuuugucuccuuccgggagacaguucacaaccugcaaagcccacc

SEQ ID NO: 35816 - RNA, 46 nt, Mus musculus
ucuuguacccaaaccaagucuaccgacucguggcuuccggccccuc

SEQ ID NO: 35817 - RNA, 42 nt, Mus musculus
agcuuuagcaauaaaaggaaacaggaacagaaaaugcaggga

SEQ ID NO: 35818 - RNA, 46 nt, Mus musculus
ugcugagauuuugucucggauacugugugaaccaccucuggcccuu

SEQ ID NO: 35819 - RNA, 46 nt, Mus musculus
cucccugagugcuuggguucugccuuguggagaaagcaggacggag

SEQ ID NO: 35820 - RNA, 45 nt, Mus musculus
acagagagggaaacaacagcgaaggcaagagaugcagaggcagau

SEQ ID NO: 35821 - RNA, 46 nt, Mus musculus
agugaucagacugaguuuugcaagcaaauucuugaggcccacacgu

SEQ ID NO: 35822 - RNA, 32 nt, Mus musculus
uguucugggauccuugcgaggcaguggagccc

SEQ ID NO: 35823 - RNA, 45 nt, Mus musculus
aaggacgcccaaucucaaaguugucaauagugaaaggcugccuga

SEQ ID NO: 35824 - RNA, 45 nt, Mus musculus
agcugugaaaguagguggggcacguguuggggaggaguccagggg

SEQ ID NO: 35825 - RNA, 42 nt, Mus musculus
agcauuugggaggugggggaaagagguuuagaaauucaaggu

SEQ ID NO: 35826 - RNA, 46 nt, Mus musculus
uucucugcguugauaauacuauagggucucagaagggaagauggga

SEQ ID NO: 35827 - RNA, 45 nt, Mus musculus
augaugggcuggcaaauaggugugggagcccaucuuggguugaag

SEQ ID NO: 35828 - RNA, 41 nt, Mus musculus
gacaucaugagggugaauguggacaagguccuggagcggga

SEQ ID NO: 35829 - RNA, 76 nt, Mus musculus
agucugcccugccuaagaagggccucucccccacccccagccguuccuccaccucucagccauaucuuucagcccc

SEQ ID NO: 35830 - RNA, 45 nt, Mus musculus
guuuuauuacuagaagauuuuuuccgguuguccuuaacaccccuu

SEQ ID NO: 35831 - RNA, 66 nt, Mus musculus
ucucucacccucugucccuuuuccucuuuccugaucagccccaagucccuucauuugcaucugcua

SEQ ID NO: 35832 - RNA, 42 nt, Mus musculus
ccucguccuucuccagggcuguugagcccagagagagagagu

SEQ ID NO: 35833 - RNA, 44 nt, Mus musculus
cuguguggaggggaaccaaggagaucuaaacuguggugugaaag

SEQ ID NO: 35834 - RNA, 44 nt, Mus musculus
uccuucuuccccugccccaugcccccaauucuguggcgcaucca

SEQ ID NO: 35835 - RNA, 42 nt, Mus musculus
auacuauaacaugagauaagcuagaggccauagcugguggag

SEQ ID NO: 35836 - RNA, 33 nt, Mus musculus
acgacacaagauagagauauaaagagaaaagaa

SEQ ID NO: 35837 - RNA, 46 nt, Mus musculus
uuguacucucucuacccuaguccagucccagucccuucccgagucc

SEQ ID NO: 35838 - RNA, 45 nt, Mus musculus
ggagggaauaaggaaggagggaccaaguggcaaguggaagacagg

SEQ ID NO: 35839 - RNA, 42 nt, Mus musculus
cuggaaaaaccacagaaaauaauaacaauaacaacaaugaua

SEQ ID NO: 35840 - RNA, 41 nt, Mus musculus
gugcugggggaaugacauagaucccagcaccgauucagaga

SEQ ID NO: 35841 - RNA, 42 nt, Mus musculus
gaaggaaggaaugugaagaucuguggggaaaugggggcagag

SEQ ID NO: 35842 - RNA, 36 nt, Mus musculus
cugagcuuaguaacacaaaccuauguaggcccaguu

SEQ ID NO: 35843 - RNA, 41 nt, Mus musculus
uaaagaaaaaggaauggaguucagcacagguaggguuguag

SEQ ID NO: 35844 - RNA, 42 nt, Mus musculus
ggguucaucagagaaggugagagccagugcaggcaggggggu

SEQ ID NO: 35845 - RNA, 46 nt, Mus musculus
uugucagcccuacucccucagcucagagggacuccccuccuaagau

SEQ ID NO: 35846 - RNA, 42 nt, Mus musculus
gccuggagaccaacugaaacuaauggaucagcucagggagug

SEQ ID NO: 35847 - RNA, 45 nt, Mus musculus
gcagucgguuagcuaaaagccacaucccuacugagagcccagagu

SEQ ID NO: 35848 - RNA, 45 nt, Mus musculus
acuguccggggagugaugcuacaggcuuaaugagugggcugcaag

SEQ ID NO: 35849 - RNA, 46 nt, Mus musculus
cccagcauuugagaggcagaggcaggcagauuuuugaguuugaggc

SEQ ID NO: 35850 - RNA, 45 nt, Mus musculus
ggauggccaccaccaagaguugugaucuuugaaggggaucaagau

SEQ ID NO: 35851 - RNA, 42 nt, Mus musculus
guggcuauguuacaaauaaagggagccaaguuuguguugugg

SEQ ID NO: 35852 - RNA, 42 nt, Mus musculus
gugucugucugaaaugccaagggagucagagacagggcagag

SEQ ID NO: 35853 - RNA, 45 nt, Mus musculus
ggcccuaggcucagggaugcuugcagugguuagaugccccauagu

SEQ ID NO: 35854 - RNA, 37 nt, Mus musculus
gccauucauuuuaauuagugcccugcauucugucugu

SEQ ID NO: 35855 - RNA, 43 nt, Mus musculus
gccuugcuucagucccuaagacugaaaagccugcacggaagaa

SEQ ID NO: 35856 - RNA, 24 nt, Mus musculus
gaucuguggggccuguggggccug

SEQ ID NO: 35857 - RNA, 45 nt, Mus musculus
augaggugcuggauucagucccuaguacaccaaaagagggaagug

SEQ ID NO: 35858 - RNA, 46 nt, Mus musculus
guucucacuccuuauaacuguggcuuguguauggaccugaccaguc

SEQ ID NO: 35859 - RNA, 30 nt, Mus musculus
ccgucuguccucugcagcaccuccccagau

SEQ ID NO: 35860 - RNA, 63 nt, Mus musculus
aagcuuauuauauacacuuuagaauuaucuagcccaaaugucagcagauagcaggaaagagag

SEQ ID NO: 35861 - RNA, 25 nt, Mus musculus
gccaagaaugaggccucuguuucuc

SEQ ID NO: 35862 - RNA, 45 nt, Mus musculus
acguggaucaguagccggggcuuaggagaugaggcgugcaucagu

SEQ ID NO: 35863 - RNA, 46 nt, Mus musculus
gggacaacagauacaugaaaggccaaagaugacauuaagcagagau

SEQ ID NO: 35864 - RNA, 32 nt, Mus musculus
cagaauaaggugagaugccaggauauggaggu

SEQ ID NO: 35865 - RNA, 46 nt, Mus musculus
uuuugagacaccauguaguugcugagauuugaacucaugaccucug

SEQ ID NO: 35866 - RNA, 45 nt, Mus musculus
cccgcuacacuagccuucggcccggcccccccaccaaccccccag

SEQ ID NO: 35867 - RNA, 48 nt, Mus musculus
guucggggucagcuccagaccaugcuccauaccucccgugauacugcc

SEQ ID NO: 35868 - RNA, 46 nt, Mus musculus
auugggccagcuuugguuugaggucuguuucaguuugcacauuuug

SEQ ID NO: 35869 - RNA, 46 nt, Mus musculus
uacagcguacaacgggucaugugggcaauguccuugaccucuggac

SEQ ID NO: 35870 - RNA, 42 nt, Mus musculus
ccgggcgcggcggcggcggcggcggcggcgguggcggcggcc

SEQ ID NO: 35871 - RNA, 42 nt, Mus musculus
ggcgggaagagguggcagcugggggggcuguggcggucgcgg

SEQ ID NO: 35872 - RNA, 46 nt, Mus musculus
cucugagggacgaggaggaggaggaggaggagaugguggugucgga

SEQ ID NO: 35873 - RNA, 51 nt, Mus musculus
cuccucgucccucagaggggaagccauccuguggcucuggcccccccacca

SEQ ID NO: 35874 - RNA, 42 nt, Mus musculus
cgccgaggaggaggaggaggaggaggaggaggaggaggaggu

SEQ ID NO: 35875 - RNA, 46 nt, Mus musculus
gagagagagaguguguguguguguguguguguguguguguguuggg

SEQ ID NO: 35876 - RNA, 41 nt, Mus musculus
agacuagagacguaaguucugcugguauggggucgguggaa

SEQ ID NO: 35877 - RNA, 45 nt, Mus musculus
gcgacaaacgcacuucagguaguucuuggaccugauaguuuuaag

SEQ ID NO: 35878 - RNA, 42 nt, Mus musculus
uagaggcauugcucaacaagaccaugcguauccguaugacag

SEQ ID NO: 35879 - RNA, 46 nt, Mus musculus
uuuucugcgggcgaaccccgugugcugggucuggccaugguaccag

SEQ ID NO: 35880 - RNA, 45 nt, Mus musculus
cacaauugcacuucucuuugagaccauuaaacccuaugaccaaag

SEQ ID NO: 35881 - RNA, 42 nt, Mus musculus
cucaguguugaucuuggguuucacagacugggcaggggacag

SEQ ID NO: 35882 - RNA, 47 nt, Mus musculus
caucaagguggaaaguggggacaaggagaccuuuaucgccucugagg

SEQ ID NO: 35883 - RNA, 47 nt, Mus musculus
cuuccaccucagaggcgauaaaggucuccuuguccccacuuuccacc

SEQ ID NO: 35884 - RNA, 46 nt, Mus musculus
cggagcuucagcauaucugcccggcucacaccuggaggccccggag

SEQ ID NO: 35885 - RNA, 43 nt, Mus musculus
ucgugaggaggcuccggggccuccaggugugagccgggcagau

SEQ ID NO: 35886 - RNA, 30 nt, Mus musculus
cccgccugugccgccgaugcuccuuuugac

SEQ ID NO: 35887 - RNA, 46 nt, Mus musculus
gccucuagccaaguuuccuccaccuccccagccacagcccccacca

SEQ ID NO: 35888 - RNA, 42 nt, Mus musculus
aagggcucuuugagugggggugggggagccacgccugccucc

SEQ ID NO: 35889 - RNA, 45 nt, Mus musculus
agacccccuccccaggccauccagcccaaccuugagcccccagga

SEQ ID NO: 35890 - RNA, 46 nt, Mus musculus
aagguugggcuggauggccuggggagggggucuauacuucuggcca

SEQ ID NO: 35891 - RNA, 46 nt, Mus musculus
ugaggggauaucuccagcgcaggguuuugguaauggucagcgccag

SEQ ID NO: 35892 - RNA, 42 nt, Mus musculus
ggggaccuggaccaagggguguguuggggaccagccgauggc

SEQ ID NO: 35893 - RNA, 42 nt, Mus musculus
uugcguuccgcggacuacucguucacgcggagcuccggucag

SEQ ID NO: 35894 - RNA, 42 nt, Mus musculus
aacagaggagugcccacagucaaaugagggucagucggggag

SEQ ID NO: 35895 - RNA, 46 nt, Mus musculus
ccucauaccaugaauuacacuggaggagcaccccauggacggcuag

SEQ ID NO: 35896 - RNA, 45 nt, Mus musculus
uucuacaaacuguaccugguagagggugcccagggucggcguugu

SEQ ID NO: 35897 - RNA, 42 nt, Mus musculus
aacaaaggcaaugggcgggagcuaagaauugcuguccgaggu

SEQ ID NO: 35898 - RNA, 46 nt, Mus musculus
uccucaacuggagaacacuuuccucagaaaguuuaagccccaaggu

SEQ ID NO: 35899 - RNA, 45 nt, Mus musculus
aagggcagggacaccuagcucccaggaggcacucgguguugcaga

SEQ ID NO: 35900 - RNA, 44 nt, Mus musculus
ucucuuuaauccuuuccaaucuccucuucaccgcagcccccacg

SEQ ID NO: 35901 - RNA, 45 nt, Mus musculus
uuaaaaaacaaacaaacaaacaaacaacccuaugacaucccuaga

SEQ ID NO: 35902 - RNA, 98 nt, Mus musculus
aagggaagaccuuagugaccaguuagcaacuugcaaggaguagccagagagaggauggggguggguagaucugggcuuagggaguccccccagccagc

SEQ ID NO: 35903 - RNA, 46 nt, Mus musculus
aaguugcuaacuggucacuaaggucuucccuuucugcaugccagcc

SEQ ID NO: 35904 - RNA, 42 nt, Mus musculus
gcuggggggacucccuaagcccagaucuacccacccccaucc

SEQ ID NO: 35905 - RNA, 49 nt, Mus musculus
agccaucaguuaaaaaacaaaguggauauucagagcaggucaagcccgc

SEQ ID NO: 35906 - RNA, 85 nt, Mus musculus
aggauguaucaggaaggacggaaaaggccacagaaccaacuuguacugagcuacaaauggcagcuuuucagagggagagggauca

SEQ ID NO: 35907 - RNA, 79 nt, Mus musculus
agaagucaaagccaccaagauacuggcuauggugacagaagugugaagagaugaaaggaaaguggcuagaaccuuguaa

SEQ ID NO: 35908 - RNA, 46 nt, Mus musculus
cgaacuagaaaacucccgacuccucucugucucuggcuaagcuaag

SEQ ID NO: 35909 - RNA, 46 nt, Mus musculus
augcccacacaauuuccaacaucuuccaaccuuagcuuagccagag

SEQ ID NO: 35910 - RNA, 45 nt, Mus musculus
agaggaacugucuucuuagguagaaagacugagaguucagggaga

SEQ ID NO: 35911 - RNA, 46 nt, Mus musculus
uagcuagccaaccucguuuauuuuuagcucucacccacccccuugg

SEQ ID NO: 35912 - RNA, 46 nt, Mus musculus
uggcugugcaccccggaauuugcagcagcuguauaucugacuggag

SEQ ID NO: 35913 - RNA, 45 nt, Mus musculus
aaggugccucggcaucccuuucccugguuaucuuucccuguuuug

SEQ ID NO: 35914 - RNA, 45 nt, Mus musculus
cucucccuggccucucggauucgcguggaagccauuccgagccuc

SEQ ID NO: 35915 - RNA, 46 nt, Mus musculus
uuuaauuccugcagaggcaggcagaccucugaguuggaggccagcc

SEQ ID NO: 35916 - RNA, 42 nt, Mus musculus
guggcucaaccaguaacgccagagcuguaauccuaggcugag

SEQ ID NO: 35917 - RNA, 59 nt, Mus musculus
uuccacucauaaaagucaaaagauguucagaaccccacugaucagaagaagaaaauauc

SEQ ID NO: 35918 - RNA, 46 nt, Mus musculus
aaagaagggaggaagggaaagggaaaggaagaaagaaggaagagau

SEQ ID NO: 35919 - RNA, 46 nt, Mus musculus
cucauagauagguggauggauagaaagaaauaauaaguugccagau

SEQ ID NO: 35920 - RNA, 46 nt, Mus musculus
aagugacugaaugaauuuuagaagaaacuuugaacacuguugagac

SEQ ID NO: 35921 - RNA, 42 nt, Mus musculus
aaccauccguaacgagaucugacucccucuucuggagggucu

SEQ ID NO: 35922 - RNA, 23 nt, Mus musculus
aaguuugggggggggccggugag

SEQ ID NO: 35923 - RNA, 42 nt, Mus musculus
cacuuuccgagccugcuggauguuggcaccgugcguuccgau

SEQ ID NO: 35924 - RNA, 50 nt, Mus musculus
acuccucucucuuuucugacucugucucugaagcuguggaggggucugag

SEQ ID NO: 35925 - RNA, 42 nt, Mus musculus
cuugcuggaggagguucaccaggcuccgaaucaacuggaggc

SEQ ID NO: 35926 - RNA, 42 nt, Mus musculus
uguuaggaccaucagacuccaggccuccguccaugacagucc

SEQ ID NO: 35927 - RNA, 44 nt, Mus musculus
aaagagaauccucugaggguuucgugcguuccaggggccgcugg

SEQ ID NO: 35928 - RNA, 45 nt, Mus musculus
cucccccguagauaagagcagcuccagcgcaggucaguuggaccc

SEQ ID NO: 35929 - RNA, 43 nt, Mus musculus
agucugaaagggaaggggaggcucccucacccuggggguaggg

SEQ ID NO: 35930 - RNA, 23 nt, Mus musculus
cuccagcggaagucccccagacg

SEQ ID NO: 35931 - RNA, 45 nt, Mus musculus
accacaugccaggccaccuccuucuuggcuaaaggggacagaccc

SEQ ID NO: 35932 - RNA, 46 nt, Mus musculus
guuuaacuuggcacucuggccucuguucccacccagcucucaagga

SEQ ID NO: 35933 - RNA, 46 nt, Mus musculus
uccucaacucuucgugggggacuggucugaccaguuugcagcagac

SEQ ID NO: 35934 - RNA, 41 nt, Mus musculus
ugagggaaggugcaugguaagggggccuccggucugcagug

SEQ ID NO: 35935 - RNA, 44 nt, Mus musculus
uuguacaaaauuguguuuagugugcauucugguuccuuggagau

SEQ ID NO: 35936 - RNA, 76 nt, Mus musculus
ugggguuggguggggagguuccugccgaggcagguccuggcggaagggugugugaaggcgcugguugcugcuguag

SEQ ID NO: 35937 - RNA, 50 nt, Mus musculus
ccugugcugcccgggugggauggucuauuggagcccaguucuggggguga

SEQ ID NO: 35938 - RNA, 45 nt, Mus musculus
cuccccacaugacuugaucugcgggugcaguguaagcacccucca

SEQ ID NO: 35939 - RNA, 42 nt, Mus musculus
uguggucucuucucucugcaauggccucauugcugcccaggu

SEQ ID NO: 35940 - RNA, 42 nt, Mus musculus
cgcucacgccucuggcuguagucacucugcuccaggccucca

SEQ ID NO: 35941 - RNA, 46 nt, Mus musculus
aguguguggauccuggggcuggaacguaggcaaucagacucagagg

SEQ ID NO: 35942 - RNA, 41 nt, Mus musculus
cugaccucgagaacucagagaacucagaaauccgccugccu

SEQ ID NO: 35943 - RNA, 42 nt, Mus musculus
uuuuuucagccaggcgugguggcacacgccuuuaaucccagc

SEQ ID NO: 35944 - RNA, 46 nt, Mus musculus
aguacaccguagcugacuucagacacaccaaaagagggcgucagau

SEQ ID NO: 35945 - RNA, 52 nt, Mus musculus
aaauaaauaaaucuuuaaaaaaaagaaguaaaugauagagauaguggaagaa

SEQ ID NO: 35946 - RNA, 42 nt, Mus musculus
gaaggcgguucugacgagggcggaaguguuuggggcccugca

SEQ ID NO: 35947 - RNA, 26 nt, Mus musculus
cagccuuucuucauccccuuuccucu

SEQ ID NO: 35948 - RNA, 45 nt, Mus musculus
uuaaagagggcaagaggcaaguccugggcucguucagcagggaag

SEQ ID NO: 35949 - RNA, 46 nt, Mus musculus
gccacaguuucucccaccacaaauggcacugcuacuaguccaagau

SEQ ID NO: 35950 - RNA, 45 nt, Mus musculus
guaugaggcucacacagugaguuugcagugacacaguuccuugua

SEQ ID NO: 35951 - RNA, 46 nt, Mus musculus
cuccauaggacacucaugguucuuauggaauauaucauuuguagau

SEQ ID NO: 35952 - RNA, 45 nt, Mus musculus
uuaaaucgggugguggcggcgcacgccuuuagucccagcacuugg

SEQ ID NO: 35953 - RNA, 46 nt, Mus musculus
cugccucccgaguacugugauuuaaggcguaaagcucagugcccag

SEQ ID NO: 35954 - RNA, 46 nt, Mus musculus
guugguuccuuccuuuugcucuguggguucucggaaucaaacccag

SEQ ID NO: 35955 - RNA, 57 nt, Mus musculus
aggcuuugcagcucugucuguuggaucaguagugcgacagcacaagucacagccccc

SEQ ID NO: 35956 - RNA, 42 nt, Mus musculus
gaagagcggguuacgcaagggagaaauaaaaaggaacuugag

SEQ ID NO: 35957 - RNA, 45 nt, Mus musculus
acucugacacuccuuccccccuagccucaggagaauuuggugcca

SEQ ID NO: 35958 - RNA, 27 nt, Mus musculus
gagagcaaggccccucagugaacuuga

SEQ ID NO: 35959 - RNA, 46 nt, Mus musculus
guguguguguguauacacacacauacaugguacagcuugcccagag

SEQ ID NO: 35960 - RNA, 46 nt, Mus musculus
cggggagugggggggaguggugugugugugugugugugugugugug

SEQ ID NO: 35961 - RNA, 45 nt, Mus musculus
guccuaaggucauggugucaaggugggggacagagauaggcagag

SEQ ID NO: 35962 - RNA, 42 nt, Mus musculus
cagcguugcccagcuccccaggcugaccacgaccagcaggag

SEQ ID NO: 35963 - RNA, 42 nt, Mus musculus
ggggccagcagggcggugcccggcuccccccggcgcccccuc

SEQ ID NO: 35964 - RNA, 46 nt, Mus musculus
guacuuacauauaaauaaauaaaucuuuaaaaaaaaaaaagauagu

SEQ ID NO: 35965 - RNA, 45 nt, Mus musculus
cuauccuggaauucacuuuguagaccaggcugcccuugaacucag

SEQ ID NO: 35966 - RNA, 41 nt, Mus musculus
ccuacccugggucccuuguacauaacuccuugugacaaaac

SEQ ID NO: 35967 - RNA, 46 nt, Mus musculus
agaguacaccccagcuucucccaaauacucaccuacaagcccuaaa

SEQ ID NO: 35968 - RNA, 46 nt, Mus musculus
accaagcuacucccccuccagcccacgauauacaccacagucucca

SEQ ID NO: 35969 - RNA, 45 nt, Mus musculus
ccucacccaguuacucaccuacaagucccaacuauacacccacca

SEQ ID NO: 35970 - RNA, 46 nt, Mus musculus
accagcccuaacuauucuccaacuagucccaacuauaccccgacau

SEQ ID NO: 35971 - RNA, 47 nt, Mus musculus
ccuacuccccaaccucuccaucuuacucuccaaccagucccaacuac

SEQ ID NO: 35972 - RNA, 45 nt, Mus musculus
uauggugccugguccccgaguguuggugaguagccucguccagga

SEQ ID NO: 35973 - RNA, 46 nt, Mus musculus
aaccgccaggacacuggaccgcucaugaaaugcuccuuugaggaaa

SEQ ID NO: 35974 - RNA, 56 nt, Mus musculus
caggaauggaucuuagagacggauggugugagccugaugcgggugcugagugagaa

SEQ ID NO: 35975 - RNA, 46 nt, Mus musculus
ccuucgaauccgcaucaugaacagugaugaaaacaagaugcaagag

SEQ ID NO: 35976 - RNA, 46 nt, Mus musculus
ggaggagaaagguuauuguagauuaagggggaguauagccaaaggc

SEQ ID NO: 35977 - RNA, 46 nt, Mus musculus
ccauauacagaaugagcuggaacgggaauuugaacggaugcgugaa

SEQ ID NO: 35978 - RNA, 46 nt, Mus musculus
ucucacacccacugaguucuucuuccaugccaugggaggacgagaa

SEQ ID NO: 35979 - RNA, 46 nt, Mus musculus
guuuguaaagaggaugguauguacauguuuuggugugaggaaagau

SEQ ID NO: 35980 - RNA, 104 nt, Mus musculus
cauugagaaggcucauaacaaugagcuagaacccacuccaggaaacacauugcgucagacauuugagaaucaagugaaucguauucucaaugaugcucgagaca

SEQ ID NO: 35981 - RNA, 68 nt, Mus musculus
uggggacuccauugcagauucaaagacuuaccaggacauucagaacacuauuaagaaagcuaaacaag

SEQ ID NO: 35982 - RNA, 61 nt, Mus musculus
uggagauggggcaugacaucacccgccucuucuacuccaacauucagacugucauuaacaa

SEQ ID NO: 35983 - RNA, 71 nt, Mus musculus
gcuuaucaugggcauccuuuguaagaagucccugggcaccucagcaggcucgcugguccauaucuccuacc

SEQ ID NO: 35984 - RNA, 47 nt, Mus musculus
auaccuggacacaucaauuguauccguacccacagcacccauccuga

SEQ ID NO: 35985 - RNA, 45 nt, Mus musculus
ggauguuugugauuccuacauuuuauuauucuuaguaaccugaug

SEQ ID NO: 35986 - RNA, 42 nt, Mus musculus
accugcuguggugaugcaggguucugcucgaaaccagguaag

SEQ ID NO: 35987 - RNA, 46 nt, Mus musculus
augaccugugcaagggcaaaaacaucugugaagguggagaggagau

SEQ ID NO: 35988 - RNA, 41 nt, Mus musculus
ccccaaacuugggggacuaauggauccacggcaggggguga

SEQ ID NO: 35989 - RNA, 46 nt, Mus musculus
auauaaggaccucaugugguuugauauaggcagaugaaagagagug

SEQ ID NO: 35990 - RNA, 44 nt, Mus musculus
caugcauuauugauagaagaauaaguugguuagcuuuuuggaga

SEQ ID NO: 35991 - RNA, 46 nt, Mus musculus
uauucguuaccccuuuucuucuuccucccucccaaaaccuccuccu

SEQ ID NO: 35992 - RNA, 83 nt, Mus musculus
gaccauuagccccaccaggccaaaaaggaaggccacaguugguagacaggaagggaaguguagagagcgguaaaucugcagcc

SEQ ID NO: 35993 - RNA, 46 nt, Mus musculus
uggcuggggugaccagcucuaucagaaccuguccagaccaagucag

SEQ ID NO: 35994 - RNA, 45 nt, Mus musculus
uaaugggagggggugcccagcacccuucucgaagcgcaggucaca

SEQ ID NO: 35995 - RNA, 42 nt, Mus musculus
ccucaggcaggacuucugugggagaccccgcccuagccacac

SEQ ID NO: 35996 - RNA, 45 nt, Mus musculus
cccucucaccagggcaugcucaggacccaacccaccgccccaccc

SEQ ID NO: 35997 - RNA, 45 nt, Mus musculus
gauuugaagaaagugggagacccacuccauuuagaguauagaaaa

SEQ ID NO: 35998 - RNA, 44 nt, Mus musculus
ccugcagacaaccaccuggugucugcacuaagaaggguugauuu

SEQ ID NO: 35999 - RNA, 59 nt, Mus musculus
gggaaauuuaaggggcaacuagaaaacagacagaaacggcggaugcuccuuuuuucggg

SEQ ID NO: 36000 - RNA, 47 nt, Mus musculus
ggaggacgagaaagcccuggcgcaggaagcucugaugcgcugugacu

SEQ ID NO: 36001 - RNA, 46 nt, Mus musculus
aagccgucggaggcuccaaaggcauggcccacauuaugcccgaccc

SEQ ID NO: 36002 - RNA, 47 nt, Mus musculus
cuguagauccgucacaugauuaugucccugaaccugagccacacaug

SEQ ID NO: 36003 - RNA, 41 nt, Mus musculus
uuggaggugggguuggaucagaaaucuggacuuccgccaag

SEQ ID NO: 36004 - RNA, 45 nt, Mus musculus
gccugcggcugcgccugucauuagagcgcuugcaaaaauaguggg

SEQ ID NO: 36005 - RNA, 46 nt, Mus musculus
uuuuuugcccuccguugggacaccagucuucgguguguggaaaugu

SEQ ID NO: 36006 - RNA, 45 nt, Mus musculus
cucaaagugggcaacuuuccggcuuccgcagugacacuagcagac

SEQ ID NO: 36007 - RNA, 64 nt, Mus musculus
aaaaaaaaaagaaagaaagaaaagagguucagugugggaggggaaagggaagcaacagagcugc

SEQ ID NO: 36008 - RNA, 73 nt, Mus musculus
uggguuuucacgggugccugacaagaaaagugaaauagauaaauaaaagaaagaaaagagccgggcgugguca

SEQ ID NO: 36009 - RNA, 41 nt, Mus musculus
agccagcauggaacuagagggggcagggcgguugggguguu

SEQ ID NO: 36010 - RNA, 63 nt, Mus musculus
ccgggauguucaacuggcccaguuuuaccggcccauccuugaggaacucaacgucacucggcc

SEQ ID NO: 36011 - RNA, 41 nt, Mus musculus
cuaggccauccauuuaaagcagucggccauccuccugagac

SEQ ID NO: 36012 - RNA, 44 nt, Mus musculus
ugugugugugugugugagagagagagagagagagaggugguagu

SEQ ID NO: 36013 - RNA, 85 nt, Mus musculus
cugccgugaguaaaagaaaaggccguggagcccccuggggagcgaagagaguagggcgacggccugaggagcuugggcggcuggg

SEQ ID NO: 36014 - RNA, 45 nt, Mus musculus
ccaggaucccccaguacaccagggaagguauugauggggagggua

SEQ ID NO: 36015 - RNA, 46 nt, Mus musculus
ccgaucugggagggggccuggaaggcagcuccgaugaggucuaggg

SEQ ID NO: 36016 - RNA, 38 nt, Mus musculus
guaaggaaggccuaaggcuguccugggcagccaggagc

SEQ ID NO: 36017 - RNA, 41 nt, Mus musculus
ucugugguauguguaaaagcagauucagauuuaguuuaauc

SEQ ID NO: 36018 - RNA, 70 nt, Mus musculus
gggguguguguguguguguguguguguguggagagggguguggagcaggagcauggaccaguugggugag

SEQ ID NO: 36019 - RNA, 45 nt, Mus musculus
uucaccaccagucugaaguguauggagggaaaagagguggcagac

SEQ ID NO: 36020 - RNA, 41 nt, Mus musculus
ugacuugggggugguggcugcagugggcugggugggacagc

SEQ ID NO: 36021 - RNA, 45 nt, Mus musculus
gacccgccuggaaaaggugaccacgucauggagaaaagaugcaga

SEQ ID NO: 36022 - RNA, 41 nt, Mus musculus
gggguuaaguggguagguucuagagauuugugggucacaug

SEQ ID NO: 36023 - RNA, 41 nt, Mus musculus
guccuccaguacggagacaacaaaaacucaaaggacacaga

SEQ ID NO: 36024 - RNA, 45 nt, Mus musculus
aagacuauggcuuuaugaaggcggaugagcccagaacccccuacc

SEQ ID NO: 36025 - RNA, 46 nt, Mus musculus
uuuuuuuuuuuuaaugguuuuagagcuuuauuguagaaaggcaggg

SEQ ID NO: 36026 - RNA, 45 nt, Mus musculus
uccuaaaaaacagcagcuccauuuugauaaagaaaccccccgguu

SEQ ID NO: 36027 - RNA, 42 nt, Mus musculus
uugcgcucccgcuccaucaugaugugccggugcagagcccug

SEQ ID NO: 36028 - RNA, 46 nt, Mus musculus
gguauauuuguucuugaaugauugggauuaacaguacugauccaca

SEQ ID NO: 36029 - RNA, 48 nt, Mus musculus
gccaaccuggcccccgacucccuuucauccaacacagccagaacccaa

SEQ ID NO: 36030 - RNA, 44 nt, Mus musculus
caguggugcuugggggugaaggacuauggagaacaggggaccag

SEQ ID NO: 36031 - RNA, 41 nt, Mus musculus
cacaagcaguacccaacucccuuucccccaucagggcugcg

SEQ ID NO: 36032 - RNA, 42 nt, Mus musculus
cguuugauguuggggacauccauauuaugaguugacgggcag

SEQ ID NO: 36033 - RNA, 44 nt, Mus musculus
acaaguggaauaggcugagaaaaugaagcaaaggaauguaaaag

SEQ ID NO: 36034 - RNA, 36 nt, Mus musculus
ucuuaaguaaaccaaagaacaguggacagucagcag

SEQ ID NO: 36035 - RNA, 45 nt, Mus musculus
auucguccauaaagucacuguuugaagaugaguguccugugcugg

SEQ ID NO: 36036 - RNA, 46 nt, Mus musculus
cacugguugggagggagccuuugguauuuuuguauguuuugaagaa

SEQ ID NO: 36037 - RNA, 47 nt, Mus musculus
cuucuuugagauuggcccuggccccauucccugguucauuguggcag

SEQ ID NO: 36038 - RNA, 45 nt, Mus musculus
uugcccagguaaaaagaccuggcuuuguggggagcuggaguagga

SEQ ID NO: 36039 - RNA, 45 nt, Mus musculus
gacccuauacccuauucauuuuuuucuuauugcagcgccugaguc

SEQ ID NO: 36040 - RNA, 42 nt, Mus musculus
uaccucuuugcuaggggggauguaaccagcauaggccaagac

SEQ ID NO: 36041 - RNA, 26 nt, Mus musculus
gcuggucgaggucuccgaagcacccc

SEQ ID NO: 36042 - RNA, 58 nt, Mus musculus
uccucuucagagucuguaucacugggaggagcccuaggagggccaggaggugggaguc

SEQ ID NO: 36043 - RNA, 42 nt, Mus musculus
aauuaaaaauacauccgguguaaaagaaaguaaacgggagag

SEQ ID NO: 36044 - RNA, 45 nt, Mus musculus
cguuuugcagcggcccgcgggcgccaaguacuuuuucaaguccau

SEQ ID NO: 36045 - RNA, 26 nt, Mus musculus
acggacaagguuauauuuggacacau

SEQ ID NO: 36046 - RNA, 46 nt, Mus musculus
cagagaccgaaucugucguaucacugaggcgagaccgaccuaggag

SEQ ID NO: 36047 - RNA, 45 nt, Mus musculus
caauucccagcagccacaugguggcucacaaccauuuguaaugag

SEQ ID NO: 36048 - RNA, 85 nt, Mus musculus
augccuccacccccacccccugucuccacagcagugcagcccccuggugccccuccagucagagaccugggcuccgugcccccag

SEQ ID NO: 36049 - RNA, 45 nt, Mus musculus
aauagacaguuccucuuuuauauggagaaucccuucuaaccccag

SEQ ID NO: 36050 - RNA, 46 nt, Mus musculus
gucagcucucauguugagggugggugguggucagugguacccuggg

SEQ ID NO: 36051 - RNA, 46 nt, Mus musculus
uuuagucacuuguacaaaacaccaaauaaagcaaauagaggccaac

SEQ ID NO: 36052 - RNA, 45 nt, Mus musculus
accaggccaccauucuccaccauggccuuggagaugcuucugaag

SEQ ID NO: 36053 - RNA, 42 nt, Mus musculus
agagccacaaacagucgaagaaugucauuugccccuucaaag

SEQ ID NO: 36054 - RNA, 42 nt, Mus musculus
ggaaccacaguuagguccacgguccuagugggcugcacacag

SEQ ID NO: 36055 - RNA, 46 nt, Mus musculus
aagggcagagcaguuaggcuggagaugggucuuaaaaggugugcag

SEQ ID NO: 36056 - RNA, 48 nt, Mus musculus
uguggaugucugugagugugagcaugugagcaaauguguguuagagug

SEQ ID NO: 36057 - RNA, 41 nt, Mus musculus
acagggaccgcaggccagugacauuggguuucagggcguug

SEQ ID NO: 36058 - RNA, 47 nt, Mus musculus
gggcaaggauagagagaaguaaucugggcagugcuggggcagugagg

SEQ ID NO: 36059 - RNA, 46 nt, Mus musculus
gugugacaggaaguggugauugaugggcaguggggaguggucagag

SEQ ID NO: 36060 - RNA, 41 nt, Mus musculus
uagcaugugggaugaggugacagacucucauagauacccag

SEQ ID NO: 36061 - RNA, 42 nt, Mus musculus
gagaacgcccaccugcuggucaucaacuccagggaggagcag

SEQ ID NO: 36062 - RNA, 45 nt, Mus musculus
aucagccugguguaugcugcuuaguuggucguccaguguucgaga

SEQ ID NO: 36063 - RNA, 46 nt, Mus musculus
gguuagcuucuugaguucuuuauauauuuuggauauuagcuuucug

SEQ ID NO: 36064 - RNA, 36 nt, Mus musculus
cugccagcaggugaaccgcuggguaugcgaaaagag

SEQ ID NO: 36065 - RNA, 41 nt, Mus musculus
ccugaccuucacuccgaccauggccugccuuucccguuacu

SEQ ID NO: 36066 - RNA, 42 nt, Mus musculus
gccugccacccucggagaaaagagggaauuuggggaccagaa

SEQ ID NO: 36067 - RNA, 49 nt, Mus musculus
guuugggguacuccguuccuucggugucuucuucguggaauuuguggcg

SEQ ID NO: 36068 - RNA, 42 nt, Mus musculus
gcugagccccccgacgggggcuggggauggaugguggugcuc

SEQ ID NO: 36069 - RNA, 46 nt, Mus musculus
ugcaggguaggugggagggccaaagugagcgauuuaaagcccagau

SEQ ID NO: 36070 - RNA, 41 nt, Mus musculus
gagcucuagcaaauaacuccuaccucuucacaccccgggcu

SEQ ID NO: 36071 - RNA, 42 nt, Mus musculus
cacugccccagcuguccucgcagcugccaccuauuugcagau

SEQ ID NO: 36072 - RNA, 42 nt, Mus musculus
ucuccaguggcuucuucuauucaauuuuccggggccgagcgg

SEQ ID NO: 36073 - RNA, 46 nt, Mus musculus
uugggucuagcgauaggagucgcguagaugggugugggcugcagau

SEQ ID NO: 36074 - RNA, 42 nt, Mus musculus
aggagcagagaccgaaagaggagagagaccccgccccccucg

SEQ ID NO: 36075 - RNA, 45 nt, Mus musculus
guguaugaagacuccggcaucccccuuccagcugagucacccaag

SEQ ID NO: 36076 - RNA, 42 nt, Mus musculus
augacacccuaaucugcucucucucaucuucagggcucagau

SEQ ID NO: 36077 - RNA, 46 nt, Mus musculus
aggaaagaugcugagcugggaguucugagagagaacaaugggucag

SEQ ID NO: 36078 - RNA, 23 nt, Mus musculus
gcgcugggcggggggcgggcgga

SEQ ID NO: 36079 - RNA, 28 nt, Mus musculus
cauggccccgcgcaccuccucacggaga

SEQ ID NO: 36080 - RNA, 42 nt, Mus musculus
gggacggagucugcggagucuuuaaauagagaagggggcugg

SEQ ID NO: 36081 - RNA, 65 nt, Mus musculus
gcgcuagagcgcgguccgccucucccuccccagcccccuucucuauuuaaagacuccgcagacuc

SEQ ID NO: 36082 - RNA, 67 nt, Mus musculus
gcaagucagcuacaacuguuucaucgccgcgggccucuaccuccuccucggaggcuucuccuucugc

SEQ ID NO: 36083 - RNA, 42 nt, Mus musculus
aauucuaucaugguaaccauuuuacagagguagaccaaggag

SEQ ID NO: 36084 - RNA, 42 nt, Mus musculus
auucugcuguguuaauugaggacguucccuucacagagaaag

SEQ ID NO: 36085 - RNA, 42 nt, Mus musculus
cccuuucuaguucaucucuggcgcaaguguugggccaacauu

SEQ ID NO: 36086 - RNA, 74 nt, Mus musculus
agggugcuggggcaggacccugggaaugggagccagcucgggcaaauuugcggacuccccaagguaaacaagag

SEQ ID NO: 36087 - RNA, 46 nt, Mus musculus
gagcaaguaccgagagcagauguucagacugcucauggccagcaag

SEQ ID NO: 36088 - RNA, 42 nt, Mus musculus
aagauauugaaauugacgagcaacaggguugcaaggaacagg

SEQ ID NO: 36089 - RNA, 42 nt, Mus musculus
cuagaucccagucacagucagaaaggagacgcugagccacag

SEQ ID NO: 36090 - RNA, 45 nt, Mus musculus
ugcacccccucugauguccccacuguugucuucagggacccgagg

SEQ ID NO: 36091 - RNA, 77 nt, Mus musculus
gaauauuuugaagaggaagaagaggaagaagaguuugaggaggaauuugaggaggaagaaggugaauuagaagagga

SEQ ID NO: 36092 - RNA, 71 nt, Mus musculus
aagaggaagaggaggaagaagaugaagaugaggaagaagaagacuuugaggaagaggaagaagaugaagaa

SEQ ID NO: 36093 - RNA, 45 nt, Mus musculus
cugcggcuccugccggcccaccaacagccucaccuccugugccag

SEQ ID NO: 36094 - RNA, 42 nt, Mus musculus
cuccagcaacagccaaccauuuaggccucucugucccaggcc

SEQ ID NO: 36095 - RNA, 48 nt, Mus musculus
caccuuccccucggugcccuccuccucuugccugugcccugaaagcuu

SEQ ID NO: 36096 - RNA, 46 nt, Mus musculus
cuuccugucugccuuugacacaccauucucuucucaggccucaguc

SEQ ID NO: 36097 - RNA, 46 nt, Mus musculus
acuugugggugggaauccagggauccaugccagugggguucaugug

SEQ ID NO: 36098 - RNA, 42 nt, Mus musculus
uaugggggaagcuuuggcuccacccagccaaaggaaaggaga

SEQ ID NO: 36099 - RNA, 46 nt, Mus musculus
cuagcuccaggccaggagaggccuuacaggugauuguccacgaggg

SEQ ID NO: 36100 - RNA, 46 nt, Mus musculus
cuguguccguuccugugcaggaaauccuggaccucaucugccggau

SEQ ID NO: 36101 - RNA, 27 nt, Mus musculus
uacaaagggaaaaggagggaugggaga

SEQ ID NO: 36102 - RNA, 42 nt, Mus musculus
gcacacagagaacugggaacaggagcugcacagccugcugac

SEQ ID NO: 36103 - RNA, 42 nt, Mus musculus
agcugcugagagggaguggucucacucgaaaagucgucaguc

SEQ ID NO: 36104 - RNA, 46 nt, Mus musculus
cuuuauggcuucucuuuagccugccugaauugacaucacuugagau

SEQ ID NO: 36105 - RNA, 46 nt, Mus musculus
caggaagaacgugcuacagaggcucauuaccuccucaccccaauuu

SEQ ID NO: 36106 - RNA, 60 nt, Mus musculus
cuuugcucccucuuuuuaaugacccccacugagcuacccucaggccccaccccucagccc

SEQ ID NO: 36107 - RNA, 38 nt, Mus musculus
gccuucauaaacaaacaaacaaacaaacaaacaaacaa

SEQ ID NO: 36108 - RNA, 46 nt, Mus musculus
gaaguugggauuugcaaguucauuggagaaagcuagcuaaaaagaa

SEQ ID NO: 36109 - RNA, 79 nt, Mus musculus
ugagaagagaagaaaggauaguauuaagcccagugaaggggucaguuauggacaggaggagggguuuguaagccaggaa

SEQ ID NO: 36110 - RNA, 45 nt, Mus musculus
caagcuagacuggauugggagcagagggauggacaugguuaacag

SEQ ID NO: 36111 - RNA, 41 nt, Mus musculus
ugggguuggauggacuccagggagaguacagaaggaacgag

SEQ ID NO: 36112 - RNA, 46 nt, Mus musculus
cuagggaauugauuaccagugcuuagccagcagugaggaugggggu

SEQ ID NO: 36113 - RNA, 56 nt, Mus musculus
guucuggguaaagaaccggaauggagaggccugaagcagagggaccagauaggugg

SEQ ID NO: 36114 - RNA, 46 nt, Mus musculus
uaaaguauucuaagaguguaaaagccccacaggggaggaagcugau

SEQ ID NO: 36115 - RNA, 46 nt, Mus musculus
ugauguaaccaacuguggagugacaccuguuacaguaaauagagac

SEQ ID NO: 36116 - RNA, 46 nt, Mus musculus
guuugcccuuucacucucagcuucaccuggcuuccuuacccaagga

SEQ ID NO: 36117 - RNA, 41 nt, Mus musculus
gucuacagagugaguuccaggacagccaggggcagugugug

SEQ ID NO: 36118 - RNA, 46 nt, Mus musculus
ccuuacaccuguggggcaugagggaggaggccagcaagauagaauu

SEQ ID NO: 36119 - RNA, 48 nt, Mus musculus
uaaggaaggucugcugaggugagcaagcuuuauuguugaaaucuagua

SEQ ID NO: 36120 - RNA, 48 nt, Mus musculus
uggguuauguguaaaggggcugacgaaggaacuugcuucugugugagg

SEQ ID NO: 36121 - RNA, 45 nt, Mus musculus
cgaacucauagagaucuuccugucuuugcuucuggauacugagau

SEQ ID NO: 36122 - RNA, 42 nt, Mus musculus
ugcuucuccuggaguagccgacuacauguguacuggacagau

SEQ ID NO: 36123 - RNA, 45 nt, Mus musculus
ucuggccguugaacgugcguuuuauuauccuuuguguguagagau

SEQ ID NO: 36124 - RNA, 46 nt, Mus musculus
guuagguagugaaagaaaauuagaagggguaguugaaacguuagag

SEQ ID NO: 36125 - RNA, 45 nt, Mus musculus
accgguguagagagaguauuuagagauuucuccaaaagaccugga

SEQ ID NO: 36126 - RNA, 42 nt, Mus musculus
ggcaccguggucccgccuuccugaagcugacacuggagcugu

SEQ ID NO: 36127 - RNA, 41 nt, Mus musculus
ggggcccaaucuaguucuaaaagcuugaggaggggcgggga

SEQ ID NO: 36128 - RNA, 46 nt, Mus musculus
ggggaggagagccuggguaguuccugggguagcuaguggccauuau

SEQ ID NO: 36129 - RNA, 33 nt, Mus musculus
uuuucuuaaggcuauugccuuacuuggguagag

SEQ ID NO: 36130 - RNA, 46 nt, Mus musculus
ggagccccuuaaugucaacguccaugucaccaacaauucugccaag

SEQ ID NO: 36131 - RNA, 46 nt, Mus musculus
cagagaugucuccguggagcuacccuucguccuaaugcaccccaag

SEQ ID NO: 36132 - RNA, 42 nt, Mus musculus
ccaaccucaucgaauucgauaccaaguaagaaacacccccug

SEQ ID NO: 36133 - RNA, 108 nt, Mus musculus
acacaccuaaaguuuugggaagggaacagugaacgcaaggagugaauguagagaaaagguguagaaagaacgcccauguuuggccucacaccaacucgcccccaguca

SEQ ID NO: 36134 - RNA, 42 nt, Mus musculus
gaucauccgaacucaguucuccagcaucugcucacagguucu

SEQ ID NO: 36135 - RNA, 32 nt, Mus musculus
cucgagggaacucacagaaaaacacccacguc

SEQ ID NO: 36136 - RNA, 44 nt, Mus musculus
uccugguuauucuugacaucugaaggggggagggaacagagagg

SEQ ID NO: 36137 - RNA, 44 nt, Mus musculus
guggagacuucccgguuuucccagucuggggugagagccuccgg

SEQ ID NO: 36138 - RNA, 46 nt, Mus musculus
ucagucacucgauuggcgauguaggaccugcaggauggcggaaaca

SEQ ID NO: 36139 - RNA, 32 nt, Mus musculus
uggguaucagcggcugagccugagcggcagca

SEQ ID NO: 36140 - RNA, 46 nt, Mus musculus
uggguggagaagguggucgccuugaucaacugcaguucgaugugag

SEQ ID NO: 36141 - RNA, 42 nt, Mus musculus
aggggcuuaauugcuugcguaucuucauccugggaggagaac

SEQ ID NO: 36142 - RNA, 42 nt, Mus musculus
aacaaacugcggguauauuaccuguccuggcuucggaacaag

SEQ ID NO: 36143 - RNA, 45 nt, Mus musculus
gggcuggggcuccccacauggacccagcucucuucccacagccag

SEQ ID NO: 36144 - RNA, 46 nt, Mus musculus
ucccuugcuugcaucuguauauagugugagcagcaaguagcccuuc

SEQ ID NO: 36145 - RNA, 46 nt, Mus musculus
guggccuuggauauauccccuuuguuaauaaagacaauucaaccag

SEQ ID NO: 36146 - RNA, 41 nt, Mus musculus
guggguaagggagaucaggaacuugguugaaguaaccccca

SEQ ID NO: 36147 - RNA, 42 nt, Mus musculus
cacuuccacagcuccaccgaggugaggguauuagaauggcag

SEQ ID NO: 36148 - RNA, 42 nt, Mus musculus
gcaaggguagugaguggaaugaucacauggaaagggccauag

SEQ ID NO: 36149 - RNA, 45 nt, Mus musculus
gacccgugcaaaccucguccacacagguacaaccacgcccccugg

SEQ ID NO: 36150 - RNA, 42 nt, Mus musculus
gcuuaggccauccaggacaccaggagacagugagcccaacuu

SEQ ID NO: 36151 - RNA, 44 nt, Mus musculus
augguaguagugggcacugggguggugcugugcucugggguagu

SEQ ID NO: 36152 - RNA, 42 nt, Mus musculus
ggcaguagugggcacugggguggugcugugcucugggguagu

SEQ ID NO: 36153 - RNA, 46 nt, Mus musculus
aauugucucaauugggguagacucuggaguggucagggugguagug

SEQ ID NO: 36154 - RNA, 41 nt, Mus musculus
auaggagccagaggagaccaaggacauagaagcccaggggg

SEQ ID NO: 36155 - RNA, 26 nt, Mus musculus
caggaaaaggcuagaccggaaaguag

SEQ ID NO: 36156 - RNA, 71 nt, Mus musculus
uuccgggcugccuggucuugcuucuuggugagaaaggugccccuggugggaaagaagaguccccacuuuaa

SEQ ID NO: 36157 - RNA, 42 nt, Mus musculus
uucuuauagagugcaaacugcagggaaggagaggggggacag

SEQ ID NO: 36158 - RNA, 46 nt, Mus musculus
gugcugaguccucagaaacccaccauuacucucagugccuaccagc

SEQ ID NO: 36159 - RNA, 45 nt, Mus musculus
auaaacaagcaacacauaauuaauugugagcacugaguggagcag

SEQ ID NO: 36160 - RNA, 46 nt, Mus musculus
aguguggggcugacuuggauucacaaacugcacaaauuucuuggau

SEQ ID NO: 36161 - RNA, 46 nt, Mus musculus
aucuggagaggacgaucccuuugccucugacuuuuccugcccaauu

SEQ ID NO: 36162 - RNA, 46 nt, Mus musculus
ugggaagcuguugggcccacugccuaugcauccugcagcugaagau

SEQ ID NO: 36163 - RNA, 46 nt, Mus musculus
uucagguaaaaaacaacaaauauugaaguugccgugcagguaaaaa

SEQ ID NO: 36164 - RNA, 46 nt, Mus musculus
augugguggcguauccacuguacauccuguaugagaauggggagac

SEQ ID NO: 36165 - RNA, 46 nt, Mus musculus
ucaaccauuucuaugcccacagauccccagauaaugacacggaggc

SEQ ID NO: 36166 - RNA, 69 nt, Mus musculus
gagccccagacacccacuaaggugauuguacuuucagaagcagaagaggaaaguuuaauacucaauaaa

SEQ ID NO: 36167 - RNA, 46 nt, Mus musculus
aagaaauauuuaugugacuuuuggguuguuuuuguuuaugugagac

SEQ ID NO: 36168 - RNA, 46 nt, Mus musculus
auuugcaugugccuaaagagaccacggugaauauauuuauuuagau

SEQ ID NO: 36169 - RNA, 46 nt, Mus musculus
accccuugauaaucuauuauuuuagcaucuuuuguauaugcuagaa

SEQ ID NO: 36170 - RNA, 46 nt, Mus musculus
aagagcaguuauuuguuuguagccaucaucucuccagcccccuuuc

SEQ ID NO: 36171 - RNA, 46 nt, Mus musculus
caucaagucuuguugaguccaacccaacaucauguagcacuuaucg

SEQ ID NO: 36172 - RNA, 42 nt, Mus musculus
ccuuaacgcuacccccucacuggcccagcagcagccccaaag

SEQ ID NO: 36173 - RNA, 45 nt, Mus musculus
cugaacagggagauaagcugcuucuuagaaggaacuacuugaguu

SEQ ID NO: 36174 - RNA, 45 nt, Mus musculus
ucuucuuacauccaggcuuuccagacacacgcauaaugcacagac

SEQ ID NO: 36175 - RNA, 42 nt, Mus musculus
guucaucagaagacugggcuucucuucuguuccaccggugac

SEQ ID NO: 36176 - RNA, 42 nt, Mus musculus
gggcuucgauaguacugggauuacagacaagugccaccacac

SEQ ID NO: 36177 - RNA, 48 nt, Mus musculus
uacaaauuuauuauuuguagauuuuuguauaacaugaugauggacaau

SEQ ID NO: 36178 - RNA, 45 nt, Mus musculus
ggauuuccuugcggaccgagggguggauaacacuuuugcggauga

SEQ ID NO: 36179 - RNA, 70 nt, Mus musculus
gugguugaaguuaccaagacugauggcaagaagacccuuguacuggacugucacuauccugaggaugagg

SEQ ID NO: 36180 - RNA, 46 nt, Mus musculus
gcgccaccacuggccggccuuacauauuuuuaacauuugaccaguu

SEQ ID NO: 36181 - RNA, 46 nt, Mus musculus
acccugucuugaaaagccaaaaaagaaagaaaguucaaggccaggc

SEQ ID NO: 36182 - RNA, 41 nt, Mus musculus
gccgggcgugguggcgcacgccuuuaaucccagccaggcag

SEQ ID NO: 36183 - RNA, 45 nt, Mus musculus
uggcuuguguuuguaguaguuaaaaaugcaagguauguaacuuuu

SEQ ID NO: 36184 - RNA, 70 nt, Mus musculus
ugaauacagacuucugggcuugguuauuaaggaggccugaagcagcuccaggguguguagaggggagucu

SEQ ID NO: 36185 - RNA, 44 nt, Mus musculus
agaugucuggagauugggagcuggaggugaacggcacggaggcu

SEQ ID NO: 36186 - RNA, 45 nt, Mus musculus
cuuuucaaguuggcaaacucuccaaccugaagacuccagccugga

SEQ ID NO: 36187 - RNA, 42 nt, Mus musculus
ggccaaacugccuucaaggcacuucgaagacagugggcaguu

SEQ ID NO: 36188 - RNA, 47 nt, Mus musculus
ggcugcgaguccuaggccagccugggcuaggccuuguaucuaaguga

SEQ ID NO: 36189 - RNA, 46 nt, Mus musculus
uccugaaacucgcucuauagaccacacuggccucaaacccagagau

SEQ ID NO: 36190 - RNA, 47 nt, Mus musculus
gcuuucaggaaaccagcagguuuccuggaacuaggaagccaacuuuu

SEQ ID NO: 36191 - RNA, 50 nt, Mus musculus
gucuaccuguguguauuuuagauagaaaauuaaaaaauugacucccacag

SEQ ID NO: 36192 - RNA, 109 nt, Mus musculus
uguuucuccccccuucuuacucccucucccguggaucccagagccucaugcaugcuaugcaaaacacuuugccacugagccaauccccagcccucacuucuacuuuaau

SEQ ID NO: 36193 - RNA, 29 nt, Mus musculus
cggagucggauaagacuuacacguucaga

SEQ ID NO: 36194 - RNA, 42 nt, Mus musculus
gaugucgaccuguuuucucaguacuucaauagagccccuguc

SEQ ID NO: 36195 - RNA, 42 nt, Mus musculus
ucacacagaugugcucuuuggaguggugaagacugcacagaa

SEQ ID NO: 36196 - RNA, 46 nt, Mus musculus
aaggacagugcuuuuaccccguguuccauagugcuuacccuagauu

SEQ ID NO: 36197 - RNA, 46 nt, Mus musculus
acuauagguaucuagaaugagucuuggagcuauguuggagucagau

SEQ ID NO: 36198 - RNA, 42 nt, Mus musculus
ucuugguacuaucagcuuugcuuucauagguauuggcaaguu

SEQ ID NO: 36199 - RNA, 42 nt, Mus musculus
auaccaugaagcuucaaguuuagaccacaggaggagggagaa

SEQ ID NO: 36200 - RNA, 46 nt, Mus musculus
ccagggguuccucacuaugcugguacuaaaaguauaaccucuugga

SEQ ID NO: 36201 - RNA, 75 nt, Mus musculus
ccuuguugcaaaagcguggacaguuuugacagcuugacagauuuuuaacuccagaagcacuuuacgggaugguac

SEQ ID NO: 36202 - RNA, 45 nt, Mus musculus
uguuugcuuguuuugggggguuuuuuuuguuuuguuuuucgagac

SEQ ID NO: 36203 - RNA, 57 nt, Mus musculus
gacaagcugauagcguucugaucagcgaagggggugcuggagagaugcagggaaaca

SEQ ID NO: 36204 - RNA, 79 nt, Mus musculus
gagaggagcuugcagguuugugaaagcugcugucuaaguagagagacgugaacagcagcaugagcagcacaguccagag

SEQ ID NO: 36205 - RNA, 45 nt, Mus musculus
uucccagcaaccacaugguggcucacaaccaucugugaucugaug

SEQ ID NO: 36206 - RNA, 46 nt, Mus musculus
auaacaucagcaccagcuggcacaguagugaagcagcgugaaagau

SEQ ID NO: 36207 - RNA, 45 nt, Mus musculus
gccucugcgaacgaacgccaaggcgggcuggaucgcacuccugau

SEQ ID NO: 36208 - RNA, 43 nt, Mus musculus
gcaugccgggaacucuaggucuccguacccaggccggccagac

SEQ ID NO: 36209 - RNA, 42 nt, Mus musculus
uguacauaccaguacgcacucuagcacgagauucccagaccc

SEQ ID NO: 36210 - RNA, 23 nt, Mus musculus
cagucaguaggucaucugaaaau

SEQ ID NO: 36211 - RNA, 41 nt, Mus musculus
ugacucuuccaagaucacucaggaaaggggagguguaugua

SEQ ID NO: 36212 - RNA, 45 nt, Mus musculus
caauuaaguguuaugagcagaccugucauugaaguauguuagacu

SEQ ID NO: 36213 - RNA, 55 nt, Mus musculus
uggcaccaaguggcugauggagacacaggugaaagugagaaggaagcgaggagcc

SEQ ID NO: 36214 - RNA, 25 nt, Mus musculus
uggggguugcugcgccacagcagug

SEQ ID NO: 36215 - RNA, 46 nt, Mus musculus
auaccguaucuccagacauggacuauauuauuaaaaagcuggguaa

SEQ ID NO: 36216 - RNA, 45 nt, Mus musculus
cccaaauaaugacuucagacaaaaacugaaaauaaccgcagugcc

SEQ ID NO: 36217 - RNA, 42 nt, Mus musculus
caguaguucuuuccuggugguggugguggcagggcuaggggu

SEQ ID NO: 36218 - RNA, 45 nt, Mus musculus
auagauuaucuuauguuagaccacaugggaaccauagagagaggc

SEQ ID NO: 36219 - RNA, 42 nt, Mus musculus
guuagcuagggcuguuggcacagggguucaggagccugaguc

SEQ ID NO: 36220 - RNA, 44 nt, Mus musculus
caucagaaaauaggugugagggcacugugccugggagaggggga

SEQ ID NO: 36221 - RNA, 44 nt, Mus musculus
ggccacauuucuuuugcuucaggauaaagugggggugggggaga

SEQ ID NO: 36222 - RNA, 47 nt, Mus musculus
aagggagagggagauggagaaagggaaaagggggaggaggaagagag

SEQ ID NO: 36223 - RNA, 46 nt, Mus musculus
aguuggacaagacagccgagauaaccugaaaggcuucccccuggau

SEQ ID NO: 36224 - RNA, 45 nt, Mus musculus
auuuagaaugggcaagggaaguaaaauucggcacugacaacaguu

SEQ ID NO: 36225 - RNA, 45 nt, Mus musculus
guuguuuacuugguuagugccaagucacagaacugaggggcggag

SEQ ID NO: 36226 - RNA, 46 nt, Mus musculus
agcacuuuguuacacggugcugcuaguuucugaaccacccccucug

SEQ ID NO: 36227 - RNA, 92 nt, Mus musculus
gaagcuggaaagcuagugggaacugggaagcuagugggaucugggaagcuagugggaucugggaagcuagugggaacugggaagcuaguggg

SEQ ID NO: 36228 - RNA, 46 nt, Mus musculus
gagaacuauugggaagaaaagagguucauaggaguagguuggggca

SEQ ID NO: 36229 - RNA, 46 nt, Mus musculus
caccaguacuuggggauagauguccagaaccaaaggaacuguugau

SEQ ID NO: 36230 - RNA, 46 nt, Mus musculus
uagcuuccaguccaauugauaaagaucagcagggaaugguccagug

SEQ ID NO: 36231 - RNA, 45 nt, Mus musculus
cuucggugcccccuacccuuagacgccaccuuugcccagcgagau

SEQ ID NO: 36232 - RNA, 44 nt, Mus musculus
aaugggaugucuucaaaagacugcaacagcuaccaggcaagacc

SEQ ID NO: 36233 - RNA, 46 nt, Mus musculus
agggcuagcacuccaaaaagguuugcaaagagacuaggucucauca

SEQ ID NO: 36234 - RNA, 42 nt, Mus musculus
uccuggaacauggacucugggaccuggagugggggcacaggu

SEQ ID NO: 36235 - RNA, 55 nt, Mus musculus
accgagcccaugagugacucgagcuuugucggcacccucugcuuagccaggagga

SEQ ID NO: 36236 - RNA, 45 nt, Mus musculus
ccuucuuccagaacaguucgaaucugcucuccuugagcgccaggc

SEQ ID NO: 36237 - RNA, 57 nt, Mus musculus
gcaucaccaacugcaacugcuccucugacagaagcggcagagacgcacccaguaggc

SEQ ID NO: 36238 - RNA, 46 nt, Mus musculus
caucauagucaacugccgcuuagggucauccuggcaccccucuagg

SEQ ID NO: 36239 - RNA, 42 nt, Mus musculus
uguaagugaccucagaaacaggguaccccuuugccccgggau

SEQ ID NO: 36240 - RNA, 78 nt, Mus musculus
ugcucaaccacagcuucauccuucuccagaugcaaaugauccacaaggcugaccaggcgguggaugauccacuuccgg

SEQ ID NO: 36241 - RNA, 46 nt, Mus musculus
uccucauuaucugagucuucguccuaugggugggaagagguaagac

SEQ ID NO: 36242 - RNA, 45 nt, Mus musculus
gcugagggagagucuugagcagggcugacccuggcucaccucuga

SEQ ID NO: 36243 - RNA, 27 nt, Mus musculus
ccucgugauugacuguccucaacagag

SEQ ID NO: 36244 - RNA, 45 nt, Mus musculus
ugcucugaagcacgcccaagggagcagugagguccacagacagcu

SEQ ID NO: 36245 - RNA, 47 nt, Mus musculus
cauccugcugugacgcagcauucuuuucugguguggugcccucagau

SEQ ID NO: 36246 - RNA, 45 nt, Mus musculus
ccuauuuaaauguuuugguggcucuccaguggaacaaccugggga

SEQ ID NO: 36247 - RNA, 42 nt, Mus musculus
accgguggggccgacgggcgggcagaggagggaagcgggcga

SEQ ID NO: 36248 - RNA, 47 nt, Mus musculus
aggaugacggagcugcagucggcgcugcuacugcgaagacagcuggc

SEQ ID NO: 36249 - RNA, 45 nt, Mus musculus
ggacaaguauuaaaauucuaggugggacagcaauuugaaguggau

SEQ ID NO: 36250 - RNA, 46 nt, Mus musculus
ucugaugcccucuucuggacugucugaagacagcuacaguguacuu

SEQ ID NO: 36251 - RNA, 45 nt, Mus musculus
uucuuggcuaccugucuuaaguagauuguuauguuguacguguca

SEQ ID NO: 36252 - RNA, 45 nt, Mus musculus
gaugguugugagccaccauaugguugcugggauuugaacucuuug

SEQ ID NO: 36253 - RNA, 45 nt, Mus musculus
gugaacuuucuuaauguugaggacuaaaacaguuuuuaagcagua

SEQ ID NO: 36254 - RNA, 46 nt, Mus musculus
uuuguuauuaagaauagcuuacaagaaguucaagauaacugcacag

SEQ ID NO: 36255 - RNA, 46 nt, Mus musculus
ugaggugguaaaaaucuuccugagggacaagaucauccugccagag

SEQ ID NO: 36256 - RNA, 46 nt, Mus musculus
acacuuuucuggcuggcugugaagugagcuucuuggucagaagcaa

SEQ ID NO: 36257 - RNA, 62 nt, Mus musculus
uugucaguuuuauaugccagaaggcaaaucaaaaaccagaauacaucguauuucacaaagga

SEQ ID NO: 36258 - RNA, 68 nt, Mus musculus
guagugggagcaagguacaaccucagaacaccuaggauuguagagaucaugaagagaaguugaggcuu

SEQ ID NO: 36259 - RNA, 46 nt, Mus musculus
uggacaugccaacauuuuggagaugccuauacugugagaugaccag

SEQ ID NO: 36260 - RNA, 46 nt, Mus musculus
gugucaccuugucccacucagcuaucucuguacucacauacuggga

SEQ ID NO: 36261 - RNA, 53 nt, Mus musculus
cauccaucaaucagaguuuuuguaacagccuugcugcccuagaacucacucug

SEQ ID NO: 36262 - RNA, 46 nt, Mus musculus
gagugcugggauuaaaggcagaugccaucaccucacaagccugugg

SEQ ID NO: 36263 - RNA, 45 nt, Mus musculus
uacuuugggauaaagucuguguugagaguuuuccagggauugaag

SEQ ID NO: 36264 - RNA, 46 nt, Mus musculus
cuauuuuuugucaguauauuauauagacuccuuucugaaggcuuag

SEQ ID NO: 36265 - RNA, 46 nt, Mus musculus
aucauaaaugcuucaaccucucuucuaacccaccaacuagagguag

SEQ ID NO: 36266 - RNA, 46 nt, Mus musculus
cguaacaagaucugacucccucuucuggugugucugaagacagugu

SEQ ID NO: 36267 - RNA, 42 nt, Mus musculus
ccuuucagcaaaaucuugcucuaguauaugcaauggugucag

SEQ ID NO: 36268 - RNA, 45 nt, Mus musculus
agaccuuguuguggugugucucagcccuugcacacaccucuacuc

SEQ ID NO: 36269 - RNA, 45 nt, Mus musculus
gaggcagggagcaaguaaucagcccacagggagugaacauaguaa

SEQ ID NO: 36270 - RNA, 46 nt, Mus musculus
gcuuuaaaaaaaaaagauauugcuauauauaauaaguuuuacuuag

SEQ ID NO: 36271 - RNA, 46 nt, Mus musculus
aaauuaauagaaugauguauuaggguaaugucuuaccagccugaag

SEQ ID NO: 36272 - RNA, 45 nt, Mus musculus
gaagacagcaacagugugugugugugugugugugugugugugugu

SEQ ID NO: 36273 - RNA, 42 nt, Mus musculus
aaacaucuuaagauguuuuagaaucaaguuauuugagggcuu

SEQ ID NO: 36274 - RNA, 46 nt, Mus musculus
cugccacacccagguuuuacauugagugcugggauucugaacuaag

SEQ ID NO: 36275 - RNA, 45 nt, Mus musculus
gaacagcauaaaauucuugcuagcauaagagagauaauaagccag

SEQ ID NO: 36276 - RNA, 45 nt, Mus musculus
aauuaaccuugguuggucuguaagucaaacgaagaaaguuucaca

SEQ ID NO: 36277 - RNA, 45 nt, Mus musculus
augaauguuacuuugaaggaggcaguuucagugaagugggccaaa

SEQ ID NO: 36278 - RNA, 45 nt, Mus musculus
uuguagaauuguuagcauauuuaauacugagauugaauuuagugg

SEQ ID NO: 36279 - RNA, 46 nt, Mus musculus
caucugaagcaacaagaaagaugguggugugguuaguauaugagag

SEQ ID NO: 36280 - RNA, 45 nt, Mus musculus
gaguuucuauuggguuaugggaaagcagugacaggugugagguag

SEQ ID NO: 36281 - RNA, 42 nt, Mus musculus
ggcuugggacuuguuuuguuagaccaagauggccccaaagag

SEQ ID NO: 36282 - RNA, 45 nt, Mus musculus
ggucuguguguaugugagcuuuuguguaccaugggcacaugugua

SEQ ID NO: 36283 - RNA, 46 nt, Mus musculus
uuuuccuuucuguuaggagaaaggaauucuggucaaguuaugguag

SEQ ID NO: 36284 - RNA, 45 nt, Mus musculus
guucugcccagaagauuuagccuuccuccuucgccucagccccuc

SEQ ID NO: 36285 - RNA, 23 nt, Mus musculus
ccuggccgcaguuuagcugguuu

SEQ ID NO: 36286 - RNA, 44 nt, Mus musculus
uguaggaggaaacuguaaggcaacaugaaaacgucaggagucca

SEQ ID NO: 36287 - RNA, 44 nt, Mus musculus
auuuugacuaugguuccaggaagaguauaaugucaagguuguug

SEQ ID NO: 36288 - RNA, 45 nt, Mus musculus
ccacucaccuaauugcucaugguuuuaaagacuauaguucuuuau

SEQ ID NO: 36289 - RNA, 46 nt, Mus musculus
caauguucagugagagacccugucucaaaauuaaaaccaccagcug

SEQ ID NO: 36290 - RNA, 46 nt, Mus musculus
aagaaaaaugaaacuuggaaaaaaagagaugacuuaauuugguaag

SEQ ID NO: 36291 - RNA, 44 nt, Mus musculus
gauuuauuuauuuauuauauguaaguacacuguagcagccuuca

SEQ ID NO: 36292 - RNA, 46 nt, Mus musculus
uuaaauuucugcagcuucuuaaacuagaaagauaaagaggaggaag

SEQ ID NO: 36293 - RNA, 41 nt, Mus musculus
cuuugguuuucaaaauaauguauugcuugcacagagugggc

SEQ ID NO: 36294 - RNA, 46 nt, Mus musculus
uuuauuuuauguauaugaguaaaauguagcugucuucagucaccag

SEQ ID NO: 36295 - RNA, 42 nt, Mus musculus
gugaaccaccauguaguugcuggggauugaaaucaggaucuc

SEQ ID NO: 36296 - RNA, 46 nt, Mus musculus
gaagagaaaaaucuuaggauaucaucacuaauucuguaggcaccag

SEQ ID NO: 36297 - RNA, 46 nt, Mus musculus
ucaucucgauuugaucauguguagagccuuuguguuaugcuugaag

SEQ ID NO: 36298 - RNA, 45 nt, Mus musculus
gugagguuauauguaaacaacuccccucccccccaaacacacaca

SEQ ID NO: 36299 - RNA, 60 nt, Mus musculus
uacauacauacauacauacauacauauucuagaauuuaggagauuaauuuuugcaaacuu

SEQ ID NO: 36300 - RNA, 55 nt, Mus musculus
aagauuauccccuccggccuccuaaaaugaaauucauuacagagauuuggcaccc

SEQ ID NO: 36301 - RNA, 46 nt, Mus musculus
auguucauacauggaaaagaaauaauuuuuucaaauuaaugaacag

SEQ ID NO: 36302 - RNA, 46 nt, Mus musculus
ugguugcuuaggacuaauggagaguuugaaggggaagagggucaau

SEQ ID NO: 36303 - RNA, 45 nt, Mus musculus
auaacaagacaaaacauuguauggggaauagagcauuuuggcaag

SEQ ID NO: 36304 - RNA, 40 nt, Mus musculus
ucugcuucuaugagaucuucaguaauuaaaauggggcauu

SEQ ID NO: 36305 - RNA, 44 nt, Mus musculus
uuuguuaauuccauuuuguuggacuucacaagccaugggaguga

SEQ ID NO: 36306 - RNA, 46 nt, Mus musculus
gauaaaaauggugauguuugcauuucuauucuucaugagccugggg

SEQ ID NO: 36307 - RNA, 75 nt, Mus musculus
uacuguggaaaccaucaugauuagugucauuucuaugcuggcagauccuaauggagacucaccugcaaauguaga

SEQ ID NO: 36308 - RNA, 45 nt, Mus musculus
gguggcucaaaaccauccguaacaagaucugacucccucuucugg

SEQ ID NO: 36309 - RNA, 47 nt, Mus musculus
auauaaaauaauuugauuuuaauuuuguaucugcagaaagaauggag

SEQ ID NO: 36310 - RNA, 54 nt, Mus musculus
acuugagauggaaaaggcguaauucauucuaacaacucuaaggucacaauccau

SEQ ID NO: 36311 - RNA, 105 nt, Mus musculus
cacugagggaagucaguacagaaauucaagguagggaacuuagaagcaggaauagaagcagaggucauggggagauugcucacugacuuguuccucauagcuugc

SEQ ID NO: 36312 - RNA, 42 nt, Mus musculus
uacaaauguccagggguggcaccaccuccucgcuuggcucau

SEQ ID NO: 36313 - RNA, 66 nt, Mus musculus
uccuauuacccuucuccuuaguccauauuuguuucuucuuacagcagauuuuccucaccuauugua

SEQ ID NO: 36314 - RNA, 52 nt, Mus musculus
guuggcuuuuauuguauuaaaugaagguuauaguacugaauaccagagaagu

SEQ ID NO: 36315 - RNA, 52 nt, Mus musculus
aaaacaacuucggugauggguaaaauuaguacauuaaauguugaagacaggc

SEQ ID NO: 36316 - RNA, 57 nt, Mus musculus
uggccuaaacuccugucugguuuuagcugagaugggaaguuguguuugguauacaag

SEQ ID NO: 36317 - RNA, 45 nt, Mus musculus
agguguggcucugcccuugggguuuggauaaaucuuuuggcagaa

SEQ ID NO: 36318 - RNA, 46 nt, Mus musculus
guaacuauggagcaacugugaacaccucaguuuuguuggagcccaa

SEQ ID NO: 36319 - RNA, 46 nt, Mus musculus
aauauacuuauuuaccuuuggauaaccuuguguuucuuugggcuag

SEQ ID NO: 36320 - RNA, 42 nt, Mus musculus
gcacagaaaguucuagacaagaagaaugacuuccugcagcag

SEQ ID NO: 36321 - RNA, 48 nt, Mus musculus
uuauuuuaauauuuauuuauuacuuaacauuuacuuauguuugauggg

SEQ ID NO: 36322 - RNA, 60 nt, Mus musculus
uugaaaagaaagaacagcgagccaagcgcuuccacuuucgagcagaaguaaaucuugccc

SEQ ID NO: 36323 - RNA, 59 nt, Mus musculus
agagaaauguagccuuggaccgagacaugaugaagaaagguacaguguguuugggggag

SEQ ID NO: 36324 - RNA, 45 nt, Mus musculus
cuuucuggcuuuguccuguauguccggucgucauccaaauaccca

SEQ ID NO: 36325 - RNA, 46 nt, Mus musculus
uguuguauacaugauaaaauaaaucuuaaaaaagaaagagagagag

SEQ ID NO: 36326 - RNA, 46 nt, Mus musculus
ucaaaucccagcaaccacaugguggcccacaaccacccguaaugag

SEQ ID NO: 36327 - RNA, 45 nt, Mus musculus
aacagcuucaguguacuuacauauaauaaauaaauaaaucuuaaa

SEQ ID NO: 36328 - RNA, 44 nt, Mus musculus
ugcagucccccugauugucaguucaaucucugugagcccaggcu

SEQ ID NO: 36329 - RNA, 45 nt, Mus musculus
uucuuuugagacaagugucucacugugcaguccuagcuggcccag

SEQ ID NO: 36330 - RNA, 46 nt, Mus musculus
uccugaaugcugagaguaaggccuacaccaucauacagaggccaua

SEQ ID NO: 36331 - RNA, 37 nt, Mus musculus
uauaaaauaaauaaaccuuaaaaaaaaaaaaagaagc

SEQ ID NO: 36332 - RNA, 46 nt, Mus musculus
agagcucaguagcaggugacagucagauccugcauaccagacuggg

SEQ ID NO: 36333 - RNA, 46 nt, Mus musculus
ucauggaaacauucagauggcauggcuuucaacuuuuuuucaccag

SEQ ID NO: 36334 - RNA, 46 nt, Mus musculus
acuggagacaaucuacauuuguggaguggaugaaaugagcacccag

SEQ ID NO: 36335 - RNA, 55 nt, Mus musculus
ucaucaauaugaguucucugccagcccaggauaagaugagaagcagagaugccag

SEQ ID NO: 36336 - RNA, 28 nt, Mus musculus
aaagagggcccuugccgcccugugcacc

SEQ ID NO: 36337 - RNA, 46 nt, Mus musculus
aagcaggaagacaguucagaugacgacgagacugaagaaggagaag

SEQ ID NO: 36338 - RNA, 46 nt, Mus musculus
acuuuccugugcacauaauuuuuaaaaaguguucauaauaaaggag

SEQ ID NO: 36339 - RNA, 46 nt, Mus musculus
uucguccagcuaacaaacuugcuaaaggaaauagacuauucaugag

SEQ ID NO: 36340 - RNA, 41 nt, Mus musculus
aaauaauuuaugaaaaagcagcuuacugacugagggggaau

SEQ ID NO: 36341 - RNA, 45 nt, Mus musculus
cagcacacacugaagucuaccacuguguccauccuggucguccua

SEQ ID NO: 36342 - RNA, 70 nt, Mus musculus
aggaacuuggagcagccagaagaagucaauacuacaugaaguauggaaauccaaauuauggaggcaugaa

SEQ ID NO: 36343 - RNA, 46 nt, Mus musculus
auguacauguagaaaaugcauuuucauaguuugauguuggccucuc

SEQ ID NO: 36344 - RNA, 47 nt, Mus musculus
aagcgaagauaucauucccgucgcauucagcgggaugugaucaagaa

SEQ ID NO: 36345 - RNA, 45 nt, Mus musculus
uccuggaacacacuguuguagaccagacuggccuugaacucucag

SEQ ID NO: 36346 - RNA, 47 nt, Mus musculus
ggauuagugaauguuccugaggaacccauugaggaagaggaggagga

SEQ ID NO: 36347 - RNA, 46 nt, Mus musculus
gagccugucuaggcgauccagugcgagcagcucagacucagaugag

SEQ ID NO: 36348 - RNA, 45 nt, Mus musculus
cuacucccuccccaaagaaaagcaugaaaaugaccauguaugcag

SEQ ID NO: 36349 - RNA, 46 nt, Mus musculus
cgucaucucuuagaugaaaagaggcagcauuccuguccacggccag

SEQ ID NO: 36350 - RNA, 45 nt, Mus musculus
accaauaaaguugggugguuagaaacaugguugagugugaacuag

SEQ ID NO: 36351 - RNA, 41 nt, Mus musculus
gacaaugacgucagaaggggugagaauggaacccugggaag

SEQ ID NO: 36352 - RNA, 45 nt, Mus musculus
caccaucugguggcuggccagacuuuuuuuuuuuuuaaucagcuu

SEQ ID NO: 36353 - RNA, 46 nt, Mus musculus
gagcccucuucagauguacauaguaggcuagguguucccaggcaag

SEQ ID NO: 36354 - RNA, 43 nt, Mus musculus
aacaggugguuuguggacucgcuuaggaucuacacccaagacc

SEQ ID NO: 36355 - RNA, 42 nt, Mus musculus
acucggagcuucagagagcauggggugcucugaucaaggaga

SEQ ID NO: 36356 - RNA, 46 nt, Mus musculus
augaccgcuauguggccaucugcuucccucuucauuacaccagcau

SEQ ID NO: 36357 - RNA, 42 nt, Mus musculus
uucaucuacagucugagaaacagagauauaaaagaggcccug

SEQ ID NO: 36358 - RNA, 42 nt, Mus musculus
cagguuaccuccaacuguugucauguaagccaagaggaagag

SEQ ID NO: 36359 - RNA, 46 nt, Mus musculus
ccaccaagauccucuguauaguguaguucauucgggugcuguaagu

SEQ ID NO: 36360 - RNA, 42 nt, Mus musculus
ccugcgaggugcgugguucaaaaaucucuuauccgguugcgc

SEQ ID NO: 36361 - RNA, 42 nt, Mus musculus
cagccuggacgucugugcagcacgugcacagugcaggcagag

SEQ ID NO: 36362 - RNA, 46 nt, Mus musculus
gaguauccuauaagcuucaguuuuagaagaaaugaugugugaagag

SEQ ID NO: 36363 - RNA, 26 nt, Mus musculus
aagaaggcuggccuagaggucuuuug

SEQ ID NO: 36364 - RNA, 42 nt, Mus musculus
gcagacauucacuuaacuuugaggaaugggguggauaggcag

SEQ ID NO: 36365 - RNA, 46 nt, Mus musculus
uguguaucagcugacuuccugcuacuguagcaaauagcaaucaucu

SEQ ID NO: 36366 - RNA, 46 nt, Mus musculus
ccaggucgucagguacuucacccaaggaguuguuuucuggccccag

SEQ ID NO: 36367 - RNA, 42 nt, Mus musculus
ugugugugugugugugugugugugugugugagagagucuucu

SEQ ID NO: 36368 - RNA, 44 nt, Mus musculus
aggucagaauagggcauuggaucccuagguacuggaguaaguua

SEQ ID NO: 36369 - RNA, 49 nt, Mus musculus
gaaacucacagagauucccaaguacaacuagcuauaugugguagaaauu

SEQ ID NO: 36370 - RNA, 46 nt, Mus musculus
aaguaacagacagaaagaaaggaaagacagcaaagaacauugaggg

SEQ ID NO: 36371 - RNA, 46 nt, Mus musculus
uucaugccuggggcacauaaauuaaaaaaaaaaaaaacuuucacag

SEQ ID NO: 36372 - RNA, 45 nt, Mus musculus
uauauuuacuuaccguuuuaauuuuuauuaguguacaugugugug

SEQ ID NO: 36373 - RNA, 45 nt, Mus musculus
uugugugacagaugcuuucaccugcugagcuaucuugcuggacag

SEQ ID NO: 36374 - RNA, 45 nt, Mus musculus
uggugcacugguguauuccuauaauccuagugcuggagaggcaga

SEQ ID NO: 36375 - RNA, 45 nt, Mus musculus
uauuggaauaggauaugaauguuuauuauuuuacuugaauauaga

SEQ ID NO: 36376 - RNA, 82 nt, Mus musculus
aggcuggccucaaaccuaacaggccuguuucugccuccuaaguagggagaguaaaggugugugccaccacgcuuggcuguua

SEQ ID NO: 36377 - RNA, 42 nt, Mus musculus
gguuucuuuugagaggggauguccagguaaguuagggagcaa

SEQ ID NO: 36378 - RNA, 27 nt, Mus musculus
uuuugagacauccugacuguccuggaa

SEQ ID NO: 36379 - RNA, 101 nt, Mus musculus
agugugguggcagguguuugugacccuggaacuugcguuauggcagugggaggauagcagguuguaggccagugcuggccugggcuaugcagugagaucag

SEQ ID NO: 36380 - RNA, 41 nt, Mus musculus
auacacgagguuaauggauuuuaguucuucacaaggggcaa

SEQ ID NO: 36381 - RNA, 49 nt, Mus musculus
ucaaaucccagcaaccacaugguggcucacaaccaccuguuaugagauc

SEQ ID NO: 36382 - RNA, 46 nt, Mus musculus
agcaacuuagugagacccugucucagaauuugaaagagaaggccag

SEQ ID NO: 36383 - RNA, 46 nt, Mus musculus
agaugguugugagccaccaugugguugcugggauuuugaacuccag

SEQ ID NO: 36384 - RNA, 46 nt, Mus musculus
accaaauaagugucuggugccugaggaggacagaaaagauuguugg

SEQ ID NO: 36385 - RNA, 45 nt, Mus musculus
uaguugugggguacaugccuuguaaucccagcauuuggaaagcag

SEQ ID NO: 36386 - RNA, 44 nt, Mus musculus
guaacaauuuaguuggagccaccauauuuuguucugcaguugag

SEQ ID NO: 36387 - RNA, 33 nt, Mus musculus
gcagaauuguugggcuauauuugaauaucccuu

SEQ ID NO: 36388 - RNA, 46 nt, Mus musculus
caccuucacagaguuuugucagggucggacaaugagaugggccuua

SEQ ID NO: 36389 - RNA, 42 nt, Mus musculus
cccccaaccccccguuaagggcugccccuuguccacccccug

SEQ ID NO: 36390 - RNA, 47 nt, Mus musculus
cauuacagaugguugugaaccgccaugugguugcugggauuugaacu

SEQ ID NO: 36391 - RNA, 44 nt, Mus musculus
cagaaagacacagggaagacuaaucugcucagacaucacuucag

SEQ ID NO: 36392 - RNA, 46 nt, Mus musculus
cucuuuuuauuaaaccaggaaacaguucuauggagagugguaccag

SEQ ID NO: 36393 - RNA, 46 nt, Mus musculus
cuauagauaugaaauucaggauauagguacagaauuuauggaguag

SEQ ID NO: 36394 - RNA, 42 nt, Mus musculus
ucugcaaugcuggaauuaaagacaugugccaccaccaccgag

SEQ ID NO: 36395 - RNA, 45 nt, Mus musculus
uucagucaccuccaaguaaacgaagaaaauuagaaaagccaagga

SEQ ID NO: 36396 - RNA, 46 nt, Mus musculus
augaaagaauugucucucaaagcuucaucuuugggcuccgagacag

SEQ ID NO: 36397 - RNA, 46 nt, Mus musculus
gccauggaaaguuguaaaggcuccagcaauggagcccaggacggag

SEQ ID NO: 36398 - RNA, 42 nt, Mus musculus
gugcuacagagacagacacucgucuaaauaaaaagaaggaaa

SEQ ID NO: 36399 - RNA, 46 nt, Mus musculus
agaauugagcgagcugguucccagaaaggagcuagccuguugauag

SEQ ID NO: 36400 - RNA, 45 nt, Mus musculus
gauauuuaauaaauaauaaauguuuguuucaucauagguuagcag

SEQ ID NO: 36401 - RNA, 29 nt, Mus musculus
agcugugucuguuguuauuucacggauag

SEQ ID NO: 36402 - RNA, 45 nt, Mus musculus
uugcuauggaaugagcaguaggcauugaggaauagcacaagacag

SEQ ID NO: 36403 - RNA, 46 nt, Mus musculus
agaguuuaccgaugaagcuagguuggcuggccagcagaccccagau

SEQ ID NO: 36404 - RNA, 46 nt, Mus musculus
guuauugucguaggcaaaacaaagccuucaaguguccgggguuuua

SEQ ID NO: 36405 - RNA, 65 nt, Mus musculus
gcagcucagucgcaaagcuugcaggaggaaagcaaggacccgacugugagcuccuaagaacaggu

SEQ ID NO: 36406 - RNA, 47 nt, Mus musculus
aggcgggcggcaucacggcgguggguccgcacaacgggacagcaaag

SEQ ID NO: 36407 - RNA, 65 nt, Mus musculus
acuugggacccuugcccaaggcucuuaagcggcgcaggaagguucuuguugguugauuugacuga

SEQ ID NO: 36408 - RNA, 47 nt, Mus musculus
ggcaucgcgccagccagcuccgaaagcaaaagagggagucggugagu

SEQ ID NO: 36409 - RNA, 46 nt, Mus musculus
ucugcacagcaggauuucccuuccagaggcauuuaaacugcuucag

SEQ ID NO: 36410 - RNA, 41 nt, Mus musculus
gugcccuagcuugaaacaucgaugguuuuucacauaugcaa

SEQ ID NO: 36411 - RNA, 46 nt, Mus musculus
uucuguuccuccuggacccacuagaaggcugggacaguacggggga

SEQ ID NO: 36412 - RNA, 45 nt, Mus musculus
cuggcuucccaccaaagaaacaaauagaugcccgaaagaagcuaa

SEQ ID NO: 36413 - RNA, 164 nt, Mus musculus
cuuguuugcccauguugcugacuucgugccuagugaggagagugacuuagugggcaccuugaaaaucucaggcuauguucgugggaggacucugaauguaaauagcuugcugcauaucguuggacacggugauuuccaaaugaaucaaauagaugcuccugugg

SEQ ID NO: 36414 - RNA, 46 nt, Mus musculus
auccuagagugauuaaaucccagaagaaaccaaacauggcaaugga

SEQ ID NO: 36415 - RNA, 46 nt, Mus musculus
accugcuguggaaauucagaggacacuagcugguugcacaggagag

SEQ ID NO: 36416 - RNA, 46 nt, Mus musculus
gaggcuauuccagauccuauggaaggagagcagaccuggcccacug

SEQ ID NO: 36417 - RNA, 52 nt, Mus musculus
aaaggaacauccaguuaccaggcugaguggauucuggaugaaggugaugaaa

SEQ ID NO: 36418 - RNA, 46 nt, Mus musculus
aaauguuuccagaugaaauggauaccccccgugauguagcugcuag

SEQ ID NO: 36419 - RNA, 42 nt, Mus musculus
agaucucuucucuagguagccuauagucauguauacugggag

SEQ ID NO: 36420 - RNA, 46 nt, Mus musculus
cguaaaggaggcagagaguuaaagauguguuacccuuggugaucag

SEQ ID NO: 36421 - RNA, 47 nt, Mus musculus
accaaggacaauuuuauaacuuuuuuguacguagcuguuacauguag

SEQ ID NO: 36422 - RNA, 46 nt, Mus musculus
gaacccaacaacaccaaauccuugcauaccuuguucgauuggagaa

SEQ ID NO: 36423 - RNA, 46 nt, Mus musculus
aauuuuguuauagaccaagaauacauucucaauuagaaagccacaa

SEQ ID NO: 36424 - RNA, 42 nt, Mus musculus
aaucaacgaaacagacacaccugcacaguuggaaauggagga

SEQ ID NO: 36425 - RNA, 95 nt, Mus musculus
agcugaggagacuccggcgcucgccauggccgacgagaaacccaaggaaggagucaagacugagaacaacgaucauauuaauuugaagguggcgg

SEQ ID NO: 36426 - RNA, 45 nt, Mus musculus
gagucccgacucucaaaucuccguucgaggaacucaauggauuuu

SEQ ID NO: 36427 - RNA, 45 nt, Mus musculus
acagagaaacccugucuuguggggugggggagaagguguucccaa

SEQ ID NO: 36428 - RNA, 41 nt, Mus musculus
aggagccaauccgccuguuacgggaggugguguugcugacc

SEQ ID NO: 36429 - RNA, 42 nt, Mus musculus
ggccaccaagcucccacccuuuuucccucuaucuggucccag

SEQ ID NO: 36430 - RNA, 45 nt, Mus musculus
cuccaccagcacaugcucccauccuuggccuuccuuucacugcag

SEQ ID NO: 36431 - RNA, 46 nt, Mus musculus
gccuuccuuuucuaguuggccccuuucaucaccccaaacccccuaa

SEQ ID NO: 36432 - RNA, 42 nt, Mus musculus
ucccugucccgucccuucccguccggucccgucccgucccau

SEQ ID NO: 36433 - RNA, 46 nt, Mus musculus
auucuuaucucaugaguggugaaccgaugggaucaggaguccugug

SEQ ID NO: 36434 - RNA, 42 nt, Mus musculus
gcacgccuuuauucccagcacucgggaggcagagacaggcag

SEQ ID NO: 36435 - RNA, 46 nt, Mus musculus
gcaaucacuguaaggcaagaacaaggcacagagaccaaucccccac

SEQ ID NO: 36436 - RNA, 46 nt, Mus musculus
ucaacuccccgcacuuauccucugaucuccacaagucugcacccau

SEQ ID NO: 36437 - RNA, 45 nt, Mus musculus
ucuuaaccucugagccaucucaccagcccuaauggcaauucuuga

SEQ ID NO: 36438 - RNA, 46 nt, Mus musculus
cuaguagcggcugaguccaugaggcucaaugucccagcugggccag

SEQ ID NO: 36439 - RNA, 46 nt, Mus musculus
cgacgaccagccaaauuuuuuacaggcuuauauaguaaaacucaag

SEQ ID NO: 36440 - RNA, 46 nt, Mus musculus
gcgguuguuuuaggaggcccuuaucucaaaaauguucuaggaacag

SEQ ID NO: 36441 - RNA, 45 nt, Mus musculus
ccggaggucuuguaccgggcgauagucauuggucccugguuuuug

SEQ ID NO: 36442 - RNA, 45 nt, Mus musculus
gacgaccagccaaauuuuucauaggcuuauauaguaaaacucaag

SEQ ID NO: 36443 - RNA, 45 nt, Mus musculus
gagguuguuuuaggaggcccuuaucucaaaaauguucuuggaaca

SEQ ID NO: 36444 - RNA, 45 nt, Mus musculus
agaaucagagaaagguuugacaggauaggaucugcccaacccuca

SEQ ID NO: 36445 - RNA, 46 nt, Mus musculus
gcacaggauacaggagagcuguggagagcagugcaguagagcugag

SEQ ID NO: 36446 - RNA, 46 nt, Mus musculus
uucagaggccaagagaaaagacagauugugaauaaaaucaucgggg

SEQ ID NO: 36447 - RNA, 41 nt, Mus musculus
ggagggagagagggagagagggagggagagagagagagaaa

SEQ ID NO: 36448 - RNA, 46 nt, Mus musculus
aaacuaggaugguaauuuaccuuuuauuuauuuauuuuugagccag

SEQ ID NO: 36449 - RNA, 45 nt, Mus musculus
gagcccucguacaaaugagacuuccuagcuauauaauuaggccga

SEQ ID NO: 36450 - RNA, 46 nt, Mus musculus
ccuccuccuccuccuccucuuccuccucuucuuccuccuccucuuc

SEQ ID NO: 36451 - RNA, 42 nt, Mus musculus
gaaaguuaguucauugucgucauugguggcaugcagggccag

SEQ ID NO: 36452 - RNA, 45 nt, Mus musculus
aauuaaaaauuaaaaaaaucuuuauuagcauuuaggaggcugagg

SEQ ID NO: 36453 - RNA, 46 nt, Mus musculus
uaaauauugcuaaaaaagaaagaaagaaagaaagaaagaaagaaag

SEQ ID NO: 36454 - RNA, 42 nt, Mus musculus
aaagggagagggagagggaggagagggaaaggaaggaaggaa

SEQ ID NO: 36455 - RNA, 70 nt, Mus musculus
caauaggccagcacuucuguguccauaucagcuagaugugcugcugauaguauuuuagauuccaaaaugu

SEQ ID NO: 36456 - RNA, 45 nt, Mus musculus
aggggucugacuuccuguucuggccucuacaggcagaaagcacag

SEQ ID NO: 36457 - RNA, 45 nt, Mus musculus
aguggaagcagguaugcauggguauccugaaagacugcagcccaa

SEQ ID NO: 36458 - RNA, 46 nt, Mus musculus
gauucugcaaaggaauguccagcaucugaaaauaaagauccaagaa

SEQ ID NO: 36459 - RNA, 68 nt, Mus musculus
gccucccucucugucagcuuaugcacacacccuuugaaaggccgccaucuaguugccacaaaagacau

SEQ ID NO: 36460 - RNA, 45 nt, Mus musculus
acgaccucaucauugccuugagaacaagugggauaccagaguuac

SEQ ID NO: 36461 - RNA, 46 nt, Mus musculus
cacaguaccuuguggcagcugcagcuaugccaaguauugcagccag

SEQ ID NO: 36462 - RNA, 40 nt, Mus musculus
uucugccauguugcccugagaaugacucuuuuagccagau

SEQ ID NO: 36463 - RNA, 46 nt, Mus musculus
agcaagaaucuggucaaggcauuugauuacacaagucagggagaga

SEQ ID NO: 36464 - RNA, 46 nt, Mus musculus
auugugagucaccaugugguugcugggauuugaacucaggcccucc

SEQ ID NO: 36465 - RNA, 46 nt, Mus musculus
ucagacacuuaucaaguacugccugagugcuaggaaucaaaccaag

SEQ ID NO: 36466 - RNA, 46 nt, Mus musculus
acacuauagaagcuuauucuuuagacuuucacauuacacuguccag

SEQ ID NO: 36467 - RNA, 41 nt, Mus musculus
cugcagcaucccgguccagcugggagugaaugcugggguca

SEQ ID NO: 36468 - RNA, 51 nt, Mus musculus
ucaaaucccagcaaccacaugguggcucacaaccaccugugaugagaucug

SEQ ID NO: 36469 - RNA, 41 nt, Mus musculus
cacauauuuaaucccagcacucaggaggcagaggcaggcag

SEQ ID NO: 36470 - RNA, 44 nt, Mus musculus
gucccugucccccauagcaacagauaauaggauugucugcagag

SEQ ID NO: 36471 - RNA, 45 nt, Mus musculus
caaaugcagugauauuuacaggccuauaccuggcuuucccugaua

SEQ ID NO: 36472 - RNA, 42 nt, Mus musculus
gggggaaauugaagauggccuggcccaggcccaugcuaccuu

SEQ ID NO: 36473 - RNA, 46 nt, Mus musculus
agcucugagugccaucuggaaggcagaaaggauccuguuggugcac

SEQ ID NO: 36474 - RNA, 46 nt, Mus musculus
accugaccugagccuagugucuggcacagagagcacuugaaaacag

SEQ ID NO: 36475 - RNA, 57 nt, Mus musculus
gaacccccagagggaagcugauuauacauuccaggaaggcggccgguagcuucagug

SEQ ID NO: 36476 - RNA, 43 nt, Mus musculus
cugagggacacggacacgggggcccuccucuucauaggcagaa

SEQ ID NO: 36477 - RNA, 43 nt, Mus musculus
ggcggacgggcuggaggccugggcuggggcugcuuccugcccc

SEQ ID NO: 36478 - RNA, 123 nt, Mus musculus
agcucacccaaguggaacacagggcugcuuucgaguggaaugaagagggggcaggaagcagccccagcccaggccuccagcccguccgccucaccuucccgcuagacuaucaccuuaaccaac

SEQ ID NO: 36479 - RNA, 46 nt, Mus musculus
aacaccacacacacacacacacacacacacacacacacacucccug

SEQ ID NO: 36480 - RNA, 45 nt, Mus musculus
acaaacagggagugugugugugugugugugugugugugugugugu

SEQ ID NO: 36481 - RNA, 92 nt, Mus musculus
caucuucuuccugccccugaccgugacccagaacuugaccaugauagaagagagccucaccucugaguucauucaugacaucgaccgagaac

SEQ ID NO: 36482 - RNA, 47 nt, Mus musculus
cucucuucuaucauggucaaguucugggucacggucaggggcaggaa

SEQ ID NO: 36483 - RNA, 45 nt, Mus musculus
acuuauuaaccuuuucuaggcuacggcuucuuuggaaaucuaaga

SEQ ID NO: 36484 - RNA, 46 nt, Mus musculus
aaggccaucuuacgauacggcuuggacucugaucucaacugcaagg

SEQ ID NO: 36485 - RNA, 50 nt, Mus musculus
uaggaucugacaucauggggacucucacgguccuguccucguccaaauga

SEQ ID NO: 36486 - RNA, 46 nt, Mus musculus
ucgagaaagacgacccuccaggauuuucauuuggacgaggacagga

SEQ ID NO: 36487 - RNA, 46 nt, Mus musculus
cgagggaaaugcccagugcccucagcauccuucuccuuggcguggc

SEQ ID NO: 36488 - RNA, 95 nt, Mus musculus
guggaccgggcaaucuucccuuucaucugggccugcacccaguuguuaaucuccugaaggucuacucgaggguugcccgugaggauccggggccu

SEQ ID NO: 36489 - RNA, 70 nt, Mus musculus
uuuguugccccucuggagaaguccuaugggaccaggccccggauccucacgggcaacccucgaguagacc

SEQ ID NO: 36490 - RNA, 77 nt, Mus musculus
cuugagguucuucucaggggcaguaacagaggcaaggagcuccuuguaggugcuguggaugucaggguuggugauca

SEQ ID NO: 36491 - RNA, 82 nt, Mus musculus
gggcucucuacuacgaccugaucaccaacccugacauccacagcaccuacaaggagcuccuugccucuguuacugccccuga

SEQ ID NO: 36492 - RNA, 48 nt, Mus musculus
agacagcaggacguugcccguugggcuggcacuggaucucaggcggua

SEQ ID NO: 36493 - RNA, 41 nt, Mus musculus
gcugccagcuuguucacagggaccuugaagaagggguccuc

SEQ ID NO: 36494 - RNA, 45 nt, Mus musculus
ccucccugucuuuccugacaagccauccccucugacuagacccga

SEQ ID NO: 36495 - RNA, 45 nt, Mus musculus
cauguguguaacaugugugagggccugggcuucacccccaacaga

SEQ ID NO: 36496 - RNA, 42 nt, Mus musculus
gagcccugcucgggcacggcagcagccagaacguccccagca

SEQ ID NO: 36497 - RNA, 42 nt, Mus musculus
uauaguauuguauuguauuguauuguauuguauugcauugua

SEQ ID NO: 36498 - RNA, 41 nt, Mus musculus
caaagaguucuguucugcagggcugaccuuucugggggugu

SEQ ID NO: 36499 - RNA, 45 nt, Mus musculus
caccccgacccaggucguggcauaauuaccgcaucccugcuagau

SEQ ID NO: 36500 - RNA, 46 nt, Mus musculus
gguccugaucccaagcaagacugaacagccacuuugggggccggaa

SEQ ID NO: 36501 - RNA, 45 nt, Mus musculus
acccugacauuugggaaagugaaggaaaauaauaguaaaacucug

SEQ ID NO: 36502 - RNA, 46 nt, Mus musculus
ucaccagccccccuaucucucuguuucuauuucuggcuuagcaguu

SEQ ID NO: 36503 - RNA, 42 nt, Mus musculus
gacccagugaaaggaaugacagcagacgacuagcgccaccgc

SEQ ID NO: 36504 - RNA, 42 nt, Mus musculus
cagaugaggaaugaaguagguuuucucauuucacagggagcu

SEQ ID NO: 36505 - RNA, 46 nt, Mus musculus
caggcaacuuucaaucccuuacuauagcuauuucuagaugcccuuu

SEQ ID NO: 36506 - RNA, 69 nt, Mus musculus
ucagccuugggauaaacugagcuauuuugcuuccugggcagaucuuuggcaaugcugaauauucacuug

SEQ ID NO: 36507 - RNA, 45 nt, Mus musculus
cucauguguauguaugugugugcacaacucuccauugucugcaga

SEQ ID NO: 36508 - RNA, 45 nt, Mus musculus
gcauaauuauuuuucgggauucuuagaaagcaauguuguaugaag

SEQ ID NO: 36509 - RNA, 45 nt, Mus musculus
ggaguugguucuuuucaucuacuauaguuucuaaaacucagaguc

SEQ ID NO: 36510 - RNA, 46 nt, Mus musculus
gucucugcuaagagagaugcagugaggauauucuacaccgggagau

SEQ ID NO: 36511 - RNA, 46 nt, Mus musculus
acuaagaaaggacugcuggaugcgagugcaggacacagaaggagau

SEQ ID NO: 36512 - RNA, 54 nt, Mus musculus
gccacugaccucggagaagcugaguucuuagacuccuuuuccccacccccaccc

SEQ ID NO: 36513 - RNA, 46 nt, Mus musculus
gcccacgaggggaugagacccaugcgggcugucuucacgcggcugg

SEQ ID NO: 36514 - RNA, 42 nt, Mus musculus
gcccaagcggggacuggaugucagcaaaugugaaaucgccag

SEQ ID NO: 36515 - RNA, 45 nt, Mus musculus
auuuauaaucucaccuuaaaaaaaaaucuugcagacaccccccac

SEQ ID NO: 36516 - RNA, 45 nt, Mus musculus
cauucugcaucagagagaggaaaagaaaagaauccugaggcaggc

SEQ ID NO: 36517 - RNA, 46 nt, Mus musculus
aggcaagaggaauccaaggggaaggagguuuccauugggggugugg

SEQ ID NO: 36518 - RNA, 34 nt, Mus musculus
cuucuggugugucugaagacagcuacagcagugu

SEQ ID NO: 36519 - RNA, 42 nt, Mus musculus
accauaggaaggucucuaaagaaaacucaugccggggcuggu

SEQ ID NO: 36520 - RNA, 42 nt, Mus musculus
cccagcaacuacaugguggcucacaaccacccaaaaugagau

SEQ ID NO: 36521 - RNA, 42 nt, Mus musculus
gccuguuaaguuguagcucagggcuggcgagaaggcucagug

SEQ ID NO: 36522 - RNA, 42 nt, Mus musculus
uucaugagcuguugcaccuuggccucggagguagccagagcc

SEQ ID NO: 36523 - RNA, 25 nt, Mus musculus
accgugcuguggaaaggcuggagcc

SEQ ID NO: 36524 - RNA, 42 nt, Mus musculus
gguggguuagugucuggaguggcccagcucccauggccagug

SEQ ID NO: 36525 - RNA, 41 nt, Mus musculus
cuguccucugccuggccagcacacuucccauaggggucggg

SEQ ID NO: 36526 - RNA, 42 nt, Mus musculus
gcccugaccuuccuacuaguccugcucaccuuggccacacuu

SEQ ID NO: 36527 - RNA, 41 nt, Mus musculus
ggaccuggaggcaaugguagguccaggacagaggcucagau

SEQ ID NO: 36528 - RNA, 45 nt, Mus musculus
agccuggguugcccacuggcugaagaggcagcggcggcggaagca

SEQ ID NO: 36529 - RNA, 46 nt, Mus musculus
gacugacuaaaacuuaaggggggaaaagugaaacgacaguugagga

SEQ ID NO: 36530 - RNA, 43 nt, Mus musculus
cgggccacaaagcgggagcgaggaccugagggccaaccagaga

SEQ ID NO: 36531 - RNA, 46 nt, Mus musculus
cauauuuuguuauuaaaucugguaaguacauaaccccccgccccaa

SEQ ID NO: 36532 - RNA, 41 nt, Mus musculus
uagaaauguguuucauccuuguuuuuguacuuacgccccac

SEQ ID NO: 36533 - RNA, 46 nt, Mus musculus
ucucuugaucguagaugguuaucugaauggaguugaaugggacaag

SEQ ID NO: 36534 - RNA, 42 nt, Mus musculus
cuuggccaggucccgaggaaccugaacugaagaagucaggag

SEQ ID NO: 36535 - RNA, 45 nt, Mus musculus
aaaauuuuauaaaagaaauaaaaggcagaaaaaugauagaggaag

SEQ ID NO: 36536 - RNA, 42 nt, Mus musculus
uacacacacaaacgugcauacaccacacauacaugcagagag

SEQ ID NO: 36537 - RNA, 42 nt, Mus musculus
caguauauuccucaaggcuaccugcugcugucaaggucccug

SEQ ID NO: 36538 - RNA, 45 nt, Mus musculus
ggccguggcuuuugaaaucuguuucuucaucucuccauggucauu

SEQ ID NO: 36539 - RNA, 42 nt, Mus musculus
cacaaccaucuguaacaagaucugacgcccuccucuggagug

SEQ ID NO: 36540 - RNA, 42 nt, Mus musculus
aaagaggggagaagagaagagaaaagagaaaagaagagaaaa

SEQ ID NO: 36541 - RNA, 46 nt, Mus musculus
uccuuaggacaugaucaucaaccugguccugaguccccagccccug

SEQ ID NO: 36542 - RNA, 23 nt, Mus musculus
gagggagaaggccagcuguucuc

SEQ ID NO: 36543 - RNA, 46 nt, Mus musculus
ucaaaucucagcaaccacaugauggcucacaaccauccauaaugag

SEQ ID NO: 36544 - RNA, 41 nt, Mus musculus
cccagggcgccgccgacaccagaaacaggaugaagagccaa

SEQ ID NO: 36545 - RNA, 46 nt, Mus musculus
agaacaaguuucugauuauuuuacaacagugggcaggcggucgagg

SEQ ID NO: 36546 - RNA, 45 nt, Mus musculus
uuguccauauacacaguagcuaccuguagugcaacugcugcagag

SEQ ID NO: 36547 - RNA, 45 nt, Mus musculus
cuguguccuuuuuuguucuuaccacuucucuuccuccucacccca

SEQ ID NO: 36548 - RNA, 45 nt, Mus musculus
acuauguacauugguuguggggaagaggaaguaucuggggugagg

SEQ ID NO: 36549 - RNA, 45 nt, Mus musculus
gugucagucucagguagucuccagggaagcuugguggagaaggca

SEQ ID NO: 36550 - RNA, 46 nt, Mus musculus
gucauggaguaacaaccauguaauacccacuguuucggaguuugag

SEQ ID NO: 36551 - RNA, 45 nt, Mus musculus
uccaguuguugguaggaacacaauuuuucucuucucccccaaguu

SEQ ID NO: 36552 - RNA, 46 nt, Mus musculus
ccacacccuagaacccaugguucuaagucauguccaccccgcuagc

SEQ ID NO: 36553 - RNA, 46 nt, Mus musculus
auauguagcagaggauggccuagucggucggucaucaaugggagga

SEQ ID NO: 36554 - RNA, 44 nt, Mus musculus
gauccaacagaaccuucuggugcccaaagaaucucaugugguaa

SEQ ID NO: 36555 - RNA, 46 nt, Mus musculus
cacuagccagacacccgaagagaucugugccaauaaaaucagagag

SEQ ID NO: 36556 - RNA, 45 nt, Mus musculus
uuguuuaauugacauuggaauaagauagagguauugcauuacaga

SEQ ID NO: 36557 - RNA, 85 nt, Mus musculus
aguauguaaauggacagcugaagaauaaguacggagaugcguucauccguggaaacaaugugcuguacauaaguacacagaagag

SEQ ID NO: 36558 - RNA, 94 nt, Mus musculus
ccaguuguggugaaauuaaauucuggcguggauuaucgaggggucuuggccugccuggauggcuacaugaauauagcccuggaacagacagagg

SEQ ID NO: 36559 - RNA, 46 nt, Mus musculus
auuuucuaccauucuauucuaccucaucaaaacuuacagagcaggc

SEQ ID NO: 36560 - RNA, 41 nt, Mus musculus
aauauguuuuaugcuaccaugucuguaagugccucuggagg

SEQ ID NO: 36561 - RNA, 23 nt, Mus musculus
accugcccggacggugcaggguu

SEQ ID NO: 36562 - RNA, 41 nt, Mus musculus
ugaagccaugacgacaggaugccaagccaaccagccuuccu

SEQ ID NO: 36563 - RNA, 58 nt, Mus musculus
ugagcaguucucauuuucuguguaguguccccuagagagagagaaagagagagagaga

SEQ ID NO: 36564 - RNA, 40 nt, Mus musculus
ccgucaaaguccuugaguaugcuuuuggcuggcacuuuga

SEQ ID NO: 36565 - RNA, 42 nt, Mus musculus
cacauaauuuaaaaacuggucuucagucacauugcuucagau

SEQ ID NO: 36566 - RNA, 45 nt, Mus musculus
uggcaaagggagggguaaggguaguuagaagaaucugccuugaga

SEQ ID NO: 36567 - RNA, 44 nt, Mus musculus
guuuugccaacagugcccuaagcuggcaaugggacgucacgugg

SEQ ID NO: 36568 - RNA, 55 nt, Mus musculus
cccacgccugccuguucccugccccaaccaauguggagugggcacuguggcccgg

SEQ ID NO: 36569 - RNA, 42 nt, Mus musculus
agcaugccacgucugagugccccaagcgcacccagcccugug

SEQ ID NO: 36570 - RNA, 46 nt, Mus musculus
cuccagcaggcucugauagcaacuccaccguccucugcccacagau

SEQ ID NO: 36571 - RNA, 42 nt, Mus musculus
accaggcucuguggguguuaauaucuguguggagaugggaga

SEQ ID NO: 36572 - RNA, 46 nt, Mus musculus
aggccuaccucaccaaguucuuccuacaguaugcuggccagaggac

SEQ ID NO: 36573 - RNA, 59 nt, Mus musculus
uugaugauaaucaucuacuuuucucgccuccuccgcucugauuucugcccugaacgugc

SEQ ID NO: 36574 - RNA, 44 nt, Mus musculus
auaaacuaguacucugccccaagcuuggguguauucuggggcca

SEQ ID NO: 36575 - RNA, 46 nt, Mus musculus
gaguccagauggcuaauucuaaauauauacuuuuuucaccauaaau

SEQ ID NO: 36576 - RNA, 45 nt, Mus musculus
cacucuuguguucauuguggaugucaaggccaauaagcaucagau

SEQ ID NO: 36577 - RNA, 42 nt, Mus musculus
uugaucuggucucauaauaguaaauguggaacuccaguggau

SEQ ID NO: 36578 - RNA, 64 nt, Mus musculus
gaagauccgaacgucacccaccuuccggcggcccaagacccugcggcuccggaggcagccaaaa

SEQ ID NO: 36579 - RNA, 46 nt, Mus musculus
ugcuggcaggacggccggaaggggucacuuuacgaaugccacacuu

SEQ ID NO: 36580 - RNA, 45 nt, Mus musculus
uugccugcaugaaacuguguagcacaugcaugcuuggugcaggag

SEQ ID NO: 36581 - RNA, 41 nt, Mus musculus
ccccaggccucucuguuaugguagggccaucccagccccga

SEQ ID NO: 36582 - RNA, 42 nt, Mus musculus
ggauaaucgucgggucuccacgggucccggccgccggggcgg

SEQ ID NO: 36583 - RNA, 43 nt, Mus musculus
uuugcagucucugaucggcgacuccauuuucuucggugggagc

SEQ ID NO: 36584 - RNA, 42 nt, Mus musculus
aggaaaugacccucccacucccagugacagagagccggaggu

SEQ ID NO: 36585 - RNA, 100 nt, Mus musculus
aauuaggcccguccccggaaccggaagccgaggguagaacuacgccaagauggaagagaagacuccuuaaccugaaucuuuaugguuccuuuggcgagag

SEQ ID NO: 36586 - RNA, 45 nt, Mus musculus
aauaaauauuugggaaaaaaacaacaacaacauguggugguuagg

SEQ ID NO: 36587 - RNA, 46 nt, Mus musculus
caguggaagaauguuugaaccucaccucaccaucucuaacccagua

SEQ ID NO: 36588 - RNA, 46 nt, Mus musculus
ugcgcugacaccaccugguggccaaccggaccacaagccaccugca

SEQ ID NO: 36589 - RNA, 48 nt, Mus musculus
cugcuggugcugcugaaacuuaagacugacauucuggauccaaaaaaa

SEQ ID NO: 36590 - RNA, 42 nt, Mus musculus
ucaacaaggaugggcugagggacaguuccuuuugcuccaccu

SEQ ID NO: 36591 - RNA, 42 nt, Mus musculus
aacugcugacgcugaccuguaggcgcagguccagggccagug

SEQ ID NO: 36592 - RNA, 73 nt, Mus musculus
cuggugucgguaaugaaugauacagguguucagaacuagagaagcugagaggucgaugguggucaccugggaa

SEQ ID NO: 36593 - RNA, 46 nt, Mus musculus
ucaggugaacuggcuccuugggucuccagugcuagcauaaggagcc

SEQ ID NO: 36594 - RNA, 36 nt, Mus musculus
cgaugcaguuaggagacccugaugcagcccccacac

SEQ ID NO: 36595 - RNA, 42 nt, Mus musculus
cucaguuguauuauagggguccuacaaugacccgcccgagcc

SEQ ID NO: 36596 - RNA, 46 nt, Mus musculus
gcacagccacuguagguccagugucaugcagaggucaggcagguga

SEQ ID NO: 36597 - RNA, 46 nt, Mus musculus
auggcgagucaaauccaucuugauggagagauugagguucucagag

SEQ ID NO: 36598 - RNA, 45 nt, Mus musculus
uuucuugcugggcuucaaguuauuaaacaguuuuccucuacagau

SEQ ID NO: 36599 - RNA, 46 nt, Mus musculus
acugccugcccacuuuccaucagcuccugaacagaguccagacuac

SEQ ID NO: 36600 - RNA, 44 nt, Mus musculus
ugcugggcuugcugggcuuccgcuggcugguuccagucugggaa

SEQ ID NO: 36601 - RNA, 45 nt, Mus musculus
uugccaguauguuacagagaagguaagaccaaacauagccgggag

SEQ ID NO: 36602 - RNA, 42 nt, Mus musculus
auaaugcuggggcugcuacugaggaguuuaucaagcgggcag

SEQ ID NO: 36603 - RNA, 46 nt, Mus musculus
aggucuuaggauuccuucaccacuauaguuacuguuagagguccuu

SEQ ID NO: 36604 - RNA, 46 nt, Mus musculus
cuaaggugccugacccaagcaucuuagagcuauuuauacauucaag

SEQ ID NO: 36605 - RNA, 46 nt, Mus musculus
uccccugaaugauagacauacaaagugcuuuaaagauggguccuag

SEQ ID NO: 36606 - RNA, 42 nt, Mus musculus
aggcagggugaugcccgucuaucaucccugcuaccugggggg

SEQ ID NO: 36607 - RNA, 42 nt, Mus musculus
guuguugcuccuguuguacagcagcuucaccacaggcuguga

SEQ ID NO: 36608 - RNA, 46 nt, Mus musculus
uaagcaagagguagagagaacacuaaagucagcagagaggucacag

SEQ ID NO: 36609 - RNA, 24 nt, Mus musculus
acgaaggcauucuaggggccggag

SEQ ID NO: 36610 - RNA, 45 nt, Mus musculus
ugggaucacagucucccuguggugugggcaucucaccagcuccuc

SEQ ID NO: 36611 - RNA, 41 nt, Mus musculus
cccagcaaccacaugguggcucacaaccaucuguaauucga

SEQ ID NO: 36612 - RNA, 46 nt, Mus musculus
ucuaaaaggaacacauuuuggggacaguagugacauggcggcgggu

SEQ ID NO: 36613 - RNA, 98 nt, Mus musculus
gaagaagagggaggauggucuggcaggaagccagagaagacaagugcuacaugagaaggaagagcugggguuuaugggaauugcaacagacuuugggg

SEQ ID NO: 36614 - RNA, 46 nt, Mus musculus
gaacaaagcgcaaacgaucacgguaguucaaagacuugggguucua

SEQ ID NO: 36615 - RNA, 45 nt, Mus musculus
cgcguguugcaucuauuucccagcaagcaccgcagggugggcgga

SEQ ID NO: 36616 - RNA, 27 nt, Mus musculus
ucuuaaauacucaaacuauccaacuag

SEQ ID NO: 36617 - RNA, 45 nt, Mus musculus
agaggccagguguuaaauccucuggaacuagaauuagaaauguua

SEQ ID NO: 36618 - RNA, 42 nt, Mus musculus
agagagaagcccagcagcagcagcugcaggcccugauagcag

SEQ ID NO: 36619 - RNA, 46 nt, Mus musculus
gaccaauuuauuuuucagaaaugaacugaaaauuucaguuuuauag

SEQ ID NO: 36620 - RNA, 45 nt, Mus musculus
gagcugccaugugggugcuggacaccaaacugagguccuucagaa

SEQ ID NO: 36621 - RNA, 45 nt, Mus musculus
auaugccgcaaugggaaagaaaggcagcuggaacacaagcucaca

SEQ ID NO: 36622 - RNA, 48 nt, Mus musculus
gcuguuaggggugguggcacauaguaaccccagcacuugggagaugga

SEQ ID NO: 36623 - RNA, 45 nt, Mus musculus
uuaagugguggucugcaugaugcuggucacaucuaguuguuucag

SEQ ID NO: 36624 - RNA, 46 nt, Mus musculus
auguccaauaggaccacagguguacagaaggauguucaaaggggag

SEQ ID NO: 36625 - RNA, 46 nt, Mus musculus
gcaauaugacggaugaccugcagagauugcagugaaagggccacag

SEQ ID NO: 36626 - RNA, 46 nt, Mus musculus
aagacaguuguguuagagcugccuccuuuguccuggcuguuagcau

SEQ ID NO: 36627 - RNA, 46 nt, Mus musculus
cugugauggcgugucuccacucggaggacugguugugcuggcagag

SEQ ID NO: 36628 - RNA, 42 nt, Mus musculus
ccccccauccucguaacuggggauaaccgaaggaacccccag

SEQ ID NO: 36629 - RNA, 42 nt, Mus musculus
ugccuggaugauguucacaccagcauccuugauagccggaug

SEQ ID NO: 36630 - RNA, 45 nt, Mus musculus
guauguaugugagugugugagccaccuaacggguucagugacuca

SEQ ID NO: 36631 - RNA, 47 nt, Mus musculus
uacauugaauacuaaucagacuauucuuugaauacaacgugguagag

SEQ ID NO: 36632 - RNA, 55 nt, Mus musculus
caggaucaggaugggcuaguuaaaccuugucuccauucuuacgugugaggugaca

SEQ ID NO: 36633 - RNA, 46 nt, Mus musculus
cuagguggugguggaugugggacagagaaacugagccaggacauag

SEQ ID NO: 36634 - RNA, 46 nt, Mus musculus
aacgagaucugacucucucuucuggugugucugaagacagcuacag

SEQ ID NO: 36635 - RNA, 46 nt, Mus musculus
gaggcaaaagguguaguggcacaggugugcaauaauagaccagcag

SEQ ID NO: 36636 - RNA, 42 nt, Mus musculus
uaacugggcaugauggugcucacuuucaaucccagcacucaa

SEQ ID NO: 36637 - RNA, 46 nt, Mus musculus
gguagaguggguagaggucagagaucugaccuggaucugacagugu

SEQ ID NO: 36638 - RNA, 45 nt, Mus musculus
uguguguguguguguacguguaugugugcauguaugugugggugu

SEQ ID NO: 36639 - RNA, 46 nt, Mus musculus
gcaacaggagugaguaccaccaauucauuuuugauuguugcaccug

SEQ ID NO: 36640 - RNA, 46 nt, Mus musculus
aucuuggugaauaaacuucgacagaaacauucuuagcaaccccaaa

SEQ ID NO: 36641 - RNA, 42 nt, Mus musculus
ugguggaguacaccaaucuuccaguccugcuggaggcagcag

SEQ ID NO: 36642 - RNA, 45 nt, Mus musculus
auuuguuucugagugaagauaaugggauaauuaacuaaacuggua

SEQ ID NO: 36643 - RNA, 45 nt, Mus musculus
uuguggcuauuucuguuaccuugauggcuucaucucuggccccua

SEQ ID NO: 36644 - RNA, 45 nt, Mus musculus
ugcagucauagugcccugucccaggaugccucaggguaccuuuaa

SEQ ID NO: 36645 - RNA, 45 nt, Mus musculus
acaaauaguugugagccaccauguugcuggaaauugaauucaaga

SEQ ID NO: 36646 - RNA, 46 nt, Mus musculus
auguguguaaguuugcagcuuuauucuucuggauuuucuauugauu

SEQ ID NO: 36647 - RNA, 85 nt, Mus musculus
uccucuagaugcuuuuaaccacugagccacucucuggccacaagaaggaagagauuuuaauguauuaggauugaugauguaguug

SEQ ID NO: 36648 - RNA, 41 nt, Mus musculus
gaucgggcuagugagauggcucagugguuaaaagcgccaac

SEQ ID NO: 36649 - RNA, 46 nt, Mus musculus
ucaagucccagcaaccacaugguggcucacaaccaucuguauuggg

SEQ ID NO: 36650 - RNA, 45 nt, Mus musculus
cauaugcauaaaauaaaaacaaacuuuuaaaaauguaauuucggu

SEQ ID NO: 36651 - RNA, 42 nt, Mus musculus
uucccagcaaccacaugguggcucaugaccaucuguaagggc

SEQ ID NO: 36652 - RNA, 41 nt, Mus musculus
acacuguagcugucuucagacacuccagaagagggagggca

SEQ ID NO: 36653 - RNA, 46 nt, Mus musculus
ggucagagcagaaaucagugaacugaaggaugaaagaacuguguag

SEQ ID NO: 36654 - RNA, 60 nt, Mus musculus
auucaggcuaccucucugaggcucagggagcaguguagaaugaggagugggaagaguaga

SEQ ID NO: 36655 - RNA, 45 nt, Mus musculus
gauggauaagacauucuguaaguucauggaugauaguuuuggcag

SEQ ID NO: 36656 - RNA, 46 nt, Mus musculus
uuguuaggaaaagacacuuuaacagaaguagaaaacaagcacuugg

SEQ ID NO: 36657 - RNA, 46 nt, Mus musculus
agagcugagaguucugcaucuucaucugaaggcugcuagcagagua

SEQ ID NO: 36658 - RNA, 45 nt, Mus musculus
gagugucuaguguucuuaaccaccaagccauuucucaguccccau

SEQ ID NO: 36659 - RNA, 46 nt, Mus musculus
gcagcaguguggccccuacaaaucauucuccuuaucuuguguccag

SEQ ID NO: 36660 - RNA, 46 nt, Mus musculus
gccugcagauguggaccucaugauugacugucuugucucuugcuuu

SEQ ID NO: 36661 - RNA, 111 nt, Mus musculus
guucuccccuuucugaggagugcugcauguaugaaggcagagugugucugcauccggggacauuuguauauaaagcacccauacugacuagucuuuaaauacaucaacauc

SEQ ID NO: 36662 - RNA, 46 nt, Mus musculus
aggucucaccauguaguuuuagacggucugaaacuauguagaccag

SEQ ID NO: 36663 - RNA, 46 nt, Mus musculus
uuugagcauauccaugaagauugauaucaugauuacguuaauugag

SEQ ID NO: 36664 - RNA, 46 nt, Mus musculus
uacaguguauaguguauuuguguaugugcaugugauauauccagag

SEQ ID NO: 36665 - RNA, 54 nt, Mus musculus
gacaguauucugaucaaggcucaaauuuuuaauggcagacacgcuuuauaaagg

SEQ ID NO: 36666 - RNA, 45 nt, Mus musculus
uacuagguuggcauugaauuuauuauguaugacauacugaccuca

SEQ ID NO: 36667 - RNA, 46 nt, Mus musculus
uacuauuaaaguuacuguaucauuuaauauuuccauuagcagugua

SEQ ID NO: 36668 - RNA, 41 nt, Mus musculus
agagaaagggagagagagagagagagagagagagagggagg

SEQ ID NO: 36669 - RNA, 46 nt, Mus musculus
auagaccugucugaaaguaaacaaaaccagcaugaguacugaugag

SEQ ID NO: 36670 - RNA, 46 nt, Mus musculus
cuccaaaugaccuccugcuguacucugugugugugugugugugugu

SEQ ID NO: 36671 - RNA, 45 nt, Mus musculus
uugugauagauuuuacaucaucaucuauauuguacuugguuugga

SEQ ID NO: 36672 - RNA, 42 nt, Mus musculus
gaugaguuccugcgugccuguacuccuggagcaucucugcgg

SEQ ID NO: 36673 - RNA, 46 nt, Mus musculus
ugugccuuaguuucucagauugcaggagaugauagcagggcauggu

SEQ ID NO: 36674 - RNA, 47 nt, Mus musculus
ugcccaacuauaacacauucauggaauuugccucagucagcaauaug

SEQ ID NO: 36675 - RNA, 39 nt, Mus musculus
uuuuauuauuauuauaaaauguaccuuuccuacugguag

SEQ ID NO: 36676 - RNA, 46 nt, Mus musculus
uuguuuuacuacagacccagugugacuauggcaauaagauaaucag

SEQ ID NO: 36677 - RNA, 87 nt, Mus musculus
augcaauacaaauaaaaacaaaauugugucaguuaguugaagucaugauggcaagaagagaugaccucucguuuugucaagagauga

SEQ ID NO: 36678 - RNA, 69 nt, Mus musculus
auaaaaugucuuacgagguaaaauaaaacagaacaaaauggacagagagagagguggggaggggaagga

SEQ ID NO: 36679 - RNA, 46 nt, Mus musculus
uuuauuauuuuacuggaaggacuuuuaguugaagcaugugagguag

SEQ ID NO: 36680 - RNA, 46 nt, Mus musculus
uucucuccucgcuggucuuccacugcagcccgaagaaggagauggg

SEQ ID NO: 36681 - RNA, 42 nt, Mus musculus
aaggaacagaauucgauacacuugcggaaacgguguuggcag

SEQ ID NO: 36682 - RNA, 45 nt, Mus musculus
uuguugagaagaaacuuagagacuguguggagggauuauguuuua

SEQ ID NO: 36683 - RNA, 46 nt, Mus musculus
cugccucuuccccuuaagugcuacagucauaugcuaccacacccag

SEQ ID NO: 36684 - RNA, 24 nt, Mus musculus
ccuuugaccuuccaccacacccac

SEQ ID NO: 36685 - RNA, 23 nt, Mus musculus
ccugcaggguagccugcugguua

SEQ ID NO: 36686 - RNA, 27 nt, Mus musculus
ugccaaucauguacuguucacaaaaga

SEQ ID NO: 36687 - RNA, 46 nt, Mus musculus
agguuuuuccuagauauagcaucagauugucccacaagugaugcag

SEQ ID NO: 36688 - RNA, 69 nt, Mus musculus
aaacguuaagcaucuucuaccaagcuggcaccuccaaagcugggaauccuauuuuuuauuauguugcac

SEQ ID NO: 36689 - RNA, 46 nt, Mus musculus
guguguguguguguguguguguguguguguguguaaguguaauuaa

SEQ ID NO: 36690 - RNA, 46 nt, Mus musculus
cuugccuagcaagugcaaggccuuggauuugguucucagcucagga

SEQ ID NO: 36691 - RNA, 46 nt, Mus musculus
auagcuaggagccagucacgugcuuggagccucgccucuuuggaag

SEQ ID NO: 36692 - RNA, 45 nt, Mus musculus
cuggaaugaaugugaauuuauuguugugcagguaaagauguguga

SEQ ID NO: 36693 - RNA, 45 nt, Mus musculus
gacagacagaaaggcagagagagagagagagagagagagagagag

SEQ ID NO: 36694 - RNA, 46 nt, Mus musculus
uuuucuccgggaaacuugcagcuuaaaggucgucuuguugugggag

SEQ ID NO: 36695 - RNA, 42 nt, Mus musculus
aggaagaggaggaggaagaggaggaggaggaagaggagggga

SEQ ID NO: 36696 - RNA, 45 nt, Mus musculus
gaguagacucuacuucugguuuuccagaagagguaggagcaggug

SEQ ID NO: 36697 - RNA, 46 nt, Mus musculus
cccaguuuagcccagguuggccuugcuaagauccaugauugcugag

SEQ ID NO: 36698 - RNA, 46 nt, Mus musculus
gacuuuguuugccagaaccacaguugauagaaauagaaagguacag

SEQ ID NO: 36699 - RNA, 41 nt, Mus musculus
agugugugccaaaguuggcaauugcagcucucuuucccccu

SEQ ID NO: 36700 - RNA, 41 nt, Mus musculus
cugagcaguaaugaugcagcccuuuaaucccagcacucggg

SEQ ID NO: 36701 - RNA, 46 nt, Mus musculus
caaagccauaugaaauuguaguggaccuuacccauacugggccuag

SEQ ID NO: 36702 - RNA, 46 nt, Mus musculus
cuaaccauugcaaaccaaggcacaccacugaccuucaugcaccaag

SEQ ID NO: 36703 - RNA, 46 nt, Mus musculus
guaugacuuaucagucagagaaagauaagcauaaauucacagacag

SEQ ID NO: 36704 - RNA, 46 nt, Mus musculus
auaaaaagacugcauagguacguuuuguucuauuuuuuuccgucaa

SEQ ID NO: 36705 - RNA, 46 nt, Mus musculus
gaucuccacagaaaaaagaacacaccggugugugacuaagcugggc

SEQ ID NO: 36706 - RNA, 46 nt, Mus musculus
gaagcagauguauccuucuauucaagcaaaaaucugggggagccuu

SEQ ID NO: 36707 - RNA, 46 nt, Mus musculus
acccuguucugucccucagaagcauguagacacauacccagcccug

SEQ ID NO: 36708 - RNA, 45 nt, Mus musculus
caucugcccuaucucuuccauguugucacuuucuuaguagccaca

SEQ ID NO: 36709 - RNA, 45 nt, Mus musculus
ggacagccauagcuaccuagagauaaugcugucuugggggguggg

SEQ ID NO: 36710 - RNA, 42 nt, Mus musculus
gcuuagagauacacagaguucaccaguggccugggucugggu

SEQ ID NO: 36711 - RNA, 46 nt, Mus musculus
cacuuugucggacucaacuucaacucuaacuuuaacuuugcacuag

SEQ ID NO: 36712 - RNA, 42 nt, Mus musculus
auuacauagauggagucaggcuuuaguuuccaugugguggag

SEQ ID NO: 36713 - RNA, 46 nt, Mus musculus
guucagcugggcagugguggcgcacgccuuuaaucccagcacuagg

SEQ ID NO: 36714 - RNA, 46 nt, Mus musculus
ccuuguguggcuggcuccucuaagggaguugauuuuaauggaugag

SEQ ID NO: 36715 - RNA, 32 nt, Mus musculus
ggcagugaugagagugguuagcuaucuagagg

SEQ ID NO: 36716 - RNA, 45 nt, Mus musculus
uguuuuauuuguuuguuuguuuguuuguuuguuuguuuguuguuu

SEQ ID NO: 36717 - RNA, 109 nt, Mus musculus
ggugggaguuacccagggggucucuauuugcuccgagaagggagggaggauggggaaaggauuucgggaggagguaaccuggaggggggcagugaauggaauguaaagu

SEQ ID NO: 36718 - RNA, 46 nt, Mus musculus
guuguguuucccaaaguguuuccuguuguguaaguaucuccuguug

SEQ ID NO: 36719 - RNA, 46 nt, Mus musculus
auuguuaaauuucuugaugccuugauugacacguacuugccuggaa

SEQ ID NO: 36720 - RNA, 33 nt, Mus musculus
gccguacgcggaggacggccuucuguguucccg

SEQ ID NO: 36721 - RNA, 45 nt, Mus musculus
accacagaggccaagccucaauaaagccacaggccagggacugag

SEQ ID NO: 36722 - RNA, 42 nt, Mus musculus
aucuuaacauugcugaauuaaagcuauugguucugaggccuu

SEQ ID NO: 36723 - RNA, 46 nt, Mus musculus
uuuuuuccaguugauuaucuuuuaauuuuuacauaugaagguguuc

SEQ ID NO: 36724 - RNA, 46 nt, Mus musculus
uccauuggcuccguagcaaaauggaaugguacgugacauaggguag

SEQ ID NO: 36725 - RNA, 46 nt, Mus musculus
ggucaucugagacccucugggccuugguuucaacugcuguacugga

SEQ ID NO: 36726 - RNA, 42 nt, Mus musculus
guacugugcagaccuguuccacgugucucuauuuggccccaa

SEQ ID NO: 36727 - RNA, 42 nt, Mus musculus
ugggggugaggacaugaaaggggagagaggugguuggcugag

SEQ ID NO: 36728 - RNA, 42 nt, Mus musculus
gugugcugucaugugguugcugggaaucgaaccuagguccuc

SEQ ID NO: 36729 - RNA, 41 nt, Mus musculus
ggcugugagccaccaugugguugcugggaguugaacccagg

SEQ ID NO: 36730 - RNA, 41 nt, Mus musculus
ggauggaugggauggguggaugaguagauggauugguggau

SEQ ID NO: 36731 - RNA, 46 nt, Mus musculus
caaagguaauuauugcuuuucugucugaggugugagauagaaugag

SEQ ID NO: 36732 - RNA, 45 nt, Mus musculus
gacugcugguagagccaguagguguaagguucaguggggcugcca

SEQ ID NO: 36733 - RNA, 42 nt, Mus musculus
acgggacacuguggccuuguuuccacuguugccgugcuggcc

SEQ ID NO: 36734 - RNA, 46 nt, Mus musculus
ugaaaaaaaaguagaagagaauuaaaaauucccgaagaacauuuau

SEQ ID NO: 36735 - RNA, 45 nt, Mus musculus
cugucuuaucaccacaauacagaaauaccuaaggcaggccccuuu

SEQ ID NO: 36736 - RNA, 41 nt, Mus musculus
cuaaccaguuaccaccaucaacaccaggcaaauaggaggug

SEQ ID NO: 36737 - RNA, 42 nt, Mus musculus
gguucucugaguucuaggccagccuggccgagagagagagag

SEQ ID NO: 36738 - RNA, 45 nt, Mus musculus
uggagcagggaacugugaggugaauauaaauaagaaacacuccag

SEQ ID NO: 36739 - RNA, 64 nt, Mus musculus
ugugugacuguguaugguguaugaguguguguguguaugugugugugagugugugugugagugu

SEQ ID NO: 36740 - RNA, 41 nt, Mus musculus
aaaguugcacugcaaaugcagcuagcugcucccugccuggu

SEQ ID NO: 36741 - RNA, 46 nt, Mus musculus
gagcuucuaggcuagcuagaauuacaaagugaaccccugccucaaa

SEQ ID NO: 36742 - RNA, 47 nt, Mus musculus
ccauuaugauacaaccauccacuguguucugagacuggaaacugaga

SEQ ID NO: 36743 - RNA, 48 nt, Mus musculus
acuuucuaaguguguacucuaggaaacucugaagagaggugacaaagg

SEQ ID NO: 36744 - RNA, 46 nt, Mus musculus
uuuuuuuaaaagaccuuuuuauuauacuuauuuauuaugugugggg

SEQ ID NO: 36745 - RNA, 45 nt, Mus musculus
ccucucacggggcaucugaaggguuagaagacagaaccagccuag

SEQ ID NO: 36746 - RNA, 46 nt, Mus musculus
guacauuuauuuuaggugagggucaggaggaacuggaacgggggag

SEQ ID NO: 36747 - RNA, 45 nt, Mus musculus
uguguguguguucuuuuggccuccaacuuaagucccugugcucag

SEQ ID NO: 36748 - RNA, 45 nt, Mus musculus
accucuggagaaauuauguaauucacccaguuucuacaaagcagg

SEQ ID NO: 36749 - RNA, 45 nt, Mus musculus
ugugugugugugugugugugugcgugugcaugugugcaugugugc

SEQ ID NO: 36750 - RNA, 46 nt, Mus musculus
cauagcuggggugucugaugugagguuuuaggugcauguggccuua

SEQ ID NO: 36751 - RNA, 46 nt, Mus musculus
gauuuggugugcacauguggggagucuggguggaaacauccaccga

SEQ ID NO: 36752 - RNA, 42 nt, Mus musculus
guguguauauguguguguguguguguauaugugugugugugu

SEQ ID NO: 36753 - RNA, 46 nt, Mus musculus
gcaaaaaugacagucccugcucucuaggggaaaucccagggccuug

SEQ ID NO: 36754 - RNA, 42 nt, Mus musculus
ccacaacagaccaaaguauggauacagcaaaguccaccccag

SEQ ID NO: 36755 - RNA, 41 nt, Mus musculus
ucagagaggguguuugugaauuuguaggggcauuugugggu

SEQ ID NO: 36756 - RNA, 46 nt, Mus musculus
uccgcucaggaccgggcuuggggagcgcccugucuaccauccuuag

SEQ ID NO: 36757 - RNA, 46 nt, Mus musculus
ggaggaggaggcccggcgacaccgugaggucuacugcaagcuggag

SEQ ID NO: 36758 - RNA, 46 nt, Mus musculus
guuuuaaaugacuacaggcucaagagagguggcugggaacagagag

SEQ ID NO: 36759 - RNA, 45 nt, Mus musculus
ccaaacacagcaguguguucuguaaccuuagugaucugcagcaga

SEQ ID NO: 36760 - RNA, 44 nt, Mus musculus
aucugagaacgacaguggcucgacucaagucacagaccgagaag

SEQ ID NO: 36761 - RNA, 46 nt, Mus musculus
caggguaugguagcacacaccugugaucccagcacgcaggcugcag

SEQ ID NO: 36762 - RNA, 45 nt, Mus musculus
uuuauauguaaguacacuguagcugucuucagacacuccaguaga

SEQ ID NO: 36763 - RNA, 46 nt, Mus musculus
uggcgaguucaacgccagagcccgggagguggaacuugaacaugag

SEQ ID NO: 36764 - RNA, 40 nt, Mus musculus
cauggugucccaucauuccugaugcugcagccuguguuag

SEQ ID NO: 36765 - RNA, 46 nt, Mus musculus
uuuguagccccuuugugaggggcagagggggcuggaugugggggag

SEQ ID NO: 36766 - RNA, 46 nt, Mus musculus
caccuuucaagccggguuuuuuuguuuuguuuucuuuagcucagag

SEQ ID NO: 36767 - RNA, 45 nt, Mus musculus
agacucccuguaaucaugugcuuggaauucaucucaugcugcaua

SEQ ID NO: 36768 - RNA, 76 nt, Mus musculus
acgggguuuccuucccuggcgucugggaagauagagaaaaagggggcuggguagggagucuugugaggaacaaugg

SEQ ID NO: 36769 - RNA, 78 nt, Mus musculus
guggguuuccagagaaggccacagagaccagagucagugucacagaagaggaaggagucugucagggaaacaggcagg

SEQ ID NO: 36770 - RNA, 42 nt, Mus musculus
cuagcaugcgcuugacgaggggccuccaguuagagcagccag

SEQ ID NO: 36771 - RNA, 42 nt, Mus musculus
uguuaccaccacacaggauucucuguuacccacugcccccuu

SEQ ID NO: 36772 - RNA, 50 nt, Mus musculus
gcgggggagggagugggaagugccucaguaggggguggaggggcagauug

SEQ ID NO: 36773 - RNA, 59 nt, Mus musculus
cuucaccugcaggaaaaagggagacuuggaagaugagugacagagaaggaggcgcuggg

SEQ ID NO: 36774 - RNA, 42 nt, Mus musculus
uccucagccccguacauucaaguuccaagucuggccggcaga

SEQ ID NO: 36775 - RNA, 42 nt, Mus musculus
uucucuucuuguugugaaagccugcaugauaccuguggagau

SEQ ID NO: 36776 - RNA, 46 nt, Mus musculus
gaacccugcaagaugguaaaccugagggaguauuacgagagggcgc

SEQ ID NO: 36777 - RNA, 46 nt, Mus musculus
ugucucagguggucuuaacuguaacuuaugaauacagugaaaaggu

SEQ ID NO: 36778 - RNA, 46 nt, Mus musculus
gcacgugccuuaggaggcuaaaagagggugucugauccccugagac

SEQ ID NO: 36779 - RNA, 45 nt, Mus musculus
cauuggguuucuucacaauuuuguaaaauucuguuguaaacagau

SEQ ID NO: 36780 - RNA, 69 nt, Mus musculus
aagaacagccugugucgaaacaagccaaagcaguggaaaugggccgaagggaagagaggugcugcgcgg

SEQ ID NO: 36781 - RNA, 63 nt, Mus musculus
augacccacucacuugggauuauguggcgcggcgagaauuagagaucgagucccaaccaggug

SEQ ID NO: 36782 - RNA, 45 nt, Mus musculus
gugucacuucuugcuauugcucagcuauuugauuuugccaaagau

SEQ ID NO: 36783 - RNA, 44 nt, Mus musculus
uaggguucgggagaggagugaguagaagccagccaugacuagau

SEQ ID NO: 36784 - RNA, 42 nt, Mus musculus
uauuucaaaauguuaaugucuuuguacaugugguggggauau

SEQ ID NO: 36785 - RNA, 47 nt, Mus musculus
gggauuuugaucauccugaagaaauccuuaaaggcgaguuggcacgg

SEQ ID NO: 36786 - RNA, 45 nt, Mus musculus
ugggugaggggugucuuacaggcacuauaaugugugugugguggu

SEQ ID NO: 36787 - RNA, 42 nt, Mus musculus
gggcagaccuguaauuccaggauuugugacugagccagaagg

SEQ ID NO: 36788 - RNA, 46 nt, Mus musculus
uagaaugauauuuuagugcguguuuaugucaugguguuugugggga

SEQ ID NO: 36789 - RNA, 46 nt, Mus musculus
uuaggauggagcugaugcaugcugagaaacugagaaaggagaagca

SEQ ID NO: 36790 - RNA, 58 nt, Mus musculus
ugccgguuccgugggguauauuuuaugugggggcaguaggugcugagugauucuaaag

SEQ ID NO: 36791 - RNA, 44 nt, Mus musculus
auauucucugccaugcuugccauucacucaaacaagccagguau

SEQ ID NO: 36792 - RNA, 98 nt, Mus musculus
uugcacuggacauauuagauagauacagauuuuugucuuggaacauggucggugggaguuagcucauucucaugguuaagagagcccaggcaucagug

SEQ ID NO: 36793 - RNA, 46 nt, Mus musculus
aaaccaaaaaaaaggggguggaaagggacuuaccuagcaugcauaa

SEQ ID NO: 36794 - RNA, 46 nt, Mus musculus
ccuccgugaugacaccguugcuugaagcagguuuugagccacagaa

SEQ ID NO: 36795 - RNA, 66 nt, Mus musculus
aagaaggaugagauugaauauucuaugguacaucggguccagggugucuuuggucgugcuucagcg

SEQ ID NO: 36796 - RNA, 45 nt, Mus musculus
uguacagagucagaccagaaagaugaaaaaaaauaucugcagagg

SEQ ID NO: 36797 - RNA, 46 nt, Mus musculus
uagaaaaugguuauaguuuaaaaguuugggguauacagcuuuagau

SEQ ID NO: 36798 - RNA, 45 nt, Mus musculus
guuggaacagcuggagcgcaucggacucuucagucacgcggagau

SEQ ID NO: 36799 - RNA, 45 nt, Mus musculus
ugugaauuuuuguuuguuuuuuaucaauaguaaaaaaaaaaagug

SEQ ID NO: 36800 - RNA, 45 nt, Mus musculus
ggcugcucgagcaggccuguggcccucuuuacuucggaugcucgu

SEQ ID NO: 36801 - RNA, 46 nt, Mus musculus
uuagccggcaaaaguacaugcugugcagauuccacaaccuggaacc

SEQ ID NO: 36802 - RNA, 45 nt, Mus musculus
augggagggggagacaguagaagcccuggaagcuuucaggucaga

SEQ ID NO: 36803 - RNA, 45 nt, Mus musculus
ucaacagggaacagaaaugaaguuaauuuguuuuuaacuaggauc

SEQ ID NO: 36804 - RNA, 46 nt, Mus musculus
uauuaacauuuuuaucauuucugaaugaauuuaagcucaaagagau

SEQ ID NO: 36805 - RNA, 46 nt, Mus musculus
uuaacugcuaggauuacaaguauucaccaaaugagcugggcaguga

SEQ ID NO: 36806 - RNA, 55 nt, Mus musculus
uuucaggaguguguucucagcuuccacaggugaguucuguggaccaagcucaggu

SEQ ID NO: 36807 - RNA, 93 nt, Mus musculus
uguguauacacauaugcauauuuugauuuguaugugugccuuaucaugaguguaggugcacucaucguagcaugcgugggaaggucggaugac

SEQ ID NO: 36808 - RNA, 83 nt, Mus musculus
ugagcuaugugaauuugcuucagugcuugcuuuggugccuccuccauuccccacccccagcaucccacaauaagggucuuagu

SEQ ID NO: 36809 - RNA, 47 nt, Mus musculus
uucccugugccugggugcuaguaucauggcaguacucccacccccag

SEQ ID NO: 36810 - RNA, 46 nt, Mus musculus
uagaaguguagaguuaccccagguugugugcucagugcugucuacu

SEQ ID NO: 36811 - RNA, 46 nt, Mus musculus
gaguggacaacuggcuuugagggauacagucugagcagucgaagaa

SEQ ID NO: 36812 - RNA, 46 nt, Mus musculus
ccacauuuuuaagcauggaacaguagcuucccgcccaccaguacag

SEQ ID NO: 36813 - RNA, 46 nt, Mus musculus
guguaccauggaauacuugguaucuguggagaccggauccccugaa

SEQ ID NO: 36814 - RNA, 46 nt, Mus musculus
aguacacuguagcugucuacagacacgccagaagagggugccagau

SEQ ID NO: 36815 - RNA, 25 nt, Mus musculus
uuuguguguguggggguguuuuugu

SEQ ID NO: 36816 - RNA, 46 nt, Mus musculus
ggucccuaggcacuauaagaaagcacacuguaaagggcuggagagu

SEQ ID NO: 36817 - RNA, 46 nt, Mus musculus
ucacaacuauccguaaggagaucugacacccucuucuagugcaucu

SEQ ID NO: 36818 - RNA, 46 nt, Mus musculus
uugcgugguggcuaggauauucuuagaguuccagucauuuguagau

SEQ ID NO: 36819 - RNA, 28 nt, Mus musculus
aggagcaaaacaagauguuucagggagg

SEQ ID NO: 36820 - RNA, 88 nt, Mus musculus
guuuagaaagccugagggcacugaccuggggacaguaaagguggagacgaaguagagggagagggaagaaguaaggagaaauggagag

SEQ ID NO: 36821 - RNA, 44 nt, Mus musculus
augacaacucuuccugcgaaacaaucaccaaauauuuaucacca

SEQ ID NO: 36822 - RNA, 46 nt, Mus musculus
aaauccuaaacaaugcaccacaaaaagugaugacaggauacugagg

SEQ ID NO: 36823 - RNA, 45 nt, Mus musculus
accuucccuagcugaggaaaacgacuccaggacucaugcaaccaa

SEQ ID NO: 36824 - RNA, 46 nt, Mus musculus
caggugaagcagucaaaagugguucugaaggcgaauugucgggaag

SEQ ID NO: 36825 - RNA, 73 nt, Mus musculus
agcuggagaauagucucucugacccagaaaaugagcagccaguucagaagaggaaaucuaauguugugaucca

SEQ ID NO: 36826 - RNA, 46 nt, Mus musculus
aguaaaaagccaaauaaaaaggguaagaaaacuaggacuacugcag

SEQ ID NO: 36827 - RNA, 46 nt, Mus musculus
ugaaggcuuccaccccaaaaucagccagaacaucagaaaagcacaa

SEQ ID NO: 36828 - RNA, 46 nt, Mus musculus
ugagcgaccaugugguugcugggauuugaacucaggaccuuugcaa

SEQ ID NO: 36829 - RNA, 46 nt, Mus musculus
aagcaaaagaacugauugaggaagcaaaagcauuccaaauuggcgg

SEQ ID NO: 36830 - RNA, 46 nt, Mus musculus
cgguccucuaggcaccaggcacguucugcaaaggagaagucgccag

SEQ ID NO: 36831 - RNA, 46 nt, Mus musculus
uuuaaguauacaauucaaaaccuaaggcauuauggugcauaucuag

SEQ ID NO: 36832 - RNA, 46 nt, Mus musculus
aucugccugucucugcauaugaagugcuggaauuaaaggcauauag

SEQ ID NO: 36833 - RNA, 46 nt, Mus musculus
uaaaaaugaaaguuuccuaggggauuugauauuacaaagcugauga

SEQ ID NO: 36834 - RNA, 46 nt, Mus musculus
uuaaaagauucaaaaauaugaguuugcucauuuuuacaaauuaaag

SEQ ID NO: 36835 - RNA, 45 nt, Mus musculus
gaaaucagaagucaaaaagaaagagacaaaaugaauauucaguga

SEQ ID NO: 36836 - RNA, 45 nt, Mus musculus
uaagucacauugugaacuccuaaccuuucauucucucuugccccc

SEQ ID NO: 36837 - RNA, 46 nt, Mus musculus
gaacuggaagaaagacauaauuugaaaggaaagagagaugaaaaag

SEQ ID NO: 36838 - RNA, 42 nt, Mus musculus
gguaguucauaccugaaauaugagcacauauuugagacugag

SEQ ID NO: 36839 - RNA, 46 nt, Mus musculus
uuuuugaaugcagucaaaaccuucauggcaacaacuaaacgaccag

SEQ ID NO: 36840 - RNA, 46 nt, Mus musculus
ugguauguaaaaauaauuucaguacuguuugguuuuguugaaauau

SEQ ID NO: 36841 - RNA, 46 nt, Mus musculus
aguguugagauuaaaggugugcaccacaaugcucuguggaaacuag

SEQ ID NO: 36842 - RNA, 45 nt, Mus musculus
auguuacccuccaugucuucuuucuuuguuuugaugcuaggccua

SEQ ID NO: 36843 - RNA, 46 nt, Mus musculus
agguauuacuccacuaauuauuauuauuucuccacuaauuuuagag

SEQ ID NO: 36844 - RNA, 46 nt, Mus musculus
ucagauauaguggugcacaccuuuaaucccaauacucaggaggcag

SEQ ID NO: 36845 - RNA, 46 nt, Mus musculus
gagggaaacuuuuucccaguaugguguugcaagcccaugccuccag

SEQ ID NO: 36846 - RNA, 46 nt, Mus musculus
gguuuguuuuguuuauuuuugguuuuguuuauuuguuuguuuuuug

SEQ ID NO: 36847 - RNA, 45 nt, Mus musculus
auuuuuuuuaauuacguguuugcauuuauuuauugguggugugga

SEQ ID NO: 36848 - RNA, 45 nt, Mus musculus
aauaaaugaucacacaaacccaagggcaacaaacaaaauaggaaa

SEQ ID NO: 36849 - RNA, 46 nt, Mus musculus
gguuucaagccccacucuguaccucagcccccuaagacacuagcag

SEQ ID NO: 36850 - RNA, 46 nt, Mus musculus
uuaaaaguggacuuugugaugaguuuagucuugagaauagagacag

SEQ ID NO: 36851 - RNA, 44 nt, Mus musculus
augguggagguagacuggcacgcaugugcagauucuuggacuug

SEQ ID NO: 36852 - RNA, 45 nt, Mus musculus
acacaaagugaauuaaguuacugucaucauucguaggagacggga

SEQ ID NO: 36853 - RNA, 42 nt, Mus musculus
acccacuggcgcaucaacauaucacuggacacaaugcccacu

SEQ ID NO: 36854 - RNA, 42 nt, Mus musculus
uuacaguuaggugacccaaggccuagugaugccaauguggag

SEQ ID NO: 36855 - RNA, 39 nt, Mus musculus
ucuagaagggcaagcugguauguccuggacugagggcag

SEQ ID NO: 36856 - RNA, 46 nt, Mus musculus
guguguguguguguguguuugugugugugugugugugugaaguagu

SEQ ID NO: 36857 - RNA, 45 nt, Mus musculus
gagggaaagagaaagaaagaaagaaagaaagaaagaaaaagggaa

SEQ ID NO: 36858 - RNA, 41 nt, Mus musculus
uaauuuagugagaccuaaugucaaaaugagagagagagaga

SEQ ID NO: 36859 - RNA, 48 nt, Mus musculus
ccggagcggaaauucaucuucaccugccccacugaaaaggaacagcga

SEQ ID NO: 36860 - RNA, 59 nt, Mus musculus
gggacagucacagccagggcagguuacacugagaaacccugucuagaaaaacuaaaaac

SEQ ID NO: 36861 - RNA, 94 nt, Mus musculus
aaaaaacagaaacaaaagcaagcaagcaaacaacaacaaaaacuacagauagggguggauguugcaauuaaaaaaaaaaaagugcccacagcau

SEQ ID NO: 36862 - RNA, 46 nt, Mus musculus
cuuacauguugcuauacagccagccuggauucuucaaaugacacga

SEQ ID NO: 36863 - RNA, 76 nt, Mus musculus
auauagagaauuuguuucaaacaaacaaacaacaacaaaaaacgaggagaggggaugauacagacagacagaccaa

SEQ ID NO: 36864 - RNA, 46 nt, Mus musculus
agggaaguagaggcaggacgaucagagguucugcuauuauacacag

SEQ ID NO: 36865 - RNA, 45 nt, Mus musculus
aagcaggagugcuagcaugugcuuguagucccagcacuggggagg

SEQ ID NO: 36866 - RNA, 46 nt, Mus musculus
uuucuuccuuauuucuagauaaaaaugcuggaauucuuaagcagua

SEQ ID NO: 36867 - RNA, 46 nt, Mus musculus
gaggacuggaugcaagcuuucuuacacggugcugaagccgguaacc

SEQ ID NO: 36868 - RNA, 46 nt, Mus musculus
ccaauguuucuguuuaguccauauauauaugaacacaucugaagau

SEQ ID NO: 36869 - RNA, 45 nt, Mus musculus
ucagaucucauuacagaugguugugagccaccauguucaaaagaa

SEQ ID NO: 36870 - RNA, 46 nt, Mus musculus
cucucauaggcucuaaguuacacuccuguugaauuuaaagagucgg

SEQ ID NO: 36871 - RNA, 62 nt, Mus musculus
acuuaagacuuaaauuacuugugugugugagagagagagagagagagagagagagacggaga

SEQ ID NO: 36872 - RNA, 46 nt, Mus musculus
ggugcacaucuuugauccagcacuugagagacagaggcaggcagau

SEQ ID NO: 36873 - RNA, 46 nt, Mus musculus
caaauaaaaauaaaaauuuuaaauuguuuugaagaggggccuaagg

SEQ ID NO: 36874 - RNA, 45 nt, Mus musculus
aggcuacacagagaaauccugucuugaaaaaacaaaacaaaacaa

SEQ ID NO: 36875 - RNA, 45 nt, Mus musculus
accaacaacacaacuguagcccggagcccaaguucuguucccaga

SEQ ID NO: 36876 - RNA, 24 nt, Mus musculus
gguucacucucccgccacacacac

SEQ ID NO: 36877 - RNA, 41 nt, Mus musculus
uaccuucaagauggcgaugcagugggacaugaggccccugg

SEQ ID NO: 36878 - RNA, 42 nt, Mus musculus
caggagauaggggcacugcacggucuaaauauggugggagag

SEQ ID NO: 36879 - RNA, 42 nt, Mus musculus
aggcugacacauggcuggcaccuuccucuuagggauucagga

SEQ ID NO: 36880 - RNA, 42 nt, Mus musculus
ugcuuccagcaagguguggcaccuggguaaguccaaagauca

SEQ ID NO: 36881 - RNA, 46 nt, Mus musculus
caaaguagugaucagagauggagggaggggugaaucuuguucugga

SEQ ID NO: 36882 - RNA, 46 nt, Mus musculus
acaggaccaggucuuacaugucaauucauucuggugcaugugauag

SEQ ID NO: 36883 - RNA, 42 nt, Mus musculus
auucuagaaguaggggcucucagccugaguguuugccuggag

SEQ ID NO: 36884 - RNA, 45 nt, Mus musculus
cacccguuccauuuuaagauugcacaaaggacagccguuuuggag

SEQ ID NO: 36885 - RNA, 25 nt, Mus musculus
gcaggggagagaagggcuucugugg

SEQ ID NO: 36886 - RNA, 42 nt, Mus musculus
ugugagagagagagagagagagagagagaaagauggagagac

SEQ ID NO: 36887 - RNA, 41 nt, Mus musculus
aaucagggaaugcuucaggaguuuggagcacugagaccgug

SEQ ID NO: 36888 - RNA, 45 nt, Mus musculus
acagcagcugagucucugggagcaguaagggauagagucaugguu

SEQ ID NO: 36889 - RNA, 48 nt, Mus musculus
gcuucagugagaguuggcuggugcuggugcugggcuggccuuccuccc

SEQ ID NO: 36890 - RNA, 54 nt, Mus musculus
ugugaacagcaggcccagaagcaugacagggaccugcauggugguggaggaaga

SEQ ID NO: 36891 - RNA, 50 nt, Mus musculus
accugcugcuacucauucaccagcaagaugaucccaaugaguaggcugga

SEQ ID NO: 36892 - RNA, 48 nt, Mus musculus
agccuacucauugggaucaucuugcuggugaaugaguagcagcaggug

SEQ ID NO: 36893 - RNA, 48 nt, Mus musculus
ugcugaccccaagaaggaauggguccagacauacauuaaaaaccugga

SEQ ID NO: 36894 - RNA, 82 nt, Mus musculus
gaagcuaaugcauccacuaccuuuuccacaaccaccucaagcacuucuguaggagugaccagugugacagugaacuagugug

SEQ ID NO: 36895 - RNA, 46 nt, Mus musculus
ugguauucccuuucaugaauacuaaaauuucuuaaaugcaaggugu

SEQ ID NO: 36896 - RNA, 46 nt, Mus musculus
gccagcucucucacucucuuucuccaccaugaggaucucugccacg

SEQ ID NO: 36897 - RNA, 53 nt, Mus musculus
caccgcuguucuuucugagaacuguugaugaaauguguugaucacgguccuaa

SEQ ID NO: 36898 - RNA, 50 nt, Mus musculus
auauuuuuauuuaauuagccauguacuuuggugugauuugaauguaaagc

SEQ ID NO: 36899 - RNA, 42 nt, Mus musculus
acuggaguugaucuuaacccaauggacuuucccugugcugac

SEQ ID NO: 36900 - RNA, 45 nt, Mus musculus
gggaagggcaaacaguugggcuuuguuagguaaauaaagugcaga

SEQ ID NO: 36901 - RNA, 45 nt, Mus musculus
uuuuaauuaaaguagugccuuuuaauucagcaaaacuccugcggu

SEQ ID NO: 36902 - RNA, 67 nt, Mus musculus
aaacaugcacuuaaugugguaccacucuuucauaucacccccagacucugagaagggguugggcacc

SEQ ID NO: 36903 - RNA, 37 nt, Mus musculus
aaagcaaacugacuuguuaucaagaaggaaaucugug

SEQ ID NO: 36904 - RNA, 45 nt, Mus musculus
gcuuuguaacacaagccuguaaucuuaguccugagaagacaagac

SEQ ID NO: 36905 - RNA, 45 nt, Mus musculus
cgaggauugguacugguaauaaacgaagcaccuuucacuggagau

SEQ ID NO: 36906 - RNA, 42 nt, Mus musculus
agaguuuacuguccucuuacugaugaguccaaggcccgagag

SEQ ID NO: 36907 - RNA, 45 nt, Mus musculus
ugggggcuuaugccauuuuaugcaagcccccaaagagucccuaga

SEQ ID NO: 36908 - RNA, 48 nt, Mus musculus
gacaaucuuugugcuuagggucacauuuacuugcagacagacucguuc

SEQ ID NO: 36909 - RNA, 45 nt, Mus musculus
ggucuugguguuauagcuaggauuuucagccaccauggcgcacag

SEQ ID NO: 36910 - RNA, 41 nt, Mus musculus
gcugcugcucauccucuuuggugagcuuggagaggugcagg

SEQ ID NO: 36911 - RNA, 46 nt, Mus musculus
acagacacggacugagacacaguaagcacugagucaauccacagua

SEQ ID NO: 36912 - RNA, 46 nt, Mus musculus
ccuuccaagcccucucggaucacccgguuuaucaugucagccaggu

SEQ ID NO: 36913 - RNA, 41 nt, Mus musculus
cacagggaccaaaccacuaaccuuugcucccuugcccauag

SEQ ID NO: 36914 - RNA, 50 nt, Mus musculus
cuacagagaaacccugucucgaaaaaaccaagaggagggagagagagaga

SEQ ID NO: 36915 - RNA, 42 nt, Mus musculus
cagugcaccacuuuuggcugucagggucauagcagcccauga

SEQ ID NO: 36916 - RNA, 44 nt, Mus musculus
gcuuucugucagaaauaaaacagguggauuaucacuggccagga

SEQ ID NO: 36917 - RNA, 41 nt, Mus musculus
aaccaagaacaagaaggaagaggguaaggaacagcccugag

SEQ ID NO: 36918 - RNA, 23 nt, Mus musculus
gacaggacgggaggggaggggcu

SEQ ID NO: 36919 - RNA, 41 nt, Mus musculus
cccaagaucacaagaaugcauuggagaaacugugggacagu

SEQ ID NO: 36920 - RNA, 46 nt, Mus musculus
cuaaucuuuccaauuauucuguggauuuugcugauugcaccaagau

SEQ ID NO: 36921 - RNA, 47 nt, Mus musculus
uaugcuguugacuggaguccagauggccagagaguagcaagcggcgg

SEQ ID NO: 36922 - RNA, 45 nt, Mus musculus
cagcagugacagcacgcugaaggugugggaugugaaggcccagaa

SEQ ID NO: 36923 - RNA, 48 nt, Mus musculus
ccuuauuccugugguccccagcagaggacaagaagccccucgcccgga

SEQ ID NO: 36924 - RNA, 42 nt, Mus musculus
gcugaagccacagugaaugcccaagaccugcagggguccugu

SEQ ID NO: 36925 - RNA, 45 nt, Mus musculus
uucugcuucccaggaccgaaccaucaaagucuggagggcccauga

SEQ ID NO: 36926 - RNA, 50 nt, Mus musculus
uacaaccgcaggccgcugugaacgcauccucacgggacacacgcagucag

SEQ ID NO: 36927 - RNA, 46 nt, Mus musculus
cggggcugcaggugggcaggacccucacuggccacagcaaauggau

SEQ ID NO: 36928 - RNA, 46 nt, Mus musculus
cuuaggacaccggcacuggguccuuagcauauccugguccccagau

SEQ ID NO: 36929 - RNA, 42 nt, Mus musculus
ggucugaagacugcguagaggaguccuauacauggcauacuc

SEQ ID NO: 36930 - RNA, 46 nt, Mus musculus
cagccagagcuacacagagaaacccugucucaaaaaagccucugcc

SEQ ID NO: 36931 - RNA, 46 nt, Mus musculus
guuccggagacaccacugugcgcuucugggaucucagcacugagac

SEQ ID NO: 36932 - RNA, 42 nt, Mus musculus
gucauagacuuggggucuggacucacguugcaaguaacagac

SEQ ID NO: 36933 - RNA, 55 nt, Mus musculus
gucccagucuguggagacagagaaaaucgucgauaucaucuaccagccccaagcu

SEQ ID NO: 36934 - RNA, 42 nt, Mus musculus
acaucacgccggacaagcugcagcuggugugcaacgcgcugc

SEQ ID NO: 36935 - RNA, 46 nt, Mus musculus
auauacagccaccaaacccagaugauauuguggaugccagaaagug

SEQ ID NO: 36936 - RNA, 28 nt, Mus musculus
uacaggagaaacuaugaagacaaaguag

SEQ ID NO: 36937 - RNA, 45 nt, Mus musculus
agaucaggagucauagaugcaagcaucaccaacagaauacuagag

SEQ ID NO: 36938 - RNA, 42 nt, Mus musculus
accaaaucacaugaggcaacagcaagaacacaagcaacagau

SEQ ID NO: 36939 - RNA, 45 nt, Mus musculus
gacauaggcuaugggaacguugagaccauaaggacugaaaccaga

SEQ ID NO: 36940 - RNA, 42 nt, Mus musculus
aaaauagcuucuuuagcuucacacuuugaacauaccugagau

SEQ ID NO: 36941 - RNA, 46 nt, Mus musculus
uguauucuaaaaagggacuggaacauaaagucgaccugcagcagcg

SEQ ID NO: 36942 - RNA, 46 nt, Mus musculus
uaugcucuuuguuauucuaacucuucauuuaccgugucacacagag

SEQ ID NO: 36943 - RNA, 46 nt, Mus musculus
ugaaugcuuucuugcauguauguauuuacacuuuguacucauagag

SEQ ID NO: 36944 - RNA, 76 nt, Mus musculus
auccagggagccaggguggguugaugaggagagccaguugauagagagggagaaggggagacuaaggagcuggagg

SEQ ID NO: 36945 - RNA, 41 nt, Mus musculus
uggauuuuguuuuuuacuauguccgauugauuggcacagaa

SEQ ID NO: 36946 - RNA, 49 nt, Mus musculus
gacaaaucagggugcaauuaguaauagcaggaaaaugagaagcaggggu

SEQ ID NO: 36947 - RNA, 48 nt, Mus musculus
cagugucugucuacuaaguugucauuugguaaaacaagcauuagggau

SEQ ID NO: 36948 - RNA, 45 nt, Mus musculus
caaccacgucacagggagugaacagaagaagacuggggagagaga

SEQ ID NO: 36949 - RNA, 44 nt, Mus musculus
auauauaccaagcugugauaucucacuccauggcacacccuugg

SEQ ID NO: 36950 - RNA, 45 nt, Mus musculus
cauuuuggaaaccuggaagagaagaggggcuaggcggggcgagau

SEQ ID NO: 36951 - RNA, 59 nt, Mus musculus
ucuccugucugaagacccggauauuuucucagacuuggcgacacguuccuuuaaaagua

SEQ ID NO: 36952 - RNA, 65 nt, Mus musculus
ccgagguccagcacaccagaacuggaaccugagcagcccagaagccaggguggcaccacuguguc

SEQ ID NO: 36953 - RNA, 53 nt, Mus musculus
uuccauaaauuaguugguaaauagguacacuugggccggugacagaacacugg

SEQ ID NO: 36954 - RNA, 45 nt, Mus musculus
agaaaaagaagaacaagaagaagaagaagaagaagaacaagaaga

SEQ ID NO: 36955 - RNA, 45 nt, Mus musculus
agaagaacaagaacaacaagaagaagaagaacaagaagaagaaca

SEQ ID NO: 36956 - RNA, 42 nt, Mus musculus
gccagcaaccacaugguggcucacaaccaccuauaauaagau

SEQ ID NO: 36957 - RNA, 45 nt, Mus musculus; identical to SEQ ID NO: 36939

SEQ ID NO: 36958 - RNA, 46 nt, Mus musculus
aacugaacaauucacuuuggaagacaugguaaucuauguagcagau

SEQ ID NO: 36959 - RNA, 46 nt, Mus musculus
auacugucuggacauuuuucuuccuuugacaguuagggcagcagac

SEQ ID NO: 36960 - RNA, 46 nt, Mus musculus
gaagguugguggucauucugguuagccacgggaucaggaguaggau

SEQ ID NO: 36961 - RNA, 45 nt, Mus musculus
uaggaaauagcuucuuuagcuucacacuuugaacauacuugagau

SEQ ID NO: 36962 - RNA, 46 nt, Mus musculus
gccguuuaaucagcuuuuaaggauggagggaaagcauagggcagau

SEQ ID NO: 36963 - RNA, 43 nt, Mus musculus
ucaagguaagaauggacauuuuuuaccauuaagagaaagagau

SEQ ID NO: 36964 - RNA, 46 nt, Mus musculus
aucagggugcaauuaguaauaacaggaaaaugagaagcagggguca

SEQ ID NO: 36965 - RNA, 48 nt, Mus musculus
cgugcccagacuugaccaucuacgcaggagaagugacuaucggagaag

SEQ ID NO: 36966 - RNA, 44 nt, Mus musculus; identical to SEQ ID NO: 36949

SEQ ID NO: 36967 - RNA, 61 nt, Mus musculus
gugucucuccugucugaagacccggauauuuucucagacuuggcgacgcguuccuuuaaaa

SEQ ID NO: 36968 - RNA, 87 nt, Mus musculus
ucaguuucacuguaauucugagaccuuuccagucaccgguagccuuggcaaugucaucgccaacuuucuucggagacagacccagag

SEQ ID NO: 36969 - RNA, 60 nt, Mus musculus
gaccgaucuucggggccaaggcggauguggcgccgaccucgccuccggugcaccucaggu

SEQ ID NO: 36970 - RNA, 45 nt, Mus musculus
aggucugugccaugguguaucccugagaaaauaugucaugcaaca

SEQ ID NO: 36971 - RNA, 79 nt, Mus musculus
aaauaugcuaagcugggucuaaaucucggagcaaucacuuuuggagagaaggauaggaagaaaaugaagaauucucacc

SEQ ID NO: 36972 - RNA, 46 nt, Mus musculus
agaaaagcacauccggcagcugccugucacucacuucugugaggag

SEQ ID NO: 36973 - RNA, 45 nt, Mus musculus
aguauucgcugcagagcccgaguccuggcauguggaaggcggcug

SEQ ID NO: 36974 - RNA, 46 nt, Mus musculus
acauugaaacaucggcauggaaguuucuucuaggagccugccccca

SEQ ID NO: 36975 - RNA, 45 nt, Mus musculus
cggguccccagaaaauggcggcagagguaguuugcagagucaucu

SEQ ID NO: 36976 - RNA, 77 nt, Mus musculus
aagaaagaaaacaugacugguccugguuuucggcgccauguguaugagaaaaagaaauaaaaagaaaggaagaggac

SEQ ID NO: 36977 - RNA, 42 nt, Mus musculus
uuggagcguccagaaugaacaugucccuagcuuuuuuaggag

SEQ ID NO: 36978 - RNA, 41 nt, Mus musculus
aguggcuggccaugagcacguggagaguagggaggggaaug

SEQ ID NO: 36979 - RNA, 46 nt, Mus musculus
ucauggaauuugucccaccgguuagcacaaccacaucaagaggcag

SEQ ID NO: 36980 - RNA, 64 nt, Mus musculus
aguaaaguuaggcuaagaugcuuuugcuagcggcuuggaaguagaaaaccguggggaacaauug

SEQ ID NO: 36981 - RNA, 45 nt, Mus musculus
auuuugcugggacauacaauaugugugagaaaaauaaaguuguug

SEQ ID NO: 36982 - RNA, 46 nt, Mus musculus
gacuaugcugaacugguucuguuuauuggagaaaucacacuuggag

SEQ ID NO: 36983 - RNA, 84 nt, Mus musculus
uacaggcugugugcacccagcugaauucuggagggggcgugaucaaggcucacauuaaaaaucaaaacuacagcuucaccagag

SEQ ID NO: 36984 - RNA, 79 nt, Mus musculus
uucgcugcagagcccgaguccuggcacguggaaggcggcugugugaagagguuuaccacagaggaaugggugaagcgcc

SEQ ID NO: 36985 - RNA, 23 nt, Mus musculus
ucuaccccaucccuggagcucug

SEQ ID NO: 36986 - RNA, 46 nt, Mus musculus
auuaaucgagauaagguuuccuguguaaaguggcagcaguauggag

SEQ ID NO: 36987 - RNA, 46 nt, Mus musculus
ucuguaagauucguuaggauuauguuauuaacuaguuaagggguaa

SEQ ID NO: 36988 - RNA, 46 nt, Mus musculus
uugaauuacugauacuuucauguuuuccuucuuagguccaggugag

SEQ ID NO: 36989 - RNA, 45 nt, Mus musculus
aauauucaccaagcaucaacuauaugcaggccuggggccagagau

SEQ ID NO: 36990 - RNA, 41 nt, Mus musculus
gaggcaggugauuacuguaaaaagaugcuauuugugucaag

SEQ ID NO: 36991 - RNA, 46 nt, Mus musculus
uugucuuugaguaauuguuggguuuuuuuucgguuucucagcagau

SEQ ID NO: 36992 - RNA, 41 nt, Mus musculus
gaguucagaggugccuaagcacccugaagcaaggcccaaga

SEQ ID NO: 36993 - RNA, 45 nt, Mus musculus
uaacauaacuaucaguuagaagaaaagggaaauugggagggagaa

SEQ ID NO: 36994 - RNA, 45 nt, Mus musculus
acucuugauguucugauaggacacaagcuggaguuaucacagaga

SEQ ID NO: 36995 - RNA, 46 nt, Mus musculus
gcagguagcaagccuggagauguagucagaugguggcgaaucagau

SEQ ID NO: 36996 - RNA, 42 nt, Mus musculus
gcacugaaaagcagccuaccucugaguguggagccucccucc

SEQ ID NO: 36997 - RNA, 45 nt, Mus musculus
acaagccggcuguuucacggugggcuugcgacauucaucauagua

SEQ ID NO: 36998 - RNA, 45 nt, Mus musculus
gugggugaauaugccugggaugcugauugugccuguccugguguu

SEQ ID NO: 36999 - RNA, 44 nt, Mus musculus
uagaaaggccuaggagaaguggaacaugagaaaacacccacaga

SEQ ID NO: 37000 - RNA, 46 nt, Mus musculus
aucgcaggaugaugccaaggacucugaaagugccaacgucucagau

SEQ ID NO: 37001 - RNA, 45 nt, Mus musculus
ggcacggaggcucucggagucaggguuuguuuacucaccgcgaga

SEQ ID NO: 37002 - RNA, 42 nt, Mus musculus
gggaagcuuguucagguuaaaucaaucagaaaacgggagggg

SEQ ID NO: 37003 - RNA, 47 nt, Mus musculus
cauggucagaccuggaaacaaggagucugaaaugcccacugugggag

SEQ ID NO: 37004 - RNA, 24 nt, Mus musculus
ccacaugugugccugguggcccag

SEQ ID NO: 37005 - RNA, 45 nt, Mus musculus
ggauagagcaaugccccuucuagguacaucccuuuccuaggucaa

SEQ ID NO: 37006 - RNA, 42 nt, Mus musculus
ggacucgguggccacacaugcuggguggaagaaggggaaggg

SEQ ID NO: 37007 - RNA, 42 nt, Mus musculus
acugcaguggaacaacuaaccuggauuugagcaggggccacc

SEQ ID NO: 37008 - RNA, 42 nt, Mus musculus
aguucaaggccauccuuuaguagagagugaauuccaggccaa

SEQ ID NO: 37009 - RNA, 67 nt, Mus musculus
cugcuuuuccagaggaccccaguuuucagcaccuauuugacuacuuacaacuguaauugguugcaga

SEQ ID NO: 37010 - RNA, 46 nt, Mus musculus
ugacuccuccguagcugauuuccucaacagugaugaggaagaagac

SEQ ID NO: 37011 - RNA, 46 nt, Mus musculus
gguauggccuuuagaagggacuuucguggagaugcaccccgcagau

SEQ ID NO: 37012 - RNA, 45 nt, Mus musculus
ggaccaacguugaucugucgguccgucucagaaccccacguagac

SEQ ID NO: 37013 - RNA, 46 nt, Mus musculus
cagcaugugccgcguguauaaguagucccacauucucaccccagua

SEQ ID NO: 37014 - RNA, 42 nt, Mus musculus
cagccucagcuaacaauuaccuuucccagauuccggggaauu

SEQ ID NO: 37015 - RNA, 45 nt, Mus musculus
caggacagacaccuuaaaugguggcuuguaucacaggcugugcuu

SEQ ID NO: 37016 - RNA, 42 nt, Mus musculus
caggaucuaggagcacagacaagcucucuagaccucaacuaa

SEQ ID NO: 37017 - RNA, 46 nt, Mus musculus
augacaugaaucaguaugaaaaugcugagaaacuguaccugcgguc

SEQ ID NO: 37018 - RNA, 45 nt, Mus musculus
acuuauucuagaggagauugcgauugacugucacaacaaggagac

SEQ ID NO: 37019 - RNA, 46 nt, Mus musculus
acuuucuguuaaugucauaacauguguuguuuaacuaaagagagac

SEQ ID NO: 37020 - RNA, 46 nt, Mus musculus
aaaucccagaaaccauauggugacucacaaccacccauaaugagau

SEQ ID NO: 37021 - RNA, 84 nt, Mus musculus
aagaggguugcuauggggauggcagaaaaugaugucagagagguggcagggagacugaguuuuauagaccauaaugcagacuuu

SEQ ID NO: 37022 - RNA, 85 nt, Mus musculus
agugacagugaaccaccagcauguggaggggaaaaucccacagagaaggaagagcagaugcuggagguguguguggcucggggcu

SEQ ID NO: 37023 - RNA, 56 nt, Mus musculus
uuauguccagagcgacaaaucuauagccagaaagggaaugauccucagaggugggg

SEQ ID NO: 37024 - RNA, 46 nt, Mus musculus
caagacaccuuucuccagaaaaacccaaacauuuccaaaggcagac

SEQ ID NO: 37025 - RNA, 46 nt, Mus musculus
agacuauugccaauguuaacaaaguauucacuguauagccccuaac

SEQ ID NO: 37026 - RNA, 42 nt, Mus musculus
aacucugugagcaccccuuucuuucuccuguaggccccacca

SEQ ID NO: 37027 - RNA, 36 nt, Mus musculus
ccugucucagauauaaaggagagagugaguagaaga

SEQ ID NO: 37028 - RNA, 42 nt, Mus musculus
cugauugguauugcaaacuuuauaugccucaguacaggggaa

SEQ ID NO: 37029 - RNA, 46 nt, Mus musculus
uccucucagaugacuuaucccugucaaacugacauaaaaacuagau

SEQ ID NO: 37030 - RNA, 46 nt, Mus musculus
ugcuucaugugcgaaauggaaauuguaaauaucaucuaggugaaga

SEQ ID NO: 37031 - RNA, 46 nt, Mus musculus
auacuuguucuguguauacaugagaucacuccauuacccaggcuga

SEQ ID NO: 37032 - RNA, 46 nt, Mus musculus
uuuuaggcaauuauuuauucaaauuauuuccuccuucuguccagau

SEQ ID NO: 37033 - RNA, 46 nt, Mus musculus
aauguuuuuaaccauaauugucgugcaucaaauucacagccagaau

SEQ ID NO: 37034 - RNA, 76 nt, Mus musculus
acugauagccugucucaguuuguucuaauuucucacuacguauuugcagauucaggacugcagaccuucccuagau

SEQ ID NO: 37035 - RNA, 45 nt, Mus musculus
acaggauauuuuaaggcuuggagucaaaguauuuuuccagcacag

SEQ ID NO: 37036 - RNA, 45 nt, Mus musculus
uccuuccacccugugggucccugugacugaguucccguuaucaga

SEQ ID NO: 37037 - RNA, 42 nt, Mus musculus
cuugcacuagcuaccacucuacaguggagcucacccccaggc

SEQ ID NO: 37038 - RNA, 42 nt, Mus musculus
agcugcuaggcuccugcuucuuccagguucccccugucagac

SEQ ID NO: 37039 - RNA, 61 nt, Mus musculus
auggcagcagcuaggcagacaugaugcuggaggaucugagaguucuacaucuuuaucggaa

SEQ ID NO: 37040 - RNA, 46 nt, Mus musculus
cuccagcugcccccacugccccccagccuccccggugcugggauua

SEQ ID NO: 37041 - RNA, 45 nt, Mus musculus
uuugucucugagaacuucaugaguuucauaacagauuuguuuggu

SEQ ID NO: 37042 - RNA, 46 nt, Mus musculus
cugauguaaauagugagauccugguauuauugucauguccucguua

SEQ ID NO: 37043 - RNA, 61 nt, Mus musculus
uccguacaaccauaaaauaaacuuuucauguuaaauuaaacacauacauagaauaggguga

SEQ ID NO: 37044 - RNA, 74 nt, Mus musculus
uaagccaucuucagcuucucuucccugcuagaaguagagugcuugccagcauguugaggucuucucuagcugga

SEQ ID NO: 37045 - RNA, 42 nt, Mus musculus
uuccauguauccauauauacaccugaguauggaggccagaca

SEQ ID NO: 37046 - RNA, 49 nt, Mus musculus
ggacaacacucaauguuguccucugugucccaugugcccagucaaaaua

SEQ ID NO: 37047 - RNA, 46 nt, Mus musculus
uggucaacucugcucacucagucccugcuugcuccggcccaaagau

SEQ ID NO: 37048 - RNA, 46 nt, Mus musculus
aggacaaauuaauuuguuuugcucaaccuggaaaacugcugcagua

SEQ ID NO: 37049 - RNA, 46 nt, Mus musculus
gauuaguuaguugucucccagcaguguaauuugauauuuagcagau

SEQ ID NO: 37050 - RNA, 46 nt, Mus musculus
uacuaauagauuaguaauagacuggaucuuuagaaaggacgcagug

SEQ ID NO: 37051 - RNA, 42 nt, Mus musculus
cuugggagguauagaaacuguuguugaaaggcaggccagcau

SEQ ID NO: 37052 - RNA, 33 nt, Mus musculus
uucucggaccagggcgggaggaaguacauggag

SEQ ID NO: 37053 - RNA, 45 nt, Mus musculus
ugugcgcugccauccgcaaagguuuccucgccugucaccucgcca

SEQ ID NO: 37054 - RNA, 46 nt, Mus musculus
ccucuguucauuuugcuuguguguuuucaugacugacaaaugcuag

SEQ ID NO: 37055 - RNA, 41 nt, Mus musculus
ggucaaggcgacacauggcacuugccugcagucccagcccu

SEQ ID NO: 37056 - RNA, 41 nt, Mus musculus
auuagcuucuuuuggagaccucucuggcucucugggcacuu

SEQ ID NO: 37057 - RNA, 47 nt, Mus musculus
agggaugauucugugaauuguagcugguacuuuacaacaguaggagg

SEQ ID NO: 37058 - RNA, 46 nt, Mus musculus
aauuugccuucuucaguauguauguaaaguaauggguuacuaaaag

SEQ ID NO: 37059 - RNA, 44 nt, Mus musculus
aucaugucugcugagcuguugggcaaauucuagugcuuuuguga

SEQ ID NO: 37060 - RNA, 45 nt, Mus musculus
gaaaagcucaaguaaaaauauucaguuuaagaucaugcgcuggua

SEQ ID NO: 37061 - RNA, 43 nt, Mus musculus
ugaguucuugaagcucucugcaaugcugcugcuaucagguggg

SEQ ID NO: 37062 - RNA, 42 nt, Mus musculus
cacccacguccuugcgccccucguccuuccuccgggccucgg

SEQ ID NO: 37063 - RNA, 45 nt, Mus musculus
aggcuugcaagccccacugugcacuucagaccuggcaccucaggu

SEQ ID NO: 37064 - RNA, 45 nt, Mus musculus
agaaaaaaggaugaucgagucucuugcuugcucgccugcccaggg

SEQ ID NO: 37065 - RNA, 42 nt, Mus musculus
cggcugcggcggcggcagcugcagcgcugguggcggguaaag

SEQ ID NO: 37066 - RNA, 56 nt, Mus musculus
ugcugaaugguuugguggccacugagguguggaugugguuuuauaucggagagauc

SEQ ID NO: 37067 - RNA, 46 nt, Mus musculus
uucuuggaccauguguaacaggacugcuaucugaauaaaauacuag

SEQ ID NO: 37068 - RNA, 44 nt, Mus musculus
ggcggggccaaaggcccugcagcuugagcugcaugaggagagag

SEQ ID NO: 37069 - RNA, 42 nt, Mus musculus
aacuggcgaaaggccuccaugagucucucuaggaaggcagag

SEQ ID NO: 37070 - RNA, 42 nt, Mus musculus
ucaguuucucaauuguucacuuccuugagguccugggcaggu

SEQ ID NO: 37071 - RNA, 46 nt, Mus musculus
uccaugucuuugaccaggauagcaaccaaggccacgaucgggaggc

SEQ ID NO: 37072 - RNA, 44 nt, Mus musculus
uccuuauaaagccuaagaccccagguguauccuuuuguccauuc

SEQ ID NO: 37073 - RNA, 46 nt, Mus musculus
ggaacaaaaguuaaaagcaacaucaggauuagcaauggucccagaa

SEQ ID NO: 37074 - RNA, 46 nt, Mus musculus
auuagucauaauccuucuguacccaaagucuuauuucuggcaagau

SEQ ID NO: 37075 - RNA, 46 nt, Mus musculus
uuuccaaaagggguacuguaagacccuuagagccuuacguccaggg

SEQ ID NO: 37076 - RNA, 46 nt, Mus musculus
gcugacuuuuucagcccucuguuaggagcuucacguuuaaggagau

SEQ ID NO: 37077 - RNA, 41 nt, Mus musculus
ucugcacaaccggugugauccacuugugagaacugggugaa

SEQ ID NO: 37078 - RNA, 46 nt, Mus musculus
ucagugccuuaucuguugccuguuacaccaaauguacauugcagau

SEQ ID NO: 37079 - RNA, 45 nt, Mus musculus
uguacauuuaugucugugcagcauuuguaugcaguggccuuagaa

SEQ ID NO: 37080 - RNA, 46 nt, Mus musculus
cccaggucacagagcuuuuauggcaagugccuuuaccugcagaguc

SEQ ID NO: 37081 - RNA, 42 nt, Mus musculus
uagaccaggcugucuucaaacuacagaaaaucacaaccaggu

SEQ ID NO: 37082 - RNA, 46 nt, Mus musculus
uauacccagaaugauuugaugauagauccucucauugucuugaggu

SEQ ID NO: 37083 - RNA, 46 nt, Mus musculus
caggacagccagaucuacauagugagacccugucucgaaaacagaa

SEQ ID NO: 37084 - RNA, 45 nt, Mus musculus
aaaucccagcaaccacaugguggcucacaaccacccacagugaga

SEQ ID NO: 37085 - RNA, 38 nt, Mus musculus
ccacagguacggugcccacugaucuucuggaauuaaga

SEQ ID NO: 37086 - RNA, 45 nt, Mus musculus
aggacccagugcuauagaccaugagaagagacugcuuuggggagu

SEQ ID NO: 37087 - RNA, 24 nt, Mus musculus
uuguuauguguuuuaaugcuguug

SEQ ID NO: 37088 - RNA, 46 nt, Mus musculus
agccaagcuccuuaagcaggaugaagaccaucuucacacaggagau

SEQ ID NO: 37089 - RNA, 46 nt, Mus musculus
uagagaagaaaaaaaccuccuaggaaaaauaauuucagggcuggag

SEQ ID NO: 37090 - RNA, 42 nt, Mus musculus
uguggagauggaaccuaccgugucgguguacucggggcugaa

SEQ ID NO: 37091 - RNA, 46 nt, Mus musculus
cagagaaaacgggagaccagugguuccgugcuuuggcagaugagaa

SEQ ID NO: 37092 - RNA, 46 nt, Mus musculus
auuuauucauuuuuuagauacaguucagaauauucacaguauaggg

SEQ ID NO: 37093 - RNA, 42 nt, Mus musculus
uuugacauuggaucauacuaaaaccgaagcuugugaggaugg

SEQ ID NO: 37094 - RNA, 46 nt, Mus musculus
ucauuuuuuaucauauauuugaguaauguguauuauaaguccagau

SEQ ID NO: 37095 - RNA, 24 nt, Mus musculus
ggcucaacaagagcaguauuaucu

SEQ ID NO: 37096 - RNA, 26 nt, Mus musculus
gcacuguugucuguggacuuccacgc

SEQ ID NO: 37097 - RNA, 46 nt, Mus musculus
cuuuaauugugccaacaacauugccaaugcaaggaccuacuaagua

SEQ ID NO: 37098 - RNA, 46 nt, Mus musculus
cccaagugagacucucuuuaacuccuucagcugacuguacauacac

SEQ ID NO: 37099 - RNA, 23 nt, Mus musculus
agcgucggcuucucgggcccaag

SEQ ID NO: 37100 - RNA, 45 nt, Mus musculus
auuacagacuguuagcugccuugugaacucugguccucuggaaga

SEQ ID NO: 37101 - RNA, 42 nt, Mus musculus
ugccugcauauucuguguacaauaugucuucagugcccauag

SEQ ID NO: 37102 - RNA, 45 nt, Mus musculus
ccuccauugggcucccugcucacucugaugaauuggcugcuagau

SEQ ID NO: 37103 - RNA, 45 nt, Mus musculus
ugugagccaccaugugguugcugggaauugaacucaggacugcaa

SEQ ID NO: 37104 - RNA, 47 nt, Mus musculus
uaaaaaaaaguacuccccuccuccccacccuccaauacuggcccaga

SEQ ID NO: 37105 - RNA, 46 nt, Mus musculus
acuuaagcaaaaguuaugaucauuuaaaaacuuucucccaagaguu

SEQ ID NO: 37106 - RNA, 46 nt, Mus musculus
aagucuuuaaaugcuaucgcauccuagacccucuucccaccuacua

SEQ ID NO: 37107 - RNA, 46 nt, Mus musculus
acuguaauaucaaaauacuaugucgaauuauuucagauguucagau

SEQ ID NO: 37108 - RNA, 24 nt, Mus musculus
ucaauugucaguauggcacagauc

SEQ ID NO: 37109 - RNA, 44 nt, Mus musculus
ccuguuuugugugcaguuaauccauucugaagcaggugaaaggu

SEQ ID NO: 37110 - RNA, 50 nt, Mus musculus
cacaucagauuuugcucaaauaggagguaacuaaauagccauuagaagaa

SEQ ID NO: 37111 - RNA, 41 nt, Mus musculus
cuaggaaucaggaacuagucccaaauauacaggauugaguc

SEQ ID NO: 37112 - RNA, 45 nt, Mus musculus
uuuuacuuuuuauuuuuaaauuaaagauugggaaugcgugugaga

SEQ ID NO: 37113 - RNA, 45 nt, Mus musculus
aauuuguauugucucaauguacaguuuaacagggauagaggggaa

SEQ ID NO: 37114 - RNA, 42 nt, Mus musculus
uuacuucaacaaauauuguuuugacuuggggggcggggcuau

SEQ ID NO: 37115 - RNA, 42 nt, Mus musculus
cgcaaggaaagaacgggaagaaaggauauuuugcugcaagau

SEQ ID NO: 37116 - RNA, 46 nt, Mus musculus
ggguucaguguuuccuuaaucauuugcuuuauagacuugggcagau

SEQ ID NO: 37117 - RNA, 46 nt, Mus musculus
gguucuggucagcaugcccucaagcacaauaucaaugcccccuuuu

SEQ ID NO: 37118 - RNA, 46 nt, Mus musculus
uuaguauaugaaauuaaaaacuuucccuuugaaauuagcaagaggu

SEQ ID NO: 37119 - RNA, 45 nt, Mus musculus
uagugguacaggauccaugucugcacaagcaaguacgguucagag

SEQ ID NO: 37120 - RNA, 55 nt, Mus musculus
ugacuucagguguucccauaucuacuucaguugccacagcuaauucaacuuugac

SEQ ID NO: 37121 - RNA, 47 nt, Mus musculus
cguuggacagcucucugcucucccagccaaauuuaguugccccucca

SEQ ID NO: 37122 - RNA, 45 nt, Mus musculus
augaagcauuuuccaaauugaagcuguaugcacaagucugcagau

SEQ ID NO: 37123 - RNA, 42 nt, Mus musculus
gcuacugcaucaaagaaacuuucagaaaaguuuguaacagaa

SEQ ID NO: 37124 - RNA, 66 nt, Mus musculus
cauauguauuuggguagcugaaacaggagacucgcuagaacuaugucuuggaaaaaauguauuacc

SEQ ID NO: 37125 - RNA, 63 nt, Mus musculus
uuuuauguuuaaaguguacugggagauucuaugggcugaugaagaaugcugauguugacagua

SEQ ID NO: 37126 - RNA, 58 nt, Mus musculus
ucuguccagagaaugaagcuuuguuaaauggagccagaagcuuuuuuagagaucucac

SEQ ID NO: 37127 - RNA, 46 nt, Mus musculus
ucuccaaacccacaccaguacuugcaaucuauuuuuuauugaagac

SEQ ID NO: 37128 - RNA, 46 nt, Mus musculus
gugagccaugucuuuagcccgauuuuuucccccuuccguucagauu

SEQ ID NO: 37129 - RNA, 46 nt, Mus musculus
auccuuaugugcuauuuuagaaauauggucagacauguuagggggg

SEQ ID NO: 37130 - RNA, 45 nt, Mus musculus
ggaagucagccuugucuacauauggaguuucaggauagccaagac

SEQ ID NO: 37131 - RNA, 45 nt, Mus musculus
ugaagcacuugucagaagcucaugcuuacauccgugggccaagca

SEQ ID NO: 37132 - RNA, 60 nt, Mus musculus
agcgggacuguuguagugacugcugccucgccuuagaacaugggcgucaguucauggaua

SEQ ID NO: 37133 - RNA, 46 nt, Mus musculus
ggaaucugaaaaggugccugaugaauuaauauuacugcuacaagau

SEQ ID NO: 37134 - RNA, 46 nt, Mus musculus
cagaaaaacguuuugaagcucucagggcuuccucuguggagaaugu

SEQ ID NO: 37135 - RNA, 42 nt, Mus musculus
aaccaaaccucugaaccuauggccccccaaaaugcagcaaau

SEQ ID NO: 37136 - RNA, 45 nt, Mus musculus
gcacugcagaccuccacaaaauguaccccacgccacccucacugg

SEQ ID NO: 37137 - RNA, 35 nt, Mus musculus
cuggauaugguugcacaugccuuuaaaccccgguc

SEQ ID NO: 37138 - RNA, 42 nt, Mus musculus
cccagcaaccacauaguggcucacaaccauccuuaaugagau

SEQ ID NO: 37139 - RNA, 46 nt, Mus musculus
acacacacauacacacacacacacacacacacacacaauaacggaa

SEQ ID NO: 37140 - RNA, 46 nt, Mus musculus
aauccuggacuuuguauugaggcucaaaagaauuugguacugagua

SEQ ID NO: 37141 - RNA, 45 nt, Mus musculus
agaggcuauggagaagcaucaggugaaguuggagaggagagaaga

SEQ ID NO: 37142 - RNA, 41 nt, Mus musculus
uggaggaaguaaaggagauggguagacaaacauugcaagca

SEQ ID NO: 37143 - RNA, 26 nt, Mus musculus
gcuucuauucuaaugagaguuugaaa

SEQ ID NO: 37144 - RNA, 45 nt, Mus musculus
ccaccucuggccuagagauuuaaaaguuaaagauagcccuugugc

SEQ ID NO: 37145 - RNA, 46 nt, Mus musculus
gguggugugcuugaagcuaggucucucugagacugcaguugcaggu

SEQ ID NO: 37146 - RNA, 46 nt, Mus musculus
acaaaaaacgaggagcggggaguguuuguguguguguguuugagag

SEQ ID NO: 37147 - RNA, 46 nt, Mus musculus
gucauguauuucauuacucuuuuuuaaucuuuucuucccuuaagau

SEQ ID NO: 37148 - RNA, 42 nt, Mus musculus
guugcaucuccugaaguugcagacaguugugagccaccaugu

SEQ ID NO: 37149 - RNA, 41 nt, Mus musculus
cgccacuaccacccggccuuuauagacaauuuauuaugagu

SEQ ID NO: 37150 - RNA, 46 nt, Mus musculus
auuucaggaagcuguagaaccuaccguguauguugguacagcagua

SEQ ID NO: 37151 - RNA, 46 nt, Mus musculus
cucucaagcccugggauuaaaggugcccaucaccaugcccuaaguc

SEQ ID NO: 37152 - RNA, 42 nt, Mus musculus
cuuaaguccauuuggacuaaauggcacucucacgggacaggc

SEQ ID NO: 37153 - RNA, 45 nt, Mus musculus
uuauuuuauugccauaggcauuugauuucuuauucucauuucagu

SEQ ID NO: 37154 - RNA, 44 nt, Mus musculus
agaaacccugucucgaaaaacaaaaagaaagagagagagagaga

SEQ ID NO: 37155 - RNA, 46 nt, Mus musculus
agccauuuugcugauugggcaguuaaguuuguauauuuggcaagau

SEQ ID NO: 37156 - RNA, 45 nt, Mus musculus
acuugauuuguagacuaggcugaccuugaacuccugaugucugau

SEQ ID NO: 37157 - RNA, 46 nt, Mus musculus
uaucuuaugucuucuuaaaacuuagcaguaguuauaaugcaaagau

SEQ ID NO: 37158 - RNA, 46 nt, Mus musculus
uuccauguguucccaccuccuuucuuuccuuguuacagugcuggug

SEQ ID NO: 37159 - RNA, 45 nt, Mus musculus
aaauuuuuugaguaucacuggugguuaagauuucuaauaccaaua

SEQ ID NO: 37160 - RNA, 46 nt, Mus musculus
uagucgaugccuuaaggcagauguacuugguguuuggcggcgagau

SEQ ID NO: 37161 - RNA, 45 nt, Mus musculus
aaaucucauuaugggugguugugagccaccaugugguggcuggaa

SEQ ID NO: 37162 - RNA, 45 nt, Mus musculus
acaaaaucaauccucuuccuuugaggugaaagcaaagggcaaaag

SEQ ID NO: 37163 - RNA, 46 nt, Mus musculus
ggauugacccagaccuugcuuauucaaauuguaauugaagugagau

SEQ ID NO: 37164 - RNA, 46 nt, Mus musculus
gucucaaagagucagugucauuaccuggaaugcuuucgauggagga

SEQ ID NO: 37165 - RNA, 46 nt, Mus musculus
ugcggaugaaucuaugaugaaacaaugcuuuuauuaaugcaaaauc

SEQ ID NO: 37166 - RNA, 46 nt, Mus musculus
auacccaauggaaacaagugggauagagcagauggaugugacagug

SEQ ID NO: 37167 - RNA, 58 nt, Mus musculus
uuaacaguauaugucauuaagggcuuaaaggucaaguguagagguaaagaggccaguu

SEQ ID NO: 37168 - RNA, 82 nt, Mus musculus
uaaauaaggaaaauggccagcaaauugggaaaguauuuuaagugcaauaggaagucauuuuuaagugggagaguaaaaugag

SEQ ID NO: 37169 - RNA, 42 nt, Mus musculus
uguauaauacauguaauacagacuuguuccuuccugacagaa

SEQ ID NO: 37170 - RNA, 45 nt, Mus musculus
ucauaucugccuaauauaggcauaacaucuacucacaccaaguau

SEQ ID NO: 37171 - RNA, 85 nt, Mus musculus
agaggaugugagucaguuugauucaaaguuuacacgucagacaccuguugacagcccugaugacuccacucucagugaaagugcc

SEQ ID NO: 37172 - RNA, 45 nt, Mus musculus
aggcucaagagucaaacuccgagcuucaguccugccacagaaccc

SEQ ID NO: 37173 - RNA, 45 nt, Mus musculus
uguaacuggugaaaagucccuguuccagccaagcccaucccccag

SEQ ID NO: 37174 - RNA, 28 nt, Mus musculus
gcuccagguaagucucgacuccuucuag

SEQ ID NO: 37175 - RNA, 46 nt, Mus musculus
cuuagagguggcauugauacgcuacccuagcgugaaaaaaauggag

SEQ ID NO: 37176 - RNA, 46 nt, Mus musculus
uaugcaccuaugcuacacacacacacauacacacacacacacacac

SEQ ID NO: 37177 - RNA, 45 nt, Mus musculus
cuaugaauaaucaaagcacauauacagacucuaacacacuuguaa

SEQ ID NO: 37178 - RNA, 42 nt, Mus musculus
ggcaggagacauacacagaaacgaggucagcuugggcuauag

SEQ ID NO: 37179 - RNA, 45 nt, Mus musculus
ugguugugagccaccaugugguuguugggauuugaacucagggcu

SEQ ID NO: 37180 - RNA, 60 nt, Mus musculus
ucuugggagagaguggggaauacaaaaugauucuugugguucgaacugaccuuaaaaugg

SEQ ID NO: 37181 - RNA, 45 nt, Mus musculus
gaguacuguggccagcccaaagugguggucaaagcuccagaugaa

SEQ ID NO: 37182 - RNA, 45 nt, Mus musculus
cuugggacugacuguaaguuuaauccaagaugcuggacguacuca

SEQ ID NO: 37183 - RNA, 42 nt, Mus musculus
uaaaugguacaggaccaaucgcaacacugaaugaugccacag

SEQ ID NO: 37184 - RNA, 46 nt, Mus musculus
gcauugauugaacucagugcacuguuaugaaagagaucaaccugag

SEQ ID NO: 37185 - RNA, 46 nt, Mus musculus
uaaaauaaauuacuggacuguggaaauaacauguagaauugcaguu

SEQ ID NO: 37186 - RNA, 47 nt, Mus musculus
gguuuguguauguuggauauugugguguuuuagaucacugaguguac

SEQ ID NO: 37187 - RNA, 85 nt, Mus musculus
uccucauguugugcuguauccugugcuuuuucugugggaccauuccauucaggaacaagaagcaccaugauuccacgcgugugua

SEQ ID NO: 37188 - RNA, 46 nt, Mus musculus
gccaaauagcggguauuucacaugauccuuacauuccaugguaguc

SEQ ID NO: 37189 - RNA, 49 nt, Mus musculus
uuuggagcuugucucuuuaccuguuaugaucucuuaaggccagaugucg

SEQ ID NO: 37190 - RNA, 26 nt, Mus musculus
ccucugaaucuaaagacacagaauug

SEQ ID NO: 37191 - RNA, 46 nt, Mus musculus
aucugugaaugaaucacugaacaaccucuuuauuacugaagaagau

SEQ ID NO: 37192 - RNA, 46 nt, Mus musculus
gacaaugccaucauuaccaugaugaaucaccccaccgaugcaugga

SEQ ID NO: 37193 - RNA, 56 nt, Mus musculus
cucacaugggaauguucacagagcuagcuauuuuguauucuaaauucaagccacag

SEQ ID NO: 37194 - RNA, 46 nt, Mus musculus
ggauauuuugaagaacucaucaccauguuggaggcagccuugggac

SEQ ID NO: 37195 - RNA, 42 nt, Mus musculus
uggacuccauauuguggugcaugcagaugaauuagaggagcu

SEQ ID NO: 37196 - RNA, 46 nt, Mus musculus
uuggugaccguuguuaugaugaaaaaauguaugaugcugcuaaguu

SEQ ID NO: 37197 - RNA, 45 nt, Mus musculus
gacagaauugauauuugcacuggcuaaaacaaaccgccuugcaga

SEQ ID NO: 37198 - RNA, 45 nt, Mus musculus
ugggaagaauuggugaaguauuugcagauggcacgcaagaaggcu

SEQ ID NO: 37199 - RNA, 81 nt, Mus musculus
uaauuaugaugcuccagauauugccaacauugccaucagcaaugagcuguuugaagaggcauuugcuauuuuccggaaguu

SEQ ID NO: 37200 - RNA, 41 nt, Mus musculus
gcugaccgaacacguguuauggaguauauuaaccgccugga

SEQ ID NO: 37201 - RNA, 45 nt, Mus musculus
acagacagccuugucugaaacucaggacccagaagaagugucagu

SEQ ID NO: 37202 - RNA, 76 nt, Mus musculus
ucucgcuacuuaguccgucgaaaggauccagaauugugggguagugugcuacuggaaagcaauccauacagaagac

SEQ ID NO: 37203 - RNA, 46 nt, Mus musculus
uaauuaaaguauuuauuacuugugcacaaguauguagaagucagag

SEQ ID NO: 37204 - RNA, 46 nt, Mus musculus
cccagagagauuucuucgugaaaacccuuauuaugacagucguguu

SEQ ID NO: 37205 - RNA, 47 nt, Mus musculus
ggaggcaaaacuaacagaucaguugccacuuaucauugucugugauc

SEQ ID NO: 37206 - RNA, 45 nt, Mus musculus
gauuguuagaggcuagguguuuugguauuauuagagcuugguauu

SEQ ID NO: 37207 - RNA, 45 nt, Mus musculus
uguggaauauaacaggacauguaucagguaauugccccacacagg

SEQ ID NO: 37208 - RNA, 46 nt, Mus musculus
cagucaguaaagugcuugccuugcaagccuugguuagaguccagau

SEQ ID NO: 37209 - RNA, 51 nt, Mus musculus
agagaaagcaacugcuaugaucccgagcgagucaagaauuuucucaaggua

SEQ ID NO: 37210 - RNA, 42 nt, Mus musculus
ucauaucgcccagcugugugagaaggcgggccugcugcagcg

SEQ ID NO: 37211 - RNA, 48 nt, Mus musculus
agguccuuugcagacgcgauugcuugagaugaaccuuaugcacgcacc

SEQ ID NO: 37212 - RNA, 46 nt, Mus musculus
gcuauacuccagacuggaucuuucuccugagaaaugucaugcggau

SEQ ID NO: 37213 - RNA, 45 nt, Mus musculus
uugacagccugacuucuguagucuggcagucaaauguacauaaac

SEQ ID NO: 37214 - RNA, 42 nt, Mus musculus
ucaccucuacuucaguauuucggaauccuuuuggaccagggc

SEQ ID NO: 37215 - RNA, 77 nt, Mus musculus
ugcggaacaacuuagcuggugcugaagaacucuuugcccggaaauuuaaugcucucuucgcccagggaaacuacuca

SEQ ID NO: 37216 - RNA, 47 nt, Mus musculus
uucuuuccuccagaagcacaaaaugacuuuccuguugcaaugcaggu

SEQ ID NO: 37217 - RNA, 47 nt, Mus musculus
ucaacauuauuuuguuuugcugugcggggucaggcaggaggaaaggu

SEQ ID NO: 37218 - RNA, 62 nt, Mus musculus
ucagccuauugaagggcaugcagcuaguuuugcacaauuuaagauggaaggaaaugcagaag

SEQ ID NO: 37219 - RNA, 42 nt, Mus musculus
ucuagccucgcaggaugccagaucaucaauuaccguacagau

SEQ ID NO: 37220 - RNA, 46 nt, Mus musculus
gaucaucaagugcuaaaaguggcuugaauuuaaacuuguuagagag

SEQ ID NO: 37221 - RNA, 46 nt, Mus musculus
agaccaaucucagcagacagugccaucaugaauccugccagcaaag

SEQ ID NO: 37222 - RNA, 46 nt, Mus musculus
uaccuugacuauggagucagacaaauucaucugcauuagagaaaaa

SEQ ID NO: 37223 - RNA, 42 nt, Mus musculus
aaugacauuagccuuaccagguuccuuuuucaucgagcaugu

SEQ ID NO: 37224 - RNA, 46 nt, Mus musculus
ucugucacccccugguauuugguuuguuuaaaucuccaucucaguc

SEQ ID NO: 37225 - RNA, 42 nt, Mus musculus
gagcaaacauauuaucuaguaggcacaaauacaguugcaagu

SEQ ID NO: 37226 - RNA, 45 nt, Mus musculus
agccuuucuauacauauaaauauuaauucucccaacugccuuaga

SEQ ID NO: 37227 - RNA, 42 nt, Mus musculus
caugugauggucauaaguaacagggaaaauauaggugcaguu

SEQ ID NO: 37228 - RNA, 26 nt, Mus musculus
uucuggauguuaguggacagugggcu

SEQ ID NO: 37229 - RNA, 26 nt, Mus musculus
uuaggcucacuuugauucuugcaggu

SEQ ID NO: 37230 - RNA, 23 nt, Mus musculus
agaaagaagauagaggggcggca

SEQ ID NO: 37231 - RNA, 45 nt, Mus musculus
gugacaggaggagaccauacuccccgacagcgccauggcccagau

SEQ ID NO: 37232 - RNA, 43 nt, Mus musculus
ccaguucccugcguccccggagaguaucccucugagcccagcc

SEQ ID NO: 37233 - RNA, 45 nt, Mus musculus
gcuuuuccuuguaaaacgagacugaucagauagucaucaagaaga

SEQ ID NO: 37234 - RNA, 27 nt, Mus musculus
cucuauauauauagacaucugcagaga

SEQ ID NO: 37235 - RNA, 46 nt, Mus musculus
cauacucgaaaugaucugaaagaucagaucagccuuggccugagag

SEQ ID NO: 37236 - RNA, 45 nt, Mus musculus
acuuagauaguaccuggcaacaaacaaaagcuuuuggcugaagau

SEQ ID NO: 37237 - RNA, 45 nt, Mus musculus
aauaaagcuauuccugggaagagaagugcaguugugaugggcaga

SEQ ID NO: 37238 - RNA, 45 nt, Mus musculus
cugauccacaggcaggaggagacaacccagaaguccacgggcaag

SEQ ID NO: 37239 - RNA, 42 nt, Mus musculus
guguaucuguguuucuuaauggccagagaacuaugugaagaa

SEQ ID NO: 37240 - RNA, 41 nt, Mus musculus
uauuaguguguguuuguaugguguggugugugugucugaga

SEQ ID NO: 37241 - RNA, 45 nt, Mus musculus
aaggcgggggaaacgcggcuggcacgcccgagcccccguggaggg

SEQ ID NO: 37242 - RNA, 45 nt, Mus musculus
uaccgccgccuuggucucuuaaccgccgcgggggaagggguuaca

SEQ ID NO: 37243 - RNA, 45 nt, Mus musculus
acagucugaaagaagaugcuagacuugcacgagaaacuugcccgc

SEQ ID NO: 37244 - RNA, 46 nt, Mus musculus
gaggcuaauucuguguuuuuaacggguugcuuuuuguaauuggugg

SEQ ID NO: 37245 - RNA, 45 nt, Mus musculus
cugucuucuggucucugcaggcacacaaauacaaacacacacacu

SEQ ID NO: 37246 - RNA, 42 nt, Mus musculus; identical to SEQ ID NO: 26049

SEQ ID NO: 37247 - RNA, 73 nt, Mus musculus
aaaaucagccacaaguagaaaugucugaagggagaaauaauuaggccagauguaaaaaaagcuaugggaacgu

SEQ ID NO: 37248 - RNA, 46 nt, Mus musculus
ucuagaggcggggcugaugaggaagccugacauuucccuugaccga

SEQ ID NO: 37249 - RNA, 46 nt, Mus musculus
aaucaccuccaaacccagcuuaagguauauacugagaggugcacag

SEQ ID NO: 37250 - RNA, 41 nt, Mus musculus
aauggaguuggaguauaggcuggagaccaaaggcaggguua

SEQ ID NO: 37251 - RNA, 42 nt, Mus musculus
acuuguuaauuuuuaaguagcuagucaaaaagguugggguau

SEQ ID NO: 37252 - RNA, 46 nt, Mus musculus
gaauccaaggcuuugcacugucggucuucacuuuugggcagaagau

SEQ ID NO: 37253 - RNA, 61 nt, Mus musculus
ugugguuguugcaguuuucaaugguuuaccuacuguugagaagagaaggaaaauggucacc

SEQ ID NO: 37254 - RNA, 45 nt, Mus musculus
uaaaaaauuuuauaagaaaaaagguaggaagguaggaagguagga

SEQ ID NO: 37255 - RNA, 46 nt, Mus musculus
gugucuguaacucuaguccugagaaucuaauacuugggcaccagau

SEQ ID NO: 37256 - RNA, 88 nt, Mus musculus
ucauaccacccagaugaucuuguucuuaaaacaaucccucacccaugcuccuguaaaucacuucaugaaauucauugcuuucccaaaa

SEQ ID NO: 37257 - RNA, 67 nt, Mus musculus
aggacuaaugcaaaaggaggucgucuggaaggaaugcagauggcagauuuggaaagucauucugaag

SEQ ID NO: 37258 - RNA, 45 nt, Mus musculus
aaaucccagcaaccauaugguggcucacaaccauccauaacaaga

SEQ ID NO: 37259 - RNA, 41 nt, Mus musculus
gccccauaggaacaacaauaugaacuaaccaguacccccag

SEQ ID NO: 37260 - RNA, 45 nt, Mus musculus
agaaaggcaccucuuacugccuguaaaggagucgcgcguccccac

SEQ ID NO: 37261 - RNA, 45 nt, Mus musculus
uuuaaaaauuguguguguguguguguguguguguguguguugugu

SEQ ID NO: 37262 - RNA, 46 nt, Mus musculus
cgugcgugcgugcauccgccaguguauguacaucaugugcagucag

SEQ ID NO: 37263 - RNA, 46 nt, Mus musculus
gggccuugguuguaggagcgaucggggaggcgaaacgggagaaaga

SEQ ID NO: 37264 - RNA, 46 nt, Mus musculus
ggugaacuugcugugguggacuggaaagacacuaggagccagagca

SEQ ID NO: 37265 - RNA, 46 nt, Mus musculus
aaauauguaagcugaauuagggacgcgagcaaaaagguaugagggu

SEQ ID NO: 37266 - RNA, 42 nt, Mus musculus
cagucagugcucuuaccugcugaaccaucucaccagccccua

SEQ ID NO: 37267 - RNA, 41 nt, Mus musculus
gucagugcuggacauccacagguaaaaacuuacuggcccgg

SEQ ID NO: 37268 - RNA, 46 nt, Mus musculus
ccagguguauaugcuguguccgucacuggucgccugccccaaggua

SEQ ID NO: 37269 - RNA, 46 nt, Mus musculus
aagaaucacaucaagcaacuuccuucauuaccagccugcugcccag

SEQ ID NO: 37270 - RNA, 46 nt, Mus musculus
cuuggaaauacacaauugacaacguguccucccucgcacagccaga

SEQ ID NO: 37271 - RNA, 41 nt, Mus musculus
cggccggcacaaggaguaccucagcagccucgugggcacag

SEQ ID NO: 37272 - RNA, 46 nt, Mus musculus
cgcccagacagauaacacaaacaauuaaugaagaaaaccuggcugc

SEQ ID NO: 37273 - RNA, 30 nt, Mus musculus
gcccacacgccauaccccuacuuaauucgg

SEQ ID NO: 37274 - RNA, 46 nt, Mus musculus
uggggcuggggacugguucaaauucuucauagcaguaaacugagaa

SEQ ID NO: 37275 - RNA, 46 nt, Mus musculus
cucaguacgugaggagagaccugccccugccuucagagauugggaa

SEQ ID NO: 37276 - RNA, 44 nt, Mus musculus
gagauuucaauacagucgggguggaaugagcauccggugauguu

SEQ ID NO: 37277 - RNA, 42 nt, Mus musculus
uucccacguauauaguuaguacuagauaggguaggugcauug

SEQ ID NO: 37278 - RNA, 42 nt, Mus musculus
gagccuuuguccuccacuuggggcaugugugggcaagcauuu

SEQ ID NO: 37279 - RNA, 46 nt, Mus musculus
cuugaccaaagcaacagaucuuuucuuguuuugaaggccaucagcc

SEQ ID NO: 37280 - RNA, 37 nt, Mus musculus
gcuaaccauccagcagaauaaagcacuuaagagcuaa

SEQ ID NO: 37281 - RNA, 46 nt, Mus musculus
gaaacccugucucgaaaaaaaacaaaaaaagaaagaaagaaagagg

SEQ ID NO: 37282 - RNA, 46 nt, Mus musculus
ucagaggguagcuuuugggagucaguuuucuccuuucccuguggcu

SEQ ID NO: 37283 - RNA, 46 nt, Mus musculus
uacucuggcuccugcauucagagaacacugggugugguguagggag

SEQ ID NO: 37284 - RNA, 46 nt, Mus musculus
cagggccccugcgcuuccugugcagacaggaagcugugugggagac

SEQ ID NO: 37285 - RNA, 42 nt, Mus musculus
caaagggaacucaaaacucuuccacauucuucccgaggaaau

SEQ ID NO: 37286 - RNA, 46 nt, Mus musculus
uacuuccuccgggucucuaggaacucagacuuuuuuaaacauagau

SEQ ID NO: 37287 - RNA, 42 nt, Mus musculus
uucuccccacccaaaccccacacugcagcaggcaggccaggg

SEQ ID NO: 37288 - RNA, 42 nt, Mus musculus
uguucucacugagucuucuuuccccauucuguaguccugugg

SEQ ID NO: 37289 - RNA, 45 nt, Mus musculus
gugugugugugugugagagagagagagagagagagaguguaggag

SEQ ID NO: 37290 - RNA, 46 nt, Mus musculus
augaugaucauuuuucaccggaggcagacgcagccaugagugagau

SEQ ID NO: 37291 - RNA, 42 nt, Mus musculus
agaguguggcccggagaggacaggcacgcuggucugagagau

SEQ ID NO: 37292 - RNA, 48 nt, Mus musculus
ucaaugcugggcaccuauuuguccagcagcacacacaccccaccuucc

SEQ ID NO: 37293 - RNA, 45 nt, Mus musculus
aaguuuaaggaacugaaccucaccaauaucuaugcgccaccacug

SEQ ID NO: 37294 - RNA, 23 nt, Mus musculus
uggcaaagguaccagaggggagu

SEQ ID NO: 37295 - RNA, 82 nt, Mus musculus
acgguacgugaguuuucugaagcagacaucuggugccaagaucuacaucuccacccugccuuacacacagaacauccagauc

SEQ ID NO: 37296 - RNA, 44 nt, Mus musculus
ggcaggcuccaacccuaagaagguugaccuuaucaucugggaga

SEQ ID NO: 37297 - RNA, 41 nt, Mus musculus
cggggugcugaaggaggagcugucagacuuagggaccgagg

SEQ ID NO: 37298 - RNA, 46 nt, Mus musculus
gaggugaugacaacuuugucgccuguauggccaacaacagccagag

SEQ ID NO: 37299 - RNA, 42 nt, Mus musculus
uccaccagaacaggugccacugccagcccuucagcagaagcu

SEQ ID NO: 37300 - RNA, 93 nt, Mus musculus
cguuggaaccccaggucaaagguagcagcaauacuucggauagagaccuggcuggagagcuggacaaagacgagaccgugccugaaaaugacc

SEQ ID NO: 37301 - RNA, 53 nt, Mus musculus
ugagggagaagaggugagccauggccccccacagguagcugaacuuuuaaaga

SEQ ID NO: 37302 - RNA, 114 nt, Mus musculus
gccucuggagagaaagcgagagagacaggugggacagaggggacuggagaugcuguguugggggaaaauguaucugaggaaggccuauugucccaggagugugucucagaagug

SEQ ID NO: 37303 - RNA, 59 nt, Mus musculus
uguccgcuucucccaaaggaugcguccuuccccuaugaagcaguggaaagguguaagca

SEQ ID NO: 37304 - RNA, 45 nt, Mus musculus
cguugcagacacgaggucgcagccaggaccgugcagagaugagau

SEQ ID NO: 37305 - RNA, 45 nt, Mus musculus
aggccagccuggguugccaguaaaacaaaauaaucuuccucggug

SEQ ID NO: 37306 - RNA, 46 nt, Mus musculus
uguguaggugugugugugugugugugugugugugagagagagagag

SEQ ID NO: 37307 - RNA, 47 nt, Mus musculus
gccucucaguucuagaccuuagcuuuccuuuuuggccagagaaguuu

SEQ ID NO: 37308 - RNA, 46 nt, Mus musculus
aacccccaggugguggagacaguggucacugaguguagcccaagua

SEQ ID NO: 37309 - RNA, 84 nt, Mus musculus
agaauaauuggggagcaauguuaacacaauauugaagcaggagauucuuagaauaaaaauugcuaccagauaugggggcccgga

SEQ ID NO: 37310 - RNA, 45 nt, Mus musculus
ucuucuaaacugauccggcuaccucccagccaaaaucccagagau

SEQ ID NO: 37311 - RNA, 46 nt, Mus musculus
uuccuuggaugugauaccuguugcacuuuuaacccagcuagcuccc

SEQ ID NO: 37312 - RNA, 46 nt, Mus musculus
gagagcugugagcugccaugugggugcugggaauugaacccagguc

SEQ ID NO: 37313 - RNA, 45 nt, Mus musculus
uugagcuacauaaugaaaaccugucucaaaacccaaaccccagau

SEQ ID NO: 37314 - RNA, 46 nt, Mus musculus
uggaaagcaggguuguuguugcaagaucugauucagaguaguagug

SEQ ID NO: 37315 - RNA, 45 nt, Mus musculus
guggagcuauuuggaucgcauuucacaggauacugaaguucagau

SEQ ID NO: 37316 - RNA, 46 nt, Mus musculus
gaucugggaugguguaucuucuacuuccccauauacuggccugcuc

SEQ ID NO: 37317 - RNA, 46 nt, Mus musculus
gcccauuugcauugggagcaaagcaaggaaggggguuaguucugga

SEQ ID NO: 37318 - RNA, 74 nt, Mus musculus
gguuggggggguguucagcaacaucauucuguccagguccuugcuauuuggaugcuccugaaguucacguuagu

SEQ ID NO: 37319 - RNA, 46 nt, Mus musculus
auggagaucaucauauuuaagacuugggacuauuuguagcagagga

SEQ ID NO: 37320 - RNA, 45 nt, Mus musculus
ggacuucgcuccaggugagaguggaggcuucucaaaccgguaagg

SEQ ID NO: 37321 - RNA, 46 nt, Mus musculus
aaagauuuauuuauuuuauguaugugaguacccuguagcuguauag

SEQ ID NO: 37322 - RNA, 46 nt, Mus musculus
agaagaagaagaagaagaagaagaagaagaagaagaggagcagcag

SEQ ID NO: 37323 - RNA, 45 nt, Mus musculus
aaccaggguuaucaugcacuucuaagauaccagcauuccagaggu

SEQ ID NO: 37324 - RNA, 46 nt, Mus musculus
aaaucccagcaaccacauggugguucacaaccauccauaacaaaau

SEQ ID NO: 37325 - RNA, 46 nt, Mus musculus
uccaccaagccugaugacuugaguucaauccccaggacccacaggg

SEQ ID NO: 37326 - RNA, 42 nt, Mus musculus
agucaguugucaugucaagugauguuuuacuggggcacagau

SEQ ID NO: 37327 - RNA, 41 nt, Mus musculus
gagaaggagaaggagaaggagaaggagaagaaggaagaaga

SEQ ID NO: 37328 - RNA, 42 nt, Mus musculus
aaucccagcaaccacaugguggcucacaaccauucggaagga

SEQ ID NO: 37329 - RNA, 46 nt, Mus musculus
gccccggaacugaagccgaagcgcuggcggaugagacugaugagau

SEQ ID NO: 37330 - RNA, 46 nt, Mus musculus
ugucucucaccaggcgcgcgcucucggcagggggcagcagcccccc

SEQ ID NO: 37331 - RNA, 102 nt, Mus musculus
uugccucaaaaaagaaagggagcgagagaaaggggaggaguuggagaagguggaagaagaggggaagggaagggagagaaggggaggggaagagaggagaga

SEQ ID NO: 37332 - RNA, 44 nt, Mus musculus
cuuaaauuuguuuuaugucugugaguacacuguagcuguacaga

SEQ ID NO: 37333 - RNA, 45 nt, Mus musculus
uguguagcgcuggcuguccuggaacucacucuguggccucgagau

SEQ ID NO: 37334 - RNA, 46 nt, Mus musculus
aaauaccagcaaccacaugguggcucacaaccauccauaacgagau

SEQ ID NO: 37335 - RNA, 46 nt, Mus musculus
ggagcugggcagugguggcgcacgccuuuaaucccagcacuaggaa

SEQ ID NO: 37336 - RNA, 45 nt, Mus musculus
uuuuuuaaagauuuauuaauuuauuauaugcaaguacacuguagc

SEQ ID NO: 37337 - RNA, 46 nt, Mus musculus
uccgccccgucucaucugggaggaguuuaguuuccagguccgaggc

SEQ ID NO: 37338 - RNA, 45 nt, Mus musculus
guagcgaggagaggaccucuauguccacuugcugggucucuggau

SEQ ID NO: 37339 - RNA, 46 nt, Mus musculus
aacaugauggucuccaguuacagugagggcuggugagauggcucag

SEQ ID NO: 37340 - RNA, 46 nt, Mus musculus
accaaagcauuggaggaugugagauccaagcaacagugugugcagg

SEQ ID NO: 37341 - RNA, 46 nt, Mus musculus
ucaaggaacucacuguguggauuaaucuggacucgaauccacggag

SEQ ID NO: 37342 - RNA, 45 nt, Mus musculus
cuuugaucaucuuuaggaauuuguuugaaauuguuucauggcucc

SEQ ID NO: 37343 - RNA, 104 nt, Mus musculus
ucguaggauucuaugaagaggaagauggaacagcugagacaggaguauauggaaaugaaggcugucaucgacgcagcagagaccagcuccuugcgcaaguuaaa

SEQ ID NO: 37344 - RNA, 46 nt, Mus musculus
gagagucuacggaaaauucgacaccaucuaccagguucucgucaag

SEQ ID NO: 37345 - RNA, 46 nt, Mus musculus
gagugaacugaagcacuccauuaagaagcuacagaagaagucugag

SEQ ID NO: 37346 - RNA, 46 nt, Mus musculus
aaaagcaacuuaugggagaaaaggcuuguuuccgcucacaguucag

SEQ ID NO: 37347 - RNA, 41 nt, Mus musculus
gccaucuucccagccccguguuucucucucuuucccccuau

SEQ ID NO: 37348 - RNA, 46 nt, Mus musculus
cccuaauuaucccuaccagugagaauuugauucuacacacgcacag

SEQ ID NO: 37349 - RNA, 46 nt, Mus musculus
uucuuucuuuuguagggcucucaucuaccaguaguaaaaugcacag

SEQ ID NO: 37350 - RNA, 46 nt, Mus musculus
ggugauguguguaucugaguaaguguucugauagaugaaugguuag

SEQ ID NO: 37351 - RNA, 46 nt, Mus musculus
gccaguguucugggaaaucucuccaggcugcuaguuacuugggcag

SEQ ID NO: 37352 - RNA, 45 nt, Mus musculus
ucucugggguagccuucagaucuuuguguuuugauuauggccuag

SEQ ID NO: 37353 - RNA, 46 nt, Mus musculus
cgugcacuuaauccgagccuuugggaaauagaagcagacgcagcuu

SEQ ID NO: 37354 - RNA, 41 nt, Mus musculus
agucaggacucuuuccccaggcagugugcagcucaggcuag

SEQ ID NO: 37355 - RNA, 46 nt, Mus musculus
cguagcucagaucacaugaaacuggauaaagaacacucaagagaga

SEQ ID NO: 37356 - RNA, 45 nt, Mus musculus
auaaacucucgcuucagaccccaguuuuuccucuauccuggagau

SEQ ID NO: 37357 - RNA, 46 nt, Mus musculus
ucuuucgcacugagugaaauagagggugaaacagcugugcccagaa

SEQ ID NO: 37358 - RNA, 58 nt, Mus musculus
auugcugaugcuuagaagcuguuucacugugagccucgaucuaauaagcauagaaaga

SEQ ID NO: 37359 - RNA, 44 nt, Mus musculus; identical to SEQ ID NO: 27166

SEQ ID NO: 37360 - RNA, 41 nt, Mus musculus
caaccuauuguccugacugaaaagccuauaccauagccaga

SEQ ID NO: 37361 - RNA, 46 nt, Mus musculus
gggaaucaugcugguaauugaguucaucuuggugaugugcccuguu

SEQ ID NO: 37362 - RNA, 42 nt, Mus musculus
aagauuuuacaccucccauugguguggagaggauucccccag

SEQ ID NO: 37363 - RNA, 45 nt, Mus musculus
cacucaauuuuauuauuucuuacuuguacaauaagcuucccagga

SEQ ID NO: 37364 - RNA, 45 nt, Mus musculus
uacguggacgacaguagugaaaccggcugugagcuggauaaggag

SEQ ID NO: 37365 - RNA, 42 nt, Mus musculus
acauguaucguacaaguuaaaaugcaucggcccaagggggaa

SEQ ID NO: 37366 - RNA, 46 nt, Mus musculus
auucauuaguuugacaaaguagcucauaacaggaagaugucugaag

SEQ ID NO: 37367 - RNA, 45 nt, Mus musculus
cucccuuugagccuuaugggcuucuccggugcacagguagcuuca

SEQ ID NO: 37368 - RNA, 42 nt, Mus musculus
cagcgccuggagcaaugaugcggaggaacauggccagcagaa

SEQ ID NO: 37369 - RNA, 42 nt, Mus musculus
guggacauggccugggguagaugauuagguuccccgggauca

SEQ ID NO: 37370 - RNA, 46 nt, Mus musculus
gggcgggggugagggguggaggguugaaauccaagcuaggaaaaga

SEQ ID NO: 37371 - RNA, 45 nt, Mus musculus
ccccucuucggacccccgggaccccagcuggccagaggauggaug

SEQ ID NO: 37372 - RNA, 46 nt, Mus musculus
gaggagccacaaugaugucauccuccacaacaccuuuuuuugagag

SEQ ID NO: 37373 - RNA, 44 nt, Mus musculus
cauggguuguuggugagagugagggucuccagguugucaaaggg

SEQ ID NO: 37374 - RNA, 41 nt, Mus musculus
uucugguuccucaccaagauguggcacccaaacauccauga

SEQ ID NO: 37375 - RNA, 42 nt, Mus musculus
cagaaugucagaaccauccuccugaguguaaucucgcugcug

SEQ ID NO: 37376 - RNA, 42 nt, Mus musculus
guuggcaggagaggagguguugggcucauucagcagcgagau

SEQ ID NO: 37377 - RNA, 46 nt, Mus musculus
ccugacccacgucccugaaauaaacuuacaaauuuuaccucagcag

SEQ ID NO: 37378 - RNA, 42 nt, Mus musculus
gccucccaggcuugucaucaucugaaagcugagugggguguc

SEQ ID NO: 37379 - RNA, 55 nt, Mus musculus
uagcuucggcucaugcguggccucacuccgcgugccuccugcuccgucccgagga

SEQ ID NO: 37380 - RNA, 56 nt, Mus musculus
agcaggaggcacgcggagugaggccacgcaugagccgaagcuaaccccccacccca

SEQ ID NO: 37381 - RNA, 44 nt, Mus musculus
uccugcuccucuuaggggccacugcccuccugacgcauggccaa

SEQ ID NO: 37382 - RNA, 41 nt, Mus musculus
acugucuucuuggccaugcgucaggagggcaguggccccua

SEQ ID NO: 37383 - RNA, 85 nt, Mus musculus
ugcacgucaucgcacacagccgugccauuguggcagauacagaucaagcauaccucggguuuccacgucucaccauuggggaccc

SEQ ID NO: 37384 - RNA, 116 nt, Mus musculus
cuugaucuguaucugccacaauggcacggcugugugcgaugacgugcaaugcaaugaagaacuggacugucccaacccccaaagacgggagggcgagugcugugcuuucugcccgg

SEQ ID NO: 37385 - RNA, 45 nt, Mus musculus
agaagcaaagaaaacugcaguuuauuggaggacagugggggucgu

SEQ ID NO: 37386 - RNA, 82 nt, Mus musculus
ccccccuggacgagauggcaucccuggacagccuggacuuccugguccuccuggucccccugggccccccggacccccuggc

SEQ ID NO: 37387 - RNA, 56 nt, Mus musculus
cuucccagauguccuauggcuaugaugaaaaaucagcuggaguuuccgugccuggc

SEQ ID NO: 37388 - RNA, 59 nt, Mus musculus
ucuaggguccaauggguccccgaggucccccuggcccuccuggcaagaauggagaugau

SEQ ID NO: 37389 - RNA, 41 nt, Mus musculus
gguuuggauggugccaaaggagaugcugguccugcuggucc

SEQ ID NO: 37390 - RNA, 45 nt, Mus musculus
cuagggagagcccggcaguccuggugaaaacggagcuccuggcca

SEQ ID NO: 37391 - RNA, 41 nt, Mus musculus
agggugcuacuggaguucaaggucccccaggcccugccgga

SEQ ID NO: 37392 - RNA, 47 nt, Mus musculus
gguccagggaaucccaucacaccagccuggccacgggcuccaggagg

SEQ ID NO: 37393 - RNA, 41 nt, Mus musculus
cuggugugaugggauucccuggaccuaaggguaccgcugug

SEQ ID NO: 37394 - RNA, 44 nt, Mus musculus
gguucucccuguguagaaagggaagcaagauugagggucacagg

SEQ ID NO: 37395 - RNA, 46 nt, Mus musculus
ccaggggcucccugagcuccagcuucuccaucuuugccagcaggac

SEQ ID NO: 37396 - RNA, 41 nt, Mus musculus
gagaagucaccuugccuagaggcuaccaagccagugccaga

SEQ ID NO: 37397 - RNA, 42 nt, Mus musculus
gaacgugguguacaaggucccccagguccugcugguccccga

SEQ ID NO: 37398 - RNA, 71 nt, Mus musculus
gcaaagguccccguggugagacuggcccugcuggacguccuggugaaguuggucccccagguccccccggu

SEQ ID NO: 37399 - RNA, 47 nt, Mus musculus
ggguauugcuggacaacgugguguggucggucuucccggucagagag

SEQ ID NO: 37400 - RNA, 46 nt, Mus musculus
aucuuaggacuugaguacuagaaggggcaggguagcagcaguggag

SEQ ID NO: 37401 - RNA, 46 nt, Mus musculus
cuggcaaacaagguccuucuggaucaaguggugaacgcgguccccc

SEQ ID NO: 37402 - RNA, 43 nt, Mus musculus
uggugcucccggugcucccggcccuguuggucccgcuggcaag

SEQ ID NO: 37403 - RNA, 57 nt, Mus musculus
ccccaaggcccccguggugacaagggugagacaggcgaacaaggugacagaggcaua

SEQ ID NO: 37404 - RNA, 61 nt, Mus musculus
cuugagguggcugaggcaggaagcugaagucauaaccgccacugggagguccaggagggcc

SEQ ID NO: 37405 - RNA, 62 nt, Mus musculus
ugaccuugagguggacaccacccucaagagccugagucagcagauugagaacauccgcagcc

SEQ ID NO: 37406 - RNA, 48 nt, Mus musculus
agaguggcacaucuugaggucgcggcaugugcgggcaggguucuugcg

SEQ ID NO: 37407 - RNA, 61 nt, Mus musculus
ccgaaggcagccgcaagaacccugcccgcacaugccgcgaccucaagaugugccacucuga

SEQ ID NO: 37408 - RNA, 63 nt, Mus musculus
uacuggaucgacccuaaccaaggcugcaaccuggacgccaucaaggucuacugcaacauggag

SEQ ID NO: 37409 - RNA, 76 nt, Mus musculus
ggucaugcucucuccaaaccagacgugcuucuuuuccuugggguucgggcugauguaccaguucuucugaggcaca

SEQ ID NO: 37410 - RNA, 45 nt, Mus musculus
ccgucugugccucagaagaacugguacaucagcccgaaccccaag

SEQ ID NO: 37411 - RNA, 47 nt, Mus musculus
uggacauuaggcgcaggaaggucagcuggauagcgacaucggcgggg

SEQ ID NO: 37412 - RNA, 51 nt, Mus musculus
cgccuaauguccaccgaggccucccagaacaucaccuaucacugcaagaac

SEQ ID NO: 37413 - RNA, 45 nt, Mus musculus
acuggcaaccucaagaaggcccugcuccuccagggauccaacgag

SEQ ID NO: 37414 - RNA, 25 nt, Mus musculus
cgaucucguuggaucccuggaggag

SEQ ID NO: 37415 - RNA, 49 nt, Mus musculus
ggcgggaggucuuggugguuuuguauucgaugacugucuugccccaagu

SEQ ID NO: 37416 - RNA, 56 nt, Mus musculus
ccaucaucgauguggcucccuuggacauuggugccccagaccaggaauucggacua

SEQ ID NO: 37417 - RNA, 100 nt, Mus musculus
uucguguaaacucccuccaccccaaucugguucccucccacccagcccacuuuuccccaacccuggaaacagacgaacaacccaaacucaauuuccccca

SEQ ID NO: 37418 - RNA, 54 nt, Mus musculus
ucaccuuucaaacuuaguuuuuaccuuugaccaacugaacgugaccaaaaacca

SEQ ID NO: 37419 - RNA, 82 nt, Mus musculus
cuugcuugaagaccuauguggguauaagucccuuccugcccacuuggcuuaugauacccuaaugcugccuuuucugcuccuu

SEQ ID NO: 37420 - RNA, 64 nt, Mus musculus
ccccaagaggggguggagaaaggagcagaaaaggcagcauuaggguaucauaagccaagugggc

SEQ ID NO: 37421 - RNA, 59 nt, Mus musculus
ucuccacccccucuuggggccucuccuccauugcuccccaaauuuaagucucccccaag

SEQ ID NO: 37422 - RNA, 51 nt, Mus musculus
auuuccugugucuugggggagacuuaaauuuggggagcaauggaggagagg

SEQ ID NO: 37423 - RNA, 46 nt, Mus musculus
ggccauggagaugccagaugguuagguuccuucaacaguccaagaa

SEQ ID NO: 37424 - RNA, 46 nt, Mus musculus
aaccuaaccaucuggcaucuccauggccucugcaacaaacccccca

SEQ ID NO: 37425 - RNA, 44 nt, Mus musculus
ugugugggggcggggaugggggcaggguggcagcacgcccaguu

SEQ ID NO: 37426 - RNA, 45 nt, Mus musculus
uuuuuguuuuguuuuguuuuuuuuccugaaggugcuauuuaacaa

SEQ ID NO: 37427 - RNA, 45 nt, Mus musculus
aggggaggguuucagaagaaagagagagaucagauaggcccagga

SEQ ID NO: 37428 - RNA, 47 nt, Mus musculus
cucucuuucuucugaaacccuccccucuugcugcugcucccuccccu

SEQ ID NO: 37429 - RNA, 46 nt, Mus musculus
guauguguauaauaauuugagauguuuuuaauuauuuugauugcug

SEQ ID NO: 37430 - RNA, 45 nt, Mus musculus
cccaggagcgggaaagacucuuuaaguucuggagggggcgugcac

SEQ ID NO: 37431 - RNA, 42 nt, Mus musculus
gggaggccgagcgcccgggagacaaagaacgguagggaagga

SEQ ID NO: 37432 - RNA, 45 nt, Mus musculus
gggaaaccugacgggaggaugcuccgugugugcgugcguguacgu

SEQ ID NO: 37433 - RNA, 44 nt, Mus musculus
auuccaggguguugugggggaucggcggggagagucccggaaag

SEQ ID NO: 37434 - RNA, 41 nt, Mus musculus
ggagagaaagggagagagagagagagagagagagacagaga

SEQ ID NO: 37435 - RNA, 45 nt, Mus musculus
agaggauagaacaguuucuucaacccauaggucuaacugccagau

SEQ ID NO: 37436 - RNA, 45 nt, Mus musculus
cccccaucuccagccugcaugucaaccacuucugggacuugucgg

SEQ ID NO: 37437 - RNA, 46 nt, Mus musculus
ugugugugugucugugugucugugugugugugugugugugucugug

SEQ ID NO: 37438 - RNA, 46 nt, Mus musculus
gcauccuuguguaguuaacacuccugaguaagagugugagccaaag

SEQ ID NO: 37439 - RNA, 45 nt, Mus musculus
uuguaauguuuagguuugggcauuugguuugguuugugguuggaa

SEQ ID NO: 37440 - RNA, 44 nt, Mus musculus
cagggcuauacagagaaacccugucucaaaagaagaagaagaag

SEQ ID NO: 37441 - RNA, 42 nt, Mus musculus
uccugaauaguucaaaacagcagguggugagggcccuggcaa

SEQ ID NO: 37442 - RNA, 27 nt, Mus musculus
guacagcucuggguguuaggcguuagg

SEQ ID NO: 37443 - RNA, 45 nt, Mus musculus
gggccuggugguggugguggugguggugguggugguggcggcagc

SEQ ID NO: 37444 - RNA, 46 nt, Mus musculus
aaccugggcagauagaccauuggucuagggggcaagaugccugaug

SEQ ID NO: 37445 - RNA, 41 nt, Mus musculus
cauugaacaagggugccuuugggaugucuacagacgggaga

SEQ ID NO: 37446 - RNA, 42 nt, Mus musculus
ucuuguccaagccgaugguggggcuggcaggcucaggggggc

SEQ ID NO: 37447 - RNA, 46 nt, Mus musculus
gacuaccuagaggacauaguccuagcauuaaguuaggcugauggau

SEQ ID NO: 37448 - RNA, 45 nt, Mus musculus
ucuacccugagcgaugacuccacaccccccagcagcagccccaag

SEQ ID NO: 37449 - RNA, 46 nt, Mus musculus
aucccaacaaccacaugguggcucacaaccauccguaacgaaaucu

SEQ ID NO: 37450 - RNA, 45 nt, Mus musculus
ugguugugagccaccaugugguuguugggauuugaacucagggcg

SEQ ID NO: 37451 - RNA, 45 nt, Mus musculus
uugagagcuguuggggacacgggucacucccccaacuagugucua

SEQ ID NO: 37452 - RNA, 32 nt, Mus musculus
ucagucaccuucacuggaagagggggccucau

SEQ ID NO: 37453 - RNA, 45 nt, Mus musculus
ccggcucaagugccagcgggauggcagcauugaaggcccccauga

SEQ ID NO: 37454 - RNA, 55 nt, Mus musculus
cuuguggagaaagacccaaagaagucccagaaauggaggagagacugggaaguag

SEQ ID NO: 37455 - RNA, 44 nt, Mus musculus
uccugaaacaaaugauccugaacuagaaagcguauuaaaaggag

SEQ ID NO: 37456 - RNA, 46 nt, Mus musculus
uaugcucccuacuguaacccuuucucugaaagcugagacucaaguc

SEQ ID NO: 37457 - RNA, 42 nt, Mus musculus
uucucuggguuccuauuuuuggugguguuaagugaaggaaga

SEQ ID NO: 37458 - RNA, 46 nt, Mus musculus
accccucccaagggcacuuaaagugaccuaucauuccgagccagcg

SEQ ID NO: 37459 - RNA, 46 nt, Mus musculus
ccguggacauugucagcacucugcaagcccuucagaugcucaagua

SEQ ID NO: 37460 - RNA, 45 nt, Mus musculus
uucuccugucuggaguuguuagcacuuaauucauauaaaaucgaa

SEQ ID NO: 37461 - RNA, 46 nt, Mus musculus
aggagguacugcuccgauaccugcacaacuuccagggcaaggagau

SEQ ID NO: 37462 - RNA, 45 nt, Mus musculus
ugccaaaaccucugccuuuuggcaaagcuuuuucuggaccauaag

SEQ ID NO: 37463 - RNA, 45 nt, Mus musculus
gaugagauuuaucgcaaaggcuccaucucuguguuugaaguagac

SEQ ID NO: 37464 - RNA, 42 nt, Mus musculus
uuuugacugggcgucaaaauuggguaaaucaaaggggucaua

SEQ ID NO: 37465 - RNA, 45 nt, Mus musculus
auaaauagaggaauuaagcuauuugugauaauaauagcaguagua

SEQ ID NO: 37466 - RNA, 46 nt, Mus musculus
agcagauagaagaaaggaugcugucccacaggcaagaugacaacaa

SEQ ID NO: 37467 - RNA, 58 nt, Mus musculus
aaugucgaagauaagauuaaauucgggauauguucugaaggagaggaagcuacuagga

SEQ ID NO: 37468 - RNA, 28 nt, Mus musculus
uguucagcacaggacuauguuuuguucc

SEQ ID NO: 37469 - RNA, 45 nt, Mus musculus
uugacauaggauuuagauguuuacggugucauaguagcaggggau

SEQ ID NO: 37470 - RNA, 44 nt, Mus musculus
aauauccauuuauguugugauagacaccaugaaaaaccaauaga

SEQ ID NO: 37471 - RNA, 46 nt, Mus musculus
cugccgcauucauuuccuugguaacugaagucauauccugccaggg

SEQ ID NO: 37472 - RNA, 46 nt, Mus musculus
aggaaaauagugcaugaggguacacaucgggaucuucacggcagcu

SEQ ID NO: 37473 - RNA, 46 nt, Mus musculus
cagggcgaucauucgauugguagauagauauagauagauagaucga

SEQ ID NO: 37474 - RNA, 46 nt, Mus musculus
aaaucccagcaaccacaugguggcuuacaaccacucauaaugagau

SEQ ID NO: 37475 - RNA, 47 nt, Mus musculus
aaugcaccuucuucugagucugacauagacaucuccagccccaacgu

SEQ ID NO: 37476 - RNA, 46 nt, Mus musculus
uuuugguuauuuuucagacuuuauauuugauuuugauuacucagga

SEQ ID NO: 37477 - RNA, 45 nt, Mus musculus
uggcucaguguuuaagagcacguacugcucuuuuucugcaggggu

SEQ ID NO: 37478 - RNA, 45 nt, Mus musculus
ucuuacuguauauuuugcuugcuagaguauuagguguauucaguu

SEQ ID NO: 37479 - RNA, 46 nt, Mus musculus
aaugguucuuagacacugcaguuagcuaugcccuaaaggugaugga

SEQ ID NO: 37480 - RNA, 46 nt, Mus musculus
cgaucugcccgagucacccgcuccucagccaggcuaagccagaguu

SEQ ID NO: 37481 - RNA, 45 nt, Mus musculus
cagcaaaugcucuuaaccaccaaaccaucucuccagccccaagaa

SEQ ID NO: 37482 - RNA, 45 nt, Mus musculus
gaucaauauacaggcaaaacuuucacacauacaguaaaauaaauc

SEQ ID NO: 37483 - RNA, 42 nt, Mus musculus
gaauugaauuuuuaggaccucugcucacucaggcccaaagau

SEQ ID NO: 37484 - RNA, 46 nt, Mus musculus
uuuacuuguggucagauuuuugaaugaaauauuuggauggauagac

SEQ ID NO: 37485 - RNA, 45 nt, Mus musculus
cguaaaaugcaaagagcaguguuacgugcuaguugcuaggaauuc

SEQ ID NO: 37486 - RNA, 52 nt, Mus musculus
cacuuuccuuuccugguggggggauuacaacaaagccgaggaugggugguua

SEQ ID NO: 37487 - RNA, 42 nt, Mus musculus
accuagccuagcuacucugucuccucucgguaccagacagaa

SEQ ID NO: 37488 - RNA, 42 nt, Mus musculus
gcugcagcuggaaggggaccguagcccugaguggcugcagac

SEQ ID NO: 37489 - RNA, 42 nt, Mus musculus
ugcuggggcgacgggcuggagaguacuagaaguagaugggag

SEQ ID NO: 37490 - RNA, 46 nt, Mus musculus
aacuuugguuuucauccagugugugaucaaugcuauguuugccaag

SEQ ID NO: 37491 - RNA, 41 nt, Mus musculus
acauuuuccccuuuaucccuuugacuucgcuuuguguguca

SEQ ID NO: 37492 - RNA, 42 nt, Mus musculus
ugccaggguggaucgcacucggaccuggcucuaugcugccug

SEQ ID NO: 37493 - RNA, 45 nt, Mus musculus
uuguguggacaggacuaaggggaucuucccuccucuuccccucag

SEQ ID NO: 37494 - RNA, 44 nt, Mus musculus
uugcuaauuguggcuggcguggcucuuuucauguauaagcccaa

SEQ ID NO: 37495 - RNA, 46 nt, Mus musculus
cagucgagaagcacacggugaaacacacagagauaauuaggaacag

SEQ ID NO: 37496 - RNA, 45 nt, Mus musculus
guugugagccaccaugugguugcugggauuugaacucagagccuc

SEQ ID NO: 37497 - RNA, 45 nt, Mus musculus
caagcuauaaacagcuggcgaauuuugauucugauuuuucuuuug

SEQ ID NO: 37498 - RNA, 52 nt, Mus musculus
uuuaacaagauguguugcuaauuucugauuuugcacaaauaaagagaagaaa

SEQ ID NO: 37499 - RNA, 46 nt, Mus musculus
auaauccaacaccacacacacacacacacacacacacacacacaga

SEQ ID NO: 37500 - RNA, 42 nt, Mus musculus
agaggcagggacuaaccuaggccacccaacaacagggagauc

SEQ ID NO: 37501 - RNA, 45 nt, Mus musculus
gccagaccuuccucaaccccucccuucucccaucuggccaaagau

SEQ ID NO: 37502 - RNA, 46 nt, Mus musculus
guaacaggggcaccccuaagacucaggggguacuaaugaaccagag

SEQ ID NO: 37503 - RNA, 45 nt, Mus musculus
cggcgagagauaggaccaccccaagccugucuugccccgugacca

SEQ ID NO: 37504 - RNA, 84 nt, Mus musculus
cccuguccugucccacauuccgaccgcugauguucuagcccccacagagccgccccccucucccuugggguggcccaacaguca

SEQ ID NO: 37505 - RNA, 46 nt, Mus musculus
agagcuuucagagugugugugugugugugugugugugugugugugu

SEQ ID NO: 37506 - RNA, 46 nt, Mus musculus
gccaagccugcuuacuaccacugagcaauagcuccagucccaagac

SEQ ID NO: 37507 - RNA, 45 nt, Mus musculus
gggggugagugugugugguguguaugugugugguaugugugggag

SEQ ID NO: 37508 - RNA, 48 nt, Mus musculus
aauguguguguaugugugguauauguguggugugcauguguauagugu

SEQ ID NO: 37509 - RNA, 46 nt, Mus musculus
ugugugugcucauauaguguguguguauguguauggugugugugug

SEQ ID NO: 37510 - RNA, 46 nt, Mus musculus
ugggccugccuuauccagauaacucaccugaaagagauagagagau

SEQ ID NO: 37511 - RNA, 24 nt, Mus musculus
gcaggcugaggcaggcgcugccau

SEQ ID NO: 37512 - RNA, 45 nt, Mus musculus
ucuaaagaaggggggaagccuaaggagaggggaggagagggaagg

SEQ ID NO: 37513 - RNA, 45 nt, Mus musculus
ccaauucauccaagcacugacagccagcccugcaaugacauaaau

SEQ ID NO: 37514 - RNA, 41 nt, Mus musculus
ggccuggggcgcugcguaguucugauccuggaggggugagg

SEQ ID NO: 37515 - RNA, 46 nt, Mus musculus
ggggcaucgaaaggagcgauucgggaguggcagagagguugaagag

SEQ ID NO: 37516 - RNA, 44 nt, Mus musculus
uuucucuuuagcaucuuagucccuggggaguuguagggcagaga

SEQ ID NO: 37517 - RNA, 42 nt, Mus musculus
gccaggccgaacuuuccaauggacucaaacacuuuggcagcc

SEQ ID NO: 37518 - RNA, 42 nt, Mus musculus
ucaugcuugcccuccugaggacugaggucccccccaccuuuu

SEQ ID NO: 37519 - RNA, 44 nt, Mus musculus
caggacccagucuuagccaaacugaguguauugggcugugagag

SEQ ID NO: 37520 - RNA, 42 nt, Mus musculus
guccacuauaagccauauucagaauuucaguuagacccuaga

SEQ ID NO: 37521 - RNA, 23 nt, Mus musculus
aagggccagcugagggcagcaaa

SEQ ID NO: 37522 - RNA, 44 nt, Mus musculus
gugcuuacacagacuucagucacgccaugaggagaguggcaccu

SEQ ID NO: 37523 - RNA, 46 nt, Mus musculus
cugcuuaucccagacagaugaccaauuucuaggccacccggcagau

SEQ ID NO: 37524 - RNA, 46 nt, Mus musculus
aacaugccagggggaacauguuuauguguaggagaggguuuuugau

SEQ ID NO: 37525 - RNA, 45 nt, Mus musculus
agaagcacggacuggcccgcuggcagguaggugauguuccgagag

SEQ ID NO: 37526 - RNA, 46 nt, Mus musculus
ucaagugugugugccacugucuuuaaaucuucaauauacggcagaa

SEQ ID NO: 37527 - RNA, 42 nt, Mus musculus
ccugcaggaugcaauccuucaagcuggaaucccauuggguau

SEQ ID NO: 37528 - RNA, 46 nt, Mus musculus
caucugaauggaucaguuugaaugaaccaucgcaaccucaaaaaga

SEQ ID NO: 37529 - RNA, 45 nt, Mus musculus
uggguugugucugcaagaggcaugcuuagagaauuaaucggagag

SEQ ID NO: 37530 - RNA, 45 nt, Mus musculus
gcacugcgcacgcgcgccgagucgggcggaaaaauaaacgaguug

SEQ ID NO: 37531 - RNA, 57 nt, Mus musculus
gaagguuuugagagggcgcacacaggaagcauccugggggaagguuuugagagggcg

SEQ ID NO: 37532 - RNA, 63 nt, Mus musculus
cacacaggaagcguccugggggaagguuuugagagggcgcacacaggaagcguccugggggaa

SEQ ID NO: 37533 - RNA, 42 nt, Mus musculus
augcgcaggcugugggucucagaacuuaguuuuggggugcug

SEQ ID NO: 37534 - RNA, 46 nt, Mus musculus
ucaauucccagcaaccacaugguggcucacaacuaucuauaauaag

SEQ ID NO: 37535 - RNA, 41 nt, Mus musculus
aaagccgggcaugguggcacaugccuuuaaucccggcacuc

SEQ ID NO: 37536 - RNA, 46 nt, Mus musculus
ccauagccauaaugcugccagggaacacacagggggaucccggcau

SEQ ID NO: 37537 - RNA, 46 nt, Mus musculus
uccccacuauugggauauaaaguucaaggucuagaaggugggagag

SEQ ID NO: 37538 - RNA, 45 nt, Mus musculus
uccucuuccggcuuccaugccaugugcauaugugcaugcaugcac

SEQ ID NO: 37539 - RNA, 45 nt, Mus musculus
ugccaagguuaaucaugcuuaugaugcaaguccauucucugugug

SEQ ID NO: 37540 - RNA, 44 nt, Mus musculus
cacuggguaggugaccacauguaauaccuagaguggagcagcug

SEQ ID NO: 37541 - RNA, 36 nt, Mus musculus
uuuuauuaaaaacuuggaaaauauguagccgggcag

SEQ ID NO: 37542 - RNA, 42 nt, Mus musculus
gcagaguuucagggacaggugugagggacaguuuugggguga

SEQ ID NO: 37543 - RNA, 46 nt, Mus musculus
guggggccugagggcagccuuuagguaagcuggugggguagguuag

SEQ ID NO: 37544 - RNA, 54 nt, Mus musculus
gggauaaggcauccggaacggagcugcagggcucaccggaggucgcuaaggggc

SEQ ID NO: 37545 - RNA, 46 nt, Mus musculus
guggcgaaugucaacacccaugauggcgccuccugcucggccaggu

SEQ ID NO: 37546 - RNA, 45 nt, Mus musculus
aaaaagugaggaaaucccccccaggcugcaggccaggcccggggg

SEQ ID NO: 37547 - RNA, 45 nt, Mus musculus
uccccaaaacagcuccucccaaagcuccagaaaacacccaaacag

SEQ ID NO: 37548 - RNA, 46 nt, Mus musculus
aggguguucauggcuguaaaugcagacucuuauuugugguguguga

SEQ ID NO: 37549 - RNA, 44 nt, Mus musculus
accggcggaugaaaaugaagaagaugaauaaggagcagggcaaa

SEQ ID NO: 37550 - RNA, 42 nt, Mus musculus
agggcaagaaaaagcagggagugguuuuaugaagguaccauu

SEQ ID NO: 37551 - RNA, 44 nt, Mus musculus
gcggggagaggggguugcgaggaaagauggggacgcggugagag

SEQ ID NO: 37552 - RNA, 25 nt, Mus musculus
uugcagggcugggggugggggggag

SEQ ID NO: 37553 - RNA, 41 nt, Mus musculus
ccaggggcgcagggggugagggaggcggcugaacgugauug

SEQ ID NO: 37554 - RNA, 42 nt, Mus musculus
cccaagccuccuuccucccuuccuuuuucucccagcccccau

SEQ ID NO: 37555 - RNA, 46 nt, Mus musculus
uuuucucuuccacucaauuccuucuuccccaaaucucgccugcaag

SEQ ID NO: 37556 - RNA, 49 nt, Mus musculus
gcugucgacccccgcgggcuggaggcagcuugcaggcgagauuugggga

SEQ ID NO: 37557 - RNA, 45 nt, Mus musculus
cuaauuguccugaugggaauaaugggggagcgggguuggcuagaa

SEQ ID NO: 37558 - RNA, 45 nt, Mus musculus
augcugguauccgcccucuugggaaggagacaggagaggggagag

SEQ ID NO: 37559 - RNA, 89 nt, Mus musculus
ccgaaagacagaucaagaucugguuucagaaccggcgcaugaaguggaaaaaggagaacaaaaccucaggaccgggaaccaccggccag

SEQ ID NO: 37560 - RNA, 45 nt, Mus musculus
gaagcaugaaacucaaauaaaggggcaaacuauuuaaaugaagag

SEQ ID NO: 37561 - RNA, 46 nt, Mus musculus
auacuucaauaucagcucgauagagcgagagagagagagagagaga

SEQ ID NO: 37562 - RNA, 46 nt, Mus musculus
gugaggacuauaaaaugggacgaaagguccccagagaagcuaucag

SEQ ID NO: 37563 - RNA, 42 nt, Mus musculus
ugcccccccccccgaccuccagaucaguccucuugcccgcag

SEQ ID NO: 37564 - RNA, 45 nt, Mus musculus
ggaccagggagcugugagacacuaccauagggucguauagucuga

SEQ ID NO: 37565 - RNA, 46 nt, Mus musculus
auccacgucauuagggauuaagggccagaaucuaucaucgaguagg

SEQ ID NO: 37566 - RNA, 46 nt, Mus musculus
ugaaguggaaaaaggagagcaaacugcucagugcgucucagcucag

SEQ ID NO: 37567 - RNA, 41 nt, Mus musculus
auucuccaucucuuuuuuguccucuccgcauuccugcccug

SEQ ID NO: 37568 - RNA, 46 nt, Mus musculus
gacaggcucgugggaacugguccccagcgggcagcggcagugcagg

SEQ ID NO: 37569 - RNA, 45 nt, Mus musculus
uaauaauuauuauuaacaauaauaacaagauaaccaguccaggag

SEQ ID NO: 37570 - RNA, 45 nt, Mus musculus
ugcaaccccagcuaugggccuucucaguauuauucugugggucag

SEQ ID NO: 37571 - RNA, 45 nt, Mus musculus
aagagaguagcgaaccaucuuggcaggugaccucuggccacuuac

SEQ ID NO: 37572 - RNA, 45 nt, Mus musculus
gccacagugagaugauccucacugagaaggaacagaucguuccaa

SEQ ID NO: 37573 - RNA, 41 nt, Mus musculus
aucccagaagaaacugaagaaacaaaaacucauggccgggg

SEQ ID NO: 37574 - RNA, 46 nt, Mus musculus
uuuaguugagaguugaggggcuuuggccugaaauaaacugcaagua

SEQ ID NO: 37575 - RNA, 46 nt, Mus musculus
cuuugauuuucgggggauuccuuccuuuucuccuuccagcaaugag

SEQ ID NO: 37576 - RNA, 45 nt, Mus musculus
gccgacacuacccuccccucaagagaaagggaauaggcuggggac

SEQ ID NO: 37577 - RNA, 46 nt, Mus musculus
ggcauuuaaguccccaauguuagguccaggcccagcccuucuccag

SEQ ID NO: 37578 - RNA, 41 nt, Mus musculus
ggcacugggugccauauuguauguaugauuguggcccacau

SEQ ID NO: 37579 - RNA, 45 nt, Mus musculus
uaggucuagggucucagagucagagcuguaaccaacagcacccuc

SEQ ID NO: 37580 - RNA, 45 nt, Mus musculus
auuggcugugccauugagcugggauggaaagaaaagcccugcuag

SEQ ID NO: 37581 - RNA, 73 nt, Mus musculus
gcagccccccagggacgccugaugcaggcugacauucugauugaugggaguguugggugcaaggcuguaguug

SEQ ID NO: 37582 - RNA, 45 nt, Mus musculus
cuucuggcgaugacuguagucaaaaaccucacgcccagcccccag

SEQ ID NO: 37583 - RNA, 41 nt, Mus musculus
ugagucgggacucccaccccaugcuccgcgcucacgcugca

SEQ ID NO: 37584 - RNA, 45 nt, Mus musculus
ugguagggccugggucagagaaaacacaccuucuuuacggccaug

SEQ ID NO: 37585 - RNA, 41 nt, Mus musculus
aagccagacagcagaacaugccucaugauaaucccagcauu

SEQ ID NO: 37586 - RNA, 42 nt, Mus musculus
ggcagagcugggccccaggaugaucucccggagaggggggag

SEQ ID NO: 37587 - RNA, 66 nt, Mus musculus
caaaucaaggccacugcucugccacuucagccagcaggcuacccuccucagugccagacccuggac

SEQ ID NO: 37588 - RNA, 46 nt, Mus musculus
ugguugugagucaccaugugguugcuggaaauugaacucaagaucu

SEQ ID NO: 37589 - RNA, 41 nt, Mus musculus
uuccguggaggaugggugggccuuacuuucggugcggcugg

SEQ ID NO: 37590 - RNA, 41 nt, Mus musculus
cgucuacaagagcagcauugacaucuuccuguauguggugg

SEQ ID NO: 37591 - RNA, 41 nt, Mus musculus
ggcuaccagaaagcuuaggcucuugugucugcccucaggaa

SEQ ID NO: 37592 - RNA, 81 nt, Mus musculus
aaacgcugguugcuggagaacauggacggagccuucuuggugcuggaugaaacugucgauggagggugaggaggggacugg

SEQ ID NO: 37593 - RNA, 45 nt, Mus musculus
ugacuagcuuuggguaaugcucaaccgaggaggggcuugugagac

SEQ ID NO: 37594 - RNA, 45 nt, Mus musculus
auaagagaaaauuugggggugaguuggugaugugauucccccccc

SEQ ID NO: 37595 - RNA, 46 nt, Mus musculus
cugaguucaaauccuagcaaccacaugguggcucacaaccaccaau

SEQ ID NO: 37596 - RNA, 44 nt, Mus musculus
agccccauauuaaacauucuauaaggggaguguugaugagcaga

SEQ ID NO: 37597 - RNA, 45 nt, Mus musculus
gucucgggaaaaagagagagagagagagagagagagagagagaga

SEQ ID NO: 37598 - RNA, 63 nt, Mus musculus
aaaugaagaccuuggaaucaaggcuccuuccccagagaacuuuugccaguccccgcguaagcc

SEQ ID NO: 37599 - RNA, 45 nt, Mus musculus
gaggucuccugccagggauucugagacgcaaaagcuugaccccag

SEQ ID NO: 37600 - RNA, 23 nt, Mus musculus
uuggcuuuccaugauuccguguu

SEQ ID NO: 37601 - RNA, 45 nt, Mus musculus
cucugcccaccuuguuugcacugacuuauuuuuuugcucuuuaga

SEQ ID NO: 37602 - RNA, 46 nt, Mus musculus
agauugccaagugccagcaacugcagcaagaauacagccgcaagga

SEQ ID NO: 37603 - RNA, 45 nt, Mus musculus
gguaacacguccuuaagaggguguuugccgaccucagccccugga

SEQ ID NO: 37604 - RNA, 41 nt, Mus musculus
ugcaggguggcgguuggacucguggaaugagcgcgcgcgag

SEQ ID NO: 37605 - RNA, 40 nt, Mus musculus
ucuuuggccggaagcggaaguggagaaaggaugcaggugu

SEQ ID NO: 37606 - RNA, 91 nt, Mus musculus
uaacacuggacccaagaauguuggggaaucaccagggggcagagaguggggaaaagcaguuaugggaauaagggaauggaagcccggucua

SEQ ID NO: 37607 - RNA, 45 nt, Mus musculus
gaggcugucuccaggagaugccagggucuugucaaacuagcagaa

SEQ ID NO: 37608 - RNA, 45 nt, Mus musculus
gaggccgagaacuacuuccauucccgccccaagagcagccagauu

SEQ ID NO: 37609 - RNA, 45 nt, Mus musculus
guacuaucgaaacaggaaaucgguacuuccugcauguagggggaa

SEQ ID NO: 37610 - RNA, 45 nt, Mus musculus
cacacugcccuaaccaccgugugacuguuuuuggaagauaagagg

SEQ ID NO: 37611 - RNA, 41 nt, Mus musculus
agagagagagagagaauagggccucagggccagucccagca

SEQ ID NO: 37612 - RNA, 42 nt, Mus musculus
ggggugagcagauaggagccugagggaggccaagggccguga

SEQ ID NO: 37613 - RNA, 46 nt, Mus musculus
uguaaaaugcuuaaaacagucauaaacgugauauaaauuuauaaag

SEQ ID NO: 37614 - RNA, 46 nt, Mus musculus
gacacauuucaacucaaaucuggacucaccugagaacaccuuccau

SEQ ID NO: 37615 - RNA, 46 nt, Mus musculus
aaaacauacauuucacuccgucgaggagcaaagugagcccccaucc

SEQ ID NO: 37616 - RNA, 45 nt, Mus musculus
gggcaagaagaagcacgugugccacaucccggacugcgggaagac

SEQ ID NO: 37617 - RNA, 97 nt, Mus musculus
cugcagauggagcaggcucuagccggagaggcccagccuggggagaaacggcggcgcauggccugcacgugucccaacugcaaggauggggagaaga

SEQ ID NO: 37618 - RNA, 42 nt, Mus musculus
agcagcugaccgugcagaacguuucuggaaacaaccugacua

SEQ ID NO: 37619 - RNA, 45 nt, Mus musculus
ucauaucugucuucacacuugguccuuacaguaauacugugagau

SEQ ID NO: 37620 - RNA, 52 nt, Mus musculus
aaugguguccaaguccagggugugccugucaccaucaccaacacuggcggug

SEQ ID NO: 37621 - RNA, 55 nt, Mus musculus
ccugaacgccgcacagcuggcagcagcugcucaggccaugcagaccaucaacauc

SEQ ID NO: 37622 - RNA, 42 nt, Mus musculus
aauaaaguauuuuuaauguaagaguauauauaacagcaagaa

SEQ ID NO: 37623 - RNA, 43 nt, Mus musculus
agcccccccaccccacugucuaagacuaacaagaaagcuagga

SEQ ID NO: 37624 - RNA, 41 nt, Mus musculus
gucccuaucaaacccgcuccucucccucucagucccugcaa

SEQ ID NO: 37625 - RNA, 45 nt, Mus musculus
cgcugggcugggcuugguaguacacaccuauaauccuggcauucg

SEQ ID NO: 37626 - RNA, 46 nt, Mus musculus
aacuaagacauagacaccugucuaagaugucaaaguugggucaggc

SEQ ID NO: 37627 - RNA, 44 nt, Mus musculus
agcauuugcugugcgugugugaggcccugagucaaaccccuaga

SEQ ID NO: 37628 - RNA, 42 nt, Mus musculus
gugugugauauggcucagcagauaaggugauugcugccaaac

SEQ ID NO: 37629 - RNA, 41 nt, Mus musculus
cccuaagcaagggaaggguaacagagauaagcuccugggau

SEQ ID NO: 37630 - RNA, 46 nt, Mus musculus
uguacagccugauuggagccacgcucaggaaugauuguggagagua

SEQ ID NO: 37631 - RNA, 46 nt, Mus musculus
acauaaaauaacuguuuccaggaccaagaacagucagcucucagau

SEQ ID NO: 37632 - RNA, 58 nt, Mus musculus
ggauucuggagcuuagaguuuaacugccuagaauuugacaagaggggaaaaaccacca

SEQ ID NO: 37633 - RNA, 46 nt, Mus musculus
cccacugcuguaaaagagaagaugccggcaggagguggucuggaga

SEQ ID NO: 37634 - RNA, 44 nt, Mus musculus
acaaaaaucaaagacaauuccaaggucuuagggccgagcagcug

SEQ ID NO: 37635 - RNA, 80 nt, Mus musculus
guggcuucauuuauguuugauguguugagaauaaacugacagaucagugccugucucagcugcccaggaacagacaugga

SEQ ID NO: 37636 - RNA, 47 nt, Mus musculus
gcucuggggaggacaggaagucagaucacauaggccugugcgugaug

SEQ ID NO: 37637 - RNA, 45 nt, Mus musculus
auaauucugccucugguuuauguuuaauuggaaauuggaggagga

SEQ ID NO: 37638 - RNA, 49 nt, Mus musculus
uaucagucauuauuuuggaacaaguggauaaugggcacagagagaaaga

SEQ ID NO: 37639 - RNA, 45 nt, Mus musculus
aucccaggaggcagaggcagguggauuucugaguuggaggccagc

SEQ ID NO: 37640 - RNA, 45 nt, Mus musculus
cagcaaccuuuucuucgaagugacaggaagaaggaggaggaagau

SEQ ID NO: 37641 - RNA, 46 nt, Mus musculus
gagcauggaggguaugugugcgugugugugugugugugugugugug

SEQ ID NO: 37642 - RNA, 46 nt, Mus musculus
gcacgaggcucuggguucaauccccaguauaggaaucaggcauagu

SEQ ID NO: 37643 - RNA, 46 nt, Mus musculus
gcuguaaugguuugaagaauuagccugucaaacuugggccauagga

SEQ ID NO: 37644 - RNA, 41 nt, Mus musculus
gagguggaugguguuuucugggacgcugagggacgggcaga

SEQ ID NO: 37645 - RNA, 42 nt, Mus musculus
agaggaaggggcaggcugaagcaugaggacauuuggucaggu

SEQ ID NO: 37646 - RNA, 44 nt, Mus musculus
ugucuguaccaaugcucagcugguuggaaauauuccgggcaccu

SEQ ID NO: 37647 - RNA, 43 nt, Mus musculus
gcagggaacaucacagcagaggugaugaugggcauccucaggg

SEQ ID NO: 37648 - RNA, 46 nt, Mus musculus
augaggaggauauacccuccaccucucucugccuuucuguucuuca

SEQ ID NO: 37649 - RNA, 42 nt, Mus musculus
aagaaagggcaugccccacaggccuguggggugucaggagga

SEQ ID NO: 37650 - RNA, 45 nt, Mus musculus
gccaagugacuuuaccucuguguaccucuuuucuuaccugugagg

SEQ ID NO: 37651 - RNA, 46 nt, Mus musculus
ccaugagguuugggagccauauaaguaaugucuauagccuggacuu

SEQ ID NO: 37652 - RNA, 45 nt, Mus musculus
ugggcgggguggcuggggcgucgaggggcagccauggguaaagau

SEQ ID NO: 37653 - RNA, 44 nt, Mus musculus
ucagugguuccagccccuucucauagugaaaguuacacacacac

SEQ ID NO: 37654 - RNA, 47 nt, Mus musculus
ugggacugaugagggagaccccucccucagcuaggcuucuguggggg

SEQ ID NO: 37655 - RNA, 45 nt, Mus musculus
gagaaacugcuuaaacuuccuugugcuuaguuccucucugggaga

SEQ ID NO: 37656 - RNA, 42 nt, Mus musculus
ucugaccugccuugucuguuuauuuaaagggaggagugcuug

SEQ ID NO: 37657 - RNA, 41 nt, Mus musculus
cgacuuggagacagagcugggggagauggugaggcccagag

SEQ ID NO: 37658 - RNA, 46 nt, Mus musculus
ccgccaccuaacccaguguguuuuuacuaagucucagcccuuuccc

SEQ ID NO: 37659 - RNA, 45 nt, Mus musculus
uaguucccucccugccucccuucugugugauccccaaccccccaa

SEQ ID NO: 37660 - RNA, 51 nt, Mus musculus
ucacauaguggagccugugcagaauuauaaguggguuuucuuuuuccuuuu

SEQ ID NO: 37661 - RNA, 46 nt, Mus musculus
guaggucccugcucacacuccagaauuaaauucuauugaaaaagga

SEQ ID NO: 37662 - RNA, 46 nt, Mus musculus
aucuuuaaaaaaagaaacaaaaaaccaaagcaaaacuagguuagau

SEQ ID NO: 37663 - RNA, 46 nt, Mus musculus
acauguaacaggcacuugugagugggaacuaaggaauccuggagac

SEQ ID NO: 37664 - RNA, 46 nt, Mus musculus
gagagaaaauauccugaaacauuuggaagaguccagaacagaggag

SEQ ID NO: 37665 - RNA, 46 nt, Mus musculus
ggccagucacgcugcaguauggaagauaguuugagaagguugagac

SEQ ID NO: 37666 - RNA, 46 nt, Mus musculus
gggggaaagauuuauucugagugggaaaugcaaaacuccauuauac

SEQ ID NO: 37667 - RNA, 46 nt, Mus musculus
auccagacuaauaaagguauguaggagucuugaguagcuugcuaau

SEQ ID NO: 37668 - RNA, 44 nt, Mus musculus
uucgccuuaggaagagguccguccgcaggacacugugucgguga

SEQ ID NO: 37669 - RNA, 46 nt, Mus musculus
uuguuugguuuucauuuuauuauugcuuuauuuuguauggcagggu

SEQ ID NO: 37670 - RNA, 46 nt, Mus musculus
uagguaaaaagcuugcugcacagcaagaaaaccucaguuuggaguc

SEQ ID NO: 37671 - RNA, 46 nt, Mus musculus
ucuggguuccauuccagcaugggaaagaagagucagagaaagaggg

SEQ ID NO: 37672 - RNA, 50 nt, Mus musculus
ucccagcgaccacaugguggcucacaaccauccguaacaagaucuggcgc

SEQ ID NO: 37673 - RNA, 46 nt, Mus musculus
aggacccacagauugagaaccacuggacuagauguauaagccagau

SEQ ID NO: 37674 - RNA, 47 nt, Mus musculus
aacucuuaucuuccuugcauuuccccuugaugccaagacuuuggaga

SEQ ID NO: 37675 - RNA, 46 nt, Mus musculus
ggcuuguaaucucagguaguaaggagauuaaagcaggagugcagag

SEQ ID NO: 37676 - RNA, 47 nt, Mus musculus
gggaaaagcaggccauaaggcaacuuuggaagaagcccgucgucggu

SEQ ID NO: 37677 - RNA, 25 nt, Mus musculus
cuguguuuaaucccaggaagauagc

SEQ ID NO: 37678 - RNA, 68 nt, Mus musculus
cuaaaaggaauuuuguuggccacagaaauagacuugacgugggauuggagaagaaauguucuuuaagg

SEQ ID NO: 37679 - RNA, 124 nt, Mus musculus
aucacaaaagaaacugacuggccucugaggagcaucaggagaaaguagaguggcccauaauuucaaaguauuguauuauaaggucgagggaaagugguaagcuguguugguugccacaagcaga

SEQ ID NO: 37680 - RNA, 42 nt, Mus musculus
ccuaauaacugaucuucgagcauaaauggagaacugagagag

SEQ ID NO: 37681 - RNA, 48 nt, Mus musculus
uuacauucuaaugggagacacagcaaauuauauuaagguagaguauag

SEQ ID NO: 37682 - RNA, 41 nt, Mus musculus
uaacuaguaaaaggcaggugcuauuuuacaaacuggcaguc

SEQ ID NO: 37683 - RNA, 47 nt, Mus musculus
aauccaggaguuugucaaagaugucuuuucaccuauaggagagagau

SEQ ID NO: 37684 - RNA, 48 nt, Mus musculus
auggaggcuuuugugaaugagcccaauuauacuguauggagcgaccug

SEQ ID NO: 37685 - RNA, 46 nt, Mus musculus
cgaaaguuuauuaccaggcauccgugaccuuucucugcccccagug

SEQ ID NO: 37686 - RNA, 42 nt, Mus musculus
ugccgagacagauucagcuuccuguucgaugcugccccaguu

SEQ ID NO: 37687 - RNA, 41 nt, Mus musculus
ccauuucucuucuacuuuccucucacuuuuuuggucccagc

SEQ ID NO: 37688 - RNA, 42 nt, Mus musculus
ccuguuuuuugaaggcuuuuguccuuugguggggguggguga

SEQ ID NO: 37689 - RNA, 42 nt, Mus musculus
ggcugcuggguauaauggugcacaccuuuaagcuuaggaugu

SEQ ID NO: 37690 - RNA, 45 nt, Mus musculus
ccaguggcaaacccauagcagcugugaugaauaccuggaccaaac

SEQ ID NO: 37691 - RNA, 46 nt, Mus musculus
aacaaaucaaaucuguuuaagaauaaauagaauguucgcagcuuga

SEQ ID NO: 37692 - RNA, 45 nt, Mus musculus
guuucugcagauuauacccgugcccaggaacuugaugccuuagau

SEQ ID NO: 37693 - RNA, 46 nt, Mus musculus
uagguggcuuuuuaaaaaauaacuuauuuuacuuuaugguguuugu

SEQ ID NO: 37694 - RNA, 46 nt, Mus musculus
cccaacauguuuaaggcccuuagguucccuggcaucuagaggaggu

SEQ ID NO: 37695 - RNA, 46 nt, Mus musculus
acauuuccugagaaaauguuuacuugauauugcuaaagccuaauau

SEQ ID NO: 37696 - RNA, 45 nt, Mus musculus
guggguuucugugugacuuauaauacaauauucauagggugauuu

SEQ ID NO: 37697 - RNA, 45 nt, Mus musculus
ugcaugaagucgugaguucaaaccucucccucuggaguaaagaga

SEQ ID NO: 37698 - RNA, 45 nt, Mus musculus
auugacaggaaaccauauccugaugaugaaaauuuaguggaagug

SEQ ID NO: 37699 - RNA, 46 nt, Mus musculus
caaagcaacuuuugauaucucgcugguugugccuaaagacagagug

SEQ ID NO: 37700 - RNA, 45 nt, Mus musculus
uagcauauuccucccucuuuuaucucccuuccacacacauccaga

SEQ ID NO: 37701 - RNA, 45 nt, Mus musculus
gggauuaaaggcgugcgccaccaccacccagcuuuuccggguauu

SEQ ID NO: 37702 - RNA, 46 nt, Mus musculus
ucuauaacauagaauagaguuuauucagggcauggggaggggaguu

SEQ ID NO: 37703 - RNA, 45 nt, Mus musculus
caucagauuugcucuuguuacuguuguuuuagacugcauagugaa

SEQ ID NO: 37704 - RNA, 46 nt, Mus musculus
auauuaaaaauagaaaccuuuaaaaaagaacaggagggaaugagag

SEQ ID NO: 37705 - RNA, 45 nt, Mus musculus
ucacuuauuuauuuauuauaaguacacuguugcugucuucagaga

SEQ ID NO: 37706 - RNA, 44 nt, Mus musculus
gagccaccaugugguugcugggauuugaacucuggaccccugga

SEQ ID NO: 37707 - RNA, 46 nt, Mus musculus
aaaaggauguggauguagcuaguguuaaaacugucaugcccaaggu

SEQ ID NO: 37708 - RNA, 46 nt, Mus musculus
cacccgacugcucucccgaaggucuggaguucaaaucccagcaacc

SEQ ID NO: 37709 - RNA, 45 nt, Mus musculus
guaaggcaaaguccagccccaggacugcaaaaaucaguagggaag

SEQ ID NO: 37710 - RNA, 46 nt, Mus musculus
uuuauugcuaugauguuacuauuauuugacauaaaagcacaaagaa

SEQ ID NO: 37711 - RNA, 46 nt, Mus musculus
uccuaacuguggcaguugagauuuguucuuuucaaugugcucagau

SEQ ID NO: 37712 - RNA, 46 nt, Mus musculus
acaguauaaaugaauaaauaaaaaagaaaauuaucgccgggcaugg

SEQ ID NO: 37713 - RNA, 42 nt, Mus musculus
ccuagcaaccacaugguggcucacaaccaucugggcugggac

SEQ ID NO: 37714 - RNA, 46 nt, Mus musculus
cauaguuuugucuuuucuaaaauaacacaauuggaaucaugcagua

SEQ ID NO: 37715 - RNA, 42 nt, Mus musculus
uaggggacugccagggccaggaagugggaguagcuggguugu

SEQ ID NO: 37716 - RNA, 45 nt, Mus musculus
auauuuuauuuuauuuugauuuuuauuuuguguguggggugugug

SEQ ID NO: 37717 - RNA, 42 nt, Mus musculus
gugagcuaccaugugguugcugggauuugaacucugaaccuu

SEQ ID NO: 37718 - RNA, 46 nt, Mus musculus
gcccagcaaggcuuugauugauagauuaauagauagauagauagau

SEQ ID NO: 37719 - RNA, 46 nt, Mus musculus
gggugguugugagccaccaugugguugcugggcuuugaacuucgga

SEQ ID NO: 37720 - RNA, 45 nt, Mus musculus
gagccgcugugcucaguuucaacaggcucugaacaugucucaggg

SEQ ID NO: 37721 - RNA, 42 nt, Mus musculus
aaaucuguuuugaaaaacaaaacaaaacaaacaaaaggagau

SEQ ID NO: 37722 - RNA, 45 nt, Mus musculus
aaacgguuacgauaaauaaccauggguaugauguguuacgugaga

SEQ ID NO: 37723 - RNA, 63 nt, Mus musculus
ggcuguggaggcggcggcggcggcgagaggagcggcugaggaggagaaggaggggaggaggcg

SEQ ID NO: 37724 - RNA, 46 nt, Mus musculus
cuuccuucucuccuuuacccugucccuccucucucuuucccccuug

SEQ ID NO: 37725 - RNA, 60 nt, Mus musculus
aacaaaacaaaaaaaacaacaaaaagcugucugggaggacuuaacgaagaaaggaaagga

SEQ ID NO: 37726 - RNA, 42 nt, Mus musculus
uaacauggggggcaucaguacagaccacacagauacucagag

SEQ ID NO: 37727 - RNA, 46 nt, Mus musculus
accucugcuacauggcuucauguacugaacccgaggaugcaagcag

SEQ ID NO: 37728 - RNA, 47 nt, Mus musculus
caagcagacagaggauagagauggaaucacaguuggaaaggagucgg

SEQ ID NO: 37729 - RNA, 44 nt, Mus musculus
cucucucucucucccuguuuaacacuggaaauccaucugucugu

SEQ ID NO: 37730 - RNA, 45 nt, Mus musculus
uuuguuguccuuuugguuuguuugguuuuuauuuuuugcuuuuug

SEQ ID NO: 37731 - RNA, 46 nt, Mus musculus
cgacagcuuuguaauccuaauccugcuacuuucaccucccaccccc

SEQ ID NO: 37732 - RNA, 42 nt, Mus musculus
ugguagugcaugccuggaacccuggcauucaagaggcagaga

SEQ ID NO: 37733 - RNA, 42 nt, Mus musculus
aggguggaaaggcuuggucacugagagcccgaggugucccga

SEQ ID NO: 37734 - RNA, 43 nt, Mus musculus
aaagaacuuuccaacuuagcaccugggggaauugcucucugag

SEQ ID NO: 37735 - RNA, 46 nt, Mus musculus
ccaacucugcaagggaaccagaggacgguuagaggcaaggucucaa

SEQ ID NO: 37736 - RNA, 42 nt, Mus musculus
aacccacagagaugcaccugccucugccuccugacugcugag

SEQ ID NO: 37737 - RNA, 42 nt, Mus musculus
gucugucauccaucagucucuccagccucauccucacucaag

SEQ ID NO: 37738 - RNA, 42 nt, Mus musculus
cuugguacucucuuuuuguuuguuuguuuguuuguugguugg

SEQ ID NO: 37739 - RNA, 45 nt, Mus musculus
ucaaaucccagcaaccacaugguggcucacagccauccauuauga

SEQ ID NO: 37740 - RNA, 45 nt, Mus musculus
agagcucaaaacugagagcagagggaguuaguagccugggcgaga

SEQ ID NO: 37741 - RNA, 46 nt, Mus musculus
gauggagauggcuuucuguaagaaguuaaaagagggacgagguagg

SEQ ID NO: 37742 - RNA, 42 nt, Mus musculus
gagucugggcaggaugacugaggagcgcuaucucagagggga

SEQ ID NO: 37743 - RNA, 42 nt, Mus musculus
aauccagcagugcaggcuuccuuucuguggaacuacagagau

SEQ ID NO: 37744 - RNA, 44 nt, Mus musculus
acuguuacauagagaaauucugucucaaacaaagcaaaagaaaa

SEQ ID NO: 37745 - RNA, 69 nt, Mus musculus
ccuucugagagauaaugucucacgugaaucucuggcuggcuagaacuuagaaccagagcaggcugaucu

SEQ ID NO: 37746 - RNA, 57 nt, Mus musculus
uauagucguauuaugcuaaacugcauuaauuuaguuaggccaagugguauuaguuaa

SEQ ID NO: 37747 - RNA, 45 nt, Mus musculus
cuagucugagcuuuaaauaaaguucuagccaacccaaggcuguau

SEQ ID NO: 37748 - RNA, 45 nt, Mus musculus
cuauuuaaaauaaacaaauaaaauaaaguaaaauaaaaugggucc

SEQ ID NO: 37749 - RNA, 42 nt, Mus musculus
uucccugccuccugugucugucacccccacugccauccccac

SEQ ID NO: 37750 - RNA, 45 nt, Mus musculus
accuugucauuacugcucaacuuuaaauauauuuugugugugugu

SEQ ID NO: 37751 - RNA, 46 nt, Mus musculus
agaguggcgggaaaggcccgcagccacagcauuaaggguugucuug

SEQ ID NO: 37752 - RNA, 44 nt, Mus musculus
cagccuacuaaagccagcccaguagguggggcugcuccccagac

SEQ ID NO: 37753 - RNA, 80 nt, Mus musculus
aacaggaaauccugagugacagagcuuaguccugccccagccucaggguacccuauuaaccugcaggagaugcucaggug

SEQ ID NO: 37754 - RNA, 46 nt, Mus musculus
cccaaaaaaaucaaagcccccaagccggaggugaggcggggcagag

SEQ ID NO: 37755 - RNA, 45 nt, Mus musculus
aauggggcacaugcagcauacuuggggcugagggagaaccacaca

SEQ ID NO: 37756 - RNA, 41 nt, Mus musculus
agcgagagagacacacacacacacacacacacacacacaca

SEQ ID NO: 37757 - RNA, 46 nt, Mus musculus
aagcuuccugaaggcccaaagguacgggaggccagaccccccaggc

SEQ ID NO: 37758 - RNA, 45 nt, Mus musculus
gcuuucuacaggagcauccuucagaaggggaccaggagcagggac

SEQ ID NO: 37759 - RNA, 46 nt, Mus musculus
ucuuuaaaaaaaaaaaaggugaggucaucagagccauuuugcagaa

SEQ ID NO: 37760 - RNA, 46 nt, Mus musculus
accuucccgccacgggcacaacccuacuacacucacaccaccacac

SEQ ID NO: 37761 - RNA, 42 nt, Mus musculus
agggcagucuuuccggagggagcucccgaguagaugccaaga

SEQ ID NO: 37762 - RNA, 45 nt, Mus musculus
cccacauugcagggcucggggaaacgagaaugcuccacuccccac

SEQ ID NO: 37763 - RNA, 46 nt, Mus musculus
cgcacaguggcccuauguaccugcaaggccacucagcggcccccuu

SEQ ID NO: 37764 - RNA, 45 nt, Mus musculus
augguuugguggccacugagguguggaugugguuuuauaucggag

SEQ ID NO: 37765 - RNA, 46 nt, Mus musculus; identical to SEQ ID NO: 37067

SEQ ID NO: 37766 - RNA, 23 nt, Mus musculus
uggccuggcgcugcaggggcugc

SEQ ID NO: 37767 - RNA, 41 nt, Mus musculus
ugcgauugagcuguagacagggacuauucagaauauggaag

SEQ ID NO: 37768 - RNA, 46 nt, Mus musculus
aaccaaaacccaaacaaacaaacaacuaaaaagauacaauccagag

SEQ ID NO: 37769 - RNA, 45 nt, Mus musculus
gcuccgagcagggaccgccugcugcacuuuggguucaaggcgaca

SEQ ID NO: 37770 - RNA, 45 nt, Mus musculus
gagcugagauuuaaauuuugaguuuaaaaauguacaucaggagca

SEQ ID NO: 37771 - RNA, 33 nt, Mus musculus
uaacagcaauauaucaugaauuuucagaagagc

SEQ ID NO: 37772 - RNA, 46 nt, Mus musculus
caaagaaucccgaguuaggaucuggaugaaggauaagccccugaau

SEQ ID NO: 37773 - RNA, 42 nt, Mus musculus
cuucuuaguuucugcaggaaaauuguuguuauaugggguuuc

SEQ ID NO: 37774 - RNA, 42 nt, Mus musculus
cacaacucuucuggauuacaaaacaagcaaaagccaggugau

SEQ ID NO: 37775 - RNA, 48 nt, Mus musculus
agacaccauaggaauauuaggagugaguuaccucccuaugcagauaaa

SEQ ID NO: 37776 - RNA, 51 nt, Mus musculus
augguauccgaccacuuccagaguacagcacugagaagcauaagaagcaca

SEQ ID NO: 37777 - RNA, 46 nt, Mus musculus
cagugguuccacuccaaagcacgaacgggguucucccagccacagu

SEQ ID NO: 37778 - RNA, 42 nt, Mus musculus
gggagcacggggguggcaaaaaucauuaucagcaagcacgac

SEQ ID NO: 37779 - RNA, 42 nt, Mus musculus
ccaucccauguccuccaaacauaacacgucaggaggggaguu

SEQ ID NO: 37780 - RNA, 45 nt, Mus musculus
auaagcuugccucuccaaugaagccuguuccuggaacccccccau

SEQ ID NO: 37781 - RNA, 46 nt, Mus musculus
auuccuaaagggacagugauggugggcaagcccuccucucacaguc

SEQ ID NO: 37782 - RNA, 44 nt, Mus musculus
ucaccccaccuaccagcacggguggguccaaauccccaggcagu

SEQ ID NO: 37783 - RNA, 45 nt, Mus musculus
ucagacagcaagccaggcaagcgcagccgcacucccuccaaugau

SEQ ID NO: 37784 - RNA, 57 nt, Mus musculus
aucugauggagcaccacagugggagucagaguccuuuacugaccacuggagaauuag

SEQ ID NO: 37785 - RNA, 45 nt, Mus musculus
uacauuggggaugccaaugcuuggaggugacaauggggagccaaa

SEQ ID NO: 37786 - RNA, 46 nt, Mus musculus
caaagugguuuuggagaggaguauuuugaugaaaguagucagagug

SEQ ID NO: 37787 - RNA, 46 nt, Mus musculus
ccaagccaguguagcacucccccagcaacguacccacagccagugu

SEQ ID NO: 37788 - RNA, 43 nt, Mus musculus
ccgaugcucaugaaccuucuuaaagauaacccugcccaggauu

SEQ ID NO: 37789 - RNA, 37 nt, Mus musculus
gggucccauuaccaccuuguuuaauaugagcaugagc

SEQ ID NO: 37790 - RNA, 46 nt, Mus musculus
ggggggcugaggggaagcuguacugugucacaguguguccugaggu

SEQ ID NO: 37791 - RNA, 38 nt, Mus musculus
aucuugaauaugaucagacaccaaguggccuauaacac

SEQ ID NO: 37792 - RNA, 42 nt, Mus musculus
aggucagcagcacugcuauuuucucaauaaagaugcuccucu

SEQ ID NO: 37793 - RNA, 41 nt, Mus musculus
aaggaccccuucuuucuccgcagucacuagugccaacagug

SEQ ID NO: 37794 - RNA, 34 nt, Mus musculus
guguuuggacuaauacagcaaaagaacagaagaa

SEQ ID NO: 37795 - RNA, 46 nt, Mus musculus
ugcuaucucacuggcccuaucgaguuaaguguguguguggugugug

SEQ ID NO: 37796 - RNA, 47 nt, Mus musculus
acggaugguugugagccacuaugugguugcugggaauugaacacacg

SEQ ID NO: 37797 - RNA, 45 nt, Mus musculus
gggccaaaauagucuaccagacgccuuguugguggaggugcagac

SEQ ID NO: 37798 - RNA, 46 nt, Mus musculus
auggaacuuaucuuuacaucauauuuuuagucacuuaguaugcaug

SEQ ID NO: 37799 - RNA, 46 nt, Mus musculus
caaauauauugguaugcauacaucuguaauuauuuccaguauccca

SEQ ID NO: 37800 - RNA, 46 nt, Mus musculus
agaccaugaugguggcacaugccuuucaccucaguacucgggaggc

SEQ ID NO: 37801 - RNA, 46 nt, Mus musculus
gguauagcuugucuuuuaggguuuuuucaugagccacuguagagau

SEQ ID NO: 37802 - RNA, 59 nt, Mus musculus
cagugccaguggcacugaguguuacaucacgucagauauguucuauguggaagugcagu

SEQ ID NO: 37803 - RNA, 46 nt, Mus musculus
ccccaauccccauuaucuuuuuacaguaacaucuuugccagcaaug

SEQ ID NO: 37804 - RNA, 46 nt, Mus musculus
agccuaggagucaacccaagaggggcaccauucugccuggccagcu

SEQ ID NO: 37805 - RNA, 42 nt, Mus musculus
acaugacagcucacaacuguguguaacuccaguuccagggga

SEQ ID NO: 37806 - RNA, 56 nt, Mus musculus
aguacugugagaauccuuuuuuuguuguuuggggagcuaccaguugaacuaagggg

SEQ ID NO: 37807 - RNA, 48 nt, Mus musculus
auauauguaugugaacuauaugaauauagugacaauggaggucagaag

SEQ ID NO: 37808 - RNA, 44 nt, Mus musculus
augguugauauuuuuacuuaauucauucuguaauuugauacagg

SEQ ID NO: 37809 - RNA, 46 nt, Mus musculus
ggagcuugcgcucgucaaccaccucgaugacagccgguggcgggaa

SEQ ID NO: 37810 - RNA, 46 nt, Mus musculus
gccagggcuacccagagaaacccugucuugaaaaaaacaaacagaa

SEQ ID NO: 37811 - RNA, 46 nt, Mus musculus
ccuagcauguauaagacacagucauucacuagcaucggaggaagaa

SEQ ID NO: 37812 - RNA, 45 nt, Mus musculus
ugguuucugggaauugaacucaggaggaauugaacucaggaccuc

SEQ ID NO: 37813 - RNA, 44 nt, Mus musculus
accuuggagugaaaccauuaagcuugugcgucaaguaaugguga

SEQ ID NO: 37814 - RNA, 47 nt, Mus musculus
uauuauauauguaaguacacuguaguugucuucagacacuccagaag

SEQ ID NO: 37815 - RNA, 63 nt, Mus musculus
uguccauggguucaauucccagcaccaaaagaaaaggaaaaagggagccaggugugguggccc

SEQ ID NO: 37816 - RNA, 76 nt, Mus musculus
auagaaagguuaguggaauaugaaaugaagugagagguuuggcuguuuggagguuggggcaguguggcucucagag

SEQ ID NO: 37817 - RNA, 75 nt, Mus musculus
cucgacguagguauguguugguguguguugguugugaaaacaugggaccaugugggaacaaaggaggucugcagg

SEQ ID NO: 37818 - RNA, 45 nt, Mus musculus
gcucagggggaaaccgagggugagugacugggggguggcggggaa

SEQ ID NO: 37819 - RNA, 45 nt, Mus musculus
agccacaucucacucccucgcccagacucacucacacacuagauu

SEQ ID NO: 37820 - RNA, 41 nt, Mus musculus
gagggacaaagggggggagcugaggcaaccuaggccgcgga

SEQ ID NO: 37821 - RNA, 45 nt, Mus musculus
caggaguuucaucuucgcuacaagaggaagguaaaauugcgugug

SEQ ID NO: 37822 - RNA, 27 nt, Mus musculus
ccgaguagugcauagaguagugguagc

SEQ ID NO: 37823 - RNA, 42 nt, Mus musculus
ccccccucgggacguggacuuuuaagggaggcccgugagguc

SEQ ID NO: 37824 - RNA, 45 nt, Mus musculus
ggggucccagcccguccucucugccagggacuggcgcccaggcgu

SEQ ID NO: 37825 - RNA, 41 nt, Mus musculus
aacugaaucuucuugcgguccuugggguccauggcgggcgg

SEQ ID NO: 37826 - RNA, 42 nt, Mus musculus
guacacagagaaacccugucucagaaaaaaaaaagagucaag

SEQ ID NO: 37827 - RNA, 46 nt, Mus musculus
agcagaagccuggaaucacagcauccagaaaguagaggcaagaaga

SEQ ID NO: 37828 - RNA, 42 nt, Mus musculus
ucgguuguccugugucucgccuuaguuuuuagaaagggauga

SEQ ID NO: 37829 - RNA, 41 nt, Mus musculus
guucaugggcacuuuuccaaaggaaauauuauguaagaaga

SEQ ID NO: 37830 - RNA, 45 nt, Mus musculus
uuuacaaagauuuauuacagcguaggagggguucaggccuagagu

SEQ ID NO: 37831 - RNA, 46 nt, Mus musculus
gguauugccacgcuggggagaggaccaaacugcagagggcacagau

SEQ ID NO: 37832 - RNA, 47 nt, Mus musculus
gacgcacgggugaggacuuugggguuuggggcugaauggcuucagga

SEQ ID NO: 37833 - RNA, 45 nt, Mus musculus
gcuuugaggcgaccuaccuggagcuggcgagcgcugugaaggagg

SEQ ID NO: 37834 - RNA, 51 nt, Mus musculus
gagcuggcguggaggguuaauuuacccacagaacgaugcugauaggaaggg

SEQ ID NO: 37835 - RNA, 50 nt, Mus musculus
guugggucuuacuuagaauggacaagauaacugcagccgauauggaucag

SEQ ID NO: 37836 - RNA, 52 nt, Mus musculus
ggcaacccacgauggguaggcuguggggcaggggagauuaggaaaggaagau

SEQ ID NO: 37837 - RNA, 45 nt, Mus musculus
ucugcacaccgugaaagggacgcccuucgagacuccagaccaagg

SEQ ID NO: 37838 - RNA, 42 nt, Mus musculus
gcgucccugucgucuggacccucaccaaccuuauccacaacc

SEQ ID NO: 37839 - RNA, 45 nt, Mus musculus
ccacauccuacccgugcacauccuacccguguugaugucagcugu

SEQ ID NO: 37840 - RNA, 45 nt, Mus musculus
ggaagggagcgaggucaggugaggccgagaagagaggcgguagga

SEQ ID NO: 37841 - RNA, 26 nt, Mus musculus
agugggacguagaauucuaacuuugc

SEQ ID NO: 37842 - RNA, 46 nt, Mus musculus
gaggagcuaguaggggcauggucgcagauaaacauaauccuggagu

SEQ ID NO: 37843 - RNA, 46 nt, Mus musculus
aauuaaguagugguugaaagaagcaggcgaggacuugaggggccgg

SEQ ID NO: 37844 - RNA, 41 nt, Mus musculus
uacaggugagaugucucaacaccaauaggaaucaugaacua

SEQ ID NO: 37845 - RNA, 46 nt, Mus musculus
auucccugaugcugcucugauguguguccgugacugacuugaccag

SEQ ID NO: 37846 - RNA, 46 nt, Mus musculus
ucucucucucugucucucucugucugucugucucucucugugucuc

SEQ ID NO: 37847 - RNA, 46 nt, Mus musculus
augcuguaaggacagagauguguuuucauacagaagcaaaggggag

SEQ ID NO: 37848 - RNA, 45 nt, Mus musculus
ccaggggaagacuuccugaaugagauaagaauggggcagcuggug

SEQ ID NO: 37849 - RNA, 46 nt, Mus musculus
agggugccagacacauuaacugugccccuaggggagaugcacgaag

SEQ ID NO: 37850 - RNA, 45 nt, Mus musculus
auaguguauguacguauaugugugugugugugugugugugugugu

SEQ ID NO: 37851 - RNA, 46 nt, Mus musculus
gcgaccgagcacucccagagagagcuggacacugucaccuuagaag

SEQ ID NO: 37852 - RNA, 45 nt, Mus musculus
acaaauacaaaugcuacuuucuacauagcaauaacaggcgcuaga

SEQ ID NO: 37853 - RNA, 91 nt, Mus musculus
aaauggguucuguagcucuaggcuccuuuagcaaacucccucggagagccauuucuaccuucugccuuccuucuguaguugaagcaucuaa

SEQ ID NO: 37854 - RNA, 45 nt, Mus musculus
cuggcugucagcagagcaggagccugcaccucucugucccuaguc

SEQ ID NO: 37855 - RNA, 45 nt, Mus musculus
cacugcagaugauccgccaguuggcagggccacuguacagcgaga

SEQ ID NO: 37856 - RNA, 42 nt, Mus musculus
cccggaaauucaucaagugaguagagcuaugcccugcugugc

SEQ ID NO: 37857 - RNA, 46 nt, Mus musculus
cauccagccgaauccuggccugauccugcgggcagagcccacgguc

SEQ ID NO: 37858 - RNA, 46 nt, Mus musculus
acaggaaugcuaaaauaggugacacccaugucuucagggcucagug

SEQ ID NO: 37859 - RNA, 46 nt, Mus musculus
guguggaaggaaggcagaggacguguugggggugggggugggggug

SEQ ID NO: 37860 - RNA, 33 nt, Mus musculus
gcuggccuagcacugagcuccguaccccucagc

SEQ ID NO: 37861 - RNA, 46 nt, Mus musculus
uugguuauaaauaaacaaacacuggccgggaacggcacggucauuc

SEQ ID NO: 37862 - RNA, 42 nt, Mus musculus
aaccauccagcucccccuacagguuggcauucagcaggguuc

SEQ ID NO: 37863 - RNA, 25 nt, Mus musculus
aaaguagaggaggggcuggggacaa

SEQ ID NO: 37864 - RNA, 46 nt, Mus musculus
uccucccucccucuccuucccuccacccuuccuucccuuucuccuu

SEQ ID NO: 37865 - RNA, 48 nt, Mus musculus
caaggucucuauggugaguagaaguuagccacacagaugaaugagaau

SEQ ID NO: 37866 - RNA, 45 nt, Mus musculus
guuuaugguaugauuagggcagaguauagaaaugaagagaggaua

SEQ ID NO: 37867 - RNA, 45 nt, Mus musculus
guaggaaaagaaggaauuacaacuucagggccgaggaagguagag

SEQ ID NO: 37868 - RNA, 41 nt, Mus musculus
ugguaaaugauuuccuuaguaggugucaagauggcgcugcc

SEQ ID NO: 37869 - RNA, 42 nt, Mus musculus
ucuggcgucacuggcaggguuuuauguccacgaaugcaggug

SEQ ID NO: 37870 - RNA, 42 nt, Mus musculus
gugugagcuuguaguaguggggguguacuugauggucccuag

SEQ ID NO: 37871 - RNA, 41 nt, Mus musculus
cgggggggggaacuguagcccacacauagcccacacaugag

SEQ ID NO: 37872 - RNA, 41 nt, Mus musculus
ugggaguucagcugccuagguuugaacccuaaaugcugcuu

SEQ ID NO: 37873 - RNA, 45 nt, Mus musculus
ggaucaggauccucuuucccacaagccccauuuauucagccccug

SEQ ID NO: 37874 - RNA, 42 nt, Mus musculus
cauccaucccuucaaauguggaggcugggcauaaccagggag

SEQ ID NO: 37875 - RNA, 42 nt, Mus musculus
cuuggcagugcccagacacauuuggaguuaaggcugggccag

SEQ ID NO: 37876 - RNA, 49 nt, Mus musculus
aauggaacagaagccaagcaagguggagugugggucagacccagaggag

SEQ ID NO: 37877 - RNA, 45 nt, Mus musculus
ccaagcaaagcccuugugcccaagaccgguucuuuggagggucag

SEQ ID NO: 37878 - RNA, 46 nt, Mus musculus
ggcucacaaccaucuguaaugagaucugacucccucuucugagugu

SEQ ID NO: 37879 - RNA, 46 nt, Mus musculus
agaagauugccaaagguucuuuuuagcagaggaucaaaggccacag

SEQ ID NO: 37880 - RNA, 41 nt, Mus musculus
ggaccaccaccuccugcagguacaggucuuuccagaaggag

SEQ ID NO: 37881 - RNA, 42 nt, Mus musculus
gcccuuggacagggccauaaaugaacuugcuaugaaaggcag

SEQ ID NO: 37882 - RNA, 46 nt, Mus musculus
aguaggaagaauugagagggacaugccaucuugacuguagggucag

SEQ ID NO: 37883 - RNA, 65 nt, Mus musculus
aagaaaaacuagacagaaaaaaaaaacaaaaaacaaaaacaaaaagacaaaaaaagagagcguua

SEQ ID NO: 37884 - RNA, 41 nt, Mus musculus
agagagagagggagggaggagguggcccucccagaguggaa

SEQ ID NO: 37885 - RNA, 45 nt, Mus musculus
ucuuccccugacuccacuccccuccauucccauucucagccauag

SEQ ID NO: 37886 - RNA, 76 nt, Mus musculus
cucccccucagugauguggaguguauguguguguuccuucgugugaguggaugagugagucuacguugugggagga

SEQ ID NO: 37887 - RNA, 41 nt, Mus musculus
aggagagagaagugcagaguucgauucuguacaagggggca

SEQ ID NO: 37888 - RNA, 45 nt, Mus musculus
acuucuggaauguaauuuaaccgaaggucaccagcuccggccuag

SEQ ID NO: 37889 - RNA, 42 nt, Mus musculus
gggcacagacggugcccauugcuguuagguugguggcagcug

SEQ ID NO: 37890 - RNA, 41 nt, Mus musculus
uugaaguuaccaggugaggugccuaacuugucaugggcaua

SEQ ID NO: 37891 - RNA, 45 nt, Mus musculus
gugggggcuggugcaggaggaggugaggggcccauggagccagag

SEQ ID NO: 37892 - RNA, 42 nt, Mus musculus
aggcgugcacuccauaguggaagccugaggccacguccccac

SEQ ID NO: 37893 - RNA, 42 nt, Mus musculus
ugucuuccauggccacuuguagacuuccuggggggcucccgu

SEQ ID NO: 37894 - RNA, 42 nt, Mus musculus
gcuggcccuaaaaccaagcugggccgggacaacugaggggag

SEQ ID NO: 37895 - RNA, 45 nt, Mus musculus
gcccuccagaaggguaggacgcugaggcaccugagaucugauuug

SEQ ID NO: 37896 - RNA, 44 nt, Mus musculus
ccguguguagcuucugggaggcuuacauaaacacuggcuaggau

SEQ ID NO: 37897 - RNA, 30 nt, Mus musculus
ucugugcugguugcaaaaaugcagacgugu

SEQ ID NO: 37898 - RNA, 46 nt, Mus musculus
gacaacucugcuuccucucucucuucagguucauagcccuggagca

SEQ ID NO: 37899 - RNA, 45 nt, Mus musculus
uuucagggccaggcagugguggcacacgccuuuaaucccagcacu

SEQ ID NO: 37900 - RNA, 42 nt, Mus musculus
auucccagcaaccacauggcucccaaccacccguaaugagau

SEQ ID NO: 37901 - RNA, 45 nt, Mus musculus
caaggcuacuuccaaggcaguagucagcugacacagucaccaucc

SEQ ID NO: 37902 - RNA, 46 nt, Mus musculus
uauuauuuuugaggagcauguuauaaagaaacaacacaggucagag

SEQ ID NO: 37903 - RNA, 44 nt, Mus musculus
ggcuuuggcgcgaguugacuuugcagcugcuguagaauuugugg

SEQ ID NO: 37904 - RNA, 45 nt, Mus musculus
agaagcgguucgagcacgccgcguugggaaggagagagcugcugg

SEQ ID NO: 37905 - RNA, 45 nt, Mus musculus
ggugauuuggccauaucugaagauuguucccguugaggggguggu

SEQ ID NO: 37906 - RNA, 48 nt, Mus musculus
caggaauuuucugaaggagcacaucugugggaagaaagcuggcagucu

SEQ ID NO: 37907 - RNA, 65 nt, Mus musculus
aaggcgugcaccaccacgccuggcuaacaauugacucuuaaagguucaggaagaauagaugguug

SEQ ID NO: 37908 - RNA, 45 nt, Mus musculus
ugaagaugacauaacuccgguguuuguuuguuuguuuuaaccuag

SEQ ID NO: 37909 - RNA, 48 nt, Mus musculus
ccugaggagugcccaggcuguguucccagcuauugcucaggagauugg

SEQ ID NO: 37910 - RNA, 45 nt, Mus musculus
uugaugagaaaacuggaaaagcacuugacagcagagaaaggcccc

SEQ ID NO: 37911 - RNA, 74 nt, Mus musculus
uccaucuguaggagaagguaaugccugguacguagaagggagaaaggaaaaaagaugcuaugagcaagcaucag

SEQ ID NO: 37912 - RNA, 43 nt, Mus musculus
cuugugguaaagcaaucgaagcagauugguguggggcaagugc

SEQ ID NO: 37913 - RNA, 45 nt, Mus musculus
ccggcucuggggaggguagguacuacaugcuaggcuagcccgugg

SEQ ID NO: 37914 - RNA, 46 nt, Mus musculus
aggcuugcuggcaucugucuggguucuugcuuauucaggaggguag

SEQ ID NO: 37915 - RNA, 46 nt, Mus musculus
gagucgccgguccccaagcgcguuggucuugcucacauaucccaag

SEQ ID NO: 37916 - RNA, 46 nt, Mus musculus
caguagcaucugucgcaaacagcaggugacggccguagaccagucu

SEQ ID NO: 37917 - RNA, 41 nt, Mus musculus
cacuugcaggugucccucccacuggcauuugagagccccca

SEQ ID NO: 37918 - RNA, 46 nt, Mus musculus
ccucugucuacaaaggauauauuuuguaaagaacuuugaaguuuag

SEQ ID NO: 37919 - RNA, 69 nt, Mus musculus
gagagucuggaacuguaaggguuaacgagcacaacuguaaagauuguccgaagacugaugggaagcaga

SEQ ID NO: 37920 - RNA, 46 nt, Mus musculus
cuccgaggagaagcuggcgcgcugccgcccccccguggguugcgag

SEQ ID NO: 37921 - RNA, 78 nt, Mus musculus
ccccugcguacauugaugcacgggcaaggcgugugcacggagcugucggaaaucgaagccauccaggaaagccugcag

SEQ ID NO: 37922 - RNA, 49 nt, Mus musculus
uggcaaccagcuuugcuggaggaggaggaggaagaggaggaggaggagg

SEQ ID NO: 37923 - RNA, 46 nt, Mus musculus
ucuacaguuucacaucauggacuuuugaaauccgagaggguguucg

SEQ ID NO: 37924 - RNA, 49 nt, Mus musculus
gugaagguggagaugaaggagcugaagcugggacuuuggagaccauagg

SEQ ID NO: 37925 - RNA, 42 nt, Mus musculus
ggaacaaaccaaggacuucaagaggaauaugcucccaaagag

SEQ ID NO: 37926 - RNA, 82 nt, Mus musculus
agcgaacaucccaacaacagcuucaaccccugcagugcccaugaucacaggugccugcagaagcauauggccaaaauuagag

SEQ ID NO: 37927 - RNA, 46 nt, Mus musculus
aagaccucuucaucauccccauuccaaacugugaccgcaacggcaa

SEQ ID NO: 37928 - RNA, 46 nt, Mus musculus
ugucaccccgcccuggacggacagcguggcaagugcuggugugugg

SEQ ID NO: 37929 - RNA, 42 nt, Mus musculus
ugccagcaggugggggacucagugcccccuacuaggccccua

SEQ ID NO: 37930 - RNA, 55 nt, Mus musculus
uggagucugaguccuggcugucugccucuggcccugcccaaaauuucccuuugug

SEQ ID NO: 37931 - RNA, 126 nt, Mus musculus
cauccaccugaaaacacguauugaaaacauacuaugugccagcuuuaguuuucagcgccgggaagccucguugugauuuccuccgauuguagaaugugacgagguguucucaacucaaggcccacg

SEQ ID NO: 37932 - RNA, 42 nt, Mus musculus
aaguggugaacauugaacgcccucccucuccaucuuggccag

SEQ ID NO: 37933 - RNA, 84 nt, Mus musculus
ucuuuggucaggguauucggucauccgacaaugccuugcagguagaucucugcugugggaaaggaauggggugaggaaggccgg

SEQ ID NO: 37934 - RNA, 63 nt, Mus musculus
aaggacagggggcagggaggugggcucaucacucugagccugcaggagagaggaaagaaugug

SEQ ID NO: 37935 - RNA, 42 nt, Mus musculus
cuguaguccauuauaagaacauuccauuccuuaagcucugcc

SEQ ID NO: 37936 - RNA, 44 nt, Mus musculus
cccuccugcccacucuccuuguccucaggaguagacgugccuuc

SEQ ID NO: 37937 - RNA, 45 nt, Mus musculus
acucuuaacuauucugauggcauuggacagccacacguggagaag

SEQ ID NO: 37938 - RNA, 46 nt, Mus musculus
aaauuaggaaguauaugaaaggggcuggagagguggaucagugguu

SEQ ID NO: 37939 - RNA, 54 nt, Mus musculus
aacaagaucugacucccucuucuggugugucugaauacagcuacaguguacuua

SEQ ID NO: 37940 - RNA, 25 nt, Mus musculus
aaaaaaaaggaagccagaagcgaga

SEQ ID NO: 37941 - RNA, 44 nt, Mus musculus
cagccgcaaucuucuccaugucuacuuccaccuucagaccacau

SEQ ID NO: 37942 - RNA, 44 nt, Mus musculus
gaucuagccaccaucaggcaugcaggggcaggggcugcugggcc

SEQ ID NO: 37943 - RNA, 46 nt, Mus musculus
auucucucuauguagucuuggaacucacuauauagaccaggcugac

SEQ ID NO: 37944 - RNA, 45 nt, Mus musculus
gaauuuccucuucuuuuccuggugucguuccucuaucugaaggag

SEQ ID NO: 37945 - RNA, 46 nt, Mus musculus
caaaaaaagggaagguggagcugaaaguugagaggaggaggaggag

SEQ ID NO: 37946 - RNA, 42 nt, Mus musculus
aggaucacauggauacuccugucccacuaacauggccaccaa

SEQ ID NO: 37947 - RNA, 46 nt, Mus musculus
cauaaaaucaaggcaaaaugcauaaaaagaaugugguaaagaagag

SEQ ID NO: 37948 - RNA, 72 nt, Mus musculus
aaaagacacaggaacucauuaguaauaaaaguagacuagccugcagugaguugguagagggaauggaaggaa

SEQ ID NO: 37949 - RNA, 46 nt, Mus musculus
aaauuuagaguuauauuagagauggauuuuuagguuuuugcuuaug

SEQ ID NO: 37950 - RNA, 46 nt, Mus musculus
uuuuauccugcaauuguucaugcuaaaaaugacuugggggcaagaa

SEQ ID NO: 37951 - RNA, 46 nt, Mus musculus
guuugaggagcaguuagauuuaauuagugaguacaccacgacccag

SEQ ID NO: 37952 - RNA, 46 nt, Mus musculus
uuagaaaugcaacagaaagcccugaagaauuguguggacugcugag

SEQ ID NO: 37953 - RNA, 102 nt, Mus musculus
cugcacccaguccagcugcugucagcccaccugcacccaguccagcuguugucagcccaccugcacccaguccagcuguugucagcccaccugcacccaguc

SEQ ID NO: 37954 - RNA, 42 nt, Mus musculus
aaaguugucauugggagcaaugccagccccggcaucgaaggu

SEQ ID NO: 37955 - RNA, 41 nt, Mus musculus
uggaaauugugagggagaugcucaguguugggggccggguu

SEQ ID NO: 37956 - RNA, 42 nt, Mus musculus
auggguugugaauacugagaacaucaggugucgccuccagug

SEQ ID NO: 37957 - RNA, 62 nt, Mus musculus
aagggaucgcugaugauuacgauaaaaagaaacuagugaaggcguuuaagaaggugggucug

SEQ ID NO: 37958 - RNA, 45 nt, Mus musculus
guguaacuccuucaugcaauaaacugaaaagagccaugcugugua

SEQ ID NO: 37959 - RNA, 46 nt, Mus musculus
uggaacaaagcaaugacaagguuucagccaagccaagaaccccaag

SEQ ID NO: 37960 - RNA, 46 nt, Mus musculus
aagucauggacauuuaguucaccaccaggguggucuuuugaagcag

SEQ ID NO: 37961 - RNA, 46 nt, Mus musculus
cguuucuauuacugugugugacguaaaguguaucugcgugaggguu

SEQ ID NO: 37962 - RNA, 42 nt, Mus musculus
cuaggccuggaacgaaggccucugccagcaagggccacaguu

SEQ ID NO: 37963 - RNA, 42 nt, Mus musculus
ggcuggaggaggacagggccacucacucucccagugccaggg

SEQ ID NO: 37964 - RNA, 50 nt, Mus musculus
uacuauuuacauaguugccuccagucccccuuggcuagaacugcugccuc

SEQ ID NO: 37965 - RNA, 49 nt, Mus musculus
cccuccugccagugggacaagcuuucgaucaucaaccauaugagaggug

SEQ ID NO: 37966 - RNA, 45 nt, Mus musculus
cagcaacuguccaacuggcaggacgcccacucuaagcggcagcag

SEQ ID NO: 37967 - RNA, 44 nt, Mus musculus
gccuagacgugacacucacugcagggaggggcggaagaaggagc

SEQ ID NO: 37968 - RNA, 46 nt, Mus musculus
gugugcccuggguuucagcccugcuggcugauuucugccuucagau

SEQ ID NO: 37969 - RNA, 41 nt, Mus musculus
uggggagauccggagcuguggagaggguguuagggccagau

SEQ ID NO: 37970 - RNA, 42 nt, Mus musculus
caugugaggcucccuggggucacccagccgucccugcugcuu

SEQ ID NO: 37971 - RNA, 42 nt, Mus musculus
agaccagugucauuucccgggacaucgacacagcagccaagu

SEQ ID NO: 37972 - RNA, 42 nt, Mus musculus
aaucaggccugugucugccucccuccugagcagaccagaggc

SEQ ID NO: 37973 - RNA, 45 nt, Mus musculus
agcucugcugcucaauaaauguuuauuguugaaaugaaucauaac

SEQ ID NO: 37974 - RNA, 46 nt, Mus musculus
cucucuugugucuuugaaccgcagacugguagccauauugcugguu

SEQ ID NO: 37975 - RNA, 46 nt, Mus musculus
cucuguuguaagacccugucucaaaauaaaacaaaaggaaaaaccu

SEQ ID NO: 37976 - RNA, 55 nt, Mus musculus
gaaggcgagggcgacuaugaggaaggucucuaugcugacugguggcaagagccag

SEQ ID NO: 37977 - RNA, 41 nt, Mus musculus
cgggaguugcuagacuucacacacauguaccuucagucaga

SEQ ID NO: 37978 - RNA, 42 nt, Mus musculus
ggugaggagccagcacauauucugagaggcgucugggggguu

SEQ ID NO: 37979 - RNA, 41 nt, Mus musculus
gggcugugaaacuuuacaacagcggggacuuucgcagcagc

SEQ ID NO: 37980 - RNA, 42 nt, Mus musculus
ugagucccucaccgaccuggaggcccagcccuacgaggugug

SEQ ID NO: 37981 - RNA, 45 nt, Mus musculus
ugcagaugggggauuuugugcguuaccacuacaauggcacuuucg

SEQ ID NO: 37982 - RNA, 41 nt, Mus musculus
cccagcaaccacaugguggcuuacaaccauucguaaugaga

SEQ ID NO: 37983 - RNA, 46 nt, Mus musculus
gguuguaagccaccaugugguugcugggauuugaacuucggacuuu

SEQ ID NO: 37984 - RNA, 42 nt, Mus musculus
cuggaaguguaguuccagcaucccaguuguaaucccagcacc

SEQ ID NO: 37985 - RNA, 45 nt, Mus musculus
agaggcacccaaagggcacuggauguccucauccaucacucuaug

SEQ ID NO: 37986 - RNA, 46 nt, Mus musculus
auuauauguaaguacauuguagcugucuucagacacgccagaagag

SEQ ID NO: 37987 - RNA, 42 nt, Mus musculus
cacuguucugcaccauucgggggcaguagggagggcgcagga

SEQ ID NO: 37988 - RNA, 45 nt, Mus musculus
ucccuacugcccccgaauggugcagaacagugacuuugugcgcua

SEQ ID NO: 37989 - RNA, 43 nt, Mus musculus
aucaaaggcauggaccaggggcugcugggcaugugcccuggag

SEQ ID NO: 37990 - RNA, 46 nt, Mus musculus
ccucaggacacccccugaccuggaaucaaagaggguaccauccauc

SEQ ID NO: 37991 - RNA, 46 nt, Mus musculus
gccucggggagcuaugggugugaaaugcagagaaaugaggguguaa

SEQ ID NO: 37992 - RNA, 45 nt, Mus musculus
aggccccucaagagaucacccucggagccaacaaagugaucgaag

SEQ ID NO: 37993 - RNA, 45 nt, Mus musculus
aggagagaggaggcagcucauugugcccccacaccuggcccacgg

SEQ ID NO: 37994 - RNA, 42 nt, Mus musculus
cccgugggccaggugugggggcacaaugagcugccuccucuc

SEQ ID NO: 37995 - RNA, 51 nt, Mus musculus
cuuccacuagccuuuuugaagacauggaucucaauaaagauggagaggugc

SEQ ID NO: 37996 - RNA, 46 nt, Mus musculus
cucugcucuccccucccccaguucucuuccuucaucaaggcucaag

SEQ ID NO: 37997 - RNA, 69 nt, Mus musculus
cagugacauguuucagaaccaggaccggaaccaggauggcaagaucacagcugaggagcucaagcugaa

SEQ ID NO: 37998 - RNA, 46 nt, Mus musculus
ugggaagaccacaguagucuccacugauauccagugacucccagag

SEQ ID NO: 37999 - RNA, 46 nt, Mus musculus
ggcacugagauuugguuagggccaucgcgaaccccacacacccauc

SEQ ID NO: 38000 - RNA, 47 nt, Mus musculus
gugaaggaccaagaagcucacccuugccgugccuagugacgugagau

SEQ ID NO: 38001 - RNA, 45 nt, Mus musculus
uucacuuucccagacgugcccuuuauuuguacuguccugucccau

SEQ ID NO: 38002 - RNA, 46 nt, Mus musculus
cucuaaaaugaaagguuguguaagaggaaagccugcucaggcccaa

SEQ ID NO: 38003 - RNA, 46 nt, Mus musculus
uaaacugauccaguccuuucuccuuugugucaauaaaaggcuaaac

SEQ ID NO: 38004 - RNA, 46 nt, Mus musculus
auuuuaaacggacauaacagcauuuguaauaauaaucgugcagguc

SEQ ID NO: 38005 - RNA, 44 nt, Mus musculus
cacucgguguagagagaagacuucuguuuuagguacuggagaga

SEQ ID NO: 38006 - RNA, 42 nt, Mus musculus
uuucuuuucugauuagucauuccuuccaacuuaccuguagau

SEQ ID NO: 38007 - RNA, 44 nt, Mus musculus
gcccugcagcggggcugaggcauuggaggaaggagcauccaccu

SEQ ID NO: 38008 - RNA, 46 nt, Mus musculus
ugcuucuucauuuucuaaggaguaacucuugggacagcaugaugcu

SEQ ID NO: 38009 - RNA, 46 nt, Mus musculus
ucaauaagcgguaaagauuccacaucuugccacugucgagucucug

SEQ ID NO: 38010 - RNA, 46 nt, Mus musculus
aaccaugauuacguccauguuuuguccauagcgagguaacagugag

SEQ ID NO: 38011 - RNA, 45 nt, Mus musculus
agaauccacagugauuuccaaguccgaaagccagucccgaaugag

SEQ ID NO: 38012 - RNA, 44 nt, Mus musculus
gaaauuucuccguaucauaucugcagcuuucagagcaagcuggc

SEQ ID NO: 38013 - RNA, 44 nt, Mus musculus
uuggccacuguaaagcagcacuguuaugagguauggccuuguug

SEQ ID NO: 38014 - RNA, 46 nt, Mus musculus
uuccgaaaacugacccgagaguaagggcgugaaguacucgguggca

SEQ ID NO: 38015 - RNA, 45 nt, Mus musculus
gguguuguaugagugugugugugugugugugugugugugugugug

SEQ ID NO: 38016 - RNA, 51 nt, Mus musculus
ccagugcugaggacuagggagggagggaagccagggguagacagggaagca

SEQ ID NO: 38017 - RNA, 45 nt, Mus musculus
uacuuucaguuuggcuaaugaaggccaacuacuuaaaacccagaa

SEQ ID NO: 38018 - RNA, 46 nt, Mus musculus
gugacagaccagcacuggccccucacucagcagcaccuggggaauc

SEQ ID NO: 38019 - RNA, 42 nt, Mus musculus
cacaguggggccagugccgaaguucagaaggaggaggagaag

SEQ ID NO: 38020 - RNA, 66 nt, Mus musculus
ggacaagaaugccucugaggacgagaucaagaaagcuuaccggaaacgggccuugaugcaccaucc

SEQ ID NO: 38021 - RNA, 44 nt, Mus musculus
cagaacacaaacagcuccuuaagaaugcacagcuggaacugaag

SEQ ID NO: 38022 - RNA, 50 nt, Mus musculus
cacagagcaguuugaagaagccgugcgggacuaugaaaaaguguaucaga

SEQ ID NO: 38023 - RNA, 46 nt, Mus musculus
cacucagaugucagguucgguguuguuuguuuguuucgggacaggu

SEQ ID NO: 38024 - RNA, 47 nt, Mus musculus
augcggugaagcucgaugacacuuacaucaaagccuaccugagaaga

SEQ ID NO: 38025 - RNA, 45 nt, Mus musculus
uagcauaugaacuguacacagaagccuuggggauagaucccaaca

SEQ ID NO: 38026 - RNA, 46 nt, Mus musculus
ugacagcuccacuugucaguguguuaaaccuucccugugggggccg

SEQ ID NO: 38027 - RNA, 42 nt, Mus musculus
cucgaugggguauugguguacuuacugaaugaacgaacgugu

SEQ ID NO: 38028 - RNA, 42 nt, Mus musculus
ucauggugaugucacaaaugaagaauuaugauccuggcaggg

SEQ ID NO: 38029 - RNA, 45 nt, Mus musculus
caggagauuuaugcgcuccuucaaccaggugauuucaguccaagg

SEQ ID NO: 38030 - RNA, 46 nt, Mus musculus
agcaucucaaaacugcccaaccccuggcuuaugguggccauauuuu

SEQ ID NO: 38031 - RNA, 42 nt, Mus musculus
cguucguguuugguaaccacaaacaucaaaaagggaguauug

SEQ ID NO: 38032 - RNA, 90 nt, Mus musculus
gaagcagaauccuucaaggaacaagggaaugcauauuaugcuaagaaggacuacaacgaagcuuauaacuauuacacaaaagccauaggu

SEQ ID NO: 38033 - RNA, 45 nt, Mus musculus
aguacacuauaucugucuucagacacaccagaagagagcaucaga

SEQ ID NO: 38034 - RNA, 42 nt, Mus musculus
auugaaagauuucaguugagacucuuaaguguugcaggugag

SEQ ID NO: 38035 - RNA, 46 nt, Mus musculus
uguuacuaauaagcuuugugcugcuggcacagugggggugcuuugg

SEQ ID NO: 38036 - RNA, 49 nt, Mus musculus
cuaguugagcauggaacucccauggcucacauaauagugauguccacug

SEQ ID NO: 38037 - RNA, 46 nt, Mus musculus
cucugcuagucucagagcugguggcaggccgcuggucuuguguguu

SEQ ID NO: 38038 - RNA, 46 nt, Mus musculus
ccagcacucgggaggcagaggcaggaagaaaggaaggaagggagaa

SEQ ID NO: 38039 - RNA, 45 nt, Mus musculus
ugaguuuaacccagcauaaauuaagagggguacaguggcacaacu

SEQ ID NO: 38040 - RNA, 50 nt, Mus musculus
aaaaaaagaagggggggggagaaaauugugugugugugugugugugugug

SEQ ID NO: 38041 - RNA, 46 nt, Mus musculus
ggguaagcccaguguacauauugaguuccaggccagccaaggcuac

SEQ ID NO: 38042 - RNA, 46 nt, Mus musculus
aagguugacccuggaauauaaagaaccuugggauuuaaaaagaaga

SEQ ID NO: 38043 - RNA, 45 nt, Mus musculus
aguugugagcugccaugugggugcugggacuugaaccuggguucu

SEQ ID NO: 38044 - RNA, 46 nt, Mus musculus
auucuguauccucccaaacaucagugcuugaaugugugugagcaug

SEQ ID NO: 38045 - RNA, 46 nt, Mus musculus
gcuuacucugagaaaguuagcaccuguugaaaugaggacccaagag

SEQ ID NO: 38046 - RNA, 46 nt, Mus musculus
uugaccaucucugugaaucuauuaccuuuugacaauagugggagca

SEQ ID NO: 38047 - RNA, 46 nt, Mus musculus
auggggauccgaugcccucuucuggugugucugaagacagcgacag

SEQ ID NO: 38048 - RNA, 44 nt, Mus musculus
gugugugugugugugugugugugugugagagagagagcgagaac

SEQ ID NO: 38049 - RNA, 47 nt, Mus musculus
agugcgaugugguaauggcggcgaccgagccugaacugcuggaggac

SEQ ID NO: 38050 - RNA, 41 nt, Mus musculus
gacacacugcaaagucaggaagguagucuuggggggggcuu

SEQ ID NO: 38051 - RNA, 42 nt, Mus musculus
cuguaagaucuggggucccuggcuggaguuucuccagcugag

SEQ ID NO: 38052 - RNA, 53 nt, Mus musculus
agauggagguggauguugcggaucccagcugggggcuacuugucgaugagccc

SEQ ID NO: 38053 - RNA, 50 nt, Mus musculus
gacaguauucgcugucugggggauuguacucccggcaguuggcgaugacc

SEQ ID NO: 38054 - RNA, 45 nt, Mus musculus
uucuucacagguuccaugaagggccaggcacuggggugugacuag

SEQ ID NO: 38055 - RNA, 25 nt, Mus musculus
ucuugaugaugugggacagcucugu

SEQ ID NO: 38056 - RNA, 45 nt, Mus musculus
gagaacagagggcaggaacggaacccugaaagguggagcccuguu

SEQ ID NO: 38057 - RNA, 46 nt, Mus musculus
aaaucccagcaaccauauggugccucacaaccauccgcaaugagau

SEQ ID NO: 38058 - RNA, 42 nt, Mus musculus
ugaaaugccucgggucaucaggcucaggcaccuggcccagcu

SEQ ID NO: 38059 - RNA, 44 nt, Mus musculus
guucugccccacacuacgaaguguuuguagagcugaggggguug

SEQ ID NO: 38060 - RNA, 46 nt, Mus musculus
agaaaggaaggaaggaagaaaaaagaaagaaagaaagaaaggaaga

SEQ ID NO: 38061 - RNA, 45 nt, Mus musculus
caagcaguggggcaguggccaggggccaagcuguuggaccauguc

SEQ ID NO: 38062 - RNA, 46 nt, Mus musculus
gccgccugggugacgugguccaggugguugguaccuacaaucagug

SEQ ID NO: 38063 - RNA, 44 nt, Mus musculus
gugacucacagccaugggaguaaugggauucgaugcccccuucu

SEQ ID NO: 38064 - RNA, 46 nt, Mus musculus
cguucaggacagggagcuucuagcggaggugaagagaccagcaggu

SEQ ID NO: 38065 - RNA, 46 nt, Mus musculus
cacacauacaccacacacacacacacacagagagagagagaguguu

SEQ ID NO: 38066 - RNA, 42 nt, Mus musculus
cuugagacaccugccccgugcuccaccccuaagcagccgaac

SEQ ID NO: 38067 - RNA, 45 nt, Mus musculus
ucugaccucggagugugcuaccucccccaugugaggagcugaaac

SEQ ID NO: 38068 - RNA, 24 nt, Mus musculus
guccaggauagccggggcucuauu

SEQ ID NO: 38069 - RNA, 41 nt, Mus musculus
ugcucaguuguccccaggaauagggaggacauggggugaga

SEQ ID NO: 38070 - RNA, 46 nt, Mus musculus
cuccgcucuaacuuauuguguaugcauguguguugggggugguccu

SEQ ID NO: 38071 - RNA, 46 nt, Mus musculus
aggcugcccagagacauuccucaggggcaaggccugggcaugagaa

SEQ ID NO: 38072 - RNA, 45 nt, Mus musculus
uguuggcagccuggggcagagcugacaucaagcuggagguguuga

SEQ ID NO: 38073 - RNA, 91 nt, Mus musculus
uugucuaccucuaccccgacauucccaaggaggaggcauuuggaaaguacuguaggcccgagagccaggagcaccccgaagccgacccagg

SEQ ID NO: 38074 - RNA, 44 nt, Mus musculus
aggaggggucacuuucacuuggguggaaaaggacaucaguggua

SEQ ID NO: 38075 - RNA, 41 nt, Mus musculus
gaccuagaggugaggccuucccagaaccaggcggcucgugu

SEQ ID NO: 38076 - RNA, 45 nt, Mus musculus
auguagugcauaugugaggaucauguccuugggucuuugggugga

SEQ ID NO: 38077 - RNA, 42 nt, Mus musculus
cugucugcagaguucaagcaccuggucgguguccgaggggag

SEQ ID NO: 38078 - RNA, 52 nt, Mus musculus
ucccucaucuauccagaaucccucaucuauccagaaucccucaucuauccag

SEQ ID NO: 38079 - RNA, 45 nt, Mus musculus
gugugcauugauaaguaaguauucuuuauguguguguguguguaa

SEQ ID NO: 38080 - RNA, 41 nt, Mus musculus
cgacccuaucgugcagcaccggcccaugcuggaggagagga

SEQ ID NO: 38081 - RNA, 42 nt, Mus musculus
agagcuggcugacuggaagaggcggcagcagaucgcgugcau

SEQ ID NO: 38082 - RNA, 45 nt, Mus musculus
gaaccuccaggacgacuuugauuucaacuacaaaacccucaagag

SEQ ID NO: 38083 - RNA, 46 nt, Mus musculus
gugacagagaagcagcagauguuggagcagcaucuucaggaugucc

SEQ ID NO: 38084 - RNA, 42 nt, Mus musculus
agcgacagcuuccccauggagcugcggcaguuccuggcaccu

SEQ ID NO: 38085 - RNA, 46 nt, Mus musculus
aguuguuuacgugguauucagcucuccuuccuuucuuaccccagau

SEQ ID NO: 38086 - RNA, 45 nt, Mus musculus
uucuucauguagaauaguuuggcaguauuaccuaucuugguuaga

SEQ ID NO: 38087 - RNA, 46 nt, Mus musculus
gacugaggcagggagaucagccagccuacacuacccagccauagca

SEQ ID NO: 38088 - RNA, 45 nt, Mus musculus
auauccaauuucaggucagcccgagcuacauauauggccccaaag

SEQ ID NO: 38089 - RNA, 45 nt, Mus musculus
ugaaggcaagcacacaugugaaggcccgugaacggaggaguagag

SEQ ID NO: 38090 - RNA, 46 nt, Mus musculus
guuuuuaauuuaauuuuauuuuuuaaaacuuaaaaugugugcagau

SEQ ID NO: 38091 - RNA, 46 nt, Mus musculus
aaaacucuguugaguuugaggccagacugaucuacagagggaguua

SEQ ID NO: 38092 - RNA, 45 nt, Mus musculus
agcuggggugugggaugugagcagacacugacuuaaacaugagaa

SEQ ID NO: 38093 - RNA, 45 nt, Mus musculus
agugguuaggguugaaucuuucuuaggaaggaggagacgggagag

SEQ ID NO: 38094 - RNA, 83 nt, Mus musculus
ccaucucuccagccccuaaaacaauuuuuuaaaagggaagcagagagaauaugauuggugguguguguucauaaaccccagug

SEQ ID NO: 38095 - RNA, 46 nt, Mus musculus
cuggcggcacaugcccuuaauuccagcacuuggaaggcagcagcag

SEQ ID NO: 38096 - RNA, 46 nt, Mus musculus
cugucuuugauggugaaaagaauguuuggcuugcucuggugcagau

SEQ ID NO: 38097 - RNA, 42 nt, Mus musculus
uagcccuaaaucuugaaggacuccuggugcuguggaccggcc

SEQ ID NO: 38098 - RNA, 46 nt, Mus musculus
gcccagaagccuuuuagcugauguuuucuaagagauggugauggug

SEQ ID NO: 38099 - RNA, 45 nt, Mus musculus
ucuucuuuuuaauguggaauuagacuguuaggauuugagccagcc

SEQ ID NO: 38100 - RNA, 41 nt, Mus musculus
ggggugcuuagagcugugaauggacacuuacauggggcagg

SEQ ID NO: 38101 - RNA, 44 nt, Mus musculus
uuuucuugguccccuucccuccucugaaugcuuggagacggaga

SEQ ID NO: 38102 - RNA, 46 nt, Mus musculus
agguuuucuccuaaggacacauuuguucccccuuuaauggcugauc

SEQ ID NO: 38103 - RNA, 42 nt, Mus musculus
uaaaguuucacauuagagaaagauccaugguagaagcagcug

SEQ ID NO: 38104 - RNA, 46 nt, Mus musculus
cggaaaauuaggguuccagcagggggcagcagcgaguuguggagaa

SEQ ID NO: 38105 - RNA, 44 nt, Mus musculus
aaaacugacuucccuccugacccggaagcugcccugcugucuug

SEQ ID NO: 38106 - RNA, 52 nt, Mus musculus
agucccacuuugguaggaucucaagacagcagggcagcuuccgggucaggag

SEQ ID NO: 38107 - RNA, 78 nt, Mus musculus
guguggggagaggggcuuauuuacaaagcuacaaaaccugcacacaggagcacgugaguauucuuuggaaagagagag

SEQ ID NO: 38108 - RNA, 71 nt, Mus musculus
gaguguuugguggauaaaggccccaccaaaauaagcagaaggcggguagagccugggaaagggugguaggu

SEQ ID NO: 38109 - RNA, 46 nt, Mus musculus
auuccacgaagauaaaauguguguagagagaccuuugcccagaggu

SEQ ID NO: 38110 - RNA, 50 nt, Mus musculus
ugcagagugagcucaaagccagcaugagcaauuuagccagaugcaguuuc

SEQ ID NO: 38111 - RNA, 46 nt, Mus musculus
cuuuuccucacccugggagacuccaaagcccaaauuucugcaagag

SEQ ID NO: 38112 - RNA, 68 nt, Mus musculus
cucugcccuggaggccggcgccugacccugccgcccccugaucccccaccccugcccacaccgccuuu

SEQ ID NO: 38113 - RNA, 46 nt, Mus musculus
aggugccgccuuucaccuuccacgucaagaagauccgcgagggcga

SEQ ID NO: 38114 - RNA, 110 nt, Mus musculus
gacgcgccugaagaccaaggagaaccuggagaagacacggcacacgcuggagaagcgcaugaacaagcugggcacgcgccuggugcccguggagcgacgagagaagcuga

SEQ ID NO: 38115 - RNA, 61 nt, Mus musculus
cgcguggacgacuucaagaaggccuucuccaaggagaagauggagaagaccaaggugcgca

SEQ ID NO: 38116 - RNA, 25 nt, Mus musculus
agucaagcugccggccaaacugagc

SEQ ID NO: 38117 - RNA, 42 nt, Mus musculus
gaccagucugucgaaugguccuuauacaggcagcacgcggag

SEQ ID NO: 38118 - RNA, 45 nt, Mus musculus
ugauuacacuaaauauucccagggacccuuacacaaaccgcugug

SEQ ID NO: 38119 - RNA, 46 nt, Mus musculus
uucuauuccagggcagagaaaacagaaccagaagaaauguucagac

SEQ ID NO: 38120 - RNA, 46 nt, Mus musculus
ccagaaaaaucagcuagcuccaucuucagggguuagggugggacag

SEQ ID NO: 38121 - RNA, 24 nt, Mus musculus
aggggaggcccaggccugggaguu

SEQ ID NO: 38122 - RNA, 45 nt, Mus musculus
augggcuggcaauggguguuggaaaaugguuguauucugcagugc

SEQ ID NO: 38123 - RNA, 46 nt, Mus musculus
ccaagaagaagccgaaugcacccucuggcccagccacgcccaagau

SEQ ID NO: 38124 - RNA, 45 nt, Mus musculus
ccacuguucugcacgagacggucauggcuacugaggggcuggaga

SEQ ID NO: 38125 - RNA, 42 nt, Mus musculus
uugacuuuuacaauagucagauuugacuuuuaaaacggggag

SEQ ID NO: 38126 - RNA, 42 nt, Mus musculus
aucuccuuauccugaguuucccauaaacucugccgcccccag

SEQ ID NO: 38127 - RNA, 47 nt, Mus musculus
aggcgcacgccaccacgagcaacaccgugagcaaguugcuggagaag

SEQ ID NO: 38128 - RNA, 47 nt, Mus musculus
agauccagcugacccaagcccagcuggaggagcgacaggcggagaug

SEQ ID NO: 38129 - RNA, 65 nt, Mus musculus
cuccauaucguugagcggccguauuccggauuucccgaugcuuccucagagggcccggagcccac

SEQ ID NO: 38130 - RNA, 87 nt, Mus musculus
agccgugcggggccgaccggguggaacuggagcgggagaccgggagagaaggaggagcgagagacuggacagcgagcaggagcccag

SEQ ID NO: 38131 - RNA, 74 nt, Mus musculus
ucucucccggucucccgcuccaguuccacccggucggccccgcacggcuccgggaagccauggaggaugucacg

SEQ ID NO: 38132 - RNA, 44 nt, Mus musculus
gggaaccucuuccuacgggagcugaccaaggaguuuggcacaga

SEQ ID NO: 38133 - RNA, 42 nt, Mus musculus
auggucccaagcacauucacauccaacacagcacccacagcg

SEQ ID NO: 38134 - RNA, 46 nt, Mus musculus
acaacaaaaacaacuaucaaugaagcuuuuaaggaggucaugagau

SEQ ID NO: 38135 - RNA, 42 nt, Mus musculus
cgucagaauucuacugaccaauauccaaaccaagagcaccuu

SEQ ID NO: 38136 - RNA, 45 nt, Mus musculus
acagauauuguguggccaguuaucgcaaagcuggcccgggaggag

SEQ ID NO: 38137 - RNA, 25 nt, Mus musculus
ugaagcuggcuggcagaguauggua

SEQ ID NO: 38138 - RNA, 42 nt, Mus musculus
gugcuuucuacaaaaagcccuggaaaaaagaggccucaaguc

SEQ ID NO: 38139 - RNA, 46 nt, Mus musculus
guguaaaaacuggauguagucaauggcuggaguaggagccaagaga

SEQ ID NO: 38140 - RNA, 46 nt, Mus musculus
agugcacuugaccucagccccccagcccccaauucagcaccccucu

SEQ ID NO: 38141 - RNA, 24 nt, Mus musculus
ugcuauggcagcugucuaccugaa

SEQ ID NO: 38142 - RNA, 45 nt, Mus musculus
uugaggaucuccugucccaccuaacucuauccccaggccccagga

SEQ ID NO: 38143 - RNA, 46 nt, Mus musculus
agucuggguaggagaauguaaauuugauguguuugggguagugggg

SEQ ID NO: 38144 - RNA, 41 nt, Mus musculus
uccagggagaaaaaauccacgaggacauuuuugacaucaua

SEQ ID NO: 38145 - RNA, 42 nt, Mus musculus
cccaaaaaacuagugcagacauacucuguguuccccaaccag

SEQ ID NO: 38146 - RNA, 45 nt, Mus musculus
auagccacagaccgccuacacauccagaacccauccuucucccag

SEQ ID NO: 38147 - RNA, 46 nt, Mus musculus
guguccaccaucaugucagccagcaccaccacccugcgcuacccug

SEQ ID NO: 38148 - RNA, 53 nt, Mus musculus
ccaccccucggcuccacuuucucaugacuggcuauaccccccucaccacggac

SEQ ID NO: 38149 - RNA, 58 nt, Mus musculus
uccuggaugucaugaggcgccugcuacagcccaagaaugugaugguguccacaggccg

SEQ ID NO: 38150 - RNA, 42 nt, Mus musculus
cccuggggcccagccagcauccagguggcccugucaaggaag

SEQ ID NO: 38151 - RNA, 41 nt, Mus musculus
ugcuccacucccuacugucauucgcuccccaugccccaucu

SEQ ID NO: 38152 - RNA, 41 nt, Mus musculus
acgcgcgcacacauacauacacacacacacacacacgcacg

SEQ ID NO: 38153 - RNA, 45 nt, Mus musculus
uagagaaacccugucaagaaagaaagaaagaaagaaagaaagaga

SEQ ID NO: 38154 - RNA, 42 nt, Mus musculus
aucucagaaaccacaugguggcuuacaaccacccauaaugag

SEQ ID NO: 38155 - RNA, 41 nt, Mus musculus
gguuaagcuucaagaggagccccacuuaagguuuccaguga

SEQ ID NO: 38156 - RNA, 46 nt, Mus musculus
ggagaagcugagacaggaggaucauuuagguccauaguucugugag

SEQ ID NO: 38157 - RNA, 45 nt, Mus musculus
aacgagccaagugugguggcaaacacccugaaaucccagcacuug

SEQ ID NO: 38158 - RNA, 45 nt, Mus musculus
acagucuacgaggcagagcuacccagcuccagggucaacagccag

SEQ ID NO: 38159 - RNA, 45 nt, Mus musculus
aaauacacuguagcuguuuucagacacaccaaaagggggcaucag

SEQ ID NO: 38160 - RNA, 23 nt, Mus musculus
uccuugaggguuugcuaugcacc

SEQ ID NO: 38161 - RNA, 46 nt, Mus musculus
gauuggaaggcaagucuccccacuugugguagaguagaggaugcaa

SEQ ID NO: 38162 - RNA, 46 nt, Mus musculus
gguggucccagcaaccacaugguggcucacaaccauccuuaaugag

SEQ ID NO: 38163 - RNA, 47 nt, Mus musculus
cuagccucaugagagcaaaauccuagauucaguucccaacaccacaa

SEQ ID NO: 38164 - RNA, 46 nt, Mus musculus
gagaaaauucacgaggacaucuuugacauuauagaccgagaagcag

SEQ ID NO: 38165 - RNA, 45 nt, Mus musculus
aucgccacagaccgccuacacauccagaacccauccuucucccag

SEQ ID NO: 38166 - RNA, 46 nt, Mus musculus; identical to SEQ ID NO: 38147

SEQ ID NO: 38167 - RNA, 51 nt, Mus musculus
accccucggcuccacuuccucaugacuggcuacaccccccucaccacggac

SEQ ID NO: 38168 - RNA, 46 nt, Mus musculus
acaacaguccuggaugucaugaggcgccugcuacagcccaagaaug

SEQ ID NO: 38169 - RNA, 42 nt, Mus musculus; identical to SEQ ID NO: 38150

SEQ ID NO: 38170 - RNA, 46 nt, Mus musculus
uggccuuugcucccagacccaggcagagcuucuguggagcaccucc

SEQ ID NO: 38171 - RNA, 45 nt, Mus musculus
gggauacagagcagcgcccugggaggaaggcacgauccagaggaa

SEQ ID NO: 38172 - RNA, 42 nt, Mus musculus
ccuggcgcggagagcagaggcggaugcuguguuuccggccag

SEQ ID NO: 38173 - RNA, 42 nt, Mus musculus
ggguagagaagaggugugacgagaggaaagaagggggccgga

SEQ ID NO: 38174 - RNA, 42 nt, Mus musculus
ucaccagagcccgcugggggcucgcugucugggcccgggcag

SEQ ID NO: 38175 - RNA, 46 nt, Mus musculus
gaggucugcacguuuaugauaacuuuccccggaaagcccggugcaa

SEQ ID NO: 38176 - RNA, 41 nt, Mus musculus
gucccggaacucgacuucaccgugggaccucaugugccggg

SEQ ID NO: 38177 - RNA, 50 nt, Mus musculus
cucaccgcuugcucguccccucccuccgugccggccggccacccgcccgc

SEQ ID NO: 38178 - RNA, 45 nt, Mus musculus
cagccagcaggcgggcgggcggguggccggccggcacggagggag

SEQ ID NO: 38179 - RNA, 41 nt, Mus musculus
cucugacuggauagaguaaggccugggucucccaagucagg

SEQ ID NO: 38180 - RNA, 46 nt, Mus musculus
uguaauucugcuaagagguguuuuguuaguacuuguguguuagaca

SEQ ID NO: 38181 - RNA, 42 nt, Mus musculus
aaugugaugaacuguguuggaugauguaggguuuggaugcag

SEQ ID NO: 38182 - RNA, 47 nt, Mus musculus
uaaggccuacuggguaggcugauguuaguagaaccuuuggcaagagc

SEQ ID NO: 38183 - RNA, 45 nt, Mus musculus
uuucuucaaugaagaucccucuaucuucuccccuggcagcgugua

SEQ ID NO: 38184 - RNA, 45 nt, Mus musculus
augaaggcuuauaggccugaggcuauggugaggccccaggguagg

SEQ ID NO: 38185 - RNA, 47 nt, Mus musculus
gcagagaugguccaugguuuuaaggcauuuauuguagaaaggcagag

SEQ ID NO: 38186 - RNA, 42 nt, Mus musculus
agaagggaacaagaguaagaggaagaaaauaagaaggguggg

SEQ ID NO: 38187 - RNA, 64 nt, Mus musculus
agaccagccuggucuacaaagugaguucccagacagccccagggcuauacagagaaaccccugu

SEQ ID NO: 38188 - RNA, 46 nt, Mus musculus
aaaaaaaguaauaaaaauaaugauugaauuacaucucagagccuuu

SEQ ID NO: 38189 - RNA, 41 nt, Mus musculus
acaauuuauagguuaauaguuuugccuaaaggauuggggag

SEQ ID NO: 38190 - RNA, 45 nt, Mus musculus
uguaccuuggcaaccggaguaccagaugcagaggcugcaggugac

SEQ ID NO: 38191 - RNA, 45 nt, Mus musculus
cccucuugggugggugggugaaagguguuguaaugggaagcacga

SEQ ID NO: 38192 - RNA, 38 nt, Mus musculus
gaaacccugucuugaaaaaaaaaaaaacaaaaacaaaa

SEQ ID NO: 38193 - RNA, 53 nt, Mus musculus
acugaaggaacugaaagaccaguagaagcccugccgucugagacuugccuagc

SEQ ID NO: 38194 - RNA, 34 nt, Mus musculus
auacaccuguaauccuaccacuucagaaauggag

SEQ ID NO: 38195 - RNA, 46 nt, Mus musculus
uggccccccuugcuugcuuguugccaguuuucuccucagcccccga

SEQ ID NO: 38196 - RNA, 45 nt, Mus musculus
cagcugccuuugugucugugucaauaaaaagccaaacccugaguc

SEQ ID NO: 38197 - RNA, 46 nt, Mus musculus
ggcagcucugcuguucagccccaaacuuuguuuacacugcuaggga

SEQ ID NO: 38198 - RNA, 46 nt, Mus musculus
ucagugccuuagcaucugaaaaccugugcuuguauaugugugugua

SEQ ID NO: 38199 - RNA, 46 nt, Mus musculus
accccuggacuugaucaguauucaaccuugucuccuguccccaaug

SEQ ID NO: 38200 - RNA, 66 nt, Mus musculus
cugagaaggagaccuagggccagagggcugagggcccuggagagccggggagggagaagaugggaa

SEQ ID NO: 38201 - RNA, 42 nt, Mus musculus
uucuuuucaaauccagcaccuucaugagaugcugccccagag

SEQ ID NO: 38202 - RNA, 36 nt, Mus musculus
acuacuucauaaauaauuuugcuugcugaaggaaga

SEQ ID NO: 38203 - RNA, 46 nt, Mus musculus
cugagcugggcauggugguacuugccuauaaucacagcauuuggug

SEQ ID NO: 38204 - RNA, 45 nt, Mus musculus
uaccugguacagaauaucaccugugacaguagugagccacaagac

SEQ ID NO: 38205 - RNA, 46 nt, Mus musculus
uaagguccuaauguguuguuucugaguaccugcuuagcccuaagaa

SEQ ID NO: 38206 - RNA, 45 nt, Mus musculus
cauugaccuacauggaaguuccucggguggauuaaaugguccagu

SEQ ID NO: 38207 - RNA, 46 nt, Mus musculus
caaaucccagcaaccacaugguggcucacaaccacccgaucacgag

SEQ ID NO: 38208 - RNA, 44 nt, Mus musculus
acuacacagagaaacccugucucaaaaaaaaaaaaaucaaaauu

SEQ ID NO: 38209 - RNA, 46 nt, Mus musculus
auuuuuaggauaaucuggagcauggauauagucucuauuuuggggu

SEQ ID NO: 38210 - RNA, 46 nt, Mus musculus
aauaacaguaaacaagaauggccaauucccuguucuggaaaugaug

SEQ ID NO: 38211 - RNA, 46 nt, Mus musculus
uagaacuccugcuccuccuguaucugucucccgagugcugggauug

SEQ ID NO: 38212 - RNA, 42 nt, Mus musculus
ugaugcagaacaggccaggaaaugucauauucucaggcauuc

SEQ ID NO: 38213 - RNA, 46 nt, Mus musculus
cauuuuaagcagcaaguuuggaugaaaggugauaaaggcugaaaag

SEQ ID NO: 38214 - RNA, 45 nt, Mus musculus
gaguggccaggcaaagugcugaaccacuuccugucuaccugcuug

SEQ ID NO: 38215 - RNA, 46 nt, Mus musculus
ugggcaugggcagcacguguguaccguugccuucaggugugcagau

SEQ ID NO: 38216 - RNA, 46 nt, Mus musculus
cuaacccaaaaguucaaaauccucaacuauuugaauguagacagca

SEQ ID NO: 38217 - RNA, 46 nt, Mus musculus
gaaggagagaagcuauucuacaauccuguccuuugacgccuacaca

SEQ ID NO: 38218 - RNA, 46 nt, Mus musculus
ucuccuauaguuaacuguuacgguaauauauaauaacaugucagac

SEQ ID NO: 38219 - RNA, 42 nt, Mus musculus
auagagacauauccaugguggugucaggcuugacccccaaag

SEQ ID NO: 38220 - RNA, 45 nt, Mus musculus
auuuuaacuucaaagaacauuaaugagaauccuguaagccaaaau

SEQ ID NO: 38221 - RNA, 46 nt, Mus musculus
aucugacucuucccugcgccacccacccaccaccuccgcccccacc

SEQ ID NO: 38222 - RNA, 45 nt, Mus musculus
cuuugguggucauguugguaaucccagcaguugggguguggaggc

SEQ ID NO: 38223 - RNA, 46 nt, Mus musculus
ugucccccaucuuuaaaagaaaaugaggagcuacagugaagcagau

SEQ ID NO: 38224 - RNA, 56 nt, Mus musculus
caaaucccugcaaccacaugguggcucacagccaucuguaauggcaucugaugccc

SEQ ID NO: 38225 - RNA, 41 nt, Mus musculus
ucagauaacgaggaaauggcaacuugccuagaagaggauaa

SEQ ID NO: 38226 - RNA, 29 nt, Mus musculus
ugcaucgaagucucagagucuccacagag

SEQ ID NO: 38227 - RNA, 44 nt, Mus musculus
gguagaaacagagggccuaaggugaacacugugccuccauuaga

SEQ ID NO: 38228 - RNA, 46 nt, Mus musculus
uugagagacauacaucaucaacugagauggcggugggaaaugagaa

SEQ ID NO: 38229 - RNA, 48 nt, Mus musculus
cugaguccaaaggugacagcuaaagguaaacaaaaagaacgucaggga

SEQ ID NO: 38230 - RNA, 46 nt, Mus musculus
cccccuugagacacgcgcuuaaccucagucaggagaaaguagaaau

SEQ ID NO: 38231 - RNA, 46 nt, Mus musculus
gcaagaacaggauccgcucaguguaugacucaguuuguagcaagcg

SEQ ID NO: 38232 - RNA, 31 nt, Mus musculus
aggagagcccaguggcaaaaccacugaccga

SEQ ID NO: 38233 - RNA, 46 nt, Mus musculus
aguccuagaaaaucucaagggccugucaaucccagcccucagagaa

SEQ ID NO: 38234 - RNA, 62 nt, Mus musculus
caacucaucgaagacacugaaccugcagcggaugccaagaagaacgagccaaaugaacacau

SEQ ID NO: 38235 - RNA, 46 nt, Mus musculus
cccaccuacuugugcugagcuucaaaucgauaguugugguagcagu

SEQ ID NO: 38236 - RNA, 42 nt, Mus musculus
uuggagguagaauuaaacguccacaguucaaaagcaccuaag

SEQ ID NO: 38237 - RNA, 30 nt, Mus musculus
agugaguacuaccaguaacugucaggagaa

SEQ ID NO: 38238 - RNA, 45 nt, Mus musculus
accaugugacugaaauuauaggcacauuuauuacagaaccacaga

SEQ ID NO: 38239 - RNA, 45 nt, Mus musculus
acaguguacucacauauaauuaauaaauaaaucuuaaagaaagaa

SEQ ID NO: 38240 - RNA, 42 nt, Mus musculus
ccccuucuuuaucaauggucugugagcaugcuugcaagagua

SEQ ID NO: 38241 - RNA, 48 nt, Mus musculus
ggacagccuagguguccagcugucuaaccuuggaaucgugagaucagu

SEQ ID NO: 38242 - RNA, 45 nt, Mus musculus
guuuuaguuuuucaaaaaagagaaauaauucuugugagcguuuga

SEQ ID NO: 38243 - RNA, 42 nt, Mus musculus
caagcacuuguaccugcugggcuagcuugucagccugcgguu

SEQ ID NO: 38244 - RNA, 45 nt, Mus musculus
guccucgggcagguggggcuuacagguuaacuuuagcccucaccc

SEQ ID NO: 38245 - RNA, 46 nt, Mus musculus
aacaagccccgggugcagucagagagccugucucaaaaaauaaggu

SEQ ID NO: 38246 - RNA, 46 nt, Mus musculus
ccaaagauuuugguauccaugagaccuaucucgcccauucugaggg

SEQ ID NO: 38247 - RNA, 46 nt, Mus musculus
uggaaaucaggaaacaaauugcaucuacauggaacauccacaaacc

SEQ ID NO: 38248 - RNA, 23 nt, Mus musculus
gagguaacuuagugguuaaaagc

SEQ ID NO: 38249 - RNA, 45 nt, Mus musculus
cuuuuggcgacuuuuaaaauaauaugugugcuucuuuuuuguuug

SEQ ID NO: 38250 - RNA, 29 nt, Mus musculus
cguguuuaaagagagccuuaacagggaaa

SEQ ID NO: 38251 - RNA, 45 nt, Mus musculus
uacgagggggaguucuggcuguaaucguaucuugaagguuguaua

SEQ ID NO: 38252 - RNA, 46 nt, Mus musculus
agcuguggguuccaggaagacuacaauucccguccagccccgcgau

SEQ ID NO: 38253 - RNA, 43 nt, Mus musculus
aaaaaacaaacaaaccaaccaacuugaacgugcuggggaguug

SEQ ID NO: 38254 - RNA, 28 nt, Mus musculus
gggggggucggggggggggggaggcuga

SEQ ID NO: 38255 - RNA, 45 nt, Mus musculus
ugugugugugugugugugugugugugugugagagagagacagaua

SEQ ID NO: 38256 - RNA, 46 nt, Mus musculus
uucauuugaucugaauacuauccagauaaaauaccuggaugaggag

SEQ ID NO: 38257 - RNA, 42 nt, Mus musculus
gaauucacuguugcuuuuuuucucuucauagauauccaucaa

SEQ ID NO: 38258 - RNA, 46 nt, Mus musculus
uuagcuuuacuuaauauuugccugacaugacaucuuuaaaguccag

SEQ ID NO: 38259 - RNA, 42 nt, Mus musculus
gcuccugaguacuggauuacaggcuuaugcuuccacccccac

SEQ ID NO: 38260 - RNA, 45 nt, Mus musculus
auguuuuuaauagaagauaguacauuuguaugggucauaaggaca

SEQ ID NO: 38261 - RNA, 35 nt, Mus musculus
uugggcuuucuugcagagcagaguuauauguacaa

SEQ ID NO: 38262 - RNA, 46 nt, Mus musculus
uuaacuauagucuuuguuuuacacuggaacuauaggauuagccaag

SEQ ID NO: 38263 - RNA, 25 nt, Mus musculus
guagggaaagugagugcuuagcuau

SEQ ID NO: 38264 - RNA, 42 nt, Mus musculus
caguaucauaguggauccuuuuccuuccucugagagcccuga

SEQ ID NO: 38265 - RNA, 42 nt, Mus musculus
ccacaugacaguccuuuaauagagaagccaggcuuggggcag

SEQ ID NO: 38266 - RNA, 46 nt, Mus musculus
gauagcucaguggguaacagcccuuacucuuuaaacgagaccugag

SEQ ID NO: 38267 - RNA, 85 nt, Mus musculus
acggugguuacuuuuauuccuuagugaaauuugccuugccugaagaaggaccgcguggagaugagagggaggagauuguccacau

SEQ ID NO: 38268 - RNA, 41 nt, Mus musculus
cagcucugcgcucucccagccaggccuggagcgaggggcug

SEQ ID NO: 38269 - RNA, 46 nt, Mus musculus
ggcucacaaccauccauaaugagaucugacgcccucuccuggugug

SEQ ID NO: 38270 - RNA, 46 nt, Mus musculus
uuccuccuuguucuuacgucugacacuuaugagcaccaccggcaga

SEQ ID NO: 38271 - RNA, 44 nt, Mus musculus
ccccacacacaaacauacaguaaaaugcauaauaaacugggcgu

SEQ ID NO: 38272 - RNA, 62 nt, Mus musculus
aguaauuuugcauaaauuuuauuuaaggagaauccuggguagugugaaauauuuugcuaauc

SEQ ID NO: 38273 - RNA, 44 nt, Mus musculus
auguguggaauccccuugugagguauccagcccuagaaagccga

SEQ ID NO: 38274 - RNA, 60 nt, Mus musculus
ucuaggucucauuuaguuuauaaagggaagcuuuggguccagauggugaaagaaaaggca

SEQ ID NO: 38275 - RNA, 44 nt, Mus musculus
aagaaggacccagguccugcugugguucuauuccccagcuccua

SEQ ID NO: 38276 - RNA, 46 nt, Mus musculus
cagccagggcuauacagagaaacccugucucggaaaaaaaaaagga

SEQ ID NO: 38277 - RNA, 51 nt, Mus musculus
uacagagaaacccugucucagaaaaaaagagagagagagagagagagagag

SEQ ID NO: 38278 - RNA, 46 nt, Mus musculus
guuacaguguacuauaaauaauauauaauaauaaauaaaucuuuuu

SEQ ID NO: 38279 - RNA, 41 nt, Mus musculus
ugcaaggguaaaaguccacauucucuuccuguugggccuag

SEQ ID NO: 38280 - RNA, 45 nt, Mus musculus
gccagggcuaagguguacaaaccaaaggagacccagggaagucaa

SEQ ID NO: 38281 - RNA, 46 nt, Mus musculus
guuaguggagcuggugcaagccuugcucaaagaacgagguuuaaag

SEQ ID NO: 38282 - RNA, 57 nt, Mus musculus
uguuaaggaagggcagcgacuuuugcaggagcaccaggaaaguaugucagaaacaga

SEQ ID NO: 38283 - RNA, 46 nt, Mus musculus
cgcgcagaaaaauaaguaaaauaagaaauauaaaaagagaaaauga

SEQ ID NO: 38284 - RNA, 23 nt, Mus musculus
gcagcagcagcagcccccgcgaa

SEQ ID NO: 38285 - RNA, 45 nt, Mus musculus
acuaccuuugauacuuuuaaggcuucucuggucaaaaauggugca

SEQ ID NO: 38286 - RNA, 46 nt, Mus musculus
acucagauccgguuguuaaacccaaaaccgaaaaagaaaagcugag

SEQ ID NO: 38287 - RNA, 46 nt, Mus musculus
aggugguuauaauaguaaccuuuugaaacaaagguagaguugcaag

SEQ ID NO: 38288 - RNA, 53 nt, Mus musculus
gggaccgggacagggaccgugacaaggaccgagaacgagauagagaucgagaa

SEQ ID NO: 38289 - RNA, 28 nt, Mus musculus
aggagcagaagucagagucccuucaaag

SEQ ID NO: 38290 - RNA, 46 nt, Mus musculus
uccuagaauucucuauguagaucaggcugaccccaaacucacagag

SEQ ID NO: 38291 - RNA, 45 nt, Mus musculus
acgggaaggucgaguggccaauguggcugauguugugaguaaagg

SEQ ID NO: 38292 - RNA, 46 nt, Mus musculus
ggccaaggaaagacgggagcugaagcaggcccagcgggaagcagag

SEQ ID NO: 38293 - RNA, 92 nt, Mus musculus
aucauggaauguaaaaguguucuaagcauggguauggcaucaucagaggucucugggaggaguugggaagggcaagaguagaugcuucaggu

SEQ ID NO: 38294 - RNA, 46 nt, Mus musculus
auagcaagaggagaggaucauggccuggacaugguguuaucagaga

SEQ ID NO: 38295 - RNA, 46 nt, Mus musculus
guguccuaugagcagcagagugauggugccuuuggguaagggacag

SEQ ID NO: 38296 - RNA, 42 nt, Mus musculus
aaguacacuguaugugucuucagacacaccagaagagggcau

SEQ ID NO: 38297 - RNA, 72 nt, Mus musculus
uggaagaagcaugccuuugggggcaacaaagcuucuuaugggaagaagacccagaugucaauccuugagcag

SEQ ID NO: 38298 - RNA, 47 nt, Mus musculus
guaggugggcuacaccauucgauuugaggauugcaccagcccagaaa

SEQ ID NO: 38299 - RNA, 46 nt, Mus musculus
uuagggccagccuggauaacauaauagaauucucaaaauaaaacag

SEQ ID NO: 38300 - RNA, 44 nt, Mus musculus
guaaaacccaguggcagagccaagcugagaguaauaaucuucua

SEQ ID NO: 38301 - RNA, 45 nt, Mus musculus
uuuuucauagccauaaccuuguggaggaaagauggggauugcuca

SEQ ID NO: 38302 - RNA, 42 nt, Mus musculus
cuggguggagguacauugaugcacauccagggacaucugggg

SEQ ID NO: 38303 - RNA, 41 nt, Mus musculus
gccuaguaccuccaugccuuugugugugugugugagacaga

SEQ ID NO: 38304 - RNA, 42 nt, Mus musculus
gauuugucugggggagucauaggcacuggaguugagggggag

SEQ ID NO: 38305 - RNA, 46 nt, Mus musculus
ggucugugcggggacucugggguuccuucuugauccuggugguggg

SEQ ID NO: 38306 - RNA, 23 nt, Mus musculus
gcucuagagcuuucgaaaggcaa

SEQ ID NO: 38307 - RNA, 89 nt, Mus musculus
uuuguuguuguuuuuaguauagaauagagucuauuuagggcaugggauggggaguuaagagaguaguagaggcagagaaaggcagugag

SEQ ID NO: 38308 - RNA, 44 nt, Mus musculus
caaauccuagcaaccacaugguggcucacaaccauccguaagga

SEQ ID NO: 38309 - RNA, 46 nt, Mus musculus
aaagcucuacaugcaacugggagcugggcacucaggcaugcagcag

SEQ ID NO: 38310 - RNA, 45 nt, Mus musculus
acuuuuguuguuauuuuggcuuggucaguaaauuggcccucggag

SEQ ID NO: 38311 - RNA, 57 nt, Mus musculus
gucucuuggaagugacugagguccuggaagagaucugaugggugaauauuggauugg

SEQ ID NO: 38312 - RNA, 46 nt, Mus musculus
gauuaagcagaggggucgcaguuugucuguuucuuuaccuucugag

SEQ ID NO: 38313 - RNA, 45 nt, Mus musculus
uccaaguauccgccuuucauccuccgcuccauccggccgcucccu

SEQ ID NO: 38314 - RNA, 25 nt, Mus musculus
gcggaagcgggcgccgaacagagag

SEQ ID NO: 38315 - RNA, 45 nt, Mus musculus
gguucuccuagagacagagagguggagaucuacaugcacagggag

SEQ ID NO: 38316 - RNA, 45 nt, Mus musculus
aaaugaugauaagaaacagccugcuacccucucuaccggcuuaga

SEQ ID NO: 38317 - RNA, 45 nt, Mus musculus
cuauucuauauuuaguuaaaagaugugugugugugugugugugug

SEQ ID NO: 38318 - RNA, 42 nt, Mus musculus
cccugacuuugccauguugcccugguucccuugcccauaauc

SEQ ID NO: 38319 - RNA, 42 nt, Mus musculus
aaaggauugaagcauuaggaaagccaagaaccacugcuuuag

SEQ ID NO: 38320 - RNA, 41 nt, Mus musculus
uggaaaccucuuugugggaacaugaagaaagagccuuuggg

SEQ ID NO: 38321 - RNA, 46 nt, Mus musculus
cugcuugaggcuguucuuggcuuggaccugaaaucugcccccaaca

SEQ ID NO: 38322 - RNA, 46 nt, Mus musculus
auaacacuguagaguugacagaacugguucauguguuaugagagag

SEQ ID NO: 38323 - RNA, 42 nt, Mus musculus
ugggggagucuucaccacugguccaaaccuucuggccugcag

SEQ ID NO: 38324 - RNA, 46 nt, Mus musculus
uucuucgaugucagcauuggcggccaggaaguuggucgcaugaaaa

SEQ ID NO: 38325 - RNA, 70 nt, Mus musculus
ccuuccacagggucauaaaggauuucaugauucaggguggagauuuuguuaauggcgauggcacuggagu

SEQ ID NO: 38326 - RNA, 46 nt, Mus musculus
gacacucugcuccaggccugcuuuccauggcaaacaguggucccag

SEQ ID NO: 38327 - RNA, 46 nt, Mus musculus
gacccauucauuaaccugcccagcacuuacugggauuuuggcucug

SEQ ID NO: 38328 - RNA, 41 nt, Mus musculus
ucuccagggaccuccagucugggacaaagaugaagggcacu

SEQ ID NO: 38329 - RNA, 41 nt, Mus musculus
cuccucccagcggccuuggacucugggacaccuugggggga

SEQ ID NO: 38330 - RNA, 45 nt, Mus musculus
caccacugcaacaggucugucuccaccgcgacgaugccaccguag

SEQ ID NO: 38331 - RNA, 41 nt, Mus musculus
uccgcucagcauuuuuaaacagggugccacagccugggaga

SEQ ID NO: 38332 - RNA, 45 nt, Mus musculus
gcagagcuggggugcagguagaaguuggggacagaggaagaucug

SEQ ID NO: 38333 - RNA, 42 nt, Mus musculus
guuuuuuuuuauuuuaauaguuacauuuuugggggggaagau

SEQ ID NO: 38334 - RNA, 42 nt, Mus musculus
gggggcaguggcgauugcaggaacuuacagagguccccagau

SEQ ID NO: 38335 - RNA, 45 nt, Mus musculus
gaggaaacgccuucgcaaagguuuguccccuccgcuguccaguag

SEQ ID NO: 38336 - RNA, 45 nt, Mus musculus
cacucagcaaugaaggugauccagagcacggagaugcccaggcgg

SEQ ID NO: 38337 - RNA, 49 nt, Mus musculus
uucuuauccccuuaggcccuagucuucaccucagaucucacaguucacc

SEQ ID NO: 38338 - RNA, 45 nt, Mus musculus
cgacuuaaggggcguguucaacugcaaauacagucuccgccucag

SEQ ID NO: 38339 - RNA, 67 nt, Mus musculus
acucuaaagcuccaggccagaucugcacuuuaacaagccccccacccccacccccgauuauaaugug

SEQ ID NO: 38340 - RNA, 42 nt, Mus musculus
uauaaucggggguggggguggggggcuuguuaaagugcagau

SEQ ID NO: 38341 - RNA, 47 nt, Mus musculus
uggugggugcaugaauccggguacuccacccagacuccaauccagau

SEQ ID NO: 38342 - RNA, 46 nt, Mus musculus
cgagaagccaccugagaagaaauggccgucauuacaggccaaagag

SEQ ID NO: 38343 - RNA, 42 nt, Mus musculus
gggugauuccuggccuggcuuauuguaccuuccuauuggcag

SEQ ID NO: 38344 - RNA, 44 nt, Mus musculus
gggugccagccucauguauuggacucucuuuacacugggccuag

SEQ ID NO: 38345 - RNA, 46 nt, Mus musculus
cauggggcugcuggucuuccuggaauggcugggcuacccaccucag

SEQ ID NO: 38346 - RNA, 42 nt, Mus musculus
cccauucgcuccucuugauguguuuugccucccuugccccaa

SEQ ID NO: 38347 - RNA, 33 nt, Mus musculus
uccggagcccaggaaaagggcugucucuuagag

SEQ ID NO: 38348 - RNA, 42 nt, Mus musculus
gcaggaguggguuggcacaggauaagaucagccuacggggag

SEQ ID NO: 38349 - RNA, 46 nt, Mus musculus
aagaaugacgggagcaaagguguuccaagagucgucaggcccccag

SEQ ID NO: 38350 - RNA, 25 nt, Mus musculus
gcauuggugacuuugaagcaccuga

SEQ ID NO: 38351 - RNA, 42 nt, Mus musculus
uaucugccaguggcuggaaggaccauccgaagcagcccacag

SEQ ID NO: 38352 - RNA, 46 nt, Mus musculus
auacccauaaaauaaauaaauaaaucuuuaaaauaaaaggauggau

SEQ ID NO: 38353 - RNA, 46 nt, Mus musculus
uucuuguaccaucuguagaacaaguguuugacuugaugaccuccag

SEQ ID NO: 38354 - RNA, 45 nt, Mus musculus
agaacaacaugugcucuuaacugcugagccaccucuccagccauc

SEQ ID NO: 38355 - RNA, 42 nt, Mus musculus
gauggccucuuaaccuucuacaaucguuauacagagucccua

SEQ ID NO: 38356 - RNA, 46 nt, Mus musculus
cugggaaucccuaccuuugaggucauuuugguagaggcacccccac

SEQ ID NO: 38357 - RNA, 44 nt, Mus musculus
gagcaucaccaaccccugggugcuuggcacagucucugucccau

SEQ ID NO: 38358 - RNA, 42 nt, Mus musculus
gggaggggcuggcaacucaggauucuguccaggguccgaucu

SEQ ID NO: 38359 - RNA, 46 nt, Mus musculus
ucaggaaccgugauguacacaaaaggaaacuguggcaaagacagau

SEQ ID NO: 38360 - RNA, 66 nt, Mus musculus
aaucugaagcuaccacugaggcugcugggugcaugcagaugugcuuggucauguguuaggaauccu

SEQ ID NO: 38361 - RNA, 46 nt, Mus musculus
uuuaggcccaauacuccgauaggggcaagugauuuugaagccagcc

SEQ ID NO: 38362 - RNA, 41 nt, Mus musculus
cucuauagaccaggcuggcuucaaaaucacuugccccuauc

SEQ ID NO: 38363 - RNA, 47 nt, Mus musculus
uuucuggugacccaugcuucuuaugagcacagaaucugaaagcuaga

SEQ ID NO: 38364 - RNA, 45 nt, Mus musculus
aggaaauuggcuggcugcccuuccuacacaacaccaagcccccau

SEQ ID NO: 38365 - RNA, 42 nt, Mus musculus
aaaaaaaaaaaaggaaaaaaggaugggggcuugguguugugu

SEQ ID NO: 38366 - RNA, 52 nt, Mus musculus
gaaagcaaaauauccuauuccugcuacaaggggcacaaggaggagguggugg

SEQ ID NO: 38367 - RNA, 46 nt, Mus musculus
cuuuguaaacgcuguguauuccccucugcccucauggcugcuggug

SEQ ID NO: 38368 - RNA, 46 nt, Mus musculus
auugggggagggggguggggcucacgcuguccuguggucuugagau

SEQ ID NO: 38369 - RNA, 45 nt, Mus musculus
ggaugggaugagaagguagucucugcccuggguugucaguggagu

SEQ ID NO: 38370 - RNA, 46 nt, Mus musculus
ccuccugggguggccccguguucucccucccauccugcccccugcc

SEQ ID NO: 38371 - RNA, 41 nt, Mus musculus
uuuuccuauuuauucugugaguuacuggauguccagcuagg

SEQ ID NO: 38372 - RNA, 41 nt, Mus musculus
gaaagugggcuuccucugagguugguuucuacguggucagu

SEQ ID NO: 38373 - RNA, 46 nt, Mus musculus
aagcuaugguaucucccauuccagaacccuaauuccccucgaagau

SEQ ID NO: 38374 - RNA, 42 nt, Mus musculus
accccccggccccgggccccgggccccggggagaggcgagga

SEQ ID NO: 38375 - RNA, 53 nt, Mus musculus
ugguacuaaauuuuagaauaaggacagugugugugugugugugugugugugug

SEQ ID NO: 38376 - RNA, 45 nt, Mus musculus
cucgucguccuccuccuccucaucgucauccuccucggacuccug

SEQ ID NO: 38377 - RNA, 42 nt, Mus musculus
cgcuugggcuucucggagccacccuaagggaaguacggggag

SEQ ID NO: 38378 - RNA, 42 nt, Mus musculus
gcagggagcaaagcuggggauggccgugugucugugugucug

SEQ ID NO: 38379 - RNA, 45 nt, Mus musculus
gaacuagacuccuccuuguaagaggcaccaggagcaagcaaggag

SEQ ID NO: 38380 - RNA, 46 nt, Mus musculus
uccagcaucccuuuacaguguuagcacugcccuccaccacacugag

SEQ ID NO: 38381 - RNA, 25 nt, Mus musculus
gagccaagcagagggcgggaggacg

SEQ ID NO: 38382 - RNA, 42 nt, Mus musculus
ggccuccggcagggcugggggcgggggugcgcggggcuggag

SEQ ID NO: 38383 - RNA, 52 nt, Mus musculus
ggggcgaaggggaauguuacaaaaaagaaaaagggaaaaaaaaaagccuccu

SEQ ID NO: 38384 - RNA, 42 nt, Mus musculus
cugugagaaccaggaagugacauuguguaugagaggggggag

SEQ ID NO: 38385 - RNA, 42 nt, Mus musculus
ucuuccgaggaguuuguuaauuucgcagccauuuuagagcag

SEQ ID NO: 38386 - RNA, 51 nt, Mus musculus
gugcccaacaacugugugagcagcauugagaacauggagaacaucagcaca

SEQ ID NO: 38387 - RNA, 46 nt, Mus musculus
agcuucugucuaaagggcgaaguucuggaugggaagacaccggugg

SEQ ID NO: 38388 - RNA, 46 nt, Mus musculus
ugacggaugaggaggagaggcacagugccgagagcagcaccagcga

SEQ ID NO: 38389 - RNA, 74 nt, Mus musculus
gucaccgaugaagacaguugguacaacaaguggcacaagauggaacagaaguuucgcauugucuacgcacagaa

SEQ ID NO: 38390 - RNA, 47 nt, Mus musculus
ugcagcugcagcuggaggaggccgcggcacaaaaucagcgugagaag

SEQ ID NO: 38391 - RNA, 44 nt, Mus musculus
cuagucaaccaguggcccucccugagcacacuucauaggcccga

SEQ ID NO: 38392 - RNA, 42 nt, Mus musculus
cugggggaccacauggggccaucauucagggugugggcugag

SEQ ID NO: 38393 - RNA, 45 nt, Mus musculus
ggauacaaaaaagggcgaucaucagauuuggucuugaauucggga

SEQ ID NO: 38394 - RNA, 45 nt, Mus musculus
ccaggacuccauugcaguauaggaggcacuucccuggggacugua

SEQ ID NO: 38395 - RNA, 42 nt, Mus musculus
gcugguugccgagggucucugagacugaaggcggaccuucac

SEQ ID NO: 38396 - RNA, 46 nt, Mus musculus
ccggcuccugaggccaccauuugcugaagggggcuaaugcccccag

SEQ ID NO: 38397 - RNA, 40 nt, Mus musculus
uuuucuuuucagugaugucucugugugugucugugucugu

SEQ ID NO: 38398 - RNA, 44 nt, Mus musculus
auugcguauguaagucugggggugcgcuaaugcuauggugugug

SEQ ID NO: 38399 - RNA, 46 nt, Mus musculus
ugcccccaggacacuguaugugaccugauccagaguaagugccuau

SEQ ID NO: 38400 - RNA, 46 nt, Mus musculus
ggaucacauucauugcugcccggcaggguuucagugucacacagag

SEQ ID NO: 38401 - RNA, 46 nt, Mus musculus
cccuggaugaagaaggucauagccccccuccgccugccagacccac

SEQ ID NO: 38402 - RNA, 45 nt, Mus musculus
uugcugcccucagggcuucacaugucuggcucagggguacuguca

SEQ ID NO: 38403 - RNA, 46 nt, Mus musculus
ccucgcugggacauguuuuugagggauccggucccaagaccgcuac

SEQ ID NO: 38404 - RNA, 52 nt, Mus musculus
ccuccccuaacgucuccccggccuacucauccugagucacccuaucaccaug

SEQ ID NO: 38405 - RNA, 46 nt, Mus musculus
auccuucauaucaaaaugacguucuauuuggguacagccggugcag

SEQ ID NO: 38406 - RNA, 39 nt, Mus musculus
uccacgguguucuaaaaguccaaauaugguucuggggag

SEQ ID NO: 38407 - RNA, 46 nt, Mus musculus
cucuuuuccuuuggucguucuuccugauuuggagaggggauggcuc

SEQ ID NO: 38408 - RNA, 46 nt, Mus musculus
cucaucccagcuccaccuucagaguccccugaguuuggaucaugag

SEQ ID NO: 38409 - RNA, 45 nt, Mus musculus
aauguuaagcaauaggcagaggccugugacaccauacauuaucag

SEQ ID NO: 38410 - RNA, 46 nt, Mus musculus
gaguugcaaccaggaugaucuggaauacccagaagcgcacguggga

SEQ ID NO: 38411 - RNA, 46 nt, Mus musculus
cagcacagugagccagaucuucccuacaaaugucgaaugguugugg

SEQ ID NO: 38412 - RNA, 44 nt, Mus musculus
gaguugaggcccgcugcaagagcagaacaugcuauccagccccu

SEQ ID NO: 38413 - RNA, 46 nt, Mus musculus
uaaaauucauaaagccaaaaaaguacauaaaauuaaguacucuggg

SEQ ID NO: 38414 - RNA, 89 nt, Mus musculus
cagugauaaacuguuaccaggaaguguaaaaugaaauaccacccaccccagaaauacugugagacagagcccugcuaggcaugccauag

SEQ ID NO: 38415 - RNA, 45 nt, Mus musculus
ccauaugugugccuggugccugcacaggucagaaaaaggcaucag

SEQ ID NO: 38416 - RNA, 46 nt, Mus musculus
ugucucgaaaagaacaacaaaaacucagaaaauaucugguaccaaa

SEQ ID NO: 38417 - RNA, 46 nt, Mus musculus
cacaaccaguuagauaccacaaagacacagauaaaacaggccacag

SEQ ID NO: 38418 - RNA, 41 nt, Mus musculus
aagccgccuccuccgccgggccucggcccgucccgccggcc

SEQ ID NO: 38419 - RNA, 68 nt, Mus musculus
uugggaauggggccaggcaaaggccacagaagaaaccaggccagaugccccuuccucacugggaugga

SEQ ID NO: 38420 - RNA, 45 nt, Mus musculus
cagacaguaggguaagcccagggucaugcagaaccuguacuuggg

SEQ ID NO: 38421 - RNA, 46 nt, Mus musculus
aagccgaaugagucgauggccgggaugaacgcuuugaugguauaga

SEQ ID NO: 38422 - RNA, 46 nt, Mus musculus
cauauugcagccacacaaagauaugauacagacagcucacauccag

SEQ ID NO: 38423 - RNA, 42 nt, Mus musculus
ggcaaccugccacccgggccggaacugcgugcgugcgggaag

SEQ ID NO: 38424 - RNA, 50 nt, Mus musculus
gauuugaagguuucauugacuuuuugaggcucugacuaguuuuaagacau

SEQ ID NO: 38425 - RNA, 45 nt, Mus musculus
uggaaccacguggauuauaacuuggaaaacaucuaaaaauggcag

SEQ ID NO: 38426 - RNA, 45 nt, Mus musculus
gacagagaugaauggcagauuccaguaagaaauggucaaaagaca

SEQ ID NO: 38427 - RNA, 42 nt, Mus musculus
cccuccggcgcggagacugcuucuccuuauccuugcccuaga

SEQ ID NO: 38428 - RNA, 45 nt, Mus musculus
guugcauguaaacuugccgcuggccgcaucguaguuguugccuag

SEQ ID NO: 38429 - RNA, 45 nt, Mus musculus
ccugaccgucggcagcugcucaacuccauuacccacccugagauc

SEQ ID NO: 38430 - RNA, 42 nt, Mus musculus
auuccaacagcugggcugugcuguaaucgacguggacgucau

SEQ ID NO: 38431 - RNA, 42 nt, Mus musculus
ugguaaccaagucuggaggagacagagccagguggucgagug

SEQ ID NO: 38432 - RNA, 45 nt, Mus musculus
gucugucugucucugugugugugugcgugcccaccugugugugug

SEQ ID NO: 38433 - RNA, 45 nt, Mus musculus
aucugucugucucugugugugugugugcgugcccaccugugugug

SEQ ID NO: 38434 - RNA, 46 nt, Mus musculus
aaguguaugaaucucugugugugugugugugugugugugugugugu

SEQ ID NO: 38435 - RNA, 41 nt, Mus musculus
gcagccccaggaccuggucucggggucugguuuaagggaga

SEQ ID NO: 38436 - RNA, 42 nt, Mus musculus
cugaucagauaggaguccuggaagaagggcgugacugggaac

SEQ ID NO: 38437 - RNA, 46 nt, Mus musculus
ggugaacagauuacaucaucccaaagucuacgugaauggaggaggc

SEQ ID NO: 38438 - RNA, 42 nt, Mus musculus
agccugcagaccuaaggaaugaugguagcacaacggccuggg

SEQ ID NO: 38439 - RNA, 46 nt, Mus musculus
ugaagcucugcaggcagcuuuggggcaaauucuccucucucugcag

SEQ ID NO: 38440 - RNA, 45 nt, Mus musculus
ggguacugcagugggcuggagacugaggcagggaccuaggcagau

SEQ ID NO: 38441 - RNA, 45 nt, Mus musculus
gcucaugggggcucagcagcagcagauggggaaguaaagggcaga

SEQ ID NO: 38442 - RNA, 45 nt, Mus musculus
guuugugucccagugugcaaggaaauauggggcugagacaguggg

SEQ ID NO: 38443 - RNA, 45 nt, Mus musculus
acuguuuuuuaagugcagacucucugggagugguggaggggcagu

SEQ ID NO: 38444 - RNA, 42 nt, Mus musculus
aagaucaaggucauccuugaauacaaauggaggccagcuggg

SEQ ID NO: 38445 - RNA, 46 nt, Mus musculus
aaccauaaaggccuuggggacauagaaacuggauaaggggcaggaa

SEQ ID NO: 38446 - RNA, 45 nt, Mus musculus
agucauguggaacccucucuaggguauuugacugugcccugagaa

SEQ ID NO: 38447 - RNA, 46 nt, Mus musculus
gccugggagggaggggaauccugggaugauucauccacggugagau

SEQ ID NO: 38448 - RNA, 42 nt, Mus musculus
uauauuuacaguucauuaaaggauauggaaaauccaaauaaa

SEQ ID NO: 38449 - RNA, 46 nt, Mus musculus
ugaaccaugcugcuguuguaccuuaauaacucagugaucaccagug

SEQ ID NO: 38450 - RNA, 45 nt, Mus musculus
uuaguaggaguuuauguccugugccagagggacuucuggugcuga

SEQ ID NO: 38451 - RNA, 46 nt, Mus musculus
aaaauuuuagagaaaccuuaguuaacauuuuauuaagugccaaugu

SEQ ID NO: 38452 - RNA, 45 nt, Mus musculus
uaccagaagagucaguaugagaacacuaaagagaaaccuucgaga

SEQ ID NO: 38453 - RNA, 46 nt, Mus musculus
gccuucauuucuaggucuucgagaaugguguuagcaagugccagau

SEQ ID NO: 38454 - RNA, 72 nt, Mus musculus
uucuuuaaucucuucaguuggaaaucuaucauggaaggaagaguuauguuuuaucuugaaggaaccauuaga

SEQ ID NO: 38455 - RNA, 46 nt, Mus musculus
cagcaugacagaugcagaugacacacaacuucaugcggcggaaagu

SEQ ID NO: 38456 - RNA, 46 nt, Mus musculus
ucccagcaaccacaugguggcucacaagcacuccucguaaugagau

SEQ ID NO: 38457 - RNA, 42 nt, Mus musculus
uucccgccuuuucacuagugacaguucuacaaccaagguaaa

SEQ ID NO: 38458 - RNA, 35 nt, Mus musculus
cuggugaugcaaagcagcaucuuuaucguuuagga

SEQ ID NO: 38459 - RNA, 46 nt, Mus musculus
aguuuauuaggaggaccaacugcucuuagcccauuaaccccaaggu

SEQ ID NO: 38460 - RNA, 46 nt, Mus musculus
uaauuucaccagauaacgucccccuuggaccugguacugccauauu

SEQ ID NO: 38461 - RNA, 62 nt, Mus musculus
ccccaagacacaauuguaaguguguuucuucuauguucaaaguguucuaaaagcccacaaga

SEQ ID NO: 38462 - RNA, 65 nt, Mus musculus
guacaacucuaguaucuaaucacaguuuaucucacagacagccugagacaguccuuacagaaaca

SEQ ID NO: 38463 - RNA, 44 nt, Mus musculus
caaagaaauagauguuugagggcaauaaaugauuuacagggagu

SEQ ID NO: 38464 - RNA, 46 nt, Mus musculus
agauuuuuauuauuucauugaaagguauccuaagguuugggcagua

SEQ ID NO: 38465 - RNA, 45 nt, Mus musculus
uaaaugcaaaaugacaugauguuauacauuaugagagaagugauu

SEQ ID NO: 38466 - RNA, 45 nt, Mus musculus
acuuagccuaguuagugauaacagcuguagcagcucuagcaaguu

SEQ ID NO: 38467 - RNA, 46 nt, Mus musculus
acugugcccauuuugauauugauguuuacagacacagcuggcuuug

SEQ ID NO: 38468 - RNA, 46 nt, Mus musculus
aggcaggacuacauggugagacccugucucaaaaaaaggaguggaa

SEQ ID NO: 38469 - RNA, 84 nt, Mus musculus
agugaguagcugagucuacaaugucuauauuaaguugcagucuaccaaugugaauaaaguuucuuuacauuuguugucaaagau

SEQ ID NO: 38470 - RNA, 41 nt, Mus musculus
gaaagaaagggugugugugugugugugugugugugugugug

SEQ ID NO: 38471 - RNA, 46 nt, Mus musculus
agacccugucuuaaaauacauaaauaaaauuauauuucagcaaguu

SEQ ID NO: 38472 - RNA, 32 nt, Mus musculus
cuccacuucggcuauuuccgugucucgcucgg

SEQ ID NO: 38473 - RNA, 45 nt, Mus musculus
aaggcuccauuuacauauuauauguguaugguuaugucucuguag

SEQ ID NO: 38474 - RNA, 46 nt, Mus musculus
agcugugucuaggcagaggguguguugugucugagucccuagggaa

SEQ ID NO: 38475 - RNA, 46 nt, Mus musculus
cagcuuguugaugggguggaguugggaaauggguagcaaccaggac

SEQ ID NO: 38476 - RNA, 45 nt, Mus musculus
aaaucccagcaaccgcaugguggcucacaaccauccuuaaugaga

SEQ ID NO: 38477 - RNA, 45 nt, Mus musculus
uguguguguguguguguauguguguguguuugugugugugucugu

SEQ ID NO: 38478 - RNA, 45 nt, Mus musculus
guauguguguaugugcaugugugugaggguguaguaugugugugg

SEQ ID NO: 38479 - RNA, 29 nt, Mus musculus
guguagugaguguguauguguguagugag

SEQ ID NO: 38480 - RNA, 47 nt, Mus musculus
caauugugcuccagagucuauugaguucccagucagugaggcccaga

SEQ ID NO: 38481 - RNA, 48 nt, Mus musculus
gaucacucaagucagcccucagaggauugcccuucgacuacggccagg

SEQ ID NO: 38482 - RNA, 46 nt, Mus musculus
auagaguggaaaagaagagguucaagaugcugcaagagggcaggag

SEQ ID NO: 38483 - RNA, 33 nt, Mus musculus
cuugcccauguuuggcuacaaacacgugcugac

SEQ ID NO: 38484 - RNA, 42 nt, Mus musculus
ucaugaacuaaucaaugaugugauggcucccuuaugggccag

SEQ ID NO: 38485 - RNA, 47 nt, Mus musculus
ggauuaccaagaugacagguaacaggagaaaugagccaggucagugc

SEQ ID NO: 38486 - RNA, 98 nt, Mus musculus
aggacuacccaucucuggggcugaugacugagaaacuaucccagaaaaacauuaacuugaucuuugcagugacugaaaaugucgucagccuuuaccag

SEQ ID NO: 38487 - RNA, 42 nt, Mus musculus
gaugacucaagcaacguccuccagcucauuguugaugcuuac

SEQ ID NO: 38488 - RNA, 44 nt, Mus musculus
aauccgcucuaaaguggagcuggaaguacgugaccugccggaag

SEQ ID NO: 38489 - RNA, 46 nt, Mus musculus
auagaguuacagaugguugcgaucagcuguguggauuuuaacccag

SEQ ID NO: 38490 - RNA, 45 nt, Mus musculus
caggugagcuuuaguaucgaggccaaggugcguggcugcccccag

SEQ ID NO: 38491 - RNA, 48 nt, Mus musculus
ccaggccuuugcccagccuuccagcccacgcugcaacaaugggaacgg

SEQ ID NO: 38492 - RNA, 84 nt, Mus musculus
guccaugugugagugcucugaggaggauuaccgacccucucagcaggaagagugcagccccaaggagggccagcccaucugcag

SEQ ID NO: 38493 - RNA, 46 nt, Mus musculus
guacugugagugcgaugacuucuccugcguccgcuacaaaggggag

SEQ ID NO: 38494 - RNA, 45 nt, Mus musculus
ugucucugugugugugugugucugugugugucucugugugugugu

SEQ ID NO: 38495 - RNA, 46 nt, Mus musculus
gacaaucuuugcugcugcucucgguauaucugauacguugucugag

SEQ ID NO: 38496 - RNA, 46 nt, Mus musculus
uagcacgcccugcucggaggaagaaauaagaaccagaaagggccag

SEQ ID NO: 38497 - RNA, 53 nt, Mus musculus
uacaagaacgaggaugacugugucgucagauuccaguacuacgaagacaccag

SEQ ID NO: 38498 - RNA, 45 nt, Mus musculus
ccuggggccuccugcaggugcaguauuuccacagucggacccuca

SEQ ID NO: 38499 - RNA, 46 nt, Mus musculus
uccaggauuagcagguguaggggugugugugugugugugugugugu

SEQ ID NO: 38500 - RNA, 46 nt, Mus musculus
ggccuugcuacucugcucaucuggaagcuacucaucacuauccaug

SEQ ID NO: 38501 - RNA, 46 nt, Mus musculus
guauaaagaggccaccuccaccuucaccaauaucaccuaccggggg

SEQ ID NO: 38502 - RNA, 75 nt, Mus musculus
gauuuggggcguggguugggcugggcuggaagaaugucaguaugugggaauguaucucucuguguguacuuaugu

SEQ ID NO: 38503 - RNA, 46 nt, Mus musculus
cccagaagagaagggcagggcugagguuccccaacccccauuccag

SEQ ID NO: 38504 - RNA, 70 nt, Mus musculus
auggucagaugcuaugggcugaggcucucucucauggucagaugcuaugggcugaggcucucucucaugg

SEQ ID NO: 38505 - RNA, 49 nt, Mus musculus
ugacauugucagaugcuaugggcugaggcucucucucauggucagaugc

SEQ ID NO: 38506 - RNA, 101 nt, Mus musculus
uggggacacccaaaacuaugaugaggcccgaucacucuagaggagcacguauauaaacauacuugcauuauuauauuuauaauuuuguaugaugacaaagg

SEQ ID NO: 38507 - RNA, 46 nt, Mus musculus
ucuguuggcccagcaagcaugguuugcucugcuggcauugacuuag

SEQ ID NO: 38508 - RNA, 42 nt, Mus musculus
uuucaguuuccagacugaaugccuuggcuuucacgagagcag

SEQ ID NO: 38509 - RNA, 81 nt, Mus musculus
uccgugagaguagagugggguuuucuuuagagaagacuguuuagaugaggaaacuagcagggaaggaagaaaauguauuag

SEQ ID NO: 38510 - RNA, 46 nt, Mus musculus
ggcccguucucuuacaggugguuucgguccagucucugucugagga

SEQ ID NO: 38511 - RNA, 44 nt, Mus musculus
aggcgacuguucuucccacagguacauacacguuccucagguag

SEQ ID NO: 38512 - RNA, 45 nt, Mus musculus
cgugguggugguggugaaggugggugggagaggauuguugguaag

SEQ ID NO: 38513 - RNA, 46 nt, Mus musculus
ugaaagguccuggguucaacccucagcucugcaccucccaccggaa

SEQ ID NO: 38514 - RNA, 46 nt, Mus musculus
uuguuuuaaagauagggucuugcuagauagcccaggcugccccaua

SEQ ID NO: 38515 - RNA, 90 nt, Mus musculus
uguuuuaauaaaauuguguguguguguguguguguguguguguguguacacgugugcccgcgaguguaugcagguacccuaggagaucag

SEQ ID NO: 38516 - RNA, 44 nt, Mus musculus
cccuuuuccugggccaggacuucagauccaccggaaagcgcaca

SEQ ID NO: 38517 - RNA, 42 nt, Mus musculus
ggcccacaguuuggacaggcaggaacugauagcugcugagca

SEQ ID NO: 38518 - RNA, 41 nt, Mus musculus
aguggacaugauucugggugauuuucagcaugaagggcaga

SEQ ID NO: 38519 - RNA, 41 nt, Mus musculus
guggguggcuucuuauuuauauagaaagaggagggguguca

SEQ ID NO: 38520 - RNA, 46 nt, Mus musculus
gugugugugugugugugugugugugugugauguguggugugugugu

SEQ ID NO: 38521 - RNA, 42 nt, Mus musculus
auaaaagcaagccauauuuucucucuuuuucggucccagcua

SEQ ID NO: 38522 - RNA, 42 nt, Mus musculus
ccaagccugggggucuggguucaagucccaggauccaaagag

SEQ ID NO: 38523 - RNA, 51 nt, Mus musculus
gcucacaaccauccguaaugagaucugacacccucuucugaugugucugaa

SEQ ID NO: 38524 - RNA, 87 nt, Mus musculus
gccagucaccaacaccacaguuuccuugggcauguaugagugugacagagaggccuugagucuucgauggcagugucguacacuagg

SEQ ID NO: 38525 - RNA, 50 nt, Mus musculus
uggagcgcggugaccagacccgcaguggccauuggaacaucuauggcagu

SEQ ID NO: 38526 - RNA, 89 nt, Mus musculus
aauacgacaaccagugguuccacggcugcaccagcacuggcagagaagaugggcaccuguggugugccaccacccaggacuacggcaaa

SEQ ID NO: 38527 - RNA, 24 nt, Mus musculus
uugugggauuguggcgggacaguc

SEQ ID NO: 38528 - RNA, 45 nt, Mus musculus
ggccagcugcgagcagcagggugcagacuugcugaguaucacgga

SEQ ID NO: 38529 - RNA, 45 nt, Mus musculus
ggagaacuguggagugauccggacugaguccucaggcggcuggca

SEQ ID NO: 38530 - RNA, 48 nt, Mus musculus
ccacagcauggcugagcuggaguucaucaccaaacagaucaagcaagg

SEQ ID NO: 38531 - RNA, 46 nt, Mus musculus
agagguggaggagcuauggauuggccucaaugauuugaaacugcag

SEQ ID NO: 38532 - RNA, 45 nt, Mus musculus
agcagcagaucuguuugcacaaagggauucuauauaaaaauuuaa

SEQ ID NO: 38533 - RNA, 51 nt, Mus musculus
cgaugaagaauuugccuguggguuccgaggcuugaucuguaguaaguguuu

SEQ ID NO: 38534 - RNA, 46 nt, Mus musculus
cagagccugagagccaugagcagcacugguuuuggauuggccugaa

SEQ ID NO: 38535 - RNA, 45 nt, Mus musculus
gacgcagcuugacuggaucugcaagaucccuagagguuggaugug

SEQ ID NO: 38536 - RNA, 47 nt, Mus musculus
accaggagcagcacugguggaucggccugcacaccuuggagagugac

SEQ ID NO: 38537 - RNA, 23 nt, Mus musculus
uggaugcuacaugaugguggcac

SEQ ID NO: 38538 - RNA, 42 nt, Mus musculus
aucuguaagcgcagcaauagcucuggagagacucagccccaa

SEQ ID NO: 38539 - RNA, 46 nt, Mus musculus
ggaaccaguuccucaauaagguagggaguugggaagggacacggag

SEQ ID NO: 38540 - RNA, 42 nt, Mus musculus
ugaacagcaagaagcccagcuggucaccauugcaaaccccuu

SEQ ID NO: 38541 - RNA, 42 nt, Mus musculus
guagaccccucgcuaagcccauccccagcagcaacacccccu

SEQ ID NO: 38542 - RNA, 45 nt, Mus musculus
uauuccuggcucucagaggagccucugaauuaugugagcuggcaa

SEQ ID NO: 38543 - RNA, 45 nt, Mus musculus
agaauguguuugucugggagcaccugcagacagcugaagcccaaa

SEQ ID NO: 38544 - RNA, 51 nt, Mus musculus
uagagccaagggcguggucgggguggagccaaagcgggggaggcaggggcc

SEQ ID NO: 38545 - RNA, 42 nt, Mus musculus
acccagccuaccauagaggcuaggcugagacuuggcaguggg

SEQ ID NO: 38546 - RNA, 66 nt, Mus musculus
uaggauucuuuccuaucuguaggccuggaaagccugccccgucccuugggguggcucucugucacc

SEQ ID NO: 38547 - RNA, 66 nt, Mus musculus
ucuccuacucggcuacaucagcucugucuccucacccugcccucgugccuuuuuuuccacccagug

SEQ ID NO: 38548 - RNA, 90 nt, Mus musculus
cugugccugcuggaauggaccuaggguauggcaggagggagccuagguggcucagguguacaaaccagggcaccgguguggugucugcug

SEQ ID NO: 38549 - RNA, 57 nt, Mus musculus
cugguguggccuaggagaccaacucauggaaccacucagcaccuuuuuccagaggag

SEQ ID NO: 38550 - RNA, 77 nt, Mus musculus
agucccagccaggauggagagugccaguccccgugucccagugcaggacgaugugaacaaaaacucaaagcggaccc

SEQ ID NO: 38551 - RNA, 46 nt, Mus musculus
agagaaaaagaauagcaaacaaauaaaaaccuuccagaggcuugag

SEQ ID NO: 38552 - RNA, 46 nt, Mus musculus
gaaagaugcuuaaggauguggugaguguccuuaccaagugccucug

SEQ ID NO: 38553 - RNA, 42 nt, Mus musculus
agcuugggaagcauguguccuuggcaguagagcaagugauau

SEQ ID NO: 38554 - RNA, 42 nt, Mus musculus
guaccgugucuucagaagagaagccaaacgcacgaccaagau

SEQ ID NO: 38555 - RNA, 49 nt, Mus musculus
caggcagauugacuagggagaggcuagcguggucugguauggcugcaga

SEQ ID NO: 38556 - RNA, 45 nt, Mus musculus
ggugggaacauaguggggcugcagaaagauaauuuaggauggugu

SEQ ID NO: 38557 - RNA, 46 nt, Mus musculus
uggggacaaaguagugagcaaggugccauugcccuggggugaaucu

SEQ ID NO: 38558 - RNA, 55 nt, Mus musculus
ucgagagcaucgugggacuaaucuagagcagaacccaagaggguaaggaaguuuu

SEQ ID NO: 38559 - RNA, 47 nt, Mus musculus
gcuucgggcucuaaagagaugaauccaauaagggaggagugaccugg

SEQ ID NO: 38560 - RNA, 103 nt, Mus musculus
aacuauagugcgaugugucaagaggcugaggcagggggauaucuaguuagaagccagccuggguuacacugugagaucauguuuugagagaaaggagagggag

SEQ ID NO: 38561 - RNA, 41 nt, Mus musculus
cagcuuggagaauggacaaggccucccugauggcacacagu

SEQ ID NO: 38562 - RNA, 46 nt, Mus musculus
gcacuuuaagaccaacacuuaaacaagauuccauccugccaaaauc

SEQ ID NO: 38563 - RNA, 42 nt, Mus musculus
ccuggcacacagcaggugcccagugaacccauuccugaaggg

SEQ ID NO: 38564 - RNA, 46 nt, Mus musculus
caguguacuggcuaguuuugugucaacucgacacaggcuggaguua

SEQ ID NO: 38565 - RNA, 28 nt, Mus musculus
ucccuuggggcuggggagauggcuccaa

SEQ ID NO: 38566 - RNA, 23 nt, Mus musculus
ccacagggagggacuugccucuu

SEQ ID NO: 38567 - RNA, 45 nt, Mus musculus
acaggcaagguggaaagaaaggcagccugagcugcucgggugaag

SEQ ID NO: 38568 - RNA, 42 nt, Mus musculus
ccggcucugcggcccagccgccaccaugucccugcacggcaa

SEQ ID NO: 38569 - RNA, 46 nt, Mus musculus
caugccugaggcagauaagauuuucgaugguaguagcagguuucag

SEQ ID NO: 38570 - RNA, 45 nt, Mus musculus
auuugcagcauugcuggacaucaucacuucaucaaaacacuggca

SEQ ID NO: 38571 - RNA, 46 nt, Mus musculus
acugcacaaggcucugaagguaggggacagacgaggcacagaaugg

SEQ ID NO: 38572 - RNA, 46 nt, Mus musculus
augacagugucagggucaauuuccccagcacucccuuaguguguaa

SEQ ID NO: 38573 - RNA, 53 nt, Mus musculus
cuguacuuguccgcagcaggaguuuguuggacaaagggaaaaggucuuuuagg

SEQ ID NO: 38574 - RNA, 46 nt, Mus musculus
ggcuagccagguugacuuugugagaaccuguccuaaaaacaaagcu

SEQ ID NO: 38575 - RNA, 73 nt, Mus musculus
gugauguccuggauucaaccccugugcugggagugggagaaacagagauuacacugagaaagaacaggaggug

SEQ ID NO: 38576 - RNA, 47 nt, Mus musculus
aaucaccaccauucccagcacccccuuuucuugacaaggacuuagcu

SEQ ID NO: 38577 - RNA, 46 nt, Mus musculus
ugaauuuaaauccccagcauccauguaaaaagcccaaagcccagaa

SEQ ID NO: 38578 - RNA, 45 nt, Mus musculus
auggcuggggacgguggggauggugaggcucaggucacagcuacu

SEQ ID NO: 38579 - RNA, 48 nt, Mus musculus
cgacauaauaucaauaaacaguugaaaaugggguuuaaaaaucauggu

SEQ ID NO: 38580 - RNA, 45 nt, Mus musculus
accccaguguuugggagggaaggcggaaugaucagauggucucag

SEQ ID NO: 38581 - RNA, 56 nt, Mus musculus
cgcagguaccucaagcauugacacaacgugcaccaucuggggacuagagaccgggc

SEQ ID NO: 38582 - RNA, 55 nt, Mus musculus
aagugcugggacgagugaaucucgugucuggccaugugaagacccagcuaauugc

SEQ ID NO: 38583 - RNA, 81 nt, Mus musculus
aauguguuaaaacagaaaacaacacuuauuggaugcacccuuuaaaacauguuuuauuuauugcuauuauuaugagagaga

SEQ ID NO: 38584 - RNA, 46 nt, Mus musculus
augcugucuugaaaacuaaaaaaacaccuuuaaucccagcacucag

SEQ ID NO: 38585 - RNA, 58 nt, Mus musculus
gucuaugacaucgccuucagccgcgcuggagggggcagggacauguuugccucugugg

SEQ ID NO: 38586 - RNA, 69 nt, Mus musculus
gcgcugaugggucugugagaauguuugaccuccgccaucuggaacauagcaccaucauuuaugaagacc

SEQ ID NO: 38587 - RNA, 52 nt, Mus musculus
uaacuaccuggccaccauggccauggacgggauggagguaagccccgagccu

SEQ ID NO: 38588 - RNA, 24 nt, Mus musculus
agggguggauuguuggucgagagg

SEQ ID NO: 38589 - RNA, 90 nt, Mus musculus
guucccugcacaccgguugcuaggcuaaacaaccaccgagcaugugucaauggcauugccugggccccacacucguccugccacaucugu

SEQ ID NO: 38590 - RNA, 58 nt, Mus musculus
gaugccucgggccaucgaggacccuaucuuggccuacacagcugagggagagaucaac

SEQ ID NO: 38591 - RNA, 62 nt, Mus musculus
aaugugcagugggccuccacucagccugacuggaucgcuaucugcuacaacaacugccugga

SEQ ID NO: 38592 - RNA, 46 nt, Mus musculus
guccccaucugugucgugcuagcacuuaagugggaacaaaggccaa

SEQ ID NO: 38593 - RNA, 46 nt, Mus musculus
cuuuuaacaaaccucaacuuuguauguuuuuuaucuaucaggcuag

SEQ ID NO: 38594 - RNA, 45 nt, Mus musculus
aaguuuuaaaagguuagcagcaguuuuagaauacauuugugugag

SEQ ID NO: 38595 - RNA, 45 nt, Mus musculus
aaagccagucucuuaauauuugcuaguucuuagccugacggugag

SEQ ID NO: 38596 - RNA, 46 nt, Mus musculus
gaucccguguauguuaugaccccucugucagugacuuuccccugag

SEQ ID NO: 38597 - RNA, 46 nt, Mus musculus
ucuccagccccuuccaccaucgguucucuuggcagagaaaacaaga

SEQ ID NO: 38598 - RNA, 41 nt, Mus musculus
agauagccuggaacugaugguugugagcugucacauggaga

SEQ ID NO: 38599 - RNA, 46 nt, Mus musculus
uuacagaaaugaaaucuaaaucagaaaguuuuaaaugacugggcaa

SEQ ID NO: 38600 - RNA, 41 nt, Mus musculus
uuucuuuuucaaccaaacaauucuuauucuggacuugcuca

SEQ ID NO: 38601 - RNA, 47 nt, Mus musculus
agaaucgauuuaaaaaguuaaagauauuuaucaaauaaaaugacugg

SEQ ID NO: 38602 - RNA, 45 nt, Mus musculus
gcuagguagacagcauggagaccuauacaguggagagcugcauua

SEQ ID NO: 38603 - RNA, 86 nt, Mus musculus
uguguguaugugugaguguguguguguaugugugaguguguguguguguaugugugagugugugugugugagugugugugugugug

SEQ ID NO: 38604 - RNA, 46 nt, Mus musculus
guguguguaugugagugugugagugugugugugugugugugugugu

SEQ ID NO: 38605 - RNA, 34 nt, Mus musculus
aauauauccugaacaagaauggguaagugugugu

SEQ ID NO: 38606 - RNA, 42 nt, Mus musculus
gggcugugaaagcgaugugggggcagacaaaggcggggggac

SEQ ID NO: 38607 - RNA, 46 nt, Mus musculus
ugcauguguguauacaagugcacacauaugcacuccauguauguaa

SEQ ID NO: 38608 - RNA, 45 nt, Mus musculus
aaaaaagaaaagaauaaaaaucuaacuacauaaauggggccauau

SEQ ID NO: 38609 - RNA, 46 nt, Mus musculus
aacaagaagaucaucaaaacagggaaaggacagcagaaugucagga

SEQ ID NO: 38610 - RNA, 44 nt, Mus musculus
uucccagcaaccacaugguggcucacaaccaucugcgaugggau

SEQ ID NO: 38611 - RNA, 46 nt, Mus musculus
ggacuugaugacagugaauuuagccagguacaaaccaacgggagag

SEQ ID NO: 38612 - RNA, 42 nt, Mus musculus
aaaccagagaugaugagcagcuuucuuccagagggcgggugu

SEQ ID NO: 38613 - RNA, 46 nt, Mus musculus
gccucugcuccacucuccaccucuguuuucucaguuaaccucuuuu

SEQ ID NO: 38614 - RNA, 46 nt, Mus musculus
ccagcagaauggcaguugacugggguaguuguccuugcugguagau

SEQ ID NO: 38615 - RNA, 42 nt, Mus musculus
gauggaguacuccuguaaucucagcacuuagaaggcagaggc

SEQ ID NO: 38616 - RNA, 46 nt, Mus musculus
aaguugacagaaaaccuaucaggacaccccaucucuuuugucagua

SEQ ID NO: 38617 - RNA, 45 nt, Mus musculus
aaaaauucaucccuuugcucugaacauugacuuuaaaaaucugga

SEQ ID NO: 38618 - RNA, 45 nt, Mus musculus
guguuuucauucaggaaacaaacaaacaaaauaauuuuuaagaga

SEQ ID NO: 38619 - RNA, 46 nt, Mus musculus
uacugcuuugcugaaacguguguaccuuaaaccaacgcccccgccc

SEQ ID NO: 38620 - RNA, 45 nt, Mus musculus
ucuccagcccaugcuaauggaguuauuucuauuacuuuugaagau

SEQ ID NO: 38621 - RNA, 46 nt, Mus musculus
uuuaagauguuuggaaauaacuagcccuguguuuuaugguggagac

SEQ ID NO: 38622 - RNA, 42 nt, Mus musculus
ccgcuauucuccugcugacugcaucaguuuauagacguuagc

SEQ ID NO: 38623 - RNA, 42 nt, Mus musculus
aaacuaaguaaccguugcuuguaaauaauaaagcgggauguc

SEQ ID NO: 38624 - RNA, 45 nt, Mus musculus
ccuggcugggcguggggcugaugucuuuucaaguguuugaagauc

SEQ ID NO: 38625 - RNA, 46 nt, Mus musculus
gugccucauuuaacucuaaagguaaaggauguaagagggaagaguu

SEQ ID NO: 38626 - RNA, 46 nt, Mus musculus
uaaguuauuaaaaauaacacaaaauuaaaucacuuuaaggccagau

SEQ ID NO: 38627 - RNA, 45 nt, Mus musculus
uguaccaggucauuuuugcuggggugggaaagggugguuuuugcu

SEQ ID NO: 38628 - RNA, 46 nt, Mus musculus
gugagcuuuuuuuaaaugaaucagaauuuugucugacucaugaggc

SEQ ID NO: 38629 - RNA, 46 nt, Mus musculus
acuuugcuuccacgccugcuuuuauaucguccacaaggccgguuug

SEQ ID NO: 38630 - RNA, 60 nt, Mus musculus
aggagggaaucugucgguauuaggauacuguaagucaguggaagauucuagauguaggua

SEQ ID NO: 38631 - RNA, 86 nt, Mus musculus
uagaacacuauguggugauaaauucagagacuuagagcauaguacagcguaugguuuguguguggguggugcuauggcaguauuau

SEQ ID NO: 38632 - RNA, 46 nt, Mus musculus
aacuggacaguugaaauaacuauggagacugacucuaaaccaagac

SEQ ID NO: 38633 - RNA, 48 nt, Mus musculus
auuauaaugugaaucaucagugcguuacuuugguguuugaagaccgau

SEQ ID NO: 38634 - RNA, 42 nt, Mus musculus
agucugcaccuaacagucacgagucucugcugacugagagau

SEQ ID NO: 38635 - RNA, 45 nt, Mus musculus
cuacuauaauucucuguagaaaugugcacaaaguugggcaguggu

SEQ ID NO: 38636 - RNA, 41 nt, Mus musculus
gugugugugugugugugugugcgcgcgugcgugcgcgugcg

SEQ ID NO: 38637 - RNA, 56 nt, Mus musculus
acaugugcagagacaggaggcugcacagucucggcgugaggagaaaaaaagagcug

SEQ ID NO: 38638 - RNA, 46 nt, Mus musculus
aggggaaacaaaaagcagauaagaaccgggcucguguggaagagaa

SEQ ID NO: 38639 - RNA, 45 nt, Mus musculus
uuuuucagaccaguucucugguccaaagauuaugcaagaguaugu

SEQ ID NO: 38640 - RNA, 46 nt, Mus musculus
ggagcaaaguauggacugccagacucuuuggccauucugucagaaa

SEQ ID NO: 38641 - RNA, 47 nt, Mus musculus
uguuugcugucggcacucgcaaagcuuugcugcgacuacagaaagag

SEQ ID NO: 38642 - RNA, 45 nt, Mus musculus
aaggcugaacuuuuagggccauuuagaaaccuacccaccauagaa

SEQ ID NO: 38643 - RNA, 46 nt, Mus musculus
cccuggagucccuccacggcccuucuguaacuguaagcugaaggua

SEQ ID NO: 38644 - RNA, 43 nt, Mus musculus
gggaugaugggacuaacaaagaagccacaagcacagggaaguu

SEQ ID NO: 38645 - RNA, 46 nt, Mus musculus
aacauugcugguccuuuaaucccuguccaaggagauucugugagau

SEQ ID NO: 38646 - RNA, 55 nt, Mus musculus
cugguuuaacucucauagagagcuuuuggagagcaauuuuacauuaguggguaag

SEQ ID NO: 38647 - RNA, 57 nt, Mus musculus
ugccuauaucaugaacuacaucauugggaagaauaaaaacagccgacuugcucaggc

SEQ ID NO: 38648 - RNA, 46 nt, Mus musculus
uugugagccaccaugugguugcugggauuugaacuccagaucuucg

SEQ ID NO: 38649 - RNA, 49 nt, Mus musculus
ugaggguuaugaagacaaaccagauaccucuucuaacaaaaauaaagau

SEQ ID NO: 38650 - RNA, 121 nt, Mus musculus
ggaagauucuguuacggagucgccucagcgagugaucagcacugaagaugacgaggacgaggccaccguggaguuggaagggcaggaugaaagccaagaaggugauuucgaagaugcagau

SEQ ID NO: 38651 - RNA, 68 nt, Mus musculus
uugaugauuucgaagaugaggaagacauaguagaguaugaugauaaugauuuugcugaguuugaggac

SEQ ID NO: 38652 - RNA, 58 nt, Mus musculus
gccuucuaugcuuucugugugguccucuugguguuugggagugucucggaagccaagu

SEQ ID NO: 38653 - RNA, 63 nt, Mus musculus
ugacaucgcggcccgcagauuaucuuugcgaccugaagacagaaaccagacaaaggcaggcug

SEQ ID NO: 38654 - RNA, 46 nt, Mus musculus
guugcccgagucguggguuuuuuguguugcuuugguuuuuggcaag

SEQ ID NO: 38655 - RNA, 41 nt, Mus musculus
cccccagucagcaacgggccgugaggcggcggcgaaggggg

SEQ ID NO: 38656 - RNA, 41 nt, Mus musculus
auuccuucgcucccuccccaucuccccaucucugaccacau

SEQ ID NO: 38657 - RNA, 41 nt, Mus musculus
ccaguauccagcuugaauugagucugcuguauggggguguu

SEQ ID NO: 38658 - RNA, 45 nt, Mus musculus
aaaacaaaaacaacaaaaacccuguauauauuuauuuguguucag

SEQ ID NO: 38659 - RNA, 26 nt, Mus musculus
ucuuugccagcacuuucucucccaga

SEQ ID NO: 38660 - RNA, 46 nt, Mus musculus
ugaggcauuaugagauacccuacuguuuuuuaauaacagucauccu

SEQ ID NO: 38661 - RNA, 45 nt, Mus musculus
uugccuagucaaguguuuuguguguuuguaugaguguuugccugu

SEQ ID NO: 38662 - RNA, 41 nt, Mus musculus
aaaacucaccuacccgccagcaguuccauuccaagcccgca

SEQ ID NO: 38663 - RNA, 45 nt, Mus musculus
caggcugcuagagacaugaagagacuugaagaaaaggacaaggaa

SEQ ID NO: 38664 - RNA, 46 nt, Mus musculus
cuauucuuaagaacuuauaaaggaaagaacacuaaaguacacaaag

SEQ ID NO: 38665 - RNA, 46 nt, Mus musculus
auccuucuaguucccuuggaaauagcaaacgcugcaaguugguuag

SEQ ID NO: 38666 - RNA, 46 nt, Mus musculus
aguaagauguccccacaaacaggaaggcuucuguuaaauaaaucag

SEQ ID NO: 38667 - RNA, 76 nt, Mus musculus
uauuuucgauacauggcagagaacccaacugcuggggugguucaggaggaagaagaggacaauuuggaguaugaca

SEQ ID NO: 38668 - RNA, 44 nt, Mus musculus
gacuauccaccauuugaaaaaaauuuuuacaaugaacaugagga

SEQ ID NO: 38669 - RNA, 41 nt, Mus musculus
cuuguuuuaaauaugauaaaacuacauauaaaauuggccau

SEQ ID NO: 38670 - RNA, 42 nt, Mus musculus
gaaguuuugagaaaugugaacauauuuccguaauaaggguag

SEQ ID NO: 38671 - RNA, 41 nt, Mus musculus
gguuugggaaagcguauaaucuucgaucaguggccguguau

SEQ ID NO: 38672 - RNA, 42 nt, Mus musculus
ccagagacaucuugauugacccuauucgaguggugcagggag

SEQ ID NO: 38673 - RNA, 45 nt, Mus musculus
cacccacauccacacacacacacacacacacacacacacacagag

SEQ ID NO: 38674 - RNA, 46 nt, Mus musculus
ucuguuuuuauuuuugagaugaguucuuauauacguauagcccaag

SEQ ID NO: 38675 - RNA, 27 nt, Mus musculus
uuuuuuuauauuuauguuacucgcaaa

SEQ ID NO: 38676 - RNA, 45 nt, Mus musculus
aguuaauaaaaacaauucaacugaguaaggaauucaacaggcaag

SEQ ID NO: 38677 - RNA, 46 nt, Mus musculus
auguaaugagcaauuaugaagccuacaagcccuccacaggagccau

SEQ ID NO: 38678 - RNA, 56 nt, Mus musculus
aggggcaaguggauggacuagugcaggaagcuuaaauucuguuccaacuaauucag

SEQ ID NO: 38679 - RNA, 57 nt, Mus musculus
gcuucagggaauaacagccgugaagggauuggggguggcaaugggaagagagagaga

SEQ ID NO: 38680 - RNA, 61 nt, Mus musculus
ggcauggaggaagugccggcagacacggagagagccggggugcaaaugauggcaggaaugg

SEQ ID NO: 38681 - RNA, 46 nt, Mus musculus
agccacccaaaagaaagaaaagccgaugggauaguuagaggguaug

SEQ ID NO: 38682 - RNA, 44 nt, Mus musculus
cuggguugggguccaagauauacagacccccugcccuuggugga

SEQ ID NO: 38683 - RNA, 46 nt, Mus musculus
uuccuugggaaccugagcuggcccuggaaagcagagagcugggaag

SEQ ID NO: 38684 - RNA, 45 nt, Mus musculus
aagaugccugagcgcucagguuccccagacuguuuccagcccuga

SEQ ID NO: 38685 - RNA, 42 nt, Mus musculus
ucaggaaguucucccuccucuucauuaaaagcauaccugcgu

SEQ ID NO: 38686 - RNA, 45 nt, Mus musculus
ugaggucucucuuugccuuuuuugaagaggcaauaacagcaccua

SEQ ID NO: 38687 - RNA, 42 nt, Mus musculus
uguccaaugccuuugcuugcucuuucagcuucuuagccacau

SEQ ID NO: 38688 - RNA, 46 nt, Mus musculus
aaguaggcaaugacaccagcacauaaagaggaaagaaaagaaggag

SEQ ID NO: 38689 - RNA, 46 nt, Mus musculus
gauugagcuggaucaguuugaaggcagagcgcgaacgauaaccugg

SEQ ID NO: 38690 - RNA, 46 nt, Mus musculus
uggcccaucaagcgccaucuucccucucucggcagggaucgccggc

SEQ ID NO: 38691 - RNA, 43 nt, Mus musculus
aaccauggugggugugugugugugugugugugugugugugugu

SEQ ID NO: 38692 - RNA, 50 nt, Mus musculus
uuuugcagucggucuuaaagaggaugggccuaaggcuuggcaaacuugga

SEQ ID NO: 38693 - RNA, 47 nt, Mus musculus
gcugguuuguccuucuuuuuggguauuugcacuauuuggggagcagg

SEQ ID NO: 38694 - RNA, 46 nt, Mus musculus
cuggguuugcauguuuacaggcuccacccuagggccagugccagag

SEQ ID NO: 38695 - RNA, 43 nt, Mus musculus
ucauccaggaguggcuccguucccaacgccgagaccucaaggu

SEQ ID NO: 38696 - RNA, 46 nt, Mus musculus
ccucuaccaccaaccagcaggagauugcuucucuugacgucaaggu

SEQ ID NO: 38697 - RNA, 41 nt, Mus musculus
gagcgcgaguacaucaacugcaaucguuacuuccgccaggu

SEQ ID NO: 38698 - RNA, 41 nt, Mus musculus
gugccucaggcccagcccccgaugccugcccagcgccgagg

SEQ ID NO: 38699 - RNA, 46 nt, Mus musculus
auguaagcaggccugccuacccccaugguggagcaggcuggcagag

SEQ ID NO: 38700 - RNA, 46 nt, Mus musculus
augcuagcuguagaugguugugagccauuauguaguugcuggaacc

SEQ ID NO: 38701 - RNA, 45 nt, Mus musculus
ggcccagauaacuccaggauagauuagaaauagcuguguccaggu

SEQ ID NO: 38702 - RNA, 42 nt, Mus musculus
gcgggggagcuaaaggggcuugaagcuguagucccggaagga

SEQ ID NO: 38703 - RNA, 45 nt, Mus musculus
uacaaggggcuaauuaaucucaugggcagcuaugaccuggaagag

SEQ ID NO: 38704 - RNA, 43 nt, Mus musculus
cagcuuccucagagaacacauuaccuuagagcaguccccgucg

SEQ ID NO: 38705 - RNA, 46 nt, Mus musculus
gcguuagacugcugauccgggugaugcgaaucguaaucugagccga

SEQ ID NO: 38706 - RNA, 46 nt, Mus musculus
ccaccuuuccccgagccucugaauaaaguguuuaaauaaccccgcu

SEQ ID NO: 38707 - RNA, 46 nt, Mus musculus
cguuccaugccgaaggcccaaagaagagaaauggcuggcuacaaca

SEQ ID NO: 38708 - RNA, 45 nt, Mus musculus
cagucaaggcagugcacgucccugggaggucguccaugucccgag

SEQ ID NO: 38709 - RNA, 24 nt, Mus musculus
ucauguguggugguaguggugaug

SEQ ID NO: 38710 - RNA, 44 nt, Mus musculus
gccagggcuacacagagaaacccugucuugacaaacgagggaga

SEQ ID NO: 38711 - RNA, 42 nt, Mus musculus
caaggagguggagucagaaaggucuuugggguuacuggggga

SEQ ID NO: 38712 - RNA, 56 nt, Mus musculus
ggugagccuaaggccaacgagagacccuguugaaagaagggaaggaggaaaggaaa

SEQ ID NO: 38713 - RNA, 75 nt, Mus musculus
gacugcauacuaagucccuggugagagagggaaggggagaggaaaaggaaggaggaaggggaagagaagagagau

SEQ ID NO: 38714 - RNA, 42 nt, Mus musculus
agucagggaugcuaugaaacaucucgugguacagucagucuc

SEQ ID NO: 38715 - RNA, 45 nt, Mus musculus
uccagcucugggaacgagagccacagagacgguguacagugagau

SEQ ID NO: 38716 - RNA, 46 nt, Mus musculus
augcauauggcuguuggggugaugcugcaagagaaggaaccgcguc

SEQ ID NO: 38717 - RNA, 45 nt, Mus musculus
ccagaucuaacccuggcuggcagcucaccaaguggucacugcgga

SEQ ID NO: 38718 - RNA, 41 nt, Mus musculus
caugauacuugugugggagcgcgugccugugcgcugggagu

SEQ ID NO: 38719 - RNA, 46 nt, Mus musculus
caagacagaugugcuaucacugugcaagagauagugggugccagaa

SEQ ID NO: 38720 - RNA, 60 nt, Mus musculus
ccauacauguuaguccucccaagacauacaaccacugcacacauaccauacauacauaca

SEQ ID NO: 38721 - RNA, 42 nt, Mus musculus
cucucucucucucucucucauuagaaaaaaaacaggcauccg

SEQ ID NO: 38722 - RNA, 46 nt, Mus musculus
gaguugaccuuuuuaaaagaaauguuuuuuaccaagcuggagagau

SEQ ID NO: 38723 - RNA, 46 nt, Mus musculus
caggaaggacaguacuacuguacagccuccaacagagccagcagua

SEQ ID NO: 38724 - RNA, 88 nt, Mus musculus
ucuggaagugaaaugguacuucggugcucugugaaagaggggacgagcccaaucacguuucaguuuuacaaagaaaaggaggacagac

SEQ ID NO: 38725 - RNA, 46 nt, Mus musculus
acaggaggugucuguugcuguccuucuggucuaaucaguggaagug

SEQ ID NO: 38726 - RNA, 46 nt, Mus musculus
ccugaugcucagcuuccuucaagaucauacgcccuuugugcucaga

SEQ ID NO: 38727 - RNA, 45 nt, Mus musculus
cugugguaaauuaucccuaguaauauuuaaaauagcacaugagac

SEQ ID NO: 38728 - RNA, 45 nt, Mus musculus
uuccaagugacaguugacugcugguauuauguaguugggcuuccg

SEQ ID NO: 38729 - RNA, 63 nt, Mus musculus
cuccaaugacccagcaacauucacagauaagcccaccagagacauggaauaccagugcagagc

SEQ ID NO: 38730 - RNA, 94 nt, Mus musculus
ccauaggcaucagcugccaguccgaaaauggaacugcacccaucacuuaccaccuuaugaaagcaaagagugacuuccagacucucgaggugac

SEQ ID NO: 38731 - RNA, 45 nt, Mus musculus
acaagaucucauguggccgaggcuagccuuucacuuacuguguag

SEQ ID NO: 38732 - RNA, 45 nt, Mus musculus
ucgcugccaagcugggauccuguccggauucaaauugcaggaguc

SEQ ID NO: 38733 - RNA, 91 nt, Mus musculus
auccaagcccaaggugacacuggacaaaaaggaggugacagaaggcggggucgugacggucaauuguuccuugcaagaagaaaagccaccg

SEQ ID NO: 38734 - RNA, 53 nt, Mus musculus
cgggaaguacaaaugcacagugaugcugaacaacaaggaaaaaaccacgauug

SEQ ID NO: 38735 - RNA, 84 nt, Mus musculus
gagugccuuguggacaucagcaccaccucgaaaagcaggucucagcaccgggugcuguucuauaaggacgaugcgaugguguau

SEQ ID NO: 38736 - RNA, 45 nt, Mus musculus
uguggugugcguguauaugugugugguguauauguguguggugug

SEQ ID NO: 38737 - RNA, 46 nt, Mus musculus
auguguguggguuuguguggugugguguguguguauaugugugugg

SEQ ID NO: 38738 - RNA, 46 nt, Mus musculus
guaugguguaugugugugugugcuguguauguaugugugugugguc

SEQ ID NO: 38739 - RNA, 34 nt, Mus musculus
ugacucuuagacacccaggcgcugaggggaauga

SEQ ID NO: 38740 - RNA, 46 nt, Mus musculus
uaaacuguuuguguguguguguguguguguguguguguguaugugu

SEQ ID NO: 38741 - RNA, 46 nt, Mus musculus
cuuuggggaagcauuccugggauuccaacugaugaacugggcuggu

SEQ ID NO: 38742 - RNA, 23 nt, Mus musculus
guuaaaccuagaggacaguucga

SEQ ID NO: 38743 - RNA, 46 nt, Mus musculus
gucagguucuugcuaagcguaacucuuuuuuucucaggccucaggu

SEQ ID NO: 38744 - RNA, 46 nt, Mus musculus
uucugucauaagcuauuucuuuuuacaucauacuaugccucuaauu

SEQ ID NO: 38745 - RNA, 44 nt, Mus musculus
agucuuacaucuugguggguuucuguuuguuggaaugggagaga

SEQ ID NO: 38746 - RNA, 33 nt, Mus musculus
cucaaagccuuguucuaaaucaagguucaaaga

SEQ ID NO: 38747 - RNA, 45 nt, Mus musculus
ccuucuucccuucuuaugagacuugaauucgugaaaucaacagau

SEQ ID NO: 38748 - RNA, 39 nt, Mus musculus
ucagggcgaagaaggaagugguaugauuccaagguagag

SEQ ID NO: 38749 - RNA, 42 nt, Mus musculus
gaguaaggagaaacugaguaacgauuagucagaaaagaagag

SEQ ID NO: 38750 - RNA, 45 nt, Mus musculus
agcacaacacacagagaugaccauguguacuucuucaggugaaug

SEQ ID NO: 38751 - RNA, 42 nt, Mus musculus
uagaguuauugaaaagagaaaugcuggugugagggcccagag

SEQ ID NO: 38752 - RNA, 42 nt, Mus musculus
uauuuggggagcgccgcuagggagguagccagaccagcagau

SEQ ID NO: 38753 - RNA, 45 nt, Mus musculus
ugaggugggagaggagaaggcaccuugagaggagagguacgguga

SEQ ID NO: 38754 - RNA, 43 nt, Mus musculus
gaaaggagagaaagagacagagacagagagagacagggagaga

SEQ ID NO: 38755 - RNA, 41 nt, Mus musculus
auccugagaugggcucuugacccuaaguuuaacaucacaga

SEQ ID NO: 38756 - RNA, 45 nt, Mus musculus
gauggcgccauugucaaguuucuguaauuuuuaaaguucugggau

SEQ ID NO: 38757 - RNA, 30 nt, Mus musculus
ccagccugugcuaugugaagcacuggagag

SEQ ID NO: 38758 - RNA, 45 nt, Mus musculus
aaauggcagcggcgagaaaauguggcgcagagagaaaugcgagac

SEQ ID NO: 38759 - RNA, 45 nt, Mus musculus
uggggggaauguauuaaauuaaaauaacuuaaaaacagcaaaaau

SEQ ID NO: 38760 - RNA, 41 nt, Mus musculus
uuacaaccaucuguaauguuaucugaugcccucuucuggug

SEQ ID NO: 38761 - RNA, 46 nt, Mus musculus
cagggaagaaagauuuguuaguacccaucucacucaguguccagag

SEQ ID NO: 38762 - RNA, 40 nt, Mus musculus
gcucaacaagaucgcagucagcuuccgggagcugcagaga

SEQ ID NO: 38763 - RNA, 46 nt, Mus musculus
ucucagguuugugguucuuuaauauugucagguuuuguuuugagug

SEQ ID NO: 38764 - RNA, 46 nt, Mus musculus
ccuacuucuagaugcuaauuuuacuguccuauuaaugauaccagaa

SEQ ID NO: 38765 - RNA, 46 nt, Mus musculus
agcuuucuguaaggaaagccagcuagugcuaagugcuggauuagau

SEQ ID NO: 38766 - RNA, 48 nt, Mus musculus
ucucuuccuuuggugagauguaaaaccuauggcccagccagccuggag

SEQ ID NO: 38767 - RNA, 47 nt, Mus musculus
ugugcugagcaccaaaucaaccugauaaaggcugaugacaacaagaa

SEQ ID NO: 38768 - RNA, 46 nt, Mus musculus
aaaaaaaaaaagaauugccgaaugaauauucagggccagccuaguc

SEQ ID NO: 38769 - RNA, 45 nt, Mus musculus
agucaguuuuugauuauagugauuccacacaagaugagaaaaagg

SEQ ID NO: 38770 - RNA, 45 nt, Mus musculus
cuucccgcuaccaccaccuuaauauaaucacaugcuuauuggaca

SEQ ID NO: 38771 - RNA, 46 nt, Mus musculus
agaaacccugucucgaaaaaaaaacaaaaacaaaauugcccagggu

SEQ ID NO: 38772 - RNA, 45 nt, Mus musculus
ugcuuguagagccccagcagaacaucgaaucugucauaccugaug

SEQ ID NO: 38773 - RNA, 41 nt, Mus musculus
ccugacucuguaaaccgaacucauagagaugcauuggaauu

SEQ ID NO: 38774 - RNA, 45 nt, Mus musculus
cggauggugggaagaggcagggauuucuugguguccuagaaagau

SEQ ID NO: 38775 - RNA, 42 nt, Mus musculus
ugagguucagaaguuguuugucaguagugaggaccggcguau

SEQ ID NO: 38776 - RNA, 45 nt, Mus musculus
ccgggggcgggaggcuugaguuucucacacuugggaaggaaagcc

SEQ ID NO: 38777 - RNA, 46 nt, Mus musculus
cacucaguacauacaugaaagcuaacaaccaccuguaacuccaguc

SEQ ID NO: 38778 - RNA, 45 nt, Mus musculus
guguuggaggaguagcugagaggucuauauccgguugggcagaca

SEQ ID NO: 38779 - RNA, 45 nt, Mus musculus
gagaaaaggguuuauuuggcuuaaacuuccacggcacuguucauc

SEQ ID NO: 38780 - RNA, 44 nt, Mus musculus
acagaauuaaaaggcuggaugggguguaauggguguaaugguga

SEQ ID NO: 38781 - RNA, 45 nt, Mus musculus
ggcggacgguggcucggagcgggccgaugggcgcauugugaagau

SEQ ID NO: 38782 - RNA, 58 nt, Mus musculus
agcgccacgguggaccagcgccugccugagugcgagaagcuggccaaggugaggggag

SEQ ID NO: 38783 - RNA, 47 nt, Mus musculus
auuuugggagcugugaagagacaggaaggaagaugaugcauagucau

SEQ ID NO: 38784 - RNA, 64 nt, Mus musculus
gaaugagugagugaguguguaaaugaacaaaugaauaaaaaagaaguguggggaggggacaaaa

SEQ ID NO: 38785 - RNA, 41 nt, Mus musculus
uguggguccuugggaggaaaggccuaaccuaaagacugccu

SEQ ID NO: 38786 - RNA, 63 nt, Mus musculus
ccucugacaugguguccacgucccgcaucuugguugcaguagugaaaaugugcuaugaggcua

SEQ ID NO: 38787 - RNA, 44 nt, Mus musculus
gcaguugcaaaaaugguucagcagugcuguacuuacguggagga

SEQ ID NO: 38788 - RNA, 45 nt, Mus musculus
ggcucacaaccaucuguaacaagaucugacucccucuucuggggu

SEQ ID NO: 38789 - RNA, 56 nt, Mus musculus
auugagcgugcucggcugacuaaaaccuuagcaacuauuaaagagcaaaauggcga

SEQ ID NO: 38790 - RNA, 46 nt, Mus musculus
gcagaugagacucugccuagcugugaaggauuacauucgcacacag

SEQ ID NO: 38791 - RNA, 95 nt, Mus musculus
uggaucagcacgagggguccuaucuguccaucugcaaacacuacagagccaucuaugacacucccugcauucaggcagaaagugacaaguggcag

SEQ ID NO: 38792 - RNA, 45 nt, Mus musculus
uaagcucacuaacagcaaggauuguccuugauauauuugccccca

SEQ ID NO: 38793 - RNA, 45 nt, Mus musculus
caucugaagugugucaaccuucacaacaaaccguuucuucccaag

SEQ ID NO: 38794 - RNA, 44 nt, Mus musculus
agaauggcagggacaguaaggagaacacuuuugauagaggggaa

SEQ ID NO: 38795 - RNA, 46 nt, Mus musculus
caagccugaaguugaugcauguuucaucuauaccuuauagggcuag

SEQ ID NO: 38796 - RNA, 72 nt, Mus musculus
ggcuccucagagaccccggcgacugacguuuucagcucuacagaagaaggggaaaagagguggaaagacuug

SEQ ID NO: 38797 - RNA, 41 nt, Mus musculus
auaauguacuuauguauaauaauaaauaaauguuugggcca

SEQ ID NO: 38798 - RNA, 46 nt, Mus musculus
aucuacaaugaggcucuggaugcuuuuagaagacacaaaauuggag

SEQ ID NO: 38799 - RNA, 72 nt, Mus musculus
gcuaaaauuuuaagauaguaaauguguuuaagcccccucugccuuucccacucucugauuucaugauaacug

SEQ ID NO: 38800 - RNA, 41 nt, Mus musculus
ccuggagaaccagcagucuuuaggccacguuggaaccccag

SEQ ID NO: 38801 - RNA, 44 nt, Mus musculus
agagagaugggaacgcaccgacacucgcaacagcgcagucaagu

SEQ ID NO: 38802 - RNA, 42 nt, Mus musculus
uagcgcgaauacucugaauuaucaccuaaaagaacuggaaga

SEQ ID NO: 38803 - RNA, 42 nt, Mus musculus
gaaggcggcgaaggcuccggccguggucagcagcaucugcag

SEQ ID NO: 38804 - RNA, 45 nt, Mus musculus
gggaaaaauuaucuuuugcugggagaagggaauauaaacaaauag

SEQ ID NO: 38805 - RNA, 46 nt, Mus musculus
uccaaccaaacuuauuuuuaaaaaacuacuuuugccugguucugau

SEQ ID NO: 38806 - RNA, 45 nt, Mus musculus
acacaaggacuuguugcuuauuugcucacaucagcucugaaccag

SEQ ID NO: 38807 - RNA, 46 nt, Mus musculus
guuguauccaucaaguaugucagaaauaacuaacuucacucaugau

SEQ ID NO: 38808 - RNA, 45 nt, Mus musculus
aaagacuguugucaaacaucaaaaaaaaaggcagcccucugagau

SEQ ID NO: 38809 - RNA, 41 nt, Mus musculus
uaaugcaucauucuaaauaucugagggccaagaagaggaga

SEQ ID NO: 38810 - RNA, 46 nt, Mus musculus
guguguuguguguguguguguuguguguguguuguguguguguggu

SEQ ID NO: 38811 - RNA, 45 nt, Mus musculus
ugugugugugugcauguggguaugugucuguaugugugucugugu

SEQ ID NO: 38812 - RNA, 45 nt, Mus musculus
gugucugugugcacaugugugugucuguguuuaugugucugugug

SEQ ID NO: 38813 - RNA, 42 nt, Mus musculus
aguagagggccaagagagugcauggccaaaaugacagguuug

SEQ ID NO: 38814 - RNA, 46 nt, Mus musculus
uaccaucaugucuuuccuaaccauuccaugaguauggcccucagca

SEQ ID NO: 38815 - RNA, 46 nt, Mus musculus
uuccuuaccagaaacucugcccucaaaggugauagaaagggcagca

SEQ ID NO: 38816 - RNA, 46 nt, Mus musculus
ugacuugcacaccuguaacccaacacuggggagacugaggugggag

SEQ ID NO: 38817 - RNA, 42 nt, Mus musculus
cuuacacacuacagggggguggggaggggagaggaggggaaa

SEQ ID NO: 38818 - RNA, 46 nt, Mus musculus
gccuaugucaggucuccaucugcagagauuaggaacagccacagau

SEQ ID NO: 38819 - RNA, 46 nt, Mus musculus
uccauuuccuaguuaaacugaguuaaauguuacuugggaggcagag

SEQ ID NO: 38820 - RNA, 46 nt, Mus musculus
aauguaaaaaugaacuugguagagacaauaauacagugcccuaaga

SEQ ID NO: 38821 - RNA, 42 nt, Mus musculus
ugugugugugugugagugugugugugugagugugcgugugcg

SEQ ID NO: 38822 - RNA, 43 nt, Mus musculus
guuagcaauggugugugugugugugugugugugugugugugug

SEQ ID NO: 38823 - RNA, 45 nt, Mus musculus
aggacaagucaggucucucaaguauacauacacuagggcccagcu

SEQ ID NO: 38824 - RNA, 42 nt, Mus musculus
ccccacagagccucagcuccaaggcauggcucaggggccagg

SEQ ID NO: 38825 - RNA, 45 nt, Mus musculus
gacacuugugugguucucugucaguaagcaggaaggcugcgggau

SEQ ID NO: 38826 - RNA, 42 nt, Mus musculus
gggagggagagaaggggggaaagagagagaggugacugugac

SEQ ID NO: 38827 - RNA, 42 nt, Mus musculus
ggagggagaggggagaaggagaaagaagagaaggggagagag

SEQ ID NO: 38828 - RNA, 46 nt, Mus musculus
ggguggcugggugaucugcgaaugagccaagggauggggaauagag

SEQ ID NO: 38829 - RNA, 45 nt, Mus musculus
cucccucucccucucucucucucucucugugugugugugugugug

SEQ ID NO: 38830 - RNA, 44 nt, Mus musculus
cgcaugagaagaucugguuugacaaguuuaaauaugacgaugca

SEQ ID NO: 38831 - RNA, 41 nt, Mus musculus
auggugccagcgugauccuccgagacauugcaagagccuga

SEQ ID NO: 38832 - RNA, 55 nt, Mus musculus
aauccuccauccuuuuggauguuaaaccuugggaugaugagacugacauggccca

SEQ ID NO: 38833 - RNA, 45 nt, Mus musculus
gugguggaggaugacaaagugggcaccgacuugcuccaggaggag

SEQ ID NO: 38834 - RNA, 45 nt, Mus musculus
gcagagugucgacaucgcagcuuucaacaagaucugaacguccga

SEQ ID NO: 38835 - RNA, 46 nt, Mus musculus
uguuccuaaucgccgcagccuaucuggccugccaggcggcacccag

SEQ ID NO: 38836 - RNA, 41 nt, Mus musculus
uucagcccucacugugcagaaccagaaugaauggcgggggg

SEQ ID NO: 38837 - RNA, 46 nt, Mus musculus
uccaugcugagaaaauaaugagaauucuguuggcuuggcuuaagau

SEQ ID NO: 38838 - RNA, 46 nt, Mus musculus
gucaaacaugccuuucagggcuggggugggacugauggccacagac

SEQ ID NO: 38839 - RNA, 68 nt, Mus musculus
acaaacacgggacauguuugugugaccggggaggggagaauauacaaauguaaauaucagaucacaag

SEQ ID NO: 38840 - RNA, 45 nt, Mus musculus
ugcgugcauggggguugggaggcagagugcccagggagagcgggg

SEQ ID NO: 38841 - RNA, 46 nt, Mus musculus
uucuuucaaauaaaguccuacugggguuuugacggcuguguuggga

SEQ ID NO: 38842 - RNA, 46 nt, Mus musculus
ugggaccaacuaagaaucuguugauucuaucagugcucuuggcugg

SEQ ID NO: 38843 - RNA, 41 nt, Mus musculus
ucgaggccaagguacugggaaaccaagggagaagcuggugg

SEQ ID NO: 38844 - RNA, 46 nt, Mus musculus
aggaaugggcuucgauguguggagugaggcauccuggaucucagau

SEQ ID NO: 38845 - RNA, 24 nt, Mus musculus
uauuagucuugccagacagggccu

SEQ ID NO: 38846 - RNA, 78 nt, Mus musculus
aaaggcuaaaaggauagaccaugaggucuuuaugugugauacgaggugaacggaggugacaggcaaauucgaggugag

SEQ ID NO: 38847 - RNA, 48 nt, Mus musculus
aaagcugaacgugucugcucuugcgggagaaaugggagugauggagag

SEQ ID NO: 38848 - RNA, 46 nt, Mus musculus
agcagggcucuugggggcugcaccagggcgaggggaggccugugau

SEQ ID NO: 38849 - RNA, 45 nt, Mus musculus
ccuccuccuccucacauucuguccuuccuuccccacccccuacug

SEQ ID NO: 38850 - RNA, 42 nt, Mus musculus
gcuucuggagaaggcaugggugcaggcucagcaggggcugga

SEQ ID NO: 38851 - RNA, 46 nt, Mus musculus
auggagacauugccuuugugguggcugguuugaguauaggcugggu

SEQ ID NO: 38852 - RNA, 41 nt, Mus musculus
gaggaagaggaggaggaggaggaggaggaggaagagacauc

SEQ ID NO: 38853 - RNA, 43 nt, Mus musculus
agcucccucagcuaugaaaagggacucaauuacugcugcuuga

SEQ ID NO: 38854 - RNA, 45 nt, Mus musculus
ggugcuagugauguggugguacguagggggacaccucaguugugu

SEQ ID NO: 38855 - RNA, 44 nt, Mus musculus
uuuguuggucuuccuuaauuauuucuccaccucauguuuugaga

SEQ ID NO: 38856 - RNA, 45 nt, Mus musculus
aaaaaaauuaaaauaaaaagaaaaccuaagacacuuauucuuaga

SEQ ID NO: 38857 - RNA, 42 nt, Mus musculus
ucggugggcuauacauccaguucuaggaaaaacaggggagag

SEQ ID NO: 38858 - RNA, 45 nt, Mus musculus
uggagcuugcuauguggaccaaacuguccuugaacgcacagagau

SEQ ID NO: 38859 - RNA, 42 nt, Mus musculus
ugugcuuggugugagacugucuccgugauauaaugcuugaga

SEQ ID NO: 38860 - RNA, 46 nt, Mus musculus
cccaacaaccacaugguggcucacaaccauccguaacgagauuuga

SEQ ID NO: 38861 - RNA, 47 nt, Mus musculus; identical to SEQ ID NO: 36421

SEQ ID NO: 38862 - RNA, 46 nt, Mus musculus; identical to SEQ ID NO: 36422

SEQ ID NO: 38863 - RNA, 45 nt, Mus musculus
uuuuuuaaacuaaaugaccgauguucuguucugguugacaugaga

SEQ ID NO: 38864 - RNA, 46 nt, Mus musculus; identical to SEQ ID NO: 36423

SEQ ID NO: 38865 - RNA, 42 nt, Mus musculus
uucccagcaaucacaugguggcucacaaccauccuguauugg

SEQ ID NO: 38866 - RNA, 48 nt, Mus musculus
aaucccagcaaucacaugguggcucacaaccaucugugaugagaucug

SEQ ID NO: 38867 - RNA, 25 nt, Mus musculus
gugcuuaggagguagaggaggugcu

SEQ ID NO: 38868 - RNA, 47 nt, Mus musculus
uugagacauguuuuugcagagaccaaagcugugaaauaggccagaag

SEQ ID NO: 38869 - RNA, 47 nt, Mus musculus
uaucugcauagaaaauguuagcauauuggggaaguuucauagauaca

SEQ ID NO: 38870 - RNA, 46 nt, Mus musculus
auucugugccaagugguuguggcacacaccucuaaccccagcagca

SEQ ID NO: 38871 - RNA, 46 nt, Mus musculus
gaauuagucaacaaagaaauuugggaaaggguccuuuugagguggc

SEQ ID NO: 38872 - RNA, 46 nt, Mus musculus
ccuguguuagcauuuuauuuaugucuggccugaaacucacagagau

SEQ ID NO: 38873 - RNA, 58 nt, Mus musculus
uaggcaugugccgccauauuuucuguuuuaugcccccuuuauaguacaauaaagaacu

SEQ ID NO: 38874 - RNA, 42 nt, Mus musculus
cuuucccacacugguucguuagcuguaguaauagcagaagua

SEQ ID NO: 38875 - RNA, 42 nt, Mus musculus
aagaugcaugugauuauauuguauguacauuugcagguaggu

SEQ ID NO: 38876 - RNA, 45 nt, Mus musculus
aagacugagaacaacgaucauauuaauuugaagguggcgggacag

SEQ ID NO: 38877 - RNA, 42 nt, Mus musculus
ucugaacugaaaaugaagcaguuauauagucgaacguuaauc

SEQ ID NO: 38878 - RNA, 45 nt, Mus musculus
ucuauuuggagggggacacaggauggacgaaucgaauccuuggac

SEQ ID NO: 38879 - RNA, 44 nt, Mus musculus
cagcugaggagacuccggcgcucgccauggccgacgagaaaccc

SEQ ID NO: 38880 - RNA, 41 nt, Mus musculus
uguauauguguaugugcuuggcccagggaguggcacuauua

SEQ ID NO: 38881 - RNA, 45 nt, Mus musculus
guaccuaugugauagcucacaaccaucuauaacucuguucccuga

SEQ ID NO: 38882 - RNA, 45 nt, Mus musculus
aggaccuugagaggaaugauugggggguguuguuguuguuguuuu

SEQ ID NO: 38883 - RNA, 42 nt, Mus musculus; identical to SEQ ID NO: 22922

SEQ ID NO: 38884 - RNA, 46 nt, Mus musculus
gcuucuuagaagaacuuugucuuaaaauagaaagaaauguuggcaa

SEQ ID NO: 38885 - RNA, 45 nt, Mus musculus
uuauuuauuuaucuuauguauaugaguauacuguagcugucuuca

SEQ ID NO: 38886 - RNA, 46 nt, Mus musculus
cuauucccagcaaccacaugguggcucacaaccaccuguaauugga

SEQ ID NO: 38887 - RNA, 46 nt, Mus musculus
gagaaaacucuucaaugaaucccauggaaucuuuguuggccugcaa

SEQ ID NO: 38888 - RNA, 42 nt, Mus musculus
gguucgagugaguaaaaauuaccguucagucauacgggccug

SEQ ID NO: 38889 - RNA, 46 nt, Mus musculus
caucacaggguuccugucguccucuguccuuccuaguugcagggaa

SEQ ID NO: 38890 - RNA, 51 nt, Mus musculus
ccuucuugacuggguccgacugcacgugugcgagguggacaguuugucggc

SEQ ID NO: 38891 - RNA, 35 nt, Mus musculus
cgucguuucaggaggauuuuguuuguaggucugag

SEQ ID NO: 38892 - RNA, 46 nt, Mus musculus
acacuuauucaaguccuaaguuuagaugcagaauaggucguuggag

SEQ ID NO: 38893 - RNA, 50 nt, Mus musculus
agccaccauguuugacucucagaagugugugugugugugugugugagaga

SEQ ID NO: 38894 - RNA, 44 nt, Mus musculus
gugaauuuuaguaauuuuuuauuugcuuuuuauuuuggggugug

SEQ ID NO: 38895 - RNA, 48 nt, Mus musculus
aaauacucuacgauucgacaacaaaaggagaucaaacuagacaaacua

SEQ ID NO: 38896 - RNA, 46 nt, Mus musculus
acacaugcuccacuauguucauagcaucauuauuuauaauagccag

SEQ ID NO: 38897 - RNA, 46 nt, Mus musculus
uagcccagaaaacuagaacauccaagauacaauuugcaaaacacaa

SEQ ID NO: 38898 - RNA, 42 nt, Mus musculus
gaaagagggaacuucuugucuuauugaaacccauggccccag

SEQ ID NO: 38899 - RNA, 27 nt, Mus musculus
uuuuguuucccaauaauuccaaaauua

SEQ ID NO: 38900 - RNA, 46 nt, Mus musculus
ugaauucaugugccuuuuagcuauuaaccuguucuguaacaccaac

SEQ ID NO: 38901 - RNA, 45 nt, Mus musculus
uuaucaaagcugcggccgcgacugaaaccagcucgguguucgcag

SEQ ID NO: 38902 - RNA, 46 nt, Mus musculus
cccaacucugccucuuuuauuguuagguuguccccccaccccaccc

SEQ ID NO: 38903 - RNA, 42 nt, Mus musculus
ggaaaggacacacugccacgagaaaccacccgacggcuggag

SEQ ID NO: 38904 - RNA, 46 nt, Mus musculus
aguuucuugcaggaaaucucugagacacauucugucuuugagaggu

SEQ ID NO: 38905 - RNA, 45 nt, Mus musculus
ucucuauaaaauauauaaaacaccauuucuuguaacuugcccuua

SEQ ID NO: 38906 - RNA, 41 nt, Mus musculus
caggaggaagguggugggaagauaacaggacuugaggggag

SEQ ID NO: 38907 - RNA, 46 nt, Mus musculus
agucaaaaaagucuagaaggggcugaagcaaggauucuggugccag

SEQ ID NO: 38908 - RNA, 56 nt, Mus musculus
ccuucccgugacccucuuuucaagcuggcaccagaauccuugcuucagccccuucu

SEQ ID NO: 38909 - RNA, 67 nt, Mus musculus
agaccacuccugcugcccacaaguauuacuacagugaggucucugacuaagcccaggucugcacaug

SEQ ID NO: 38910 - RNA, 45 nt, Mus musculus
uggucuuccagccagcugcccggaacucaaucaucuccagcagca

SEQ ID NO: 38911 - RNA, 55 nt, Mus musculus
cuggugcugcagcugcaccgggucggggagcagcuggagaagaugaacgggcagc

SEQ ID NO: 38912 - RNA, 47 nt, Mus musculus
ugguuuggaguucagccuggucagaauguucuggaaagccccuuuug

SEQ ID NO: 38913 - RNA, 45 nt, Mus musculus
cagcugugggcacagauggcccagaaaucaucucagagucgggua

SEQ ID NO: 38914 - RNA, 49 nt, Mus musculus
gguuaacccugucuaugacugucucuuccagcuggcccagccugagagu

SEQ ID NO: 38915 - RNA, 42 nt, Mus musculus
augggcauguuguucaccuguggggagagcaaaggcggcggg

SEQ ID NO: 38916 - RNA, 71 nt, Mus musculus
ccaaggcugauuugcucccuccugacugcagcucccaccaaugcagcuccccccgccgccuuugcucuccc

SEQ ID NO: 38917 - RNA, 45 nt, Mus musculus
agguagucaaagauguugcagauaaaggugacauagcagacccag

SEQ ID NO: 38918 - RNA, 46 nt, Mus musculus
gagcaugcucccugcagggcugggucugcuaugucaccuuuaucug

SEQ ID NO: 38919 - RNA, 42 nt, Mus musculus
ucuugcugcuagagaguaauagaguaauuauugagcaccaaa

SEQ ID NO: 38920 - RNA, 45 nt, Mus musculus
agaacaugcccugaucugaaauugugcaagucgagcuggcugcca

SEQ ID NO: 38921 - RNA, 24 nt, Mus musculus
gggauccagagagcagaguggacc

SEQ ID NO: 38922 - RNA, 45 nt, Mus musculus
ucugaaaacugagccagggauaugcacccuaauucaaaccccaag

SEQ ID NO: 38923 - RNA, 42 nt, Mus musculus
accaggccucucacuuucagaggcugcacaacacacaggcag

SEQ ID NO: 38924 - RNA, 44 nt, Mus musculus
cccagagacagggcagaacuacccacuuagcaauccagccccaa

SEQ ID NO: 38925 - RNA, 50 nt, Mus musculus
ucauccuaccauccuaccacaccugcccugucguccccuuccaacuccaa

SEQ ID NO: 38926 - RNA, 42 nt, Mus musculus
gcucaccugaauggcucaaugcuguucccuccugggggccag

SEQ ID NO: 38927 - RNA, 46 nt, Mus musculus
cauccaagacucugauccugaagggaaaaaaaaaaaaagucaaugu

SEQ ID NO: 38928 - RNA, 49 nt, Mus musculus
gggugguggugggggcuguacauagcccauggccccauccaucauggga

SEQ ID NO: 38929 - RNA, 44 nt, Mus musculus
guacauuccauuggcgacuggcgggggaaagacauaggccccgc

SEQ ID NO: 38930 - RNA, 41 nt, Mus musculus
aggggagagagacaugagugucaccugccccagggacugau

SEQ ID NO: 38931 - RNA, 41 nt, Mus musculus
caaagggcaacaugguggggucaaggccaggugugagggaa

SEQ ID NO: 38932 - RNA, 46 nt, Mus musculus
gccuucuucuggagugucugaagacagcuacaguguacucacguaa

SEQ ID NO: 38933 - RNA, 46 nt, Mus musculus
agugacagagcagauagcguaguccccuccuggcagccacguggcu

SEQ ID NO: 38934 - RNA, 46 nt, Mus musculus
cuacauccuaccucagagagaguuuuguggaauuugcauggcccag

SEQ ID NO: 38935 - RNA, 46 nt, Mus musculus
aaggaggcagugguguguggaucugugaguucgaggccagucuggu

SEQ ID NO: 38936 - RNA, 42 nt, Mus musculus
ucggcuucccaaacaaacccugacaccauucucuggccccac

SEQ ID NO: 38937 - RNA, 46 nt, Mus musculus
cuggugcguagacugugugaaguguugccaauuuccccguaccaua

SEQ ID NO: 38938 - RNA, 45 nt, Mus musculus
gcucucuccggaggugugaccuuccagcugcugcgacaguucccc

SEQ ID NO: 38939 - RNA, 43 nt, Mus musculus
uugaagagcaagaaggcaaagcgguggaagccagagccucgag

SEQ ID NO: 38940 - RNA, 44 nt, Mus musculus
aaccaucuauaaugggauucgaugcccucuucuggugugucuga

SEQ ID NO: 38941 - RNA, 24 nt, Mus musculus
gugucacagacaaaaacugggaau

SEQ ID NO: 38942 - RNA, 45 nt, Mus musculus
aggggaucaaugcgggggcuggagcacacgggggugcuggagcaa

SEQ ID NO: 38943 - RNA, 51 nt, Mus musculus
auguuacacucguaaaugacaaaaccaaaucuucuauuaaaaggcaaagau

SEQ ID NO: 38944 - RNA, 51 nt, Mus musculus
augcgagcagugucacccagaguuguggucagccuuaccccuucuccgaga

SEQ ID NO: 38945 - RNA, 48 nt, Mus musculus
ucuguguccccugugccuccuggggacugcugcuguccugcccuugua

SEQ ID NO: 38946 - RNA, 60 nt, Mus musculus
gcggccguucaucuuguguguuugugacuuacuuuuguagccugucaucuucugggccca

SEQ ID NO: 38947 - RNA, 35 nt, Mus musculus
ugcagagacacaaaccccacacauuguccucagau

SEQ ID NO: 38948 - RNA, 42 nt, Mus musculus
gguguggcucacuugaaaggggucuaggcagacaggggagga

SEQ ID NO: 38949 - RNA, 96 nt, Mus musculus
cuaccugaccuacaucaagcugucaacagcaaucaggcgaaacgagaacauggcuaaaggcuugcacagggcucugcugcagcagcagccggaaga

SEQ ID NO: 38950 - RNA, 41 nt, Mus musculus
gcccuugauggagagucugggaaggugucaaaucuccagua

SEQ ID NO: 38951 - RNA, 42 nt, Mus musculus
ccaugcugagugagugccgagacgcccuccaagccgugaggg

SEQ ID NO: 38952 - RNA, 49 nt, Mus musculus
caaguuaguaagggacaggaaagucagguggcccguaaguggcagcguc

SEQ ID NO: 38953 - RNA, 44 nt, Mus musculus
gggaguugaggggguaguagagacagaaaggcagagagagagua

SEQ ID NO: 38954 - RNA, 46 nt, Mus musculus
uuccuugguuguuguggaauaucuucauaaauccuuacugagacau

SEQ ID NO: 38955 - RNA, 42 nt, Mus musculus
gugcugggauuaaagguguaugccaucacugccuggccccuu

SEQ ID NO: 38956 - RNA, 45 nt, Mus musculus
ggcaagcuacucacgcuggagaccacagaccagacccuagcaccg

SEQ ID NO: 38957 - RNA, 45 nt, Mus musculus
ccucugugaagucaggugugaagggguuacguuuaugggguagau

SEQ ID NO: 38958 - RNA, 82 nt, Mus musculus
guggcgaggccggacgguccccgugaagaucgacaaagugaggaucuuccuccugggccuggccgacaacgaggccgccauc

SEQ ID NO: 38959 - RNA, 46 nt, Mus musculus
gaauuuugacuuuccauaaacuuaaaauuuaugauaccagggagac

SEQ ID NO: 38960 - RNA, 46 nt, Mus musculus
auuauaucuggcaaccuauuuccucccugagcaaguaacacagaug

SEQ ID NO: 38961 - RNA, 42 nt, Mus musculus
gcuuccccauggccauucugccccaaacuucagccccaagau

SEQ ID NO: 38962 - RNA, 60 nt, Mus musculus
gccuccggaaaacacucaacuuuaagauggggaacagacacaaauucacggggaagaaag

SEQ ID NO: 38963 - RNA, 26 nt, Mus musculus
cucccuggccccaauuugggccucac

SEQ ID NO: 38964 - RNA, 46 nt, Mus musculus
ucccaacaugaccucaugcuugcuaacagcaaguccuuuaccagcu

SEQ ID NO: 38965 - RNA, 42 nt, Mus musculus
ggcggcggagggagcgguggcggacgcagugccggaggagac

SEQ ID NO: 38966 - RNA, 42 nt, Mus musculus
aaugccuuggacuuggaucgauacuugcugcugcacccagac

SEQ ID NO: 38967 - RNA, 45 nt, Mus musculus
ucaaaaggguuagucaggugggacugcuucugugacacuuggaga

SEQ ID NO: 38968 - RNA, 41 nt, Mus musculus
guagacgaggcuuccagcaugugccucugggaaaggugaga

SEQ ID NO: 38969 - RNA, 44 nt, Mus musculus
cugggaccaaggugacuuagauuuggagacccugggguccagag

SEQ ID NO: 38970 - RNA, 46 nt, Mus musculus
ugugugugugugcguguguguguguguguguguguguggugcaugu

SEQ ID NO: 38971 - RNA, 45 nt, Mus musculus
agucacgccuugaguguguuugucacacagaagauuaugccagau

SEQ ID NO: 38972 - RNA, 44 nt, Mus musculus
gguuauuucuggaagcaucuggggugguaguugaagcaagcagu

SEQ ID NO: 38973 - RNA, 46 nt, Mus musculus
cacacacacugccuuagcuagacacagagccacaugaccaacaguc

SEQ ID NO: 38974 - RNA, 25 nt, Mus musculus
ccuucagagagucagagaguuggcc

SEQ ID NO: 38975 - RNA, 45 nt, Mus musculus
ugaggggaagccaguacaagaagaugaugaccaaagaagaacugg

SEQ ID NO: 38976 - RNA, 45 nt, Mus musculus
cuuuggggaugcuaacuggagacuuucugucucucacugccucug

SEQ ID NO: 38977 - RNA, 45 nt, Mus musculus
uucucaucaauggcaagaguagacuuagugagugggguccaagug

SEQ ID NO: 38978 - RNA, 47 nt, Mus musculus
gagucuugucugaggcugggaugcaaguguugggcaguugcccagaa

SEQ ID NO: 38979 - RNA, 44 nt, Mus musculus
cuguaguccaaaggauugccuaacguguucucaaaguaggagga

SEQ ID NO: 38980 - RNA, 46 nt, Mus musculus
gcuguccugggacucacucuguaaaccaggcuagcuucauagagau

SEQ ID NO: 38981 - RNA, 46 nt, Mus musculus
gagaaguugccugucuuuuaggucaacucgaauccagauuccagag

SEQ ID NO: 38982 - RNA, 62 nt, Mus musculus
ggugcugcuggcaaaguucugggugauggcaaugguggugucaagguugaggacaacaugcc

SEQ ID NO: 38983 - RNA, 45 nt, Mus musculus
ccugguuucuguaauaucuccagggguuugaauucagguggccag

SEQ ID NO: 38984 - RNA, 42 nt, Mus musculus
augaguucucuggguguguuuguugggaagaggcaccaccgc

SEQ ID NO: 38985 - RNA, 42 nt, Mus musculus
gacucucgcuucgacacgggcggagggcuucucgaucgcgac

SEQ ID NO: 38986 - RNA, 45 nt, Mus musculus
uguagcgggagcggcuucgcgaccuggaccgacuccggcuucgag

SEQ ID NO: 38987 - RNA, 46 nt, Mus musculus
agggaagagguuccuccuccucugggauuuuacuuuaggucaaggu

SEQ ID NO: 38988 - RNA, 46 nt, Mus musculus
ugauaucauagcucaucauuuuguguucaacuucacaggacugcag

SEQ ID NO: 38989 - RNA, 45 nt, Mus musculus
ccugcugcugcucaaccugcugaccaugcugcugacugccugcuu

SEQ ID NO: 38990 - RNA, 46 nt, Mus musculus
ccagcacaaacucagacauccucgguauagggucgagacaguggag

SEQ ID NO: 38991 - RNA, 46 nt, Mus musculus
uuucacaguccaccucugacaacuccacugugucagucacuaagga

SEQ ID NO: 38992 - RNA, 89 nt, Mus musculus
cucuaugcgcuuccuucucuggauaugcagucacagcuuuccccaccuuaugccugguuauuccugacugcguaaggccaucccaggag

SEQ ID NO: 38993 - RNA, 42 nt, Mus musculus
uagcucauucagguccaaggugccauagggcaggucggggag

SEQ ID NO: 38994 - RNA, 42 nt, Mus musculus
gaacccagggucuuucuucugagcauguuuacacagcauccg

SEQ ID NO: 38995 - RNA, 45 nt, Mus musculus
ccccucugccgguuccaggcugguaccugagaaacaggggccuac

SEQ ID NO: 38996 - RNA, 42 nt, Mus musculus
caggccuucgaggcugucugaagaugcuugaaaaacucaacc

SEQ ID NO: 38997 - RNA, 44 nt, Mus musculus
caaaacagagagaaaaaagccaccccaacacacagcugccccac

SEQ ID NO: 38998 - RNA, 65 nt, Mus musculus
uguguuggggagaaacaaguuuucugaagucagguauggggcuggguggggcagcuguguguugg

SEQ ID NO: 38999 - RNA, 41 nt, Mus musculus
uccaggcccugcacagcccucccuucucaccuggggggagg

SEQ ID NO: 39000 - RNA, 86 nt, Mus musculus
uggugagcuggccgccuuuuccaacaccgaagggaggcagaucaacagaugagccaucuuggagcccagguuucccuggagcagau

SEQ ID NO: 39001 - RNA, 88 nt, Mus musculus
acugccucuucacaacggggaggguucuggggugcaagggaucugcgagguuucauuagcugccccauggagaggagccuggcaccag

SEQ ID NO: 39002 - RNA, 47 nt, Mus musculus
ccuugcaccccagaacccuccccguugugaagaggcaguagcauuua

SEQ ID NO: 39003 - RNA, 44 nt, Mus musculus
guggcuccuggcucuggggagaguggcaaggggugaccugaaga

SEQ ID NO: 39004 - RNA, 42 nt, Mus musculus
uucaggucaccccuugccacucuccccagagccaggagccac

SEQ ID NO: 39005 - RNA, 42 nt, Mus musculus
ggcagcucccccuccccucagacgaauuccagguccugccag

SEQ ID NO: 39006 - RNA, 42 nt, Mus musculus
cuuccucaggcccuccacucccgcagaguagagcuggcagga

SEQ ID NO: 39007 - RNA, 42 nt, Mus musculus
agagaggucggcucaguaccagcggaaucuucucgcccccag

SEQ ID NO: 39008 - RNA, 42 nt, Mus musculus
caccuuucuuauccgcgacagcucggaccagcgccacuucuu

SEQ ID NO: 39009 - RNA, 44 nt, Mus musculus
cgcggauaagaaaggugcccgcgggcucggcgcugagcagcagg

SEQ ID NO: 39010 - RNA, 45 nt, Mus musculus
gcacggagccagcguggaucugcgcggcgguggcugcagcugcuu

SEQ ID NO: 39011 - RNA, 45 nt, Mus musculus
uccccgaggcgaggcggcggccagcaguggcucgcgcugcgccca

SEQ ID NO: 39012 - RNA, 42 nt, Mus musculus
gcccccucuggcuucgcugcuccccgggccgaugaggcgcac

SEQ ID NO: 39013 - RNA, 42 nt, Mus musculus
ugggccgggaagggggcguccgggagcccggagagacagcgg

SEQ ID NO: 39014 - RNA, 45 nt, Mus musculus
ugcgcgacauuuaccuguagacagguccaaaagaugaagcuguga

SEQ ID NO: 39015 - RNA, 57 nt, Mus musculus
gugagaguuguugaaagucagcaagccgagcgcgccugaugcucuguaucagucucu

SEQ ID NO: 39016 - RNA, 48 nt, Mus musculus
auaacucaacgcuuuguugauuuuguuucuguuugaacucuugguugu

SEQ ID NO: 39017 - RNA, 70 nt, Mus musculus
uuaagguguuguuuuacuucuguuauauucuaagcccugggccucccucccuuacucccgucaugccagc

SEQ ID NO: 39018 - RNA, 46 nt, Mus musculus
guuucuagccacaccaggcagaugagaggaaaccgagcgagcaaac

SEQ ID NO: 39019 - RNA, 46 nt, Mus musculus
aucuuccuuugaguucuuugacuaucugcuuuuccagccucucccg

SEQ ID NO: 39020 - RNA, 64 nt, Mus musculus
uuugcacuuuuaaaaaaaaaaaaaacaaaaauguugaagcaucgaggaagcaucgaacccagag

SEQ ID NO: 39021 - RNA, 46 nt, Mus musculus
ugauuucaugacauguucugguuuguuucugauguucgccgugagc

SEQ ID NO: 39022 - RNA, 47 nt, Mus musculus
aacgguuaaggacucccccucagacucucccuacccaagccccuaca

SEQ ID NO: 39023 - RNA, 46 nt, Mus musculus
cugucccaaggacacaaauguauauuauccauacaugcacgcauau

SEQ ID NO: 39024 - RNA, 47 nt, Mus musculus
guauaucuacuugcuccuuaaagcaauuuucuuucugaugccaauag

SEQ ID NO: 39025 - RNA, 45 nt, Mus musculus
aguccuaggcaccuaggaaaagucuagugaacucucccugcuaga

SEQ ID NO: 39026 - RNA, 47 nt, Mus musculus
uccaaccagugguucauuuuucuaggagucccagucagccccaugaa

SEQ ID NO: 39027 - RNA, 42 nt, Mus musculus
cugagagugacaugucccucguuuucugcaguggccaccucu

SEQ ID NO: 39028 - RNA, 46 nt, Mus musculus
ugucucagucuuugauccuugcuacaggcaggaguggagcacagac

SEQ ID NO: 39029 - RNA, 46 nt, Mus musculus
ucaaucauccaaguggguucacgcuagugugauucugcccccuccc

SEQ ID NO: 39030 - RNA, 41 nt, Mus musculus
gcggcaccccccaagcaagaguuucuugacaucgaggaccc

SEQ ID NO: 39031 - RNA, 46 nt, Mus musculus
acaucuccuccccggaugagugccucuggauggacugggucacaga

SEQ ID NO: 39032 - RNA, 45 nt, Mus musculus
cugugacuucauugugcccugggacacgcuuagcaucacccagaa

SEQ ID NO: 39033 - RNA, 103 nt, Mus musculus
aaaggaccugacaaagacaucgaguuuaucuacacggcccccucuucagcagugugcggggucucgcuggacguuggaggaaagaaggaguaucuaauugcag

SEQ ID NO: 39034 - RNA, 75 nt, Mus musculus
gagaaggagguggauuccgggaaugacaucuauggcaaccccaucaagaggauucaguaugagaucaagcagaua

SEQ ID NO: 39035 - RNA, 46 nt, Mus musculus
ugcagagggaggucuccagggagggagcagggguuugauuccugau

SEQ ID NO: 39036 - RNA, 46 nt, Mus musculus
gcaucaucuggcucaaaaaguuaagggaagguauuuugcaggaaug

SEQ ID NO: 39037 - RNA, 24 nt, Mus musculus
uuaagcccuccaccggcuaagcua

SEQ ID NO: 39038 - RNA, 77 nt, Mus musculus
gaugaggacaaacagaaccagaugauucgugaccuccagcagcagaucuuagagcaaaacaaguuacaccaggaguu

SEQ ID NO: 39039 - RNA, 46 nt, Mus musculus
gaguaccccagauaccagcagauagcaaaguacccguuaaagagug

SEQ ID NO: 39040 - RNA, 46 nt, Mus musculus
cagccgagcggagcaugggaaacgaucccagcgugcaugaacagaa

SEQ ID NO: 39041 - RNA, 46 nt, Mus musculus
uguguggugugcauucuuauaagcuuagcacuuggaggguugagac

SEQ ID NO: 39042 - RNA, 42 nt, Mus musculus
uauugagggcugaaguguagguaucacauaguagggggagca

SEQ ID NO: 39043 - RNA, 42 nt, Mus musculus
acccauccucaggcagcugcaacugcucuugugcauagugau

SEQ ID NO: 39044 - RNA, 42 nt, Mus musculus
uucucugcagccauuugggaguuuuugcuuagcagggcagaa

SEQ ID NO: 39045 - RNA, 41 nt, Mus musculus
uaacccccuccaccguuccucucuuuucuuuuccccucuga

SEQ ID NO: 39046 - RNA, 42 nt, Mus musculus
cgcccggccgacgccugcagcugcuccccggugcacccgcaa

SEQ ID NO: 39047 - RNA, 82 nt, Mus musculus
uuccaugagguccugugggauuuccugugccuacugcaguagccccaucugucacagucacucaucaaaaaucauuaaaguc

SEQ ID NO: 39048 - RNA, 46 nt, Mus musculus
gguggggacgcagacauuccuguguccccuccuucgccuccagcug

SEQ ID NO: 39049 - RNA, 46 nt, Mus musculus
uccccaccacugagauguaccauuuacaccaugucaguggaguuag

SEQ ID NO: 39050 - RNA, 83 nt, Mus musculus
cagcuuugaaggcuccaaggccccuauucccacugcccuggacaccaauaguuccaagacucccucccucuuucccugugccu

SEQ ID NO: 39051 - RNA, 46 nt, Mus musculus
cauagccaauugucggauuggaguagcuggauguggugaggcccag

SEQ ID NO: 39052 - RNA, 47 nt, Mus musculus
ggccucaccacauccagcuacuccaauccgacaauuggcuaugagaa

SEQ ID NO: 39053 - RNA, 63 nt, Mus musculus
cuauggcucaguagcccgguacaauagcuaccaguccuuccaaaccccacaacaccccagcuu

SEQ ID NO: 39054 - RNA, 75 nt, Mus musculus
uagcuuggugauggccuccaccuggagggcacaaagauaugaauacaaucgauacaaucagcucuauacauaugg

SEQ ID NO: 39055 - RNA, 45 nt, Mus musculus
uaucuuugugcccuccagguggaggccaucaccaagcuacuccag

SEQ ID NO: 39056 - RNA, 42 nt, Mus musculus
uacuuggccagcacuucgacaggcacuguguggaacuccaag

SEQ ID NO: 39057 - RNA, 46 nt, Mus musculus
ccaggagcuguucgagcugcaguucaaccuguccuuguaccaagau

SEQ ID NO: 39058 - RNA, 46 nt, Mus musculus
cuggggcagcaucauggggaagcggaccuguuccaccaggcgcucu

SEQ ID NO: 39059 - RNA, 42 nt, Mus musculus
auaaagguccaagggaguauggaaaguggggucuugggggag

SEQ ID NO: 39060 - RNA, 46 nt, Mus musculus
ugcuggguuccugugguaaccucucuccccaaguaucuacccccag

SEQ ID NO: 39061 - RNA, 46 nt, Mus musculus
uacuguucucauaaaugucacguuccauuauauaaagcuccagguc

SEQ ID NO: 39062 - RNA, 45 nt, Mus musculus
agaucuuugacagccagcagggcugcgaccuauucauccagguga

SEQ ID NO: 39063 - RNA, 45 nt, Mus musculus
uuugugaagaguaggcacagccuuaggguuggugucuccucuaga

SEQ ID NO: 39064 - RNA, 46 nt, Mus musculus
uuggauggugagccgcugugggcacgagaaggacgcaggcgugguc

SEQ ID NO: 39065 - RNA, 46 nt, Mus musculus
ccgugugccgugugugugugugugugugugugugugugugugccca

SEQ ID NO: 39066 - RNA, 45 nt, Mus musculus
cagaggcaguguagaagggucugggacuucaugaugugaccuggg

SEQ ID NO: 39067 - RNA, 46 nt, Mus musculus
aacuguguucgguugugugauucugagcugaaagaugaaaugagag

SEQ ID NO: 39068 - RNA, 42 nt, Mus musculus
ucauccccaacacggaugaccagaucaucguggcucucaagu

SEQ ID NO: 39069 - RNA, 41 nt, Mus musculus
gcuuucuggcugggcuguaguggcugcaugguugucccagg

SEQ ID NO: 39070 - RNA, 47 nt, Mus musculus
ggaaacucuacuccguggaugaccgcacaggggucaucuaccagauc

SEQ ID NO: 39071 - RNA, 46 nt, Mus musculus
agcuauuccugaggaggauugggauagucaccuugagguuggagaa

SEQ ID NO: 39072 - RNA, 45 nt, Mus musculus
agaaggaggaggaaagggcgggaaugugauauucuugaggugguc

SEQ ID NO: 39073 - RNA, 46 nt, Mus musculus
uaggggaggugccuaggcuacagagauaccuagaauaaagaacgug

SEQ ID NO: 39074 - RNA, 46 nt, Mus musculus
cugggaaccuggucucacggugucaguggggccugacugacuagau

SEQ ID NO: 39075 - RNA, 45 nt, Mus musculus
uauauguguguaugugguguaucuguuugauguuuuuuggucugu

SEQ ID NO: 39076 - RNA, 46 nt, Mus musculus
cauggcgaagcaaaacauaacaaaugaagcccaagaugacucagag

SEQ ID NO: 39077 - RNA, 26 nt, Mus musculus
agagaauuuaugugucacugagcugg

SEQ ID NO: 39078 - RNA, 45 nt, Mus musculus
ggaaaggaagaggacaaugagaccgagcauggagcugggccagca

SEQ ID NO: 39079 - RNA, 45 nt, Mus musculus
ugagccgaggcagagaucaguuggagauuuauacauagcugagaa

SEQ ID NO: 39080 - RNA, 28 nt, Mus musculus
ggcaggacgacgagggcagugagggcag

SEQ ID NO: 39081 - RNA, 46 nt, Mus musculus
gugcuguaccuaaaggaaaccaggaagaauggagcaucagucccug

SEQ ID NO: 39082 - RNA, 31 nt, Mus musculus
gaaggcuaguggcagccuucagggaaugucu

SEQ ID NO: 39083 - RNA, 46 nt, Mus musculus
gagcucaugauggccaccuuggaaaaggagagguagccaguuugga

SEQ ID NO: 39084 - RNA, 46 nt, Mus musculus
gccauggagagucucagcauuuauucuaagucucuagcucccacag

SEQ ID NO: 39085 - RNA, 42 nt, Mus musculus
gccuaccuccccaggaucacacuucuguccugcaccccagua

SEQ ID NO: 39086 - RNA, 45 nt, Mus musculus
aguggugcugcaggacagugccacguuuaaaggugcugaccagaa

SEQ ID NO: 39087 - RNA, 42 nt, Mus musculus
ucgucucuuaacggucccuacuucaaggcagugggcagaggu

SEQ ID NO: 39088 - RNA, 46 nt, Mus musculus
ugcucgcgucugacccgaguuuaauaagucauuguccagcccaggc

SEQ ID NO: 39089 - RNA, 44 nt, Mus musculus
auaccauugugaacaaguuagugcgugugaccaaggagggagcu

SEQ ID NO: 39090 - RNA, 36 nt, Mus musculus
gcaucccugucuccaauuucaccuacagcccugaca

SEQ ID NO: 39091 - RNA, 47 nt, Mus musculus
ccugacacaucuuugagcuuuucccaccguguuacugcaugcgcccc

SEQ ID NO: 39092 - RNA, 45 nt, Mus musculus
uuauuugaagccacuaaagcugugguaaugaguugagccagugau

SEQ ID NO: 39093 - RNA, 46 nt, Mus musculus
auguacauaauccgaugcuuaaccuuuuacauuaaacguggacauu

SEQ ID NO: 39094 - RNA, 47 nt, Mus musculus
cugaccucaucugaagcuggugcuggugcaccgaggcccuguuugga

SEQ ID NO: 39095 - RNA, 44 nt, Mus musculus
uaacuacgaccugcccaacaacagagaacuguacauucacaggu

SEQ ID NO: 39096 - RNA, 44 nt, Mus musculus
ggacauccaggccccgggcccagacgucuguggagaugagcacc

SEQ ID NO: 39097 - RNA, 45 nt, Mus musculus
aguaguaggcuccuguucauaacuggauuuuugcuaagccgacuu

SEQ ID NO: 39098 - RNA, 41 nt, Mus musculus
uaauuucuuagcucuagcuaaccagcaucaguagucccagu

SEQ ID NO: 39099 - RNA, 46 nt, Mus musculus
caacguggaagucagcucucucucuucaccgugucugccccaagga

SEQ ID NO: 39100 - RNA, 45 nt, Mus musculus
gccaauuucacugugucguccaugcauggagacaugccccagaaa

SEQ ID NO: 39101 - RNA, 45 nt, Mus musculus
cuuugguuuaagcugggcccaggcccaguaggcugaagugauggc

SEQ ID NO: 39102 - RNA, 40 nt, Mus musculus
cagaagaugacggccugggugauggucagcgugucauaga

SEQ ID NO: 39103 - RNA, 45 nt, Mus musculus
aggcaucaaacaguucuuuguggcuguggaaagagaggaauggaa

SEQ ID NO: 39104 - RNA, 44 nt, Mus musculus
ggucguccucaucagcgccacacugccucaugagauccuggaga

SEQ ID NO: 39105 - RNA, 60 nt, Mus musculus
cggacacgggcuaucaagaugcugguuuuggaugaggcugaugaaauguugaacaaaggu

SEQ ID NO: 39106 - RNA, 46 nt, Mus musculus
aaaccagcaucuugauagcccguguccguaaacuucuccggcggau

SEQ ID NO: 39107 - RNA, 67 nt, Mus musculus
uuuccuuagagccacgugugauucuuucaaaaucuaauccccagauaugauccgccggagaaguuua

SEQ ID NO: 39108 - RNA, 46 nt, Mus musculus
cugccaccacgugcuguccguaguccagcuuccggauguccucgcc

SEQ ID NO: 39109 - RNA, 45 nt, Mus musculus
gaacgugcagugccaugccugcauugggggcaccaacgucggcga

SEQ ID NO: 39110 - RNA, 46 nt, Mus musculus
ccauuuauucugccuuuagcaguuugugucugugggggcugugaag

SEQ ID NO: 39111 - RNA, 46 nt, Mus musculus
gagccugcuuauuuguuuguuuguuuguuuaugccaguuuguuuug

SEQ ID NO: 39112 - RNA, 45 nt, Mus musculus
cgggcuuacaguuugaaaguuuaucuuggugucuggauuuggagu

SEQ ID NO: 39113 - RNA, 46 nt, Mus musculus
gacaggggguucuuuuucuguuccuggcacaggucuggccauggcu

SEQ ID NO: 39114 - RNA, 41 nt, Mus musculus
gaagagccuggcugacugcagccccgggggagcaggccgga

SEQ ID NO: 39115 - RNA, 45 nt, Mus musculus
gcgcagcagguccucucgcaggcccauggugucgaacgugggggu

SEQ ID NO: 39116 - RNA, 46 nt, Mus musculus
gucccuggggaaaucuggauuugcaagcuuuuggcauugagauaga

SEQ ID NO: 39117 - RNA, 42 nt, Mus musculus
gcucuuugggagggcauagagaagcaaguuaagccccgggcc

SEQ ID NO: 39118 - RNA, 46 nt, Mus musculus
acccucucccugcccagcccucccuccccuggcagcuaccugaguu

SEQ ID NO: 39119 - RNA, 88 nt, Mus musculus
ugauggggugagaccaggcuucaugagccccaggcacugcgcagcuuugguguaacuagggcaggggacagguccacuccgggggaga

SEQ ID NO: 39120 - RNA, 46 nt, Mus musculus
cuaguguuggaaaauccuuuuuacaauaguauaaucauucacagaa

SEQ ID NO: 39121 - RNA, 46 nt, Mus musculus
uucccuuccuucacuugccaagggacagaagcacugcuuagaaauc

SEQ ID NO: 39122 - RNA, 46 nt, Mus musculus
aacaaaagacuucgucuuuguuuauuuugucacaaaacugucgaga

SEQ ID NO: 39123 - RNA, 45 nt, Mus musculus
aaggaauuggcagaggaacaaauggaaguggaagauucagaggag

SEQ ID NO: 39124 - RNA, 42 nt, Mus musculus
ccaagccauaaguuauugaaaguuccuagaaaaagcccccag

SEQ ID NO: 39125 - RNA, 43 nt, Mus musculus
ucagguucagagcaucgaguucacgcagaucgagaugaaggug

SEQ ID NO: 39126 - RNA, 42 nt, Mus musculus
cgggcauggccucugcuucccaagguuccccuguguccccag

SEQ ID NO: 39127 - RNA, 31 nt, Mus musculus
aggugagucgagggcgcgggggcaucagguu

SEQ ID NO: 39128 - RNA, 77 nt, Mus musculus
ggugucccugggcaucaaagaaggugguggugguggugugagugggcauuguguuaugcuggcuuugcgggacacau

SEQ ID NO: 39129 - RNA, 45 nt, Mus musculus
ggucagcuggcgagacuccucuccacugauuaugaaguccggguc

SEQ ID NO: 39130 - RNA, 74 nt, Mus musculus
aaaucagcaguuaucaauaauucccacccaggaaacuuuuauuuauuguuuuuuaaagauaaaacugcacagau

SEQ ID NO: 39131 - RNA, 45 nt, Mus musculus
cucuaugaucuuuguuuucugccuucccaccuucucccccagugu

SEQ ID NO: 39132 - RNA, 42 nt, Mus musculus
ugcccugguauuccagauacccugaagcgucuccgugcagau

SEQ ID NO: 39133 - RNA, 48 nt, Mus musculus
agggcagcuggccccacuguuucagggcugugggcuucaggccuuaua

SEQ ID NO: 39134 - RNA, 45 nt, Mus musculus
ugcagugcugacaggcccacauggcagagguagcagcgcgugcag

SEQ ID NO: 39135 - RNA, 42 nt, Mus musculus
uguaggaauauacuaucauucuucaaggacauggcagggaaa

SEQ ID NO: 39136 - RNA, 25 nt, Mus musculus
aucgagaacacuuacugcauaacug

SEQ ID NO: 39137 - RNA, 48 nt, Mus musculus
gcgcugcuguccuugagccugcugcugccgccgccccugcggcugucc

SEQ ID NO: 39138 - RNA, 45 nt, Mus musculus
aaauuaugaggagccgacaggagaugaaaaagacgcuaaguaaca

SEQ ID NO: 39139 - RNA, 48 nt, Mus musculus
acuggaaaaggcccagaggaaaagggaagcaagagccguggacagauu

SEQ ID NO: 39140 - RNA, 45 nt, Mus musculus
gcuagaccuggguaagggagaggcagcggaugcucuccuugcaua

SEQ ID NO: 39141 - RNA, 46 nt, Mus musculus
caaagcagguuagugggcugguggaagggcaagugggggcggcaau

SEQ ID NO: 39142 - RNA, 46 nt, Mus musculus
acauugacacgcauugacuagggccguggauaagcauguuggagag

SEQ ID NO: 39143 - RNA, 29 nt, Mus musculus
cugagcuuuucauagagaugggggugagc

SEQ ID NO: 39144 - RNA, 42 nt, Mus musculus
uggcuccagaaucaacacaggcacagcaguugacagcaagau

SEQ ID NO: 39145 - RNA, 46 nt, Mus musculus
gcugugccuguguugauucuggagccagagcaauacuguugccaag

SEQ ID NO: 39146 - RNA, 41 nt, Mus musculus
cauccugcaugcagcuccugggucuccuuucugcagaagaa

SEQ ID NO: 39147 - RNA, 46 nt, Mus musculus
ccuugauucccagauugggagucagccaaggacacuggggcugaau

SEQ ID NO: 39148 - RNA, 49 nt, Mus musculus
uguccuaguguugccaugguagcauggcuuuguaguuugcauuuaaccu

SEQ ID NO: 39149 - RNA, 46 nt, Mus musculus
uauguggaauuugucccaugugcuugcuaaaauguuuggggaucuc

SEQ ID NO: 39150 - RNA, 141 nt, Mus musculus
gccugaacccaaaaccucggugggccacgcucccagcagcccacaucuccggagccugagccucaccccaggagggagcgccaucagaacccagggaaucuuucugaagccacacucaucugacacacguacacuuagacc

SEQ ID NO: 39151 - RNA, 41 nt, Mus musculus
ggaccucgaccuagaagaagcuuuagagccagacauggagg

SEQ ID NO: 39152 - RNA, 47 nt, Mus musculus
gcgagcggacacuggacgguuuuaagaaauucuuggagagugguggc

SEQ ID NO: 39153 - RNA, 46 nt, Mus musculus
acauagcuuucccacacugaaguucuucccagcaagugcagacaga

SEQ ID NO: 39154 - RNA, 35 nt, Mus musculus
agcuagcccccauuugggauaaacugggagagaca

SEQ ID NO: 39155 - RNA, 90 nt, Mus musculus
gaugagccaagaagugccugaagacugggacaaacagccgguaaaaguacugguuggggcgaacuuugaagaggucgcuuuugaugagaa

SEQ ID NO: 39156 - RNA, 87 nt, Mus musculus
uuauuacccuagaggaagagaugaccaaguacaaaccagagucagaugagcugacggcugagaaaaucacagaguuuugccaccgcu

SEQ ID NO: 39157 - RNA, 70 nt, Mus musculus
gaccacacugauaaccagcgcauacuugaguucuuuggccugaagaaggaggagugucccgcugugcggc

SEQ ID NO: 39158 - RNA, 45 nt, Mus musculus
agcugagcagcuucaagagagcagccgagggcuucaagggcaagg

SEQ ID NO: 39159 - RNA, 77 nt, Mus musculus
gcuuccuguuccacagacagcuccgaagauuuuuggaggugagaucaagacacacauucugcuguuccugcccaaga

SEQ ID NO: 39160 - RNA, 62 nt, Mus musculus
ggagaagcuucuagacuucaucaagcacaaucagcugccuuuggucaucgaguucacugaac

SEQ ID NO: 39161 - RNA, 90 nt, Mus musculus
cagcuuaggcuguugggggacaugcaaagcucacagcccccuuucuguccguaguuugaugaaggccgcaacaacuuugagggugagauc

SEQ ID NO: 39162 - RNA, 45 nt, Mus musculus
augaguauugcugugcuccucccacccaccuaccccccuuuuaaa

SEQ ID NO: 39163 - RNA, 46 nt, Mus musculus
acagagaaacccugucucaaaaaaaacuaacaaaaagccaaaaaga

SEQ ID NO: 39164 - RNA, 46 nt, Mus musculus
uauuuccacagugccaagagacuaggcuuuuuccucagcccagaca

SEQ ID NO: 39165 - RNA, 24 nt, Mus musculus
acugggaucagcugagcuaucacu

SEQ ID NO: 39166 - RNA, 69 nt, Mus musculus
ugugugaguacuguaggaauaccugaacaagaguguucaaggaaauaugggaaugcgaacagauugagg

SEQ ID NO: 39167 - RNA, 46 nt, Mus musculus
cuaauguuagacgugccuugauuaguccaaaaggcacaguccagga

SEQ ID NO: 39168 - RNA, 46 nt, Mus musculus
cugagccaucucaccagccccguggcacacuuuuuuaaccccagaa

SEQ ID NO: 39169 - RNA, 42 nt, Mus musculus
cucuugaguacgguggcccguagcccucagcuugccccacgg

SEQ ID NO: 39170 - RNA, 67 nt, Mus musculus
cuggccugggcggcuagggugggcgccgacgcccuggaggaggaggacaacguccugguguugaaga

SEQ ID NO: 39171 - RNA, 42 nt, Mus musculus
cgggucuuugucgacuugguggcccagccuugaguggguguc

SEQ ID NO: 39172 - RNA, 45 nt, Mus musculus
uauauacuuaauauuuggguguuugccuuuucuaaugacccuuga

SEQ ID NO: 39173 - RNA, 45 nt, Mus musculus
cuggacaacccugacaguguucuguuccauucuagaagccagggc

SEQ ID NO: 39174 - RNA, 45 nt, Mus musculus
uggagggacacagcagauuggaggccugggcuggaaccccucccc

SEQ ID NO: 39175 - RNA, 45 nt, Mus musculus
guggaggaggggcagacaggagagcugacugccugaguggacuag

SEQ ID NO: 39176 - RNA, 46 nt, Mus musculus
ccacaccuuccuucaagacaaacgacuguuucuugaagcucuccag

SEQ ID NO: 39177 - RNA, 45 nt, Mus musculus
uggguuccuguucugccaugcuuaccucuagcuugggacaccugu

SEQ ID NO: 39178 - RNA, 46 nt, Mus musculus
ccuggcgcauugcucuggggacugcgugccccccgagcccccguau

SEQ ID NO: 39179 - RNA, 42 nt, Mus musculus
cucgccuuucccuuuaagcuuaggccagccgcgucgccgcuu

SEQ ID NO: 39180 - RNA, 46 nt, Mus musculus
aucaaacaaaccucccauagaccucggucugaguugguguggagau

SEQ ID NO: 39181 - RNA, 46 nt, Mus musculus
gcgccgcccguuuggggccagcaccgacaccgcggagcccccgccg

SEQ ID NO: 39182 - RNA, 46 nt, Mus musculus
guccagggaaggaccuguggcugggcuaaaggcaucaggcacucag

SEQ ID NO: 39183 - RNA, 46 nt, Mus musculus
cuaaggcccgagggagccggguagagcagccaccaggagucggcag

SEQ ID NO: 39184 - RNA, 64 nt, Mus musculus
gcucccucaacccuguucuucauaggacaccagugggugucuggguagagaaggcagugcacag

SEQ ID NO: 39185 - RNA, 26 nt, Mus musculus
gggcggggcgggggccggggcccagg

SEQ ID NO: 39186 - RNA, 46 nt, Mus musculus
uccugcggaucgacaucaaucugcauggguuccacggcccccugca

SEQ ID NO: 39187 - RNA, 42 nt, Mus musculus
uucgcaucaggccacuguagcuggcugcauacugcuccagau

SEQ ID NO: 39188 - RNA, 46 nt, Mus musculus
uaccagauucucaaggauuaggaagcucaacugucugcacagaggc

SEQ ID NO: 39189 - RNA, 51 nt, Mus musculus
guagucucgggcucgugaguaacauuugagggcauugcugagguccccaca

SEQ ID NO: 39190 - RNA, 45 nt, Mus musculus
uaucugugagguggaccuuaccucagcaaucucuggaguagacuc

SEQ ID NO: 39191 - RNA, 45 nt, Mus musculus
ggguccagaaaccugggguccugggccauugacgggcacacagac

SEQ ID NO: 39192 - RNA, 33 nt, Mus musculus
cuuggauaagagcccgguuacgaaucugggugu

SEQ ID NO: 39193 - RNA, 46 nt, Mus musculus
gguuggacuugccccguucccacacuuguguuuccagcacugaaca

SEQ ID NO: 39194 - RNA, 42 nt, Mus musculus
guggccaccaagucugcugaagggcugguggcuuggcaguga

SEQ ID NO: 39195 - RNA, 46 nt, Mus musculus
ccauggagcccagcuaugcuacaccccuaugcuacaugcccagguc

SEQ ID NO: 39196 - RNA, 45 nt, Mus musculus
ccuggaauccaucaucaacaucauccauagcucccuggcugagcc

SEQ ID NO: 39197 - RNA, 30 nt, Mus musculus
uaggugcuggaggcccugcugccacugaag

SEQ ID NO: 39198 - RNA, 41 nt, Mus musculus
caaggugugccuggagacacccuagagagggcagggaaggc

SEQ ID NO: 39199 - RNA, 46 nt, Mus musculus
guggggugccauuggugacgugggcauuguccuggaagcgaugggc

SEQ ID NO: 39200 - RNA, 42 nt, Mus musculus
ucuccucuguaagcugcgggcgugguaaugcuggccaaacua

SEQ ID NO: 39201 - RNA, 86 nt, Mus musculus
cagguuuugagggaugccaugcuggagaaccagaccccagagcucuuccaggaugucaacaagcccaaauacaauggcacccugaa

SEQ ID NO: 39202 - RNA, 42 nt, Mus musculus
gagguggcggcacuccugaaggcuggcauucgugauggaguc

SEQ ID NO: 39203 - RNA, 46 nt, Mus musculus
augacaccagcuuugccaacucgagggacacaucauuugagcagca

SEQ ID NO: 39204 - RNA, 46 nt, Mus musculus
uggaaauauuuucacugcuaccagcccaggggaugagauaucagaa

SEQ ID NO: 39205 - RNA, 43 nt, Mus musculus
augccuuugaggugucugacacuggcaaucugauugugagcgg

SEQ ID NO: 39206 - RNA, 42 nt, Mus musculus
ugagaaugugucguuucaucaggccacuauacuacccaagac

SEQ ID NO: 39207 - RNA, 45 nt, Mus musculus
ugaauuuguggagcagcuaaagcaagaagguguguuugccaagga

SEQ ID NO: 39208 - RNA, 45 nt, Mus musculus
gggucugggccccuaaccugcacuuccacaaccccaacccugaga

SEQ ID NO: 39209 - RNA, 42 nt, Mus musculus
gacccaucuguuugggcuucugggccuggcuuggggggguug

SEQ ID NO: 39210 - RNA, 50 nt, Mus musculus
ucggcgggucuaugccacgauucugaaugccggcaccaauacagauggca

SEQ ID NO: 39211 - RNA, 46 nt, Mus musculus
cccgcggcccuugugggugggaucaaccugcuccugaagccgaaca

SEQ ID NO: 39212 - RNA, 42 nt, Mus musculus
accaagcauugcccuggacacagccugcuccuccagcuugcu

SEQ ID NO: 39213 - RNA, 46 nt, Mus musculus
gcauggugggcugccagcgugcaaugauggccaaccggcucucuuu

SEQ ID NO: 39214 - RNA, 23 nt, Mus musculus
augugcccccagggauagaaggc

SEQ ID NO: 39215 - RNA, 42 nt, Mus musculus
ucauuggugguguggacauggucacagaugaugacaggagau

SEQ ID NO: 39216 - RNA, 46 nt, Mus musculus
uggcgagaggcuucaccuuuccccuaaccgcaccaagcugagagua

SEQ ID NO: 39217 - RNA, 45 nt, Mus musculus
aaggcagcuuuccucgucguuaagaacaugcuggagaugggagac

SEQ ID NO: 39218 - RNA, 74 nt, Mus musculus
ucaaggcagcuuuccuauugaauaaacucuaccuggagaugggagacuggcaagaggaggaagaggaagaggaa

SEQ ID NO: 39219 - RNA, 91 nt, Mus musculus
ucgugucaguguucaguguuugguaggugaggccuagcuguauguuuagcuguauggaguguugugugguggguguuaugggggcuccggu

SEQ ID NO: 39220 - RNA, 45 nt, Mus musculus
gaguguguguggggugugugcacugugguguguguguguucaugu

SEQ ID NO: 39221 - RNA, 46 nt, Mus musculus
gagugauuguguacaugugugcaugccacagugaucauguggaggu

SEQ ID NO: 39222 - RNA, 46 nt, Mus musculus
cacauuccuuuaauguuaaaguuaaacaugaaccaucucaucaggu

SEQ ID NO: 39223 - RNA, 45 nt, Mus musculus
guuacuguucauacaguuggagagccugucugcacagguguccgg

SEQ ID NO: 39224 - RNA, 89 nt, Mus musculus
cuuguuggguuuuggcuuguugccuauaggcucuuaagguacuuuagacaagagaggaaggugucuuaggugcugucauagacucacuc

SEQ ID NO: 39225 - RNA, 46 nt, Mus musculus
ccuuaaacaugccaaagugagcuuuuuaaguggauaaguuagagau

SEQ ID NO: 39226 - RNA, 46 nt, Mus musculus
aguuacauagacaaaggccuugaggccacuguaccuaagccgagca

SEQ ID NO: 39227 - RNA, 45 nt, Mus musculus
gagacacagcccaauaaaucccaguguugagaacugcagcgggaa

SEQ ID NO: 39228 - RNA, 45 nt, Mus musculus
agguauauguuuaguuuuuuuacguaucuucuaagaagcucaguu

SEQ ID NO: 39229 - RNA, 49 nt, Mus musculus
gggacccuuauaagaauauuugauacuucaucagggcauuuaauccagg

SEQ ID NO: 39230 - RNA, 42 nt, Mus musculus
agacaagaagcuuaaugaauuuuaggugauguggguaaguca

SEQ ID NO: 39231 - RNA, 46 nt, Mus musculus
uaaggaacuggagcagggaugggucaagaccugccuacaaggagau

SEQ ID NO: 39232 - RNA, 44 nt, Mus musculus
cucacaaccaucuguaauaggaucugaugcccucuucuggcgca

SEQ ID NO: 39233 - RNA, 57 nt, Mus musculus
auuuugucuaaagugaaaacugaucauuuauaccugguuuagauucagugguagggg

SEQ ID NO: 39234 - RNA, 45 nt, Mus musculus
guaguacuuccucaaggaagauucugucuccucaagguuccauaa

SEQ ID NO: 39235 - RNA, 45 nt, Mus musculus
aggcuagccagcggaaguuucaaggcuacccccaagccagcagag

SEQ ID NO: 39236 - RNA, 46 nt, Mus musculus
ccacguacagcuuguggaccuggccagcacugaaaagccacccgug

SEQ ID NO: 39237 - RNA, 46 nt, Mus musculus
ucucuuuucucuguugucucuuccucccaccacuccaccccacccc

SEQ ID NO: 39238 - RNA, 49 nt, Mus musculus
caucgagauagaauucuccacagaggucaaggcugucaaguugcggaga

SEQ ID NO: 39239 - RNA, 46 nt, Mus musculus
ucccuucccuucccuucccuucccuuccuuuccccuccccugcagg

SEQ ID NO: 39240 - RNA, 45 nt, Mus musculus
uugaggguuaaccacugggaaagaagcuuccagaaagugugugga

SEQ ID NO: 39241 - RNA, 23 nt, Mus musculus
auuuagcuuuaguugguggugga

SEQ ID NO: 39242 - RNA, 46 nt, Mus musculus
cagagagaacaagcuagacacagaugaagacagacaagccggagaa

SEQ ID NO: 39243 - RNA, 46 nt, Mus musculus
auaauaauaaauaaaucuuuaaaaaaaaaaaaaaaaaacaaauaca

SEQ ID NO: 39244 - RNA, 46 nt, Mus musculus
aacagucuggacugccacauagaaccccugucuugaaaaaccaagu

SEQ ID NO: 39245 - RNA, 45 nt, Mus musculus
ggacccauuauacuugacacaauucucaagccgaaaaggggaguc

SEQ ID NO: 39246 - RNA, 46 nt, Mus musculus
uuuucccguuugggagagugagaauguauacaaucugggcauagau

SEQ ID NO: 39247 - RNA, 46 nt, Mus musculus
cuacacagagaaacucugucuuguaaaaccagagggagagagagga

SEQ ID NO: 39248 - RNA, 42 nt, Mus musculus
augcgcuuguucgcgccuccgcccuggaagcguucggcgaga

SEQ ID NO: 39249 - RNA, 42 nt, Mus musculus
gagcuccacguuuaucugggaucuccguuccaggcagagcag

SEQ ID NO: 39250 - RNA, 46 nt, Mus musculus
agacauaccucggaagaaaucucaagugaguaauugccaccaccag

SEQ ID NO: 39251 - RNA, 23 nt, Mus musculus
ugaauugucaguuuugccugcau

SEQ ID NO: 39252 - RNA, 42 nt, Mus musculus
auguauaugugcaugugucagaauucuuggaguugcaggcag

SEQ ID NO: 39253 - RNA, 49 nt, Mus musculus
acagcuguuuauuuugcuauuuucuaguccuuucauuaguguagauaaa

SEQ ID NO: 39254 - RNA, 46 nt, Mus musculus
ggaucuccucggagcuuuguucgguagacagauucauauaguggag

SEQ ID NO: 39255 - RNA, 46 nt, Mus musculus
caugacccucuuuauccugucucacugcauuaguuaaccuagccug

SEQ ID NO: 39256 - RNA, 23 nt, Mus musculus
guguggccugugucuggagcaug

SEQ ID NO: 39257 - RNA, 46 nt, Mus musculus
ucccaccugaucaucccauucccauccucucucucccugcccccag

SEQ ID NO: 39258 - RNA, 25 nt, Mus musculus
cuggggggagacuagagagaaggug

SEQ ID NO: 39259 - RNA, 44 nt, Mus musculus
aacaggcuugugcaacaugagguugugguagaggaagguccuug

SEQ ID NO: 39260 - RNA, 45 nt, Mus musculus
ucugggaggugacuuuuauguaggauaggcucuuuucccugagca

SEQ ID NO: 39261 - RNA, 45 nt, Mus musculus
augugacuguuuuugacuguugugauuaaugcuacuggggaacau

SEQ ID NO: 39262 - RNA, 45 nt, Mus musculus
uaguaauagauuguuuuccucagcacauagaacaacccccccccu

SEQ ID NO: 39263 - RNA, 45 nt, Mus musculus
acaugacaggcaaguacugaacuaucuauccuuacccagccccug

SEQ ID NO: 39264 - RNA, 45 nt, Mus musculus
uagagguuagugcaaguuguggcuuacccugaaagguagugugag

SEQ ID NO: 39265 - RNA, 46 nt, Mus musculus
uuuuagauggcuuuuguucggcuguuugcauucuuucuuggguuag

SEQ ID NO: 39266 - RNA, 41 nt, Mus musculus
ugugugugugggugugugugugugugugugagagagagaca

SEQ ID NO: 39267 - RNA, 46 nt, Mus musculus
uacaauuccacuaccagugguuugcuaagccuuuuaugauggggaa

SEQ ID NO: 39268 - RNA, 25 nt, Mus musculus
guuuuucuuugucagaguaucauuu

SEQ ID NO: 39269 - RNA, 46 nt, Mus musculus
aauuauuaaauuauguguauauguguaugucuuuguuuguugucau

SEQ ID NO: 39270 - RNA, 45 nt, Mus musculus
agauggggaauaagccucauuuucugguguaauuuguuguuggag

SEQ ID NO: 39271 - RNA, 45 nt, Mus musculus
uguaugugucuguaugugugccacaugcauggaguucccguggag

SEQ ID NO: 39272 - RNA, 45 nt, Mus musculus
uaauguuuuuauugauuauuuggaaauuucacauaaugcacccca

SEQ ID NO: 39273 - RNA, 42 nt, Mus musculus
caccaucacagugagggagagcuugggagggaccagaugcag

SEQ ID NO: 39274 - RNA, 41 nt, Mus musculus
cuggccucaucuucaugaugaauucuaggccuacuacggcu

SEQ ID NO: 39275 - RNA, 45 nt, Mus musculus
ucgcuagugacgugugugugugugugugugugugugugugugugu

SEQ ID NO: 39276 - RNA, 42 nt, Mus musculus
uguguguaugugugugugugugugguguguguggugugugua

SEQ ID NO: 39277 - RNA, 46 nt, Mus musculus
accguuuaucuccuuuucugcuguuuuuguucaguggaggacccug

SEQ ID NO: 39278 - RNA, 45 nt, Mus musculus
uuuccuugugcagaucagccccuguauuaguugguuuaguuggag

SEQ ID NO: 39279 - RNA, 52 nt, Mus musculus
guaauuauggacccugucaaguugacaguuaucacaccccucuagagaaccu

SEQ ID NO: 39280 - RNA, 45 nt, Mus musculus
uacaacaguuuuguuaggagcaugcuugugaaagagaugggggag

SEQ ID NO: 39281 - RNA, 45 nt, Mus musculus
gggccugaguggagggcugaguucuuauguggguugagcaugcca

SEQ ID NO: 39282 - RNA, 42 nt, Mus musculus
auauugguguauguuuggcaaacacacaaaaaaaauagucag

SEQ ID NO: 39283 - RNA, 58 nt, Mus musculus
uuuguucuagcaaguagggugaaaggucgccuguguccagacauaguggaagggcugu

SEQ ID NO: 39284 - RNA, 41 nt, Mus musculus
gcaguacuauuccuccuggugguguccagcugucuggcgca

SEQ ID NO: 39285 - RNA, 34 nt, Mus musculus
cgagaugcaccugccggguucugaguaauccuua

SEQ ID NO: 39286 - RNA, 46 nt, Mus musculus
uaccuuguucuaacugcucugaauaguucagugaguuucuugcagg

SEQ ID NO: 39287 - RNA, 47 nt, Mus musculus
caggagcuguugugcaccugcuuuauaggaguuaaaugagcacagag

SEQ ID NO: 39288 - RNA, 44 nt, Mus musculus
cuagucugguaggucacaguuucaucaugugacaugggagguaa

SEQ ID NO: 39289 - RNA, 45 nt, Mus musculus
cucaaucgaaugcagacaggugcuguuggguauagauagugcugu

SEQ ID NO: 39290 - RNA, 45 nt, Mus musculus
uugagucauuucacacagcagccucucucacaaaacauuuuugaa

SEQ ID NO: 39291 - RNA, 46 nt, Mus musculus
uuuccuguaauuuuuugugcuccuuuugugaggaacaucuggaaag

SEQ ID NO: 39292 - RNA, 42 nt, Mus musculus
ggugguuguggugaugugugacccacugaguuuacuggggag

SEQ ID NO: 39293 - RNA, 46 nt, Mus musculus
auguccuaucaugggcauaugaaauggggucugugguacuguguau

SEQ ID NO: 39294 - RNA, 41 nt, Mus musculus
uguucaaagcuauugaacaguuuccuuauuuuaaaccuguu

SEQ ID NO: 39295 - RNA, 42 nt, Mus musculus
ugggugucuguggagguucccucucuggucuaggucuggugc

SEQ ID NO: 39296 - RNA, 44 nt, Mus musculus
ugcuucauuuuuguuggguguggggucucaaggccauucugcca

SEQ ID NO: 39297 - RNA, 41 nt, Mus musculus
gggcauguacuaccuccugccugaagcucugugcgucugag

SEQ ID NO: 39298 - RNA, 54 nt, Mus musculus
aaaccccuuugcauucaaaacuuauuuuuauuucuaaauaagccagucuuguuc

SEQ ID NO: 39299 - RNA, 47 nt, Mus musculus
cacacauacaaauaaguaaaaaguuaaaaaaagaauuuagcccaaau

SEQ ID NO: 39300 - RNA, 46 nt, Mus musculus
uacagauucaugugcgugguacuacucagccacucacauaccugag

SEQ ID NO: 39301 - RNA, 42 nt, Mus musculus
ucaucuagcgcccucuucuggagugacugaagacagcuacag

SEQ ID NO: 39302 - RNA, 42 nt, Mus musculus
gggaaucacuacaccacgcggagcuguaugaaagguuccaag

SEQ ID NO: 39303 - RNA, 46 nt, Mus musculus
uuaggcucugaacaaggugggcagcugccagcaugagucuggacag

SEQ ID NO: 39304 - RNA, 24 nt, Mus musculus
auugucauggugagaaaacauggu

SEQ ID NO: 39305 - RNA, 46 nt, Mus musculus
augcugaugugaagaguagacuugugugaaggcugauggggcuuag

SEQ ID NO: 39306 - RNA, 46 nt, Mus musculus
uuguucuccuccugugcugagggggagacagcuugucuuugaguag

SEQ ID NO: 39307 - RNA, 46 nt, Mus musculus
uuuuaggguacuuucccucauggaauugauauuuugacuacagcag

SEQ ID NO: 39308 - RNA, 46 nt, Mus musculus
uucauucauuuuuauauguugugucaagaaguucagauggcuggag

SEQ ID NO: 39309 - RNA, 25 nt, Mus musculus
gaugcccaggaaagcacacacgugu

SEQ ID NO: 39310 - RNA, 45 nt, Mus musculus
aaaaacuacuuugacaguucauuuugccccagugacaaugguuca

SEQ ID NO: 39311 - RNA, 41 nt, Mus musculus
ggagaaaaaaagucaaagaagaaaaaggaagacaggguaag

SEQ ID NO: 39312 - RNA, 46 nt, Mus musculus
auccaucuuauuguauauauaauuuaucucucuuguuuuauuuuag

SEQ ID NO: 39313 - RNA, 45 nt, Mus musculus
uaaaagacuuuaacugucuucuuccuuugguuuucaggggucuug

SEQ ID NO: 39314 - RNA, 45 nt, Mus musculus
cugcacagagaguggagaugggaaguggaaaugagagucuguaca

SEQ ID NO: 39315 - RNA, 42 nt, Mus musculus
acacugaggccuuuaaucuauuuggaguugaauuuugcgcag

SEQ ID NO: 39316 - RNA, 45 nt, Mus musculus
ugcugggauuaaaggcacgcaccaccacugccuggccgggccuga

SEQ ID NO: 39317 - RNA, 45 nt, Mus musculus
acucucaggagucuucaccuuguuucaagccauuccagacaacag

SEQ ID NO: 39318 - RNA, 46 nt, Mus musculus
ugacaugugacacauuuuuuaggcaguaagcugugauuguugauau

SEQ ID NO: 39319 - RNA, 46 nt, Mus musculus
ugcagagacccagucaccugucugugccugaggacuucucggacag

SEQ ID NO: 39320 - RNA, 46 nt, Mus musculus
uagaacugagcugucagcccaagaaguaguagcaggagcuguagag

SEQ ID NO: 39321 - RNA, 46 nt, Mus musculus
ggaucaagaauaccaacuguucccucuacaaaauggaaacaguaga

SEQ ID NO: 39322 - RNA, 41 nt, Mus musculus
ugaucucuucauuaaguccuuccagaagcugaaucagggca

SEQ ID NO: 39323 - RNA, 46 nt, Mus musculus
ugagcuuugcugaagcccggagagaugguuugaaagcaaucucaag

SEQ ID NO: 39324 - RNA, 42 nt, Mus musculus
cauacccauucuguguugguuaguuucuugucaacuuggcac

SEQ ID NO: 39325 - RNA, 46 nt, Mus musculus
gaguaaaagguuuauuguaaauaacagaggcagagacgucugggag

SEQ ID NO: 39326 - RNA, 45 nt, Mus musculus
acuaccagccuagagauggucccacccacaaggggcccuaccccc

SEQ ID NO: 39327 - RNA, 33 nt, Mus musculus
gauucuucuucagcuguuccuccuccucggcca

SEQ ID NO: 39328 - RNA, 46 nt, Mus musculus
cugugcgggacugaguucaucuuccuccugucauugugcucucuag

SEQ ID NO: 39329 - RNA, 41 nt, Mus musculus
gugugccagggcuugugugcauguuuguguaguugccuggg

SEQ ID NO: 39330 - RNA, 46 nt, Mus musculus
aguugugaaacucucucuguauugagugagacaccagacccauuag

SEQ ID NO: 39331 - RNA, 60 nt, Mus musculus
cucccugagccugggcucuuaacagcuuccugugagaucuuggguagaguugugugggug

SEQ ID NO: 39332 - RNA, 44 nt, Mus musculus
uuucuggagcuacuacuuaaaaaugaucuuugugucugggauau

SEQ ID NO: 39333 - RNA, 80 nt, Mus musculus
gacgagagccucucuacccugcgcuuugccaaccgagccaagaacaucaagaacaaaccgcgggugaacgaggaccccaa

SEQ ID NO: 39334 - RNA, 92 nt, Mus musculus
ggacacacugcugagggaauuccaggaagagaucgcucgcuugaaggcccagcuggagaagaaggggaugcugggcaagcgaccucggagaa

SEQ ID NO: 39335 - RNA, 47 nt, Mus musculus
cuauccagagggguccgugauugaggccuggguggccgaagaggaag

SEQ ID NO: 39336 - RNA, 46 nt, Mus musculus
ggaggagaaggcugccauccaggaugaccgcagccuugugagugag

SEQ ID NO: 39337 - RNA, 46 nt, Mus musculus
uggcuguggguuucccuuuucuuccuaccuccauuucccguuuuau

SEQ ID NO: 39338 - RNA, 42 nt, Mus musculus
gugccugacugaugugcaucauguaugugcaggagccugcag

SEQ ID NO: 39339 - RNA, 42 nt, Mus musculus
uucugaguuaagcaucagcugcccuucucacuuccugccuuc

SEQ ID NO: 39340 - RNA, 46 nt, Mus musculus
ugagagguugauauugauucuacaaaauuugaugcucauuggguag

SEQ ID NO: 39341 - RNA, 24 nt, Mus musculus
ugcccagcacaguguuugguuugu

SEQ ID NO: 39342 - RNA, 49 nt, Mus musculus
ggaucacaccaacgagcaacagaagauguuggaacugaagcgacaggag

SEQ ID NO: 39343 - RNA, 46 nt, Mus musculus
auggagcuacgugguaccuacucaucccugcagcaggagguggaag

SEQ ID NO: 39344 - RNA, 42 nt, Mus musculus
ugggucagggaaugcgguguggcuauggaaacuugcguccag

SEQ ID NO: 39345 - RNA, 46 nt, Mus musculus
gcggaccauacaaagcggacggagugccucuugcagugggaccaaa

SEQ ID NO: 39346 - RNA, 45 nt, Mus musculus
ggaugaguguguguguguguggaugagugugugcauacuuugugu

SEQ ID NO: 39347 - RNA, 42 nt, Mus musculus
gaaauaaggugagcaggugagcugaggagaaaaugggagcag

SEQ ID NO: 39348 - RNA, 46 nt, Mus musculus
aggcucaguuaggaccacugaguggaguugggcacuuuuuggugug

SEQ ID NO: 39349 - RNA, 46 nt, Mus musculus
gccaacuuacaaaaaauuauuuuuguuuguuucuuuguuuuugaga

SEQ ID NO: 39350 - RNA, 46 nt, Mus musculus
agccugagauggggauaugugugucucagguagggaccaggaggag

SEQ ID NO: 39351 - RNA, 46 nt, Mus musculus
aggcuuuuguguuugcugugagagcugaaagugcaggagguguuua

SEQ ID NO: 39352 - RNA, 46 nt, Mus musculus
uauguauggaguguguacguggcuauggagcacgcauguagaggug

SEQ ID NO: 39353 - RNA, 46 nt, Mus musculus
cagccuaggcaggccuuagcauucaaaguauuaagauuacaggcau

SEQ ID NO: 39354 - RNA, 46 nt, Mus musculus
ugugugucugucuaugucuauaaaugccugugcaguacccauagag

SEQ ID NO: 39355 - RNA, 41 nt, Mus musculus
uuacagguuaauauguaaagucauugucaaacaaggcacaa

SEQ ID NO: 39356 - RNA, 46 nt, Mus musculus
auuucuuuauugcuauuagucauuuuguuuguuugguggggucaag

SEQ ID NO: 39357 - RNA, 56 nt, Mus musculus
uaauguuuucuauuaauguauauuaaguauacauaguaaugagauuuucauacucu

SEQ ID NO: 39358 - RNA, 51 nt, Mus musculus
aucacuuguauauauugucauugucuuaugacacugcaaauuggaaagccc

SEQ ID NO: 39359 - RNA, 46 nt, Mus musculus
ugguugugagccaccaugugguggcugggauuugaacuucggaccu

SEQ ID NO: 39360 - RNA, 46 nt, Mus musculus
aguuuucucccggauggauuugggucuggagagcuguggcacaggg

SEQ ID NO: 39361 - RNA, 46 nt, Mus musculus
cguguuccaugacaccugacucaaauuugauauuuuuucuucauag

SEQ ID NO: 39362 - RNA, 25 nt, Mus musculus
gauauuuuucuucucagauuuuucu

SEQ ID NO: 39363 - RNA, 42 nt, Mus musculus
agcugucuucagacacaccagaagagggcauccgaucuccau

SEQ ID NO: 39364 - RNA, 151 nt, Mus musculus
uuuauguguguguguguauguauguauguuucgguacuuauaauuuucuauuucugugugcuuuuuuauuuacuaggagaaauuaauauaucauuaguuauuuguugugaaaauuguagaaaagaacaaagggcuaauagccugagaaaaa

SEQ ID NO: 39365 - RNA, 54 nt, Mus musculus
acaucagaaacaggaugugacacagauuuuuggucaucaggggcaauccuguuu

SEQ ID NO: 39366 - RNA, 47 nt, Mus musculus
aacccugucuugaaaaacaaaagaaagaaagaaagaaagaaaggaag

SEQ ID NO: 39367 - RNA, 45 nt, Mus musculus
aagaaagaaagaaagaaagaaagaaagggaaaggaaaggaaaaag

SEQ ID NO: 39368 - RNA, 46 nt, Mus musculus
gaggucauauuacugacugcaaacaaagucagaaagcagggagaua

SEQ ID NO: 39369 - RNA, 47 nt, Mus musculus
gacagagaaacccugucucgaaaaaaaaaaaaagaaagaaaaaagaa

SEQ ID NO: 39370 - RNA, 41 nt, Mus musculus
ugggagagggauagacaggaucuauaaaaaacucagggugg

SEQ ID NO: 39371 - RNA, 64 nt, Mus musculus
gaugacgauuacuaauuugaggauuguuaguauugcuggaagaucaugguauaaauuauuuggg

SEQ ID NO: 39372 - RNA, 45 nt, Mus musculus
auaacuccagaaucugacauuuucucauagacauaugugcaggca

SEQ ID NO: 39373 - RNA, 59 nt, Mus musculus
uuugucucuuaguaauuguaagaaaccaaaagaaccaaacaagaacagcaaaaauuggg

SEQ ID NO: 39374 - RNA, 45 nt, Mus musculus
augaagaaaauuuccaauuaaaaaaugugaaaaaaaacccagcaa

SEQ ID NO: 39375 - RNA, 46 nt, Mus musculus
auuuuaggaccucuguucgcucagucccugcucccuccagcccaaa

SEQ ID NO: 39376 - RNA, 45 nt, Mus musculus
cacacaaacucccgaggagaagaaggcaucuucuauaaaguucca

SEQ ID NO: 39377 - RNA, 45 nt, Mus musculus
caggugagccugugcauggcuuuagcccuagcacucaggcugcag

SEQ ID NO: 39378 - RNA, 45 nt, Mus musculus
aagccugugaagcacagugggaucccaucuuaaacaauacagaac

SEQ ID NO: 39379 - RNA, 46 nt, Mus musculus
uaaaugaagcuuucacuuucucuuuugauuacuuuagcuauucuag

SEQ ID NO: 39380 - RNA, 47 nt, Mus musculus
gaaggaauauaaaaauauggggucuguauuaagaaaguguauaacau

SEQ ID NO: 39381 - RNA, 46 nt, Mus musculus
caaacaauaguucuuuucuugcugcuacuuauuagccaauguugag

SEQ ID NO: 39382 - RNA, 46 nt, Mus musculus
guaccugcauauaaauguuuuguguaauuuuuaucuuuggauauag

SEQ ID NO: 39383 - RNA, 43 nt, Mus musculus
acaguccuaacaggaugccuacauuuucagaaagaugugccag

SEQ ID NO: 39384 - RNA, 42 nt, Mus musculus
cucugagaacagcagcagcagugaugguggcagcaacaaaga

SEQ ID NO: 39385 - RNA, 46 nt, Mus musculus
cccauccauauauaacaaugaagggggaaaggggccaugcuccagg

SEQ ID NO: 39386 - RNA, 46 nt, Mus musculus
gcauaaggauuacaguuuaaauuaccagaauguaaaaguuggacag

SEQ ID NO: 39387 - RNA, 46 nt, Mus musculus
agcguuugcuuuccacucugagguguccagacuuguucacaugggu

SEQ ID NO: 39388 - RNA, 46 nt, Mus musculus
cugauguccucuacacuuuucuggcuaacuuuugcagaggacccag

SEQ ID NO: 39389 - RNA, 42 nt, Mus musculus
uuuggggggguggugguggugaauuguuuguuugcuuugcuc

SEQ ID NO: 39390 - RNA, 41 nt, Mus musculus
uuuugccuuaggaacacuagaggggguguggaggggaggag

SEQ ID NO: 39391 - RNA, 45 nt, Mus musculus
aaguuuuaauaucuucuaaauuuaagugauaaguaaagugccuua

SEQ ID NO: 39392 - RNA, 107 nt, Mus musculus
cuuauuaauuuuaacugcauuaagaacuguugaugugucauauuauaaaaauaggucuuuuuuuucucuuauccccaugguaaugauuguucuauucuuggaaagca

SEQ ID NO: 39393 - RNA, 46 nt, Mus musculus
uaguauuaaaaggcaccuuccgcccaggguauuuuguuccacccag

SEQ ID NO: 39394 - RNA, 54 nt, Mus musculus
agagucauguuuucuugcuggcaccauaaacagagaucaacauuaaauauggcc

SEQ ID NO: 39395 - RNA, 46 nt, Mus musculus
aaguauuauuauauaagacagcuuugugaauaguuguuguuuugaa

SEQ ID NO: 39396 - RNA, 46 nt, Mus musculus
aucucuccagcccagcuuuuuuaaaauauauuacuguuuuaucuua

SEQ ID NO: 39397 - RNA, 46 nt, Mus musculus
cuugauuuuaauaauaaugauaauaugugcuuugaaagcaggucug

SEQ ID NO: 39398 - RNA, 55 nt, Mus musculus
aucaucuagacugucacauccacccucucccccgucaggcugcccaucacccacc

SEQ ID NO: 39399 - RNA, 42 nt, Mus musculus
aagaucccaaccacaugguggcucacaaccauccguaacaag

SEQ ID NO: 39400 - RNA, 46 nt, Mus musculus
gaauguaugauaaagaauaaacuuuaauaaagauaauugcccauaa

SEQ ID NO: 39401 - RNA, 46 nt, Mus musculus
uuuuuaaauugcuauauuuauuagcauaaucuuucugcugccacag

SEQ ID NO: 39402 - RNA, 41 nt, Mus musculus
cauuggccuggagcgugugguuuacucuaaacuggcugacu

SEQ ID NO: 39403 - RNA, 45 nt, Mus musculus
gcaaaacauuuauucacaucaagucaaaauaaacguaaaacuaag

SEQ ID NO: 39404 - RNA, 42 nt, Mus musculus
uagaugaggcuggccuugaacucauagagauccucgggccuu

SEQ ID NO: 39405 - RNA, 45 nt, Mus musculus
gagacagccaaaugggcaggugucagcaaagguugaaagaugaaa

SEQ ID NO: 39406 - RNA, 46 nt, Mus musculus
uacacacugcgauccugccuaaaaguaucuucuaccaccacccccc

SEQ ID NO: 39407 - RNA, 46 nt, Mus musculus
aggcaccagcauagccucacaagagacagcuauauaagggucccuu

SEQ ID NO: 39408 - RNA, 47 nt, Mus musculus
uuugcacaaguccuuuacacagugauccaucucucuccagccccaaa

SEQ ID NO: 39409 - RNA, 45 nt, Mus musculus
uugucuguucuuaaucguuguuuacauuugcaguuucuuacccau

SEQ ID NO: 39410 - RNA, 45 nt, Mus musculus
aaaaaaaaaaaacagaucguauuacagaugguuguaagccaccau

SEQ ID NO: 39411 - RNA, 46 nt, Mus musculus
auuuuuaaaaguuuagggggaagaggacagagggaggaagguagag

SEQ ID NO: 39412 - RNA, 46 nt, Mus musculus
gaguugaacucucuuacuuuauuuugauuagaaaauaaggcuggag

SEQ ID NO: 39413 - RNA, 46 nt, Mus musculus
guugucuuguuuuauuauuaacaggauaguaccucaguuaaggcag

SEQ ID NO: 39414 - RNA, 45 nt, Mus musculus
auguauauaucugugugcauauaugcuguguuuacaaguacccac

SEQ ID NO: 39415 - RNA, 46 nt, Mus musculus
ucugccaggccugguaguaaggccugaaauuucauuuaacuugaag

SEQ ID NO: 39416 - RNA, 46 nt, Mus musculus
uuuagagguuacccaucuaguuaauuauugguagcagaaauaggag

SEQ ID NO: 39417 - RNA, 46 nt, Mus musculus
auguguucuuacuaccaguuggaacuucuucuggguauaugcccag

SEQ ID NO: 39418 - RNA, 41 nt, Mus musculus
ccugaaaugcaggugagaauucgacaagagauugagaagga

SEQ ID NO: 39419 - RNA, 78 nt, Mus musculus
cucuccugucagaauugucccaguaguuccucaguccgaguguaaagaagaagcagugcagauaccaucaccauccca

SEQ ID NO: 39420 - RNA, 49 nt, Mus musculus
gaaccuguucuugcaucagcuagcaauacaaaugagcuuaucaccauga

SEQ ID NO: 39421 - RNA, 47 nt, Mus musculus
cguaauaacaaaagugagaaccaagaagcguuagcuauauccccaag

SEQ ID NO: 39422 - RNA, 47 nt, Mus musculus
gaacccugauaugaagaugccaccagcaacuguuacugaucagaucc

SEQ ID NO: 39423 - RNA, 46 nt, Mus musculus
cugggagaaaagaccacguaucacugagaaucgccagcaccagcag

SEQ ID NO: 39424 - RNA, 41 nt, Mus musculus
gacaaaguccaagagaggguggugaaaggaaaauugcugga

SEQ ID NO: 39425 - RNA, 41 nt, Mus musculus
aggucccacacuggaacuggccggaacuggaagcaggggag

SEQ ID NO: 39426 - RNA, 42 nt, Mus musculus
gcacaguugagcccaaagcagguucuaauaagaaugcaccaa

SEQ ID NO: 39427 - RNA, 41 nt, Mus musculus
agggauauucccugguaucaguguaauggaaaguagcagca

SEQ ID NO: 39428 - RNA, 42 nt, Mus musculus
aacuauuuucagugaaauuuucaaaagguauuaacagcacag

SEQ ID NO: 39429 - RNA, 46 nt, Mus musculus
uaaauaagaauccaucuagucuauuuguguuaaaacaugcuuucag

SEQ ID NO: 39430 - RNA, 46 nt, Mus musculus
aaauauaucugauaccugauggggcugugccccauccagcccucaa

SEQ ID NO: 39431 - RNA, 50 nt, Mus musculus
acugaagcuaucucccauguucugugugagauuucugaguaagaucuggc

SEQ ID NO: 39432 - RNA, 79 nt, Mus musculus
uguaguguuuggaaaaaucauugacggacuuguagugaugaggaagaucgagaauguucccacaggccccaacaauaag

SEQ ID NO: 39433 - RNA, 46 nt, Mus musculus
cacucugcuccaggccugcuuuccauggcaaacagugguuccagua

SEQ ID NO: 39434 - RNA, 70 nt, Mus musculus
uuccacagggucauaaaggauuucaugauucaggguggagauuuuguuaauggcgauggcacuggagucg

SEQ ID NO: 39435 - RNA, 58 nt, Mus musculus
uuugcagacguggugccuaagacggcagagaacuuuaggcaauucugcacccgagauc

SEQ ID NO: 39436 - RNA, 41 nt, Mus musculus
ccagaguggguggcugucaaucagaaggggcucccagcaga

SEQ ID NO: 39437 - RNA, 46 nt, Mus musculus
cugggagccccuucugauugacagccacccacucuggcagcagcag

SEQ ID NO: 39438 - RNA, 42 nt, Mus musculus
agcuuccuccucaacucuccuucagccaguguguccccagga

SEQ ID NO: 39439 - RNA, 42 nt, Mus musculus
aaauguaugcuuacucuguuugugugugugugugugugugug

SEQ ID NO: 39440 - RNA, 42 nt, Mus musculus
ccacuccacauuaccucaagaaagcuuucccuggcccaagau

SEQ ID NO: 39441 - RNA, 44 nt, Mus musculus
cccaucaauccagccacagcugcugccuacccaccugcccccuu

SEQ ID NO: 39442 - RNA, 42 nt, Mus musculus
gguggguaggcagcagcuguggcuggauugaugggcccucca

SEQ ID NO: 39443 - RNA, 46 nt, Mus musculus
accacacucucagauccuucaccaucaccugcagcaggauggccag

SEQ ID NO: 39444 - RNA, 45 nt, Mus musculus
uugcccgcugcccaucuggccauccugcugcaggugauggugaag

SEQ ID NO: 39445 - RNA, 45 nt, Mus musculus
gcacaucccaaugggcagggacaucuugccuagaggccugcuggg

SEQ ID NO: 39446 - RNA, 46 nt, Mus musculus
gucugaacugucaguggcuggugauggagucacagcaagggaagag

SEQ ID NO: 39447 - RNA, 44 nt, Mus musculus
agugcucauagugaucaagggaaaagaaucaagaggccuuagua

SEQ ID NO: 39448 - RNA, 46 nt, Mus musculus
uaagaccuaguguuuguccugugacacagcagauacggcccaagag

SEQ ID NO: 39449 - RNA, 45 nt, Mus musculus
cagcaucauacugaauuagaaguuaaauuaauuucauguuaaaau

SEQ ID NO: 39450 - RNA, 41 nt, Mus musculus
aaagguccugaguucaaaucccaguaaccacaggguggcuc

SEQ ID NO: 39451 - RNA, 44 nt, Mus musculus
cucacaaccauccguaacaagaucugacucccucuucggugugu

SEQ ID NO: 39452 - RNA, 41 nt, Mus musculus
gacgcuggaaugaggaaacugccugccuuguggccccggga

SEQ ID NO: 39453 - RNA, 42 nt, Mus musculus
cagggaaacaaagaugaccgcacagcacuuccacggccagag

SEQ ID NO: 39454 - RNA, 45 nt, Mus musculus
ugaaacaaaguucagagaacagguagaaagaaugaggcacaaaac

SEQ ID NO: 39455 - RNA, 45 nt, Mus musculus
uagggauuguuguuguuuguuuuucuuuuguucuguuugcuuuua

SEQ ID NO: 39456 - RNA, 44 nt, Mus musculus
ugggaucugacgcccucuucuggugugccugaagacagcgacag

SEQ ID NO: 39457 - RNA, 46 nt, Mus musculus
cguucagagaugaugcaucuaacccucaagagacuagaggccccag

SEQ ID NO: 39458 - RNA, 46 nt, Mus musculus
acuuuucauccaaguuucauccaagaacuugaggcugacuuguaag

SEQ ID NO: 39459 - RNA, 45 nt, Mus musculus
ggcgcacuagugagguuaggggaagaaaacgaaaucugugugaaa

SEQ ID NO: 39460 - RNA, 45 nt, Mus musculus
auuauuauauucaucuaggagaggaaaagauccauaagggcaaag

SEQ ID NO: 39461 - RNA, 46 nt, Mus musculus
cuuaugcagcuguagccugggucccuccauguguacucuuugguug

SEQ ID NO: 39462 - RNA, 46 nt, Mus musculus
ucuuggacagggucccuucaggccuucaucuucagccaggaggcag

SEQ ID NO: 39463 - RNA, 46 nt, Mus musculus
auauuggcccagaauacccaagacacaauuugcaaaacucaagaag

SEQ ID NO: 39464 - RNA, 45 nt, Mus musculus
ucaggagucacaggaggaacugcagccucuauagaucacguagga

SEQ ID NO: 39465 - RNA, 46 nt, Mus musculus
auuuauacauuuuaaugaagaguaaaacugaaaaugaugaaggaag

SEQ ID NO: 39466 - RNA, 45 nt, Mus musculus
aggacaaacggaaagccaacuaugaacgaggaaacauggagcugg

SEQ ID NO: 39467 - RNA, 82 nt, Mus musculus
gaauggaagaagcagcuggaguuggagaaacgcuuggagaaacagagagagcuggagagacagcgggaggaagagaggagaa

SEQ ID NO: 39468 - RNA, 45 nt, Mus musculus
uuagaaugggaaagacuccgucggcaggagcugcucagucagaag

SEQ ID NO: 39469 - RNA, 37 nt, Mus musculus
uauuaaacgaaagaauuaaaaacaugcagcucaguaa

SEQ ID NO: 39470 - RNA, 46 nt, Mus musculus
uuagagaucuuaacgugagaauuaugacaaagauaaacucugguag

SEQ ID NO: 39471 - RNA, 46 nt, Mus musculus
ugguugguagaacugucuuggaaggaucaggagguguggccauguu

SEQ ID NO: 39472 - RNA, 46 nt, Mus musculus
cuggcuuagcgugguucuggaaauauacagguuuuccugauuuggg

SEQ ID NO: 39473 - RNA, 46 nt, Mus musculus
ccuuaggaacucagagaaagcuauaauacacagcaguuagcccuug

SEQ ID NO: 39474 - RNA, 46 nt, Mus musculus
gaaaucgaaagaaaaagauuagagcaaauucaaaaaaagaaacuag

SEQ ID NO: 39475 - RNA, 47 nt, Mus musculus
aagcaaagcaaggaaaagaaaacuuguggagagaaaguauuagaaag

SEQ ID NO: 39476 - RNA, 77 nt, Mus musculus
guugugugugugugugugaaguggguggcacuucaggcccagggauguaggcguggggagaaguugagggagaguug

SEQ ID NO: 39477 - RNA, 46 nt, Mus musculus
uuaucugguuuggucuuuuugagacugggugucauuuugcaaucag

SEQ ID NO: 39478 - RNA, 46 nt, Mus musculus
gggcuauguugacuggcuuucagguuuuguuuuguuaaaugauaag

SEQ ID NO: 39479 - RNA, 49 nt, Mus musculus
cuacauaaaacucaucuaauacuaaauuuugucacagcuugcaguaucu

SEQ ID NO: 39480 - RNA, 46 nt, Mus musculus
cuuuuucuuuuuccauuugguuugggguuuuuguuuaucuguccaa

SEQ ID NO: 39481 - RNA, 70 nt, Mus musculus
accccaccccacacacacacgggguuucucuguguaaucuuggcugucuuggaacucacucuauagauca

SEQ ID NO: 39482 - RNA, 46 nt, Mus musculus
uggccugguuugcuuugucccaaagauugauugauugcuggccugg

SEQ ID NO: 39483 - RNA, 41 nt, Mus musculus
uugguuuguuuuuucugagguggggcacacauacuacagca

SEQ ID NO: 39484 - RNA, 44 nt, Mus musculus
agguagauagguaguagauagguagauagguagguagauaggua

SEQ ID NO: 39485 - RNA, 47 nt, Mus musculus
gauagguagguagauagauagguagguagguagguagguagguaggu

SEQ ID NO: 39486 - RNA, 46 nt, Mus musculus
gaacagucggugcucuuacccacugagccaucucacuagccccccc

SEQ ID NO: 39487 - RNA, 42 nt, Mus musculus
auuuauuacauguaagcacaccagacacaccagaagagggca

SEQ ID NO: 39488 - RNA, 42 nt, Mus musculus
ggccuagaauuccugacccuccugccuuuuacuuacuccaag

SEQ ID NO: 39489 - RNA, 42 nt, Mus musculus
ugccuagacccagcaggaccccagagcacaccagcaccccag

SEQ ID NO: 39490 - RNA, 47 nt, Mus musculus
ggaacuuuugcugugaugaaacaccaugacaaaaaacagccugcgga

SEQ ID NO: 39491 - RNA, 46 nt, Mus musculus
ugcacacuuuacauucuugaagguauuuauccauuguauauuugau

SEQ ID NO: 39492 - RNA, 45 nt, Mus musculus
aguuucggauuucuuccaugacucugggccagaaggacuggaggc

SEQ ID NO: 39493 - RNA, 46 nt, Mus musculus
acugguggucugcuggccuugcugcugucccuggaccuggacagca

SEQ ID NO: 39494 - RNA, 45 nt, Mus musculus
ccugcugaccuucuccaaccugcauggucacgggugugaucugac

SEQ ID NO: 39495 - RNA, 46 nt, Mus musculus
auaaaaaauauugcaucuuucuguuguagaaucucaguccccaggc

SEQ ID NO: 39496 - RNA, 61 nt, Mus musculus
ggucugccccuuucuuuuuuucugagggcagaacuggcagaguggaaauccuguacacccu

SEQ ID NO: 39497 - RNA, 24 nt, Mus musculus
ugcggucuggggagggucuggccg

SEQ ID NO: 39498 - RNA, 52 nt, Mus musculus
cgguaucagaaggaccccucucaggcaggccguuucggguggaugguggcuu

SEQ ID NO: 39499 - RNA, 25 nt, Mus musculus
augacuggugcugcgggagggggcg

SEQ ID NO: 39500 - RNA, 42 nt, Mus musculus
ccccucagaggaaugacacuucucuauaccacaugggccaag

SEQ ID NO: 39501 - RNA, 33 nt, Mus musculus
agcugggagugggugaagcuacccagagagcag

SEQ ID NO: 39502 - RNA, 42 nt, Mus musculus
ccaggggacagugaugaggcuuuugacuucuuugagcagcag

SEQ ID NO: 39503 - RNA, 42 nt, Mus musculus
gacagcggggaggcuggcuucccucccacagcgcugccccua

SEQ ID NO: 39504 - RNA, 103 nt, Mus musculus
uugcuuagaagggcagcagguauacuacuuagagaagacugauguucaauguccggcaaagcagggcuuaggcuuugugaugguuaauauugcccgucuaaca

SEQ ID NO: 39505 - RNA, 46 nt, Mus musculus
gggggggccgccaugguagacaaaccgugaaccuaugcaaucccug

SEQ ID NO: 39506 - RNA, 45 nt, Mus musculus
gucacuaacauaggcauccuccugcucuccuggacccuaucccuu

SEQ ID NO: 39507 - RNA, 46 nt, Mus musculus
uagaggagcaagagcaccccuucuuuacacaugggcagagacugag

SEQ ID NO: 39508 - RNA, 45 nt, Mus musculus
ccuccuugccaaucacuacuaaagccucaucccgucagccugugg

SEQ ID NO: 39509 - RNA, 45 nt, Mus musculus
gggaagcagaguuggguggaggcugucuagagucaguccucagcu

SEQ ID NO: 39510 - RNA, 46 nt, Mus musculus
uccacccaacucugcuucccuuucaccagcaggccuucacccccuc

SEQ ID NO: 39511 - RNA, 45 nt, Mus musculus
ucuuguuuuguuuuuguuuuauuuuuuuuaaauaaacugacagau

SEQ ID NO: 39512 - RNA, 45 nt, Mus musculus
auggggcuguuacauaaauacagauuuuauuuucggaggcagaau

SEQ ID NO: 39513 - RNA, 50 nt, Mus musculus
ugcgcauccaagccuaugacuaccucgagugcucggccaagaccaaggag

SEQ ID NO: 39514 - RNA, 47 nt, Mus musculus
gauuuuuccccuaaaaggcauguguggggugugugugugcgugugug

SEQ ID NO: 39515 - RNA, 42 nt, Mus musculus
gccgaugccaugcaggcggcagcacguggagggggaggggag

SEQ ID NO: 39516 - RNA, 45 nt, Mus musculus
cuuagcuuuucuuccuaagccuuuaugguauguaucauugccuga

SEQ ID NO: 39517 - RNA, 45 nt, Mus musculus
aaaguugagcucagucgacagcagugggggcuuggcggugggcac

SEQ ID NO: 39518 - RNA, 42 nt, Mus musculus
ugaucuuuucccaucuguuguaucccaacugcagggccccag

SEQ ID NO: 39519 - RNA, 45 nt, Mus musculus
uuccaggguacggggcaggugggcguucucuacaaaaaccuugua

SEQ ID NO: 39520 - RNA, 46 nt, Mus musculus
uucccuugagagagauggucucagccaggucuuucucggccugggg

SEQ ID NO: 39521 - RNA, 46 nt, Mus musculus
gagcaguguauacaggaugugggcugaugugugguaagggcaugau

SEQ ID NO: 39522 - RNA, 48 nt, Mus musculus
cagcagcaacaccgagacugcuuuuaccucuguccugccagccggaga

SEQ ID NO: 39523 - RNA, 47 nt, Mus musculus
gcuucacugcucgggacaaggaaaaggaggucaccaccaggcccagg

SEQ ID NO: 39524 - RNA, 60 nt, Mus musculus
acguguggaggguggcggcacuucugucaucaaagagguugucgaggauggaacugccaa

SEQ ID NO: 39525 - RNA, 55 nt, Mus musculus
ggacgaaggagccacaggugcuucucagagccuuuuggacaggaaggaagugcug

SEQ ID NO: 39526 - RNA, 45 nt, Mus musculus
ugcugugugccugguggcuuucaugcuguaccggaugaagaagaa

SEQ ID NO: 39527 - RNA, 42 nt, Mus musculus
ggaggccugagcuccuuggaauccacuuuucauuguggggag

SEQ ID NO: 39528 - RNA, 46 nt, Mus musculus
ugugcauggacucagggccacggccuuggccugggccaccgugaca

SEQ ID NO: 39529 - RNA, 44 nt, Mus musculus
uggcugcuagguugaucugccugauucuucccuggagcuggaga

SEQ ID NO: 39530 - RNA, 46 nt, Mus musculus
gaccccuccagcuagaccuagacuaaaugcugacuccuuaugccag

SEQ ID NO: 39531 - RNA, 42 nt, Mus musculus
gcgcacaggaguuggcaagggcccgggccgagggcgggccag

SEQ ID NO: 39532 - RNA, 42 nt, Mus musculus
ugaaccgcugggccgaaagcuuuugucaggggccugggcgag

SEQ ID NO: 39533 - RNA, 45 nt, Mus musculus
ugaauggagccuauaauauaaguucuugggaggugguaucaggag

SEQ ID NO: 39534 - RNA, 45 nt, Mus musculus
ucuaauaguuuaaaugugaaagaagugcauaaguaauacgugacu

SEQ ID NO: 39535 - RNA, 46 nt, Mus musculus
ccauuucuacauuccucaaguuuacuucuuuaucauuugaagccag

SEQ ID NO: 39536 - RNA, 47 nt, Mus musculus
gcacucagacauuaaauaaaauuuuaaaaaugguauaaaaaaagaga

SEQ ID NO: 39537 - RNA, 46 nt, Mus musculus
ccaggcaucagguaugcaagugguacacuaacuagcaggcaugcag

SEQ ID NO: 39538 - RNA, 45 nt, Mus musculus
aaaguauucuuaaaguggauauacaacacaauaaaagccagccag

SEQ ID NO: 39539 - RNA, 45 nt, Mus musculus
aaccaaaucagcauugcuuccuuucaacauuuauguucgacauag

SEQ ID NO: 39540 - RNA, 46 nt, Mus musculus
acuuucauauaauaaauaaauaaaucuuuaaaaaaaaaaaagaaaa

SEQ ID NO: 39541 - RNA, 46 nt, Mus musculus
aaauaucgcguguuuaugcaccagugaggacuaccugaacaagaag

SEQ ID NO: 39542 - RNA, 46 nt, Mus musculus
ccacagugaaaugaacuuggaaauguugcuaauaauacuaggcaag

SEQ ID NO: 39543 - RNA, 46 nt, Mus musculus
uguaagagcauaccuuuguuggguguuaaucauuuaggguggacag

SEQ ID NO: 39544 - RNA, 42 nt, Mus musculus
auucaugguauuaugaugagauuucagcaacauguuuggcag

SEQ ID NO: 39545 - RNA, 47 nt, Mus musculus
ugaaacuuacacaaaggggaaaucagaggggagcuaaaauagcuaga

SEQ ID NO: 39546 - RNA, 45 nt, Mus musculus
ucuguagagaauggugaccauagguuaacgcacacuuagaaguug

SEQ ID NO: 39547 - RNA, 46 nt, Mus musculus
cuguucuuauguuuauaaucaguucaaugcugguuuauggagccau

SEQ ID NO: 39548 - RNA, 43 nt, Mus musculus
caguugucugguggccaucaguucucucacuuacuugccaaga

SEQ ID NO: 39549 - RNA, 46 nt, Mus musculus
uuucccauacaaagaugaccuccuggcauuggacuccagcugccuc

SEQ ID NO: 39550 - RNA, 42 nt, Mus musculus
cucacaaccaucuguaaugagaucuggcgcccucuuguggug

SEQ ID NO: 39551 - RNA, 46 nt, Mus musculus
guguuuggaacugcuacaaauacaucaacaacagaaaugugccaga

SEQ ID NO: 39552 - RNA, 81 nt, Mus musculus
ucaguauguuuugccaaccuaugaaauggcugugaagauuccugagaaagagccaccaccuccuuaccugccugccugagg

SEQ ID NO: 39553 - RNA, 46 nt, Mus musculus
uagaaaguacacugucuugucugagcauuuauuuucaaacacuaag

SEQ ID NO: 39554 - RNA, 56 nt, Mus musculus
uuguuaaguaucacauuuuagagacuuuuugaagacaaucuagauuaagcaagagc

SEQ ID NO: 39555 - RNA, 62 nt, Mus musculus
uuggauguuuggugcccugaguaguuuccggggcgugacuacaguguugaggaugaauaggu

SEQ ID NO: 39556 - RNA, 88 nt, Mus musculus
uggguauaacaccugcaguuuccagcucuaugaaacaggagagagagagaaauagcaguuugacuugacuguggaagaugaugguugc

SEQ ID NO: 39557 - RNA, 41 nt, Mus musculus
cugagaccucugacccuguguaccccaguuaccucgcggcu

SEQ ID NO: 39558 - RNA, 45 nt, Mus musculus
agccacuaacauugcucugagcagaacaaaucuacagagcccaga

SEQ ID NO: 39559 - RNA, 46 nt, Mus musculus
gcuguaggcaagugacaagggggaaaaugcaaagagaaguggccag

SEQ ID NO: 39560 - RNA, 45 nt, Mus musculus
uugagcuguaugcuguggguguggaccgggcagauauggaguccc

SEQ ID NO: 39561 - RNA, 45 nt, Mus musculus
uagcuucuagcuagcgaggauguuauagucuguaguuugcgcgau

SEQ ID NO: 39562 - RNA, 45 nt, Mus musculus
agagacagagaggcaguggggcagagagaggggcagaggcagaga

SEQ ID NO: 39563 - RNA, 45 nt, Mus musculus
guugugagccaccaugugguugcugggaauugaaucagcauccuu

SEQ ID NO: 39564 - RNA, 45 nt, Mus musculus
cuugcccaggggguuuguugaggucacuggcuuuuacauacauag

SEQ ID NO: 39565 - RNA, 42 nt, Mus musculus
ggucaguuucccacaaaauggccacugggacuugacagggau

SEQ ID NO: 39566 - RNA, 46 nt, Mus musculus
cucucucucucucucucucucucucucucucucucucagcauucau

SEQ ID NO: 39567 - RNA, 65 nt, Mus musculus
ucccuccccucucuuucuccuucccccucccccuuccccccuucuuuucuuuucuuuucuuuucu

SEQ ID NO: 39568 - RNA, 48 nt, Mus musculus
ccuguugcugggauuacagguccuccuaucuaccucucucuauugcug

SEQ ID NO: 39569 - RNA, 83 nt, Mus musculus
guugcugggauuacagguccuccuaucuaccucucccuguugcugggauuacagguccuccuaucuaccucucucuauugcug

SEQ ID NO: 39570 - RNA, 46 nt, Mus musculus
ggauugcagguucuccuaucuaccucucucuauugcugggauuaca

SEQ ID NO: 39571 - RNA, 67 nt, Mus musculus
ccuguugcugggauuacagauccuccuaucuaccucucucuauugcugggauuacagguccuccuau

SEQ ID NO: 39572 - RNA, 92 nt, Mus musculus
cuaccucucucuauugcugggauuacagguccuccuaucuaccucucucuauugcugggauuacagguccuccuaucuaccucucucuauug

SEQ ID NO: 39573 - RNA, 46 nt, Mus musculus
uucauccuggcuaagcgauuacucuccuaaccaugcuacaagccag

SEQ ID NO: 39574 - RNA, 46 nt, Mus musculus
acugugcaggcggggacaucugcuucuagagcugucacaugccuag

SEQ ID NO: 39575 - RNA, 46 nt, Mus musculus
uaugacacuuuuaauucauuaaugucauggaaaugaacaacuaaag

SEQ ID NO: 39576 - RNA, 42 nt, Mus musculus
caaguuauaauauuaucuuaaaaacugucaauaagccugauu

SEQ ID NO: 39577 - RNA, 42 nt, Mus musculus
gaacaucacaagaguccuuucuguagaauaucaagccagcga

SEQ ID NO: 39578 - RNA, 46 nt, Mus musculus
uugauaauccucaccucccacuacucaccuuaauuccucucgccuc

SEQ ID NO: 39579 - RNA, 46 nt, Mus musculus
ucugugaaccacaguguugaugcuagguauugaaccugggcccuuu

SEQ ID NO: 39580 - RNA, 46 nt, Mus musculus
ucuaugggauucucugcuacaggguauuuugacgaagcuuuggaag

SEQ ID NO: 39581 - RNA, 45 nt, Mus musculus
uucaagaugcuguuuugagcuuaaaacagaccauuuuagacaaag

SEQ ID NO: 39582 - RNA, 45 nt, Mus musculus
cugagagacaggacccuugggcuuaaauauaaacacccauccuau

SEQ ID NO: 39583 - RNA, 43 nt, Mus musculus
auugcugcugugggaacacuguucuugguagaaauugccccca

SEQ ID NO: 39584 - RNA, 45 nt, Mus musculus
gcccaacagaacuuuguggcuucaguggcuuccgccaucacccuu

SEQ ID NO: 39585 - RNA, 46 nt, Mus musculus
cuuuccuuuccuuuccuuuccuuuccuuuccgucugucugccccuc

SEQ ID NO: 39586 - RNA, 46 nt, Mus musculus
cuuaguaagauuaaaaaacagcucaugcuuuaaaaaaugauaggag

SEQ ID NO: 39587 - RNA, 45 nt, Mus musculus
uuggucccaauuaaaaaaacauugcuuauaaauguuuagugccua

SEQ ID NO: 39588 - RNA, 45 nt, Mus musculus
ggauuuucgggacaaaguggaugaauacaucaaacgcuaugccag

SEQ ID NO: 39589 - RNA, 42 nt, Mus musculus
uggaccuugccucgcugcgcucagugcgagcuuucugccaag

SEQ ID NO: 39590 - RNA, 54 nt, Mus musculus
ccaaaccggaaaggcuccugccugccuuggacccggcuaggaggaggggcaggu

SEQ ID NO: 39591 - RNA, 46 nt, Mus musculus
uuguaaagcaagcaauaauaucucuacuucaugauagggaacugag

SEQ ID NO: 39592 - RNA, 46 nt, Mus musculus
uuuuucauauuuugaaagauguuuuuaagguuaucauaggaacaua

SEQ ID NO: 39593 - RNA, 46 nt, Mus musculus
caccugacguagaaggugugucaggaagguacuuuggagauuguaa

SEQ ID NO: 39594 - RNA, 45 nt, Mus musculus
gcuauggaugagucaguggcaagaaaacugugggauaucagugaa

SEQ ID NO: 39595 - RNA, 45 nt, Mus musculus
uuauuuauuauaauugggcaauuauaacuguuaaagauacuggua

SEQ ID NO: 39596 - RNA, 53 nt, Mus musculus
ucuagcucagcaaacagcuucauggucuguuuguagacugccuguuugaacag

SEQ ID NO: 39597 - RNA, 45 nt, Mus musculus
aacaguguguuccacguauucuuuucuugccugaauuacauccag

SEQ ID NO: 39598 - RNA, 54 nt, Mus musculus
guucuugacucagcauggcaaucugaugaaaucccagcuguaagucugcagaaa

SEQ ID NO: 39599 - RNA, 100 nt, Mus musculus
ugcaucaggauuugucuguguucuucaagaucccauuuaaauuccuuagugacuaaaaccauugugcauuguagagggcgucuauuuauauucugccuga

SEQ ID NO: 39600 - RNA, 46 nt, Mus musculus
ucaaccuaguguuuuccacaucuccauuugguguuagcgcaagauu

SEQ ID NO: 39601 - RNA, 46 nt, Mus musculus
gagacacugccacuugcugugccaaauggaacacagaggauaaagu

SEQ ID NO: 39602 - RNA, 72 nt, Mus musculus
ggcugugggucgagcuaagcagauuguuuggaaugguccuguugggguauuugaaugggaagccuuugccag

SEQ ID NO: 39603 - RNA, 46 nt, Mus musculus
caggcaagguaaucuucacaccauuuuucucagcuuuggacaugag

SEQ ID NO: 39604 - RNA, 179 nt, Mus musculus
cauuggugguggaauggccuuuaccuuccuuaaggugcucaacaacauggagauuggcacaucucuguaugaugaagaaggagccaagauugucaaagaucucauguccaaagcugagaaaaauggugugaagauuaccuugccuguugacuuugucacugcugacaaauuugaugaga

SEQ ID NO: 39605 - RNA, 63 nt, Mus musculus
uccagagcgacccuuccuggcuaucuugggaggcgcuaaaguugcagacaagauccagcugau

SEQ ID NO: 39606 - RNA, 73 nt, Mus musculus
uggaaacaagguuaaagcugagccggccaaaauugaugcuuuccgagccucacuguccaaacuaggagauguc

SEQ ID NO: 39607 - RNA, 72 nt, Mus musculus
ggcugggacugucauccugcuggaaaaccuccgcuuucauguagaggaagaagggaagggaaaagaugcuuc

SEQ ID NO: 39608 - RNA, 46 nt, Mus musculus
cuucugggcccacacaauccuucaagaacagaacauccuugcccag

SEQ ID NO: 39609 - RNA, 115 nt, Mus musculus
ccggccugaugguguucccaugccugacaaguacuccuuagagccaguugcugcugaacucaaaucucugcugggcaaggauguucuguucuugaaggauugugugggcccagaa

SEQ ID NO: 39610 - RNA, 53 nt, Mus musculus
augaggguggacuucaacguuccuaugaagaacaaccagauaacaaacaacca

SEQ ID NO: 39611 - RNA, 45 nt, Mus musculus
uggaaagcgacauuuuggcaacaccgugaggucgaaaggcccgga

SEQ ID NO: 39612 - RNA, 46 nt, Mus musculus
gucugugaguuccccgauguacuugaugguguacuugagugucugg

SEQ ID NO: 39613 - RNA, 45 nt, Mus musculus
guguuuggaaugacuauggggugggguauguauaaaggaggcuag

SEQ ID NO: 39614 - RNA, 45 nt, Mus musculus
ccacagacagcuaaagaaccgaggacauggggguugauuggugau

SEQ ID NO: 39615 - RNA, 47 nt, Mus musculus
uaccagcaguaccaggaugccacggcugaugagcagggcgaguucga

SEQ ID NO: 39616 - RNA, 46 nt, Mus musculus
caccucggugaacuccaucucguccaugcccucacccguguaccag

SEQ ID NO: 39617 - RNA, 45 nt, Mus musculus
cugguacacgggugagggcauggacgagauggaguucaccgaggu

SEQ ID NO: 39618 - RNA, 44 nt, Mus musculus
uguccaugaaggagguggaugagcagaugcucaacgugcagaac

SEQ ID NO: 39619 - RNA, 44 nt, Mus musculus
uagugcuggcugccccggcuggucagaggugcaaagccuggccu

SEQ ID NO: 39620 - RNA, 42 nt, Mus musculus
gguggucacuccacucaugguggcugacaccaggugguugag

SEQ ID NO: 39621 - RNA, 46 nt, Mus musculus
agggcuccaccacaguaucagagaccuugggugagggcaugacgcu

SEQ ID NO: 39622 - RNA, 46 nt, Mus musculus
cagaccacaucaugaacaccuucagcgucaugcccucacccaaggu

SEQ ID NO: 39623 - RNA, 45 nt, Mus musculus
ggucuggguacuccucucugaucuugcugaugagcagggucccca

SEQ ID NO: 39624 - RNA, 94 nt, Mus musculus
gcacaauggacucagucaggucuggaucauuugggcagaucuucaggccagacaacuucguguucggccagaguggugcaggaaauaacugggc

SEQ ID NO: 39625 - RNA, 42 nt, Mus musculus
cccacuggaaguuaccauggagacagugauuugcaacuggaa

SEQ ID NO: 39626 - RNA, 45 nt, Mus musculus
ugguaacuuccaguggggucuauaccaugcucaucacugaugacc

SEQ ID NO: 39627 - RNA, 45 nt, Mus musculus
gccagcucucugcgcugcacagggcuccccgccccacccggccug

SEQ ID NO: 39628 - RNA, 87 nt, Mus musculus
uucguguccgccgugguggucguaaacgcccaguuccuaagggugcaacuuacggcaagccuguccaccaugguguuaaccagcuga

SEQ ID NO: 39629 - RNA, 46 nt, Mus musculus
cacauauaaauuuuuugagguuauccucauugauccguuccauaaa

SEQ ID NO: 39630 - RNA, 47 nt, Mus musculus
agggccacaaguuccaccacacuauuggugguucccgccgugcagcc

SEQ ID NO: 39631 - RNA, 45 nt, Mus musculus
aaauuagguagaaauuuguccggugcaugaguggagugacuucuc

SEQ ID NO: 39632 - RNA, 45 nt, Mus musculus
ucaauaacccuccaccauuauuuauguauuuauuuauuugugagu

SEQ ID NO: 39633 - RNA, 45 nt, Mus musculus
gcgcuugaggaucagcucgccaggcugugcucgccccaggcccag

SEQ ID NO: 39634 - RNA, 42 nt, Mus musculus
uuucuucuucuuuuuaacccuuucuuuccgaggacagcgcag

SEQ ID NO: 39635 - RNA, 42 nt, Mus musculus
ggguucuugcagaucauccccggcaugguggacgcggugcag

SEQ ID NO: 39636 - RNA, 42 nt, Mus musculus
uccgcucuuuuuaauaugggggagugcuuccuucccguggag

SEQ ID NO: 39637 - RNA, 41 nt, Mus musculus
gcgaauuucuuuucgcuaaagcuauuucucugccugggcca

SEQ ID NO: 39638 - RNA, 42 nt, Mus musculus
uagcgcucguucggcuccaacccaguucccaggagccccccg

SEQ ID NO: 39639 - RNA, 42 nt, Mus musculus
auauuauuaacugaaaaaaucugacacacccggggggcgggg

SEQ ID NO: 39640 - RNA, 45 nt, Mus musculus
gacuuuaugacuccaaugcuccucugucuacaugacgucagaagg

SEQ ID NO: 39641 - RNA, 46 nt, Mus musculus
ccacugcuucauccaggaccaggaaucuaacuugagacaaguugag

SEQ ID NO: 39642 - RNA, 49 nt, Mus musculus
guagcaucccaucucuauccauaacuccaguuccagaggacagaacgcc

SEQ ID NO: 39643 - RNA, 42 nt, Mus musculus
uuggccucagugagcaucgugugugugugugugugugugugu

SEQ ID NO: 39644 - RNA, 44 nt, Mus musculus
gagggcuugguuuuuuauaugugcugguauuucaaaugccagac

SEQ ID NO: 39645 - RNA, 46 nt, Mus musculus
uucuuucuuccuuaaggaacccauggaugaagugaguugccuagag

SEQ ID NO: 39646 - RNA, 42 nt, Mus musculus
acgcacugucuuccuuuggguagccagaguucaugcacccuu

SEQ ID NO: 39647 - RNA, 46 nt, Mus musculus
cagagcaaauccacaacaaagagccagugaaaugaaaggcagcugg

SEQ ID NO: 39648 - RNA, 44 nt, Mus musculus
ugagagaauguaaaaacaaaucacagauuuguuuuugcugauaa

SEQ ID NO: 39649 - RNA, 46 nt, Mus musculus
ucuuuccuguuccaccgaagccaaauccaaacuugucaguaccuag

SEQ ID NO: 39650 - RNA, 46 nt, Mus musculus
cugcaugguagaccacccaacucugcauagcccuuggucaugacag

SEQ ID NO: 39651 - RNA, 46 nt, Mus musculus
ucugauccaauugcugcauuggagaacaagcguacagaaaugggag

SEQ ID NO: 39652 - RNA, 45 nt, Mus musculus
gacccucuaucauauggguucaucugccacuuguugagcacuaaa

SEQ ID NO: 39653 - RNA, 44 nt, Mus musculus
auauuguaccuuuguacugcucagaguguugaguuuugggcugg

SEQ ID NO: 39654 - RNA, 45 nt, Mus musculus
aaccggagaaggccgccaucuucccgcacuccuccgcugcgggcc

SEQ ID NO: 39655 - RNA, 46 nt, Mus musculus
uugucccaggccuuuucuggucgaguguuuguguuaauggcaaggg

SEQ ID NO: 39656 - RNA, 41 nt, Mus musculus
uccccagaguugcagcuagaguuguccacagaaggguuuug

SEQ ID NO: 39657 - RNA, 44 nt, Mus musculus
uucaaguccuuacugcuaugaagaacaaauaucagcugugcaga

SEQ ID NO: 39658 - RNA, 45 nt, Mus musculus
uaaaaaugugucuuguacugaaagacuacauucagugugggucag

SEQ ID NO: 39659 - RNA, 43 nt, Mus musculus
ucaggauuuggugugcccccugcuagcaugaagcgagcugcug

SEQ ID NO: 39660 - RNA, 45 nt, Mus musculus
uacccaguggacuugggaggaaggaauuuucuguccacaccucag

SEQ ID NO: 39661 - RNA, 46 nt, Mus musculus
gauaacccaauguaaguaacaggccuuaaaucgcguuccgaaccag

SEQ ID NO: 39662 - RNA, 42 nt, Mus musculus
ucuaucgcuuccagauauggaggccguucacugccaccuuuu

SEQ ID NO: 39663 - RNA, 46 nt, Mus musculus; identical to SEQ ID NO: 34468

SEQ ID NO: 39664 - RNA, 46 nt, Mus musculus; identical to SEQ ID NO: 34469

SEQ ID NO: 39665 - RNA, 42 nt, Mus musculus; identical to SEQ ID NO: 34470

SEQ ID NO: 39666 - RNA, 45 nt, Mus musculus; identical to SEQ ID NO: 34471

SEQ ID NO: 39667 - RNA, 42 nt, Mus musculus
guggacacuuggacggcuauggaacaacuagugaaugaaggu

SEQ ID NO: 39668 - RNA, 42 nt, Mus musculus; identical to SEQ ID NO: 34473

SEQ ID NO: 39669 - RNA, 46 nt, Mus musculus
guuaagacgucagcuggaccgacuaaccugcggauugaguaccaag

SEQ ID NO: 39670 - RNA, 41 nt, Mus musculus
gaagccccacggaaugggacuguucaccuguaccugaccaa

SEQ ID NO: 39671 - RNA, 47 nt, Mus musculus
uacuuggaagaauauaaauuccagguauaaguauuucucucucuuuu

SEQ ID NO: 39672 - RNA, 51 nt, Mus musculus
aaaaaaaaaaaaaaacacaugccucauauagacuaucuccgaaugcagcua

SEQ ID NO: 39673 - RNA, 84 nt, Mus musculus
auauccgguauaaaucauuguuuguuagggagaaaggcaaguuggauacauaaacugugcuuuuacuuggcgccaagccaccgc

SEQ ID NO: 39674 - RNA, 42 nt, Mus musculus
agcuguuuauuauuuauugcucuggugcaguuuaaggcagag

SEQ ID NO: 39675 - RNA, 46 nt, Mus musculus
cuuuuaggacaggcauaacuuaagcguccacuuuccccacauucau

SEQ ID NO: 39676 - RNA, 46 nt, Mus musculus
ucuuggaugcuucacgccuacuccacuggagccccuguccccagga

SEQ ID NO: 39677 - RNA, 46 nt, Mus musculus
ggcuauucuaccccacuuuucauuuuguucagaaauaguugcagau

SEQ ID NO: 39678 - RNA, 37 nt, Mus musculus
cggacauucauauuuacacauuucuugguucagagaa

SEQ ID NO: 39679 - RNA, 42 nt, Mus musculus
cucugacaagcauggcugcccagcguaugucagcccagagau

SEQ ID NO: 39680 - RNA, 41 nt, Mus musculus
caucuagggcuugcauauuuguauagauaaguugcugaguu

SEQ ID NO: 39681 - RNA, 45 nt, Mus musculus
gguugagaauggcuaaagggaaggagguugaaguccccuguagau

SEQ ID NO: 39682 - RNA, 46 nt, Mus musculus
ucuuaauuauucuuuaagaauccuagauaugaauguuaggguugga

SEQ ID NO: 39683 - RNA, 46 nt, Mus musculus
ucccuagaguaaggaauaaaauacccauggaagaaguugcagagac

SEQ ID NO: 39684 - RNA, 46 nt, Mus musculus
uggugcugcgugaccucaagcugcggaaauuuaucuucaaggauga

SEQ ID NO: 39685 - RNA, 42 nt, Mus musculus
aauaacaaaguauuugacuacagucaguuuccuacugcagug

SEQ ID NO: 39686 - RNA, 45 nt, Mus musculus
ucacaauagcgagauaugggagaucgcggaacaaaacccaggauu

SEQ ID NO: 39687 - RNA, 74 nt, Mus musculus
ucuugauccuuuuaagucgguagcaccgaggcgccugcaccggcgcggcucauccaucucuccagagggguuuu

SEQ ID NO: 39688 - RNA, 46 nt, Mus musculus
guaacugcccucucuagcaccccccuuacacgccccccacccuuuc

SEQ ID NO: 39689 - RNA, 42 nt, Mus musculus
uugagagagacagcucugcgauuuuuuggaaaagccucagac

SEQ ID NO: 39690 - RNA, 27 nt, Mus musculus
gaaagccacaguguagcuguagcuggc

SEQ ID NO: 39691 - RNA, 103 nt, Mus musculus
gccacuuagcugaauacgggaagugcaaaccuauaaucccagcacuugggagucugagguagccugggcuacacagcaaacucagagaaggaagacuaggaga

SEQ ID NO: 39692 - RNA, 42 nt, Mus musculus
uaaauguagcaauggaaagcaauggugcaucaucugguccag

SEQ ID NO: 39693 - RNA, 45 nt, Mus musculus
augucuucuuccuacacacaguggacuucaaacgacuggaccaga

SEQ ID NO: 39694 - RNA, 41 nt, Mus musculus
cucaggaugggaaguaagacacaaagcuuuuggcguuaguu

SEQ ID NO: 39695 - RNA, 46 nt, Mus musculus
ucucagaaaaggaagccuugcaaauugacuaucaacccaccaggcc

SEQ ID NO: 39696 - RNA, 56 nt, Mus musculus
acauauuaggaaggaccacagaaagugauguguuuggcaaucaggcaagagaacca

SEQ ID NO: 39697 - RNA, 47 nt, Mus musculus
acaguagcaccuauauagauggccuccauagguccuugaggguggag

SEQ ID NO: 39698 - RNA, 42 nt, Mus musculus
ugagaaauuggggugcugaauaaagcaaaagaagagggccag

SEQ ID NO: 39699 - RNA, 42 nt, Mus musculus
gagggagggggaucuuagccaggggucuaacggcaaucggag

SEQ ID NO: 39700 - RNA, 45 nt, Mus musculus
ggugccaggcacacaugguauuaauccccuggggacaugcucuca

SEQ ID NO: 39701 - RNA, 46 nt, Mus musculus
ggccuuggcuuuuggaccuuaguuuucccaagugauggugugaugu

SEQ ID NO: 39702 - RNA, 45 nt, Mus musculus
gaagcagaauuguagugaccacccuacucauggagggagaaggag

SEQ ID NO: 39703 - RNA, 33 nt, Mus musculus
acgggcgcggaacagacuaaagggguagggagc

SEQ ID NO: 39704 - RNA, 45 nt, Mus musculus
cgcagucaccgacgggaucagaaguggcaugacaaacaguacaag

SEQ ID NO: 39705 - RNA, 71 nt, Mus musculus
gcuggaaaaaguagggguugaggccaaacagccaaauucugccaucaggaagugcgucagggugcagcuca

SEQ ID NO: 39706 - RNA, 48 nt, Mus musculus
uuuggucgaaaaggucaugcuguaggugauauuccuggaguccgcuuu

SEQ ID NO: 39707 - RNA, 42 nt, Mus musculus
guucuuugcucccauccucggagaggucaacuucagcugcag

SEQ ID NO: 39708 - RNA, 73 nt, Mus musculus
guguagcaguagugaaccgaugacuauauuucuuuugcucagaauuuuaagaucaagguagacauuuuaaaau

SEQ ID NO: 39709 - RNA, 69 nt, Mus musculus
acuugugccagagauugguguucggagagcuuuuaaauuaagcuaugucauuauauccuuuccccuugc

SEQ ID NO: 39710 - RNA, 45 nt, Mus musculus
caguuaggugucaguaauacuggcagauguuggaaagcccggcaa

SEQ ID NO: 39711 - RNA, 46 nt, Mus musculus
uuuauaguggaugaacccaaagcugccuuugcaugcagugcaggag

SEQ ID NO: 39712 - RNA, 46 nt, Mus musculus
aauuguugucccucccccuaggugugccuguguguggaugggugug

SEQ ID NO: 39713 - RNA, 46 nt, Mus musculus
gguggggaacugcacuucuggcuuuuggucagcauuguagcccaag

SEQ ID NO: 39714 - RNA, 44 nt, Mus musculus
gcuucacaguuuaaagacauuucggugcuuguuccuaggccuug

SEQ ID NO: 39715 - RNA, 46 nt, Mus musculus
ucugugaagauuggcuggcuggaggccuuguauugaaagcagucuu

SEQ ID NO: 39716 - RNA, 45 nt, Mus musculus
gcuauguuaagaaaaugugcuuuucagguuauguuacuuggaaaa

SEQ ID NO: 39717 - RNA, 41 nt, Mus musculus
aagcaagugcauuuaaaguugccaagaaauagccacuggga

SEQ ID NO: 39718 - RNA, 47 nt, Mus musculus
cauauauguauaaaauaacaaaggaaaagagaguuuaugaauuugaa

SEQ ID NO: 39719 - RNA, 74 nt, Mus musculus
ugaccuuaguaaugaugaugauggugaugaagaaagaggaggaggaagaagaggaggaagaagagaagaagagg

SEQ ID NO: 39720 - RNA, 51 nt, Mus musculus
gggaacuaggaggaaaaagaagacacaauggagacaugaaggugcaagugu

SEQ ID NO: 39721 - RNA, 46 nt, Mus musculus
acauuagagagacauucucuuaaauuuacuuucuguauccacggag

SEQ ID NO: 39722 - RNA, 46 nt, Mus musculus
acccugagcuggaauguguugggaacuaaaagggggcccuggguaa

SEQ ID NO: 39723 - RNA, 42 nt, Mus musculus
ucagcgguuaagagcagagacuacucuuccagagguccugag

SEQ ID NO: 39724 - RNA, 46 nt, Mus musculus
uguaaugauaaauaaagcaggaauuggggcaggagagaugguucag

SEQ ID NO: 39725 - RNA, 25 nt, Mus musculus
gaauuuaggguucauuaguagacug

SEQ ID NO: 39726 - RNA, 46 nt, Mus musculus
uccaacgacacguggauucguugccaacugauugucauuaguugaa

SEQ ID NO: 39727 - RNA, 45 nt, Mus musculus
aggagcuugagcagggagaaaccuggaguaaggagcugaugcaga

SEQ ID NO: 39728 - RNA, 45 nt, Mus musculus
aaguuguaccuuaauuucuucauuaagaaaaugccuuacagcugg

SEQ ID NO: 39729 - RNA, 45 nt, Mus musculus
gaucagcauuggcugugaagcccaagcuuagugggagaggucagg

SEQ ID NO: 39730 - RNA, 46 nt, Mus musculus
uggcuccacccuuaacccaugaaaucauuucucuauaagcagccaa

SEQ ID NO: 39731 - RNA, 46 nt, Mus musculus
uuagcucuaaaguugcuuccucuaggaagccuuuucugacugccac

SEQ ID NO: 39732 - RNA, 46 nt, Mus musculus
gcuuccaacauggaggaggaggaagcuugaaaguuacugugucuga

SEQ ID NO: 39733 - RNA, 46 nt, Mus musculus
ucaaaucccagcaaccacaugguggcucacaaccauugguaacaaa

SEQ ID NO: 39734 - RNA, 46 nt, Mus musculus
ucaggggaagagagguaaaggcaggucaccucugaggagccaguga

SEQ ID NO: 39735 - RNA, 41 nt, Mus musculus
aaucacucagcuauggucaucuguuccuguuagaaggccuu

SEQ ID NO: 39736 - RNA, 46 nt, Mus musculus
uccaacucagucagcaaagaaguaguugcugucauugacagaugag

SEQ ID NO: 39737 - RNA, 45 nt, Mus musculus
ugcugaguaguggaagcugggguggugaguccucucuggggcugg

SEQ ID NO: 39738 - RNA, 46 nt, Mus musculus
agcacacauguccaaaccccuuugacauuuaguauacauuaagaag

SEQ ID NO: 39739 - RNA, 41 nt, Mus musculus
aagcaauaggcaggaacagaagaucuuaguaauccacaagg

SEQ ID NO: 39740 - RNA, 46 nt, Mus musculus
uggggauugucuaugguguuauaggaggcuugcagaggaggagagg

SEQ ID NO: 39741 - RNA, 46 nt, Mus musculus
uaacaaccaguugauuuaugugacuuuacuuggcgccaagagguaa

SEQ ID NO: 39742 - RNA, 49 nt, Mus musculus
uggccuugccugucuccggauugaggggugaauccaaccagaugguguu

SEQ ID NO: 39743 - RNA, 47 nt, Mus musculus
uggaaauaacagguccagcuagggcagagaauaaagaugucguccac

SEQ ID NO: 39744 - RNA, 45 nt, Mus musculus
aacagcauucuucuuucagggcugcacacaauccucccucuuuua

SEQ ID NO: 39745 - RNA, 46 nt, Mus musculus
agaggaaggauuccaguaggcaucuccuguuguuucacauccccau

SEQ ID NO: 39746 - RNA, 42 nt, Mus musculus
auuugccuagcgggguuuuaagcacugaaaauucugcgccug

SEQ ID NO: 39747 - RNA, 47 nt, Mus musculus
cuucucuuccucuguuucucucuugugauacacuuucucagccucuc

SEQ ID NO: 39748 - RNA, 55 nt, Mus musculus
gauggccuugccugucuccggauugaggggugaauccaaccagaugguguuagcu

SEQ ID NO: 39749 - RNA, 42 nt, Mus musculus
aaguuauaaaaucucaucuuccuucacacauuccagcaaaaa

SEQ ID NO: 39750 - RNA, 46 nt, Mus musculus
cagaauuuuuuugccacccuugcuugguuccugcacauuaugccag

SEQ ID NO: 39751 - RNA, 39 nt, Mus musculus
ucuuuaugaccgcauucagggcaaaaucagacucugcaa

SEQ ID NO: 39752 - RNA, 46 nt, Mus musculus
caacucucugaugugguggcagggguccuguaauugauaugguuag

SEQ ID NO: 39753 - RNA, 45 nt, Mus musculus
uucuucccauagggucuggaagauuggaguguugacagcaaugca

SEQ ID NO: 39754 - RNA, 45 nt, Mus musculus
agucucaggcacauucuauagaugcccccacacuaaccccgcucc

SEQ ID NO: 39755 - RNA, 45 nt, Mus musculus
aauauauauccaaaaccuuccaauaagcaaauaauccaugggaaa

SEQ ID NO: 39756 - RNA, 47 nt, Mus musculus
ucacaauucaguagucuccaauguuauaaaauuacacauacuggaga

SEQ ID NO: 39757 - RNA, 46 nt, Mus musculus
gagccaggucaaagaguaauguauuaaugccauuuuuuucugccag

SEQ ID NO: 39758 - RNA, 45 nt, Mus musculus
ccauggguggauagauugggagagcauggccaggugggugagccu

SEQ ID NO: 39759 - RNA, 46 nt, Mus musculus
uucuuuaaaaauauucaguugccaaaaacaaaagcaagguagaaga

SEQ ID NO: 39760 - RNA, 45 nt, Mus musculus
gguccuuugauagugauaagcccuaguauaggggaaugccugggc

SEQ ID NO: 39761 - RNA, 46 nt, Mus musculus
auagagagacucugcaccauaaggggaaacugagacagugcuguag

SEQ ID NO: 39762 - RNA, 44 nt, Mus musculus
ccuaagguuuauucaugaugcugacuguguguaucuuugaccag

SEQ ID NO: 39763 - RNA, 46 nt, Mus musculus
uucccaagcccagccaggaugcuccaucaagcauccuaaugaccag

SEQ ID NO: 39764 - RNA, 45 nt, Mus musculus
gagagagagagagagagaggagagagagagagagagagagaacau

SEQ ID NO: 39765 - RNA, 42 nt, Mus musculus
ggggguggcugggucucccucacaccuacccccagcccccag

SEQ ID NO: 39766 - RNA, 46 nt, Mus musculus
ccugggcauugaauucauuauaauauugggaaaaguaaagcuggaa

SEQ ID NO: 39767 - RNA, 42 nt, Mus musculus
gaggcuucacuuuucaaccaaguauuccagcaaggcuaagag

SEQ ID NO: 39768 - RNA, 42 nt, Mus musculus
cauagggauggagacagaagcaguggagauauucguggccaa

SEQ ID NO: 39769 - RNA, 46 nt, Mus musculus
cucugaguagucagugagguaacacaucucuguguuggggggguuu

SEQ ID NO: 39770 - RNA, 46 nt, Mus musculus
gccugguguacagagcaaguuucaggacagccagggcuacacagag

SEQ ID NO: 39771 - RNA, 46 nt, Mus musculus
gcgauggugcauggcccuaaccccaauccuugggaaaucgaggcag

SEQ ID NO: 39772 - RNA, 45 nt, Mus musculus
cauaaggaccuggguucagauccccagcacccguguaaagcgcca

SEQ ID NO: 39773 - RNA, 41 nt, Mus musculus
auaucugcauacacacacaaacacacacacgaaaagggaag

SEQ ID NO: 39774 - RNA, 46 nt, Mus musculus
acuguagccucugcaucccuggcuggacucaggcuucugguaccuu

SEQ ID NO: 39775 - RNA, 45 nt, Mus musculus
augacauucauauauaauaugagauuuuccuacaaccacauggaa

SEQ ID NO: 39776 - RNA, 45 nt, Mus musculus
acgaggaugaggaugaggacgaggaacaauauucugcuggucacc

SEQ ID NO: 39777 - RNA, 46 nt, Mus musculus
ccuccuuaucucauacugcuuaugccauuggucucaggugcuuaag

SEQ ID NO: 39778 - RNA, 46 nt, Mus musculus
auaguuuuaguacaucuugggaacaagggcaugugugugugugugu

SEQ ID NO: 39779 - RNA, 73 nt, Mus musculus
caaugaggugaguggaugcugcgugcaugagcuggaaaccaagggucuguggcaaggcuguggggugcagggc

SEQ ID NO: 39780 - RNA, 45 nt, Mus musculus
caaagagucaugauauggucuuacucuauguugggguguggauua

SEQ ID NO: 39781 - RNA, 45 nt, Mus musculus
gauaaggaaagaggacccuaaaccuugguagaagcaaggcuguga

SEQ ID NO: 39782 - RNA, 46 nt, Mus musculus
ugucucugucucucucugucucugucugucucucuguguguuugug

SEQ ID NO: 39783 - RNA, 46 nt, Mus musculus
aucuagcaccuagugcuuagaauucauaagcuucugagcaguucag

SEQ ID NO: 39784 - RNA, 42 nt, Mus musculus; identical to SEQ ID NO: 39707

SEQ ID NO: 39785 - RNA, 46 nt, Mus musculus
aggcugugugaguccagagacuacggcuguccacagcuugggaaag

SEQ ID NO: 39786 - RNA, 99 nt, Mus musculus
uguguagcaguagugaaccgaugacuacauuucuuuuggucagaauuuuaagaucaagguagacauuuuaaaauacuugugccagagguugguguucgg

SEQ ID NO: 39787 - RNA, 51 nt, Mus musculus
aagcuaugucauuacauccuuuccccuugcuugaacaaagcauucgcuauu

SEQ ID NO: 39788 - RNA, 42 nt, Mus musculus
cacccucauccccuuucuuuucucucuccugucuucccaaag

SEQ ID NO: 39789 - RNA, 49 nt, Mus musculus
uggacgaugaccugccugagagcgcgccugagucugagggagagucuga

SEQ ID NO: 39790 - RNA, 44 nt, Mus musculus
ucacccucuagagggaacagcuauuuauuuugcuauggacaaag

SEQ ID NO: 39791 - RNA, 45 nt, Mus musculus
uagagaacaggaagacuggacugcuuacauguggucagggaugug

SEQ ID NO: 39792 - RNA, 46 nt, Mus musculus
gguggggaacugcacuucuggcuuuuggucagaauuguagcccaag

SEQ ID NO: 39793 - RNA, 44 nt, Mus musculus
cugagacguuaguaucagggcagacagaaggccugugaucagag

SEQ ID NO: 39794 - RNA, 54 nt, Mus musculus
uuggggagagaauuugcacuuuggcuguggagugaugugaagcuguuagagggu

SEQ ID NO: 39795 - RNA, 46 nt, Mus musculus
agugaccuuaguaaugauggugauggugaugaagaaggagaggagg

SEQ ID NO: 39796 - RNA, 46 nt, Mus musculus
ggaggaaaaagaagacacaauggagacaugacgguggaagugucag

SEQ ID NO: 39797 - RNA, 44 nt, Mus musculus
gagcuggaauguguugggaacuaaaagggggcccuggggaagaa

SEQ ID NO: 39798 - RNA, 55 nt, Mus musculus
caagcacagugggccuugaugaacagagacauucuaugguuuuagagcuuuauua

SEQ ID NO: 39799 - RNA, 56 nt, Mus musculus
agaggccccccuagaagccuagaaggggggaggcuagauagaaagagaguaagagg

SEQ ID NO: 39800 - RNA, 53 nt, Mus musculus
agaggagaggagaggagaacacaaagagaaaggaaagaggagagaggagugca

SEQ ID NO: 39801 - RNA, 45 nt, Mus musculus
uccauaucauugcccauaucguuuggaccuuaguuaggcuggcuu

SEQ ID NO: 39802 - RNA, 85 nt, Mus musculus
uucagaauuuuuuaugguuuuauugaaaaauuauagaccucugagaggauauucuucuauuucgacuguuuguaauuucaccuuc

SEQ ID NO: 39803 - RNA, 45 nt, Mus musculus
uuguuuguugccaugaaacuuuuagaauccacauuuuuuaacuga

SEQ ID NO: 39804 - RNA, 45 nt, Mus musculus
uuugugauauuaaaagcugggagaagagacaggcaggaacagaag

SEQ ID NO: 39805 - RNA, 47 nt, Mus musculus
ucuaaggaaccuuaccuuguguccuuucaggcauggaaugugguaga

SEQ ID NO: 39806 - RNA, 45 nt, Mus musculus
uuuccagcauguauuuauucaugucuuaugaaugaagacagacca

SEQ ID NO: 39807 - RNA, 46 nt, Mus musculus
ugaucaauuugguuaacaaggguuaacgcauaaguagggccugggc

SEQ ID NO: 39808 - RNA, 45 nt, Mus musculus
aucugggggcuuugagacacuuugagaaaauauggacaaggugga

SEQ ID NO: 39809 - RNA, 45 nt, Mus musculus
aaaccaccaaccaaaaagaaucccauggcuccagcugcauaugua

SEQ ID NO: 39810 - RNA, 45 nt, Mus musculus
ugguccugugauggugcuaugcccuaguauaggggaaugccuggg

SEQ ID NO: 39811 - RNA, 42 nt, Mus musculus
ccuacccccagcccaagacacccaagcuccuacagcauucaa

SEQ ID NO: 39812 - RNA, 46 nt, Mus musculus
uguguguagagucuucccauuuugacaaaguauuccaggagguaag

SEQ ID NO: 39813 - RNA, 46 nt, Mus musculus
acuguaaccucugcaucccuggcuggacucaggcuucugguaccuu

SEQ ID NO: 39814 - RNA, 41 nt, Mus musculus
gaugaggaugaggaggacaaggaacaauauucugccgguca

SEQ ID NO: 39815 - RNA, 44 nt, Mus musculus
uucucuggugauccucucucccaggugaugggguguaucuguca

SEQ ID NO: 39816 - RNA, 46 nt, Mus musculus
uugguccucugucccaagcgucuguacugaauccuugucccguuug

SEQ ID NO: 39817 - RNA, 46 nt, Mus musculus
ucuguguguguguguguguguauguguguguguuuguguguauguc

SEQ ID NO: 39818 - RNA, 31 nt, Mus musculus
cuggcagaacaauaucucagaggcauaauaa

SEQ ID NO: 39819 - RNA, 46 nt, Mus musculus
ucagguucuuugcucccauccucagagaggucaacuucggcuguag

SEQ ID NO: 39820 - RNA, 45 nt, Mus musculus
ccaucccaucuugggaggccuggcaguucccacuacuugcaacag

SEQ ID NO: 39821 - RNA, 50 nt, Mus musculus
gaagcaggcuuggaagaggcugugugaguccagggaccacggcuguccac

SEQ ID NO: 39822 - RNA, 48 nt, Mus musculus
uggacucacaaaagguagcuggagaacgagacacacauguguaguagu

SEQ ID NO: 39823 - RNA, 46 nt, Mus musculus
uauuaggcuuugccugggcagggggugggguggggugggggacuag

SEQ ID NO: 39824 - RNA, 46 nt, Mus musculus
ucauccucgucuccuuucuuuccucucaccccucuucccaaagauc

SEQ ID NO: 39825 - RNA, 46 nt, Mus musculus
guuguccuugguuaucuuggaaauugcuuugcuguucuaacugcca

SEQ ID NO: 39826 - RNA, 46 nt, Mus musculus; identical to SEQ ID NO: 39713

SEQ ID NO: 39827 - RNA, 45 nt, Mus musculus
uugugugauguagauucaggacuuuguucuccauacuuguaggaa

SEQ ID NO: 39828 - RNA, 45 nt, Mus musculus
ggaaaagggcugagaugugaguaucagggcagagagaaggucugu

SEQ ID NO: 39829 - RNA, 46 nt, Mus musculus
gaauugcuugguugugggugcugggcaugaaacuugguaccuccag

SEQ ID NO: 39830 - RNA, 45 nt, Mus musculus
uucacaguuuaaagacauuucagugcuuguuccuaggccuaggag

SEQ ID NO: 39831 - RNA, 88 nt, Mus musculus
agcacuaagugaacuuaguaacgaugaugauugugaugaagaaggagaaggaggaggaggaggaagaagagaagagaaagaggaggag

SEQ ID NO: 39832 - RNA, 40 nt, Mus musculus
ggaggaaaaagaagucauaauggagacaugaaggcgcaag

SEQ ID NO: 39833 - RNA, 44 nt, Mus musculus
cucacagagaacaggggcaggcagcugacuagccugagcuggaa

SEQ ID NO: 39834 - RNA, 44 nt, Mus musculus
uaugggagagagggaugaggaaugagagguucccacaccgguga

SEQ ID NO: 39835 - RNA, 48 nt, Mus musculus
ugaauggagacauccuaugguuuuagagcuuuauuauagaaaggcagg

SEQ ID NO: 39836 - RNA, 46 nt, Mus musculus
gaagagagagaguccccccuagaagacuagaagggggaaggcuaga

SEQ ID NO: 39837 - RNA, 54 nt, Mus musculus
cagugcaaaaagugagagguaagagauagaaggagugagagcaagagagauagg

SEQ ID NO: 39838 - RNA, 47 nt, Mus musculus
aaucguuuggaccuuaguuaagcuggcuugugaaaacaagggugguu

SEQ ID NO: 39839 - RNA, 48 nt, Mus musculus
uuucuguugcaguuuuuuucauauuuuuuuuugcaucacauguuuaau

SEQ ID NO: 39840 - RNA, 45 nt, Mus musculus
uuucagaauauuuuugugguuuuauugaaaaauuauagaccucug

SEQ ID NO: 39841 - RNA, 64 nt, Mus musculus
gcuugaguugcauuuggugaccacagguuguggagaaaacuaacacauugagaagucugccaug

SEQ ID NO: 39842 - RNA, 46 nt, Mus musculus
uguucauaaaaccaugggucacguaaaggcuaguaauugaccacug

SEQ ID NO: 39843 - RNA, 46 nt, Mus musculus
uggcucacaaccauccauaacgaaaucugaugcccucuucuuggag

SEQ ID NO: 39844 - RNA, 45 nt, Mus musculus
ccuuugcaagacccagucaucuucaauaucaugaaagaacccaua

SEQ ID NO: 39845 - RNA, 46 nt, Mus musculus
aacccuaugaauguaaucaaugugguaaagacuuugcaggucacag

SEQ ID NO: 39846 - RNA, 46 nt, Mus musculus
cuaagcauucagcuuagauuuaacccgauguuugauuaaucccaag

SEQ ID NO: 39847 - RNA, 45 nt, Mus musculus
agccaggucaaagaguauuguauuaaugccauuguuuucugccag

SEQ ID NO: 39848 - RNA, 46 nt, Mus musculus
uauauauauauauauguguguguguguguguuuguguguguguaua

SEQ ID NO: 39849 - RNA, 32 nt, Mus musculus
agaaauauggccaacaauuauuuccuugggau

SEQ ID NO: 39850 - RNA, 46 nt, Mus musculus
aaggcagagcacauggaguggaaaacuacccuuggcacaugcgcag

SEQ ID NO: 39851 - RNA, 45 nt, Mus musculus
ggcagugacagcacaaaacuucaaucacagcauucgugaagcaga

SEQ ID NO: 39852 - RNA, 45 nt, Mus musculus
cagagagguccaagguagcccugcagcuuaugucuguggaccuga

SEQ ID NO: 39853 - RNA, 45 nt, Mus musculus
auaacauucauauauaauaugagauuuuccuacaaccacauggaa

SEQ ID NO: 39854 - RNA, 46 nt, Mus musculus
cgaggaugaggaugaggaggaagaggaacaauauucugccggucac

SEQ ID NO: 39855 - RNA, 46 nt, Mus musculus
uguuggucaucugucccaagugucuguccugaauccuuguccccuu

SEQ ID NO: 39856 - RNA, 24 nt, Mus musculus
guuccacgcagacacaaugaccca

SEQ ID NO: 39857 - RNA, 45 nt, Mus musculus; identical to SEQ ID NO: 39780

SEQ ID NO: 39858 - RNA, 41 nt, Mus musculus
ugcuccuguucagagcuggauguagguagcuucugggggua

SEQ ID NO: 39859 - RNA, 46 nt, Mus musculus
uguagagugaugauucuggccaauggacuacuguuauguggacugg

SEQ ID NO: 39860 - RNA, 90 nt, Mus musculus
uaaacugcuuugagaagaacguagugucauugcuccuuucugcugguuggaauuggaggcgacaaaugguggccuguacggggauguuca

SEQ ID NO: 39861 - RNA, 39 nt, Mus musculus
aagcagcaauaaaugcuggcaacggccagccagccuggg

SEQ ID NO: 39862 - RNA, 41 nt, Mus musculus
uguuacauggacugggcugaugcggcaugguugagagguua

SEQ ID NO: 39863 - RNA, 41 nt, Mus musculus
ggcagauggacacaaacaaugaagguaggaaacauggcagg

SEQ ID NO: 39864 - RNA, 46 nt, Mus musculus
acacacacacacacacacagagagagagagagagagagagauagag

SEQ ID NO: 39865 - RNA, 42 nt, Mus musculus
acugagccucguuguaccuaggacucugagguucuaccacag

SEQ ID NO: 39866 - RNA, 55 nt, Mus musculus
aaggaaggacuacaucacagccaaguacauggagaggagauaugcacggaaaaag

SEQ ID NO: 39867 - RNA, 42 nt, Mus musculus
cauguaagaggggcugcaaaggaugggaaaugcgggguagga

SEQ ID NO: 39868 - RNA, 26 nt, Mus musculus
cuuggaccacaaguguuuucauucgg

SEQ ID NO: 39869 - RNA, 46 nt, Mus musculus
uuuccaguaacugggaacccagucaaaccagcauccucaaaccuau

SEQ ID NO: 39870 - RNA, 42 nt, Mus musculus
auuucaggagccagaugagacagcccuccaucuugcagucag

SEQ ID NO: 39871 - RNA, 46 nt, Mus musculus
ucaugauagucuuguauuuuaauuacacuuugaugauuugcuauag

SEQ ID NO: 39872 - RNA, 45 nt, Mus musculus
guucuguacuuacugugugaggaauaaaugccauuagccugaauu

SEQ ID NO: 39873 - RNA, 27 nt, Mus musculus
uguauguugucuccaaaugcggccugu

SEQ ID NO: 39874 - RNA, 45 nt, Mus musculus
cucauucaagcugcagcgucagagccgaguugacagcaaagagac

SEQ ID NO: 39875 - RNA, 46 nt, Mus musculus
gauggacaccauccaggaagaccccagcacagacucacaugcagau

SEQ ID NO: 39876 - RNA, 46 nt, Mus musculus
ccuuuccugcaccccagacuccaggucgucugcaggcccugcagcc

SEQ ID NO: 39877 - RNA, 76 nt, Mus musculus
gcacuguagcugucuuuagacacaccagaagagggcgucagaucucauuacggguggcugcacugaauucuugcca

SEQ ID NO: 39878 - RNA, 46 nt, Mus musculus
uccugggcuaguggaaguuaaaaggaucugauuggauguggcagau

SEQ ID NO: 39879 - RNA, 45 nt, Mus musculus
cagagccgggugugguggugcacaccuuuaaucccagcacucggg

SEQ ID NO: 39880 - RNA, 41 nt, Mus musculus
gacguaauugagcgauuuugggauuucauugaccagcugag

SEQ ID NO: 39881 - RNA, 46 nt, Mus musculus
cugagugucugcacaucuggugcugacugcugacuuugacccuaga

SEQ ID NO: 39882 - RNA, 46 nt, Mus musculus
uccagggaauagcagugagugccccccacccggagaugcugaagau

SEQ ID NO: 39883 - RNA, 46 nt, Mus musculus
uuuucaaacugcaguaaacaguccaucuacaagaccauagaaagua

SEQ ID NO: 39884 - RNA, 62 nt, Mus musculus
acccugaugggcuagcagaaugugccccaaaugaggaccaaggaggaaaguaugucauguau

SEQ ID NO: 39885 - RNA, 45 nt, Mus musculus
agucccagcagccacaugguggcuuacaaccaucuguaaugggau

SEQ ID NO: 39886 - RNA, 42 nt, Mus musculus
ccuuucucagcacaagcccucuguccucaugcugcagccuca

SEQ ID NO: 39887 - RNA, 84 nt, Mus musculus
cuggcucaucuuuucacguaccaggauuuugauaugggaacucuuggauuagcuuacguugguucucccagagcaaacagucau

SEQ ID NO: 39888 - RNA, 46 nt, Mus musculus
cucuuuagcaucugaugucuuccuuugugagugucuguguccugau

SEQ ID NO: 39889 - RNA, 46 nt, Mus musculus
uccuggaacuugcucuguagaccagacuggccuugaacucagagau

SEQ ID NO: 39890 - RNA, 45 nt, Mus musculus
uccacaagagguaaaaccuggugaaagacacuucaauauggcaaa

SEQ ID NO: 39891 - RNA, 45 nt, Mus musculus
uauguauguauuuauuauauguaaguacacuguagcuguccucag

SEQ ID NO: 39892 - RNA, 64 nt, Mus musculus
uugaugacauauaccggaacacgucgugggauaaugcaggguuuaaaggguauggagugcagau

SEQ ID NO: 39893 - RNA, 45 nt, Mus musculus
acauaugaagaccaugcacauacauacacguguuccccccaggca

SEQ ID NO: 39894 - RNA, 85 nt, Mus musculus
aaccuaaccccuugaagaauacuuguaaauuacuggugguagcagaucaucgauuuuauaaauacaugggccguggagaagagag

SEQ ID NO: 39895 - RNA, 46 nt, Mus musculus
cugucuucaaaugcaccagaagagggcgucagaucucauuacggau

SEQ ID NO: 39896 - RNA, 46 nt, Mus musculus
agcacuugggaggcagaggcagaggcagaggcagaggcaggcgaau

SEQ ID NO: 39897 - RNA, 46 nt, Mus musculus
ugagccaucaugugguuacugggaaucgaacacaggaccucuggaa

SEQ ID NO: 39898 - RNA, 46 nt, Mus musculus
uuauguaucugaguacacuguagcuaucuucagacacaccagaaga

SEQ ID NO: 39899 - RNA, 45 nt, Mus musculus
ucacguuugcagucuccaaaaguaugugguuauuuaaaugcagau

SEQ ID NO: 39900 - RNA, 46 nt, Mus musculus
agcccacauaggagaugaugauguuacagugagaaucaacacagau

SEQ ID NO: 39901 - RNA, 47 nt, Mus musculus
uggcagaguccuaugauggaggagguggcucaccucacaggccagga

SEQ ID NO: 39902 - RNA, 46 nt, Mus musculus
accgaacgcuuuucacaaaacuugagagucguggugguggacggga

SEQ ID NO: 39903 - RNA, 46 nt, Mus musculus
uucaaauagcaguggaagaccaaagaauuuaagccagacugcagua

SEQ ID NO: 39904 - RNA, 46 nt, Mus musculus
guggugacuuggucugguaaagcaguugguguugguuuccuucuga

SEQ ID NO: 39905 - RNA, 42 nt, Mus musculus
agaaagaaagaaagaaaaguucuuauuuuggaggggccaggg

SEQ ID NO: 39906 - RNA, 45 nt, Mus musculus
ucuguugcagagguuguaggagaaugugcccacuaagggcuaaag

SEQ ID NO: 39907 - RNA, 48 nt, Mus musculus
uagaauauguauucaggaaaguugagacaaagguaggaagauagagaa

SEQ ID NO: 39908 - RNA, 46 nt, Mus musculus
cuggggacuauugacgaugauugucuuacuugaguuugcaccagug

SEQ ID NO: 39909 - RNA, 45 nt, Mus musculus
uguaguguguccaaaaucauuugucauuuguuuuucugguuagag

SEQ ID NO: 39910 - RNA, 25 nt, Mus musculus
caaacaggaauuauagacucugaag

SEQ ID NO: 39911 - RNA, 46 nt, Mus musculus
uuuuuguuguuggagauagcaccuguauacaaguggaaguguaauu

SEQ ID NO: 39912 - RNA, 46 nt, Mus musculus
aaauugccuagaaacuuaggguuucuacuuuaauuuuuuuagagau

SEQ ID NO: 39913 - RNA, 46 nt, Mus musculus
uuauugugaaauugaucauuuguuuaggguacaguuuaugagaguc

SEQ ID NO: 39914 - RNA, 60 nt, Mus musculus
auauaaguacacuguagcuguccgcagauacuccagaagagggcaucaaauuuuguuaca

SEQ ID NO: 39915 - RNA, 46 nt, Mus musculus
caccuguuccuaacacuccccuucuuucuugacuacagucccaucc

SEQ ID NO: 39916 - RNA, 42 nt, Mus musculus
uccaugaaggguggcaauauugggaagcaaguggucuugggu

SEQ ID NO: 39917 - RNA, 46 nt, Mus musculus
ggcaaucugcaccucuauucaccuuccagcuguuuggccaccucuu

SEQ ID NO: 39918 - RNA, 45 nt, Mus musculus
cucuccuauugcuccucacuugcaccaucgggggugaccucugaa

SEQ ID NO: 39919 - RNA, 42 nt, Mus musculus
ugugagaggaccucagggaagcucugauuucgaggcauggug

SEQ ID NO: 39920 - RNA, 44 nt, Mus musculus
gaggacaggcucaaaugcuaauguagugcaaaccacaccugaga

SEQ ID NO: 39921 - RNA, 49 nt, Mus musculus
gagugagagaagugagagguaagagaacaaaggagagagaucaagagag

SEQ ID NO: 39922 - RNA, 55 nt, Mus musculus
aaggcuagaagggggaaggcuagauagaaagaaaguaagagggagagaggaggag

SEQ ID NO: 39923 - RNA, 46 nt, Mus musculus
agagacauucuaugguuuuagagcuuuauuauagaaagucagggag

SEQ ID NO: 39924 - RNA, 65 nt, Mus musculus
cugcuuuucuaaaggccugggguuaugggagagaggaaugagggaugagagguucccacaccggu

SEQ ID NO: 39925 - RNA, 45 nt, Mus musculus
gacuagccugagcuggaauguguugggaacuaaaacggggcccug

SEQ ID NO: 39926 - RNA, 46 nt, Mus musculus
caagcagggauauauggguugguuuggaaaauagaaacgaugagau

SEQ ID NO: 39927 - RNA, 49 nt, Mus musculus
uuuugccaguugguugccagccagacauauaaauaauaguauacagauu

SEQ ID NO: 39928 - RNA, 45 nt, Mus musculus
caacaacuauuuccuagaacuuuaaacuuuccuuuagaggcauua

SEQ ID NO: 39929 - RNA, 46 nt, Mus musculus
ccaccuacagcacuuaauuuaauuaucugugcugaagcaggcagaa

SEQ ID NO: 39930 - RNA, 44 nt, Mus musculus
ucacccuaguccccuuucuuuccucucuccugucuucccaaaga

SEQ ID NO: 39931 - RNA, 46 nt, Mus musculus
cgcuauuaggcuucuucugggcaggggguggggugggggacuagac

SEQ ID NO: 39932 - RNA, 68 nt, Mus musculus
acaucgagaaggaagcaauuuggguugaaaauugaagcaggcuuggaagaggcugagugaguccagag

SEQ ID NO: 39933 - RNA, 45 nt, Mus musculus
aucccaucuugggaggccuggcaguucccacuacuugccacagag

SEQ ID NO: 39934 - RNA, 46 nt, Mus musculus
aguacauggcuuuucuaguccagaucuuggauuuuuggucugaguc

SEQ ID NO: 39935 - RNA, 44 nt, Mus musculus
augccugggccaggaaucaggaguguguggguuggggagcauag

SEQ ID NO: 39936 - RNA, 45 nt, Mus musculus
cagacacauggcaggagggccccugcuggaaaaacuguuccguuu

SEQ ID NO: 39937 - RNA, 45 nt, Mus musculus
ucaugugacagaucacaguaacugauauugcacacaggagccagg

SEQ ID NO: 39938 - RNA, 45 nt, Mus musculus
gaaugucagcagugugguaaagccuuuacauuguuggguccaguc

SEQ ID NO: 39939 - RNA, 45 nt, Mus musculus
ucacaguugucuccaguaucauaaaagaacccauaaugucgagaa

SEQ ID NO: 39940 - RNA, 41 nt, Mus musculus
gguggguaggggagcaguguugggggaguguaugggggacu

SEQ ID NO: 39941 - RNA, 46 nt, Mus musculus; identical to SEQ ID NO: 39913

SEQ ID NO: 39942 - RNA, 60 nt, Mus musculus; identical to SEQ ID NO: 39914

SEQ ID NO: 39943 - RNA, 46 nt, Mus musculus; identical to SEQ ID NO: 39915

SEQ ID NO: 39944 - RNA, 42 nt, Mus musculus; identical to SEQ ID NO: 39916

SEQ ID NO: 39945 - RNA, 46 nt, Mus musculus; identical to SEQ ID NO: 39917

SEQ ID NO: 39946 - RNA, 45 nt, Mus musculus; identical to SEQ ID NO: 39918

SEQ ID NO: 39947 - RNA, 42 nt, Mus musculus; identical to SEQ ID NO: 39919

SEQ ID NO: 39948 - RNA, 44 nt, Mus musculus; identical to SEQ ID NO: 39920

SEQ ID NO: 39949 - RNA, 49 nt, Mus musculus; identical to SEQ ID NO: 39921

SEQ ID NO: 39950 - RNA, 55 nt, Mus musculus; identical to SEQ ID NO: 39922

SEQ ID NO: 39951 - RNA, 46 nt, Mus musculus; identical to SEQ ID NO: 39923

SEQ ID NO: 39952 - RNA, 65 nt, Mus musculus; identical to SEQ ID NO: 39924

SEQ ID NO: 39953 - RNA, 45 nt, Mus musculus; identical to SEQ ID NO: 39925

SEQ ID NO: 39954 - RNA, 46 nt, Mus musculus; identical to SEQ ID NO: 39926

SEQ ID NO: 39955 - RNA, 49 nt, Mus musculus; identical to SEQ ID NO: 39927

SEQ ID NO: 39956 - RNA, 45 nt, Mus musculus; identical to SEQ ID NO: 39928

SEQ ID NO: 39957 - RNA, 46 nt, Mus musculus; identical to SEQ ID NO: 39929

SEQ ID NO: 39958 - RNA, 44 nt, Mus musculus; identical to SEQ ID NO: 39930

SEQ ID NO: 39959 - RNA, 50 nt, Mus musculus
cauucgcuauuaggcuucuucugggcaggggguggggugggggacuagac

SEQ ID NO: 39960 - RNA, 69 nt, Mus musculus
gacuucgagaaggaagcaauuuggguugaaaauugaagcaggcuuggaagaggcugagugaguccagag

SEQ ID NO: 39961 - RNA, 45 nt, Mus musculus; identical to SEQ ID NO: 39933

SEQ ID NO: 39962 - RNA, 46 nt, Mus musculus; identical to SEQ ID NO: 39819

SEQ ID NO: 39963 - RNA, 45 nt, Mus musculus
ccaucccaucuugggaggccuggcaguucccacuacuugccacag

SEQ ID NO: 39964 - RNA, 46 nt, Mus musculus
cuuggggaagccucacuuacaucauuuucuuuaccuccccaacaga

SEQ ID NO: 39965 - RNA, 46 nt, Mus musculus
uuaacaucaagguacauauauuaaaauacuugugucagaggcuggu

SEQ ID NO: 39966 - RNA, 42 nt, Mus musculus
aacaaagcauucgcuauuaggcgggggaugggguuggggacu

SEQ ID NO: 39967 - RNA, 46 nt, Mus musculus; identical to SEQ ID NO: 39824

SEQ ID NO: 39968 - RNA, 53 nt, Mus musculus
gggagagcugggaggagccauaaguacugagggaugcugagagagcugggaga

SEQ ID NO: 39969 - RNA, 44 nt, Mus musculus
gggagagcugggaggagccauaaguacugagagaugcugggaga

SEQ ID NO: 39970 - RNA, 45 nt, Mus musculus
gagcugggaggagccauaaguacugagggaugcugagagagcugg

SEQ ID NO: 39971 - RNA, 45 nt, Mus musculus; identical to SEQ ID NO: 39970

SEQ ID NO: 39972 - RNA, 44 nt, Mus musculus; identical to SEQ ID NO: 39969

SEQ ID NO: 39973 - RNA, 46 nt, Mus musculus
cuuuggcacaaacaucccauuuccuucugguaauaaggcugccugg

SEQ ID NO: 39974 - RNA, 46 nt, Mus musculus
gccgggcccgacgagggcgagguggacucgugccuaccgcaaggaa

SEQ ID NO: 39975 - RNA, 44 nt, Mus musculus
gucggcccgcuuccggaagguggacguggacgaauaugaggaga

SEQ ID NO: 39976 - RNA, 42 nt, Mus musculus
aaaugaacaaaaagaaagaaagagagagagagagagagagag

SEQ ID NO: 39977 - RNA, 46 nt, Mus musculus
uguaauuacaucaaggccuuuucgugauucuuugggugcacgccga

SEQ ID NO: 39978 - RNA, 41 nt, Mus musculus
ggucccgagacacaugguggcucacaaccaucuguaauggg

SEQ ID NO: 39979 - RNA, 50 nt, Mus musculus
uucugcauguauuacucuuagaaguaaacacaaguuaaaacaaccugacg

SEQ ID NO: 39980 - RNA, 45 nt, Mus musculus
cuuguaacucagcaaggcuugugaauggaaauaacagugcccagu

SEQ ID NO: 39981 - RNA, 41 nt, Mus musculus
caaagguccugaguucaauucccagcaaucacgugguggcu

SEQ ID NO: 39982 - RNA, 47 nt, Mus musculus
ggcgcuccucagggggagaaugggaggauggggaaagacuuggagga

SEQ ID NO: 39983 - RNA, 75 nt, Mus musculus
ugggguaggguggcacugcagggaggugcaacaggguuaguauuguauggaagggagccuuaaagggugcagagu

SEQ ID NO: 39984 - RNA, 44 nt, Mus musculus
agacuagcacugucggaaaggaggucguuggggcuucagguaca

SEQ ID NO: 39985 - RNA, 93 nt, Mus musculus
agagcagagacaaggugagaggaggagggagacagaaaaggagagccggagaugugugugugagugugagagagagagaauguccaagggagg

SEQ ID NO: 39986 - RNA, 46 nt, Mus musculus
acaauuuugcuagaggugauuuaaaauauuuaucgauauggcccag

SEQ ID NO: 39987 - RNA, 29 nt, Mus musculus
gucuccgccgcugcccucguucgccaugc

SEQ ID NO: 39988 - RNA, 45 nt, Mus musculus
gcggggugcggacggagagcauggcgaacgagggcagcggcggag

SEQ ID NO: 39989 - RNA, 45 nt, Mus musculus
cugcaguugucgccgcugaagcgacucacccuggcugacaaggag

SEQ ID NO: 39990 - RNA, 47 nt, Mus musculus
aagugcccaaggucagaguugccuuggugagaggagcucaccagcag

SEQ ID NO: 39991 - RNA, 37 nt, Mus musculus
auaaagcagugagugagucccaggcaccuuggcagag

SEQ ID NO: 39992 - RNA, 46 nt, Mus musculus
uaauaagcucauuggaaaauguaaggcccggcaucagcccccguuu

SEQ ID NO: 39993 - RNA, 41 nt, Mus musculus
cuggagccagagacaagaucaccaugaauuugaggccaguu

SEQ ID NO: 39994 - RNA, 45 nt, Mus musculus
ucccucuauuuuaaaggaauggaaacauugcuucuuugccugguu

SEQ ID NO: 39995 - RNA, 46 nt, Mus musculus
uaucaauccccugugcguauuuguccccaguuuguccuauguuuaa

SEQ ID NO: 39996 - RNA, 45 nt, Mus musculus
cacugcagcuuucugccucucucuuccuaguagacugugccacgc

SEQ ID NO: 39997 - RNA, 42 nt, Mus musculus
ggauggacagcucucaugugggcgugcuacaaaggcaggacg

SEQ ID NO: 39998 - RNA, 56 nt, Mus musculus
gaggagcaggaagagaggagacagcugaguaauguccugaugagaugggaggauag

SEQ ID NO: 39999 - RNA, 45 nt, Mus musculus
ucauuuggaaugugugaagcauuuguuggccaugggagcugaugu

SEQ ID NO: 40000 - RNA, 45 nt, Mus musculus
uaagaauucgaugacugcacugauuguggcagugaaagggggcua

SEQ ID NO: 40001 - RNA, 47 nt, Mus musculus
gauugcgucgaaggagggacauauagaaauugugcaggaccuguugg

SEQ ID NO: 40002 - RNA, 59 nt, Mus musculus
ugcaggccucuuccauuugugucucagagcaaucaguguagaugagagcuggggauuga

SEQ ID NO: 40003 - RNA, 47 nt, Mus musculus
gaagagucagguacagacacuuacacacagccaauggacauaagcag

SEQ ID NO: 40004 - RNA, 37 nt, Mus musculus
guucuguagccuauaaugagaguucaagagcaagaag

SEQ ID NO: 40005 - RNA, 45 nt, Mus musculus
ugauuccugccuuugcuuaugggaacaauauuucauacaagccaa

SEQ ID NO: 40006 - RNA, 41 nt, Mus musculus
uuccuggcaaccgcaugguggcucacaaccaucuguaaugg

SEQ ID NO: 40007 - RNA, 35 nt, Mus musculus
ucuuuuauaaucuuucuuuuuauuguuggcugcau

SEQ ID NO: 40008 - RNA, 46 nt, Mus musculus
agaaaacgccuccauagugcugccuccaaauuacauaagcugaaaa

SEQ ID NO: 40009 - RNA, 45 nt, Mus musculus
cuuacaauugcauugcuuuuuaggccugaauaauauuguugccug

SEQ ID NO: 40010 - RNA, 42 nt, Mus musculus
uauaguucauuuaccaguuuuccuuaauagucgugggcuuag

SEQ ID NO: 40011 - RNA, 35 nt, Mus musculus
gaaggcagaugcagagaaccaucacgaggcagaug

SEQ ID NO: 40012 - RNA, 46 nt, Mus musculus
uauaguuauaaaucucuuuaaaugagacuucaaucuuccaaugcug

SEQ ID NO: 40013 - RNA, 45 nt, Mus musculus
gggagcuggauuccaagaacagcuagagugccagccuggguggag

SEQ ID NO: 40014 - RNA, 49 nt, Mus musculus
ucauacuauaucugggagagacugaagguauuccugaccagaugacgcu

SEQ ID NO: 40015 - RNA, 45 nt, Mus musculus
uauaacagaagucuuucuuuagauaaaauaaggaacacuagcagg

SEQ ID NO: 40016 - RNA, 65 nt, Mus musculus
aaacauaccuacuaucauuguuuguagaaaagaaaaacggagagaaauuagcuaggcagguuggg

SEQ ID NO: 40017 - RNA, 46 nt, Mus musculus
uguucuguuauugcuacuggauuuguagccaauuaaagggugugag

SEQ ID NO: 40018 - RNA, 46 nt, Mus musculus
guagaccagacuggccuggaacucacagagaacugacugcugggaa

SEQ ID NO: 40019 - RNA, 41 nt, Mus musculus
aaaaaaaaugaguuuuauggggcuagagagauggugcaaca

SEQ ID NO: 40020 - RNA, 44 nt, Mus musculus
cccaacaacuaaagauguugagccacuucuugaaauugauggag

SEQ ID NO: 40021 - RNA, 44 nt, Mus musculus
ccuuuuugccaugcacgguaaaccuggaucccaaacuacgggag

SEQ ID NO: 40022 - RNA, 46 nt, Mus musculus
uaggaggccuugcguaucccccgcucccucugcacgaagccccucc

SEQ ID NO: 40023 - RNA, 47 nt, Mus musculus
gggccguucccaggcggcguuguguccccacagccccacagcagcua

SEQ ID NO: 40024 - RNA, 46 nt, Mus musculus
caacaucucaucucacguucaucaguaaaaacgaguuugcccagag

SEQ ID NO: 40025 - RNA, 49 nt, Mus musculus
cagacaugaugcuggagaaggaauugagaguuguacaucuggauuggca

SEQ ID NO: 40026 - RNA, 46 nt, Mus musculus
aaauaacuucacaauuuccagugucuucuuacuauuacguuuagag

SEQ ID NO: 40027 - RNA, 46 nt, Mus musculus
gacuaaucaguuuuuagcuuaucuaauaaauugacugaagaugugg

SEQ ID NO: 40028 - RNA, 41 nt, Mus musculus
cauccuaauucauuuacuuaaguauuuaguuuuaaggcuga

SEQ ID NO: 40029 - RNA, 42 nt, Mus musculus
uuauaauaggaaaaguaaugguuuuauugcugcccaggacag

SEQ ID NO: 40030 - RNA, 42 nt, Mus musculus
cccugaacuucagcuuugaagaacugaacacgcuuggccuag

SEQ ID NO: 40031 - RNA, 46 nt, Mus musculus
ucuagaacaagaaagggggaaggagaaugagcuaaagcaggaggag

SEQ ID NO: 40032 - RNA, 50 nt, Mus musculus
ggaugccacacagucugaguggccugcaagauccugucauagcucggaug

SEQ ID NO: 40033 - RNA, 128 nt, Mus musculus
aaagccccucugagugcagccugaucgcuagcagcccugaagaaagcuggccuucgugccagaaggccuacaaucuaaaccgaacacccagcacugugacucugaacaacaacacugcgcccaccaac

SEQ ID NO: 40034 - RNA, 79 nt, Mus musculus
ugcgucugagcugcaugcagccuccucagauagcacgggcuuuggggaagagagagaaagcauucucugaggaagagag

SEQ ID NO: 40035 - RNA, 46 nt, Mus musculus
gcaucacagacaccugauagguggcaggcacuggggaagcagacgg

SEQ ID NO: 40036 - RNA, 44 nt, Mus musculus
acgcacagcucugcagagaugagaucaggcugaauacagagaga

SEQ ID NO: 40037 - RNA, 46 nt, Mus musculus
uauagguuuuagaguagcccagaaacuaaaagugaauaccuagcaa

SEQ ID NO: 40038 - RNA, 45 nt, Mus musculus
agcccaaagcaguggccugggccauggugagucguuagcagagga

SEQ ID NO: 40039 - RNA, 42 nt, Mus musculus
uacguagaucagcucuagugguguguccugagccauggguag

SEQ ID NO: 40040 - RNA, 44 nt, Mus musculus
ggaaaggaaaggaaaggaaaggaaaggaaaggaaagaauggaag

SEQ ID NO: 40041 - RNA, 46 nt, Mus musculus
gcacuagaguuugucuucuuuuuuguuggguagcugugcuauagcc

SEQ ID NO: 40042 - RNA, 45 nt, Mus musculus
ggucaccuucuuguucugggggaugcugggcaccaguuccuugag

SEQ ID NO: 40043 - RNA, 46 nt, Mus musculus
cuacuucacccuuaaaagacuaacuuccauauacaaaggagcagga

SEQ ID NO: 40044 - RNA, 41 nt, Mus musculus
guuaaaauacauuaguaaguuuggucacgagggaaggacaa

SEQ ID NO: 40045 - RNA, 45 nt, Mus musculus
cacugagugagcucccuuguuguugcaugggauggcaauguccac

SEQ ID NO: 40046 - RNA, 74 nt, Mus musculus
cuucagguuuaugauguagauacugucacuuuuccuuuuguagauguacugcuccaucugaaagucaagguugg

SEQ ID NO: 40047 - RNA, 45 nt, Mus musculus
auaaaacugacacagaaucagacagaggacagauaaaugauggag

SEQ ID NO: 40048 - RNA, 80 nt, Mus musculus
gucuaagugaacuuuuaugagccggcugccauccaguuucacacggauccucuuacccacaauuucacuugggaagacua

SEQ ID NO: 40049 - RNA, 26 nt, Mus musculus
gcuuauuuuucguacggcuuuuccgg

SEQ ID NO: 40050 - RNA, 44 nt, Mus musculus
uacuucauucacccugcacacugcaccaaagccaauccugaacu

SEQ ID NO: 40051 - RNA, 46 nt, Mus musculus
ccaacagggcugacagcauccucaccaacagaacuuaagccccagg

SEQ ID NO: 40052 - RNA, 46 nt, Mus musculus
cgugcuugccacugaacuuuuucuccaauucacgaacuagccggac

SEQ ID NO: 40053 - RNA, 46 nt, Mus musculus
ccuagcacuggagagguagaggcaggaggacggaguucaaggcuag

SEQ ID NO: 40054 - RNA, 45 nt, Mus musculus
cugucaaacgccaaacucagaaacacccacugauccucaaccgag

SEQ ID NO: 40055 - RNA, 46 nt, Mus musculus
uggggaaagaaaaaaaaaaaaaaaaaaguccagcaaucaagugcag

SEQ ID NO: 40056 - RNA, 45 nt, Mus musculus
caccuuggcugcggugauguugaguucccgcagcugcgccuugag

SEQ ID NO: 40057 - RNA, 50 nt, Mus musculus
gaacucguccggcuucucgccauugggcuucacgaucuuggcgcucgagc

SEQ ID NO: 40058 - RNA, 45 nt, Mus musculus
ccaucuacgggcgcaaggcggauaauccgcugcaucccaccccgg

SEQ ID NO: 40059 - RNA, 46 nt, Mus musculus
cuaccugacggaucgccggcuuagaaagagggacggcucucgcgag

SEQ ID NO: 40060 - RNA, 45 nt, Mus musculus
uuuucaccuggaguugugcuuugcgccuucaccgaaagcccccag

SEQ ID NO: 40061 - RNA, 42 nt, Mus musculus
ccucugggggagauugugcgggccgcacgcggccagucuggg

SEQ ID NO: 40062 - RNA, 42 nt, Mus musculus
guauucuguugggauauauugccugugugcaugaucuuggau

SEQ ID NO: 40063 - RNA, 46 nt, Mus musculus
aagagcaucagagggcagggcauggggagaaggucaauaagaacag

SEQ ID NO: 40064 - RNA, 46 nt, Mus musculus
cauccuugcucaccugagggugucugcuaucuucuugagcccucug

SEQ ID NO: 40065 - RNA, 42 nt, Mus musculus
aacaggaguuagucauauuugaguaaaugaagucagccccag

SEQ ID NO: 40066 - RNA, 44 nt, Mus musculus
ugcacccuugggcuucucucugcuacagagccacagaaccccag

SEQ ID NO: 40067 - RNA, 42 nt, Mus musculus
gaagguauaggucacauagccucuuuccuacuugggccccug

SEQ ID NO: 40068 - RNA, 41 nt, Mus musculus
guagguuuugcuauucugguagguuuuguguuucuauugag

SEQ ID NO: 40069 - RNA, 46 nt, Mus musculus
cuuugcauuuagaggguugucccaguucagaggucggugaugucgc

SEQ ID NO: 40070 - RNA, 46 nt, Mus musculus
uaaauuuaggucuuuuuuuuuaaaguuauuuaucgugugugugugu

SEQ ID NO: 40071 - RNA, 42 nt, Mus musculus
cagaucaagaagauccccaauggugcauuugaggaccuggag

SEQ ID NO: 40072 - RNA, 46 nt, Mus musculus
cucuggacugguucugcccagagaguugccagggaaugaagcccau

SEQ ID NO: 40073 - RNA, 45 nt, Mus musculus
acucauaucagcaggaauggcaccuuuuccuaucuguguagucug

SEQ ID NO: 40074 - RNA, 45 nt, Mus musculus
gaugcagaugucaccucagggaacacaguguacuucaccugcaga

SEQ ID NO: 40075 - RNA, 45 nt, Mus musculus
acuugcuggacgauggcacgcugaugauucagaacacacaggagg

SEQ ID NO: 40076 - RNA, 43 nt, Mus musculus
aaugaccuacuuccuccuuucuuugaacuccagcuaagugaag

SEQ ID NO: 40077 - RNA, 53 nt, Mus musculus
cagcccgacccacuuuuguaauccagccgcagaacacagagguacuggugggu

SEQ ID NO: 40078 - RNA, 154 nt, Mus musculus
ugucacucuggagugcagugccacaggccacccucugccucagaucaccuggacaagaggugaccgcacacccuugccaauugacccucgagugaauaucacucccucuggaggacuguauauacagaacgucgcccagagugacagcggcgag

SEQ ID NO: 40079 - RNA, 46 nt, Mus musculus
cugcagcccuuccucaguucacugugaccccacagagccgaguggu

SEQ ID NO: 40080 - RNA, 45 nt, Mus musculus
augguguucagguaacagaaaguggaaaauuucacaucagccccg

SEQ ID NO: 40081 - RNA, 59 nt, Mus musculus
caaugauguuggcacugccgaugcaggucgcuaugaguguguagcucggaacacaauug

SEQ ID NO: 40082 - RNA, 44 nt, Mus musculus
aagaggagaaacaagaacacagcaagaacucagacacagcaagg

SEQ ID NO: 40083 - RNA, 24 nt, Mus musculus
gcauggcuuaugccuagaugaugu

SEQ ID NO: 40084 - RNA, 46 nt, Mus musculus
agccauugcaacuguugacagagccaucaacucuacaaggacacac

SEQ ID NO: 40085 - RNA, 45 nt, Mus musculus
gagagagacagagacagagacagagagacagagagaaagagacag

SEQ ID NO: 40086 - RNA, 26 nt, Mus musculus
auuugugcuugucugaagacuggaac

SEQ ID NO: 40087 - RNA, 68 nt, Mus musculus
aggcccucaguuuuggaccucugaaugugcuggguuucuugaggaaucacuuuauuagagcuagucgu

SEQ ID NO: 40088 - RNA, 50 nt, Mus musculus
aaccugucaggcugcacugcacaccgccgcgugaacaacugcucagacau

SEQ ID NO: 40089 - RNA, 41 nt, Mus musculus
ggcuguguaugagaauggguucaacacaccccggggcauua

SEQ ID NO: 40090 - RNA, 59 nt, Mus musculus
acaugcugaugcaauggggccaguuccuugaccaugaccuagacucuacagugguagcc

SEQ ID NO: 40091 - RNA, 50 nt, Mus musculus
agcaaugacccucccuguuucucggucaugaucccccccaaugauccccg

SEQ ID NO: 40092 - RNA, 71 nt, Mus musculus
agagcagaucaaccagcucaccuccuacaucgaugccuccaauguguacggcagcacagaccacgaagccc

SEQ ID NO: 40093 - RNA, 45 nt, Mus musculus
cagcacaucaccuaccggcacuggcugcccaagauccugggggag

SEQ ID NO: 40094 - RNA, 49 nt, Mus musculus
ugcuuacaccuuugaggaccugaaaaaugagaucaagagcccugugauc

SEQ ID NO: 40095 - RNA, 64 nt, Mus musculus
gcuguauggcucgacucucaacauugaucuguucccagcccucaugguagaagaccuaguaccu

SEQ ID NO: 40096 - RNA, 46 nt, Mus musculus
ugugccugcucagcacacaguuccgacgccugcgggauggagacag

SEQ ID NO: 40097 - RNA, 50 nt, Mus musculus
cccuggcgaggauccuuugugacaacucagacaacaucacccgugugcag

SEQ ID NO: 40098 - RNA, 46 nt, Mus musculus
gaggcacacagcgcuguguuauguaugcuuauuuuaugcaccauag

SEQ ID NO: 40099 - RNA, 46 nt, Mus musculus
gacuaguuaacuacugaaaauguuugacuagaaauucuggugucag

SEQ ID NO: 40100 - RNA, 45 nt, Mus musculus
guugcacuuaggaccaaagugcacaaagcagacacaggccaggca

SEQ ID NO: 40101 - RNA, 74 nt, Mus musculus
acggucucuagaauuuagcuaugaggacgauaagcccacaaagagagccagguggcggaaagcacuaaggugag

SEQ ID NO: 40102 - RNA, 67 nt, Mus musculus
gccagcaacuaaugaucucaaggaauuuguucuggaaaugcaaaagaucaucacagaccucagaaaa

SEQ ID NO: 40103 - RNA, 46 nt, Mus musculus
aguguaggagaagacaaaccugaauuccuguugguuagccaugucu

SEQ ID NO: 40104 - RNA, 66 nt, Mus musculus
ucggcucagcaccacagaauguguggaugacagcggugaaucucacggcggcaacacaaaguggaa

SEQ ID NO: 40105 - RNA, 46 nt, Mus musculus
caccugcuuuguggaagcuugccagccugcagccugcccccagccu

SEQ ID NO: 40106 - RNA, 46 nt, Mus musculus
gagcuuagcuccucgaagcugguccacagaauacuugugagccuag

SEQ ID NO: 40107 - RNA, 37 nt, Mus musculus
gaagcagccggggcugcuucacacccuguguuuguag

SEQ ID NO: 40108 - RNA, 49 nt, Mus musculus
uagacuucucagguuuauauuuaaguguuuuuaaauggaaaauuggugc

SEQ ID NO: 40109 - RNA, 59 nt, Mus musculus
gggauacuagggcuuucucccacugcucccucaugucugccaucuuccccuucagggcc

SEQ ID NO: 40110 - RNA, 46 nt, Mus musculus
ccauguccacccuucuacacaggacugucacauuaucaagccacag

SEQ ID NO: 40111 - RNA, 46 nt, Mus musculus
aauccuuugguccuaugccauguugagugacccgaauagccccuug

SEQ ID NO: 40112 - RNA, 42 nt, Mus musculus
aaaaggacaaaauaggugccauuuuagggagaccauggucag

SEQ ID NO: 40113 - RNA, 45 nt, Mus musculus
uugcagccucgggcgggcuuauguuggcacuaaggccauugugga

SEQ ID NO: 40114 - RNA, 45 nt, Mus musculus
aggggugagcauuugugaaauaguaagcugaacuuaguggugaga

SEQ ID NO: 40115 - RNA, 46 nt, Mus musculus
cugugauuuacauuaauuucuguauuucaaacgaagaugucugcag

SEQ ID NO: 40116 - RNA, 46 nt, Mus musculus
gacuguggccaacagccaaaugccauuuuauguuccuuguauucag

SEQ ID NO: 40117 - RNA, 46 nt, Mus musculus
guuugcacuuuguaaugauaccuuucaguucaaauaaaaggaccac

SEQ ID NO: 40118 - RNA, 46 nt, Mus musculus
ucagccauggcugcauggagcugcugggucugaaugaaggcaaucc

SEQ ID NO: 40119 - RNA, 46 nt, Mus musculus
cacauucauuccagacuuaaucaucuccuucagcaucuccacagau

SEQ ID NO: 40120 - RNA, 48 nt, Mus musculus
cagcaccuuucuccuucaccugcagugagaugagcccaucguccacgu

SEQ ID NO: 40121 - RNA, 46 nt, Mus musculus
ccaaacuucagguccuagauguccuuuuccaacacagcggggagau

SEQ ID NO: 40122 - RNA, 47 nt, Mus musculus
cccaggucaccacgagccaccaugaucccaucacuggccuccaagau

SEQ ID NO: 40123 - RNA, 46 nt, Mus musculus
caugcucuccagcaucugcguggcacagaugacaggcuucccagcu

SEQ ID NO: 40124 - RNA, 46 nt, Mus musculus
gcccgagggcgguaccuggccacuuggugagcacuccugccagacu

SEQ ID NO: 40125 - RNA, 45 nt, Mus musculus
cagccgggugaggagaacaaaguaguuaagcgacuugacccccuu

SEQ ID NO: 40126 - RNA, 46 nt, Mus musculus
cucuccucucucccaacauuugccuuuucuccccgcuaccucucca

SEQ ID NO: 40127 - RNA, 41 nt, Mus musculus
ggggaucgggggagagagagugguuggaaaugacgccguga

SEQ ID NO: 40128 - RNA, 46 nt, Mus musculus
auguggacugcacaaaccagagcccuacuguauuguuagccaccug

SEQ ID NO: 40129 - RNA, 46 nt, Mus musculus
uuuuaggaggacaagaaaugcuucauaugugacucccgagacccuu

SEQ ID NO: 40130 - RNA, 46 nt, Mus musculus
ucucauugagaacguggucaccacauuugcuccaaaccgccuuaag

SEQ ID NO: 40131 - RNA, 46 nt, Mus musculus
ucuggggacugugugugugcugaagggagucaggggagagagagag

SEQ ID NO: 40132 - RNA, 44 nt, Mus musculus
cuuguacugaacguaagcuuccauaaacaaccuggaaacggcua

SEQ ID NO: 40133 - RNA, 41 nt, Mus musculus
aaaggguuguguccaggauagccgggaaguugaaguccuua

SEQ ID NO: 40134 - RNA, 46 nt, Mus musculus
ggaugacaucaucugugacucucgauauucugacauugagcccucg

SEQ ID NO: 40135 - RNA, 44 nt, Mus musculus
cuuuagauccugcuuucaaaauugaagacccuuauaguccaagg

SEQ ID NO: 40136 - RNA, 45 nt, Mus musculus
uuuuuaaccaaggucucauggaacuuccacacuugcaacauggga

SEQ ID NO: 40137 - RNA, 44 nt, Mus musculus
aagaggcaguugugaauuggagagggaucuggggagacuaggga

SEQ ID NO: 40138 - RNA, 45 nt, Mus musculus
uacaguacacauuuaugcuguuuuuaaaaaguacuguaagacaag

SEQ ID NO: 40139 - RNA, 45 nt, Mus musculus
aaucaccaacuugagaaucaaguuugugaaacugcacaccuuggg

SEQ ID NO: 40140 - RNA, 42 nt, Mus musculus
uucugcuauggccacgccagugaaugcgccccuguggaugga

SEQ ID NO: 40141 - RNA, 45 nt, Mus musculus
ccaaaaaaaaaaaaaaacaaaacaaaacaaaaaaaaaaacaaaaa

SEQ ID NO: 40142 - RNA, 46 nt, Mus musculus
ugucacuuugacauggcagucuuccuggcuacuggcaacgucagcg

SEQ ID NO: 40143 - RNA, 82 nt, Mus musculus
uacacugauuuuucugugggucucauugcuggucagugucggugcaaauugcacguggagggagagcgcugugauguuugua

SEQ ID NO: 40144 - RNA, 65 nt, Mus musculus
augugcuugcaauccucugggaacaauuccuggugggaauccuugugauucugagacuggcuacu

SEQ ID NO: 40145 - RNA, 41 nt, Mus musculus
caaugauuuggaugggugucgaccuugugacugugaccuug

SEQ ID NO: 40146 - RNA, 45 nt, Mus musculus
agguuaagggguggggaaggguaggucauaggguaaagguuaagg

SEQ ID NO: 40147 - RNA, 45 nt, Mus musculus
gcucgguguagaaagauuuagaauauggugguaucaugaccuaag

SEQ ID NO: 40148 - RNA, 46 nt, Mus musculus
guucaauucccacauggcagcucacagcugucuaaacugcagucuc

SEQ ID NO: 40149 - RNA, 45 nt, Mus musculus
ugguacgaacauacaugcaggcagaacagccauauauaugcauaa

SEQ ID NO: 40150 - RNA, 47 nt, Mus musculus
uacuacuucaccacccuggaccacuacaucuacgaagccgaggaagc

SEQ ID NO: 40151 - RNA, 46 nt, Mus musculus
gggaggacucaccagcauaucacacugcuuuuguguacuuggcaag

SEQ ID NO: 40152 - RNA, 100 nt, Mus musculus
ggacaggaccuggguucguccgggugccugaaggggcuuauuuggaguuuuucauugacaacauaccguauuccauggaguaugaaauccugauucgcua

SEQ ID NO: 40153 - RNA, 46 nt, Mus musculus
gaccacugggagaaagcugucaucacuguacagcggccggggaaga

SEQ ID NO: 40154 - RNA, 69 nt, Mus musculus
agauacguuguccucccucgccccgugugcuuugagaagggaaugaacuacacggugagguuggagcug

SEQ ID NO: 40155 - RNA, 60 nt, Mus musculus
ccccaguauacggcaucgggcagugacguggagagcccuuacacguucaucgacucggug

SEQ ID NO: 40156 - RNA, 49 nt, Mus musculus
uaaaucgcuggacaucuucacuguuggcggcucaggcgauggggagguc

SEQ ID NO: 40157 - RNA, 55 nt, Mus musculus
gugucuggagaacagcaggagugugguaaaaacacccaugacagaugucugcaga

SEQ ID NO: 40158 - RNA, 107 nt, Mus musculus
cauaccaacauacacauaauuaaaaauaauaaaucuuaaguguacacgugagagguguuggguuuuauagaaagauaggagggaaggaauauguuuaguguagguac

SEQ ID NO: 40159 - RNA, 58 nt, Mus musculus
agaauagaguuuauucagggaaugggaaaggggaguugaggugguagagacagagaaa

SEQ ID NO: 40160 - RNA, 64 nt, Mus musculus
ggcagagagaguagaggaguagaggcuggccaugagugcguggggaaggggggaagggaaugga

SEQ ID NO: 40161 - RNA, 42 nt, Mus musculus
cagggcagcugguugguucucucccagucagcacagggguga

SEQ ID NO: 40162 - RNA, 46 nt, Mus musculus
uuugugugugcgcgugcgugcaugcgugugugugugugugugugug

SEQ ID NO: 40163 - RNA, 45 nt, Mus musculus
caccacaacauugacacuaccgauccagaagccugugacaaggag

SEQ ID NO: 40164 - RNA, 80 nt, Mus musculus
cgaugccucaagugccuguaccacacagaaggggaccauugccagcucugccaguauggguacuacggcgaugcucuucg

SEQ ID NO: 40165 - RNA, 47 nt, Mus musculus
guucacagggcagugccagugcaugccgggcuuuggaggccgaaccu

SEQ ID NO: 40166 - RNA, 45 nt, Mus musculus
ggggccagcugccugauuucaauucaugcggagccuccacaucag

SEQ ID NO: 40167 - RNA, 108 nt, Mus musculus
cugugacugugaucccaggggcauugagacaccucagugugaccaguccacgggccagugugucuguguggaggguguagaggguccucgcugcgacaagugcaccag

SEQ ID NO: 40168 - RNA, 44 nt, Mus musculus
ucucugggaugcuaucauuggugagcugaccaacaggacccaca

SEQ ID NO: 40169 - RNA, 47 nt, Mus musculus
gcagcggaaccacugaaaaacauuggcauucucuucgaggaggcaga

SEQ ID NO: 40170 - RNA, 41 nt, Mus musculus
aagugaaauuaacugauacagcuucacagaguaacagcaca

SEQ ID NO: 40171 - RNA, 46 nt, Mus musculus
caggcagaagcagagagccuugacaagaccgugaaggagcuggcag

SEQ ID NO: 40172 - RNA, 62 nt, Mus musculus
caccaaguauuuccagaugucucuugaggcagagaagcgggugaaugccuccaccacagacc

SEQ ID NO: 40173 - RNA, 57 nt, Mus musculus
ccaacagcacuguggagcagucugcccucacgcgagacagaguagaagaucugaugu

SEQ ID NO: 40174 - RNA, 48 nt, Mus musculus
uguucugaaagugaaugugguggccccaacugcagaacugacgaagga

SEQ ID NO: 40175 - RNA, 65 nt, Mus musculus
gcgcaggauguccuguuaaaaacaaaugcuaccaaagaaaaaguggacaagagcaacgaggaccu

SEQ ID NO: 40176 - RNA, 46 nt, Mus musculus
auggaaaugccuagcacgccacagcaguuacagaaccuaacagaag

SEQ ID NO: 40177 - RNA, 86 nt, Mus musculus
ugaaacccucucucaaguagagguuauuuugcagcagagugcagcugacauugccagagcugagcuguugcuugaggaagcuaaga

SEQ ID NO: 40178 - RNA, 47 nt, Mus musculus
gugcaacagauguuaaagucacugcagacauggugaaggaagcauua

SEQ ID NO: 40179 - RNA, 48 nt, Mus musculus
aggaaacccugaccaacgccucccagcgcaucagcaagcuugagagga

SEQ ID NO: 40180 - RNA, 47 nt, Mus musculus
gaauauaucgaaaaaguaguauauucuguaaaacagaaugcagacga

SEQ ID NO: 40181 - RNA, 71 nt, Mus musculus
gcgaacuugaugaaaaguauaagaagguagaaaguuuaauugcccaaaaaacugaagagucagcagaugcc

SEQ ID NO: 40182 - RNA, 53 nt, Mus musculus
cagacuuagaaagaaaauaugaggacaaucaaaaauacuuagaagauaaagcu

SEQ ID NO: 40183 - RNA, 57 nt, Mus musculus
caagaauuggugcgacuggaaggagagguucgcucccuccuuaaggacauaagugag

SEQ ID NO: 40184 - RNA, 83 nt, Mus musculus
uuggucuucaguaaacugggguaaagaguuaggauuguaauggugaggagggggugcaguuacagguggaccaccaugcugag

SEQ ID NO: 40185 - RNA, 46 nt, Mus musculus
uggagcagaggucauugguggagguggagcuuggcuauauaccaag

SEQ ID NO: 40186 - RNA, 51 nt, Mus musculus
uucaggauggugaugagcaggugcuggggcaggagguggugguucucuagc

SEQ ID NO: 40187 - RNA, 54 nt, Mus musculus
ugugcaaagggggugaaggagggaagauagggaccgauggagucggagggagag

SEQ ID NO: 40188 - RNA, 45 nt, Mus musculus
cugagcuuguauugcauagcuguaaucccugaaaggaccgcaagg

SEQ ID NO: 40189 - RNA, 47 nt, Mus musculus
aguacaaucuauauauuauaaaaacuauauauguaaagucaacauaa

SEQ ID NO: 40190 - RNA, 46 nt, Mus musculus
cagccuguucagcccaguacuccuagcauuuagaaaacucaggcag

SEQ ID NO: 40191 - RNA, 51 nt, Mus musculus
uuucuuaaagcuacuaagauuuuagccugcguuuacauuacauaucaggau

SEQ ID NO: 40192 - RNA, 45 nt, Mus musculus
gaugccgccuggaugcugcugucagugcuccagucacuagggcua

SEQ ID NO: 40193 - RNA, 49 nt, Mus musculus
aaguaguucaaugagcaaauguugcagagauuucaaaacuaggagacaa

SEQ ID NO: 40194 - RNA, 46 nt, Mus musculus
ugaaauauuuuugugcaucuguauguucuucaaaacaaucucucag

SEQ ID NO: 40195 - RNA, 45 nt, Mus musculus
uugcuggauugucagcgcaccaugugcgugcccggugcccaagua

SEQ ID NO: 40196 - RNA, 42 nt, Mus musculus
cucuugaguucaccgaguaaaugaaaaggaagguggagagua

SEQ ID NO: 40197 - RNA, 46 nt, Mus musculus
ggauuaaaaaaaaaugguuguugggccaggcauugguggugcacac

SEQ ID NO: 40198 - RNA, 41 nt, Mus musculus
agccgcaagauccggagugccauuaaggggaaauuacaaga

SEQ ID NO: 40199 - RNA, 46 nt, Mus musculus
agaaccagaugaucucauugaugaagaccucaauuuugugcaggag

SEQ ID NO: 40200 - RNA, 46 nt, Mus musculus
auugccugugguaaguucaguuguuaaaguaaaaagauuuagccau

SEQ ID NO: 40201 - RNA, 42 nt, Mus musculus
agcgagcggugacuuaagcaacggagcgcagcgaagcccauu

SEQ ID NO: 40202 - RNA, 31 nt, Mus musculus
gaagccgaguucaacauccugcuggccaccg

SEQ ID NO: 40203 - RNA, 35 nt, Mus musculus
ucuucuaaaauuaaagggaaaugguuuccuaaacu

SEQ ID NO: 40204 - RNA, 43 nt, Mus musculus
cguauuucauuguguguaauaaggaccugagaacacaggcaga

SEQ ID NO: 40205 - RNA, 48 nt, Mus musculus
agccacuccagccauuucggugguuggauugcauucgggacuuuccug

SEQ ID NO: 40206 - RNA, 48 nt, Mus musculus
uuggauuccacaaaacuguauacuuuuuuuccugaauaagcgccuaca

SEQ ID NO: 40207 - RNA, 46 nt, Mus musculus
gugaaggaacccagagggaacaacauggcguuacaauccagggugg

SEQ ID NO: 40208 - RNA, 28 nt, Mus musculus
uuuucuccuguccuuaaaacacaugcau

SEQ ID NO: 40209 - RNA, 46 nt, Mus musculus
gguuacauaggaaguaugggguagccugggcuauaugagaccuugu

SEQ ID NO: 40210 - RNA, 46 nt, Mus musculus
aacacucauacacauaaaauaaauaaaugaucuuuuaaaaaaaaag

SEQ ID NO: 40211 - RNA, 64 nt, Mus musculus
uaacaguggaaaugcauuuauuucagagggcuaaugcugagcuacgaagauucuuuaggauaga

SEQ ID NO: 40212 - RNA, 47 nt, Mus musculus
agugaguaacuuuucuucaaauggaaguuaaguuuuuaacaguggcc

SEQ ID NO: 40213 - RNA, 49 nt, Mus musculus
aagcuguuagaagacuuucauguuuuuaaaccuauaacaguuaagauca

SEQ ID NO: 40214 - RNA, 42 nt, Mus musculus
uugaccucauaaaacaagucacagucaaaauauggaggccag

SEQ ID NO: 40215 - RNA, 27 nt, Mus musculus
agaaucgaugagcuccagguuugauga

SEQ ID NO: 40216 - RNA, 71 nt, Mus musculus
uacccacccaacacaagcaaaguuuauuccuacuuugaaugccgugaaaagaagacagaaaacuccaaagu

SEQ ID NO: 40217 - RNA, 46 nt, Mus musculus
cucaccauccuguaaguagauacugcaccccagccucauuguacag

SEQ ID NO: 40218 - RNA, 45 nt, Mus musculus
uuccaauuagagucaauucauucacucuguguguguguguguaug

SEQ ID NO: 40219 - RNA, 46 nt, Mus musculus
uuguucaguccugguauccaauuacaguggccacaaauuccagaga

SEQ ID NO: 40220 - RNA, 41 nt, Mus musculus
cauaggggcaucugcucauuugguuaacuuuaaaggaacag

SEQ ID NO: 40221 - RNA, 45 nt, Mus musculus
augggacaaaagauccuguuccaggcuauucuguuccagcagcag

SEQ ID NO: 40222 - RNA, 73 nt, Mus musculus
gccugugucuguggucagcgauagcuaugacauuuauaaugcgugugagaaaauauggggugaagaccugaga

SEQ ID NO: 40223 - RNA, 46 nt, Mus musculus
cuuacaggggauaguagagaaccuugaguauagaaauuggggcugg

SEQ ID NO: 40224 - RNA, 32 nt, Mus musculus
auacauaauacauaacaugugaaaagcacuua

SEQ ID NO: 40225 - RNA, 33 nt, Mus musculus
cucuauaaauuguaaaacagauaaguucuguag

SEQ ID NO: 40226 - RNA, 46 nt, Mus musculus
cgccuggccaucacacacuaaagaugaucaaguaugucacugucaa

SEQ ID NO: 40227 - RNA, 45 nt, Mus musculus
uuaucuuuacauaggacaccagcggggaacuuuguuacacuugaa

SEQ ID NO: 40228 - RNA, 42 nt, Mus musculus
gcucgagagcaucuguccaguguccuagugaccagucccaag

SEQ ID NO: 40229 - RNA, 29 nt, Mus musculus
gauccugaguaauaauuaccaggacuacg

SEQ ID NO: 40230 - RNA, 42 nt, Mus musculus
gagcaggacguggcaccucauuaggcuucauguggccggguu

SEQ ID NO: 40231 - RNA, 45 nt, Mus musculus
cauuguacagauguguggguucguguuuaugauacacugcagcca

SEQ ID NO: 40232 - RNA, 46 nt, Mus musculus
acaucacugcccuuguagaguaugcagcagucauucuccguggaag

SEQ ID NO: 40233 - RNA, 46 nt, Mus musculus
auuuuauauguuggauauugccuguggcucuaauaugcaccucaag

SEQ ID NO: 40234 - RNA, 47 nt, Mus musculus
uuucauauucuauaguugguaugucuuaaaugaauugcuggaguggg

SEQ ID NO: 40235 - RNA, 46 nt, Mus musculus
cauguaaaacaauuucaugaggaaccauaugaggugaauuagaggg

SEQ ID NO: 40236 - RNA, 46 nt, Mus musculus
ugguuaacaugaaugucaaauugaguugauuugcgugucacccuua

SEQ ID NO: 40237 - RNA, 41 nt, Mus musculus
agaagaagguuguuauuuuaauuccaaaagucauaggggag

SEQ ID NO: 40238 - RNA, 50 nt, Mus musculus
uaugguaaauuguguguuagagauacuuguaaaguaguagguuagacagg

SEQ ID NO: 40239 - RNA, 46 nt, Mus musculus
aaaaacugguccuauguguacaagcuauagaauaucaggucguauu

SEQ ID NO: 40240 - RNA, 46 nt, Mus musculus
cucagcuugccagcuaagaagaaaggaauaguuaggaagguagaga

SEQ ID NO: 40241 - RNA, 45 nt, Mus musculus
auaauaagcuucagguucagucagaaacccugaaaucagagaauc

SEQ ID NO: 40242 - RNA, 42 nt, Mus musculus
ucagugcucuuaaagccucuuaaaauuugccugaaggggguu

SEQ ID NO: 40243 - RNA, 42 nt, Mus musculus
ugccuguuguucuuugucuaggguugagaccaccugggcuuc

SEQ ID NO: 40244 - RNA, 46 nt, Mus musculus
uagaguguaguuagggaguaugcugguucauuuaguaaaguggcag

SEQ ID NO: 40245 - RNA, 46 nt, Mus musculus
agccaaggcgguggcccacccacuucuggaauguaacuaaggggag

SEQ ID NO: 40246 - RNA, 48 nt, Mus musculus
agauguaaauguauuuuuacaugaaaguuugaaaauucgggagccugu

SEQ ID NO: 40247 - RNA, 46 nt, Mus musculus
ucuaaaugaucugcuguacuuauuagguguacuaaaauugucuuag

SEQ ID NO: 40248 - RNA, 46 nt, Mus musculus
uucuccugaguuuaacauugauauugugaaaauaaaugcaguucag

SEQ ID NO: 40249 - RNA, 44 nt, Mus musculus
guauguuugugugugucagugugugugugugugugugugugugu

SEQ ID NO: 40250 - RNA, 46 nt, Mus musculus
agcugagcuagaucaagggagacuugaguucacucucugccuccuu

SEQ ID NO: 40251 - RNA, 41 nt, Mus musculus
uugcccauuuuaaaacuauguucguugcucauaucccuauu

SEQ ID NO: 40252 - RNA, 24 nt, Mus musculus
gugguuaaggagacagaagcacuc

SEQ ID NO: 40253 - RNA, 46 nt, Mus musculus
ucuguguaugugaaugugugugugugugugugugugucugcaagug

SEQ ID NO: 40254 - RNA, 48 nt, Mus musculus
uauaugggugagugcgugugugucuguguguguaucucuguguacgug

SEQ ID NO: 40255 - RNA, 57 nt, Mus musculus
gugugugucucugugugugucuguguguguguguuaugugugugucugucuugagug

SEQ ID NO: 40256 - RNA, 63 nt, Mus musculus
aauacgugcaauacaaaaccacuagagaacauguguccagaauugaaaccgacaagagcagga

SEQ ID NO: 40257 - RNA, 44 nt, Mus musculus
cucuugcugggcugcagccugggagcacugggagcacugggagc

SEQ ID NO: 40258 - RNA, 71 nt, Mus musculus
gcugggggucauaggcugcugccuaagugggaaacaggaaaugaaauuaaaaggaagccgaagaugaagga

SEQ ID NO: 40259 - RNA, 59 nt, Mus musculus
gacauggcagaaauuggggagagaggaucuaccaccaggacaaaaggagaggccauaga

SEQ ID NO: 40260 - RNA, 58 nt, Mus musculus
gagccggggauggcuagaccaaagugaggacugccaggggagaaguggcaagaguuau

SEQ ID NO: 40261 - RNA, 47 nt, Mus musculus
guaaucugaccuagcaggcuggccuuucuaacaaacccucuugggac

SEQ ID NO: 40262 - RNA, 46 nt, Mus musculus
aaaaaaagaauuguuauuugaguuucauagaaaucauucaguggau

SEQ ID NO: 40263 - RNA, 46 nt, Mus musculus
cacaggcccucacaaagccuuucuucugaacacuacacccguauuu

SEQ ID NO: 40264 - RNA, 46 nt, Mus musculus
gaauugccagguacgugcgcuuuccauuuuaauagccuugccagau

SEQ ID NO: 40265 - RNA, 46 nt, Mus musculus
gcugguagagccacugcggagacuuugcuccgcgcacaccagagac

SEQ ID NO: 40266 - RNA, 25 nt, Mus musculus
guuuccagagaaggagaaaauggac

SEQ ID NO: 40267 - RNA, 46 nt, Mus musculus
cugcauucugauagaagucugaacacucguuuguguccccccaccc

SEQ ID NO: 40268 - RNA, 46 nt, Mus musculus
caucaggaugcagagcaggggaaugagagagagaugaauggcagga

SEQ ID NO: 40269 - RNA, 46 nt, Mus musculus
ucacaaugcaagucugcgggaggcuuggaagacacuuucauuauaa

SEQ ID NO: 40270 - RNA, 46 nt, Mus musculus
ugaagugaaaaauauuucuugacugauaucacaguguuugcaccag

SEQ ID NO: 40271 - RNA, 46 nt, Mus musculus
auuaaaaguaggcaaaaaauggaaagaaucaauuuaaagaaggcag

SEQ ID NO: 40272 - RNA, 46 nt, Mus musculus
ugacuuggagguuuggucucauacaaaugauaccauugguucaguu

SEQ ID NO: 40273 - RNA, 46 nt, Mus musculus
gaaugugacagugauuaucaugaagaaagaacaauuuugccuaugu

SEQ ID NO: 40274 - RNA, 42 nt, Mus musculus
auuaauugugcaagacaggaagcuguucgaaugguccgagug

SEQ ID NO: 40275 - RNA, 45 nt, Mus musculus
uccuguggaggcuggaugcgccagcuuaggggaaugcaagggcag

SEQ ID NO: 40276 - RNA, 45 nt, Mus musculus
gcgguuaagagcagucacuguucuugcagaguaccugggcucaga

SEQ ID NO: 40277 - RNA, 46 nt, Mus musculus
gcagcacucacccauaacaucugauccaucucccuagcccccuacc

SEQ ID NO: 40278 - RNA, 28 nt, Mus musculus
aagacacauuuacugcauccucuugcuc

SEQ ID NO: 40279 - RNA, 45 nt, Mus musculus
guguuguuuaaggagcccaauaaguaugugauauauuuccccaga

SEQ ID NO: 40280 - RNA, 46 nt, Mus musculus
auuucuuacugagaccgaaugaugauuuuugaguccuugggguuuu

SEQ ID NO: 40281 - RNA, 48 nt, Mus musculus
gugcuggguuuacgggccucaggggagcacuugugagcagcaggaaga

SEQ ID NO: 40282 - RNA, 46 nt, Mus musculus
uuuaaagcaaagcuucaccaauucguaucuuaaacucggacaugag

SEQ ID NO: 40283 - RNA, 46 nt, Mus musculus
uaucacagcuauccucccuguuuacugaggucucugcacaccagau

SEQ ID NO: 40284 - RNA, 46 nt, Mus musculus
aaaaacuguauugcacuuaaaaaaauaagugcacacagcauugcag

SEQ ID NO: 40285 - RNA, 46 nt, Mus musculus
ugacuaugaaagacuggaggccuuccaacagcgaaugcugaacgag

SEQ ID NO: 40286 - RNA, 46 nt, Mus musculus
ggcaauaaggagcaccugcucagauuugucaccacucgaggccuag

SEQ ID NO: 40287 - RNA, 83 nt, Mus musculus
gagucucuggguggaaaggacaucgcuguacuugguccagagcuuacccggcaucucccgcugguucgaaguggaaaagcgag

SEQ ID NO: 40288 - RNA, 46 nt, Mus musculus
ucuguggagcccugccucuaccugcugaacuagcgauggauucuag

SEQ ID NO: 40289 - RNA, 45 nt, Mus musculus
ggaauaacaacaacaacaacaaugaaaagaaaagaugugggcaag

SEQ ID NO: 40290 - RNA, 46 nt, Mus musculus
uccucuggaaaacgccaucgaaguguuagaaaacaagaaccagcag

SEQ ID NO: 40291 - RNA, 45 nt, Mus musculus
uccuaggcauucuuugucaaagacuauauuuuaagucauccugaa

SEQ ID NO: 40292 - RNA, 45 nt, Mus musculus
uggagccuucucagguacucuccugugggggaaucagaggcuaga

SEQ ID NO: 40293 - RNA, 45 nt, Mus musculus
uccaaggaaaagccagugaauaaaccaucuguguguguguuugca

SEQ ID NO: 40294 - RNA, 46 nt, Mus musculus
uggaugagagcgagugggauuuggcuugauugguuuaucuuugcug

SEQ ID NO: 40295 - RNA, 60 nt, Mus musculus
augccacacaugcugggucccuggcaucagaccugaaaaccccagagaagcagaagucac

SEQ ID NO: 40296 - RNA, 68 nt, Mus musculus
ucuugccaugauggugauaucucaaauuccccacccagcggacugagggaaggccuauggacaggcau

SEQ ID NO: 40297 - RNA, 48 nt, Mus musculus
aaagacagaaggugucucccaacgacuccuagcacuuucccccaggag

SEQ ID NO: 40298 - RNA, 46 nt, Mus musculus
ucaagucuagcuuugacuacaugaagccuuaucagcagaaaaagaa

SEQ ID NO: 40299 - RNA, 46 nt, Mus musculus
cccguaaggugucucagcuauaagucacuuuucuauguaccugcga

SEQ ID NO: 40300 - RNA, 46 nt, Mus musculus
ggcuaaagcaggcugguugguuggaguagauacuuaaggguuucaa

SEQ ID NO: 40301 - RNA, 46 nt, Mus musculus
ggggaagaggauuguggaccauucuagcauggauacagcagcauag

SEQ ID NO: 40302 - RNA, 46 nt, Mus musculus
ugagggcugccuuaguuagaguucuauugcugcaccaaaccaccag

SEQ ID NO: 40303 - RNA, 41 nt, Mus musculus
cacugggcuagugguccuggguucuauaagaaaguaggcug

SEQ ID NO: 40304 - RNA, 42 nt, Mus musculus
aaaagggaaaaaaacaaacaaacaaaccacaauccaaggggg

SEQ ID NO: 40305 - RNA, 45 nt, Mus musculus
uuugacuaggauccuggccgcaguaggagaaagagauaagggaag

SEQ ID NO: 40306 - RNA, 48 nt, Mus musculus
gaaaguguaucauaggagagaaacagaagaugaaaaguaagagagaga

SEQ ID NO: 40307 - RNA, 55 nt, Mus musculus
acuccagcugagauagaugaaggauuuccgcuaacccagccccgaugggauuaua

SEQ ID NO: 40308 - RNA, 41 nt, Mus musculus
caaaccuuucacccuauacauugauaaaagaaauggagugg

SEQ ID NO: 40309 - RNA, 45 nt, Mus musculus
ugacuaggauccuggccgcaguaggagaaagagauaauagaagaa

SEQ ID NO: 40310 - RNA, 45 nt, Mus musculus
aaacagaagaugaaaaguuagagagagagaaaagagaaaaaagag

SEQ ID NO: 40311 - RNA, 95 nt, Mus musculus
gagaaaccaaaaccaccgcucgggagagaugaugaucgcagcacaccagugacgaaaccccccaagaucuauucagagauugaagaacccccuga

SEQ ID NO: 40312 - RNA, 42 nt, Mus musculus
gggaauuucaguuacacaaaacuucaaggauauggccuauga

SEQ ID NO: 40313 - RNA, 27 nt, Mus musculus
uauggaguauaacauggaaaagugcag

SEQ ID NO: 40314 - RNA, 44 nt, Mus musculus
aaacuuaugacauauugccaagaaauuguguuuuaguacugggu

SEQ ID NO: 40315 - RNA, 45 nt, Mus musculus
cauuuaccaaaauaguucacagaaaacuuuuuucaucagacauag

SEQ ID NO: 40316 - RNA, 46 nt, Mus musculus
cacuaagcccaccuaguuuauucuuccuuacuaugucugaugaaaa

SEQ ID NO: 40317 - RNA, 46 nt, Mus musculus
accauauuuccucuucguugagugacaguccugcagugcuugcuag

SEQ ID NO: 40318 - RNA, 42 nt, Mus musculus
uggaggcggauuguuugaugauauguuugaagacauggagaa

SEQ ID NO: 40319 - RNA, 46 nt, Mus musculus
aauaaauacuugguuccugaauaaguaaauuaauugugguauguca

SEQ ID NO: 40320 - RNA, 44 nt, Mus musculus
aaugguagcugauaauuuuguaagucuuaaagauguuauggaga

SEQ ID NO: 40321 - RNA, 46 nt, Mus musculus
cucacaauuaguaaaacuuauacuucuuugaaagcugagcuaccag

SEQ ID NO: 40322 - RNA, 46 nt, Mus musculus
ccuuuuagaaaacaaauguuguguugaaauacugugugggcucggu

SEQ ID NO: 40323 - RNA, 46 nt, Mus musculus
uaggguuuuuauucaguuguguaaaaaccacaaaucaggugcugua

SEQ ID NO: 40324 - RNA, 24 nt, Mus musculus
accagacuggaaacgugcuucaga

SEQ ID NO: 40325 - RNA, 45 nt, Mus musculus
ggcacagaggagagccuguggucacucgcaccgauaaagagagau

SEQ ID NO: 40326 - RNA, 46 nt, Mus musculus
uccaucggucacccagagcaagagagaagguagcagaacugcagaa

SEQ ID NO: 40327 - RNA, 45 nt, Mus musculus
uggaguguuggugggaagccugggugacuuccauuggccuucaga

SEQ ID NO: 40328 - RNA, 46 nt, Mus musculus
acguuggcuuuaacaggcugcucgaauacuugaaaccucaguacuc

SEQ ID NO: 40329 - RNA, 77 nt, Mus musculus
agacaucugcagcgguuccauggccauguacucaagaaugaugucucagaggccacucugccccguucuccaggcau

SEQ ID NO: 40330 - RNA, 45 nt, Mus musculus
uuugaaucaggcacugucuuccagcaaaauaagaaggugaugaga

SEQ ID NO: 40331 - RNA, 46 nt, Mus musculus
acgggggcaacacaggcaucccaccauuguacccuaugcccccaac

SEQ ID NO: 40332 - RNA, 44 nt, Mus musculus
agcuccaaugcugucuguguccacuguaugaaugaguucaguag

SEQ ID NO: 40333 - RNA, 41 nt, Mus musculus
uccagaaaauggcucccaagaucccauccccugaccaaaua

SEQ ID NO: 40334 - RNA, 50 nt, Mus musculus
caucgcgcuacagaggcgagagggagaaggauaaaggagggagggagggu

SEQ ID NO: 40335 - RNA, 42 nt, Mus musculus; identical to SEQ ID NO: 27766

SEQ ID NO: 40336 - RNA, 46 nt, Mus musculus; identical to SEQ ID NO: 27767

SEQ ID NO: 40337 - RNA, 45 nt, Mus musculus; identical to SEQ ID NO: 27768

SEQ ID NO: 40338 - RNA, 45 nt, Mus musculus; identical to SEQ ID NO: 28313

SEQ ID NO: 40339 - RNA, 32 nt, Mus musculus
uucuugccgggacugcggugaccuucagacac

SEQ ID NO: 40340 - RNA, 65 nt, Mus musculus
uaguaacaguuccggaaauguuaagugucaagauccaaagaauccauacaauccccucugcccac

SEQ ID NO: 40341 - RNA, 42 nt, Mus musculus
ucucccuucucuuuccaaacgugggccaggcagagagcagag

SEQ ID NO: 40342 - RNA, 58 nt, Mus musculus
aaguagauugauuguacacgugaaaaggaaaaggcggugaagagagugauagaugucc

SEQ ID NO: 40343 - RNA, 42 nt, Mus musculus
cgccaagguacuguggaauagugugugugugugugugugugu

SEQ ID NO: 40344 - RNA, 46 nt, Mus musculus
cauguggacaaccccaauggugauggccgcuguaucaccuguaucu

SEQ ID NO: 40345 - RNA, 91 nt, Mus musculus
ucacccuuuuucaagacaccaucuauuugauaaugccauaauuugucaaauccuuauuacagucacuucaaaauccaacuuucggggagac

SEQ ID NO: 40346 - RNA, 45 nt, Mus musculus
ucauggaguaauggugcuaagugacuuucauuguuggcccuuaca

SEQ ID NO: 40347 - RNA, 26 nt, Mus musculus
gcagaauugcugguguuugugugauc

SEQ ID NO: 40348 - RNA, 45 nt, Mus musculus
aagaaagaaagaaagaaagaaaaagaaaagaaagaaagaaaaaaa

SEQ ID NO: 40349 - RNA, 46 nt, Mus musculus
ucucucucucucucucucucucucucucugcgagaagccccccucc

SEQ ID NO: 40350 - RNA, 45 nt, Mus musculus
ucucuauuauuugugccaauaaacuucauuuuucagacucuagau

SEQ ID NO: 40351 - RNA, 46 nt, Mus musculus
uguuuuguaaaguuguaaaaccuuuagaaaguggagcuuugcugga

SEQ ID NO: 40352 - RNA, 45 nt, Mus musculus
guuuugagaccuuucuuuuuucuccauuucuguucugcguuucuu

SEQ ID NO: 40353 - RNA, 44 nt, Mus musculus
ucucaagacacaagugcaggaaaagcagucaggagucucagaga

SEQ ID NO: 40354 - RNA, 46 nt, Mus musculus
acuguggauauggugugggccacuugagugcaucugaggugcaagg

SEQ ID NO: 40355 - RNA, 46 nt, Mus musculus
acugugugaggugacugcgcucgaaaagagaaaaucugucuugccc

SEQ ID NO: 40356 - RNA, 46 nt, Mus musculus
uuuaggaguaauguuuuccccucugagggagauuagaauuaaagau

SEQ ID NO: 40357 - RNA, 46 nt, Mus musculus
ccggcgucuccaagcggcaccugcgaggcgaccagaucacguggau

SEQ ID NO: 40358 - RNA, 46 nt, Mus musculus
cacacacacacacacaugcacacgcacacgcacgugaugugagagc

SEQ ID NO: 40359 - RNA, 46 nt, Mus musculus
agagugguaauuuuauaaaugcuuauuuauguuauaaaauggagau

SEQ ID NO: 40360 - RNA, 46 nt, Mus musculus
aagcuaacugaaugccuugaaaauauuauccacuggucggucauau

SEQ ID NO: 40361 - RNA, 45 nt, Mus musculus
ucaaaaaaagaaagaaagcaguucucuucuguuugagcgaugaca

SEQ ID NO: 40362 - RNA, 43 nt, Mus musculus
gcuuuugauugaaccaccauagaccuaguaagugagcccagug

SEQ ID NO: 40363 - RNA, 46 nt, Mus musculus
uuagcugcccuaugaugacuguguguuuggaggccagcgucugaca

SEQ ID NO: 40364 - RNA, 46 nt, Mus musculus
ugacccuggaaaaucuccagaugcuacccgagagcgaggaugagga

SEQ ID NO: 40365 - RNA, 46 nt, Mus musculus
gacacugugaucuuuuuaaaaaguuuucuccucgaugccuauauga

SEQ ID NO: 40366 - RNA, 41 nt, Mus musculus
gcgccgcuggccgccgagcccuggaagcagcagcucacgga

SEQ ID NO: 40367 - RNA, 46 nt, Mus musculus
cuugggucaggaaugcaguuggagguuugacagcacauggcuucag

SEQ ID NO: 40368 - RNA, 46 nt, Mus musculus
cugaaucucuguauccaaaacauuucucaaauuuagaccaugaggg

SEQ ID NO: 40369 - RNA, 30 nt, Mus musculus
ggcuccgggcaagggcauccuggcugcaga

SEQ ID NO: 40370 - RNA, 44 nt, Mus musculus
uuccaguggacucaucugcagccaggaugcccuugcccggagcc

SEQ ID NO: 40371 - RNA, 46 nt, Mus musculus
ugggggaagggacguccaucaucugccuucugguacagugucucau

SEQ ID NO: 40372 - RNA, 41 nt, Mus musculus
agauuaucaaguccaagggugguguugugggcauuaaggug

SEQ ID NO: 40373 - RNA, 41 nt, Mus musculus
ucuggcuccacaauggguacaaugccauucugcuggcagau

SEQ ID NO: 40374 - RNA, 41 nt, Mus musculus
ggccgcugucuacaaggcucugagcgaccaccaugucuacc

SEQ ID NO: 40375 - RNA, 42 nt, Mus musculus
gaggcauccaucaaccucaaugcuaucaacaaguguccccug

SEQ ID NO: 40376 - RNA, 46 nt, Mus musculus
uguuggcaucacacaggaaaguguaucuaaaaagcuauuuuucagg

SEQ ID NO: 40377 - RNA, 46 nt, Mus musculus
ucuacuuuucaauugacauuccacuaaaauagaucaccccucuaga

SEQ ID NO: 40378 - RNA, 45 nt, Mus musculus
ggccgugccugguacucucacccauuuuucuuagacuggccugua

SEQ ID NO: 40379 - RNA, 42 nt, Mus musculus
aagauuucagcauuuuuuccuaugcauuuagguggcccagua

SEQ ID NO: 40380 - RNA, 46 nt, Mus musculus
uucuuaacuuaguuucuagaguugugaauacauauggaccacagac

SEQ ID NO: 40381 - RNA, 46 nt, Mus musculus
uugacagacgaauaucugcauuuauugagagaaaacaagcugaaau

SEQ ID NO: 40382 - RNA, 48 nt, Mus musculus
aaccuuuuugacccagaaguaguucagaucaaggcuggaaaagcagaa

SEQ ID NO: 40383 - RNA, 46 nt, Mus musculus
cuauagaacucaaauguggaccauauccagguggggaugacaggaa

SEQ ID NO: 40384 - RNA, 44 nt, Mus musculus
auuaaaauccauauugagucuaggucuguuaauuucacuaguga

SEQ ID NO: 40385 - RNA, 46 nt, Mus musculus
ugaauuguuggaugaguuauguguggccacuucuaacuacauuacg

SEQ ID NO: 40386 - RNA, 45 nt, Mus musculus
aaacugggguccuggcgacgaaagcuugcccaaaagaugccuaaa

SEQ ID NO: 40387 - RNA, 44 nt, Mus musculus
gucgugugcuuuggacucaucgacaugauucggcgucggcugga

SEQ ID NO: 40388 - RNA, 46 nt, Mus musculus
gguaaacaccuuuaagcuucacuugucaagauuuuuaggucucaaa

SEQ ID NO: 40389 - RNA, 42 nt, Mus musculus
uggcuuugcuugucugcuguucgagcuuucuuggagcgcuag

SEQ ID NO: 40390 - RNA, 57 nt, Mus musculus
augccauaaaugaaccuucaaaugccauaaaugaaccuucaaaugucauaaaucgug

SEQ ID NO: 40391 - RNA, 42 nt, Mus musculus
uaaugggagucggggggaaaaauguauucagcguggacagaa

SEQ ID NO: 40392 - RNA, 42 nt, Mus musculus
cacgccuagacgcccaguuaugaccauuuuucagguggaggc

SEQ ID NO: 40393 - RNA, 46 nt, Mus musculus
ggaauaaucaaagaaaguagaagucugggguucuucccguuuccuc

SEQ ID NO: 40394 - RNA, 46 nt, Mus musculus
auuaaguccauagacauguauauucauuucacuuaaggacguccga

SEQ ID NO: 40395 - RNA, 46 nt, Mus musculus
guggaucauuaaauguugccagaaaaaaaaaaguguugguauggag

SEQ ID NO: 40396 - RNA, 46 nt, Mus musculus
aauaaaacuauuuggaauuuuauuaugugguugguuuggugugugu

SEQ ID NO: 40397 - RNA, 46 nt, Mus musculus
uugaaguccagcuugugcuguugcucggaggaggacaugagguugu

SEQ ID NO: 40398 - RNA, 42 nt, Mus musculus
gcuggcuuuuaaggucccuucauuucauccacggcaggcuag

SEQ ID NO: 40399 - RNA, 46 nt, Mus musculus
ugaccucgaacaaccugaacuucaucauccuucugaaugggcauag

SEQ ID NO: 40400 - RNA, 45 nt, Mus musculus
uucugucagaagucacgaagggauugaacuucauuuugguggcug

SEQ ID NO: 40401 - RNA, 46 nt, Mus musculus
uacugagacaguauuaauauaauguuuaauuaugucauguggagau

SEQ ID NO: 40402 - RNA, 46 nt, Mus musculus
auuuagagcuaaaaaauuugagugagguaauaaacccacagcagac

SEQ ID NO: 40403 - RNA, 61 nt, Mus musculus
aggugacauggaaaaauguugaugauuguagauuaagcugaaacauauaaugagagcaaug

SEQ ID NO: 40404 - RNA, 46 nt, Mus musculus
ugggauucaguagucuauuaucuuaugaaugcuacaaauauguaau

SEQ ID NO: 40405 - RNA, 53 nt, Mus musculus
aagccccaguagaugaugcacaagagauucuucacuccagauuuccaaugccg

SEQ ID NO: 40406 - RNA, 45 nt, Mus musculus
acuauagcacaguggcggaagucaggauaccaggacaugccagaa

SEQ ID NO: 40407 - RNA, 46 nt, Mus musculus
ugaguuugaggccagucugaucuacauagcagguuccaggccagcc

SEQ ID NO: 40408 - RNA, 44 nt, Mus musculus
ccucauggacacguucuuccagauuuugauuuaucacggugagg

SEQ ID NO: 40409 - RNA, 46 nt, Mus musculus
uaagaagaucuccuuucuugcaaguuuuuaacaauaguccugauga

SEQ ID NO: 40410 - RNA, 41 nt, Mus musculus
acuuugaucuugugucacaucaagagaccaguggagguaau

SEQ ID NO: 40411 - RNA, 46 nt, Mus musculus
gcugccauucucauggccaggcuggcaauauacagagcagaaacag

SEQ ID NO: 40412 - RNA, 34 nt, Mus musculus
uguagccaggcugccuugacucuccuguguaggu

SEQ ID NO: 40413 - RNA, 46 nt, Mus musculus
gguucuuuagcuuucaaacaccuuguuuuuuauuuuugcaggagau

SEQ ID NO: 40414 - RNA, 46 nt, Mus musculus
gugugucucuuaauucaaaaggaccuugcgugucugaaaauguaag

SEQ ID NO: 40415 - RNA, 46 nt, Mus musculus
gaauuuucauuaaacauaucuuauuggcauuucauugauggcuuac

SEQ ID NO: 40416 - RNA, 46 nt, Mus musculus
auauacauggccaguuuaaaaugggcuuugguggcacauuagaaau

SEQ ID NO: 40417 - RNA, 46 nt, Mus musculus
cucugaaaaccuuacuaaaugugaaagcugauccuagagccaauug

SEQ ID NO: 40418 - RNA, 41 nt, Mus musculus
ucugugugugcaugugaguagacaugcucuuggcggucaga

SEQ ID NO: 40419 - RNA, 46 nt, Mus musculus
caggcagguacuugaaacauaucaugcccucaacuuggccaaagau

SEQ ID NO: 40420 - RNA, 46 nt, Mus musculus
auucucccccccuccugugugugugugugugugugugugugugugu

SEQ ID NO: 40421 - RNA, 42 nt, Mus musculus
agaggaacaaaggaucugucugccaaacaacugcagguaagg

SEQ ID NO: 40422 - RNA, 43 nt, Mus musculus
uguguguguguguguggugugguguauguguguguggugugug

SEQ ID NO: 40423 - RNA, 45 nt, Mus musculus
ccaaaacauuauggauucuuuguuuuuuacuugguauuugcuagu

SEQ ID NO: 40424 - RNA, 46 nt, Mus musculus
cuacaagaaugguugucccaguggcagcccuguuuacaccucugaa

SEQ ID NO: 40425 - RNA, 49 nt, Mus musculus
uucagugaacagcagugaguggcauuggagcgcagagagagguugagag

SEQ ID NO: 40426 - RNA, 42 nt, Mus musculus
auuuguaacacacccacauaccuuucaucucaacccccagcu

SEQ ID NO: 40427 - RNA, 41 nt, Mus musculus
gaguugaugccacgguuguuaccuguggagcccugugacuu

SEQ ID NO: 40428 - RNA, 42 nt, Mus musculus
guccgggaaauuuaagaucuuauuacacccuacgguuggcag

SEQ ID NO: 40429 - RNA, 49 nt, Mus musculus
cagcccaauguccagauguugugguagcccagauugacccaaagaaguu

SEQ ID NO: 40430 - RNA, 44 nt, Mus musculus
cucaugccuggcccaugacuguuuuaauuagccuuaucuugaga

SEQ ID NO: 40431 - RNA, 46 nt, Mus musculus
uuggaauaucuaaguaauugguuuggagaaagagacuuuacuccag

SEQ ID NO: 40432 - RNA, 42 nt, Mus musculus
agaugaccuugaacucagaaacuucuaccucccagccuccag

SEQ ID NO: 40433 - RNA, 45 nt, Mus musculus
guauucaccucucuagacacugccuugauucauuuguagcgggua

SEQ ID NO: 40434 - RNA, 43 nt, Mus musculus
auaugcacugaacagauuauauauucaagagagagagggcgag

SEQ ID NO: 40435 - RNA, 46 nt, Mus musculus
uccugacagaaacuguaaggaaaccagcugaauguuugaccugaug

SEQ ID NO: 40436 - RNA, 45 nt, Mus musculus
agugucagcugccaaagaauagauuuacaugaagaagugcccaca

SEQ ID NO: 40437 - RNA, 46 nt, Mus musculus
acacacuccuagauacucguguuucuuuauucucguuguguucuga

SEQ ID NO: 40438 - RNA, 45 nt, Mus musculus
ugaaacccaguauaccacuugagaggguucacuuugacagcuacg

SEQ ID NO: 40439 - RNA, 46 nt, Mus musculus
gaauauguauauaugcacuacauuuaugucugguucccacaaaggu

SEQ ID NO: 40440 - RNA, 42 nt, Mus musculus
ugaagcucauuuggagucuaagugagucagaaaguggaagcu

SEQ ID NO: 40441 - RNA, 46 nt, Mus musculus
ugguuuuuuuugguugguugguuugaauuuuuuugcuucucgagac

SEQ ID NO: 40442 - RNA, 46 nt, Mus musculus
cauugaucuaccugcuugucacuguaccaauaccaugcgguuugua

SEQ ID NO: 40443 - RNA, 46 nt, Mus musculus
ggcagagcacauggaguggagaacuacccuuggcacgugcgcagau

SEQ ID NO: 40444 - RNA, 41 nt, Mus musculus
uaauggaguuccccaaagauaacuuuaaggucacugugaau

SEQ ID NO: 40445 - RNA, 45 nt, Mus musculus
augugcucacggacuauuacguacuuuaaauggcucguuauagaa

SEQ ID NO: 40446 - RNA, 42 nt, Mus musculus
aucagugguacugaucuucugagagaauaacaguuggcuugu

SEQ ID NO: 40447 - RNA, 46 nt, Mus musculus
cuuugugcugaauugccuuacucaaugcauagucaugccccacagg

SEQ ID NO: 40448 - RNA, 46 nt, Mus musculus
uuuuuuccagugcccuguuuccuaagcuuucacgugaacccauucc

SEQ ID NO: 40449 - RNA, 45 nt, Mus musculus
gaauuugaccauuggugauggguaauuaauucauagugacgaggu

SEQ ID NO: 40450 - RNA, 46 nt, Mus musculus
cccaaugucuuauguuuguaugcacccuauagagcauuccucagaa

SEQ ID NO: 40451 - RNA, 46 nt, Mus musculus
gauucuuuucacagucugguguauuaccaguguguuagcaugggaa

SEQ ID NO: 40452 - RNA, 46 nt, Mus musculus
cuucucguucuucccuccaaaccuucucuacccacuugccccuuuu

SEQ ID NO: 40453 - RNA, 46 nt, Mus musculus
aucacuaaugaaaagauuuaauauuauguuuuaucugccaccaauc

SEQ ID NO: 40454 - RNA, 45 nt, Mus musculus
aauuagucuacaugacucucauaaagaaguaacauaauacuagau

SEQ ID NO: 40455 - RNA, 58 nt, Mus musculus
uuacacagagaaacucugucuugagaggaggauagagagagggagagagggagaagaa

SEQ ID NO: 40456 - RNA, 42 nt, Mus musculus
cuucagguuaggcuugagacugucacugagaccugggcagug

SEQ ID NO: 40457 - RNA, 44 nt, Mus musculus
gagauugacaacauauguagacaaaucaagaacauuggcaaaga

SEQ ID NO: 40458 - RNA, 45 nt, Mus musculus
agacagcuguuagaccaucuaccugguuuaacugaugaugaagaa

SEQ ID NO: 40459 - RNA, 43 nt, Mus musculus
uaaaaguagaaccagagcaagaaauacaaaagaaaggcugaau

SEQ ID NO: 40460 - RNA, 46 nt, Mus musculus
augugacauaaucacugccagacauauucagauaccuugcccgaaa

SEQ ID NO: 40461 - RNA, 45 nt, Mus musculus
aaaaugacauuuuaaaaaguauuaugggaacuuaaugggagaaug

SEQ ID NO: 40462 - RNA, 42 nt, Mus musculus
cuugcugagcaccugcuuuuguucaguucccagcacccuuau

SEQ ID NO: 40463 - RNA, 45 nt, Mus musculus
aacuuaacacuguuuguaguaugugaugugugguguggugcucuu

SEQ ID NO: 40464 - RNA, 46 nt, Mus musculus
cagacacugagagaaaaauuuuauaaauucuuguucuucaggagau

SEQ ID NO: 40465 - RNA, 45 nt, Mus musculus
agagauaugacugauguuuauuggcauagcaauguaauuauagag

SEQ ID NO: 40466 - RNA, 46 nt, Mus musculus
gaucccauaaagaauacaucuaaaauuaaacguucaaguccaagac

SEQ ID NO: 40467 - RNA, 45 nt, Mus musculus
ucuauuacuucugauaaugaugugacaacagaaaggacugcaaaa

SEQ ID NO: 40468 - RNA, 46 nt, Mus musculus
ucagcuucgugcauuucaaagaaggcauuaacuagagcccaguuug

SEQ ID NO: 40469 - RNA, 46 nt, Mus musculus
ucugaagcaguggcuaagaucuauauccugauccacaggcagagag

SEQ ID NO: 40470 - RNA, 46 nt, Mus musculus
ccuccuaacacggauaagaaagcucaguugcaacaaaccuauaucu

SEQ ID NO: 40471 - RNA, 69 nt, Mus musculus
acccuuccaaacagcucucuugauaucaguguuauaaagcccagcauggauagauuaagaaaugaaaug

SEQ ID NO: 40472 - RNA, 46 nt, Mus musculus
uugguaaaauaucagaaguccucucuaaaaguuaauggucauaaaa

SEQ ID NO: 40473 - RNA, 67 nt, Mus musculus
ugaauuuucuauaaaaagaauuuuguugccacucuccuaucaagaugauuguaacaccuuugaagca

SEQ ID NO: 40474 - RNA, 45 nt, Mus musculus
uuuuguuuuuaauauguuuguguggcuaucuucuuuuggguuuau

SEQ ID NO: 40475 - RNA, 45 nt, Mus musculus
auguguuuuuuuuuucccuuugaguuuguuuauauaguggauuau

SEQ ID NO: 40476 - RNA, 69 nt, Mus musculus
uugauuugcuguauauugguuuuacuauguuuaggugugggcuaugaauuuaugaucuuugcuagacuu

SEQ ID NO: 40477 - RNA, 51 nt, Mus musculus
ugaaguuguuuaucagguguaggaguucucugguagaauuuuggggucacu

SEQ ID NO: 40478 - RNA, 46 nt, Mus musculus
guuguuucucuaauuucuuucucagccuguuuauacuuugaguaga

SEQ ID NO: 40479 - RNA, 46 nt, Mus musculus
cuuuugacaagauggccauguuuacaauacuaauccugccaaucca

SEQ ID NO: 40480 - RNA, 45 nt, Mus musculus
aguuuuuaccuuuaugaagaauagaguuggaauuuugauggagau

SEQ ID NO: 40481 - RNA, 46 nt, Mus musculus
ugacccccuuuuuccccccacccucuuccuuucuuccucccgagua

SEQ ID NO: 40482 - RNA, 44 nt, Mus musculus
acccacaguuccccaucccucauugcuucacaccucugcucaaa

SEQ ID NO: 40483 - RNA, 41 nt, Mus musculus
gugguguuagcguuguacucuuagggcccacagcuugagau

SEQ ID NO: 40484 - RNA, 43 nt, Mus musculus
guuuggaaaacaggaaguuccauggaacacagggcccccaaug

SEQ ID NO: 40485 - RNA, 36 nt, Mus musculus
ggccggguccccgccugacucuucucgggcgucuaa

SEQ ID NO: 40486 - RNA, 41 nt, Mus musculus
uggguaaccacggccucgagcugcuguccucaccaagguag

SEQ ID NO: 40487 - RNA, 31 nt, Mus musculus
ggcacuccuuucaaccaauacucuuucacaa

SEQ ID NO: 40488 - RNA, 67 nt, Mus musculus
uguaaccaaaggugacauuaugcuuccagaaaagucucaaagaaaaguguugcaagcaauggucgug

SEQ ID NO: 40489 - RNA, 28 nt, Mus musculus
ucacacugacaggcucaauuucuccacu

SEQ ID NO: 40490 - RNA, 46 nt, Mus musculus
aaauaauuuccaugccucccuuuuauaauaaacagaugaugccuga

SEQ ID NO: 40491 - RNA, 46 nt, Mus musculus
guggcuuuccaaagggcacggggaguacagagaaaucggcagcgag

SEQ ID NO: 40492 - RNA, 45 nt, Mus musculus
cgcuagcucucuuaagagauggcaagacacaagauuauguuguug

SEQ ID NO: 40493 - RNA, 46 nt, Mus musculus
gguuguucugauguuaucaauuacaguggaaauuuaauggagccac

SEQ ID NO: 40494 - RNA, 42 nt, Mus musculus
ugguacguugaccauguuugcaguagaagugucugcgaugag

SEQ ID NO: 40495 - RNA, 42 nt, Mus musculus
cccgacucaaccgcacgcgccgaacaggaaagggacgaacag

SEQ ID NO: 40496 - RNA, 24 nt, Mus musculus
aagccgcaggcggccaccacgagc

SEQ ID NO: 40497 - RNA, 46 nt, Mus musculus
cguuccucagcaucugaucgaaguucaacugguacaccagggaccg

SEQ ID NO: 40498 - RNA, 46 nt, Mus musculus
gagguauuccggccuguuaugcaccuggaccaccagcaccagcucc

SEQ ID NO: 40499 - RNA, 42 nt, Mus musculus
cacccuggagaucagacuguugaucucugcggaccagaaguc

SEQ ID NO: 40500 - RNA, 45 nt, Mus musculus
aggaagacaagcuagagucaaauacugaagaguccagucccaguu

SEQ ID NO: 40501 - RNA, 45 nt, Mus musculus
caaaucccagcaaccacaugguggcucacaaccauccuuaaaaag

SEQ ID NO: 40502 - RNA, 46 nt, Mus musculus
ucggacauuuguuucugagaaagaacuuauaguugguucgguaggg

SEQ ID NO: 40503 - RNA, 45 nt, Mus musculus
ggccacaggucuuuaaucccacacucaggagguagagguaggcag

SEQ ID NO: 40504 - RNA, 44 nt, Mus musculus
acgaugacucuucauaacuucuucaagcugaauaugggcacuga

SEQ ID NO: 40505 - RNA, 46 nt, Mus musculus
uaaauacuguauaccauacaguguauagcaugaccccucguggcag

SEQ ID NO: 40506 - RNA, 45 nt, Mus musculus
uuuccuuguucccgaagaucuuggauagcaccuuccccaucgcgu

SEQ ID NO: 40507 - RNA, 46 nt, Mus musculus
gggccucgucgaugcggucgcggucggcgcagucuaccacgaagau

SEQ ID NO: 40508 - RNA, 73 nt, Mus musculus
aguugcuauuaccccaccccguuugcuggaagucacaaggcaucuagcacuguauucgugucaaaugucagau

SEQ ID NO: 40509 - RNA, 46 nt, Mus musculus
ggcuauaaaaggucacauuugaaacugcuaaaguuagcgcuaagga

SEQ ID NO: 40510 - RNA, 49 nt, Mus musculus
uacggggcaagcugguuccaagcauaauaggacugucucgaaggaagga

SEQ ID NO: 40511 - RNA, 46 nt, Mus musculus
cuggccacagugggacacuauaucaaaauuuauguaaggcuggcuu

SEQ ID NO: 40512 - RNA, 46 nt, Mus musculus
ucaauucccagcaaccacgugguggcucacaaccauccguaauggu

SEQ ID NO: 40513 - RNA, 25 nt, Mus musculus
ugagacaguuuucaaggcugcuaaa

SEQ ID NO: 40514 - RNA, 45 nt, Mus musculus
gucuugguagcaguuacccucugggggagcuggaugcggucgcug

SEQ ID NO: 40515 - RNA, 46 nt, Mus musculus
aaaaaaaauaccauuuucaguuuauuacgucaagaguuuccuguga

SEQ ID NO: 40516 - RNA, 25 nt, Mus musculus
gauguuauagucacugaucuugaag

SEQ ID NO: 40517 - RNA, 45 nt, Mus musculus
aaaggacgauggcggcgucccacacaacgcaacccacgcccccgg

SEQ ID NO: 40518 - RNA, 47 nt, Mus musculus
acagcggcuggugaugauccuguggaaacacacaaacagacccucuc

SEQ ID NO: 40519 - RNA, 46 nt, Mus musculus
uuucauacaggguugccuuaacgggaauugguuuccaacuccagau

SEQ ID NO: 40520 - RNA, 46 nt, Mus musculus
acuguguggugguuauaucaaguuugcuuaauaaaagcuaugagac

SEQ ID NO: 40521 - RNA, 46 nt, Mus musculus
cagggugagaggugugcuuugagagacaguuacauucggccaaggc

SEQ ID NO: 40522 - RNA, 41 nt, Mus musculus
aaagagaaugaauagcuagcugcagggagggaagcccagga

SEQ ID NO: 40523 - RNA, 46 nt, Mus musculus
guagugguucauaugucaccauaugcaaccacaauaggguccauuc

SEQ ID NO: 40524 - RNA, 45 nt, Mus musculus
uacugggggugagaguauguguguguucuuuuuaagcugccagug

SEQ ID NO: 40525 - RNA, 46 nt, Mus musculus
gcccacauccaaacucacagguuuccugaccgcauucugccaaggu

SEQ ID NO: 40526 - RNA, 46 nt, Mus musculus
cuguaaugcaguuauaauuaauuacuccuaaaacagagccuaagua

SEQ ID NO: 40527 - RNA, 46 nt, Mus musculus
uucaaaaguauuugauggcugcccuuugaaaauuaauugugcaaca

SEQ ID NO: 40528 - RNA, 46 nt, Mus musculus
ugacucuaaaauggagagaaagggaagaccaugacuuuugggagaa

SEQ ID NO: 40529 - RNA, 46 nt, Mus musculus
auauuacauuggaauccuuuuguggauggagcaaauacaggcaggu

SEQ ID NO: 40530 - RNA, 46 nt, Mus musculus
gguuuuucuugaagcagauuauuugucugauguguaauuagugaau

SEQ ID NO: 40531 - RNA, 41 nt, Mus musculus
uaggggagcagggcagguggaggguauaggggacuuucggg

SEQ ID NO: 40532 - RNA, 42 nt, Mus musculus
ccacagacuaaaguguuuucuuuuauuuccuuugccugaaug

SEQ ID NO: 40533 - RNA, 42 nt, Mus musculus
gagauagccaaaagauuuagguuuuccaugagugcgcagggu

SEQ ID NO: 40534 - RNA, 45 nt, Mus musculus
gcuugcauuguagguacagcaugaguguaacuggugccuaagaga

SEQ ID NO: 40535 - RNA, 46 nt, Mus musculus
cuuuaauacugaacaacuuccauauggagaggucuagucaggaguu

SEQ ID NO: 40536 - RNA, 42 nt, Mus musculus
ccauaauuuugucaaaauagcacuaacuaaaaaccccaagaa

SEQ ID NO: 40537 - RNA, 45 nt, Mus musculus
cccccuucugaugugucugaagacagcuacaguguacucauauaa

SEQ ID NO: 40538 - RNA, 44 nt, Mus musculus
agucugucugggauguacuuuccaggcccucuaagcccucaguu

SEQ ID NO: 40539 - RNA, 45 nt, Mus musculus
uacaccuuuuaugcucaguguguuuugagggguuuuuguuugguu

SEQ ID NO: 40540 - RNA, 46 nt, Mus musculus
auaccuauuuuauuccuaaaagagaaaaaucuacugaacuugagaa

SEQ ID NO: 40541 - RNA, 46 nt, Mus musculus
augucuauguaguuguuguuuuaaaaugaaccuagauugaucagau

SEQ ID NO: 40542 - RNA, 45 nt, Mus musculus
uuagcagggcggugguagcccacucuguuaaucccagcacucaga

SEQ ID NO: 40543 - RNA, 46 nt, Mus musculus
cauguggugguacauaccuguaaucccagcauuuaggaggcaaaag

SEQ ID NO: 40544 - RNA, 42 nt, Mus musculus
uguagacuuagucucuaacauuauucuuucuuguccccagag

SEQ ID NO: 40545 - RNA, 41 nt, Mus musculus
aaaagcugcugcugguggugugccuguaacccagcccuggg

SEQ ID NO: 40546 - RNA, 46 nt, Mus musculus
uuuuaaaugauacuaccgggaaauccuguuuccuggaaguguacga

SEQ ID NO: 40547 - RNA, 46 nt, Mus musculus
ccagcacacauauugugcagcucacacccaccuauuaacuccaguu

SEQ ID NO: 40548 - RNA, 46 nt, Mus musculus
gugagcaggccccuuguguuuccccuccacuccucugccuccauuu

SEQ ID NO: 40549 - RNA, 46 nt, Mus musculus
caauacgccuagugcuccuagugcucccagaguucugcccucagua

SEQ ID NO: 40550 - RNA, 42 nt, Mus musculus
ggaauuaauguaugaugcugugguugcucacucaugcucaga

SEQ ID NO: 40551 - RNA, 73 nt, Mus musculus
auguauguguauaguguguguauguguguaguguguaugaguguguacguguguauguguguaguguauauga

SEQ ID NO: 40552 - RNA, 46 nt, Mus musculus
guguguguguaguguaaaugaguauguacguguguaguguguaugu

SEQ ID NO: 40553 - RNA, 41 nt, Mus musculus
acugauauagugugugugugugugugugugugugugugugu

SEQ ID NO: 40554 - RNA, 46 nt, Mus musculus
uccagugacaggaaguuggaguacuguguucucuguauucacaggu

SEQ ID NO: 40555 - RNA, 46 nt, Mus musculus
gggcuaagaggaucagaaauugaguuagagcccugacugagagguc

SEQ ID NO: 40556 - RNA, 46 nt, Mus musculus
uagagcagggagggagggaaggcgagugugcgugagagacuggaug

SEQ ID NO: 40557 - RNA, 42 nt, Mus musculus
acauggccuggcaccagaagaagccagaagagggagucagau

SEQ ID NO: 40558 - RNA, 43 nt, Mus musculus
aagacugcuaccuucgugggacaugguauucuagcacacagga

SEQ ID NO: 40559 - RNA, 46 nt, Mus musculus
ugguuagagugaggugcacugacugaugaggagcccugauggagaa

SEQ ID NO: 40560 - RNA, 50 nt, Mus musculus
cuaacauugcgccagcacacaguaucugcucaauaaauagaucuugaaga

SEQ ID NO: 40561 - RNA, 94 nt, Mus musculus
accagugcaugggagagcacgugugacauggaaugaggucagcaggaagcuugcacccaggagagcugaggggacuauagucucagagaagggg

SEQ ID NO: 40562 - RNA, 45 nt, Mus musculus
ucuagcuuuugccccacccuacccccuuuuuccccugguacagaa

SEQ ID NO: 40563 - RNA, 24 nt, Mus musculus
ccuuggggugauggauucugaggu

SEQ ID NO: 40564 - RNA, 45 nt, Mus musculus
uguuauuaugggggucugggauggaaauuuugagggagaugcuca

SEQ ID NO: 40565 - RNA, 44 nt, Mus musculus
uucuuacuccuuggaggccauguaggccaugagguccaccaucc

SEQ ID NO: 40566 - RNA, 46 nt, Mus musculus
gccagucaggaauuucugcaguaugguagggauuugcagggaccag

SEQ ID NO: 40567 - RNA, 42 nt, Mus musculus
uucccagcaaccacaugguggcucacaaccaucuaaugggau

SEQ ID NO: 40568 - RNA, 46 nt, Mus musculus
aggaaaaaucacaagucagcaguacaugccaggugcuggcugaugg

SEQ ID NO: 40569 - RNA, 46 nt, Mus musculus
acguaauagguuccaaauucugaugacucuacucguucccagccag

SEQ ID NO: 40570 - RNA, 44 nt, Mus musculus
guaguauuuucucccucucauuguccaguccacagaccagccag

SEQ ID NO: 40571 - RNA, 46 nt, Mus musculus
gugucaguguaaaauggccacaaaaauaacacuacuauuaaagcag

SEQ ID NO: 40572 - RNA, 46 nt, Mus musculus
ucuucauuaacuugcuuuaaaauguuaaccacugggggcuggagag

SEQ ID NO: 40573 - RNA, 42 nt, Mus musculus
gguguuuuucucaggugaaaggagcaguagaugaugacguag

SEQ ID NO: 40574 - RNA, 80 nt, Mus musculus
guagaguuuaaucauucuggagaauuacuagccacaggagauaaaggugggagagcugucaucuuucaacaagagcagga

SEQ ID NO: 40575 - RNA, 46 nt, Mus musculus
ugagccagaauuugacuacuugaaaagcuuagaaauagaagggaag

SEQ ID NO: 40576 - RNA, 45 nt, Mus musculus
gugaaagagacaaaagaccagaaggcuauaacuugaaagaggaag

SEQ ID NO: 40577 - RNA, 54 nt, Mus musculus
cacacuuaucacaucaacucaauuucuaucaauagugauuaugaaaccuacuua

SEQ ID NO: 40578 - RNA, 46 nt, Mus musculus
cccaacagcuguaacacauuuguguacagcagcaguaaaggaacca

SEQ ID NO: 40579 - RNA, 46 nt, Mus musculus
uugacagccuagacuugaacaagaaaauccuucauacagccuggca

SEQ ID NO: 40580 - RNA, 45 nt, Mus musculus
caagaauucuguccuucauuauaaguuaaaaacuaccagcaagca

SEQ ID NO: 40581 - RNA, 65 nt, Mus musculus
ccacggacggcggaauaacgugcgcguccucaccgaugagaacuggacgucguugcuggaaggag

SEQ ID NO: 40582 - RNA, 50 nt, Mus musculus
ugcuugucagaaucuucagccagaaugggaaaguuuugccgaguggggag

SEQ ID NO: 40583 - RNA, 42 nt, Mus musculus
aagcccacugccagcaucaaccugaacagaaagaaccucaag

SEQ ID NO: 40584 - RNA, 45 nt, Mus musculus
uaugcuuagaggagucuuagcaagaggaguaagacaacugaagga

SEQ ID NO: 40585 - RNA, 46 nt, Mus musculus
ggcccaaggacuaagaaggacuucauaaacuucguaagugauaaag

SEQ ID NO: 40586 - RNA, 46 nt, Mus musculus
aguuucccuccuuguguugguguuuuccuucuauuauccuuuguag

SEQ ID NO: 40587 - RNA, 45 nt, Mus musculus
auagcuugcuauguuugcuaacccucccugcagugguggguugcu

SEQ ID NO: 40588 - RNA, 46 nt, Mus musculus
agaaaaaacaucaccagaauuuucucaaccucugaaaaaaguggag

SEQ ID NO: 40589 - RNA, 45 nt, Mus musculus
guagguccuuuagguuggacaguuuccauucaggaaauaaaaaca

SEQ ID NO: 40590 - RNA, 75 nt, Mus musculus
aguaagauuuguguuuauauuuaauaaucuauuuugugugagauucgaaacugccuuucccaagauuugcauuac

SEQ ID NO: 40591 - RNA, 48 nt, Mus musculus
cuuacuuuauagcuuucauuucuacacauuacauuuaggcuauguugc

SEQ ID NO: 40592 - RNA, 46 nt, Mus musculus
auuuuggugucuuguucacuguaugauuuuuguuauuugccaugug

SEQ ID NO: 40593 - RNA, 90 nt, Mus musculus
ucgaacuguuuacuugaaaauguacaaauuuggcuauacauuccagauuuuaaauuauuauucugaaguuuucucuuuuuuaaugugaag

SEQ ID NO: 40594 - RNA, 55 nt, Mus musculus
cuauuguguuuuaaagacaaauuauauauuguauuguuguugacugcuaguacug

SEQ ID NO: 40595 - RNA, 65 nt, Mus musculus
uguaucucacaaauggaaacaagaucggcaaaaggacuacauggauuucaucuuacaaaguggga

SEQ ID NO: 40596 - RNA, 46 nt, Mus musculus
gcuucuuuuaggccucuccuuuauaguuuaaauguucugcugucag

SEQ ID NO: 40597 - RNA, 42 nt, Mus musculus
agagggaaggagggagaaagagagagagagagggagggagaa

SEQ ID NO: 40598 - RNA, 46 nt, Mus musculus
auacugggcacucggccaaguuacacucacucuccuggugcuaggg

SEQ ID NO: 40599 - RNA, 46 nt, Mus musculus
acaacuaucuauagggggaucugacgcccucuucagacaggcggau

SEQ ID NO: 40600 - RNA, 45 nt, Mus musculus
cuagaacucugcaucuuucugugucagccucaugagugcugggac

SEQ ID NO: 40601 - RNA, 46 nt, Mus musculus
aacucaggaccuuugcuugcuccagccccacucauucuggcccaaa

SEQ ID NO: 40602 - RNA, 46 nt, Mus musculus
uacguucucuccugauggaagaguuuuccaaguugaauaugccaug

SEQ ID NO: 40603 - RNA, 82 nt, Mus musculus
cagcuauugggaucagauguaaagaugguguuguguuugggguagaaaaacuaguccuuucuaaacuuuaugaagaaggcuc

SEQ ID NO: 40604 - RNA, 46 nt, Mus musculus
gggugagggaugugggagauacagacaugaggucuuaacagcucag

SEQ ID NO: 40605 - RNA, 64 nt, Mus musculus
gauacuuuaucccagcagaacacuuuauaguaaggaacagggagaggagaugacauaaagugaa

SEQ ID NO: 40606 - RNA, 52 nt, Mus musculus
gcagguuugcuggcagaugcucguucauuagcagacauagcgagagaagaag

SEQ ID NO: 40607 - RNA, 44 nt, Mus musculus
uaagcuaggcaugcugugucugcagucuggguauucaggagcua

SEQ ID NO: 40608 - RNA, 46 nt, Mus musculus
ccuuuuaaguugcuuaucagccauauuuaaauacagaagugacaga

SEQ ID NO: 40609 - RNA, 46 nt, Mus musculus
cuggggcugugcgauuggcaaagccaggcaggcugcaaagacagag

SEQ ID NO: 40610 - RNA, 46 nt, Mus musculus
ccuuuuccuuuucccuuucccuuuuccuuuucccccuuacccccuu

SEQ ID NO: 40611 - RNA, 46 nt, Mus musculus
uagaugaaggaaaugacuugccgugauguaguuaaagaaguugcaa

SEQ ID NO: 40612 - RNA, 78 nt, Mus musculus
aagauccaucuucuaccucuacuggggcuaaauuaugugcucccaugaugggaaacuuagcgucuuuucaaagauagg

SEQ ID NO: 40613 - RNA, 46 nt, Mus musculus
acacacagaaguaaauaaauccaaaaaaaguuucuuacccggcugc

SEQ ID NO: 40614 - RNA, 45 nt, Mus musculus
uguuauuuuuaagugaguucaccugugaauaaugauuauuugggg

SEQ ID NO: 40615 - RNA, 52 nt, Mus musculus
guaacuaaaggaagacaugaaauuguucccaaagacauaagagaggaagcag

SEQ ID NO: 40616 - RNA, 64 nt, Mus musculus
ccgcugguuuacauuucuguaacaguugcauauggcuagcaccauggacuauauauacccacug

SEQ ID NO: 40617 - RNA, 46 nt, Mus musculus
ucaacagcuuguuauuugguggauuguggcaguaaaucggggcgag

SEQ ID NO: 40618 - RNA, 41 nt, Mus musculus
cgcgauggggucccggugcaguugggagcuccgcaggcuga

SEQ ID NO: 40619 - RNA, 46 nt, Mus musculus
ugucagugccaaguaccgaggggccuucugugaggcaaagaucaag

SEQ ID NO: 40620 - RNA, 49 nt, Mus musculus
cgcgugugugcacgugugugugugugugugugugugugugugugucuga

SEQ ID NO: 40621 - RNA, 46 nt, Mus musculus
cgucagccucuaugguuggccaaggcgcugauuuuuaagaccaggg

SEQ ID NO: 40622 - RNA, 46 nt, Mus musculus
accaccuuacuguaaguaaaggcuuacaaggauguggaccauucag

SEQ ID NO: 40623 - RNA, 41 nt, Mus musculus
ugcauguguguguaccacauguggcugaugugagggguuca

SEQ ID NO: 40624 - RNA, 46 nt, Mus musculus
gaaggaaacugggaaaggcagggcugaggacugagggagauuucag

SEQ ID NO: 40625 - RNA, 46 nt, Mus musculus
acccagagcauuuugggacgccagucauugcaaagaagaccaacag

SEQ ID NO: 40626 - RNA, 46 nt, Mus musculus
ucagugcaggacacucacauaagcaauuguagguguuagagcuaaa

SEQ ID NO: 40627 - RNA, 46 nt, Mus musculus
aagcaagcuucaguuaagcgagagaccuugucucagcgcagugcag

SEQ ID NO: 40628 - RNA, 81 nt, Mus musculus
aauccuugaguccuccagcagugaugacgaagaaugcccagcugaggaacaugaagaggagaaggaaaaagaggccaaaaa

SEQ ID NO: 40629 - RNA, 50 nt, Mus musculus
gucugaaacauuucuuagcuuaauuugguuaaggaguuguggcuaguugg

SEQ ID NO: 40630 - RNA, 45 nt, Mus musculus
uuaccaaaaaguacuuuucgagguuaaucaacaagguuuugggga

SEQ ID NO: 40631 - RNA, 46 nt, Mus musculus
aggggacagcagauauuugccaaucagacugacaugcccagagccu

SEQ ID NO: 40632 - RNA, 46 nt, Mus musculus
uagcuuggaaauuuauuggaaaguccagaugaauagaaaugauagg

SEQ ID NO: 40633 - RNA, 47 nt, Mus musculus
uugauccugaggagagggacaauuuccuccaacagcuuuauaaguuu

SEQ ID NO: 40634 - RNA, 46 nt, Mus musculus
aagccgaugaaccagcuauuccugauggcacuuagaugaauaaaaa

SEQ ID NO: 40635 - RNA, 42 nt, Mus musculus
aucucuucaaacucuuuagacuggucuaucaucaggggggau

SEQ ID NO: 40636 - RNA, 45 nt, Mus musculus
caguggugcuguauggaagcaaauuuauauggaccuuggcauucc

SEQ ID NO: 40637 - RNA, 46 nt, Mus musculus
guggagagguggcaagggcagagggcggguaugagggaauggggag

SEQ ID NO: 40638 - RNA, 104 nt, Mus musculus
aguucagaacuauucaccaccaugaaccaaaaguaaaagaggaaaaaaaagacuuugaagacucaauggacgaagcucuaaaagaggccccggaaaugccuuug

SEQ ID NO: 40639 - RNA, 67 nt, Mus musculus
cuggacgugaagagugagcccgaggagaauacggacucaaacagugaaagcgacagagaagacacag

SEQ ID NO: 40640 - RNA, 46 nt, Mus musculus
gauguacuugcucagucugaauugauuugcucucuuuuccucccuc

SEQ ID NO: 40641 - RNA, 72 nt, Mus musculus
ccaugaaggcaaggcugaguguugguuuugcucacugaugagauccgaggcuucuagaauaaagacgcacag

SEQ ID NO: 40642 - RNA, 47 nt, Mus musculus
cuccgcauacauugauuuguauuuucccaucuaccucgccuccgccc

SEQ ID NO: 40643 - RNA, 45 nt, Mus musculus
ugguugugagccaccaugugguugcugggauuugaacuccacacc

SEQ ID NO: 40644 - RNA, 48 nt, Mus musculus
gagaaggaaaauuguucgagaugcaaacuguaucaagaaggaaauaga

SEQ ID NO: 40645 - RNA, 46 nt, Mus musculus
aagauuaaaaagccagaggacucugagagagacucagaugaagagg

SEQ ID NO: 40646 - RNA, 41 nt, Mus musculus
cuguauccaguugagagcuggcaggguugguaaauggcccu

SEQ ID NO: 40647 - RNA, 46 nt, Mus musculus
uaaauaaaaguugaguguacaaacagcagccagcauauagucccag

SEQ ID NO: 40648 - RNA, 70 nt, Mus musculus
caaguacggacgaggaaaaacucagaaaauuuaugaagccagcaucaaaagcacggagauggacgacggg

SEQ ID NO: 40649 - RNA, 77 nt, Mus musculus
auggguaaaagcugacaggauaaucuggcccuuggacaaagguggaccaaagaaaaaacaaaagaagaaaguuaagg

SEQ ID NO: 40650 - RNA, 47 nt, Mus musculus
agaauaaagaagauagugaaaaggacgaaaagagggaugaagagagg

SEQ ID NO: 40651 - RNA, 40 nt, Mus musculus
cagugagaggcauagcagcuuaucuugguuuggaaccuag

SEQ ID NO: 40652 - RNA, 78 nt, Mus musculus
gcucagggggugaagaucuuucuccugaugucaaagaagaauuggaaaaaaaugaaaaugcacaugaugauaaacuag

SEQ ID NO: 40653 - RNA, 46 nt, Mus musculus
ccaaguagaagaauuuaagaaacagguggaaaagucucccaaaggg

SEQ ID NO: 40654 - RNA, 86 nt, Mus musculus
cacucaaagaagaggaggaugcgaugccucugaucgggccugaaaccuugguuugccaugagguagaccuggaugauuuagaugag

SEQ ID NO: 40655 - RNA, 45 nt, Mus musculus
aguguugccucuggugccuguaguauaauugcacacgagcgagag

SEQ ID NO: 40656 - RNA, 47 nt, Mus musculus
caaccaucuguaacaagaucugacuccaucuccuggagugucugaag

SEQ ID NO: 40657 - RNA, 46 nt, Mus musculus
aaagcgaaccccaaagcggacaagugcugcagccaaaacugaaaag

SEQ ID NO: 40658 - RNA, 42 nt, Mus musculus
ugacaguguagcauuucuuuuucaagauauuuaacccugaag

SEQ ID NO: 40659 - RNA, 46 nt, Mus musculus
auauuguuuguuuuagaacccugauacuccauuuaguaacuagcag

SEQ ID NO: 40660 - RNA, 89 nt, Mus musculus
gagagaaucucuuuucuccaagaaaaacuacaggaaaucagaaaauacuacaugucuuugaagucugaaguugcaaccaucgacagaag

SEQ ID NO: 40661 - RNA, 46 nt, Mus musculus
acacucucucugccuucagauacacucucucugccuucagauacac

SEQ ID NO: 40662 - RNA, 46 nt, Mus musculus; identical to SEQ ID NO: 40661

SEQ ID NO: 40663 - RNA, 46 nt, Mus musculus; identical to SEQ ID NO: 40661

SEQ ID NO: 40664 - RNA, 46 nt, Mus musculus; identical to SEQ ID NO: 40661

SEQ ID NO: 40665 - RNA, 46 nt, Mus musculus; identical to SEQ ID NO: 40661

SEQ ID NO: 40666 - RNA, 46 nt, Mus musculus; identical to SEQ ID NO: 40661

SEQ ID NO: 40667 - RNA, 46 nt, Mus musculus
acacucucucugccuucagauacacucucucugccuucagauacag

SEQ ID NO: 40668 - RNA, 46 nt, Mus musculus; identical to SEQ ID NO: 40661

SEQ ID NO: 40669 - RNA, 46 nt, Mus musculus
aguauauccuuccuguauaguuuccaggauuguaucuagacccucc

SEQ ID NO: 40670 - RNA, 26 nt, Mus musculus
cggcgugugugccggacucuguggag

SEQ ID NO: 40671 - RNA, 44 nt, Mus musculus
ccuaaccccgccuccacgucuguugggguuuucagcugcagcuc

SEQ ID NO: 40672 - RNA, 47 nt, Mus musculus
acuuuuuguuuuguuuuguuuuuuguuuuugucguauuuagcccugg

SEQ ID NO: 40673 - RNA, 46 nt, Mus musculus
aauucccucuguuaagaacggcgggacuugauuugugacuaaccag

SEQ ID NO: 40674 - RNA, 46 nt, Mus musculus
uuggcagcugguuucuucaucuguugaaccauccuaccagcuccag

SEQ ID NO: 40675 - RNA, 41 nt, Mus musculus
gagcgucuccccagccuuuuauguuuaguggaaaaaaggaa

SEQ ID NO: 40676 - RNA, 46 nt, Mus musculus
ucugcccugcugucuuguucacucuaauuguuagcacagcccccgu

SEQ ID NO: 40677 - RNA, 45 nt, Mus musculus
uauagagacaggcuuguugaaaaggcaucaacuguauugcaucca

SEQ ID NO: 40678 - RNA, 26 nt, Mus musculus
ucagguggucuuugguuuuuagagag

SEQ ID NO: 40679 - RNA, 23 nt, Mus musculus
aaugcgaucugggcauguggucu

SEQ ID NO: 40680 - RNA, 60 nt, Mus musculus
ccuguuccaagaugggaguguggaggucugaguggacauguagagucaugaaguauggug

SEQ ID NO: 40681 - RNA, 47 nt, Mus musculus
gcugugaagaccggacuagguagacccagucuaaauuugguagauuu

SEQ ID NO: 40682 - RNA, 45 nt, Mus musculus
gguagguccaagugggaguuaaauguugguuacaguucaggagga

SEQ ID NO: 40683 - RNA, 46 nt, Mus musculus
acuagccucugcuuuaauuaaaaaaacaaacaaacaaaaccccaag

SEQ ID NO: 40684 - RNA, 46 nt, Mus musculus
aagacucagauucaggguuguugaccucccuagccuggcgcuggag

SEQ ID NO: 40685 - RNA, 46 nt, Mus musculus
cuuucuuccuuuuguaguauuguauguguguucacauggaggccag

SEQ ID NO: 40686 - RNA, 46 nt, Mus musculus
uacuauccccccaggugauagauuaguauuccuugccacugagaau

SEQ ID NO: 40687 - RNA, 42 nt, Mus musculus
ccccagcaccucgcagguuugccccuguaccuguuucaaggg

SEQ ID NO: 40688 - RNA, 45 nt, Mus musculus
ccaccucuggcuggaccuuacaaucagaguugcaugagauuugcc

SEQ ID NO: 40689 - RNA, 46 nt, Mus musculus
uugcaaagaaccauagugguucuagagugaguugaguagauaguaa

SEQ ID NO: 40690 - RNA, 45 nt, Mus musculus
aucagaaagcagguagaugaauggauuaaaaucauuucagcagaa

SEQ ID NO: 40691 - RNA, 46 nt, Mus musculus
aaaggcgugugucaccacgcccagccuuagcugcuguuuuaaugag

SEQ ID NO: 40692 - RNA, 46 nt, Mus musculus
ucaguagcaggaguuauaacggucaccuacuuucuuaugucuggag

SEQ ID NO: 40693 - RNA, 35 nt, Mus musculus
gcucuaagggucauauuaaaaauuggacagcucug

SEQ ID NO: 40694 - RNA, 42 nt, Mus musculus
augaguguauaugugugugugugugugugugugugugcccaa

SEQ ID NO: 40695 - RNA, 46 nt, Mus musculus
auuaaaugucagacugguauuguguuugucucucacuguggcccag

SEQ ID NO: 40696 - RNA, 46 nt, Mus musculus
guuauguguaagauaaacuaaauguaaauugcagguucugacaggg

SEQ ID NO: 40697 - RNA, 23 nt, Mus musculus
acauguucuccaguguugucuaa

SEQ ID NO: 40698 - RNA, 46 nt, Mus musculus
acggugugcuuaccuagggugagugcagggagcuuucugucaggcc

SEQ ID NO: 40699 - RNA, 46 nt, Mus musculus
auaacugacucauauuuaacucuuuucucuuuugaguaaaguccag

SEQ ID NO: 40700 - RNA, 41 nt, Mus musculus
aguucaaauugaaaauugaauaagaaguaucucgccgggca

SEQ ID NO: 40701 - RNA, 42 nt, Mus musculus
aagagucaauccuugcaacucagaauuaucuaucacagccac

SEQ ID NO: 40702 - RNA, 44 nt, Mus musculus
ggaaauuugguauauauguaauaguuuucauugacuucugugug

SEQ ID NO: 40703 - RNA, 46 nt, Mus musculus
uguggagaauaucuuagauauucucugugugugugugugugugugu

SEQ ID NO: 40704 - RNA, 46 nt, Mus musculus
ccauuacuuuuuacacggugugccuuuauucuuaacacccagucag

SEQ ID NO: 40705 - RNA, 45 nt, Mus musculus
guugugagccaccaugugguugcuaggaauugaacucagggccuc

SEQ ID NO: 40706 - RNA, 42 nt, Mus musculus
cugagguggugguuguuuaguugguauccucccuggccucau

SEQ ID NO: 40707 - RNA, 45 nt, Mus musculus
gaugcacaccuuugauagcucugaaggcuucaaguccagccugag

SEQ ID NO: 40708 - RNA, 46 nt, Mus musculus
gcuuuaaagauacaauuauuuuguguguguguguguguguguguau

SEQ ID NO: 40709 - RNA, 41 nt, Mus musculus
ucagaaaagguuuccauguacuuacuuacugugugugggag

SEQ ID NO: 40710 - RNA, 46 nt, Mus musculus
gguauugcagcagucugacauggccucagguacacacaacuaguuc

SEQ ID NO: 40711 - RNA, 46 nt, Mus musculus
auagagugugauuucucagauguaguguuuaguguguuugggcuau

SEQ ID NO: 40712 - RNA, 46 nt, Mus musculus
aguuucugugaacagugaguuuucauuagaauuauguuucugugag

SEQ ID NO: 40713 - RNA, 46 nt, Mus musculus
caacaaguagugucacuagcaaaaaaccaaaaccaaacaaagccaa

SEQ ID NO: 40714 - RNA, 43 nt, Mus musculus
gcagcaagugcuccuaacugcugagccaucucuucagccccag

SEQ ID NO: 40715 - RNA, 46 nt, Mus musculus
cugugcagggcaagaacuaucgauacccauaccuuuucacauguag

SEQ ID NO: 40716 - RNA, 46 nt, Mus musculus
uuaaguagccccuucuucaucccuccaucucugucacuaccgcaua

SEQ ID NO: 40717 - RNA, 42 nt, Mus musculus
ggcaaagccagugauggugaugccaaguucuguugccagcuu

SEQ ID NO: 40718 - RNA, 46 nt, Mus musculus
cauaaaugaagucaaauucuuugccaggacaucacaggagugccau

SEQ ID NO: 40719 - RNA, 44 nt, Mus musculus
gcagaggcagguggauauccaugacuuugaggccagccuggucu

SEQ ID NO: 40720 - RNA, 45 nt, Mus musculus
ugggcaacacauaaggcuaaaaaauaagucuuaacuugcagggga

SEQ ID NO: 40721 - RNA, 46 nt, Mus musculus
auguuggggcaccagaagaaucucuuuggacucgcuagccagccag

SEQ ID NO: 40722 - RNA, 48 nt, Mus musculus
ucuacaaaguugucuuagaguuucauugcugugaaauguagagaucau

SEQ ID NO: 40723 - RNA, 49 nt, Mus musculus
aaugagcugagguaggacuagaaggugggacauccaacauagagagaga

SEQ ID NO: 40724 - RNA, 46 nt, Mus musculus
uccccaucccccaccgcccuuggcucuugcaaccuccuacccccaa

SEQ ID NO: 40725 - RNA, 46 nt, Mus musculus
cuuugccuuucaggaccccacggccuguuuucccaacugccaccaa

SEQ ID NO: 40726 - RNA, 94 nt, Mus musculus
caggcugaucucugugaguuugaggccaggaugaucuacauaggggauucaggaacauucagagcugcuguaguaagacucagucuuggagggg

SEQ ID NO: 40727 - RNA, 45 nt, Mus musculus
ucaauucccggcaaccacaugguggcucacaaccaucuguaacaa

SEQ ID NO: 40728 - RNA, 46 nt, Mus musculus
ugugacuuaagcagauauguuguuucauuuguucuucaucggggaa

SEQ ID NO: 40729 - RNA, 46 nt, Mus musculus
aaguacuuauuuuuggcaaaaaagaaaaaagaaagaaaaaaaaaga

SEQ ID NO: 40730 - RNA, 46 nt, Mus musculus
agacuuaauuuucauucucaaauuuaguuaggaguggcuagugugg

SEQ ID NO: 40731 - RNA, 42 nt, Mus musculus
cgaacucagaaauccgccugccucugccucccaagcucuggg

SEQ ID NO: 40732 - RNA, 47 nt, Mus musculus
gagagagagagagagagagagagagagagagagagagagaucgugug

SEQ ID NO: 40733 - RNA, 41 nt, Mus musculus
ggaauacugugagguaccaugagucuuucccaguuuuggua

SEQ ID NO: 40734 - RNA, 46 nt, Mus musculus
uggcauaagaagaaacaagucuuucacauuaacuauugcugcguua

SEQ ID NO: 40735 - RNA, 46 nt, Mus musculus
auagcagggcuuacaugucugaaacauacuucagaaugugauaggg

SEQ ID NO: 40736 - RNA, 59 nt, Mus musculus
gcuucugcaucaaaacagguagcauuuugcucucaagcacugauaggauguugcaaagc

SEQ ID NO: 40737 - RNA, 72 nt, Mus musculus
cugcaggcuggguuaagugugugaggagaauuuaaugcagcaggagagguuagcagcugcuuacacaaggaa

SEQ ID NO: 40738 - RNA, 45 nt, Mus musculus
acugcauugcugggaauaguugcuauuuuuaaaaacaagguggag

SEQ ID NO: 40739 - RNA, 46 nt, Mus musculus
guuucuuagucagucuacuugauuucaagagccccuaugugccuag

SEQ ID NO: 40740 - RNA, 41 nt, Mus musculus
uuagguuuugcauuccuuagucuuauaaacccagcagccga

SEQ ID NO: 40741 - RNA, 45 nt, Mus musculus
augccaguaccaugagaugaccaccaagagcagcagcagcacugg

SEQ ID NO: 40742 - RNA, 42 nt, Mus musculus
guggcucugucugagcacucacugcacugggguuuugggguu

SEQ ID NO: 40743 - RNA, 41 nt, Mus musculus
auccuacuggagaugggcagauucuucagguccgggacaac

SEQ ID NO: 40744 - RNA, 41 nt, Mus musculus
accucuuuucaguguaucugccaagauccacauggcccugg

SEQ ID NO: 40745 - RNA, 49 nt, Mus musculus
ugcugugcucagguguuuauugcagucuggaccaagcugagaaaugugu

SEQ ID NO: 40746 - RNA, 42 nt, Mus musculus
ugauaaaccagagcaggccauuaaccugcuuuaauggcagau

SEQ ID NO: 40747 - RNA, 46 nt, Mus musculus
uuuugggcagguuguugcuaggggaagcuuuggagauaagguaagu

SEQ ID NO: 40748 - RNA, 46 nt, Mus musculus
aagacuucuuuaacgccuggagcccaacauuauguucugggcuuau

SEQ ID NO: 40749 - RNA, 46 nt, Mus musculus
acacggguuuuuagauuguauccuuagaaauguguuacuugcguug

SEQ ID NO: 40750 - RNA, 44 nt, Mus musculus
gacaguacaggcaaagccaugguuacagggcccacaucacugga

SEQ ID NO: 40751 - RNA, 45 nt, Mus musculus
ucagcgguuagcagggguuaggagggaaagaugauugaacaggag

SEQ ID NO: 40752 - RNA, 41 nt, Mus musculus
auguaccauuguauagcuggaagguagcguuguaugcgggc

SEQ ID NO: 40753 - RNA, 79 nt, Mus musculus
aaauaacaagaaaauaauaucaaaagguauccagaaaccacaagugccacagaaguuagagaaaacaagaaaaaaaaaa

SEQ ID NO: 40754 - RNA, 48 nt, Mus musculus
aauuuccagggauucucacagaaagaauaaacagcuugaaaaugagag

SEQ ID NO: 40755 - RNA, 45 nt, Mus musculus
acgugcacagaaggggauaaauggaaaggcagggaauuaucaaca

SEQ ID NO: 40756 - RNA, 46 nt, Mus musculus
ggauacuucaaucccucuuaaaagggagaacaaaauacccauggaa

SEQ ID NO: 40757 - RNA, 46 nt, Mus musculus; identical to SEQ ID NO: 36266

SEQ ID NO: 40758 - RNA, 45 nt, Mus musculus
ucuucugcuucauguucagaaagacauauauauaugagaaggacc

SEQ ID NO: 40759 - RNA, 44 nt, Mus musculus
aaaagggaaggaaacaacauagaauuaaaauuauagcaugccca

SEQ ID NO: 40760 - RNA, 46 nt, Mus musculus
acaguggguaagaaaaaauguuccauuguaucuguccauccaccag

SEQ ID NO: 40761 - RNA, 42 nt, Mus musculus
cugugggagguucauauuagacagcauaaagaacuacgggug

SEQ ID NO: 40762 - RNA, 45 nt, Mus musculus
ggauuugucagggcagugggacacuggcuaccuguaagcguguaa

SEQ ID NO: 40763 - RNA, 46 nt, Mus musculus
acucaguguucucaaagcuguuagagaaaagguuagcacuuuggag

SEQ ID NO: 40764 - RNA, 42 nt, Mus musculus
gacagcuguagcagcacucuguggagcagugggcucugucag

SEQ ID NO: 40765 - RNA, 50 nt, Mus musculus
guucucgugaagcaaugcagaccggagugucucuacuagcuauucuucca

SEQ ID NO: 40766 - RNA, 46 nt, Mus musculus
uggaagggccuuuugugcaagggcauuaaguauuuuuagugccuaa

SEQ ID NO: 40767 - RNA, 61 nt, Mus musculus
guuuuucugcugaaaugugguuuugcaggccccagacaccagacucuccucuccucgcugc

SEQ ID NO: 40768 - RNA, 46 nt, Mus musculus
ugcaacagagacagaaaagggacucagccaaugagcugacagcuaa

SEQ ID NO: 40769 - RNA, 46 nt, Mus musculus
cuuuaaugaugauccuguucuccaauuacccguucuccuggauccg

SEQ ID NO: 40770 - RNA, 41 nt, Mus musculus
ccagcacaucgacaugcuugauuuuuguguucccaggguua

SEQ ID NO: 40771 - RNA, 52 nt, Mus musculus
uuguucuggugguggugguggugauguuggugauguugguggugaugguggu

SEQ ID NO: 40772 - RNA, 60 nt, Mus musculus
ugugugugugugugugucucgugugugugugugugugugugugugugugugugucucucu

SEQ ID NO: 40773 - RNA, 46 nt, Mus musculus
gugagcuguuguccaggcucaccauacugcuagucaagaagagcaa

SEQ ID NO: 40774 - RNA, 42 nt, Mus musculus
gccagcccuaaaauauuuuugaaagaauauacaugcugcuag

SEQ ID NO: 40775 - RNA, 42 nt, Mus musculus
ggcagggggcgggcaagggcggaggcgcgcucgggcgcgcgg

SEQ ID NO: 40776 - RNA, 46 nt, Mus musculus
aaagugcuugacacauaagcauaaaaccccaauucaaucuccagaa

SEQ ID NO: 40777 - RNA, 46 nt, Mus musculus
uaauuuucuucuuuuuaggcaaagaaaaggaaaaaugacagaagga

SEQ ID NO: 40778 - RNA, 46 nt, Mus musculus
ucaugaaccucuggacuacagucaugaaccucuacacucagcucaa

SEQ ID NO: 40779 - RNA, 46 nt, Mus musculus
caaagauuuauuuauuuaucuugagcuugauaagucucccagcuca

SEQ ID NO: 40780 - RNA, 45 nt, Mus musculus
ggauguuuugccugcaugcauauauacaugccuguugccugcaga

SEQ ID NO: 40781 - RNA, 42 nt, Mus musculus
gguggggaggagaaggaggaggaggaagaggagaaggaggag

SEQ ID NO: 40782 - RNA, 45 nt, Mus musculus
gucuagaccaccugcagggcacacgggaaaagaaacaaagucagg

SEQ ID NO: 40783 - RNA, 42 nt, Mus musculus
uuuaccaacugugauaacucaauuuugaauaagcagcaacgu

SEQ ID NO: 40784 - RNA, 45 nt, Mus musculus
gcucuaucugcauguaugugugugcacuguguguguaccuggugc

SEQ ID NO: 40785 - RNA, 46 nt, Mus musculus
uaucuuuaaaacuuacuuucugaauuuaagcaaaauucccucaaac

SEQ ID NO: 40786 - RNA, 42 nt, Mus musculus
caggccaaagggaaugaaauaaagaauuuaaugacaggagca

SEQ ID NO: 40787 - RNA, 46 nt, Mus musculus
agaacaugaaacucuuuguaaugaguggcuggaaccauauccagau

SEQ ID NO: 40788 - RNA, 46 nt, Mus musculus
cuaaaauaacuuauagaguucauaaacauaaaauaaagucccgggu

SEQ ID NO: 40789 - RNA, 47 nt, Mus musculus
uuacuaacuauucaacuuauuuaaauugaaacaacauugagaagaga

SEQ ID NO: 40790 - RNA, 55 nt, Mus musculus
auauuucagaaacaaauauuagacacaauacuuuugaggagacuauuaaaaacaa

SEQ ID NO: 40791 - RNA, 45 nt, Mus musculus
caagaaauaccuucaggauacucugagcuacaauucccaaaaaaa

SEQ ID NO: 40792 - RNA, 102 nt, Mus musculus
accacuaaguaaguguaaguuaucuguuauaguccaccacugauaggaguaauacauauaccuucaaccuuuuuauauauaucuuaauuugaaguaacaauu

SEQ ID NO: 40793 - RNA, 93 nt, Mus musculus
aucuucaguuucugugucugcagaggaaagcguuugucaaucaagaggacaucaggauuuuaacauucauagaugauuuucugauuuuuagaa

SEQ ID NO: 40794 - RNA, 110 nt, Mus musculus
uuuggaguuuccgaugaagguaaaggagacauugccagguuuauauuuaauuuuucauuagaagagggaaacauuacaucauuauauaauggaacaucuucaaguuguug

SEQ ID NO: 40795 - RNA, 66 nt, Mus musculus
ggacuugauucuaauuuuaaugcaaccucuugauucagugcaggaucagcacuacuucgaaguggc

SEQ ID NO: 40796 - RNA, 45 nt, Mus musculus
aacaagauuuauguucauuuuaaccucacuuuaccacucagggau

SEQ ID NO: 40797 - RNA, 45 nt, Mus musculus
uggaauacaaugcaccacugauacuuacaauuccugcugcuugaa

SEQ ID NO: 40798 - RNA, 45 nt, Mus musculus
aaaaaggugcauuuuaaaugacacuacagcaaugcaauggugaaa

SEQ ID NO: 40799 - RNA, 42 nt, Mus musculus
agaacuuuggacuuuucacaccucuuaccgaggcuuagagga

SEQ ID NO: 40800 - RNA, 45 nt, Mus musculus
aauguaggaucauaugcuacagauugcucuaacucgcaaacgauc

SEQ ID NO: 40801 - RNA, 44 nt, Mus musculus
gucugagcagcgccuuggaucaaauccacucaugacagguaagc

SEQ ID NO: 40802 - RNA, 45 nt, Mus musculus
guguggggugugugugugugugugugugugugugugugaagucug

SEQ ID NO: 40803 - RNA, 49 nt, Mus musculus
acuucuuccauugccucagagugccuuuugauuucaaguucaccaucuu

SEQ ID NO: 40804 - RNA, 63 nt, Mus musculus
uugauuuucuccgaugacuuuucaucuggaagcaccgauuguugguucugauuucuccuuguc

SEQ ID NO: 40805 - RNA, 42 nt, Mus musculus
ggguugagacagggucccucugucugucugucugucugucug

SEQ ID NO: 40806 - RNA, 95 nt, Mus musculus
cguugucacuuuuuaaaaauauggcacuuuuacuggaacgcagaguauuuguuacaugaauauauccuagcaggauuugaacuuucuacgcagga

SEQ ID NO: 40807 - RNA, 46 nt, Mus musculus
gugaugucagccacuuauuagcccuagacucacugugugaugccag

SEQ ID NO: 40808 - RNA, 24 nt, Mus musculus
agggucuagguccagcagggucau

SEQ ID NO: 40809 - RNA, 42 nt, Mus musculus
gcagguggaucucugugaguuugaggccagucuggucuauau

SEQ ID NO: 40810 - RNA, 44 nt, Mus musculus
caucuguccucccaguauuguccucuguagucuugucacccaca

SEQ ID NO: 40811 - RNA, 45 nt, Mus musculus
ugcuuuguuuuuccauuuuaauugauacacugaccuggcccagga

SEQ ID NO: 40812 - RNA, 41 nt, Mus musculus
uauggaaagggaaauaaaguagacuuuauuuuagggaugga

SEQ ID NO: 40813 - RNA, 42 nt, Mus musculus
ucuagcucaccacagcgccagcccuguuuuuagccagaaagg

SEQ ID NO: 40814 - RNA, 44 nt, Mus musculus
gacagcgacacacuaacccgugggucacacgcuuauguaguaga

SEQ ID NO: 40815 - RNA, 46 nt, Mus musculus
aaagaaagaaaaggagcgagaagaacuguggaaaaaauuggaggau

SEQ ID NO: 40816 - RNA, 49 nt, Mus musculus
guguauguguguguguguguguauguguaugugugugugagugugugug

SEQ ID NO: 40817 - RNA, 45 nt, Mus musculus
guguguauguauguauguauguguguaugugugugugugugugug

SEQ ID NO: 40818 - RNA, 42 nt, Mus musculus
ugaaagcagcaugguaacccagccauauauucaucuggagaa

SEQ ID NO: 40819 - RNA, 46 nt, Mus musculus
aucacaugaauguaggucauaaagcauggacuuaaagagccccaga

SEQ ID NO: 40820 - RNA, 45 nt, Mus musculus
agaaggccauuccuauucaaaccaccagagagauaaugcagagau

SEQ ID NO: 40821 - RNA, 41 nt, Mus musculus
gcuacacaccaaguuugaggcuggccugugcuacauguaug

SEQ ID NO: 40822 - RNA, 46 nt, Mus musculus
uucugaggggcugugaagaaguggucugaagagauuuacauuugau

SEQ ID NO: 40823 - RNA, 45 nt, Mus musculus
agguuauuagggggcuaaugaaauuuuggccuaaaacaugcaguc

SEQ ID NO: 40824 - RNA, 45 nt, Mus musculus
aacuuuuauuuaguagcuuucugaagagggaaaaaagggacagag

SEQ ID NO: 40825 - RNA, 45 nt, Mus musculus
ugccucugccucccuagugcuguauuuucuuuuauggcuccaggu

SEQ ID NO: 40826 - RNA, 46 nt, Mus musculus
uguuuugugaucugucuaccucauuuugcaucuaaaagaaccauau

SEQ ID NO: 40827 - RNA, 33 nt, Mus musculus
ucccucugauaauugcuguucccucaucccgac

SEQ ID NO: 40828 - RNA, 42 nt, Mus musculus
uugggauaguuugcugaaacugaauuuuaaugagcaccuccu

SEQ ID NO: 40829 - RNA, 45 nt, Mus musculus
agccaagaauuccaacccagcauugccaaaaaauacauagaucag

SEQ ID NO: 40830 - RNA, 45 nt, Mus musculus
uuguguguaagugugugugugugugugugagagagagagagagag

SEQ ID NO: 40831 - RNA, 46 nt, Mus musculus
uugggccugaggguguucggugccccaguguaggagaaugccagag

SEQ ID NO: 40832 - RNA, 46 nt, Mus musculus
aguuggaaugucuugagaagacagugaaaaauaacaggaaggagag

SEQ ID NO: 40833 - RNA, 46 nt, Mus musculus
guugugaaccaccacguggguacugggaauugaaccuggguccuuu

SEQ ID NO: 40834 - RNA, 42 nt, Mus musculus
aauggaagcaaguuuaugucuuucacuauuuuggggcuggaa

SEQ ID NO: 40835 - RNA, 46 nt, Mus musculus
agaaaggaugccuaggggcagaaccaggugcucuggagcaaaacuu

SEQ ID NO: 40836 - RNA, 45 nt, Mus musculus
agcuggguagcugaugaaguucuuucacuaccuugauugaucaga

SEQ ID NO: 40837 - RNA, 47 nt, Mus musculus
auguauaaagaaauuaaauuauugaauuagcagaaauuauuagagga

SEQ ID NO: 40838 - RNA, 42 nt, Mus musculus
ugaaugaucuuuaguguucuacuuugcuccauacugacauug

SEQ ID NO: 40839 - RNA, 46 nt, Mus musculus
guuuaaucuugaaauagaaggcgaccauaguagaggguuugugguu

SEQ ID NO: 40840 - RNA, 46 nt, Mus musculus
aggucacagagccuaugaaacaggcgcacaggcauagaggggagau

SEQ ID NO: 40841 - RNA, 24 nt, Mus musculus
ugcacacagcugauuagcaggaag

SEQ ID NO: 40842 - RNA, 46 nt, Mus musculus
gugguucaggguuuucaauauacuuaauauucuuugagagguguga

SEQ ID NO: 40843 - RNA, 45 nt, Mus musculus
caguuuuaaaggugugugugugugugugugugugugugugugugu

SEQ ID NO: 40844 - RNA, 45 nt, Mus musculus
gaauaacuucacgguagaaucaccugggucuggcccugcucugug

SEQ ID NO: 40845 - RNA, 62 nt, Mus musculus
aauacauucaacaguauaacauacaguuuaccuucaggagcagaaauguuuauaggggaaag

SEQ ID NO: 40846 - RNA, 45 nt, Mus musculus
caucuaaucuaagucuggguacuacccacaggcuacuagaaugaa

SEQ ID NO: 40847 - RNA, 45 nt, Mus musculus
cuuagguaacuuguggagaguuguuuuucuugugaggggcaguga

SEQ ID NO: 40848 - RNA, 42 nt, Mus musculus
ugcacguaaaugucccagaauagucucuagcacauggcagau

SEQ ID NO: 40849 - RNA, 49 nt, Mus musculus
aauuaagaggaaaguacagagcuuucccauuugccucaguccccaguca

SEQ ID NO: 40850 - RNA, 50 nt, Mus musculus
ccacugagccaucucaccagcccgaaagcugcauuguuuauagcuacuca

SEQ ID NO: 40851 - RNA, 42 nt, Mus musculus
uccugagagcuagaugccagcagucagcgcagcacuaggauu

SEQ ID NO: 40852 - RNA, 46 nt, Mus musculus
ucagcagugcugugucauuuuugacuucauggacacgcuaucugau

SEQ ID NO: 40853 - RNA, 45 nt, Mus musculus
uuaacuuuuaacuaauguuacaugagugugcccuuucccuguucc

SEQ ID NO: 40854 - RNA, 45 nt, Mus musculus
gaaugcugcaugguguagaagaauccaggcucuggagccagacau

SEQ ID NO: 40855 - RNA, 42 nt, Mus musculus
agggaaauaaaauucggugugagugcacguguggccacagac

SEQ ID NO: 40856 - RNA, 44 nt, Mus musculus
uguagcucuagacuugagugcuguguguguccucaggaagcagu

SEQ ID NO: 40857 - RNA, 45 nt, Mus musculus
acccugucuuggaaaaaacaaaacaaaaccaaccccccccccaaa

SEQ ID NO: 40858 - RNA, 43 nt, Mus musculus
uggcccccauaggcucauauauuugaauguuugguucccaguu

SEQ ID NO: 40859 - RNA, 46 nt, Mus musculus
acuuaauuaauuaauuaauuauuauuuuuuuaaacuuuuggcggau

SEQ ID NO: 40860 - RNA, 41 nt, Mus musculus
agguuggggauuagugagcauuaagucuuucuuggugugug

SEQ ID NO: 40861 - RNA, 46 nt, Mus musculus
ucaggccuugaacuuagguuaaaaaaaaaaucuauugccaaaaucg

SEQ ID NO: 40862 - RNA, 46 nt, Mus musculus
ggguguguguguguguguguguauguguguaguguaaaagucagag

SEQ ID NO: 40863 - RNA, 72 nt, Mus musculus
gcgagugagaggaggacagggaacugugaggcagcaggagauagagggauagagggagugcuagagacugga

SEQ ID NO: 40864 - RNA, 45 nt, Mus musculus
uccauuggacguuuaaggcuguuauugugaauaauagagagcaga

SEQ ID NO: 40865 - RNA, 46 nt, Mus musculus
agagagagagagagaggaagagagaacgcgcgagcgagacagagac

SEQ ID NO: 40866 - RNA, 50 nt, Mus musculus
aaaauaguuuccuaguagaaauguuuuuaagaaucugugaaaaguggggg

SEQ ID NO: 40867 - RNA, 46 nt, Mus musculus
cagacguaagcugugugguuuugcgaggagguuggaauucugggau

SEQ ID NO: 40868 - RNA, 42 nt, Mus musculus
ccacuacagggcagacaagcaaccacaugagagggacaagag

SEQ ID NO: 40869 - RNA, 34 nt, Mus musculus
ugaguaauugacugucauuauugguuaaugagau

SEQ ID NO: 40870 - RNA, 46 nt, Mus musculus
guuucauguaauguaagcuagccugaaacuugcugagccagugagu

SEQ ID NO: 40871 - RNA, 46 nt, Mus musculus
cgaauaaaggucaaaaugucauggaaaacaacaaaacaagcaggag

SEQ ID NO: 40872 - RNA, 44 nt, Mus musculus
uuucuaucucauauugugacaugguagucaguuaugggccauaa

SEQ ID NO: 40873 - RNA, 46 nt, Mus musculus
gcaggcauggacacaugcauuguccuacaaccacaugugccaguag

SEQ ID NO: 40874 - RNA, 41 nt, Mus musculus
gaugucuuauauucuuuaagaaaaauucaugguguccaaaa

SEQ ID NO: 40875 - RNA, 46 nt, Mus musculus
ucugugucugugaugaaacaccaaggccagaaagcaauuuagagaa

SEQ ID NO: 40876 - RNA, 46 nt, Mus musculus
ugugcucuuuuuuguuguugauuuuuuucugcuuuuugaaauagga

SEQ ID NO: 40877 - RNA, 46 nt, Mus musculus
cuaacucucaucauuccacuaggagccacguuauuuaugcagagau

SEQ ID NO: 40878 - RNA, 46 nt, Mus musculus
ucuuuguggcuauugucacgugaaaggggaggcauuugaucuagag

SEQ ID NO: 40879 - RNA, 45 nt, Mus musculus
ccugagagcacagggacaucuuucauucaaacaaccacauguggu

SEQ ID NO: 40880 - RNA, 46 nt, Mus musculus
uacucaguucaaagggacauugucuaagacucgucugcuaguugau

SEQ ID NO: 40881 - RNA, 46 nt, Mus musculus
uaucagaacuguucacagugggaugaucuaaagauuuuaggcagga

SEQ ID NO: 40882 - RNA, 46 nt, Mus musculus
uuucuuugagauuuauuuauuuuucauuuuaugugucuggguauuu

SEQ ID NO: 40883 - RNA, 46 nt, Mus musculus
acccagguccuuugcaagaauagccagugcuuuuaaucccagcuca

SEQ ID NO: 40884 - RNA, 46 nt, Mus musculus
caguugggguuugugaauagugucuuuuugugugcuguguucagaa

SEQ ID NO: 40885 - RNA, 46 nt, Mus musculus
guuaaugauuauucuuuuucauuuaugcuaauguauauccccuccc

SEQ ID NO: 40886 - RNA, 46 nt, Mus musculus
guaaucuuuaaaauuuccuuuacuuuacaugucauacauaaagcaa

SEQ ID NO: 40887 - RNA, 46 nt, Mus musculus
acaccaggcugggauuuuucuucugaaaaugccauuaggaacagaa

SEQ ID NO: 40888 - RNA, 45 nt, Mus musculus
aguacuuucagcacuugggaggaugaggcugaagaacuaggaggu

SEQ ID NO: 40889 - RNA, 46 nt, Mus musculus
agggggucagaguuaccguccagggcaauuccguuuauacacaggu

SEQ ID NO: 40890 - RNA, 45 nt, Mus musculus
cccauuuaaggaugggaacaguggaacagguagagcugugagagu

SEQ ID NO: 40891 - RNA, 46 nt, Mus musculus
uguaaaacauucuaagcuacaaaaagaauuaauaauugcauggauc

SEQ ID NO: 40892 - RNA, 45 nt, Mus musculus
agucagguggaauuuccuuugugacaucauguuuuugcccccaga

SEQ ID NO: 40893 - RNA, 46 nt, Mus musculus
guguauguauaugagcguguguaccaugaacuacgugcggagguca

SEQ ID NO: 40894 - RNA, 46 nt, Mus musculus
auagaauaguuguugaugucuguguuuacuuccagcaaguccagau

SEQ ID NO: 40895 - RNA, 45 nt, Mus musculus
uuuaauaaaaauuagaauaguuuguauaaaguuauaggacaaaua

SEQ ID NO: 40896 - RNA, 46 nt, Mus musculus
caauguuuguacuugaaaaugguagaaacuauauuaaugcugauuu

SEQ ID NO: 40897 - RNA, 41 nt, Mus musculus
gcgcgcauaagaggcaaaugaugaaaaagaaagcugccuau

SEQ ID NO: 40898 - RNA, 38 nt, Mus musculus
ggccccuagcucgcagcccacuccgcgcagccacagau

SEQ ID NO: 40899 - RNA, 46 nt, Mus musculus
ccaucugcaaugauauccgaugcuccgaugcccucuucuggugugu

SEQ ID NO: 40900 - RNA, 42 nt, Mus musculus
cuucuuaugaacugugaacucaguaugaacucaccaccucag

SEQ ID NO: 40901 - RNA, 46 nt, Mus musculus
uuauugucgugagggaggcggccugugccacuguaaacauauggag

SEQ ID NO: 40902 - RNA, 46 nt, Mus musculus
accaagcccgaaaucccccuaaugugcuuuaaauugagccugugag

SEQ ID NO: 40903 - RNA, 24 nt, Mus musculus
agacugucacaaaaaagggggugg

SEQ ID NO: 40904 - RNA, 45 nt, Mus musculus
gaaucagacacguggcaagagggccccugcuggaaaaacuguucg

SEQ ID NO: 40905 - RNA, 46 nt, Mus musculus
gauuccuauauucuaaauuaccuagcaaaguuaauucagggcacau

SEQ ID NO: 40906 - RNA, 46 nt, Mus musculus
caguucuaauuugggguaggggcucaguuuguguuuuuucaugaga

SEQ ID NO: 40907 - RNA, 44 nt, Mus musculus
uucacaucguucagucaaacuuagccagucaaacuuagccagag

SEQ ID NO: 40908 - RNA, 28 nt, Mus musculus
gaacccagguuccauucuaagcacccac

SEQ ID NO: 40909 - RNA, 46 nt, Mus musculus
acacccucuucuggccuccgugggcaccagauuggcaugcagagca

SEQ ID NO: 40910 - RNA, 46 nt, Mus musculus
aaaaugucucauaccuuuaacacaucagucacccaaucucaggggu

SEQ ID NO: 40911 - RNA, 46 nt, Mus musculus
ccggauuaauguuugacuugcaaagaaaguuugaagaaauuauuag

SEQ ID NO: 40912 - RNA, 45 nt, Mus musculus
uuuggcuacaggccugggaguaggggaagcuuggaacuuugggga

SEQ ID NO: 40913 - RNA, 46 nt, Mus musculus
auuuuuugugggacgugguuguucuuuugaauuugauuuggcaaag

SEQ ID NO: 40914 - RNA, 45 nt, Mus musculus
agcaugagguguguguaaggugagccugauaugacuguggaguga

SEQ ID NO: 40915 - RNA, 41 nt, Mus musculus
gugugagugaaaggagagugcauguggugugugugaagaaa

SEQ ID NO: 40916 - RNA, 46 nt, Mus musculus
agagugcgagcagccucaagcuucgagcaagaaagcaagagaagag

SEQ ID NO: 40917 - RNA, 46 nt, Mus musculus
gugaauaauguguguguguguauauauauauauaugugugugugug

SEQ ID NO: 40918 - RNA, 46 nt, Mus musculus
ggucgugagccaccaugugguugcugggauuugaacucugguccuu

SEQ ID NO: 40919 - RNA, 76 nt, Mus musculus
uucaacuuccuggaaugccucuccaugcaaaugaggugcccccagaaaccuaaaccucagccagugaaacuuuacc

SEQ ID NO: 40920 - RNA, 89 nt, Mus musculus
cuaagaaccccuucccacuuuccaggguuaaugugucugugucugugucugugucggugucggugucugugucugugucggugucugug

SEQ ID NO: 40921 - RNA, 44 nt, Mus musculus
cuucaguaggaguguuaaaggcagacaggaaucuaaacuccuca

SEQ ID NO: 40922 - RNA, 45 nt, Mus musculus
cauuuucauauuuuccuuucccuuuuuucuuuuuggugugugugg

SEQ ID NO: 40923 - RNA, 36 nt, Mus musculus
ugugugguuaguguguaugugaguauauguuagugu

SEQ ID NO: 40924 - RNA, 46 nt, Mus musculus
gagucugagaucaaccuggaccacagagaauuaccaaaacggugga

SEQ ID NO: 40925 - RNA, 45 nt, Mus musculus
cgaguacuaaguuauaucuuugguagaaaauaaagauucugagaa

SEQ ID NO: 40926 - RNA, 85 nt, Mus musculus
uggacucucauagguuguucucugaucucagcacacacacaauagguagguaaguagguagguagguagguagguagguagauca

SEQ ID NO: 40927 - RNA, 84 nt, Mus musculus
gcaggaucuuggaggccuuaagcugauuccggcuacugaccuggagcaggcaaugcggcuuuccacguugucauaggcccuagc

SEQ ID NO: 40928 - RNA, 46 nt, Mus musculus
acgggaaacugguuucugcguaaguacuugccagugauaguggugg

SEQ ID NO: 40929 - RNA, 46 nt, Mus musculus
ugacccuauuccauauuccgucagaccaccuguucuggccgugcag

SEQ ID NO: 40930 - RNA, 46 nt, Mus musculus
aaaaaagaaaaaggaaaaaaaaaaaaagaaagaaagaaagaaaaga

SEQ ID NO: 40931 - RNA, 46 nt, Mus musculus
ccacugagcugucucuccagccccaucauguaauguggugugugug

SEQ ID NO: 40932 - RNA, 41 nt, Mus musculus
uggagaggaaauuaaauauaagcuccauuaaaaaguagcug

SEQ ID NO: 40933 - RNA, 45 nt, Mus musculus
gcucacaacgauccuuaaugagaucugacgcccuuuucuggugug

SEQ ID NO: 40934 - RNA, 42 nt, Mus musculus
cuuguuucaaccuggacaugacaucgugaugcuuaugccaag

SEQ ID NO: 40935 - RNA, 46 nt, Mus musculus
agaaagaaagaaagaaagaaagaaaaggagagagagagaaagagag

SEQ ID NO: 40936 - RNA, 46 nt, Mus musculus
ggucagucuacagagcaaguuccaggacagccaacccuaggcagug

SEQ ID NO: 40937 - RNA, 46 nt, Mus musculus
caaaagccuggucaguccuagcacagcaauaccccacucccgguac

SEQ ID NO: 40938 - RNA, 46 nt, Mus musculus
ggcucugaaguccuuacauggaagaucuaguccagggacaguggag

SEQ ID NO: 40939 - RNA, 46 nt, Mus musculus
gcauacaugcgaauaccuguagacaugaaaacaugcuuauucacag

SEQ ID NO: 40940 - RNA, 45 nt, Mus musculus
ucauagugugucacuacuagaaagacacaaaaacuggcuggaaga

SEQ ID NO: 40941 - RNA, 78 nt, Mus musculus
cgucacagcaacagcaccgcugacuaagacagcuccuggagcuaccuuugaaucccacaggagcgccaggcagggcgc

SEQ ID NO: 40942 - RNA, 45 nt, Mus musculus
aaaaaaaaaaaaagaaaggaaggaaggaagaaagaaagaaagagc

SEQ ID NO: 40943 - RNA, 46 nt, Mus musculus
guuacccaaggauggaaacuggauugaggaaaugccuccguaagau

SEQ ID NO: 40944 - RNA, 46 nt, Mus musculus
auccuaugggcaggugguucugggguguauaagaaggacggcagag

SEQ ID NO: 40945 - RNA, 42 nt, Mus musculus
uaaagauucauccaauagggaggcgaauaguugcuuaggcag

SEQ ID NO: 40946 - RNA, 46 nt, Mus musculus
ggaggaggaggagaaagaggaagaggaggaggagagagagagagag

SEQ ID NO: 40947 - RNA, 45 nt, Mus musculus
aacaaaaaaacaaaaaauaccccaacaaaacaaacaaacccccaa

SEQ ID NO: 40948 - RNA, 46 nt, Mus musculus
cacagacacacacacagaggaacagacuggccuugaauucccaguc

SEQ ID NO: 40949 - RNA, 46 nt, Mus musculus
uccucugugugugugucugugugugugugugucugucugucugucg

SEQ ID NO: 40950 - RNA, 46 nt, Mus musculus
cuguauauauuugugauugugcuaauuguuaaauuaccccuauaag

SEQ ID NO: 40951 - RNA, 46 nt, Mus musculus
cugguggcuuuuuugagacaaggucuuauggagcagaugcuggcac

SEQ ID NO: 40952 - RNA, 46 nt, Mus musculus
uuuuacagauaacuuaaugcaaugaagaaucacaaguaugaccaug

SEQ ID NO: 40953 - RNA, 42 nt, Mus musculus
ccacaguugauuuguacuaauuaaucacagacacugaaagga

SEQ ID NO: 40954 - RNA, 45 nt, Mus musculus
aguuccaagcaucccuugggugugcaugggaugaagcagucauuu

SEQ ID NO: 40955 - RNA, 24 nt, Mus musculus
cuuucuagauacguggcaauacag

SEQ ID NO: 40956 - RNA, 45 nt, Mus musculus
gacugccaaucuggacaaggagguaggcaauccaggguagcguag

SEQ ID NO: 40957 - RNA, 85 nt, Mus musculus
aaaggagacauucuggugguugccacaggccagccugagauggugaagggggaguggaucaagccuggggcuguggucauagacu

SEQ ID NO: 40958 - RNA, 45 nt, Mus musculus
accuggaacauaauugaucccacagucuaugaccacagccccagg

SEQ ID NO: 40959 - RNA, 128 nt, Mus musculus
gaucauuauuuuuuuucucccuucccaucugaaguuuaaaaugcagacacugagcugccaggagcauucgucacugucaaguucucaccauuucuaaccucccucccacucggccucgcuuuuaagac

SEQ ID NO: 40960 - RNA, 110 nt, Mus musculus
ucccacugugaauacuugcaaugugacaucuaaacucagucugcuuacauccccacaucucuggaucauaaacuacuacuaugggcauuuuaaaaagagagacagauaaa

SEQ ID NO: 40961 - RNA, 48 nt, Mus musculus
uccuaagcuaugcuacacccuggauuccauccuuauuacuucaggcaa

SEQ ID NO: 40962 - RNA, 46 nt, Mus musculus
auauguaguucccugggaauggugguaucaucguuacaggccagag

SEQ ID NO: 40963 - RNA, 45 nt, Mus musculus
caagacaggguuucucuguguagcccuggcuguuuuggagaccac

SEQ ID NO: 40964 - RNA, 45 nt, Mus musculus
gagcuggugacuggcuuuccggcuuggcuaguaaagauacuugga

SEQ ID NO: 40965 - RNA, 42 nt, Mus musculus
caguucugugguagagcacugguccagcacgagacgggcccu

SEQ ID NO: 40966 - RNA, 62 nt, Mus musculus
gauccagaugauacaaaaccaaauggaaggaaagucgugggugauguggccuacgaugaggc

SEQ ID NO: 40967 - RNA, 45 nt, Mus musculus
acaguagagagcgcacagcgcuuccuacagaaauuuaagccaggg

SEQ ID NO: 40968 - RNA, 45 nt, Mus musculus
uccacuucccuggcuuaaauuucuguaggaagcgcugugcgcucu

SEQ ID NO: 40969 - RNA, 45 nt, Mus musculus
aagugacauugcuauaucacgaucuugcaaaccaaagcucaucgg

SEQ ID NO: 40970 - RNA, 45 nt, Mus musculus
ccgauuucucgggccagguucccgaugagcuuugguuugcaagau

SEQ ID NO: 40971 - RNA, 46 nt, Mus musculus
gaguuguacggggaaacgaaggcuaaagucuugcugucagcauuag

SEQ ID NO: 40972 - RNA, 41 nt, Mus musculus
gaagccaggcgugguggcgcacgccuuuaaucccaggcaga

SEQ ID NO: 40973 - RNA, 45 nt, Mus musculus
auuguauauguaaaugaugucugcaugcaggggugcaagugugga

SEQ ID NO: 40974 - RNA, 42 nt, Mus musculus
guucugucgcaggugggcgccgagggccugcaccagcccgau

SEQ ID NO: 40975 - RNA, 45 nt, Mus musculus
agcaacgcugucuaggaaaacagagaggagcaaugggagggggag

SEQ ID NO: 40976 - RNA, 43 nt, Mus musculus
agacaaaaggaagcuaacagacagcaagucagagcuggcagga

SEQ ID NO: 40977 - RNA, 36 nt, Mus musculus
guaaacaucagcacgaaagaacagguuucauuuuug

SEQ ID NO: 40978 - RNA, 46 nt, Mus musculus
ucuuccauaggaaugaccugggaauagccgccuccugcagcgccac

SEQ ID NO: 40979 - RNA, 46 nt, Mus musculus
uacccugugugauagaguuuccuuuccagagaugagauuuaaagag

SEQ ID NO: 40980 - RNA, 42 nt, Mus musculus
aaauaaugcccaguuaucuggccuuugaaacaacucccagug

SEQ ID NO: 40981 - RNA, 45 nt, Mus musculus
ggccagauaacugggcauuauuuuuucuucaguauucacugugua

SEQ ID NO: 40982 - RNA, 42 nt, Mus musculus
acgagguuguuagcagcagugauggcguggaugucaccagug

SEQ ID NO: 40983 - RNA, 45 nt, Mus musculus
uuuaaggcucucuuuaaucgucugguaccuucaguaaacggaaua

SEQ ID NO: 40984 - RNA, 41 nt, Mus musculus
cagggcuacacagagaaacccugucucaaaagagaggaagg

SEQ ID NO: 40985 - RNA, 45 nt, Mus musculus
aaaugcauuguggugguucuugguuggggcuguuuuuggcugggu

SEQ ID NO: 40986 - RNA, 44 nt, Mus musculus
ucagaggcuaggcauugagaagacugaccccaccacgcugacag

SEQ ID NO: 40987 - RNA, 42 nt, Mus musculus
augcacaugaguaugugugugugugugugugugugugugugu

SEQ ID NO: 40988 - RNA, 42 nt, Mus musculus
uuccucaggaaucuaucguugguguccaacacuauggcagaa

SEQ ID NO: 40989 - RNA, 45 nt, Mus musculus
aaaugauuauucaaggccucugaacaauuauaaauuucucaacug

SEQ ID NO: 40990 - RNA, 46 nt, Mus musculus
uaagaaaggggagccuaucaguugcgaagaccuggugagugacagg

SEQ ID NO: 40991 - RNA, 45 nt, Mus musculus
ugacugauugcaaaaguuaugaaauuuauauuuuuagacguucuu

SEQ ID NO: 40992 - RNA, 41 nt, Mus musculus
ggggacucuagauggucacaugaucuguagucagggcuugc

SEQ ID NO: 40993 - RNA, 44 nt, Mus musculus
aagagucguuuacauuuugaucuaaagcaggugagguggcacau

SEQ ID NO: 40994 - RNA, 46 nt, Mus musculus
ccuuuucuacuguucauaucuuuccuuacuuuccuucuuacuguag

SEQ ID NO: 40995 - RNA, 26 nt, Mus musculus
gagacaggaagaguggacagugccua

SEQ ID NO: 40996 - RNA, 46 nt, Mus musculus
aaaacaagagccagugugugccuggacccccuaccacucagaagau

SEQ ID NO: 40997 - RNA, 26 nt, Mus musculus
gaagucauaaaugccacuuaaaucaa

SEQ ID NO: 40998 - RNA, 46 nt, Mus musculus
uggugucuucauuuaagaaauucggcuuauuuaaaacuguucucag

SEQ ID NO: 40999 - RNA, 57 nt, Mus musculus
guagcucugacuguccugaaacucacgauguagaccaggcuggccuugaacucacag

SEQ ID NO: 41000 - RNA, 46 nt, Mus musculus
guuucaggacagucagagcuacagaguaaaaaaaaacaaaaaccag

SEQ ID NO: 41001 - RNA, 46 nt, Mus musculus
agauggcugugagcugccaugugggugcuggaaaaugaacucaggc

SEQ ID NO: 41002 - RNA, 46 nt, Mus musculus
ccucucacagacaugcagaacaccaguacacauaaagaauagauag

SEQ ID NO: 41003 - RNA, 45 nt, Mus musculus
guaauauuucucauaugaaugagacuaucaguacauugcccagaa

SEQ ID NO: 41004 - RNA, 41 nt, Mus musculus
gcucagcaguugaggcacugacuguucuuacaaggggcucu

SEQ ID NO: 41005 - RNA, 45 nt, Mus musculus
uuuuuauucacgugucuccgugugcaggcgcgugcauagggugga

SEQ ID NO: 41006 - RNA, 45 nt, Mus musculus
aguagaggcaucagacucauccccuucaaagaacuaagaggccau

SEQ ID NO: 41007 - RNA, 46 nt, Mus musculus
ucucaaauaagauaacaagaaaaaaaaggaaggugugucuuggagc

SEQ ID NO: 41008 - RNA, 42 nt, Mus musculus
gacgcucucuggacagccugagccagggccaaggcccccugg

SEQ ID NO: 41009 - RNA, 42 nt, Mus musculus
gcugaccugaguucagaucccuccaccacauguaagauccag

SEQ ID NO: 41010 - RNA, 46 nt, Mus musculus
uuucugagugugugugugugugugugugugugugugugcgugcaca

SEQ ID NO: 41011 - RNA, 46 nt, Mus musculus
gcagaaauguuuuaaguuaaaacucaagaauaggggcuggagagau

SEQ ID NO: 41012 - RNA, 41 nt, Mus musculus
guucugugcuuccgggagcaauucgaugucaucggccccgu

SEQ ID NO: 41013 - RNA, 45 nt, Mus musculus
cucuggguugugagacaaggacaaguguguuuuggccaugcagau

SEQ ID NO: 41014 - RNA, 45 nt, Mus musculus
agguuuccuguauccuuuaguaggaacgguaagugaaggcuguaa

SEQ ID NO: 41015 - RNA, 45 nt, Mus musculus
aaagcacugaaaauccuacccguugcugcucuaacaaccaugucu

SEQ ID NO: 41016 - RNA, 46 nt, Mus musculus
uguagaaagaaagaaagggguggguguagggacaaaguggggaaag

SEQ ID NO: 41017 - RNA, 76 nt, Mus musculus
uauucauuauacaggcaguaugacagaaagaaaaauacauuuucaguucccaaccaugcgaaugugcugauaggug

SEQ ID NO: 41018 - RNA, 49 nt, Mus musculus
aaguuuagcuuuaaaaagccugcgaucguaagaauagagaccgucaaac

SEQ ID NO: 41019 - RNA, 46 nt, Mus musculus
aaaagguguuucugguucuguagcugcugcaaggcacaaaguggag

SEQ ID NO: 41020 - RNA, 46 nt, Mus musculus
aacgauacuugacaauaaucagcaaauacaacacucauguuucagu

SEQ ID NO: 41021 - RNA, 25 nt, Mus musculus
agucuuggaagucuguccccgcccu

SEQ ID NO: 41022 - RNA, 46 nt, Mus musculus
guuccuuuucuuauaugaaaauaauggggcuggugagauggcucag

SEQ ID NO: 41023 - RNA, 78 nt, Mus musculus
cagucaucacuguuccugccuauuucaacgacucgcagcgccaggccaccaaggaugcgggcaccaucaccggccuca

SEQ ID NO: 41024 - RNA, 45 nt, Mus musculus
ccucgauggucaggauggacacaucgaaggugcccccgcccaggu

SEQ ID NO: 41025 - RNA, 24 nt, Mus musculus
uugucgaagucuucgccacccagg

SEQ ID NO: 41026 - RNA, 44 nt, Mus musculus
cggaggaguucaagcgcaaacacaagaaggacauugggcccaac

SEQ ID NO: 41027 - RNA, 24 nt, Mus musculus
ucguccacgcaggccagcauagag

SEQ ID NO: 41028 - RNA, 28 nt, Mus musculus
cuuuuccaccggcuccagggucccucgg

SEQ ID NO: 41029 - RNA, 48 nt, Mus musculus
gguggaaaaggcgcugcgcgaugccaagcuagacaagggccagaucca

SEQ ID NO: 41030 - RNA, 46 nt, Mus musculus
gcaaagacgacauugaccggauggugcaggaggcggagcgguacaa

SEQ ID NO: 41031 - RNA, 42 nt, Mus musculus
aaaaaaaaaaaaaagaaaaaagaaaagaaaggaaaagagguu

SEQ ID NO: 41032 - RNA, 46 nt, Mus musculus
ggguacuccuucuccacacaguccccacacaucgucacgcaguuuu

SEQ ID NO: 41033 - RNA, 72 nt, Mus musculus
gggcuuuguuggcaguucuucaagauaaugcaguauugacaguguuugaucuuauuagucauuggaauaagc

SEQ ID NO: 41034 - RNA, 45 nt, Mus musculus
auugcuuagcuaguaaaauauuugcugccaagccagacagccuga

SEQ ID NO: 41035 - RNA, 45 nt, Mus musculus
uguuccaaaacacucaaaccuccuagagaauugugagcgccccau

SEQ ID NO: 41036 - RNA, 46 nt, Mus musculus
gugauuuaauggaugaaugcuauguagguucuaggcugauaaauag

SEQ ID NO: 41037 - RNA, 31 nt, Mus musculus
gaaguucaucaggagguacaguugugcauag

SEQ ID NO: 41038 - RNA, 46 nt, Mus musculus
gaucacuauuucuguauuccuauuuuuugauauuuucagccugcag

SEQ ID NO: 41039 - RNA, 45 nt, Mus musculus
cucugcuugagaacuaaaagagucuuguagaagccuggcaugcua

SEQ ID NO: 41040 - RNA, 41 nt, Mus musculus
gggagggagggagggagaaagagagagacagagagagagag

SEQ ID NO: 41041 - RNA, 46 nt, Mus musculus
ucaggcacuucccuuggugacauggaagacugagcuacguccaaag

SEQ ID NO: 41042 - RNA, 41 nt, Mus musculus
gguggaggcuuaaccuugacuuuaugugggaaaagccagag

SEQ ID NO: 41043 - RNA, 51 nt, Mus musculus
ggauagaagcucccagcucaggacuuggggcuaagaaucacggcuagaguu

SEQ ID NO: 41044 - RNA, 45 nt, Mus musculus
ucgacuuccauuuucaggauggaaagagaaaaauugccuaauaaa

SEQ ID NO: 41045 - RNA, 81 nt, Mus musculus
cgcuggagcugaaauguguccacuaauucuguuagaccacggauucuuuagacaccucugcccagacccagcuagggccca

SEQ ID NO: 41046 - RNA, 46 nt, Mus musculus
ugggcacuugcaacuucuggcuguagcuccaaacuaaagugccaag

SEQ ID NO: 41047 - RNA, 46 nt, Mus musculus
gcuccuuuuguaucuacauaguuccauagaagcaaagaagcccaga

SEQ ID NO: 41048 - RNA, 45 nt, Mus musculus
uacacuaaugcauguacacacacacacacacacacacacacacag

SEQ ID NO: 41049 - RNA, 45 nt, Mus musculus
uauaaaaucugagaaguugagggaaagugaggaacuuggggagaa

SEQ ID NO: 41050 - RNA, 46 nt, Mus musculus
cagaagccagaugcuucagacuucuuugcauggugcaggcccccag

SEQ ID NO: 41051 - RNA, 42 nt, Mus musculus
acugugguacuuggucaucuccucagcauuggcuuugugagg

SEQ ID NO: 41052 - RNA, 46 nt, Mus musculus
cuucauggggugcccuuguccauaauaguaguuuccaacgucccgg

SEQ ID NO: 41053 - RNA, 46 nt, Mus musculus
uucaugaauauguuccaaguuuugggggguuuauuuuguuugguug

SEQ ID NO: 41054 - RNA, 29 nt, Mus musculus
cucuagagaugugcugaucuuugggccac

SEQ ID NO: 41055 - RNA, 92 nt, Mus musculus
ugaaaaaaacggugcuugaaaaggcagucucuuacaaaguaaggaguaaagggagaaacagacaaguucuugggauuccaaacacgggguca

SEQ ID NO: 41056 - RNA, 42 nt, Mus musculus
ucccaucacugguuuggaggaugcuauucuaagggaguuugc

SEQ ID NO: 41057 - RNA, 46 nt, Mus musculus
agaugggacaaaucacuguggagucuuugaguacaguugcaaagca

SEQ ID NO: 41058 - RNA, 48 nt, Mus musculus
ccucccaguggauugguaaguggugguuuggacucaaaagaagauugg

SEQ ID NO: 41059 - RNA, 45 nt, Mus musculus
uagagagaggccuugacuauuuuaguagcuauucccuugccugcu

SEQ ID NO: 41060 - RNA, 46 nt, Mus musculus
uggguagaguuagaguggaaagaugaauaaacauacuguggguagc

SEQ ID NO: 41061 - RNA, 46 nt, Mus musculus
gguugugagccaccaugugguugcugggaauugaacucuuaacacu

SEQ ID NO: 41062 - RNA, 69 nt, Mus musculus
cugggcaggauccacuuccauaaccugcagggggagaaguucuacagugcgggucucgcguacugccac

SEQ ID NO: 41063 - RNA, 45 nt, Mus musculus
gucacuuccuccugacccauuugcugcuagaaaagcugaaggagu

SEQ ID NO: 41064 - RNA, 41 nt, Mus musculus
acauuggaagccauaaaagcaaacucagcccuggaauugga

SEQ ID NO: 41065 - RNA, 46 nt, Mus musculus
ccccagugcuaggauuaaaggcaugggccaccauacucagccagau

SEQ ID NO: 41066 - RNA, 46 nt, Mus musculus
gcgcuuucaaaguugauuucuuguuuucgaugaugacagaggaagg

SEQ ID NO: 41067 - RNA, 46 nt, Mus musculus
uccacccugugggugcugggaauugaacuggaguccucugcaagag

SEQ ID NO: 41068 - RNA, 41 nt, Mus musculus
agacacuguauagagcagguccuggagcugcaggcagagau

SEQ ID NO: 41069 - RNA, 45 nt, Mus musculus
uuuuguaacgacuauuugcaguuuaaaaaucaauaaaccccguuu

SEQ ID NO: 41070 - RNA, 46 nt, Mus musculus
cacaaugcuuuuuucccuggguuuaaacuucaucuaacuuucagaa

SEQ ID NO: 41071 - RNA, 45 nt, Mus musculus
aaaccccacauugauacauuuaagcucagccccuuucccagaaca

SEQ ID NO: 41072 - RNA, 42 nt, Mus musculus
agggacccccccccaugccuccuucaccucuccaccccaucu

SEQ ID NO: 41073 - RNA, 42 nt, Mus musculus
gggcugcuggacagccccacauccaucaccccacccccuauc

SEQ ID NO: 41074 - RNA, 74 nt, Mus musculus
cgagcuccgcagccugacccgccaccccaaguacaagacggagcugugccgcaccuuccacaccaucggcuuuu

SEQ ID NO: 41075 - RNA, 41 nt, Mus musculus
accccugcuggcgggggcuucccucgcaggcacucggucac

SEQ ID NO: 41076 - RNA, 42 nt, Mus musculus
aaaggcucucugaguugaggaauguauaaacggggcccggau

SEQ ID NO: 41077 - RNA, 46 nt, Mus musculus
ggagcaaaguucugggcgacugcuccaguuugcggggcaaggaggu

SEQ ID NO: 41078 - RNA, 26 nt, Mus musculus
agaguuuccaacuucucuucugggau

SEQ ID NO: 41079 - RNA, 42 nt, Mus musculus
gccaggugugguggugcaaacuuuuaaucucagcacuuggga

SEQ ID NO: 41080 - RNA, 25 nt, Mus musculus
gagaccguaagccgaagucccaccc

SEQ ID NO: 41081 - RNA, 46 nt, Mus musculus
uuugccagcucuccccauuuagcuuucgagaaaagaucacagaggc

SEQ ID NO: 41082 - RNA, 45 nt, Mus musculus
cagccuggugcaacucccaccugcgcaaagcggggacacagaucg

SEQ ID NO: 41083 - RNA, 44 nt, Mus musculus
gugugguggcucggguccaaagugaaguauggacagguggcagu

SEQ ID NO: 41084 - RNA, 46 nt, Mus musculus
agagagggagggagagggagagagagagagagagagagagcccaga

SEQ ID NO: 41085 - RNA, 41 nt, Mus musculus
guggcuggaggcagggaggagagagagagagagagagagag

SEQ ID NO: 41086 - RNA, 40 nt, Mus musculus
gggaccugcuccuggauccggccugggagaagcagcagag

SEQ ID NO: 41087 - RNA, 44 nt, Mus musculus
gcugcauguagucguuggucugcugggaaucauaaugguccaug

SEQ ID NO: 41088 - RNA, 44 nt, Mus musculus
gggccgggcugggcugggcugggcuggcggggccgggcucgcuc

SEQ ID NO: 41089 - RNA, 50 nt, Mus musculus
aaaacagaauaguuauagauggaugaggugggggcuagaacaggagaauc

SEQ ID NO: 41090 - RNA, 46 nt, Mus musculus
ucucuuuuaagaaagggcuggauuugauuccacucugccuccugag

SEQ ID NO: 41091 - RNA, 42 nt, Mus musculus
ggcguugguggcgcacgccuuuaaucccagcacucaggaggc

SEQ ID NO: 41092 - RNA, 24 nt, Mus musculus
gcuuauaauucccagaccaagauc

SEQ ID NO: 41093 - RNA, 24 nt, Mus musculus
cucucuuaacuacuguucuuugug

SEQ ID NO: 41094 - RNA, 23 nt, Mus musculus
uguccaaaguuuuuaagaaugua

SEQ ID NO: 41095 - RNA, 45 nt, Mus musculus
uguaagccaggcuggccuucaacucacccagauacaccugccucu

SEQ ID NO: 41096 - RNA, 46 nt, Mus musculus
ucccccaccagcucagcaacuuugggcucuccaaacaucugcaggu

SEQ ID NO: 41097 - RNA, 46 nt, Mus musculus
ucagaagcaggacaagagacaugcaaccagaggagaggcugagcca

SEQ ID NO: 41098 - RNA, 46 nt, Mus musculus
cucaggcucuaggggaggcgaaguccucauacugaaaccuggccaa

SEQ ID NO: 41099 - RNA, 46 nt, Mus musculus
uggguugucugcuggcaucaccaucacugugcuccaggacugggau

SEQ ID NO: 41100 - RNA, 45 nt, Mus musculus
aaggcauagcaaauaaagccccacugguguuguuuuuagagccag

SEQ ID NO: 41101 - RNA, 24 nt, Mus musculus
gagagagcaguuugagcuuucauc

SEQ ID NO: 41102 - RNA, 47 nt, Mus musculus
acaugaguuugaagagagcaaggagggauauauggaaggacuuggag

SEQ ID NO: 41103 - RNA, 46 nt, Mus musculus
uauguacaugcaugugagaaugcuauauguauacuugugggugcua

SEQ ID NO: 41104 - RNA, 46 nt, Mus musculus
uugcucuaguucuccgccccuuuucuucuuccuguuguguuuacgg

SEQ ID NO: 41105 - RNA, 46 nt, Mus musculus
gcuaugguggcaggcaugugggaugguugguaacuuguauugguag

SEQ ID NO: 41106 - RNA, 90 nt, Mus musculus
ucgcagcguuaggaagguugagaaucacuuuccauacuucagaaagaucaucucaaagcaaacuggaauccuaaacaccaaagccugcag

SEQ ID NO: 41107 - RNA, 46 nt, Mus musculus
uuguuucccucaggaaauacacacugaaguuucuaaagauaagcag

SEQ ID NO: 41108 - RNA, 45 nt, Mus musculus
aacccaguggagagugagugcucaaaugcauggacaagucccaag

SEQ ID NO: 41109 - RNA, 46 nt, Mus musculus
uccuuuuaugucauacuacuuagugauaccuucucauucucuguag

SEQ ID NO: 41110 - RNA, 46 nt, Mus musculus
uauuuccugucugggcuuuaaggagauugcugaccucuacccuaag

SEQ ID NO: 41111 - RNA, 42 nt, Mus musculus
agcaccaaacagcucagcugccaguguagccuaaggcaguaa

SEQ ID NO: 41112 - RNA, 75 nt, Mus musculus
ucgcccaucuccacccguguuccuagaguccgagggagaugagagucaaucguggagaaguggaacagcguacag

SEQ ID NO: 41113 - RNA, 46 nt, Mus musculus
ucaccauguaagacuggugcuuuagcaucugugccacaugccauga

SEQ ID NO: 41114 - RNA, 46 nt, Mus musculus
uugagguuagaauaaggaaaauaagggcaggagacauaagcugaac

SEQ ID NO: 41115 - RNA, 46 nt, Mus musculus
guugacacagucacuaguacucugauaauuuaagcaauugagacag

SEQ ID NO: 41116 - RNA, 24 nt, Mus musculus
cuggagguguggaugccuuaaugc

SEQ ID NO: 41117 - RNA, 46 nt, Mus musculus
augauauagaaucucaccuagauaaguacauaaauauugggcagag

SEQ ID NO: 41118 - RNA, 28 nt, Mus musculus
aauaaucccuuauucucccaaguggugu

SEQ ID NO: 41119 - RNA, 41 nt, Mus musculus
gcgcgaccgcaagaucgccgcccucaugcuggcccggcacc

SEQ ID NO: 41120 - RNA, 89 nt, Mus musculus
cuuaaaaaaguuaaagcagugacaaauacugugguuuaugugggaggcgguagcuugcugaugggaaggaagaaugcagauuaggaucu

SEQ ID NO: 41121 - RNA, 46 nt, Mus musculus
cugggauucuucaugacagcagcagagucagugcuugugcagacgg

SEQ ID NO: 41122 - RNA, 45 nt, Mus musculus
aauuaccaccagcagugacaugccuguguauccacagaaguuuaa

SEQ ID NO: 41123 - RNA, 37 nt, Mus musculus
aacugcacacuuacaggucaccuuguuguuuuaucag

SEQ ID NO: 41124 - RNA, 45 nt, Mus musculus
uaauacaaauucuauuuccaaauucuagaguuucaagaggcccaa

SEQ ID NO: 41125 - RNA, 26 nt, Mus musculus
gaaggcacaguccugauaacuaaaag

SEQ ID NO: 41126 - RNA, 45 nt, Mus musculus
uucaugguagacagagucugugggauaggaauauugaagugcggg

SEQ ID NO: 41127 - RNA, 41 nt, Mus musculus
gcggagaggguagagguaggaucaaauaaggguguuuggaa

SEQ ID NO: 41128 - RNA, 41 nt, Mus musculus
cacuagaaaagggggauuauuuugggagaggaaaugugcca

SEQ ID NO: 41129 - RNA, 46 nt, Mus musculus
ccauagacucuagccuuuccagucccucaugauaaguaggucccug

SEQ ID NO: 41130 - RNA, 42 nt, Mus musculus
ugcuuaguuugaagucucacccccaccucuuucaacccccac

SEQ ID NO: 41131 - RNA, 46 nt, Mus musculus
auaaugaugguguuauuagcuggagggcucauaauacuaggaugga

SEQ ID NO: 41132 - RNA, 46 nt, Mus musculus
augggucuuaacagaauuucagguguucucagaggguagagcaagg

SEQ ID NO: 41133 - RNA, 45 nt, Mus musculus
auauuggggaccaacaccuaagagaaacuggcaagaacaggcaca

SEQ ID NO: 41134 - RNA, 45 nt, Mus musculus
gugugugugugugagagagagagagagagagagagagagauacuc

SEQ ID NO: 41135 - RNA, 37 nt, Mus musculus
cucugugggugcuggagaaccuuggaugcugcugcug

SEQ ID NO: 41136 - RNA, 46 nt, Mus musculus
gaaguagaauuggugaaacagucacuaccugugguagaugcagcau

SEQ ID NO: 41137 - RNA, 25 nt, Mus musculus
cuucuuucuuuugguuagaauagaa

SEQ ID NO: 41138 - RNA, 46 nt, Mus musculus
uggcuuaagaggaaagcugagggugauuuuuauaauuaggagcagg

SEQ ID NO: 41139 - RNA, 46 nt, Mus musculus
ggcccucugaucugugcuuuuagagcuuuacauugaauguauggag

SEQ ID NO: 41140 - RNA, 45 nt, Mus musculus
cauugcugccaauguuuucccucugugaaguggcuucuaggagaa

SEQ ID NO: 41141 - RNA, 46 nt, Mus musculus
cccccuugugaauuugagugugagugugagagagagagagagagag

SEQ ID NO: 41142 - RNA, 29 nt, Mus musculus
cucucaggagcuccuuaucuccaccccac

SEQ ID NO: 41143 - RNA, 46 nt, Mus musculus
uuuugagauagugggaaaagcagccaucuguaucucuauacagcag

SEQ ID NO: 41144 - RNA, 59 nt, Mus musculus
gugucuagcuucuugaguucuuuauguauuuugaauauuagcccccugucagagauaag

SEQ ID NO: 41145 - RNA, 46 nt, Mus musculus
guucagccuuguugacuuaggaauggcugagagcacaagacuguag

SEQ ID NO: 41146 - RNA, 45 nt, Mus musculus
uggcagccuguccacauuuccuaagcuuggggauaggugcagaga

SEQ ID NO: 41147 - RNA, 46 nt, Mus musculus
uuuugaguaaguauauauacuuagacuuauugacagcuaugcacag

SEQ ID NO: 41148 - RNA, 45 nt, Mus musculus
uaguagcagcauggggaccucccugcugauuuauaguuucuggug

SEQ ID NO: 41149 - RNA, 60 nt, Mus musculus
gggcagggaucugguggcccaaagugggacccuuuagauuuggaguaaagggaaggaggg

SEQ ID NO: 41150 - RNA, 45 nt, Mus musculus
gccaacagccacaguggacucuucccucagugugugaacccaaag

SEQ ID NO: 41151 - RNA, 45 nt, Mus musculus
guuuaguauuuucauaaucagcaucaaguccauuauuuagcaagu

SEQ ID NO: 41152 - RNA, 101 nt, Mus musculus
aaagauugggauagucagugugagacuuuuuuugggggagagaccuggaggcaaacaggaguuaguaggcagaaaaggcaggaaggcauagggagguuuaa

SEQ ID NO: 41153 - RNA, 46 nt, Mus musculus
aagaaaaguuuaguguccuguagagaggcaggaugcugcuguagag

SEQ ID NO: 41154 - RNA, 46 nt, Mus musculus
guagggucugaaggauuaaaacaugcaaaaaaacaaauacuaaggg

SEQ ID NO: 41155 - RNA, 46 nt, Mus musculus
ugguuccagguaaguguaggaauagcuaaggucguuguauaaggag

SEQ ID NO: 41156 - RNA, 41 nt, Mus musculus
agucugggaauugggaugccuuagcccguaacacugaccua

SEQ ID NO: 41157 - RNA, 81 nt, Mus musculus
uuuugacagcucucugaacucuucuggcaacuugagugugcaguuucucccuuuuggcuccuuacagcuuaaucguucagc

SEQ ID NO: 41158 - RNA, 57 nt, Mus musculus
cuacaacuguuucucagccugcacuacuaaaaggaggcaagaaaagaccacuugaua

SEQ ID NO: 41159 - RNA, 45 nt, Mus musculus
gaggcuuguaugucgcacuaaucagcugugccuccuuagcaucag

SEQ ID NO: 41160 - RNA, 46 nt, Mus musculus
gagccaagcauuuaguugcaguuuucucaaggcuggagcauuguag

SEQ ID NO: 41161 - RNA, 45 nt, Mus musculus
gcuugccaucaucuaggccuaauugaagucaggggaagaaugaau

SEQ ID NO: 41162 - RNA, 46 nt, Mus musculus
cuucuaguuacucuugcuacucugacugguaagaguuccuuuacag

SEQ ID NO: 41163 - RNA, 45 nt, Mus musculus
cgaaaaacaaaaaacaaaacaaaacacacaaaaaaaauguaguag

SEQ ID NO: 41164 - RNA, 46 nt, Mus musculus
aaucuuucucagaauuagaaauaaaauagauaucagaugucaaugg

SEQ ID NO: 41165 - RNA, 54 nt, Mus musculus
ggcuacacagagaaccccuguauugaaaaacaaggacagaaaacaaaacagaau

SEQ ID NO: 41166 - RNA, 45 nt, Mus musculus
uaagccuaugguaagauccacauuccauagcaucagaacccccau

SEQ ID NO: 41167 - RNA, 89 nt, Mus musculus
ucuaucuaacucaaagucacucuccauuugucucucagaccccacaaaacuagcucucauccugagaagaugauucccuuagccucucu

SEQ ID NO: 41168 - RNA, 46 nt, Mus musculus
ccauaaauucuguauauuggguuggccccugcuguuuugcagccug

SEQ ID NO: 41169 - RNA, 41 nt, Mus musculus
uuucauuauuguuaagaguagcuaauguagaaaugcaguga

SEQ ID NO: 41170 - RNA, 55 nt, Mus musculus
uauuuggcagaaaucaugagacuuuuagaaagaaauuggcggaauuuggaagauu

SEQ ID NO: 41171 - RNA, 44 nt, Mus musculus
cuggagaagaagcuauugugcugcuauuaucauuccauugggag

SEQ ID NO: 41172 - RNA, 41 nt, Mus musculus
aaaaccaaaagagaaaaaaaggaaaaaaaaaggggagagag

SEQ ID NO: 41173 - RNA, 46 nt, Mus musculus
caacucugguagaaugucuuugagaaggggcuuuuaguuucggcag

SEQ ID NO: 41174 - RNA, 46 nt, Mus musculus
gguguauaccccuggauucuucaggagaauuagcaccauaaagcag

SEQ ID NO: 41175 - RNA, 80 nt, Mus musculus
auaacgguaggaggggggaaggacagagucuagcugccagccuguucuccccuccuucuuagcugugaaaacaaggagag

SEQ ID NO: 41176 - RNA, 30 nt, Mus musculus
gcucuacagcuaaaaaaggaaauggaaaag

SEQ ID NO: 41177 - RNA, 46 nt, Mus musculus
ucuuuuuguaaagucuuugcccuuccuuccccauucaaaggucaaa

SEQ ID NO: 41178 - RNA, 46 nt, Mus musculus
ggugcuuucaugaaugcuuuuaccaguugacuugucacacucguag

SEQ ID NO: 41179 - RNA, 45 nt, Mus musculus
guuuuaggaaacuggggaauaaaucuucauaagacuauguaacag

SEQ ID NO: 41180 - RNA, 46 nt, Mus musculus
ucuggggaagaugaugugugcugcagggaaacagccuaggccugug

SEQ ID NO: 41181 - RNA, 64 nt, Mus musculus
cugcuuuugaaggagagucuucaaagaagccuuugaccaccaccagaugguuacccacccccaa

SEQ ID NO: 41182 - RNA, 45 nt, Mus musculus
augacacagagcuggcuuuaccuagaguuagccaaguaaaggaca

SEQ ID NO: 41183 - RNA, 46 nt, Mus musculus
augccaaggaaaugaaccaguuagacacagucuauagagcgccaag

SEQ ID NO: 41184 - RNA, 46 nt, Mus musculus
gcgcaugcuuuuaaucccagcacuugggaggcagaggcagaggcag

SEQ ID NO: 41185 - RNA, 46 nt, Mus musculus
cuaaaaguugcuucacuuuugcaggacuuaguauccucaucauuag

SEQ ID NO: 41186 - RNA, 42 nt, Mus musculus
uaccaucucccucugucuuugcaguguguccucugcccccag

SEQ ID NO: 41187 - RNA, 42 nt, Mus musculus
guugaagggugacuacaaauaccugaccugcaaaaauggcga

SEQ ID NO: 41188 - RNA, 45 nt, Mus musculus
guguuuugccuacauguaugucugugcaugauauaugugccugua

SEQ ID NO: 41189 - RNA, 26 nt, Mus musculus
agcagcugcaaggccaggaggccugc

SEQ ID NO: 41190 - RNA, 46 nt, Mus musculus
aggguauaggacuguuaaaaaguuuuauguucaugaaaggcagaaa

SEQ ID NO: 41191 - RNA, 46 nt, Mus musculus
aaaaaacaaaaacaaaacaaaaaaaaaacaaaagaaagaaaggcag

SEQ ID NO: 41192 - RNA, 42 nt, Mus musculus
uccuguggguuugaguaccauguccucucuagcugccccacc

SEQ ID NO: 41193 - RNA, 46 nt, Mus musculus
uacugccaccuguacccgggggccaggccugaggcugcagaaacag

SEQ ID NO: 41194 - RNA, 42 nt, Mus musculus
gcagguuccuggcucuuuugagaguuucuaagaagcacccag

SEQ ID NO: 41195 - RNA, 42 nt, Mus musculus
uggacuuuguccuagguagcucuggcuuccuugcagcccaca

SEQ ID NO: 41196 - RNA, 46 nt, Mus musculus
caucuggcuuuuggcagucugggcaaguugccccuuuuuagguuug

SEQ ID NO: 41197 - RNA, 46 nt, Mus musculus
uaacugugcccaggaaguggccugcugugccacugcucccacucug

SEQ ID NO: 41198 - RNA, 46 nt, Mus musculus
uuuucccugccagcugauagagauggugggcacccagaaaccugag

SEQ ID NO: 41199 - RNA, 46 nt, Mus musculus
ggccucaaaaauaggggaauaacuucuccuagccaacugccuccau

SEQ ID NO: 41200 - RNA, 56 nt, Mus musculus
cccugcuggccacucccacacuaacccaggaggccaguccagugugcccagugucc

SEQ ID NO: 41201 - RNA, 67 nt, Mus musculus
uggagccugcuagaaacagggucaguggcagguggcaggcggaugggcaggaagaagcuucgagcaa

SEQ ID NO: 41202 - RNA, 45 nt, Mus musculus
agucagcaccaaaggacuuuuacacaggguuuuuugguuugggag

SEQ ID NO: 41203 - RNA, 46 nt, Mus musculus
uccuggugacuugcugucacauucuaucaguuuucaagggccagaa

SEQ ID NO: 41204 - RNA, 41 nt, Mus musculus
ccaguucuguguuuugugugagaacugugaaaugggcggag

SEQ ID NO: 41205 - RNA, 49 nt, Mus musculus
gucauacugucuuccccauucauccugcccuccuugcacccccagcuuu

SEQ ID NO: 41206 - RNA, 46 nt, Mus musculus
ccugcauaacaauaucuccucuguucugaggaacauucuagcauag

SEQ ID NO: 41207 - RNA, 47 nt, Mus musculus
agcucaccaugagggugcagaguagagcacuuggauugccaaguagg

SEQ ID NO: 41208 - RNA, 41 nt, Mus musculus
uuauauauauauuuuuugguauccuguacauugcagugggu

SEQ ID NO: 41209 - RNA, 46 nt, Mus musculus
uucuauguauauaacugcauuucuaaauaauaauaaaaauucuuau

SEQ ID NO: 41210 - RNA, 42 nt, Mus musculus
gcgaaugccuuuaaucccagcacuggggagucagaggcaggu

SEQ ID NO: 41211 - RNA, 45 nt, Mus musculus
agcuacaccgugaaacacugucugaagagagagagggggagagag

SEQ ID NO: 41212 - RNA, 45 nt, Mus musculus
cccaacucgucuacagucucuccacaacugacgcacuuagcagcu

SEQ ID NO: 41213 - RNA, 46 nt, Mus musculus
ucaacgauugacaccaugggggugggggauguucagucaagcaguc

SEQ ID NO: 41214 - RNA, 45 nt, Mus musculus
cucgcugcuggauuuagucucccaaugaacacucgacagccacuc

SEQ ID NO: 41215 - RNA, 46 nt, Mus musculus
agaguagagcuuuuggacgugcaugcauucuacagcacauuaagau

SEQ ID NO: 41216 - RNA, 23 nt, Mus musculus
gccuauuaucaacagucccuugu

SEQ ID NO: 41217 - RNA, 49 nt, Mus musculus
guuuucacauucuaauuugccaucugaccagaguucaggccauuagggg

SEQ ID NO: 41218 - RNA, 46 nt, Mus musculus
cuuuaggacuggaauuguuggcuucugagcugccuugaggguccug

SEQ ID NO: 41219 - RNA, 46 nt, Mus musculus
aauaauuugaagauuauucuaguaauuaguauaaaucaugccaguu

SEQ ID NO: 41220 - RNA, 45 nt, Mus musculus
acagcauccagcauuggaagaugggauccaacccuaagaagauag

SEQ ID NO: 41221 - RNA, 31 nt, Mus musculus
uuguauuuuggaaaugaguuucucuuaaagu

SEQ ID NO: 41222 - RNA, 45 nt, Mus musculus
cuaagaccauugggaaacacauauuuacuuaaaauucauagcaag

SEQ ID NO: 41223 - RNA, 45 nt, Mus musculus
cuccccccccagccccccaaguauuucucauugcucaaagcccuc

SEQ ID NO: 41224 - RNA, 44 nt, Mus musculus
agacacccugaggacauugggaccuagaagaccuaccuuggauu

SEQ ID NO: 41225 - RNA, 42 nt, Mus musculus
gucccccaaaucacugaaaaaauacggauauucgccgggcgu

SEQ ID NO: 41226 - RNA, 46 nt, Mus musculus
aagaugguccagacauaaacucaaguguauuucacuaauaagagag

SEQ ID NO: 41227 - RNA, 45 nt, Mus musculus
agaaaugguagagaaguuagauguccagucuuacuuagcggugac

SEQ ID NO: 41228 - RNA, 46 nt, Mus musculus
ccguccaaguacaaucacagacagcgacucuacacaaggaacagag

SEQ ID NO: 41229 - RNA, 46 nt, Mus musculus
gaggcuguuauguuuauugugcagacaaugauaauccaccagagaa

SEQ ID NO: 41230 - RNA, 45 nt, Mus musculus
aggaguagcauuauuggaaaggauuagaaggaguguccuuguugg

SEQ ID NO: 41231 - RNA, 61 nt, Mus musculus
gcucucugugcucugggcacuguugucuccugccugcuguucccguagcccacccaaaugg

SEQ ID NO: 41232 - RNA, 45 nt, Mus musculus
guuguuguuguuguuaaaaagaauuuaaaguuagaugaguuggga

SEQ ID NO: 41233 - RNA, 42 nt, Mus musculus
gcuaugcuuaacaaaacuggagaaccuagaugaaauggagaa

SEQ ID NO: 41234 - RNA, 45 nt, Mus musculus
caaggugaaagcuaugaauguuaauuucauucuucuauagguagu

SEQ ID NO: 41235 - RNA, 46 nt, Mus musculus
uccucaacacuuaaauucaguuguuauaacucacuaauuaauaauc

SEQ ID NO: 41236 - RNA, 46 nt, Mus musculus
uccugucaugacuugcacugaaagugguuguguaaguucaccagca

SEQ ID NO: 41237 - RNA, 45 nt, Mus musculus
aauacuuuuccuugagacuuuucuggaagcauaaugccaccuuug

SEQ ID NO: 41238 - RNA, 28 nt, Mus musculus
ucacacugacaggcucaaucucuccacu

SEQ ID NO: 41239 - RNA, 46 nt, Mus musculus
ccuggagugccaccauacccugggacaucugaacaugggcuuuaau

SEQ ID NO: 41240 - RNA, 46 nt, Mus musculus
cuggucuacaaagugggcuacuggacagacaaggcuacacagagaa

SEQ ID NO: 41241 - RNA, 45 nt, Mus musculus
ucuuuucucuguuuuagauuuaaaaaauguguucaugccgggugg

SEQ ID NO: 41242 - RNA, 89 nt, Mus musculus
acuuccuggcuuuccacaaaaggccucuagagacauguucagccugaagaccaaugggacaugugaucagugugagccaugaaugcaga

SEQ ID NO: 41243 - RNA, 44 nt, Mus musculus
uugcauacuuuauauaccccaguacaggggaaugccagggccaa

SEQ ID NO: 41244 - RNA, 46 nt, Mus musculus
agauugugugugugugugugugugagagagagagagagagauagau

SEQ ID NO: 41245 - RNA, 45 nt, Mus musculus
gucauccacuuggagauggggagggaugggaaggagguaugagau

SEQ ID NO: 41246 - RNA, 26 nt, Mus musculus
ugaccuauaauuguuacuguaugaaa

SEQ ID NO: 41247 - RNA, 47 nt, Mus musculus
ccugggaggugagagacucucaggacucaaagggagggacaucacau

SEQ ID NO: 41248 - RNA, 46 nt, Mus musculus
aaggauggcugaggaucagaugacagcuauguaggaauuucaggcu

SEQ ID NO: 41249 - RNA, 41 nt, Mus musculus
uuugaauguauaacagaagaacaaaaaguacaagggagugg

SEQ ID NO: 41250 - RNA, 46 nt, Mus musculus
caagcccagugaauacccugcuuucuacucuacugagcccaaacgu

SEQ ID NO: 41251 - RNA, 23 nt, Mus musculus
cucccauugacaaggccauccuc

SEQ ID NO: 41252 - RNA, 61 nt, Mus musculus; identical to SEQ ID NO: 41231

SEQ ID NO: 41253 - RNA, 45 nt, Mus musculus
gauuuucugagaaaggggggugauugacuuuccaguuauagagau

SEQ ID NO: 41254 - RNA, 42 nt, Mus musculus
ucguuaguuuuggguaguaagguagcggaauugaggacagca

SEQ ID NO: 41255 - RNA, 46 nt, Mus musculus
guaaagucaauuucccaguaggucccagaucugucuccccacagac

SEQ ID NO: 41256 - RNA, 42 nt, Mus musculus
uguuuuccaggauccauucauuuuggucagucucagggggug

SEQ ID NO: 41257 - RNA, 44 nt, Mus musculus
ccugauguaacaacaugagguaguuuaauggcggagcuccgagu

SEQ ID NO: 41258 - RNA, 46 nt, Mus musculus
cuucuauuucaauuuaugauuugauuuuuugugugugugaacuugu

SEQ ID NO: 41259 - RNA, 46 nt, Mus musculus
caaaggucauaaaaauaggacuaacaauuuauuauaggagcuagga

SEQ ID NO: 41260 - RNA, 45 nt, Mus musculus
ucagaauuccuaaaauuauaucagugauuauuaaacucuuuuaua

SEQ ID NO: 41261 - RNA, 45 nt, Mus musculus
gaucuuccugaaauugucugcuucugguuauaauaugaccuguga

SEQ ID NO: 41262 - RNA, 46 nt, Mus musculus
agcuacaucucuguagucuuaacauuccaucaaucacguccaguug

SEQ ID NO: 41263 - RNA, 46 nt, Mus musculus
uaaggaaagugauuguuauuucuuguuauuuuuguuguuagaugug

SEQ ID NO: 41264 - RNA, 42 nt, Mus musculus
uuuguuuguuuguuucuacuugguugauuucagcccuguguu

SEQ ID NO: 41265 - RNA, 45 nt, Mus musculus
ugaaggugcagccccaguugacaguugcaguugacagcuaaagac

SEQ ID NO: 41266 - RNA, 45 nt, Mus musculus
cgauauaagguaauuuguaggaaauuagaccacagaagguacaau

SEQ ID NO: 41267 - RNA, 42 nt, Mus musculus
gaagaccaagcugcauaucuacuacauaugugcuggcggggg

SEQ ID NO: 41268 - RNA, 45 nt, Mus musculus
cccaguacaggggaaugcuagggccaggaagcgggaguggguggg

SEQ ID NO: 41269 - RNA, 46 nt, Mus musculus
accucauaaaauuucgaagcuucuguaaggcaaaagacaccgucag

SEQ ID NO: 41270 - RNA, 46 nt, Mus musculus
auucaaugcaauccucaucaaaauuccaaguuaauccuucauagag

SEQ ID NO: 41271 - RNA, 47 nt, Mus musculus
agauauauugaggacagcaagcacuugagaugaucagauggcaggag

SEQ ID NO: 41272 - RNA, 46 nt, Mus musculus
accauugacacuuucauggcccuuggugguagcacaagccucagau

SEQ ID NO: 41273 - RNA, 46 nt, Mus musculus
caaagcauauacuuccuaauccucccaggucuguccccaacccuug

SEQ ID NO: 41274 - RNA, 41 nt, Mus musculus
ugacugagagggaacacuuuucagaagauuuugccccaaua

SEQ ID NO: 41275 - RNA, 71 nt, Mus musculus
gggacucuagcucugcuaaacaaugccaagccucaucuauguucuaugaucccuucaaacuuuuaaaacca

SEQ ID NO: 41276 - RNA, 46 nt, Mus musculus
cugggccuucuauacugcaacugaaucugcaccuucacuaacagac

SEQ ID NO: 41277 - RNA, 45 nt, Mus musculus
uuaugaaaaggcuguguugugcaguagcauaaucugggaguuggu

SEQ ID NO: 41278 - RNA, 45 nt, Mus musculus
uuccagaccuguggaaaccuggaugugaauaguaugauggcagaa

SEQ ID NO: 41279 - RNA, 45 nt, Mus musculus
aucagauauuuacauuacuauucauaacaguccccaaauuacagu

SEQ ID NO: 41280 - RNA, 47 nt, Mus musculus
uuggagaaaaaauugaaagugaauaaaauaacuuuagagucagagua

SEQ ID NO: 41281 - RNA, 41 nt, Mus musculus
gugcccuuaacacuugggcaugagcuggguccuggcuuagu

SEQ ID NO: 41282 - RNA, 46 nt, Mus musculus
uaauuauuuucaccuaaauauuaauuauuguuuguagguggcugua

SEQ ID NO: 41283 - RNA, 45 nt, Mus musculus
cacuagaaaagaaaacuaaguaauccuguuacuuuaaggacagau

SEQ ID NO: 41284 - RNA, 46 nt, Mus musculus
guuggagguucuuuuggucuucgugaauuuucacaaauccgguacg

SEQ ID NO: 41285 - RNA, 46 nt, Mus musculus
uaccucgggucccgccaucccccaccccccguuuccuuucccuucg

SEQ ID NO: 41286 - RNA, 42 nt, Mus musculus
agggcagugaggugggagucggugggggagcacccucaaaga

SEQ ID NO: 41287 - RNA, 45 nt, Mus musculus
uaccuauacagauguggaugcucacauccaaccaucggacugaga

SEQ ID NO: 41288 - RNA, 26 nt, Mus musculus
accagaaauccccacacugaucaagu

SEQ ID NO: 41289 - RNA, 46 nt, Mus musculus
uucuguuguucuagcugggcugccuuauuuggccucagugggagag

SEQ ID NO: 41290 - RNA, 46 nt, Mus musculus
aguuaucaaaacaaacaacuccaaaccuguccauauuaggcucuug

SEQ ID NO: 41291 - RNA, 44 nt, Mus musculus
ccuuccaucccauguaagugaauuaucaccacugggucccggga

SEQ ID NO: 41292 - RNA, 55 nt, Mus musculus
cauguccgagaggagagaaagggggaaaaggagagagagaagaaaggcuagagua

SEQ ID NO: 41293 - RNA, 58 nt, Mus musculus
agcuuuauuguagaaaggcagggagaaagagaaaagguagaaagagaaagagacuggc

SEQ ID NO: 41294 - RNA, 45 nt, Mus musculus
uuuguuuuuucuauuucaauuuuuagauccugugugagcacuaaa

SEQ ID NO: 41295 - RNA, 45 nt, Mus musculus
uuggucuuauuguguccuggauuuccuggauguuuuggguuagga

SEQ ID NO: 41296 - RNA, 46 nt, Mus musculus
aaaagacccagagcccagaacuggugcugcuuauauaggccuagga

SEQ ID NO: 41297 - RNA, 46 nt, Mus musculus
uucucuuuaggcuuucaauaaagaccagaaggacugauagacagcu

SEQ ID NO: 41298 - RNA, 45 nt, Mus musculus
gggacugucuuaaacugauuaguaacacuaugacuuacccugaga

SEQ ID NO: 41299 - RNA, 47 nt, Mus musculus
agaaaaauauugccauccaaaacagagcacagugcagcaacauagaa

SEQ ID NO: 41300 - RNA, 47 nt, Mus musculus
aaaggagaaggaauaaguuuuguuuguuuguagagggugcaaggaaa

SEQ ID NO: 41301 - RNA, 46 nt, Mus musculus
cuaaggaaugaucauaacugaaacauuucaagaacuauuagcagag

SEQ ID NO: 41302 - RNA, 46 nt, Mus musculus
agaaguuacauauuuuacuaggacugccaauaaaaacucagcuauc

SEQ ID NO: 41303 - RNA, 45 nt, Mus musculus
ugacauccucccauauucuuucuccuccacauagccaauacaaga

SEQ ID NO: 41304 - RNA, 46 nt, Mus musculus
auggaccuauaguacaucgaggugaaggagagccaaguggaguucc

SEQ ID NO: 41305 - RNA, 41 nt, Mus musculus
ggaggaggaggagaaggagaagaaggagaagaagaagaaga

SEQ ID NO: 41306 - RNA, 47 nt, Mus musculus
uggugagacucugaaagaaaacucaaacuauuaaaaaaagaagaaga

SEQ ID NO: 41307 - RNA, 47 nt, Mus musculus
aauuacuugguaagaggccaaaugaggauacagaggcugaagaagau

SEQ ID NO: 41308 - RNA, 42 nt, Mus musculus
uaguuccacuuaucaaagauacuagcaggacucaugaagaga

SEQ ID NO: 41309 - RNA, 45 nt, Mus musculus
uccaaagugggggaaugccagggccaggaagcaggaguggguagg

SEQ ID NO: 41310 - RNA, 46 nt, Mus musculus
gcuagagaaaggaccuaaggagcugaaaggguuugcagcccccuag

SEQ ID NO: 41311 - RNA, 49 nt, Mus musculus
agaagucaggagccauagaugcaaauaccaccaacagaauacaagagau

SEQ ID NO: 41312 - RNA, 46 nt, Mus musculus
agaugauaaagacaaaaaucuaaugaaggacugaaggacugaaagu

SEQ ID NO: 41313 - RNA, 45 nt, Mus musculus
guguguggguuauucuugauaaauaaaaauagauuuaagugggga

SEQ ID NO: 41314 - RNA, 45 nt, Mus musculus
gggcucacugacccuuuaaauuuuuuauuauuuuaacugugugug

SEQ ID NO: 41315 - RNA, 46 nt, Mus musculus
gguuugucucagcauugagagaacugaucggccucagcccccuugu

SEQ ID NO: 41316 - RNA, 44 nt, Mus musculus
auuuuucagauuuuguuacaagagucuaacaguuaccuuugaga

SEQ ID NO: 41317 - RNA, 45 nt, Mus musculus
aaaagaauuuucaugacuacaucauauauucuuccuugccccauc

SEQ ID NO: 41318 - RNA, 46 nt, Mus musculus
gcucuuaaugguaaacuggauucagaccuagagucaggaggcagac

SEQ ID NO: 41319 - RNA, 46 nt, Mus musculus
guauuugcuaguuuauauuguauauguaauaacagugguuaaagaa

SEQ ID NO: 41320 - RNA, 46 nt, Mus musculus
uacaauuaaagaaaaaaaagaaagaaagaaagaaaaaaggccauga

SEQ ID NO: 41321 - RNA, 47 nt, Mus musculus
cccaguauuaguugugacaaauaacugacaaaaacaauuuaggggag

SEQ ID NO: 41322 - RNA, 45 nt, Mus musculus
aauuaccacugacaacuucuagguaauuuugauagugucauagga

SEQ ID NO: 41323 - RNA, 46 nt, Mus musculus
gaucaaacaauucuugaaacaaacacuucaugugauucugacagga

SEQ ID NO: 41324 - RNA, 45 nt, Mus musculus
agagcagucagauaugaacggacggguggauuauuuagucacgga

SEQ ID NO: 41325 - RNA, 47 nt, Mus musculus
agacuaagagaaaccacccucaauggaaggggcaaguacucagguuu

SEQ ID NO: 41326 - RNA, 51 nt, Mus musculus
uguucaacauagaaccuguagcggcaggauauuaaagacuuugauauguag

SEQ ID NO: 41327 - RNA, 46 nt, Mus musculus
ccuuguguugguguuuucccuuuauuauccuuugaaggccuggauu

SEQ ID NO: 41328 - RNA, 46 nt, Mus musculus
caaaaaaagaggcagagccuuugccagaaacuguaaaaucugagga

SEQ ID NO: 41329 - RNA, 46 nt, Mus musculus
guggaagugaccaaagcauuuggagguagagucuggguggaaagau

SEQ ID NO: 41330 - RNA, 46 nt, Mus musculus
ggagcaccuauguucagaaagacauugagaaaacacaugacagugg

SEQ ID NO: 41331 - RNA, 39 nt, Mus musculus
uaauggguucaauaauccuagacuauaaagccacuagac

SEQ ID NO: 41332 - RNA, 45 nt, Mus musculus
ccauccuuccaaaggauauugguggcacuuuaaagaucacgaaga

SEQ ID NO: 41333 - RNA, 46 nt, Mus musculus
aggauguauucgauuccaaccaucugacugaaaggggcacacagag

SEQ ID NO: 41334 - RNA, 47 nt, Mus musculus
cuggaaaaaguagggguugaggccaaacagccaaauucugccaucag

SEQ ID NO: 41335 - RNA, 50 nt, Mus musculus
aaacaaaacgaaaccagggcuuuucugggauggacagaaauuagagguag

SEQ ID NO: 41336 - RNA, 45 nt, Mus musculus
guuucucucacaaugcugggcguuaugucggggcgaagggauagc

SEQ ID NO: 41337 - RNA, 46 nt, Mus musculus
uaguuuauuccuguuggaauaagauaaggguuuauccuggcccaga

SEQ ID NO: 41338 - RNA, 60 nt, Mus musculus
gcucccagcucaggucaguacucucaaucccaggaucuucucuuucccaucuugagacuu

SEQ ID NO: 41339 - RNA, 45 nt, Mus musculus
uaugucauuuccccugaaguuacaggaggugccauagugggggau

SEQ ID NO: 41340 - RNA, 46 nt, Mus musculus
auauuugguaaaaauugcgugugagcuuuuuucagaagggcaagaa

SEQ ID NO: 41341 - RNA, 46 nt, Mus musculus
ccggcaagccguggaacuguagcaccugggguugcugggcgggggg

SEQ ID NO: 41342 - RNA, 46 nt, Mus musculus
aauaaauggaaauuucaucucaaggauggcguuaugaaucuuaacg

SEQ ID NO: 41343 - RNA, 45 nt, Mus musculus
ggaagaugaagaugaagaugaagaagaagacuaugaugaugagga

SEQ ID NO: 41344 - RNA, 45 nt, Mus musculus
aagccagcugcuucagguggucagagcagccaauggugcccagua

SEQ ID NO: 41345 - RNA, 46 nt, Mus musculus
acucggcaaacacaaacaccgugccuaaauuguacagaucugugau

SEQ ID NO: 41346 - RNA, 41 nt, Mus musculus
ugugugugugcgugugugugugugugcgugcgcgugugugu

SEQ ID NO: 41347 - RNA, 46 nt, Mus musculus
accagggaaaaccuccagccucccacagaguaaaagaaaccgguag

SEQ ID NO: 41348 - RNA, 67 nt, Mus musculus
gggcuugggaaacugcuaacagacugggugcuggacuucuggaccacccacgagaaaagguggcgag

SEQ ID NO: 41349 - RNA, 50 nt, Mus musculus
uuguagcuaauggugaccuucagccugauccuucagccuccuacugcuaa

SEQ ID NO: 41350 - RNA, 46 nt, Mus musculus
uaaacagacuucuccccguuuucgcuuuuaucucaacauggcuuag

SEQ ID NO: 41351 - RNA, 45 nt, Mus musculus
uagaaugcuggggucaggggaugugaagacauggaguggguaugu

SEQ ID NO: 41352 - RNA, 46 nt, Mus musculus
acuguccuggaacucacucuguagaccagcuggccucgaaacucag

SEQ ID NO: 41353 - RNA, 46 nt, Mus musculus
uccauagcucugacuguccuggagcucacuauauagaucagacugg

SEQ ID NO: 41354 - RNA, 46 nt, Mus musculus
cugggacauuccaaaagacagcaaggaacucaagugcagaacugag

SEQ ID NO: 41355 - RNA, 64 nt, Mus musculus
uggccaccaugaugcugaguccccgucaaccucguccagcagaacuggagagucuucagugcca

SEQ ID NO: 41356 - RNA, 130 nt, Mus musculus
ccugaaaagaaccgauacuuccguuugcucccgggucacaacaacugcaacccccucacaaaggagggcauccagcaaaaggagauggagagcaggaggcugcagcugcugcagcaagaggacaugcaga

SEQ ID NO: 41357 - RNA, 64 nt, Mus musculus
ucuuauucugucuuuggauguuccuucuguaguucacacauccagucaggagagaccgugugcu

SEQ ID NO: 41358 - RNA, 44 nt, Mus musculus
accuggagaggaagcugucccguggaagaggaaagaggcgguga

SEQ ID NO: 41359 - RNA, 45 nt, Mus musculus
uaucccaugagcugcgggugagcugcauggagaggaaaaagguag

SEQ ID NO: 41360 - RNA, 46 nt, Mus musculus
uuuuaagguguguguguguguguguguguguguaugugugugugug

SEQ ID NO: 41361 - RNA, 46 nt, Mus musculus
gcagacacuaccagugaccgccucuucacagugaaugacgucaaaa

SEQ ID NO: 41362 - RNA, 44 nt, Mus musculus
ggggagaucuuugccauugaccugcguucuccaagucaagccaa

SEQ ID NO: 41363 - RNA, 45 nt, Mus musculus
ccucugugcaggucuucaaggaggagcaacaccugauggcgucag

SEQ ID NO: 41364 - RNA, 45 nt, Mus musculus
ccaaggccaacauucccaguguggccuucucuccucggcuugggg

SEQ ID NO: 41365 - RNA, 45 nt, Mus musculus
guuuuuuaauaaucuaaauuacaaguguucuacauggaaaggagc

SEQ ID NO: 41366 - RNA, 47 nt, Mus musculus
caggcaguagugcuacaccccuugaaucccaguacucaggaggcaga

SEQ ID NO: 41367 - RNA, 29 nt, Mus musculus
cugaugaaaugguucagcagguaaaggua

SEQ ID NO: 41368 - RNA, 46 nt, Mus musculus
uacuaaaucauuucccccaaauuaauguguaauuuguauuaccagu

SEQ ID NO: 41369 - RNA, 46 nt, Mus musculus
cuggagguacugguggaggaaagccaggaaacugugggggugggau

SEQ ID NO: 41370 - RNA, 46 nt, Mus musculus
aggagccauaauacucauugguacaggaaucaucggugucccuaag

SEQ ID NO: 41371 - RNA, 26 nt, Mus musculus
guucccaacaaaaacuguaguaguag

SEQ ID NO: 41372 - RNA, 46 nt, Mus musculus
ggcucacaaccauccguaacgagaucugaugcccuccucuggagug

SEQ ID NO: 41373 - RNA, 43 nt, Mus musculus
caaaucccagcaaccacccauaaugagaucugaugcccucuuc

SEQ ID NO: 41374 - RNA, 49 nt, Mus musculus
ucucuccaaucugaaggucaugcaauaaucugagagcacggaggguaga

SEQ ID NO: 41375 - RNA, 24 nt, Mus musculus
uucuuacuuucucaaaccugccuc

SEQ ID NO: 41376 - RNA, 46 nt, Mus musculus
ccuccuucuuuuccuuuuucuucuuucuggggugagagucagacuc

SEQ ID NO: 41377 - RNA, 41 nt, Mus musculus
aaccuuggugaugaguggguaagggaucaauggggccacug

SEQ ID NO: 41378 - RNA, 42 nt, Mus musculus
uaaagcauuuaaaacuuuaaaaagcagucuuaccuguuagau

SEQ ID NO: 41379 - RNA, 45 nt, Mus musculus
aucgccaacacuggauuaaccuugccuacaagcuauguuucuggg

SEQ ID NO: 41380 - RNA, 46 nt, Mus musculus
ggaaucuucaaccuuagguggggaaaucuguuacgaguggcaagcu

SEQ ID NO: 41381 - RNA, 46 nt, Mus musculus
agaguuaauucuguaccuccaguauacagacuuuccccggcgcaau

SEQ ID NO: 41382 - RNA, 40 nt, Mus musculus
ucuuuuuccuuuucucguucacguucucuuucccuuucuc

SEQ ID NO: 41383 - RNA, 84 nt, Mus musculus
auccuuauuucgaucugagcuccguucucgaucucggucccgaucucucucucgaucucggucucucucuuuugugcggucacg

SEQ ID NO: 41384 - RNA, 46 nt, Mus musculus
cuaauagaacauguuaaaaagacauucuaagagcagggcagcacuc

SEQ ID NO: 41385 - RNA, 45 nt, Mus musculus
ucguucucguucccguucucguucucucucucuuucccgcucccg

SEQ ID NO: 41386 - RNA, 46 nt, Mus musculus
uucucugucucuuuucuugucuuucucucuuucccguucccguucu

SEQ ID NO: 41387 - RNA, 46 nt, Mus musculus
acuagccugauauacacugauaugugauuccaaaacagucugagcu

SEQ ID NO: 41388 - RNA, 45 nt, Mus musculus
gaagagcacuaccccuggaaaguuaauagcauuuaaugaucagau

SEQ ID NO: 41389 - RNA, 84 nt, Mus musculus
ugaguuuucaugaggaauaauaauaccacaaggagacucauccccaggaguguuggggguugcguugccacuggcagaggacac

SEQ ID NO: 41390 - RNA, 45 nt, Mus musculus
uuggacuuuuuacuuuagaagugucugaauaaauuuuguguagau

SEQ ID NO: 41391 - RNA, 46 nt, Mus musculus
aauuccuaacaaccacaugguggcucacaaccaucuguaauaagau

SEQ ID NO: 41392 - RNA, 46 nt, Mus musculus
ugaaaucugaugcccucuucuggaguaucuaaggacagcuacagug

SEQ ID NO: 41393 - RNA, 42 nt, Mus musculus
ucacaauguuaaauaaaaguaaucacauagggcuggcgagau

SEQ ID NO: 41394 - RNA, 41 nt, Mus musculus
gaaagaagaaagaagaaagaagaaagaagaaagagaaaaaa

SEQ ID NO: 41395 - RNA, 92 nt, Mus musculus
gccaguguccaucagcuaagauugcauugauaaaggcacaguauaggagcucacauaaagacuuagaauaggugauggcuguuacccagaaa

SEQ ID NO: 41396 - RNA, 46 nt, Mus musculus
ccuuacauuguguugauuaugaagaacaaugaaaucuacgugccaa

SEQ ID NO: 41397 - RNA, 46 nt, Mus musculus
caaguacucuaugaaccaagcuacaucuccaaugcugugggugcuu

SEQ ID NO: 41398 - RNA, 42 nt, Mus musculus
agcuggauggauuuucuuuuuuccuccgcuacgugggugugu

SEQ ID NO: 41399 - RNA, 42 nt, Mus musculus
uuagucaaacccagaacucacuaauauagcuugucuggccag

SEQ ID NO: 41400 - RNA, 45 nt, Mus musculus
gauaaguuuuucuccacuggugaagugagccaauucaagccagag

SEQ ID NO: 41401 - RNA, 47 nt, Mus musculus
acaggggaggagggagagaaagagaaagaacaugugcacacagggag

SEQ ID NO: 41402 - RNA, 45 nt, Mus musculus
guauuuagugacggugauuauacaaugcaagguaaacugcuggga

SEQ ID NO: 41403 - RNA, 45 nt, Mus musculus
ggucuguuuuaaguugauuuuguguauguaacacaauauggguca

SEQ ID NO: 41404 - RNA, 46 nt, Mus musculus
uaaaguuaccaucucauccauuuuguuucuguuuuuguuguuguug

SEQ ID NO: 41405 - RNA, 44 nt, Mus musculus
agauuauugccaggcgugguggcacauuccuuuaaucccagcac

SEQ ID NO: 41406 - RNA, 46 nt, Mus musculus
cccagugcccuguguucaagugacugagauucagcuccgccccccc

SEQ ID NO: 41407 - RNA, 45 nt, Mus musculus
uagaagccuaguuuauuucuggugugugugugugugugugugugu

SEQ ID NO: 41408 - RNA, 45 nt, Mus musculus
caaauuauaggagggcuuuauuuggguucauucuuacaggggcag

SEQ ID NO: 41409 - RNA, 46 nt, Mus musculus
caucaugucagggaaguauggcagcagacaggcagaguggcugaag

SEQ ID NO: 41410 - RNA, 45 nt, Mus musculus
cagcauugggaauggagaggcuuuugaaaucacaaagccugcgac

SEQ ID NO: 41411 - RNA, 46 nt, Mus musculus
aaaaaggguuuuuuuguuuuuuaaaagaaugacuauaacaggauga

SEQ ID NO: 41412 - RNA, 55 nt, Mus musculus
uuuagaaugacagccaagaacggcagcagcagcaugacaggcagagacuugacaa

SEQ ID NO: 41413 - RNA, 70 nt, Mus musculus
cccugagccaauaucuaaugggcggccccagaguaacucaagacaggugguggaacaagaugaggaggaa

SEQ ID NO: 41414 - RNA, 46 nt, Mus musculus
ucaucuacugggaguagauccuaguauuucucauaacagccuguuu

SEQ ID NO: 41415 - RNA, 42 nt, Mus musculus
aacaaaaucacuuacucucuggauuaauuuuguacccucaga

SEQ ID NO: 41416 - RNA, 45 nt, Mus musculus
aagcugggaagucagggagcuacacaagacucgucucauacccug

SEQ ID NO: 41417 - RNA, 42 nt, Mus musculus
auuuuaaaaaaggagaaaaaccaucuuccuagacagccccau

SEQ ID NO: 41418 - RNA, 43 nt, Mus musculus
cccaaaggaggguacccaagaaccccaaguauaacacacaaag

SEQ ID NO: 41419 - RNA, 46 nt, Mus musculus
aggaacuuucugggagcauucuaacgagugaagacccggaggaaag

SEQ ID NO: 41420 - RNA, 46 nt, Mus musculus
gugguacacacuuguagcccuagggcuugaguggcugaggcagguu

SEQ ID NO: 41421 - RNA, 46 nt, Mus musculus
uagguacacagcuuucauacagaaugacugcauuucuccaagagga

SEQ ID NO: 41422 - RNA, 45 nt, Mus musculus
acuuccauauaaaacccccaaugucuccagcagaauggcccagcc

SEQ ID NO: 41423 - RNA, 46 nt, Mus musculus
auuccuggcuggagcacucaaaugaaaucauagaggaauggcaggu

SEQ ID NO: 41424 - RNA, 46 nt, Mus musculus
uccgacgcaguuuuuuuggaaaggcugcaccucuuucuagcuaggg

SEQ ID NO: 41425 - RNA, 42 nt, Mus musculus
ccacgccccgcgaccgcacccagccaucucccgcccggaguc

SEQ ID NO: 41426 - RNA, 42 nt, Mus musculus
uuccugccgcuuggguucccggugcucggagugccgccucuc

SEQ ID NO: 41427 - RNA, 46 nt, Mus musculus
aaacagcaaaaaagcaagaacuuuucuaaguucacagagaccagau

SEQ ID NO: 41428 - RNA, 49 nt, Mus musculus
agcggaaauagccuacagcccguugggaauuggaaauagagaugggguu

SEQ ID NO: 41429 - RNA, 44 nt, Mus musculus
gagugucucuuagccucgccuuccucucuucccugugguuugug

SEQ ID NO: 41430 - RNA, 42 nt, Mus musculus
cagcaaugcaguugccagccuggugaaacaaucccgggagag

SEQ ID NO: 41431 - RNA, 46 nt, Mus musculus
ucaggaguugcccuacgcgcagcagcuccuucuccaccugguccag

SEQ ID NO: 41432 - RNA, 45 nt, Mus musculus
uaauacaggaguucucaagcuguggguuacggccccuccggagga

SEQ ID NO: 41433 - RNA, 46 nt, Mus musculus
auaggauuucgggcagcauugggaguauuuacagauuguggaacag

SEQ ID NO: 41434 - RNA, 46 nt, Mus musculus
uuucucaaccuuuagaaaaauaaaacuggagauguuuucugaguau

SEQ ID NO: 41435 - RNA, 45 nt, Mus musculus
uuuuuguuugucaacaaccugaagagggguguuacaagaggguga

SEQ ID NO: 41436 - RNA, 46 nt, Mus musculus
uguauucauagaaaauaaauaaauccuuuuuuaaaaaaaagcuuau

SEQ ID NO: 41437 - RNA, 74 nt, Mus musculus
ugugucagaugcuaaugauaaggccuguacuuaagguugcagaugugggcugagaaucauguuuuauuucacac

SEQ ID NO: 41438 - RNA, 46 nt, Mus musculus
ucacugagucuggaagucccuuacugccuagccuggcuguccccag

SEQ ID NO: 41439 - RNA, 37 nt, Mus musculus
uacaugagacccuggagagagagagagagagagagag

SEQ ID NO: 41440 - RNA, 46 nt, Mus musculus
cacaacaucauggaaaacuauagcaaaugcacagggauggacuagg

SEQ ID NO: 41441 - RNA, 46 nt, Mus musculus
gccucuuuggcacuuugcaguacacacacacuucaaaaccccaaau

SEQ ID NO: 41442 - RNA, 42 nt, Mus musculus
aguguucaguggcaaagcuaguuggcaugccaggcccuagau

SEQ ID NO: 41443 - RNA, 47 nt, Mus musculus
cauagcuguuugugugugugugugcgugugugugugugugcgugugu

SEQ ID NO: 41444 - RNA, 46 nt, Mus musculus
ucagggacugauggacauacguuucgaagugccuguuuaccaagau

SEQ ID NO: 41445 - RNA, 45 nt, Mus musculus
ugaccuggggggugccuccacccaaaucacguuucuaccccaguu

SEQ ID NO: 41446 - RNA, 46 nt, Mus musculus
uguugggaaagagauggagucagugcaagauccaguuaaagggacu

SEQ ID NO: 41447 - RNA, 41 nt, Mus musculus
guagaggagaucuucaagaauucaccuuuccuggucccaga

SEQ ID NO: 41448 - RNA, 45 nt, Mus musculus
cuuaaacacuucaaccucccgucuagcccaccacccagcagaggu

SEQ ID NO: 41449 - RNA, 45 nt, Mus musculus
ugcuuucggugaccccucauugcucagucaugguggugaccagga

SEQ ID NO: 41450 - RNA, 46 nt, Mus musculus
uuugcugccugagcagaaagcccaggcucugcucuuggaggugagu

SEQ ID NO: 41451 - RNA, 31 nt, Mus musculus
uuggagguggccaaagacucgauccccagaa

SEQ ID NO: 41452 - RNA, 42 nt, Mus musculus
uucaagguuacccuuaucuaccuaggauauuugaggccagug

SEQ ID NO: 41453 - RNA, 45 nt, Mus musculus
uagcucaguuaguagagcauuugccuaacauucacaaagcccugg

SEQ ID NO: 41454 - RNA, 45 nt, Mus musculus
ucuucuugucuuccaugugccccauuaaugucagugccggcaccu

SEQ ID NO: 41455 - RNA, 46 nt, Mus musculus
agcaacaaagccucagguccacaucuugggaagaauauggccacuu

SEQ ID NO: 41456 - RNA, 46 nt, Mus musculus
cugguaccaaagauuuaaagcaacugaagaggcugugcuggggaga

SEQ ID NO: 41457 - RNA, 45 nt, Mus musculus
gagaucuggcgcccucuucuggagugacugaagacagcuacagug

SEQ ID NO: 41458 - RNA, 46 nt, Mus musculus
gucuguguguguguauauaugugugugggcaggugaguguguguau

SEQ ID NO: 41459 - RNA, 58 nt, Mus musculus
uaguagaggacacuuuuuaaagaagcaauaaauaaggucaagaaaguaaaauuuggcu

SEQ ID NO: 41460 - RNA, 46 nt, Mus musculus
aaagauaauuauaacaaaaugucacaagguucagagacucagggag

SEQ ID NO: 41461 - RNA, 46 nt, Mus musculus
cacuauuaggaggugugaccuuguuggaguagauguggccuucuag

SEQ ID NO: 41462 - RNA, 46 nt, Mus musculus
cauacccuaagaaacaggcuaggagacuauccaaauuucuuaccag

SEQ ID NO: 41463 - RNA, 45 nt, Mus musculus
auugcauuauaguugugaaugugaaaagucuaggauggggcaaag

SEQ ID NO: 41464 - RNA, 42 nt, Mus musculus
gggucaaagcuaaaaaagaaaaggcucaggaguaaaggggag

SEQ ID NO: 41465 - RNA, 42 nt, Mus musculus
cugccgccacugccgccgccauggcucaccgacucugcccag

SEQ ID NO: 41466 - RNA, 45 nt, Mus musculus
acccacaaguaugugggccacgugguuaaggcucaauaaggcagu

SEQ ID NO: 41467 - RNA, 45 nt, Mus musculus
aagcgagucucugauuuuaaaagggaguguaaggggcugcugggc

SEQ ID NO: 41468 - RNA, 34 nt, Mus musculus
aaagaaaagaaaaaaaaagaaaaaaaaaaaagac

SEQ ID NO: 41469 - RNA, 45 nt, Mus musculus
cucacaaccaucuguaauggaaucugacgcccucuucuggaagau

SEQ ID NO: 41470 - RNA, 46 nt, Mus musculus
gccuccaccuccuccagcccaacaacaggggcaaaauacuggugac

SEQ ID NO: 41471 - RNA, 46 nt, Mus musculus
aagaucagaccauagcauuggggaucuugagauuuaccugccucag

SEQ ID NO: 41472 - RNA, 45 nt, Mus musculus
cccccacuccguccauggccucucagcccacacagacacaggcgc

SEQ ID NO: 41473 - RNA, 45 nt, Mus musculus
gaagcuuaaaauucuucgcuuguaagucagaaauaauaucgccac

SEQ ID NO: 41474 - RNA, 27 nt, Mus musculus
cucuuacaaccgucaggcucaggaaua

SEQ ID NO: 41475 - RNA, 46 nt, Mus musculus
uugaacguaagucaucaagcuuggggacaagugccuuuacccacag

SEQ ID NO: 41476 - RNA, 46 nt, Mus musculus
uagaggucaccacaacgugaggaucugcauuaaagggucggagcau

SEQ ID NO: 41477 - RNA, 42 nt, Mus musculus
gauguugacacuguaggacuggccuuugugcagcugacaggg

SEQ ID NO: 41478 - RNA, 46 nt, Mus musculus
gaaccuguugccugugcauacauauauacacacaguacccauguag

SEQ ID NO: 41479 - RNA, 50 nt, Mus musculus
uugaagugcaggggcuccgccuggcuggcagcgaccagcgccagcagcag

SEQ ID NO: 41480 - RNA, 42 nt, Mus musculus
cagucacaagauaaacuugucccggaccgaggguggagccag

SEQ ID NO: 41481 - RNA, 57 nt, Mus musculus
cuggacucgacgcagcugcuggguucgggguggccuccuggccucggccucugcgag

SEQ ID NO: 41482 - RNA, 45 nt, Mus musculus
cgccaagccuugaccugggccuauggugaugguggaugcccgcug

SEQ ID NO: 41483 - RNA, 42 nt, Mus musculus
uggaguacccgggccccggcgaggccucgggaagcgccaccg

SEQ ID NO: 41484 - RNA, 46 nt, Mus musculus
gcagcagaugcaccagaagcaaaugcagugcgugcuccaaccccac

SEQ ID NO: 41485 - RNA, 74 nt, Mus musculus
agacuggcagccgccuccgccaccgaugcccccgccaccuggaccagcccucaguuaucagaagcagcagcagu

SEQ ID NO: 41486 - RNA, 81 nt, Mus musculus
cugcugcuucugauaacugagggcugguccagguggcgggggcaucgguggcggaggcggcugccagucuccguagccgcc

SEQ ID NO: 41487 - RNA, 43 nt, Mus musculus
gauccuggagguacagggggagauucaggaggggacuccagcu

SEQ ID NO: 41488 - RNA, 50 nt, Mus musculus
gauccuacaugcccccaucccagucguacaugccuccaccucagccacca

SEQ ID NO: 41489 - RNA, 48 nt, Mus musculus
aagguggagacugugaaggggauggcugagcaggaggcagguagggcu

SEQ ID NO: 41490 - RNA, 46 nt, Mus musculus
uccccuucacagucuccaccuucccaguccuaucuggcgcccacuc

SEQ ID NO: 41491 - RNA, 52 nt, Mus musculus
acggugguggugguagcugggguuuagaagggcccugggaggagcgggaagg

SEQ ID NO: 41492 - RNA, 42 nt, Mus musculus
gcagcuugcuucuguucagcagucuuguucuuggccccacuc

SEQ ID NO: 41493 - RNA, 42 nt, Mus musculus
agaacaagacugcugaacagaagcaagcugcuccugaaccag

SEQ ID NO: 41494 - RNA, 42 nt, Mus musculus
acaaacaccugcagucccuagcacugguggcagaggcaggag

SEQ ID NO: 41495 - RNA, 44 nt, Mus musculus
guccaaauaaccaguggagaaaaggccaacauuagaaggaugga

SEQ ID NO: 41496 - RNA, 60 nt, Mus musculus
ggugaguauagaguaugcuuuuaagaaguuuuuaacugaaagggagcaagagagaaugag

SEQ ID NO: 41497 - RNA, 46 nt, Mus musculus
uaacuggcuauuaagcuuagaaugaugacuuugaacuuauggccuu

SEQ ID NO: 41498 - RNA, 30 nt, Mus musculus
uuugguacagggucucacugcacgucaagu

SEQ ID NO: 41499 - RNA, 46 nt, Mus musculus
cugcuugaauauuguaaacagaucaacagaucaagcaaccagguga

SEQ ID NO: 41500 - RNA, 46 nt, Mus musculus
ucuggugugucugaagacagcuauagugugugugugugugugugug

SEQ ID NO: 41501 - RNA, 45 nt, Mus musculus
aaguucaaagccaaucuggacaauauauugggauucugucuaaaa

SEQ ID NO: 41502 - RNA, 45 nt, Mus musculus
uaccugggguuccucaggugagagcggagguggugcuucuucauu

SEQ ID NO: 41503 - RNA, 25 nt, Mus musculus
ugaacagugacagggagagagaggg

SEQ ID NO: 41504 - RNA, 46 nt, Mus musculus
augguggcucuuaaaccccuuguccuaccauccacaauaacuaugu

SEQ ID NO: 41505 - RNA, 46 nt, Mus musculus
cuuccaguaucaaggaauaaugcagaggcacacacaguuacagcag

SEQ ID NO: 41506 - RNA, 47 nt, Mus musculus
ugaaagccacucagaccuaucuccaggagaaagucaacucguuccag

SEQ ID NO: 41507 - RNA, 80 nt, Mus musculus
uucucagaugccuccaccucugccaacaaugccaccuccaguauuaccuccauccuugccaccaccagugaugcccccug

SEQ ID NO: 41508 - RNA, 46 nt, Mus musculus
gugacccugcugaagagagggcagguggagggagaacuggaggugg

SEQ ID NO: 41509 - RNA, 45 nt, Mus musculus
ccccuggagcuccacaagggaugccuccucaguuaacagccccac

SEQ ID NO: 41510 - RNA, 46 nt, Mus musculus
aguggggcuguuaacugaggaggcaucccuuguggagcuccagggg

SEQ ID NO: 41511 - RNA, 46 nt, Mus musculus
ugucuuuuggaucgaccccaccuucaccauaucacccuccaccuca

SEQ ID NO: 41512 - RNA, 42 nt, Mus musculus
uaugaccugcugucucauauaacagaaaggauaagucagaga

SEQ ID NO: 41513 - RNA, 45 nt, Mus musculus
gaguaaaagcaggaacuugguaggaugguuuguauaugcuuggcc

SEQ ID NO: 41514 - RNA, 42 nt, Mus musculus
uuguuuuccuuuaaaaaaaaaagcauuaaaugcagugggcag

SEQ ID NO: 41515 - RNA, 46 nt, Mus musculus
agaaagaaauauauauauuuauaaaauuuaguucuauuauugagag

SEQ ID NO: 41516 - RNA, 47 nt, Mus musculus
ucugugguacuaggugauuuauuuccuauuaccaucuaccgucugga

SEQ ID NO: 41517 - RNA, 46 nt, Mus musculus
uuaaaaauaauaaguugugccagacuauuauucuaauugagaugag

SEQ ID NO: 41518 - RNA, 30 nt, Mus musculus
uuaacuccugagcuaucucuuuagcccacu

SEQ ID NO: 41519 - RNA, 46 nt, Mus musculus
gacuucugugagcacaaagcguauugguauacaaauaugcaugcag

SEQ ID NO: 41520 - RNA, 46 nt, Mus musculus
aaguccuccucaucccccuucuuagucauuucuccucaacccaaag

SEQ ID NO: 41521 - RNA, 46 nt, Mus musculus
uggcaguacugcaugccuuccauugaucagaauguauugcuauuua

SEQ ID NO: 41522 - RNA, 45 nt, Mus musculus
cuuccagaggaccuggguucaauuccagcacccgcauggcagcuc

SEQ ID NO: 41523 - RNA, 42 nt, Mus musculus
guguauguacuacauggugcaugguguuuuuauuugcaggaa

SEQ ID NO: 41524 - RNA, 46 nt, Mus musculus
acauggauaugaaggaagggguaauuguuggaaagaaaggguucau

SEQ ID NO: 41525 - RNA, 45 nt, Mus musculus
cugaauuugaacugaguuuagcaaacagauauuuuggguuggguu

SEQ ID NO: 41526 - RNA, 46 nt, Mus musculus
ucagugcuccuaacugcugagccaucucuccagcccuagcaaacag

SEQ ID NO: 41527 - RNA, 95 nt, Mus musculus
ucucagugcaauguucaacacuuccaauuauuuucauugccacugauuuguuccccuuaaugucacaugaaaaccacucugaaaugugugcccag

SEQ ID NO: 41528 - RNA, 46 nt, Mus musculus
uggugaguaaauuuugauuuuuauaagaugauaaucuccagcacag

SEQ ID NO: 41529 - RNA, 42 nt, Mus musculus
cacugaguucuacuccccacacuagagggacugcucagagua

SEQ ID NO: 41530 - RNA, 69 nt, Mus musculus
gugaguggcuucuugcaccuuuuauuuugggaagcugaauaaacauuuuaacuccuucuuccccccaca

SEQ ID NO: 41531 - RNA, 45 nt, Mus musculus
uuguuguuguccuuugucuuccagaauuuacaaacaagggccaag

SEQ ID NO: 41532 - RNA, 45 nt, Mus musculus
aucucuugcacuucagcucauguggcucaguguccucccagaagu

SEQ ID NO: 41533 - RNA, 46 nt, Mus musculus
guugagaaggagucgacauaagacugaacucggggaggcuggauga

SEQ ID NO: 41534 - RNA, 43 nt, Mus musculus
aucguguuuagaaaugcaaaugguuguguaguguggcugaagc

SEQ ID NO: 41535 - RNA, 42 nt, Mus musculus
uuugcuuuuuuguuuuuuugauuguugauucugaaggcccca

SEQ ID NO: 41536 - RNA, 46 nt, Mus musculus
uucaggaaacaaagagccauuagcagauacaaguaauaaccaacag

SEQ ID NO: 41537 - RNA, 81 nt, Mus musculus
ugucccacucagaaaaccaccaagaaaaagaucuuccucagccagacagcagagaaaauagauuagaaggcaauaaaggca

SEQ ID NO: 41538 - RNA, 81 nt, Mus musculus
gguccaggucuggucaagcaagaagauuuccaugauaaaaugauggguagaagagaagacagucgugagaaaaugaacaga

SEQ ID NO: 41539 - RNA, 46 nt, Mus musculus
uccuuaucaccgagaugaaccuucuagggcuucguggaaccaugga

SEQ ID NO: 41540 - RNA, 45 nt, Mus musculus
ugugaacgugacuaucaagaugauacacuagauucauacagcaga

SEQ ID NO: 41541 - RNA, 48 nt, Mus musculus
augauggagacaggcgaggcccuuggugggaugauugggaaagagauc

SEQ ID NO: 41542 - RNA, 64 nt, Mus musculus
cucuuccaccuuuaccaccccucccaccucuuccaccuuuggauagauaucgggaugauagaug

SEQ ID NO: 41543 - RNA, 48 nt, Mus musculus
uugaggauucgagaguauccagaaagaggagauacauggcgggaaaag

SEQ ID NO: 41544 - RNA, 45 nt, Mus musculus
aagagaacgguugucagacagaugguacccaucugauguggauag

SEQ ID NO: 41545 - RNA, 46 nt, Mus musculus
cacgaaaucauuuugaaagcugcacaagaauugaaaaugcuucggu

SEQ ID NO: 41546 - RNA, 46 nt, Mus musculus
gugauggcaaagcauaacuguaggaagaaugaaagaaugucuggag

SEQ ID NO: 41547 - RNA, 45 nt, Mus musculus
ugauacuauuuuucguugcaagcuuuuggacagacgagguuaaga

SEQ ID NO: 41548 - RNA, 45 nt, Mus musculus
ucuaccacccccagacucaagacuacagaauccaucaagaccugg

SEQ ID NO: 41549 - RNA, 46 nt, Mus musculus
uggagcagagggucuuacaauugacccagguggcuuacccauagga

SEQ ID NO: 41550 - RNA, 46 nt, Mus musculus
cuauuccuaugacuaggccuccugugccaauaccaccaccgccucc

SEQ ID NO: 41551 - RNA, 45 nt, Mus musculus
ggaauggaagaaugaacaggugggggugguaacaccggagcagac

SEQ ID NO: 41552 - RNA, 45 nt, Mus musculus
aaaguugaacagauaccauauggagaaagaauaacucuacgucca

SEQ ID NO: 41553 - RNA, 46 nt, Mus musculus
gcuaugauagagauagagaccgugaaccuuauuuugaccguccaag

SEQ ID NO: 41554 - RNA, 41 nt, Mus musculus
cuguuuguggagacucugugugugugugugugugugugugu

SEQ ID NO: 41555 - RNA, 44 nt, Mus musculus
guauuuggcugaaaugagugcugauaaccagacuuguggcaaga

SEQ ID NO: 41556 - RNA, 46 nt, Mus musculus
cuagacauccgcucccugcuacaagaugcugcgauugaagaaguga

SEQ ID NO: 41557 - RNA, 45 nt, Mus musculus
agcugggcuaauggcacacacuuuuagucccccaaaggcugacag

SEQ ID NO: 41558 - RNA, 45 nt, Mus musculus
uuuuguguuuuuauuuacuuaaccuucucuucccacacccccuag

SEQ ID NO: 41559 - RNA, 46 nt, Mus musculus
uuguuuuguuuuugccccuccccaaucuccuaguuucccaugauau

SEQ ID NO: 41560 - RNA, 42 nt, Mus musculus
aaagaaauacagggagggagggaguucuguuaaugacccagg

SEQ ID NO: 41561 - RNA, 45 nt, Mus musculus
uucuaaauuaauuauuaaagaagaaggagaaggaagaaggaagaa

SEQ ID NO: 41562 - RNA, 49 nt, Mus musculus
cuguugcuguacgaauugaauaaggcaggggcccaggacaaagaggguc

SEQ ID NO: 41563 - RNA, 46 nt, Mus musculus
uuuuccaacaugguggcuccuacuuaagaaacagagaaccccguaa

SEQ ID NO: 41564 - RNA, 45 nt, Mus musculus
aaaaaggauugcauaagcauuuaagaaaguguuggcucacuaaga

SEQ ID NO: 41565 - RNA, 44 nt, Mus musculus
augcuaacauugaagaccagaaggaagaaaagaaagaugcagaa

SEQ ID NO: 41566 - RNA, 46 nt, Mus musculus
cucuuugcuguaagaucucaaaacugaguucuguuaccuugaggca

SEQ ID NO: 41567 - RNA, 46 nt, Mus musculus
ugaaauacuaccuacuaauuccuaguucuggcguaaagacucacag

SEQ ID NO: 41568 - RNA, 46 nt, Mus musculus
gguaauggucauagagcuuuucacugcacacagucaagggccggaa

SEQ ID NO: 41569 - RNA, 42 nt, Mus musculus
aagaugauuugauucugucagugcuuuauugauggcaaagaa

SEQ ID NO: 41570 - RNA, 45 nt, Mus musculus
uugacuauaagguuuaucaaagcauuuucuuugcgauugggccag

SEQ ID NO: 41571 - RNA, 92 nt, Mus musculus
ccugaccaguguuaguuacaccugacugcucuguccuaacugggagauagacauaguaauguacaaguuggguuuuacacauacccgcuggg

SEQ ID NO: 41572 - RNA, 45 nt, Mus musculus
auguguaaaacccaacuuguacauuacuaugucuaucucccaguu

SEQ ID NO: 41573 - RNA, 48 nt, Mus musculus
ccagagaaaguguucugcucuugccaucacuucuacucaccagacaga

SEQ ID NO: 41574 - RNA, 50 nt, Mus musculus
uauaguaauaugcagcauuuuaaagauguaguaaauucugugacugacca

SEQ ID NO: 41575 - RNA, 43 nt, Mus musculus
uuucuuccacacucaaagugaaacuugaaacaugaaugcacaa

SEQ ID NO: 41576 - RNA, 46 nt, Mus musculus
acucuugcagguuccgcccugccuuucuguauuucugccuggccau

SEQ ID NO: 41577 - RNA, 46 nt, Mus musculus
agaauugaaaugcgaaaccuucccuucagagaauguucacaccaag

SEQ ID NO: 41578 - RNA, 44 nt, Mus musculus
gcucccugacgacuacgagacucgcgcuucugagccugggaaga

SEQ ID NO: 41579 - RNA, 79 nt, Mus musculus
ggguuuuaaaaaguuggggauggagaaauggcuguccauaaaguguuugucaugcaaauauaagaacccaaauuuaggg

SEQ ID NO: 41580 - RNA, 46 nt, Mus musculus
guugugagccaccauaugguugcugggauuugaacucagggccuuu

SEQ ID NO: 41581 - RNA, 92 nt, Mus musculus
auggcucagcaguuaagagcaccaacugcucuucuaaaggcccugaguucaaaucccagcaaccauaugguggcucacaaccauccauagca

SEQ ID NO: 41582 - RNA, 38 nt, Mus musculus
uuuuaacaaaaaaacgaaauuuagucucuuguucccag

SEQ ID NO: 41583 - RNA, 72 nt, Mus musculus
acauguauguuguauauaauauguacaugccuggugccugcagagaauagaaggaucaucauaucaccuaga

SEQ ID NO: 41584 - RNA, 88 nt, Mus musculus
uaugagagaauaaaacauauuaguagauuauuuuuaugguagauauuguuucaaagacuauauuuuaaagcucauugauauacugcag

SEQ ID NO: 41585 - RNA, 44 nt, Mus musculus
gauacgacacccagcaauuaaaaaagaaaaaaaaaucaugguaa

SEQ ID NO: 41586 - RNA, 46 nt, Mus musculus
ccugcucagccugcuuuuguucacaacucaggaccacuugcccaag

SEQ ID NO: 41587 - RNA, 44 nt, Mus musculus
gggggguggagagauagauuuucaugcguauuugaaauucccag

SEQ ID NO: 41588 - RNA, 47 nt, Mus musculus
uggagcaugcuauuugguacaacuguaaucuguguucccaggccaug

SEQ ID NO: 41589 - RNA, 84 nt, Mus musculus
gcucaagaauaaaguauuuaagaagagucaagugugggacuagggagauggcuuggaugaagugcuugccgagcaagugugaga

SEQ ID NO: 41590 - RNA, 46 nt, Mus musculus
guucaaaucccagcaaccacauggcucacaaccacccguaaugaga

SEQ ID NO: 41591 - RNA, 46 nt, Mus musculus
cuacgcugacaccaaguagacagggcucagagcuguaaaaugggag

SEQ ID NO: 41592 - RNA, 75 nt, Mus musculus
agaugggcagaccuagaagaaaagaaggaugcagauaggaaaagggccauagguuuuguggucggacagacugau

SEQ ID NO: 41593 - RNA, 46 nt, Mus musculus
ggucaccuggcugaaagagcccucaaucggaccaaauauauaugag

SEQ ID NO: 41594 - RNA, 46 nt, Mus musculus
uuuuuuuaaacuaauuuggggagggaggguuagcuuaagugcuaag

SEQ ID NO: 41595 - RNA, 49 nt, Mus musculus
ggaagaauaaagagguaacaccguauuucccccuccugaggggggaggg

SEQ ID NO: 41596 - RNA, 46 nt, Mus musculus
auuucuguucaccuguauuuaaaaccagcuaaagggggggggggga

SEQ ID NO: 41597 - RNA, 45 nt, Mus musculus
gggcuaggacuauaaaggcagcaaguucucaggagcagacuggca

SEQ ID NO: 41598 - RNA, 41 nt, Mus musculus
uguucagcuuuuuguggugcugaggauagaagcuagggcau

SEQ ID NO: 41599 - RNA, 54 nt, Mus musculus
agaugcucguuagaaauacaacaaugcaaaaagucuuguccuccaggagccuga

SEQ ID NO: 41600 - RNA, 51 nt, Mus musculus
ggugacauuaaaguuguggcuugcaggaugugacagucagugaagagaaga

SEQ ID NO: 41601 - RNA, 68 nt, Mus musculus
aaacaaagugacuggucagaagccauuaguuaaaggaaacaguaucucgaggaagaugaugguguaga

SEQ ID NO: 41602 - RNA, 55 nt, Mus musculus
uauguguacuguguacacacuuggcauucugugcccacggaggccagaagaggug

SEQ ID NO: 41603 - RNA, 45 nt, Mus musculus
aagacaugaggguaguaugauaauaaagcccagcuugguagguua

SEQ ID NO: 41604 - RNA, 46 nt, Mus musculus
uguacaaaugguaacuagagagacaaggaggccugauacagaggag

SEQ ID NO: 41605 - RNA, 29 nt, Mus musculus
gcaugguuuugagguuccuuugcagugag

SEQ ID NO: 41606 - RNA, 30 nt, Mus musculus
aagaugaaguggugugugagauugagacag

SEQ ID NO: 41607 - RNA, 46 nt, Mus musculus
uaugaaaauuacaguuaugaaguagcaaugaaguggcugugggggg

SEQ ID NO: 41608 - RNA, 46 nt, Mus musculus
auacuucacggagagcuacuuagauuuauuuuagcuuguuuugagg

SEQ ID NO: 41609 - RNA, 42 nt, Mus musculus
gaggcaggagcugcuaaaggucugcguucagaacaucgggua

SEQ ID NO: 41610 - RNA, 49 nt, Mus musculus
ucaggagaaaaugaacaggaugcggcagcgcaucgcccagcgucugaag

SEQ ID NO: 41611 - RNA, 43 nt, Mus musculus
gugggaguguguaggugugcauacaugcauauaaaagccaaag

SEQ ID NO: 41612 - RNA, 46 nt, Mus musculus
uuuucaagauuuugauauaucuaaguaucagcauuuugggaaagag

SEQ ID NO: 41613 - RNA, 46 nt, Mus musculus
aucuagaagaaaaaaaagcaucaaaaagauaaaaaugaguaugaag

SEQ ID NO: 41614 - RNA, 63 nt, Mus musculus
aguauuaagucuuucccucugcuucucagugaggaaguuuguuuauuggaaauguauguaggg

SEQ ID NO: 41615 - RNA, 45 nt, Mus musculus
guucagguugauucagacgcuugggaaacacugauaugaguuggg

SEQ ID NO: 41616 - RNA, 51 nt, Mus musculus
ggaauguggaaacuaugaacuaugcagauauugaacggaccauuaaugaac

SEQ ID NO: 41617 - RNA, 42 nt, Mus musculus
uugcucaaaagaaaauaaaccuaaguuauccagaggcagcag

SEQ ID NO: 41618 - RNA, 46 nt, Mus musculus
ggcagagaggcugugacuuuccuccgaaaaaucaaggcagcaguag

SEQ ID NO: 41619 - RNA, 62 nt, Mus musculus
cagguuagccugaugacaggcaggcacauacuauuggccucaagcacggaagccagggcacg

SEQ ID NO: 41620 - RNA, 47 nt, Mus musculus
cuaggacacuguugucacuuaaagcagauuuuagcacaucauggcag

SEQ ID NO: 41621 - RNA, 50 nt, Mus musculus
gcagggcacagagacaggggaggguggacugcggugggaaccagccucag

SEQ ID NO: 41622 - RNA, 95 nt, Mus musculus
uugccguggccauuagugcugaaugcccuuuuuucuuguaauccaagacaagcuggggggaggggaagaggucaguauugagugccugcagcauc

SEQ ID NO: 41623 - RNA, 52 nt, Mus musculus
cuuguaacuaaaauauuuaaagagacugauuuugaaugaaaauuaaagggca

SEQ ID NO: 41624 - RNA, 45 nt, Mus musculus
gaucuuuguauauucuuaucucugagcagcauaccaagcccccau

SEQ ID NO: 41625 - RNA, 46 nt, Mus musculus
ccacaugugcaucauuauaagcacaugucugguuaugaacggugag

SEQ ID NO: 41626 - RNA, 42 nt, Mus musculus
gacaggauaggguuggucaccaacccaggaugaccccaaugg

SEQ ID NO: 41627 - RNA, 46 nt, Mus musculus
guugaggccaaggcaggaaugugaugaccagugguaguauauugag

SEQ ID NO: 41628 - RNA, 45 nt, Mus musculus
uguguguguguguguguauguguauguauguguguguuuguguag

SEQ ID NO: 41629 - RNA, 42 nt, Mus musculus
ugcgugcgugcgugcgugcgugugugugugugugcaugugug

SEQ ID NO: 41630 - RNA, 46 nt, Mus musculus
gcugaagcccuguggaggagagagacaagauguacaggguuucugg

SEQ ID NO: 41631 - RNA, 47 nt, Mus musculus
gugggcucuaaagcuuaagaagaaauuaaccaggaaaugcaauggag

SEQ ID NO: 41632 - RNA, 46 nt, Mus musculus
gaugguugugagccacaaugugguugcugggauuugaacuccugac

SEQ ID NO: 41633 - RNA, 44 nt, Mus musculus
ggauguguuccaagacuccccgcugaugcuggaaaaccugccua

SEQ ID NO: 41634 - RNA, 46 nt, Mus musculus
aagggaagcagggcagggugggaacauuuugucuuugcucugugag

SEQ ID NO: 41635 - RNA, 45 nt, Mus musculus
cuuccuuccuucuuuccuugcuuucuuauuuccuggugccugcag

SEQ ID NO: 41636 - RNA, 45 nt, Mus musculus
auauuuggcccaugggaguggcacuguuaggaaguguggccuugu

SEQ ID NO: 41637 - RNA, 45 nt, Mus musculus
aagaaagaaagaaagaaagaaagaaagaaagaaagagaaguucac

SEQ ID NO: 41638 - RNA, 46 nt, Mus musculus
ccuagcagugccccgucuggguguacaggagaaaucaaggcaggua

SEQ ID NO: 41639 - RNA, 41 nt, Mus musculus
uccuggccccucggagcuaggcguucauuagcuugccccag

SEQ ID NO: 41640 - RNA, 41 nt, Mus musculus
gagagagagagaaagagagagagagagagagagugagacag

SEQ ID NO: 41641 - RNA, 42 nt, Mus musculus
caaauuugaggccagcuuggguuauaugaaccccuguugaaa

SEQ ID NO: 41642 - RNA, 61 nt, Mus musculus
aaggcuucguggagacucugaagcgagguggcgggcagcgcagcucggaggacauggcucg

SEQ ID NO: 41643 - RNA, 41 nt, Mus musculus
ccgugggaaauauggugcggagaguccucaagaucauccgg

SEQ ID NO: 41644 - RNA, 46 nt, Mus musculus
ccuggcagcgaaacaccacuccacgccucucaucgucugcgccccc

SEQ ID NO: 41645 - RNA, 34 nt, Mus musculus
gaagagggccuugcguucuauguguuauagauag

SEQ ID NO: 41646 - RNA, 46 nt, Mus musculus
uacagcugguugugagcugcuauguggugguagaaaucaaaaccag

SEQ ID NO: 41647 - RNA, 46 nt, Mus musculus
gagaaggucagcguccacuguccuguguuugacuacgugccccccg

SEQ ID NO: 41648 - RNA, 43 nt, Mus musculus
cgagguagggggaggccggcgggccggcgagcgggcggaggcu

SEQ ID NO: 41649 - RNA, 46 nt, Mus musculus
cgaccagucugggggcgcuggcggccugcgcacccaccucaaggug

SEQ ID NO: 41650 - RNA, 24 nt, Mus musculus
uccuccaccucaguccugacgaga

SEQ ID NO: 41651 - RNA, 46 nt, Mus musculus
ggaguucauugaaagauuaucugggucucagcuaaucaggugaggu

SEQ ID NO: 41652 - RNA, 23 nt, Mus musculus
cucugcuguucuguggccuuugg

SEQ ID NO: 41653 - RNA, 53 nt, Mus musculus
agauuuggucgaaaaggucaugcuguaggugauauuccuggaguccucuuuaa

SEQ ID NO: 41654 - RNA, 49 nt, Mus musculus
cuggaaaaaguagggguugaggccaaacagccaaauucugccaucagga

SEQ ID NO: 41655 - RNA, 41 nt, Mus musculus
uuacgccagagcgggaauggugaagaccgugucaggaggca

SEQ ID NO: 41656 - RNA, 24 nt, Mus musculus
ccugacagcuuccuacuucauucu

SEQ ID NO: 41657 - RNA, 46 nt, Mus musculus
aagaugagaagucugcguugcagacugagauugccaaucugcugaa

SEQ ID NO: 41658 - RNA, 46 nt, Mus musculus
auuugaaugaaaaauuuuaagcauuguuugcuuauuguuccaagac

SEQ ID NO: 41659 - RNA, 87 nt, Mus musculus
uucucagagagacagcaggucaucacccauagaagaaaggaagugaaagaaaaaguucaagucuucauagaguacaaaugcugagau

SEQ ID NO: 41660 - RNA, 46 nt, Mus musculus
agaaaggagcccagucuaugugcucaggaccuugaagcagcccuug

SEQ ID NO: 41661 - RNA, 46 nt, Mus musculus
agaucaaggaaugcagagaaaagcaaaagacuggaaaaggagcuag

SEQ ID NO: 41662 - RNA, 45 nt, Mus musculus
cuguuccaaauacaaacaacucugagaggaagugucccagggcga

SEQ ID NO: 41663 - RNA, 46 nt, Mus musculus
caguacagucggcuucuuuaugucuuggccuaaaaucuggucugag

SEQ ID NO: 41664 - RNA, 89 nt, Mus musculus
ugugugugugucugugugugguguaggauguugguguggugugugugugaugguauguggugugugugugugauggcauguggugugug

SEQ ID NO: 41665 - RNA, 45 nt, Mus musculus
acuggaaacggcaggucagcauuugccgcugcucugggucagaag

SEQ ID NO: 41666 - RNA, 42 nt, Mus musculus
cucaaaaugauuaucugagccuccagacuuucauucacccug

SEQ ID NO: 41667 - RNA, 51 nt, Mus musculus
caucagacagacacagacaugcgguaagaguuugaggagucgggagaggcc

SEQ ID NO: 41668 - RNA, 46 nt, Mus musculus
aacacacaaauugucugggcaggcaaaugaauggagagguauccag

SEQ ID NO: 41669 - RNA, 41 nt, Mus musculus
ggaagcagccuucggcggcugcguugauucgggcuggggaa

SEQ ID NO: 41670 - RNA, 42 nt, Mus musculus
ggaaguggcuccagagaagggucuagaagcagaggggaggag

SEQ ID NO: 41671 - RNA, 41 nt, Mus musculus
caccgaccugcccaagguaagacauggaggggccaggcaca

SEQ ID NO: 41672 - RNA, 41 nt, Mus musculus
ugaaacgucgucuuuaagccuuugggaaagcgucucaguga

SEQ ID NO: 41673 - RNA, 42 nt, Mus musculus
acagacugccuagacaggaaacaaagggcccuggcgagagga

SEQ ID NO: 41674 - RNA, 42 nt, Mus musculus
guugguucggacuggggaaaggucuaauggcgacggauggga

SEQ ID NO: 41675 - RNA, 46 nt, Mus musculus
ugugucugugugugucuguguguguuugugugugucugugugugug

SEQ ID NO: 41676 - RNA, 45 nt, Mus musculus
uuugugucuaugucugugugugagugugucugugugugcguuugu

SEQ ID NO: 41677 - RNA, 32 nt, Mus musculus
gucuguguguuuguguguguguuugucugugu

SEQ ID NO: 41678 - RNA, 33 nt, Mus musculus
ucuuuggggucacuacagugcucaauugggggg

SEQ ID NO: 41679 - RNA, 46 nt, Mus musculus
ucugcccccuggcccuggagcacaagaucccagguagaaaagugag

SEQ ID NO: 41680 - RNA, 44 nt, Mus musculus
ucuuccugccuggaaauggaugguggcuggaaugaggaggagga

SEQ ID NO: 41681 - RNA, 46 nt, Mus musculus
gacagcagcccuaugugucucuggaaacuucaagauaugacaaaau

SEQ ID NO: 41682 - RNA, 45 nt, Mus musculus
gggaugggugguuuguuugguuuuuuuuuuuuuguugcaaguuug

SEQ ID NO: 41683 - RNA, 42 nt, Mus musculus
ggaauccggaauguuuuggggguguacuugguccaugcccgg

SEQ ID NO: 41684 - RNA, 42 nt, Mus musculus
ggaacagcagaggcagcaguggauggcaaaccagagcgaggc

SEQ ID NO: 41685 - RNA, 26 nt, Mus musculus
ggcagcaccgcggcgcuggccgggcc

SEQ ID NO: 41686 - RNA, 45 nt, Mus musculus
ccggagcugaaccgccagagccccaacucauccucagcagcaaca

SEQ ID NO: 41687 - RNA, 42 nt, Mus musculus
cggcuguggagacucgcgcucucuccugccccaggggcagaa

SEQ ID NO: 41688 - RNA, 42 nt, Mus musculus
gaggccacuggcagccggccccggacaccguagcccccuccc

SEQ ID NO: 41689 - RNA, 50 nt, Mus musculus
uccccgggagggccgggggaggaggugguggcugccaagagaggagcguu

SEQ ID NO: 41690 - RNA, 45 nt, Mus musculus
gaggcgcgucucagcgcuccugcucgggcugcggcucgcgcuguc

SEQ ID NO: 41691 - RNA, 46 nt, Mus musculus
ugugagcaaccaggcagaaauuggcaauauguaaaagugggagggg

SEQ ID NO: 41692 - RNA, 46 nt, Mus musculus
cgggaaggucugugccccacguccggggaugagggucucuccugag

SEQ ID NO: 41693 - RNA, 45 nt, Mus musculus
cuuggaagcuuuugaggggcguccaaucgcgcuuuucccugcuuc

SEQ ID NO: 41694 - RNA, 23 nt, Mus musculus
uuauaaaacacacucgcagcucc

SEQ ID NO: 41695 - RNA, 42 nt, Mus musculus
aggccugggcaaaucuguccauggccagggcuccugucuuag

SEQ ID NO: 41696 - RNA, 46 nt, Mus musculus
uauuuggcuggccucuuuaaaaaauuaagaguccgcccuaggucau

SEQ ID NO: 41697 - RNA, 46 nt, Mus musculus
caugagucuaagcaauggcuaauaacauuguggguuuuuucaccag

SEQ ID NO: 41698 - RNA, 46 nt, Mus musculus
gaauaauguggcucgggcuugcuugucguccaggcaauauuuagau

SEQ ID NO: 41699 - RNA, 46 nt, Mus musculus
auaaauacaaaaggaaaaggaaacagugauaaagaaaaggaaauag

SEQ ID NO: 41700 - RNA, 84 nt, Mus musculus
auucuuacggaacaacaagaaagcaugucagaggaagauaaggaauguaugagcaaaggaaggaaaaggggcgaaaaggaaaag

SEQ ID NO: 41701 - RNA, 46 nt, Mus musculus
aaauucauggcaaaucagggggcaugcucauccuaaaaggggccau

SEQ ID NO: 41702 - RNA, 46 nt, Mus musculus
aaaagacaagguuugugugugaaauauccugguuuaaaacauccag

SEQ ID NO: 41703 - RNA, 45 nt, Mus musculus
guauguggugaaauggcucagcgcaggcaggcucaggguccagac

SEQ ID NO: 41704 - RNA, 45 nt, Mus musculus
gccauagugcaguagcuuccuaaggaacuuuuuuucucucacaga

SEQ ID NO: 41705 - RNA, 44 nt, Mus musculus
guugaugggcacuaucucauagucaaugccuuuuaacgccagag

SEQ ID NO: 41706 - RNA, 46 nt, Mus musculus
auacacuuaaugaucccuauuaugcuuggucacuuguagguuaguu

SEQ ID NO: 41707 - RNA, 46 nt, Mus musculus
aacugacugcucagagcagagguuuacacaggaggcuggcccagga

SEQ ID NO: 41708 - RNA, 46 nt, Mus musculus
uccagaggagacagugagagagugcuagggauuguguaaagugaag

SEQ ID NO: 41709 - RNA, 46 nt, Mus musculus
ucauuucuuaaagagagguauaugauguuagaugauagcacuccag

SEQ ID NO: 41710 - RNA, 46 nt, Mus musculus
uuccccauguggcaggacugauuucaguccuuguacuacagccccu

SEQ ID NO: 41711 - RNA, 46 nt, Mus musculus
cuuccagguccccguauuaaaguuuucucuagcaacaugaagccag

SEQ ID NO: 41712 - RNA, 46 nt, Mus musculus
auauauccaaagggcuacucuggagccauugccugauccaucagug

SEQ ID NO: 41713 - RNA, 45 nt, Mus musculus
auguucucuauuuuaauaaugggaaguauuuugaaacccacagaa

SEQ ID NO: 41714 - RNA, 45 nt, Mus musculus
gugccugaggucagggagcugcacacuccuucuuuggggaguaga

SEQ ID NO: 41715 - RNA, 44 nt, Mus musculus
aacccugaccggaggauugguuuccugucuccauccuuuggggc

SEQ ID NO: 41716 - RNA, 42 nt, Mus musculus
uccaacacagcuacacaauuaccuugacaccgauaggcaguu

SEQ ID NO: 41717 - RNA, 41 nt, Mus musculus
aaacaaugaaauaaguuaucugcuuuuauccuugcccugcu

SEQ ID NO: 41718 - RNA, 46 nt, Mus musculus
aagcaauaacugcagcauagccagcaagugacagguacagagggag

SEQ ID NO: 41719 - RNA, 42 nt, Mus musculus
auguauuguaguggguggccacagagcggcaggugcuaaggc

SEQ ID NO: 41720 - RNA, 46 nt, Mus musculus
agacauguuugccgugauucuggguuuauguuuuuuacacugagga

SEQ ID NO: 41721 - RNA, 46 nt, Mus musculus
cuucuuagucucuagcucaggcugggagaccucacugccuugaaug

SEQ ID NO: 41722 - RNA, 42 nt, Mus musculus
gagaggcuccaggaguucucuacggggccgcuauggggaggu

SEQ ID NO: 41723 - RNA, 45 nt, Mus musculus
agcggggagaaguggucaccauccgggucccuacccaccccgagg

SEQ ID NO: 41724 - RNA, 46 nt, Mus musculus
cuugcccagcuugcuuuugaacuccuucacuuuggcaaagguccag

SEQ ID NO: 41725 - RNA, 79 nt, Mus musculus
cugcagauuccaaguccgcugaaagaacaucuauagccccagugugcucagacuggaucauaacuguguccucaggucg

SEQ ID NO: 41726 - RNA, 41 nt, Mus musculus
gggcuauagauguucuuucagcggacuuggaaucugcagau

SEQ ID NO: 41727 - RNA, 45 nt, Mus musculus
ucagacccucugcaaaaucuuccccacaaauauccucacagcuua

SEQ ID NO: 41728 - RNA, 56 nt, Mus musculus
ggaauguguuggaaacccuacugauguaggccuguaguaagcugugaggauauuug

SEQ ID NO: 41729 - RNA, 71 nt, Mus musculus
cacacacacucgaagaacauugcuagugaaguacagggggagacaacuuguagcaugaggggugagugagg

SEQ ID NO: 41730 - RNA, 44 nt, Mus musculus
ggcauaauaacaugaaacaaggaacacacuguaagagauucaga

SEQ ID NO: 41731 - RNA, 41 nt, Mus musculus
ccccggagccugacccucugaggcaccagccacguucugua

SEQ ID NO: 41732 - RNA, 46 nt, Mus musculus
ggggugagcagauggguguguucaugucucccuaggaaaaggucau

SEQ ID NO: 41733 - RNA, 46 nt, Mus musculus
ucucuaauuugcacugaaaaacaaacaaacaaacaaacaaacaaac

SEQ ID NO: 41734 - RNA, 47 nt, Mus musculus
auaaguaaaacuguguuuguccaagguagcacacacaggcagagagg

SEQ ID NO: 41735 - RNA, 45 nt, Mus musculus
gcauguaguagaaaagaaggguuauacugagccguagcaugugag

SEQ ID NO: 41736 - RNA, 91 nt, Mus musculus
uuaggcucccgugccauuuuuuucgggagcuaaaaauggacuagagcgggcgaguacgcccuguaguuaaccugggagcaaaaggggugaa

SEQ ID NO: 41737 - RNA, 72 nt, Mus musculus
gcugggcagaagaggguagggcgggacuucugauuccaguccggagucgcaauugaaagggaagaaugagag

SEQ ID NO: 41738 - RNA, 60 nt, Mus musculus
ugugugauaauucuuuuccaucuccccugauugauuaacagugagcugauucagccuaua

SEQ ID NO: 41739 - RNA, 46 nt, Mus musculus
ucacuuuguggugaacauacccgagugucuuugcuuuauaucagau

SEQ ID NO: 41740 - RNA, 45 nt, Mus musculus
uguaggucuggcaccucaugauuuuuaccuacgggcaccaaaucc

SEQ ID NO: 41741 - RNA, 26 nt, Mus musculus
uuuugcaaaaaucuuuguuucgggag

SEQ ID NO: 41742 - RNA, 41 nt, Mus musculus
guggguuguugauuuggguccucgauacggaagggucugga

SEQ ID NO: 41743 - RNA, 45 nt, Mus musculus
cgaggcuguccuggaucguuuucuacagaacagauuggccuaggu

SEQ ID NO: 41744 - RNA, 47 nt, Mus musculus
agugaaaucccaaaagcaagagggacgugcuuucuugcagagaagga

SEQ ID NO: 41745 - RNA, 45 nt, Mus musculus
gagugguuuuggacauagugagacccccuuggagaaaaccaacuu

SEQ ID NO: 41746 - RNA, 45 nt, Mus musculus; identical to SEQ ID NO: 41743

SEQ ID NO: 41747 - RNA, 47 nt, Mus musculus; identical to SEQ ID NO: 41744

SEQ ID NO: 41748 - RNA, 45 nt, Mus musculus; identical to SEQ ID NO: 41745

SEQ ID NO: 41749 - RNA, 45 nt, Mus musculus
uuaaaccacacuauuuauaucaacaaucucaaugagaagaucaag

SEQ ID NO: 41750 - RNA, 67 nt, Mus musculus
uacgcaaagacugacucggacaucauugccaagaugacgggcaccuuuguggagagagaucgcaaag

SEQ ID NO: 41751 - RNA, 46 nt, Mus musculus
cuuuaagaucacacaaaacaaugcuaugaagaucucuuuugccaag

SEQ ID NO: 41752 - RNA, 42 nt, Mus musculus
uacccagagucuguccccagacauugcaccuggugcuguuag

SEQ ID NO: 41753 - RNA, 46 nt, Mus musculus
ugguuuggccauaagggagauagcaucagaucaaguaaccguccag

SEQ ID NO: 41754 - RNA, 45 nt, Mus musculus
cauuauuuccugaagcuucuucagauccuuuuccuggaugcccag

SEQ ID NO: 41755 - RNA, 46 nt, Mus musculus
auuuugcaguuuuguuuuuaauaucuuuauaugggcuugguguuaa

SEQ ID NO: 41756 - RNA, 46 nt, Mus musculus
ugagacauaguaaguguuuuaauggguuugauugucuuaguguucu

SEQ ID NO: 41757 - RNA, 44 nt, Mus musculus
ggcagacaugcugcuggagaaggagccaccaaguucugcaucua

SEQ ID NO: 41758 - RNA, 45 nt, Mus musculus
ucuuugccuaugacuuuguaguucacuaaggaaggaagggaggga

SEQ ID NO: 41759 - RNA, 45 nt, Mus musculus
uacccuagcuugagaaucacugcauuaagcuauucaagagggcug

SEQ ID NO: 41760 - RNA, 48 nt, Mus musculus
uguggaugagaacuaaccugcucaugucaaauaaaguugcagaacugc

SEQ ID NO: 41761 - RNA, 45 nt, Mus musculus
uuucuauuuuugauuuugguucagggcgaauucugauuuugaugg

SEQ ID NO: 41762 - RNA, 42 nt, Mus musculus
aacguccgugugaaauacccagggcauggcugggcugcgauc

SEQ ID NO: 41763 - RNA, 40 nt, Mus musculus
uguccguguguguguccguguguguguccguguguccauu

SEQ ID NO: 41764 - RNA, 41 nt, Mus musculus
gaaaauagcagcagaaaggccuuuagggcauucggggcacg

SEQ ID NO: 41765 - RNA, 46 nt, Mus musculus
auuuuugcaaauggcucuuacagagucacagcugaccuggguaaau

SEQ ID NO: 41766 - RNA, 46 nt, Mus musculus
uauauagagaccccucggagcggcggcguauucauugcuggaagag

SEQ ID NO: 41767 - RNA, 23 nt, Mus musculus
ucagagcccugccucagcccuag

SEQ ID NO: 41768 - RNA, 46 nt, Mus musculus
gcugcgccaaguucucaaccaacgaccuauuaccugggcugcagac

SEQ ID NO: 41769 - RNA, 89 nt, Mus musculus
agauauuuacgcucaccacucugaccacaggucgcaaaggcagcuacccucccccucccagcucgaagcccuucccaaccaacuacaag

SEQ ID NO: 41770 - RNA, 30 nt, Mus musculus
cugcaggugugguauaccaagcugggaacu

SEQ ID NO: 41771 - RNA, 46 nt, Mus musculus
ggaggaaaggguuuauucggcuuacacuuccacacuguuguucauc

SEQ ID NO: 41772 - RNA, 42 nt, Mus musculus
ccuuuauggugacagauguauauuuugguaacgacuacaggc

SEQ ID NO: 41773 - RNA, 42 nt, Mus musculus
uucacuuagcauuuuugcaauuauauauucuuugaaggaaaa

SEQ ID NO: 41774 - RNA, 46 nt, Mus musculus
accaccuaacuacaugugcaggcuguaguaacagaagcccuaagau

SEQ ID NO: 41775 - RNA, 46 nt, Mus musculus
auuauaaugucucacaucagcuggcuaccuucacucuaaagggauc

SEQ ID NO: 41776 - RNA, 45 nt, Mus musculus
uggcacaugguugggucuagcuuuccuuugccuugucuggcauuu

SEQ ID NO: 41777 - RNA, 46 nt, Mus musculus
ugauugaucaauaaagaugcuauggguuaguggcggggcagaagag

SEQ ID NO: 41778 - RNA, 58 nt, Mus musculus
caacccaguuuacucaaccaggcugguauuaccugaagacagugggccaucuagagaa

SEQ ID NO: 41779 - RNA, 45 nt, Mus musculus
uucaaaauaguggaaaaguuaaguaagacuucuguguugacugga

SEQ ID NO: 41780 - RNA, 42 nt, Mus musculus
uggguuggugagcagggguauggaggaggacauagggaauuu

SEQ ID NO: 41781 - RNA, 46 nt, Mus musculus
uagccagagcaauuagacaacaaaaggagaucaaaaguauacagau

SEQ ID NO: 41782 - RNA, 46 nt, Mus musculus
caaggcccauaccuaaauaccauauauagcaaaucaguagccaaca

SEQ ID NO: 41783 - RNA, 45 nt, Mus musculus
uacuuuauuauucuaagacuagguccuuaagaaaggggguguaag

SEQ ID NO: 41784 - RNA, 47 nt, Mus musculus
caaaccagaaagcaccaaaggagguuguacaaacuaucugugcuuaa

SEQ ID NO: 41785 - RNA, 43 nt, Mus musculus
ugaacuggauuuuuaaaaaucagagugaacuauggcaacauau

SEQ ID NO: 41786 - RNA, 46 nt, Mus musculus
agagcugucaggggggagagagagagagagagagaaagagagagag

SEQ ID NO: 41787 - RNA, 36 nt, Mus musculus
ucacuauccuggaaccuacacaguguggaaugcaaa

SEQ ID NO: 41788 - RNA, 46 nt, Mus musculus
uuuccccugaucauucacuaauuaagaugacuuagagccagcucuc

SEQ ID NO: 41789 - RNA, 46 nt, Mus musculus
gauuuuccgguaguacuauguccaauuuucugaggaaucgccagac

SEQ ID NO: 41790 - RNA, 46 nt, Mus musculus
augagaucugaugcccucuucuggagugucugaagacagcuucagu

SEQ ID NO: 41791 - RNA, 42 nt, Mus musculus
uggaugggugggugugguuuuggggagagaaggggugcucga

SEQ ID NO: 41792 - RNA, 57 nt, Mus musculus
uauguaaaucuucagcucacugccuacuauguuguaagauggauuuugggugccaag

SEQ ID NO: 41793 - RNA, 45 nt, Mus musculus
ugugugugugugugugugugugugugagagagagagagaggugca

SEQ ID NO: 41794 - RNA, 46 nt, Mus musculus
aagauaaugaaaaauauggaauaagauacuuugcaaagccccuucu

SEQ ID NO: 41795 - RNA, 47 nt, Mus musculus
cuugcugcgucaugacuguuauauuguagaauauaaggaucggggcu

SEQ ID NO: 41796 - RNA, 46 nt, Mus musculus
ugugauaguaaaucuaaguguaaaggcuuuuuuaaaaaaaugagau

SEQ ID NO: 41797 - RNA, 46 nt, Mus musculus
agugauuucuuguugacucaaagaucucaggacugggaaguggguu

SEQ ID NO: 41798 - RNA, 45 nt, Mus musculus
uuaaaagagggccaccuucauccacuaacagaaacuguggcgugu

SEQ ID NO: 41799 - RNA, 45 nt, Mus musculus
cuguaagaccucuuggacucuuuagaguuguguaaagccugaagc

SEQ ID NO: 41800 - RNA, 46 nt, Mus musculus
ugauuaaagcauuaagguuuucuuuuacccagugcacuggcugguu

SEQ ID NO: 41801 - RNA, 42 nt, Mus musculus
auauguagcagaggauggccuagucggucaucaaugcgggga

SEQ ID NO: 41802 - RNA, 41 nt, Mus musculus
ucuaauaaaaaauugaaaaaagcgaagcuguccuaugggca

SEQ ID NO: 41803 - RNA, 47 nt, Mus musculus
caugggaggccaucccuuuccuggggagaggugcaagucagagggag

SEQ ID NO: 41804 - RNA, 46 nt, Mus musculus
caauuugggaguguaauggugcuaagaguuugcagggguccuaggu

SEQ ID NO: 41805 - RNA, 46 nt, Mus musculus
gaaggggcuauaagugucuucuacgcugcuaagcacugguggcuca

SEQ ID NO: 41806 - RNA, 28 nt, Mus musculus
gaaaaaggacacaaaguugguugggagu

SEQ ID NO: 41807 - RNA, 46 nt, Mus musculus
auuuauaaggaagcaaauuaauagacaaaauucaccacagccucuu

SEQ ID NO: 41808 - RNA, 57 nt, Mus musculus
uugucuuggaaaaaaauguuuaaagauaccccaaaacuggguggaagaggaaagguu

SEQ ID NO: 41809 - RNA, 45 nt, Mus musculus
cucccaaccaucuguaaugagaucugaugcccucuucuggagugu

SEQ ID NO: 41810 - RNA, 46 nt, Mus musculus
uuauugaccuugcuuaaaaacaaaacaaaaaagauggucaccugau

SEQ ID NO: 41811 - RNA, 44 nt, Mus musculus
ggugcagaggggaugcugaagccacucuggaaauacagcagaga

SEQ ID NO: 41812 - RNA, 45 nt, Mus musculus
ugacuguggaguuggacggggugguagaugauuuaggaggcagaa

SEQ ID NO: 41813 - RNA, 46 nt, Mus musculus
aauaaaugaucuugugucugcauggaccauggauuccaugucauag

SEQ ID NO: 41814 - RNA, 46 nt, Mus musculus
ucacuauaaacuugggacuugcagguuuaucugguuguacaagauc

SEQ ID NO: 41815 - RNA, 42 nt, Mus musculus
ccacaugaggucuuucaauacuucaaaaguguccugccaaau

SEQ ID NO: 41816 - RNA, 46 nt, Mus musculus
ugguuagcacucucaaacaccuccaccaaaauaagcaacccgaaga

SEQ ID NO: 41817 - RNA, 45 nt, Mus musculus
ugguucuaagccaccaugugguugcagggauuugaacucaggacc

SEQ ID NO: 41818 - RNA, 45 nt, Mus musculus
uaaaugauacuaaauaccaaaauagaacacaaguguauuucagau

SEQ ID NO: 41819 - RNA, 45 nt, Mus musculus
cgugucuugguggcacaguaaugguggggugauaaaaugugcagu

SEQ ID NO: 41820 - RNA, 46 nt, Mus musculus
auccugaggacaguuuugcuuugucagacaauuugauuuugucuag

SEQ ID NO: 41821 - RNA, 45 nt, Mus musculus
auaucagucaucaaucaagaaaaugccccauaggcuugcccaggc

SEQ ID NO: 41822 - RNA, 44 nt, Mus musculus
gucucuggagucgaucaacucuaggcuccaacuuguuaugaaaa

SEQ ID NO: 41823 - RNA, 75 nt, Mus musculus
auagaguacuaugccauguuggcuaaaacugggguccaucacuacaguggcaauaauauugaacugggcacagcg

SEQ ID NO: 41824 - RNA, 46 nt, Mus musculus
aaagaaggaacagacaaaugaagguuggucaaggucgucagugaga

SEQ ID NO: 41825 - RNA, 45 nt, Mus musculus
agagacagacagacagacagacacacacacacacacacaggagac

SEQ ID NO: 41826 - RNA, 44 nt, Mus musculus
ggcugauggaaaaauaaccucuagcaaacaguuaugugugauua

SEQ ID NO: 41827 - RNA, 46 nt, Mus musculus
ugaggauaccgcccccacccagcuuccuggcaguuugaacccgagu

SEQ ID NO: 41828 - RNA, 46 nt, Mus musculus
auuauuuuuguuuuacaguuaauuauuguuauuggugugucuaugu

SEQ ID NO: 41829 - RNA, 41 nt, Mus musculus
uucccccaaacaggccucuaggagaugacaaaugccccaga

SEQ ID NO: 41830 - RNA, 46 nt, Mus musculus
guugauguaagucucugguuuuguugggcuuuuuuccgugugugug

SEQ ID NO: 41831 - RNA, 45 nt, Mus musculus
uucugcucagcuggcagggaccuuucccguccccgcuuccccagc

SEQ ID NO: 41832 - RNA, 24 nt, Mus musculus
cucagucacagugcuaggggauca

SEQ ID NO: 41833 - RNA, 45 nt, Mus musculus
ugggacacuccaguugcuacgaggagauucuuugcuuuguuggag

SEQ ID NO: 41834 - RNA, 42 nt, Mus musculus
acaguagagguugcagguacacugccccugagggcgggagag

SEQ ID NO: 41835 - RNA, 46 nt, Mus musculus
gcucagccuaaggcgacuacaggcugcuaugugccuggugagagaa

SEQ ID NO: 41836 - RNA, 46 nt, Mus musculus
ggagcaggagguggcccagcuggagaaggacaagaaacugcuagag

SEQ ID NO: 41837 - RNA, 46 nt, Mus musculus
ccaagauggcgcagauugagacggagaaccggcagcuggagaggga

SEQ ID NO: 41838 - RNA, 45 nt, Mus musculus
ggcggaggcgcuggagaaggagcugcaccggcuggagaaggagaa

SEQ ID NO: 41839 - RNA, 25 nt, Mus musculus
ugcuugguaccccacccagcauuac

SEQ ID NO: 41840 - RNA, 55 nt, Mus musculus
uaugcucugacuuuccuucagcauaauugugaacuuggaagaaaucucuaauguc

SEQ ID NO: 41841 - RNA, 23 nt, Mus musculus
cacuuuugcccucccugcucaug

SEQ ID NO: 41842 - RNA, 51 nt, Mus musculus
uguuuuuuguuuuuaaaaagucucacacacacacacauggagagagagaga

SEQ ID NO: 41843 - RNA, 46 nt, Mus musculus
acaaaacaacaaaaaaagucuacauguuuccagcaugaauccagau

SEQ ID NO: 41844 - RNA, 46 nt, Mus musculus
uccacgucuuauucaaaacgugucgcgaucauucacagcuuaagau

SEQ ID NO: 41845 - RNA, 45 nt, Mus musculus
ggacgcggauuaacuuuuagcuccagcugaugaaagcucagagga

SEQ ID NO: 41846 - RNA, 46 nt, Mus musculus
cugcuggccucguguucucugagcccaagaugggaaaggcagagau

SEQ ID NO: 41847 - RNA, 45 nt, Mus musculus
ucucuuuaaucguucagguaaagaaaggcuuugaaaggggcaaag

SEQ ID NO: 41848 - RNA, 46 nt, Mus musculus
uauucuguaauaauggaugucuuaaaacaaauaagugaagugagac

SEQ ID NO: 41849 - RNA, 45 nt, Mus musculus
auuagcuuucaagagcaaauuccccgcggcuucucuagccaggga

SEQ ID NO: 41850 - RNA, 41 nt, Mus musculus
ugaacagcucgcuucccaaugagugagcacaguccacugga

SEQ ID NO: 41851 - RNA, 41 nt, Mus musculus
caugccuugcgguacuuguaugugcuggccaaucucuguga

SEQ ID NO: 41852 - RNA, 46 nt, Mus musculus
aucugucagagaggaccaugcucacagcacaugacugcuaccagga

SEQ ID NO: 41853 - RNA, 42 nt, Mus musculus
gagaagucugugcacaagaucguuucccugcuggcgggauuu

SEQ ID NO: 41854 - RNA, 41 nt, Mus musculus
ugccccugaccaucuugaagaggaagcugcugagaaccaac

SEQ ID NO: 41855 - RNA, 76 nt, Mus musculus
caugaaagugaugcaguuucagggaaugaagcacagagccaguucccccaucucccugccuccggucacacaccuu

SEQ ID NO: 41856 - RNA, 96 nt, Mus musculus
aacuacugcggccaaccccaaggagucaucuuaugccugcuacuacgacgaggagaggggcacuuaccugggugacugguacagcgucaacuggau

SEQ ID NO: 41857 - RNA, 46 nt, Mus musculus
accaaacugggcccguauucuucacguuucccauuugcccgugauc

SEQ ID NO: 41858 - RNA, 45 nt, Mus musculus
agcuugugagucuggcuccaugaugaaccaccugcccgacgacau

SEQ ID NO: 41859 - RNA, 42 nt, Mus musculus
acaguggcccccgagaucaugucuucauuuacuucaccgacc

SEQ ID NO: 41860 - RNA, 46 nt, Mus musculus
ccuuuccucacugccugucugccucucccucguacaacccccaaga

SEQ ID NO: 41861 - RNA, 42 nt, Mus musculus
ggggaccauagguucguacuacuguuucuaauuccauuagag

SEQ ID NO: 41862 - RNA, 40 nt, Mus musculus
augcguaacuaugugcaugcacaccgagguauauggauaa

SEQ ID NO: 41863 - RNA, 46 nt, Mus musculus
auuguuuaggacuucaaggacucuuguuaaccuguaggugugagug

SEQ ID NO: 41864 - RNA, 46 nt, Mus musculus
acuugccucuuuaaucccaagugggauaauaaacccaaagccagcg

SEQ ID NO: 41865 - RNA, 29 nt, Mus musculus
cuguagaggagagagagagagagaucaug

SEQ ID NO: 41866 - RNA, 45 nt, Mus musculus
ugugugugucucucucucucucucucuguguguguguguguguga

SEQ ID NO: 41867 - RNA, 46 nt, Mus musculus
uucccggcuuugggacaaguuaagauucccgguuuggggacaaguu

SEQ ID NO: 41868 - RNA, 47 nt, Mus musculus
ucccccaccaaguucagaacuuucagcagucagugguugcuggcagg

SEQ ID NO: 41869 - RNA, 42 nt, Mus musculus
agaggaggaagaggaggaggaagaggaagaagagggggagga

SEQ ID NO: 41870 - RNA, 45 nt, Mus musculus
caaucucaacacucaggauacuaaaguaugaggugggguggggug

SEQ ID NO: 41871 - RNA, 46 nt, Mus musculus
uuauuuccauauugucuguggcugcuuucaugauacauuggcaggg

SEQ ID NO: 41872 - RNA, 46 nt, Mus musculus
caguuuugauucuguuugcuuauguuagaugcuuguaguuucugug

SEQ ID NO: 41873 - RNA, 45 nt, Mus musculus
augguucucaaccugugggucucaaucccuuuggggguugcauau

SEQ ID NO: 41874 - RNA, 45 nt, Mus musculus
uugcuggaacggcggguugcccuggagggcgaaacugaggcagga

SEQ ID NO: 41875 - RNA, 44 nt, Mus musculus
gccuguccuugaucucuucccucaccccugcucuuucccgccac

SEQ ID NO: 41876 - RNA, 48 nt, Mus musculus
uagaaaaugaggaaggaugucaggaggaacagacaacaggcagcaugg

SEQ ID NO: 41877 - RNA, 42 nt, Mus musculus
ggaggcugaguguacucuuccaggugcucaguuccagagcag

SEQ ID NO: 41878 - RNA, 45 nt, Mus musculus
gaaagaaaguaaaaaucaaaacuaaugaacaaacaaacaaucaau

SEQ ID NO: 41879 - RNA, 46 nt, Mus musculus
uacacccgggagcaagaggagcuuagggggcagguguuccucuuag

SEQ ID NO: 41880 - RNA, 49 nt, Mus musculus
ucuucccccaaggcgggaagggccgggagcuggaacauaagcaggagga

SEQ ID NO: 41881 - RNA, 44 nt, Mus musculus
uccagagaagacaguguggaggcccgaagugacuuugaggaaaa

SEQ ID NO: 41882 - RNA, 44 nt, Mus musculus
cucaacagaguuacugggucagguggacagugggaaauggcugg

SEQ ID NO: 41883 - RNA, 41 nt, Mus musculus
ggaagcucaacucuccagagaagccuucucagagagugaga

SEQ ID NO: 41884 - RNA, 46 nt, Mus musculus
acguguguguacaggaauggugcaaacaaggcacaagguauuagaa

SEQ ID NO: 41885 - RNA, 46 nt, Mus musculus
accuucugaaugaacuccagccucuggucugcuucccaacccuguu

SEQ ID NO: 41886 - RNA, 46 nt, Mus musculus
gucugugugugugugucugugucugugugugugugucuguguaugu

SEQ ID NO: 41887 - RNA, 45 nt, Mus musculus
ugugucugugucucugugugugugugucugugugugugugucucu

SEQ ID NO: 41888 - RNA, 28 nt, Mus musculus
gugugucuguagguguguggauaugugu

SEQ ID NO: 41889 - RNA, 42 nt, Mus musculus
cuugcuucuguacgauagacuuggcaaccucugguggcuggc

SEQ ID NO: 41890 - RNA, 46 nt, Mus musculus
ugccauggcaacuauuccaagugcacaugauuuaaauucaagaguu

SEQ ID NO: 41891 - RNA, 42 nt, Mus musculus
caucucauuaauuuucuaccaauuccauguaaacugaaagca

SEQ ID NO: 41892 - RNA, 42 nt, Mus musculus
auauacacuauggcacccaacuuaacauuuguacaaacagag

SEQ ID NO: 41893 - RNA, 42 nt, Mus musculus
ucaacugucaccgggcuccgcugcgugggcccaggaggaggc

SEQ ID NO: 41894 - RNA, 42 nt, Mus musculus
acuucuccgagucgcugccgcccaggacggcgcacgccucau

SEQ ID NO: 41895 - RNA, 42 nt, Mus musculus
gggaagcugggggaaggguagcccggcuccugggcuggagaa

SEQ ID NO: 41896 - RNA, 45 nt, Mus musculus
acuuuuaggagaguccagaggcuaaagauucugaacugggcccug

SEQ ID NO: 41897 - RNA, 47 nt, Mus musculus
caaagacauguguuuauugguaggaaggaaggauggggacaagagga

SEQ ID NO: 41898 - RNA, 44 nt, Mus musculus
cccaaggcaccgugaucauggggcagaggggacugcuccccaga

SEQ ID NO: 41899 - RNA, 46 nt, Mus musculus
gugcugguacauagaaagugcaacucucaaauucaaauccucagcu

SEQ ID NO: 41900 - RNA, 46 nt, Mus musculus
caagaaagaccugaagaagaugcaggccaacaaugcaaaggcagug

SEQ ID NO: 41901 - RNA, 46 nt, Mus musculus
ggcguuuucgggcacagggacacugguggcuuccauugucuccaag

SEQ ID NO: 41902 - RNA, 60 nt, Mus musculus
uuucucaugggaucagagguggcagacauggcgacagagguggcagauauggcgauagag

SEQ ID NO: 41903 - RNA, 65 nt, Mus musculus
guggcagacauuucaacagaagaggcacugcccaacuugucuaacacagagaaggauuaauuacc

SEQ ID NO: 41904 - RNA, 45 nt, Mus musculus
gagcauggaaggggaucccaaaguaaagaagaaggggagcaaggu

SEQ ID NO: 41905 - RNA, 46 nt, Mus musculus
uucugaaaggggacucagauccagacccgacagguacucagccuca

SEQ ID NO: 41906 - RNA, 45 nt, Mus musculus
agggcucgauuucccgaagcccuguagcuauaucagugacccuag

SEQ ID NO: 41907 - RNA, 46 nt, Mus musculus
augacuaacggagucaggcugaguguucugccgacaagaaacggaa

SEQ ID NO: 41908 - RNA, 46 nt, Mus musculus
uggcugacucaucuuaaguauuuaauucuaacgugcgauuguaguu

SEQ ID NO: 41909 - RNA, 75 nt, Mus musculus
augcuucauguaaugcugcacuuagguucaagucacccgcccgagagagagagagagagagagagagagagagag

SEQ ID NO: 41910 - RNA, 45 nt, Mus musculus
aucucagacucagaaaguaaagcuguuuaggcauuugcugaaggu

SEQ ID NO: 41911 - RNA, 42 nt, Mus musculus
gcggaccccggguacuauugcacggaauaguaagggacagau

SEQ ID NO: 41912 - RNA, 46 nt, Mus musculus
caaggaugguucgggcugacacagaacaggaaaacugaaggcagaa

SEQ ID NO: 41913 - RNA, 46 nt, Mus musculus
guuuugcagcccagcggagagaacuuaugauggaaaggucagaguc

SEQ ID NO: 41914 - RNA, 45 nt, Mus musculus
uucugcaaaugugccucguucuccagugagagaauugcucgagau

SEQ ID NO: 41915 - RNA, 46 nt, Mus musculus
uugugaaauaguaaaaggcagcuaagagaagccagucugggguaga

SEQ ID NO: 41916 - RNA, 47 nt, Mus musculus
cucuuucauguuauugaugacuuugugaaguuucagcuugagaagaa

SEQ ID NO: 41917 - RNA, 46 nt, Mus musculus
gucuugacugacuugcgcucugcccuugucaauaacaccaucuuug

SEQ ID NO: 41918 - RNA, 45 nt, Mus musculus
ucuuagucccuagguuugucaaguccagugcguuugaguuugagu

SEQ ID NO: 41919 - RNA, 46 nt, Mus musculus
ugaagaucccaccgaggugcauguuugaccauccagacgcagagaa

SEQ ID NO: 41920 - RNA, 27 nt, Mus musculus
guuugccucgggccuugaggauuuuga

SEQ ID NO: 41921 - RNA, 45 nt, Mus musculus
aggaggaggaccugacguggagggcccccaaggaggaggccgagg

SEQ ID NO: 41922 - RNA, 46 nt, Mus musculus
ggauaguaaagccaccuaggugguguccugcgcagcagcuguucuu

SEQ ID NO: 41923 - RNA, 46 nt, Mus musculus
auauugguuccaugguagacagcugagagguguguugacucguggu

SEQ ID NO: 41924 - RNA, 46 nt, Mus musculus
uugaggaggcugucagggcugcuuacuagacgaagaucagucagug

SEQ ID NO: 41925 - RNA, 45 nt, Mus musculus
cguacccugaugcucaugaaggccgccuuucauauaugagaagca

SEQ ID NO: 41926 - RNA, 46 nt, Mus musculus
ucuccccagcauacuguaucgccuucacugccuucugacugcagag

SEQ ID NO: 41927 - RNA, 46 nt, Mus musculus
uaagcagugcugagaagaggaaggccaaaugggaaagucugcagaa

SEQ ID NO: 41928 - RNA, 58 nt, Mus musculus
caaguauucaaaggaaacaccguuugucuuuaaguuagaagauuaccaagaugcagug

SEQ ID NO: 41929 - RNA, 71 nt, Mus musculus
acuuuggacauugacuuuaaauucauggaggauauugagaagucggaagcucggauaggcauuccuagcac

SEQ ID NO: 41930 - RNA, 45 nt, Mus musculus
guaccuuaaauggaaaucucaccuauguuauauuuaaccuguuaa

SEQ ID NO: 41931 - RNA, 53 nt, Mus musculus
gcaccaguacauauucucacauauucuccggcuugagaagccugcccuggagu

SEQ ID NO: 41932 - RNA, 59 nt, Mus musculus
gagcugaagaagucugguuucacauugucucaacaaaugcucgagcugauuacaagauu

SEQ ID NO: 41933 - RNA, 42 nt, Mus musculus
acaccacaagaugcuuugggauccugacagccaaacccauac

SEQ ID NO: 41934 - RNA, 45 nt, Mus musculus
aacuggaugaacacuugaugccaguugggaaagagacuguuaaau

SEQ ID NO: 41935 - RNA, 46 nt, Mus musculus
agggguugcaaaacaaggucacugagaucaaggacagaccaaagau

SEQ ID NO: 41936 - RNA, 45 nt, Mus musculus
aagugcagccagcauaguggccagugaugauuuguggcaggagag

SEQ ID NO: 41937 - RNA, 36 nt, Mus musculus
ucaugagaccaaccugcucauugcaacaaguguugu

SEQ ID NO: 41938 - RNA, 46 nt, Mus musculus
cuggcaaacaagauccagagcuggcuuauaucagcagcaacuuuau

SEQ ID NO: 41939 - RNA, 45 nt, Mus musculus
ccccuauggguuucugguacuauagguuaaugccaaggagcaggu

SEQ ID NO: 41940 - RNA, 46 nt, Mus musculus
ggcgcaugcuauggucuucccucugcucugaguugcauagagagau

SEQ ID NO: 41941 - RNA, 45 nt, Mus musculus
augucuuguuagcagugugcuguccuuuaacuaguaggggcagag

SEQ ID NO: 41942 - RNA, 63 nt, Mus musculus
aaucagucauuuuugcaaaggaccuccuguccuuuuuauacccgauuuuauaggcacauauuu

SEQ ID NO: 41943 - RNA, 66 nt, Mus musculus
aacuuuuaauguauuguuuuugacauauaauuacaaggcuccuguacuuucuguugccauagccau

SEQ ID NO: 41944 - RNA, 46 nt, Mus musculus
gcuuuggaagcaaauccccacaucuagacagucuacaggaggaggg

SEQ ID NO: 41945 - RNA, 41 nt, Mus musculus
caagccaggggaccaggaagcauguggcuggaggcggggug

SEQ ID NO: 41946 - RNA, 44 nt, Mus musculus
gcuacuucuuauuuuugcuaggagaaaaggggaugguucauaga

SEQ ID NO: 41947 - RNA, 94 nt, Mus musculus
caguuccaggggaucuggacacgguuacacagacauacaugcaggcaaacacuaagcacaucgaauaaaaauaaauuauuaaaaacaaaaagau

SEQ ID NO: 41948 - RNA, 46 nt, Mus musculus
ccugaugcgauccacauuugucuccucugcaguccccggacguuaa

SEQ ID NO: 41949 - RNA, 46 nt, Mus musculus
ggccuagucggccaucagugggaggagaggcccuuggucuuucgaa

SEQ ID NO: 41950 - RNA, 46 nt, Mus musculus
uuugggacuaacugcuuccauuuuaaaugggaaaugugauccagag

SEQ ID NO: 41951 - RNA, 51 nt, Mus musculus
gaaguaaaugcaucuuggacaaaagagagauggagccaagaguuuacuaag

SEQ ID NO: 41952 - RNA, 46 nt, Mus musculus
aaaccagguugcucaacaagugucagccgucagaacucacucggau

SEQ ID NO: 41953 - RNA, 42 nt, Mus musculus
gguuggaagucagcugugaaggguaugugguugucccggacg

SEQ ID NO: 41954 - RNA, 46 nt, Mus musculus
ccaugcuucuuaaaggcuguuggguuuauguuuggggacugcagac

SEQ ID NO: 41955 - RNA, 46 nt, Mus musculus
uuguucagacucuguguuucucuuagaugaggacuucuggggagau

SEQ ID NO: 41956 - RNA, 45 nt, Mus musculus
uccuucucuuuuaaaaauuggagcauacuuaauuuccuuuguaga

SEQ ID NO: 41957 - RNA, 42 nt, Mus musculus
ugggaccuggcaaucacaggagacaggugugaguguggagac

SEQ ID NO: 41958 - RNA, 42 nt, Mus musculus
uacauuuguacacuuauuguagcauagucacaggggccaaaa

SEQ ID NO: 41959 - RNA, 51 nt, Mus musculus
uacaucuuuuucauggcugucaaaugauuucagcagcagaugggacuggca

SEQ ID NO: 41960 - RNA, 46 nt, Mus musculus
cuuugagguugauugauugagcugcucauugauguuaccagggacc

SEQ ID NO: 41961 - RNA, 42 nt, Mus musculus
gcagacauuaaaacgguaaaucuggguucucagcggcggaga

SEQ ID NO: 41962 - RNA, 41 nt, Mus musculus
cuagucuugagcugucuuauaaaccaguuugaugaaagagu

SEQ ID NO: 41963 - RNA, 45 nt, Mus musculus
cuguucuggguccugcagucaacagggaucccaggugcccguugc

SEQ ID NO: 41964 - RNA, 42 nt, Mus musculus
acgugaauguuuauuacagugauagcaaagugagccggagug

SEQ ID NO: 41965 - RNA, 46 nt, Mus musculus
ucaaucccuuuucuuucuuuagguuuuaacuaacacccaagcagau

SEQ ID NO: 41966 - RNA, 46 nt, Mus musculus
ugcacgcauaagaugcuuacccgcauugacuguaucacaugaagaa

SEQ ID NO: 41967 - RNA, 46 nt, Mus musculus
uauaaaaaauuuugacaguuuuagaaauuaacuuguggggacuggu

SEQ ID NO: 41968 - RNA, 46 nt, Mus musculus
ggaugcccacguagccuuuaggcguggggcugcugacugcugaguc

SEQ ID NO: 41969 - RNA, 45 nt, Mus musculus
aguaugcauuggaugagugcuuguguguuaguacggaccugauaa

SEQ ID NO: 41970 - RNA, 45 nt, Mus musculus
gagcaccuuaggugcguucacuuguuuguuuuaauuugccaaaau

SEQ ID NO: 41971 - RNA, 45 nt, Mus musculus
caggcuuauuauguccuaauggaggcagaggagggggcugcgaag

SEQ ID NO: 41972 - RNA, 45 nt, Mus musculus
uguagccugggaugccuuacauccugcuucguuguucagccagaa

SEQ ID NO: 41973 - RNA, 113 nt, Mus musculus
guauggucccuagcuuauagcaacagcuuuuagccuuaagauguaggaaaaguacaguuauaguaggccuuucuuuuaauuuugaaguuucgcuucucuuuccugccccaguc

SEQ ID NO: 41974 - RNA, 82 nt, Mus musculus
acacugagccacauuccgcccuucauucccaagcgacccccacaguuuccucguuuuccuugucuuugaguuuggccgugcu

SEQ ID NO: 41975 - RNA, 45 nt, Mus musculus
ugguguuauguaugagugcgucuagguguagcucugcuuucuagg

SEQ ID NO: 41976 - RNA, 45 nt, Mus musculus
cuuugccuucaggacagagccaguguccugaagacuugcccaaau

SEQ ID NO: 41977 - RNA, 44 nt, Mus musculus
cacuccugaaccaagaacaggaggcuacacaacaaaacucagag

SEQ ID NO: 41978 - RNA, 46 nt, Mus musculus
agauacagacagaggugagggauuuaagagacaaaaaaacguuaga

SEQ ID NO: 41979 - RNA, 46 nt, Mus musculus
ggcaucguggcagcaggaaugugagggggcuagucauguuguaucg

SEQ ID NO: 41980 - RNA, 45 nt, Mus musculus
cuagcagggcguggugacgcacgccuuuaaucccagcacccagga

SEQ ID NO: 41981 - RNA, 47 nt, Mus musculus
guaaaacagcugcuccgaaagccaaccuuuuguguccuuaacggcag

SEQ ID NO: 41982 - RNA, 41 nt, Mus musculus
cguugccuugccucuuaagaggcugaggcaggaggaucagu

SEQ ID NO: 41983 - RNA, 46 nt, Mus musculus
uguaaagugcucuagccgugggacggcuggcuuuggggucucggug

SEQ ID NO: 41984 - RNA, 46 nt, Mus musculus
cuacgguaacgcggccgguaguccugcgauggcgugcaccagagag

SEQ ID NO: 41985 - RNA, 46 nt, Mus musculus
cugcggcugcacgguguucgcgacuaugcggccuacaacgugcugg

SEQ ID NO: 41986 - RNA, 44 nt, Mus musculus
gaucuuuggcuuagacuuuccgcuccccugugaguguaacugga

SEQ ID NO: 41987 - RNA, 46 nt, Mus musculus
uucccucaugccagaguuuucaaagggcucugguucucacccagga

SEQ ID NO: 41988 - RNA, 77 nt, Mus musculus
guguguguguuguguguguguguuguguguguguguguuguguguguguguguuguguguguguguugugugugugu

SEQ ID NO: 41989 - RNA, 63 nt, Mus musculus
cccugauguuuuuguaacuuccuguaaaagggaaaugauggacagaggagaaaaugugguggc

SEQ ID NO: 41990 - RNA, 105 nt, Mus musculus
ccagagaagccagggucacccagggaagccuuggucuccuaguaagaauguugaaagggaaugugugggauuuuaugugguucuauuuuagagauacggcuggau

SEQ ID NO: 41991 - RNA, 52 nt, Mus musculus
ucacucaccuaaguugggccaaaucggcuuccauccuugaccgagaugccaa

SEQ ID NO: 41992 - RNA, 46 nt, Mus musculus
caccugaccugugaagccccaccuacccagcaaacauaggcuuuga

SEQ ID NO: 41993 - RNA, 46 nt, Mus musculus
uucauaagucagagacacuaguugucuugugaggccaaagggaaag

SEQ ID NO: 41994 - RNA, 46 nt, Mus musculus
agcucugcugacucccuggcaaggggcuccagagaagaucccaguu

SEQ ID NO: 41995 - RNA, 45 nt, Mus musculus
gccgagcaggcaacagcagcaugggaaggggcagcgucuggccag

SEQ ID NO: 41996 - RNA, 46 nt, Mus musculus
uguucgcuagucauguccuuuuuccucuacacugggcuccaagaag

SEQ ID NO: 41997 - RNA, 46 nt, Mus musculus
uguggggccaggccugggcaaggcagacaggagcugcaggaccugg

SEQ ID NO: 41998 - RNA, 49 nt, Mus musculus
guggaggacauguugcuugaacugauagacucggaguccaacgaugaau

SEQ ID NO: 41999 - RNA, 42 nt, Mus musculus
gccuugauaugguacaggaucugccaauacauggagucgcag

SEQ ID NO: 42000 - RNA, 50 nt, Mus musculus
uguaccccaaggacagguaccgaagcugcgacuccauguauuggcagauc

SEQ ID NO: 42001 - RNA, 42 nt, Mus musculus
cuuuagagguaaugacuccuuugucucauuuaaccaucugau

SEQ ID NO: 42002 - RNA, 46 nt, Mus musculus
gggggguacgggggacgggagagggugugaacagaacaggggaggg

SEQ ID NO: 42003 - RNA, 45 nt, Mus musculus
augaaacugcauguuucgucucuacccuuaaacguggccuuagua

SEQ ID NO: 42004 - RNA, 46 nt, Mus musculus
uccacuuguaaagccaaagaacgcuuuaaaagcaaacugcugagau

SEQ ID NO: 42005 - RNA, 41 nt, Mus musculus
cuaucauucggggugaaacaaggcuuuccuaaaccacaaaa

SEQ ID NO: 42006 - RNA, 48 nt, Mus musculus
ggauaugcccugucugggucugggggaugcugguagcaggagaccagg

SEQ ID NO: 42007 - RNA, 63 nt, Mus musculus
gaugccauggcuacccagcgggcacacagggcagagacaccugcacaccccaaccgccugugg

SEQ ID NO: 42008 - RNA, 45 nt, Mus musculus
guucauucauggugugugugugugugugugugugugugugugugu

SEQ ID NO: 42009 - RNA, 46 nt, Mus musculus
uacaaggacucugccaugucuaaaggacccucaaaccugccaagau

SEQ ID NO: 42010 - RNA, 42 nt, Mus musculus
guucuccagaaccuuuccaaaaugcaccccuaaggcccacaa

SEQ ID NO: 42011 - RNA, 46 nt, Mus musculus
ugaccccugggguaccuaaaucugaacacgcguuuucuguaaagug

SEQ ID NO: 42012 - RNA, 43 nt, Mus musculus
cagagcuuccaugaugagcacagcgcaagaacaaaauguccag

SEQ ID NO: 42013 - RNA, 42 nt, Mus musculus
agccgccccgcuaguggcguaguccccgccucagcuccagau

SEQ ID NO: 42014 - RNA, 53 nt, Mus musculus
cccccaaagcauuuauggagcacuuguugaauacacaccguuauacacugagg

SEQ ID NO: 42015 - RNA, 46 nt, Mus musculus
accgagaaggcugcugcuggugugccaaagcaaggaacugugggag

SEQ ID NO: 42016 - RNA, 48 nt, Mus musculus
cgguuacuuucuaggaccugugacaaacuucuugacagaggccacuua

SEQ ID NO: 42017 - RNA, 46 nt, Mus musculus
acacaggacacuguagccagaagaaggaaacaaaugacacacccau

SEQ ID NO: 42018 - RNA, 42 nt, Mus musculus
cagccuccaguuuaggagggguuuauuggaaugaaggcccac

SEQ ID NO: 42019 - RNA, 42 nt, Mus musculus
gaaauccaggaaggcaaagaagugguaaggggcccagcagac

SEQ ID NO: 42020 - RNA, 46 nt, Mus musculus
uugugcugggcacacuuaaccuuugagagauuccaugggcacaguu

SEQ ID NO: 42021 - RNA, 46 nt, Mus musculus
uuuuuaaaucgggaaauuuuauuuuaguguacaggaaggaccaguc

SEQ ID NO: 42022 - RNA, 42 nt, Mus musculus
cuuuccacucuguacaguugaagauucccugcccaggcagug

SEQ ID NO: 42023 - RNA, 42 nt, Mus musculus
uuacuuacuuuucuguuuacuguguggucaguucucugaggu

SEQ ID NO: 42024 - RNA, 42 nt, Mus musculus
gucagagcagaguucaaaccuggccugaaccuagaggcagga

SEQ ID NO: 42025 - RNA, 46 nt, Mus musculus
uagacggagcugcugaggcgugaaggugagggcacuaaagcuagug

SEQ ID NO: 42026 - RNA, 46 nt, Mus musculus
acaguacacaguugucuuuaaaacauuacauugacuuauuguagag

SEQ ID NO: 42027 - RNA, 45 nt, Mus musculus
cagagaguuaggcuggccugcucuguuaacuguuacgguccugau

SEQ ID NO: 42028 - RNA, 23 nt, Mus musculus
ucuggagagaguggguggguuga

SEQ ID NO: 42029 - RNA, 42 nt, Mus musculus
acaagucuuucuacagaaguggagcuucuacugacuccagau

SEQ ID NO: 42030 - RNA, 46 nt, Mus musculus
uaauauugacuuuaauauugauugcuuuugcauaauacugugaggg

SEQ ID NO: 42031 - RNA, 45 nt, Mus musculus
ugucuaacugcaggagaauuggagaggggauaauuaccagaagug

SEQ ID NO: 42032 - RNA, 46 nt, Mus musculus
ucucauaaaaaaauggauaaagucaaauuuaagugacagucaagau

SEQ ID NO: 42033 - RNA, 47 nt, Mus musculus
ugaugacuucuguauucuuuuugcaccaaaaacagucguucagguaa

SEQ ID NO: 42034 - RNA, 46 nt, Mus musculus
ggugcagccuggcaagucauaggcuugucuguacuagaauacagag

SEQ ID NO: 42035 - RNA, 46 nt, Mus musculus
guuacacuguuccagugacgucgugcacaucagaacaugcucagac

SEQ ID NO: 42036 - RNA, 42 nt, Mus musculus
gugugggaauguauuaaagcaauuuuagugugaaguggaguu

SEQ ID NO: 42037 - RNA, 23 nt, Mus musculus
ggcacaggcugugauaagcacac

SEQ ID NO: 42038 - RNA, 46 nt, Mus musculus
acaagaauaguucauaaauuguuuguauaguuuauaacuccaagau

SEQ ID NO: 42039 - RNA, 45 nt, Mus musculus
ucacuugggagguggaggcaggaaguuugcaaguuugagaccaga

SEQ ID NO: 42040 - RNA, 45 nt, Mus musculus
auacacucucaauguagugaaagcuacauucuucucugucuagau

SEQ ID NO: 42041 - RNA, 42 nt, Mus musculus
guuucuaacuugagagaagcaagggcaccagcuagaagaggg

SEQ ID NO: 42042 - RNA, 42 nt, Mus musculus
guggugcugacacugcgccucacugugucagucagcccagga

SEQ ID NO: 42043 - RNA, 45 nt, Mus musculus
auguuauagggguuucagacuguauggacacuguggauguaagua

SEQ ID NO: 42044 - RNA, 46 nt, Mus musculus
gggcuggguaauggcucggcgcucaccagacauaaugagacagaug

SEQ ID NO: 42045 - RNA, 45 nt, Mus musculus
ggguagagccuuugcauuugugucucuuagguucagcucugccug

SEQ ID NO: 42046 - RNA, 46 nt, Mus musculus
ugccucuggggucuguugcaucuuacacauuuaguuucagugggug

SEQ ID NO: 42047 - RNA, 49 nt, Mus musculus
acaacuaacuagaacguuaccggagaucgcacccucggauccagugcag

SEQ ID NO: 42048 - RNA, 46 nt, Mus musculus
cacuuuuauagauacuguuuuaagaauugaacaugugccagaaaau

SEQ ID NO: 42049 - RNA, 46 nt, Mus musculus
aguuacagugaucagcacuugcugagaguauuggcggcccaggagu

SEQ ID NO: 42050 - RNA, 46 nt, Mus musculus
cugcaugugugcccaggucucuggagaucagaagaagguuacagau

SEQ ID NO: 42051 - RNA, 46 nt, Mus musculus
ggaaugagaaggcugagucugagcgagaauaguugauuguccugag

SEQ ID NO: 42052 - RNA, 46 nt, Mus musculus
ugcuguggacagucugaagcagccccauauccuucauccgggauua

SEQ ID NO: 42053 - RNA, 46 nt, Mus musculus
gugugguuuuuagacacaggaaauuagaaaugaggccaucugaggu

SEQ ID NO: 42054 - RNA, 26 nt, Mus musculus
gcgugagguugugaauggccccagua

SEQ ID NO: 42055 - RNA, 44 nt, Mus musculus
uugggaauuguuuagauucaaguguggcccggcucagggaagug

SEQ ID NO: 42056 - RNA, 46 nt, Mus musculus
ucuaaagggaaggcuucggauuagaaauguuaucuugugucuggga

SEQ ID NO: 42057 - RNA, 42 nt, Mus musculus
acaauguaaguugggauugaagcauagacaguucaggugaau

SEQ ID NO: 42058 - RNA, 46 nt, Mus musculus
gugcaucaaccaaaacaauuuauugaaguagauuugagugcagaag

SEQ ID NO: 42059 - RNA, 46 nt, Mus musculus
guucucaacuauaauuuugcaguauaauaaauuuugguggacagaa

SEQ ID NO: 42060 - RNA, 42 nt, Mus musculus
agaaggguugggauuacagauuacagacacuuggagcuggag

SEQ ID NO: 42061 - RNA, 46 nt, Mus musculus
guuuucuuuuaagcauguuuaugagcauguuugauuccuucucccg

SEQ ID NO: 42062 - RNA, 46 nt, Mus musculus
uaccaggaaaauaaccucaguugagaagaugaaucauauugccuau

SEQ ID NO: 42063 - RNA, 45 nt, Mus musculus
gugguggugcacgccuuuaauccuagcacuuggaaggcagaugca

SEQ ID NO: 42064 - RNA, 46 nt, Mus musculus
gugugucuauggguggagggguugacucuuguauuuaugugaguag

SEQ ID NO: 42065 - RNA, 41 nt, Mus musculus
uccgccugccucucagcuaaaaacauaucuuugaagggcua

SEQ ID NO: 42066 - RNA, 46 nt, Mus musculus
uuggaacuccaguugugagguauucaacauucuucugacggccuag

SEQ ID NO: 42067 - RNA, 46 nt, Mus musculus
aggaggauugauuauuacaggccagccugaguuuaaagaggaaaag

SEQ ID NO: 42068 - RNA, 46 nt, Mus musculus
uuuagucccccauauuaauauuaaauacauauuacggugccuuuga

SEQ ID NO: 42069 - RNA, 46 nt, Mus musculus
aauauauaggaauuguuuuuguaaauaaguuauuuuguggggcggg

SEQ ID NO: 42070 - RNA, 46 nt, Mus musculus
uuauuauaauuuauuugauugcuuucaaagacuaggcaucaaguua

SEQ ID NO: 42071 - RNA, 46 nt, Mus musculus
auuggguaauugcuacaaaguuuuaagagagugaguggaucugcug

SEQ ID NO: 42072 - RNA, 55 nt, Mus musculus
cauggccguucucuguuguuguaguuaguucuuuuucuugagguguugaaagcag

SEQ ID NO: 42073 - RNA, 60 nt, Mus musculus
agggaguuguuuguuagucaugccacauugugcauguugaaguucaagagagcagcugug

SEQ ID NO: 42074 - RNA, 46 nt, Mus musculus
caccacagguacaaaguuuuaauuagauuuauuuauguguuugcag

SEQ ID NO: 42075 - RNA, 52 nt, Mus musculus
uccuuuugcucucuuuguucuguauucagugucuccugcauacuuguucugu

SEQ ID NO: 42076 - RNA, 46 nt, Mus musculus
cuuuguucauucugaagaaucuccuguuucugccacucccgggcuu

SEQ ID NO: 42077 - RNA, 47 nt, Mus musculus
uugaacucaguucagcagaccuauuaggaaaguacuguacaggcuga

SEQ ID NO: 42078 - RNA, 48 nt, Mus musculus
uauugaaguaaauuaaaaaaaacugcauaugauuuaucucaccaucag

SEQ ID NO: 42079 - RNA, 55 nt, Mus musculus
auuccccccccccaagacagggucuuuuguagcccaggcuggccuuauuuaaugg

SEQ ID NO: 42080 - RNA, 49 nt, Mus musculus
uacugauaaagugaccuugacaggaacauuccaagcugauagucaaacu

SEQ ID NO: 42081 - RNA, 41 nt, Mus musculus
cagaagaacauaguuucuuugcuuauacaacacagacagag

SEQ ID NO: 42082 - RNA, 45 nt, Mus musculus
gaggcauggugacacauaccuauaguucuagcauugugggacuga

SEQ ID NO: 42083 - RNA, 45 nt, Mus musculus
aggguuuugcuguauguuguccuggagcacacuaaauagaucaaa

SEQ ID NO: 42084 - RNA, 46 nt, Mus musculus
ccucucugguuacaguauuuuaacaguauuucaaaguugggcccag

SEQ ID NO: 42085 - RNA, 46 nt, Mus musculus
uuauuucaaacuuacuacauuuuuuacuuuguuuguugguguaugu

SEQ ID NO: 42086 - RNA, 45 nt, Mus musculus
uacuuauguuuugagauggggguucuuauaggcaggcuggccuca

SEQ ID NO: 42087 - RNA, 42 nt, Mus musculus
ugcccagucuuguacauugaccugauuccauugacaucucua

SEQ ID NO: 42088 - RNA, 47 nt, Mus musculus
uuaaggugcugauauugaugcguuguguguugcaccaagacauguug

SEQ ID NO: 42089 - RNA, 104 nt, Mus musculus
acuuuuucaccucauucuaugauaaauugaaauuacaagaagaagugaaagauuuaagaguauguacauauuggggcaagagaggaagaguuaaaugccauuua

SEQ ID NO: 42090 - RNA, 33 nt, Mus musculus
ggcuguugaagaggcauuuguaccaguuaucaa

SEQ ID NO: 42091 - RNA, 41 nt, Mus musculus
gguuaauaccaacaauuuuuuuuccggaaauggguguccau

SEQ ID NO: 42092 - RNA, 45 nt, Mus musculus
aaguagccuuuuuacuuagguuaauuuguauaaauacuuugaaga

SEQ ID NO: 42093 - RNA, 46 nt, Mus musculus
aguguuuaaacauaaagauaucuguaauuaaaauauacggugacua

SEQ ID NO: 42094 - RNA, 49 nt, Mus musculus
ucucuuuaagugugcagccaacuuacagcuccuacagauguuaaaccag

SEQ ID NO: 42095 - RNA, 46 nt, Mus musculus
uuuuauaucaccguucccaugcuuuagccucuguuuaaugugccug

SEQ ID NO: 42096 - RNA, 46 nt, Mus musculus
uaagaauuuuuuuuaaauagaaaaugccauaaaaguaguuugacag

SEQ ID NO: 42097 - RNA, 41 nt, Mus musculus
ucugaacuuagccacuguaauguuuucugccaucugcucug

SEQ ID NO: 42098 - RNA, 45 nt, Mus musculus
ucuccagugucuguagaauuuucuuuauuguuaaaaagggcuuag

SEQ ID NO: 42099 - RNA, 45 nt, Mus musculus
uuaccuuuucuuaggguuuuaaauuguguaaaauaccugcuauuc

SEQ ID NO: 42100 - RNA, 46 nt, Mus musculus
uuuguauuuuaauaaucguaguuuguuaaguaacaauaaaccacag

SEQ ID NO: 42101 - RNA, 46 nt, Mus musculus
gcuuaugaauuuaaagagaauuauaaggauuuuaacuaagagauag

SEQ ID NO: 42102 - RNA, 48 nt, Mus musculus
uuuuacauaaauuuuaauuaauuuaauuuauaucuauaucuauaugag

SEQ ID NO: 42103 - RNA, 46 nt, Mus musculus
cgugacgaggcucacaguuuggggauuauuacaguguagucuagag

SEQ ID NO: 42104 - RNA, 46 nt, Mus musculus
uauuuauaaacaaaauauuguggugcaucacuuaaucaugcugaag

SEQ ID NO: 42105 - RNA, 46 nt, Mus musculus
uuggaaggugugaaagaacagaagguucucagacuuuucagacuag

SEQ ID NO: 42106 - RNA, 45 nt, Mus musculus
aguuguaauugcuuucaaaaguccuaagaauaguuacuugcccau

SEQ ID NO: 42107 - RNA, 102 nt, Mus musculus
ugguuauaagauccagcacaaagcacauaaauaaaguaaauagcauguugucuuuaucuucaaaggcauuauauuguacuucuagcaagugcgcccacggaa

SEQ ID NO: 42108 - RNA, 42 nt, Mus musculus
uuacacuggcucaugugaauccccagucauuuccagccccca

SEQ ID NO: 42109 - RNA, 45 nt, Mus musculus
auauaaaaaaaaauauguguguguguguguguguguguguguggu

SEQ ID NO: 42110 - RNA, 42 nt, Mus musculus
gguuaguguuuaaaaaaacugaaaacucugaaaaucucagug

SEQ ID NO: 42111 - RNA, 25 nt, Mus musculus
ggagagguagccuaguugguagagu

SEQ ID NO: 42112 - RNA, 46 nt, Mus musculus
gcuucugagguuucuguaccgcaagcaaauuccagugaaagcccag

SEQ ID NO: 42113 - RNA, 46 nt, Mus musculus
agcauuccucaaacugccacacagccagccauuucuccaccaccaa

SEQ ID NO: 42114 - RNA, 42 nt, Mus musculus
ggagcuuuuugguuuggggaauguacuuuaugugauggggau

SEQ ID NO: 42115 - RNA, 46 nt, Mus musculus
ucuuuauaguuuugaaaacuuuauaaauuaaagcguuaauuggcag

SEQ ID NO: 42116 - RNA, 44 nt, Mus musculus
uagagcaguguaaaacaggaacuuagaguucagagaaaagguaa

SEQ ID NO: 42117 - RNA, 45 nt, Mus musculus
ucgcucuguugucugcucacuaauuggggcauugauuauuggaca

SEQ ID NO: 42118 - RNA, 42 nt, Mus musculus
cuacccuccuguugcuaguuugucuucuuuauuagccaccac

SEQ ID NO: 42119 - RNA, 51 nt, Mus musculus
ccaacucaacccguugucuccagaugcuuaaacaaaggaaagaaagaaaga

SEQ ID NO: 42120 - RNA, 46 nt, Mus musculus
uuuauagaguuguuuuauagugcauacaaaucagcauucggccaac

SEQ ID NO: 42121 - RNA, 42 nt, Mus musculus
agucuguuagucuucagaaagacagugcucccccacccccuu

SEQ ID NO: 42122 - RNA, 46 nt, Mus musculus
uuguaugcacaagguaaggcuuauuucacagaaaccagaaugccag

SEQ ID NO: 42123 - RNA, 105 nt, Mus musculus
cauucuaucacacguuugugcauuuucauguuacacugcaauuacuuaaacucuccccuguccuuccaaauuaauuuccaaaguuggaguauagucuuuccccug

SEQ ID NO: 42124 - RNA, 62 nt, Mus musculus
caguguucuacucuccaccucuugcucugcagucaccuugcccuuccucccaccauuugagu

SEQ ID NO: 42125 - RNA, 121 nt, Mus musculus
uuggggaaaaauucaguuuaauaaacguuccauguaacugcauccaaguuucaccaggcuggagacguggaucuuuucuguguagugacuuuuuacuucuaguuuccauaaccuggagauc

SEQ ID NO: 42126 - RNA, 23 nt, Mus musculus
gggagugugggggcagagcagaa

SEQ ID NO: 42127 - RNA, 44 nt, Mus musculus
ggaggaguggauguuagggggacaggggagaaggacugggcaga

SEQ ID NO: 42128 - RNA, 42 nt, Mus musculus
uguuccaguguccugugaaguguggagggaccacccacccca

SEQ ID NO: 42129 - RNA, 45 nt, Mus musculus
ccaaggaacaaggccagggaagucgccaugcggagggagacagag

SEQ ID NO: 42130 - RNA, 44 nt, Mus musculus
cgacuucccuggccuuguuccuugggaccagugaacccaccaca

SEQ ID NO: 42131 - RNA, 45 nt, Mus musculus
cuuugccgugaaaauuaaguccaguggauggucagcaaccuagag

SEQ ID NO: 42132 - RNA, 70 nt, Mus musculus
gugcaugcauguguguguggguagggguaucuguguaucuguucguguuugugugugucugucugugugu

SEQ ID NO: 42133 - RNA, 47 nt, Mus musculus
ccugugugucuguguauacaugcauauuugugugcauaugucuuugu

SEQ ID NO: 42134 - RNA, 25 nt, Mus musculus
guacacuggcacugcuggcaccuga

SEQ ID NO: 42135 - RNA, 42 nt, Mus musculus
ccuggcacagaacauugaggacaaaaugaguuccuccuaaga

SEQ ID NO: 42136 - RNA, 46 nt, Mus musculus
cugauggaggguggggguauccaaggggccuacagagagggguggg

SEQ ID NO: 42137 - RNA, 46 nt, Mus musculus
auaugaccuugaaugauaaagguuaauaguaugacaggggacagau

SEQ ID NO: 42138 - RNA, 45 nt, Mus musculus
uguccucgugcucugugcuuucagaugcugaucucugcgccccca

SEQ ID NO: 42139 - RNA, 41 nt, Mus musculus
ugugcugcagcuucuggccacgugcacagacucgggcugau

SEQ ID NO: 42140 - RNA, 24 nt, Mus musculus
guggcugaaucugcaauggaacau

SEQ ID NO: 42141 - RNA, 42 nt, Mus musculus
aggcggagccagggcucccgucguucaaucacagcgcgagau

SEQ ID NO: 42142 - RNA, 42 nt, Mus musculus
uuauaugugccuauguaaaucacauguauauaggugccagua

SEQ ID NO: 42143 - RNA, 44 nt, Mus musculus
gagggaggagagaaagaaggaggaaggaaggagagagggaggga

SEQ ID NO: 42144 - RNA, 44 nt, Mus musculus
aacuauauagauguaaauggcuagaaaucaugugcuuagcuagu

SEQ ID NO: 42145 - RNA, 46 nt, Mus musculus
augauuauaaacaagguuauaucuauaucuaucuacacacacacac

SEQ ID NO: 42146 - RNA, 48 nt, Mus musculus
ggccccuggggcacuugugguguaggcugaagagaugggggcugcugc

SEQ ID NO: 42147 - RNA, 46 nt, Mus musculus
gucaaaauacaaucuaaaaauaggcagucuggugaggagcagagac

SEQ ID NO: 42148 - RNA, 45 nt, Mus musculus
cugcucaagggcagguucuuccuucaaggucacuguggggcagcu

SEQ ID NO: 42149 - RNA, 46 nt, Mus musculus
augccccaguauaggggaaugucagggccaggaagcgggagugggu

SEQ ID NO: 42150 - RNA, 46 nt, Mus musculus
cucauccuguaagaguuacagcacacugagcacagggucccaaugg

SEQ ID NO: 42151 - RNA, 45 nt, Mus musculus
ccuggaccacacucaacgcccuugugaaaaaaagaucauggagau

SEQ ID NO: 42152 - RNA, 44 nt, Mus musculus
uguguguguauauguguguguguguauguguguguguauaugug

SEQ ID NO: 42153 - RNA, 42 nt, Mus musculus
uauguguauguguauguauguguguguauguguguguauaug

SEQ ID NO: 42154 - RNA, 46 nt, Mus musculus
guguauguguauguauguguguguauguguguguauaugugugugu

SEQ ID NO: 42155 - RNA, 85 nt, Mus musculus
uauguguguauauguguauguauguguguguguauguguguguauauguguguguauauguguauguauguguguguguaugugu

SEQ ID NO: 42156 - RNA, 41 nt, Mus musculus
uaggagguguagcagcucccucaggaggauccuugggguca

SEQ ID NO: 42157 - RNA, 45 nt, Mus musculus
caccucuccaucuuacccagggcauugcccaagaugccuugccua

SEQ ID NO: 42158 - RNA, 42 nt, Mus musculus
cccugaggccccggggcuggcagccugcacccccacccccac

SEQ ID NO: 42159 - RNA, 42 nt, Mus musculus
ccuccucccgcccuccgggccggcguuacgcugcccccugcc

SEQ ID NO: 42160 - RNA, 46 nt, Mus musculus
uaguugaccacaccacuuagcuucuuuuugguaauaagugcaagcc

SEQ ID NO: 42161 - RNA, 49 nt, Mus musculus
guggcacaccccuuuaaucccagcacugggagagccaggggcugguaga

SEQ ID NO: 42162 - RNA, 41 nt, Mus musculus
uaagccgggcgugguggcgcauaucuuuaaucccagcacuu

SEQ ID NO: 42163 - RNA, 46 nt, Mus musculus
cagauucuggcuucucuuuuccucccuccugauuaaggccucagau

SEQ ID NO: 42164 - RNA, 46 nt, Mus musculus
uugaguuccacccccaauggcucacaaucaccugcuaacuccagcu

SEQ ID NO: 42165 - RNA, 47 nt, Mus musculus
gaaacaccaccaccaccaaaaccaaaaccaagagagagagagagaga

SEQ ID NO: 42166 - RNA, 42 nt, Mus musculus
aaguuauuuuguaaacaaaaauucagggacccaagggcaaga

SEQ ID NO: 42167 - RNA, 46 nt, Mus musculus
accuuauugaagauguuacauuuuuguacaccuccuacccccacca

SEQ ID NO: 42168 - RNA, 45 nt, Mus musculus
gcuaagccaugacaaaugaaacaaauggcucugcuccaccucagg

SEQ ID NO: 42169 - RNA, 45 nt, Mus musculus
gacaucacuacccaucucuguguccuuauccaauucuaagcagca

SEQ ID NO: 42170 - RNA, 42 nt, Mus musculus
caucauuuguauuuucuguagaaaaugugcacgcccugaaac

SEQ ID NO: 42171 - RNA, 45 nt, Mus musculus
aaaaaaaagagagagagaaagagagagagagagagagaaagagac

SEQ ID NO: 42172 - RNA, 29 nt, Mus musculus
uauuugcuuccaauuucugggaggcucaa

SEQ ID NO: 42173 - RNA, 45 nt, Mus musculus
uaccucacccacuugcacacugcagggagcucagguuggguagau

SEQ ID NO: 42174 - RNA, 46 nt, Mus musculus
gugaccccaacuccuccaucuuccucacugacacggccaagcagau

SEQ ID NO: 42175 - RNA, 46 nt, Mus musculus
aggacagauauccagugccucaucccgugugccauugaccaggauc

SEQ ID NO: 42176 - RNA, 45 nt, Mus musculus
aauggcacacgggaugaggcacuggauaucuguccugucucggaa

SEQ ID NO: 42177 - RNA, 39 nt, Mus musculus
uuuccugcuguccaggccgcgccaucguucagcaacucu

SEQ ID NO: 42178 - RNA, 44 nt, Mus musculus
cucaggguguuucuguggacagugcacagcaugggaugcaccga

SEQ ID NO: 42179 - RNA, 45 nt, Mus musculus
cucuaccaaacugcacugcugguguaucugugaaguguuugccag

SEQ ID NO: 42180 - RNA, 46 nt, Mus musculus
cgauggucacucauauuuggcuccagaauaaauaucuuauucucug

SEQ ID NO: 42181 - RNA, 41 nt, Mus musculus
uugucaccaacuagaccacagggagucccaagaaagaggca

SEQ ID NO: 42182 - RNA, 46 nt, Mus musculus
ggggugagaggacagacguuacgacacggcucugucauugccaaag

SEQ ID NO: 42183 - RNA, 41 nt, Mus musculus
cagaaacccggggcgcccacagaagaaucucuuaccuggug

SEQ ID NO: 42184 - RNA, 51 nt, Mus musculus
ugccgaaaggccagugcuggggaccuucucccaaagccagccccuuagccu

SEQ ID NO: 42185 - RNA, 48 nt, Mus musculus
uuuucucacuagugugggcagcgcgguagagacccugauuaagaaaag

SEQ ID NO: 42186 - RNA, 46 nt, Mus musculus
gguuuugguggcugaaagccccccuuagaaucgcauuaauggugag

SEQ ID NO: 42187 - RNA, 45 nt, Mus musculus
agccaucuuuuucuccuagccagguucucggcggaacgugggcgu

SEQ ID NO: 42188 - RNA, 46 nt, Mus musculus
auccagauacucggguuuaguauagaccuaaccucgggcaaaauau

SEQ ID NO: 42189 - RNA, 53 nt, Mus musculus
caaaaaauauuaauuaauuaggcgucauccauaagggucuugagaguugacgu

SEQ ID NO: 42190 - RNA, 125 nt, Mus musculus
ucgaguaccugcugugcaccucuaccuccugguaccccagccacucccucaaguugccugcauguuauauggccugugagcucuccugcccauugcacauucaucacccccagacccauuagcca

SEQ ID NO: 42191 - RNA, 49 nt, Mus musculus
ccaaggagcacggauuccaggaacccacuaccauacagagcaacuccuu

SEQ ID NO: 42192 - RNA, 46 nt, Mus musculus
cuccguggguggggugggguggggugcuuccuucuggaaugagcac

SEQ ID NO: 42193 - RNA, 46 nt, Mus musculus
uaaaugaacugcagcagccugaggcagggcugggcagagaccucag

SEQ ID NO: 42194 - RNA, 46 nt, Mus musculus
uuccugucauucaugugucaaaggggguagccuagugucuagagag

SEQ ID NO: 42195 - RNA, 45 nt, Mus musculus
cuugccacauuagguaagagaaggggucaaaguuggacacgggug

SEQ ID NO: 42196 - RNA, 46 nt, Mus musculus
ccaaacuacauaacucacaagaaagugccuuguaaaucgcccggaa

SEQ ID NO: 42197 - RNA, 45 nt, Mus musculus
cagcacuuucuuuggccuuuuaaaccaaccauuuuuguccagaca

SEQ ID NO: 42198 - RNA, 45 nt, Mus musculus
ggacaaugguguccaggccccugaaaggggcugauuggauuauga

SEQ ID NO: 42199 - RNA, 43 nt, Mus musculus
gcgguuuccgacggggcccccccacauaacguuagccucgcgg

SEQ ID NO: 42200 - RNA, 46 nt, Mus musculus
ucgggacuccuggcuccacugugcucaccuggagccccgccagccc

SEQ ID NO: 42201 - RNA, 63 nt, Mus musculus
gcucuucuuacuuucccugggagcuuacauuccuagccccucucaguuucccaaaccugccuu

SEQ ID NO: 42202 - RNA, 46 nt, Mus musculus
caggguuaauaggcuucacuuggaaggccaggugagcuuccaucag

SEQ ID NO: 42203 - RNA, 63 nt, Mus musculus
agauauuccugagcaaaugcaauuugggacacaaguuuucucaaaguuagguucccacagaga

SEQ ID NO: 42204 - RNA, 42 nt, Mus musculus
agugacacaucccaggaagucuccguaucacauagccccauu

SEQ ID NO: 42205 - RNA, 84 nt, Mus musculus
gagcuccaaucgucaucucauaaggagcccucuuugucugcgaaggaaaaacacugauuaucauaaugagcugagcugguggcu

SEQ ID NO: 42206 - RNA, 42 nt, Mus musculus
ccaaggagggggagggaggaggcaggaaaagcacugcccccc

SEQ ID NO: 42207 - RNA, 46 nt, Mus musculus
cauucagagggcauggggugggccugguuugccugcccugccuuca

SEQ ID NO: 42208 - RNA, 42 nt, Mus musculus
auucccuccugcaagcugcuggcugcaguuuucagggccccu

SEQ ID NO: 42209 - RNA, 45 nt, Mus musculus
uguauucaaaaguacauuucucuaaaugaugucaaaaccuggcaa

SEQ ID NO: 42210 - RNA, 45 nt, Mus musculus
auguuuguuuucucaucuuccuucauccccaaguccagggugugu

SEQ ID NO: 42211 - RNA, 41 nt, Mus musculus
cucaagcaggaugugugugggagaggaauuaauuaagguga

SEQ ID NO: 42212 - RNA, 46 nt, Mus musculus
cuagcuucgaugaguuucccagguccugugaauggcuccugucaau

SEQ ID NO: 42213 - RNA, 46 nt, Mus musculus
guguguguguguguguguguguguguguguguguugcaccuaggag

SEQ ID NO: 42214 - RNA, 46 nt, Mus musculus
gcccaaagcccaaaagaugcuuuagagacagaauggggccaaggga

SEQ ID NO: 42215 - RNA, 42 nt, Mus musculus
uguaaucagacacaguccuuguuuaaccagagaagggcacgc

SEQ ID NO: 42216 - RNA, 46 nt, Mus musculus
aucagugagauauuuguacccaaaacaagaucaguuagguccugug

SEQ ID NO: 42217 - RNA, 42 nt, Mus musculus
aaggccaaaauauuuuuauauugcuguagacaaagccaccua

SEQ ID NO: 42218 - RNA, 45 nt, Mus musculus
agguuucucauggggauggccauucacuagagcccagaggggcag

SEQ ID NO: 42219 - RNA, 46 nt, Mus musculus
ccuaaggaguuuuuuuaauugaagaaggaaucuuacauaacagaag

SEQ ID NO: 42220 - RNA, 45 nt, Mus musculus
gagguuuuugaagccccuuaauauaaacagacagacaauggcgug

SEQ ID NO: 42221 - RNA, 50 nt, Mus musculus
gucuggguaccccagcuccaaggggaugagaggcagcaagugagaggaca

SEQ ID NO: 42222 - RNA, 63 nt, Mus musculus
ucucccagcaaagaaaagaaaggcuuaaauacuaaaaagaaggaaagcuggaagaaaggaugg

SEQ ID NO: 42223 - RNA, 46 nt, Mus musculus
cggagaauaaaagggcgagggagugauagagaguaacaauaagaug

SEQ ID NO: 42224 - RNA, 65 nt, Mus musculus
gccaacucaagcccugucagggauuuaaaaaaagguacaaaggcgauaaaggaagacacaugcaa

SEQ ID NO: 42225 - RNA, 51 nt, Mus musculus
gacagacacagcgaaaaggcugaggacaugccugagagggucgcgaaggga

SEQ ID NO: 42226 - RNA, 46 nt, Mus musculus
gagguccauaaauaaaagaauaaauauugaaauaaaggagugacag

SEQ ID NO: 42227 - RNA, 55 nt, Mus musculus
gagaagaugcagggagaagaggggaagggaaaggcaugagagcaaaugaaagaga

SEQ ID NO: 42228 - RNA, 45 nt, Mus musculus
aaggagaauggagagaauuaaaaaaaaaagacgcaaaaaaaggag

SEQ ID NO: 42229 - RNA, 69 nt, Mus musculus
uaaauaacggaaaauacuuaaauguaaaaggugaccagacagagggagaagauugcaagcccagauaca

SEQ ID NO: 42230 - RNA, 78 nt, Mus musculus
aggaaauuaauagauuuaaaaaaaaaauccaaacuaagacugggagaaaaaacaaggaagagagggaagcgagaucug

SEQ ID NO: 42231 - RNA, 31 nt, Mus musculus
acauccggacuuagaaaagugaguuugucag

SEQ ID NO: 42232 - RNA, 83 nt, Mus musculus
agccauuguuguccccagaggaaucaaaucuuacugcuuuugugaaggaagagaggauggcaacgauauugcaggaaaagagg

SEQ ID NO: 42233 - RNA, 79 nt, Mus musculus
ccucucugggaaaggaucucuucugauccugaugggaaggggcuuagccagccaaagggcagggauaggaggcuuuguc

SEQ ID NO: 42234 - RNA, 49 nt, Mus musculus
ccuggaagccuagaggcccaagaggcccgggugaagcaaguaucucuga

SEQ ID NO: 42235 - RNA, 50 nt, Mus musculus
augauccuaggucccagauaugccaccccuggagcccguuucaaggccca

SEQ ID NO: 42236 - RNA, 53 nt, Mus musculus
ucuagugucccccacccccugggacucuuugcuuuugcccaguuuucuuucuc

SEQ ID NO: 42237 - RNA, 42 nt, Mus musculus
acacagccuaaccuugucagaagccaccuucugugcccccag

SEQ ID NO: 42238 - RNA, 45 nt, Mus musculus
gggaugggucucuaggugggccuugucucaacauucaugccagaa

SEQ ID NO: 42239 - RNA, 42 nt, Mus musculus
uuaaucugaucuugaauaacaaaugucucuaguucugggguu

SEQ ID NO: 42240 - RNA, 41 nt, Mus musculus
gugugugcaugugugcgugugcguguguguguguguaaggg

SEQ ID NO: 42241 - RNA, 46 nt, Mus musculus
uauagcacuuagcgugucugccuguguucagcccucucaccccaug

SEQ ID NO: 42242 - RNA, 46 nt, Mus musculus
ggcuauccaucuagccaucugucagucaauccauccauccauccau

SEQ ID NO: 42243 - RNA, 46 nt, Mus musculus
ccuggugcuuugggccucucucccucuccugaaagcaaaccccuuc

SEQ ID NO: 42244 - RNA, 46 nt, Mus musculus
uguguggccaauaagaggagcuccuugauuucaauucaaacuucag

SEQ ID NO: 42245 - RNA, 47 nt, Mus musculus
aaucagcaaacuguguucccugggugcucagaaaucauagcccagau

SEQ ID NO: 42246 - RNA, 45 nt, Mus musculus
gagcucagcuaaugcuuggcuccuuuuuagagaaaauugcaggag

SEQ ID NO: 42247 - RNA, 44 nt, Mus musculus
aauguccucucucccacuaacagcaucaggccaaacugccugag

SEQ ID NO: 42248 - RNA, 46 nt, Mus musculus
aacccauaucaagccaucucucuuccuuaacauguuaagcagccac

SEQ ID NO: 42249 - RNA, 45 nt, Mus musculus
agaguaaggcggccaucggugcccaggguguagaguagccgguug

SEQ ID NO: 42250 - RNA, 44 nt, Mus musculus
acccugaggaugacgucuuuccugacccuuaccagcaccgguac

SEQ ID NO: 42251 - RNA, 41 nt, Mus musculus
gcgauggcuguggccaugccacuacucgcaaugagggucga

SEQ ID NO: 42252 - RNA, 60 nt, Mus musculus
aggggcugccuugcucucaacaucaccaggacagcugccacacccaggagacucuuccag

SEQ ID NO: 42253 - RNA, 46 nt, Mus musculus
accauauccucaauggcuuacuggcucacuucaguguggcccagau

SEQ ID NO: 42254 - RNA, 45 nt, Mus musculus
uccucuucuuccuccucuuccucuuccuccuccucuuccuccuca

SEQ ID NO: 42255 - RNA, 131 nt, Mus musculus
aagaagaaggggaggaggagggagaggaggaggaagaaggagaggaggaagaggaggaagaagaggaugaggaggaagaggaggaggaagaggaagaggaggaagaagaggaggaagaagaggaggaggag

SEQ ID NO: 42256 - RNA, 103 nt, Mus musculus
caccaucuuccuccuccuccccuucuucuucuucaccaucuuccuccuccuccccuucuucuucuucaccaucuuccuccuccuccccuucuucuucuucauc

SEQ ID NO: 42257 - RNA, 134 nt, Mus musculus
ugaagaagaagaggaggaggaggaagaugaugaagaagaagaaggggaggaggaggaagauggugaagaagaagaaggggaggaggaggaagauggugaagaagaagaaggggaggaggaggaagauggugaag

SEQ ID NO: 42258 - RNA, 71 nt, Mus musculus
caccaucuuccuccuccuccccuucuucuucuucaccaucuuccuccuccuccccuucuucuucuucacca

SEQ ID NO: 42259 - RNA, 80 nt, Mus musculus
gaggaggaagauggugaagaagaagaaggggaggaggaggaagauggugaagaagaagaaggggaggaggaggaagaugg

SEQ ID NO: 42260 - RNA, 46 nt, Mus musculus
cagcagugggcgcagaaaccuugcucugaagccucucugguuccaa

SEQ ID NO: 42261 - RNA, 43 nt, Mus musculus
caaaauugaagugugagaagaagaagacccaaugcccggggag

SEQ ID NO: 42262 - RNA, 41 nt, Mus musculus
ucaucugccucccucggguuaaacacgucggccaggucuga

SEQ ID NO: 42263 - RNA, 42 nt, Mus musculus
gcgaugcaugguggagguggggugaagcaauuccgcagacag

SEQ ID NO: 42264 - RNA, 45 nt, Mus musculus
aaccugauuguacuuguccugcaacuugaagaaaagcuggcagag

SEQ ID NO: 42265 - RNA, 46 nt, Mus musculus
aagaggaggaagaggaagguggugaagaggaaggucagcccaagaa

SEQ ID NO: 42266 - RNA, 46 nt, Mus musculus
cugguaggggccacuggauggcuccuccacuucccggaguagauca

SEQ ID NO: 42267 - RNA, 46 nt, Mus musculus; identical to SEQ ID NO: 42266

SEQ ID NO: 42268 - RNA, 47 nt, Mus musculus
gugggggccacuggauggcuccuccacuucuuggaguagaucagugg

SEQ ID NO: 42269 - RNA, 42 nt, Mus musculus
ccccugccugggcccccgccugggcuccacugcugccuggug

SEQ ID NO: 42270 - RNA, 46 nt, Mus musculus
gagaccgcaacuguggagaccaaaaccuagggacagagggauaaaa

SEQ ID NO: 42271 - RNA, 42 nt, Mus musculus
ccgcccccaugcaaaaggaucagaaaugauaucucaccccuc

SEQ ID NO: 42272 - RNA, 46 nt, Mus musculus
agcugcuccugagccuaaacuuuccuuucaaggcaugugggcagag

SEQ ID NO: 42273 - RNA, 66 nt, Mus musculus
gagaagaucuuagaacccuaacuauagcuacuaacccccucgguaagaucagggaagcaaugcccc

SEQ ID NO: 42274 - RNA, 48 nt, Mus musculus
uaaggccuucucaggauuuuggaauucagaggaaaacaaaggaaaaga

SEQ ID NO: 42275 - RNA, 46 nt, Mus musculus
gaggaaaauguucccccauggguacauugcagacguugagggucgg

SEQ ID NO: 42276 - RNA, 46 nt, Mus musculus
ccaugugguuguaggacugagccccucccucaucuauagcccccuc

SEQ ID NO: 42277 - RNA, 45 nt, Mus musculus
ugcuuggccauaacaaagauccauugccuuucugaugacacccag

SEQ ID NO: 42278 - RNA, 46 nt, Mus musculus
uguucucugcaaggaucagcgaggagggcacaccacacacacccac

SEQ ID NO: 42279 - RNA, 46 nt, Mus musculus
uacuucggagaccgccccucuaagcagagggccaugucgccugcug

SEQ ID NO: 42280 - RNA, 45 nt, Mus musculus
auggaaugacacacuccugugcacacaccuguacacacaugcacc

SEQ ID NO: 42281 - RNA, 31 nt, Mus musculus
agcugugacaaaucaguuauaaaacauacag

SEQ ID NO: 42282 - RNA, 46 nt, Mus musculus
ucucaacaaauccuuuaaucacaaaacaacaucacaacagcaccag

SEQ ID NO: 42283 - RNA, 41 nt, Mus musculus
ccaggcugccuccccagcaaccuuaacccagaagcagccag

SEQ ID NO: 42284 - RNA, 42 nt, Mus musculus
ucaggguccucucugugcugucgucaauagcaaaacccccac

SEQ ID NO: 42285 - RNA, 42 nt, Mus musculus
caccaguugcuagggagaagccucugaaugcaaagcccccug

SEQ ID NO: 42286 - RNA, 46 nt, Mus musculus
aaagucucaugaucuccauuggauuggugaagacaccauggcacag

SEQ ID NO: 42287 - RNA, 46 nt, Mus musculus
agaaauggaaacugaaccuucugagagacaaucccauuccugugug

SEQ ID NO: 42288 - RNA, 46 nt, Mus musculus
ggcaaauuagagacagguacacacgcaucccccagccucauuucaa

SEQ ID NO: 42289 - RNA, 42 nt, Mus musculus
gauuaucuuugcuaagggaucagaggcguggauguuugguag

SEQ ID NO: 42290 - RNA, 42 nt, Mus musculus
ucuguguuuauuguauuuaaaauguaugaaaacacugggaag

SEQ ID NO: 42291 - RNA, 42 nt, Mus musculus
ucaauguuuauaaaaaagaacugcuuugggguuggggguuuu

SEQ ID NO: 42292 - RNA, 42 nt, Mus musculus
gcccuaaugugaauggagacuagccugcugguagagaccuug

SEQ ID NO: 42293 - RNA, 44 nt, Mus musculus
gagccguccugggcuacauauugggaucuuaucuaagagagaga

SEQ ID NO: 42294 - RNA, 48 nt, Mus musculus
caaagcaaaacaaaaccuaaaaggagcauuaaaaggaugccaugauug

SEQ ID NO: 42295 - RNA, 46 nt, Mus musculus
uucacagucuguuggguacccucucgccccauugaaugaauagcag

SEQ ID NO: 42296 - RNA, 46 nt, Mus musculus
uacauagguguauuaaagugucccccauagacauuuuuggcguggu

SEQ ID NO: 42297 - RNA, 45 nt, Mus musculus
uuggggaaaacgacuacuaauucuguggggaauggacacuugaua

SEQ ID NO: 42298 - RNA, 48 nt, Mus musculus
caucacauauauauauaaacacaucaaugaauaaagcagcaagcacug

SEQ ID NO: 42299 - RNA, 45 nt, Mus musculus
caucugugacuuguauuauaaugggacagauucaggaaugaauaa

SEQ ID NO: 42300 - RNA, 45 nt, Mus musculus
ggaucucucagugccuuuaaccacugagucauuuugccagcccag

SEQ ID NO: 42301 - RNA, 46 nt, Mus musculus
uugaguuguauuaaccagaaauuuuaauuucuaugccuguuccuag

SEQ ID NO: 42302 - RNA, 45 nt, Mus musculus
uuuuuaugaucuugcagagcugaagucugcuaaucauggaggcuu

SEQ ID NO: 42303 - RNA, 45 nt, Mus musculus
gugcaaauagacagacacacacacacacacacacacacacacaca

SEQ ID NO: 42304 - RNA, 46 nt, Mus musculus
ggcacagccuugcugagguucaucccugggacacugacauucacug

SEQ ID NO: 42305 - RNA, 49 nt, Mus musculus
agucugaaguucugagucucacugugaggggaaacagccaccauuguua

SEQ ID NO: 42306 - RNA, 71 nt, Mus musculus
aaaucuguaagugcauggaaagaaaugaagcagagccauggguggucggaucaguuaugaugacguggauu

SEQ ID NO: 42307 - RNA, 63 nt, Mus musculus
cuauggguuucuaaggaaagccugucagaguuggcuccugggaugaguagggggaagggagau

SEQ ID NO: 42308 - RNA, 46 nt, Mus musculus
cauucagguuucacaggauguacauaggaauuuaaguauaugucag

SEQ ID NO: 42309 - RNA, 49 nt, Mus musculus
aggggguguauuuugaauagcugcuauauuuuuaauagugacagggcuu

SEQ ID NO: 42310 - RNA, 82 nt, Mus musculus
accuaacuaggcucucuuugaauuucuaaaucuugcuaaguguauuuuucuuccacaaaaugcucacagacagcugacuuac

SEQ ID NO: 42311 - RNA, 56 nt, Mus musculus
ugaguuuuacuaagaaacaaaaucacacacgguauagcucuacacauaaggaacag

SEQ ID NO: 42312 - RNA, 55 nt, Mus musculus
aggauacagcuuucaaacaauaaguuaagcucuguaagaauggaccgguggugag

SEQ ID NO: 42313 - RNA, 54 nt, Mus musculus
gaacauuguguuguguccuauggacuaaugaguuggcccgacgagggguggaag

SEQ ID NO: 42314 - RNA, 46 nt, Mus musculus
uuccuaccacauugauuugaagauuugccuaucaguguggcccugg

SEQ ID NO: 42315 - RNA, 46 nt, Mus musculus
uauuguguuguguccuauggaauaaugauuuaacacgagaggagag

SEQ ID NO: 42316 - RNA, 45 nt, Mus musculus
ugauagacauguggauacauugguuucuuuauuucuauacuagca

SEQ ID NO: 42317 - RNA, 46 nt, Mus musculus
ucauucccagcuaggguuuuacuuuucuaaugaaauuagccugugg

SEQ ID NO: 42318 - RNA, 64 nt, Mus musculus
guaggaccccugauuuaauuauuuacuguggaaccauuguccugagucaggaggauagaugagg

SEQ ID NO: 42319 - RNA, 42 nt, Mus musculus
agaucuugccuguuaaccucuagagaaggagggacgauacag

SEQ ID NO: 42320 - RNA, 46 nt, Mus musculus
gagagaaguagauaguuacaguaccaacgaaauuagagaaaccuaa

SEQ ID NO: 42321 - RNA, 45 nt, Mus musculus
auauuauaagucauagacgaugacaacauacuggauucugagguu

SEQ ID NO: 42322 - RNA, 46 nt, Mus musculus
auauugugaucaaugaauuacgauauaaacauaaauacacuugcag

SEQ ID NO: 42323 - RNA, 41 nt, Mus musculus
uuuccaaaauuuagagaaaugacagagagucacaggggcac

SEQ ID NO: 42324 - RNA, 46 nt, Mus musculus
auucuaauugauccauauaguuguuaauaaaaggggaaagugugag

SEQ ID NO: 42325 - RNA, 55 nt, Mus musculus
ucauuuuaauuagugacgaauaguugugucaaucaucaaacaugcuuguauaauu

SEQ ID NO: 42326 - RNA, 76 nt, Mus musculus
uacaguagauauuagccaugcacucucaccauuucauaguagaucacagaaucaagauacaaaucuccaugcacgg

SEQ ID NO: 42327 - RNA, 46 nt, Mus musculus
gggaagaaaccaggggauaaauauggaggccuuuacugaagcagag

SEQ ID NO: 42328 - RNA, 46 nt, Mus musculus
uucauagcuuguuuuuuauagcuccaaagaguauuuaacgcacacc

SEQ ID NO: 42329 - RNA, 46 nt, Mus musculus
uggaguguugguaaugcuuuucugguuucaaaguucauguguucag

SEQ ID NO: 42330 - RNA, 45 nt, Mus musculus
cauaucuuacacuaucucauccauaacccugauacuaguggcaga

SEQ ID NO: 42331 - RNA, 47 nt, Mus musculus
ccaucauuauauuaaaaaauacaguaauuuaugaaaacaggaugacu

SEQ ID NO: 42332 - RNA, 46 nt, Mus musculus
augcgucugagagucugagguucacaucguaauauauguagagcau

SEQ ID NO: 42333 - RNA, 46 nt, Mus musculus
auuucuaauaagacauaauuccauagcaauaauguuaagcacauag

SEQ ID NO: 42334 - RNA, 45 nt, Mus musculus
gagauaguaauagaauaaugaagaccucaugagggauauggugga

SEQ ID NO: 42335 - RNA, 46 nt, Mus musculus
uucaauucccagcaaccccaugguggcucacaaccaucuguaaggg

SEQ ID NO: 42336 - RNA, 105 nt, Mus musculus
uaacugcacucacggaucuuauaguuagggcuugucuccaguggagauuuucgcaaugguccuagucauccauugcucaauaauuuuacauagauuaguagggaa

SEQ ID NO: 42337 - RNA, 46 nt, Mus musculus
agcauucuuagagucaugaaucaugacgacaaauuuaauucugaga

SEQ ID NO: 42338 - RNA, 66 nt, Mus musculus
cauauauguauauauguauauauguaagaagaaagugugacagaguaaugaccauggaggugaggg

SEQ ID NO: 42339 - RNA, 45 nt, Mus musculus
ucccuugaaaguggaccucaugaucuagccuuuauguccguggau

SEQ ID NO: 42340 - RNA, 59 nt, Mus musculus
uucauuuagauauucucucuuauucauaaaugucacggucagcucuguucuuauagaua

SEQ ID NO: 42341 - RNA, 46 nt, Mus musculus
agucuugaccucugguagcacacgauuuguggaugauggguacagg

SEQ ID NO: 42342 - RNA, 45 nt, Mus musculus
uuaucucaguuguacucauaguuaaugucucauaagucaagagca

SEQ ID NO: 42343 - RNA, 47 nt, Mus musculus
gaauggauaccccuaagcugauguauauacacccuuccucgguugug

SEQ ID NO: 42344 - RNA, 40 nt, Mus musculus
uaugaguuguggaucaugaguacaugucuggaagucugag

SEQ ID NO: 42345 - RNA, 46 nt, Mus musculus
gacauccuucuacagcaagaguccuacuaauguaaaccaaacagag

SEQ ID NO: 42346 - RNA, 44 nt, Mus musculus
uggugccguaugagucggggaucaugaucacaggucugggaguc

SEQ ID NO: 42347 - RNA, 46 nt, Mus musculus
cagagugaguauaaucuuguuguuuuguuuguuugucuguuuauag

SEQ ID NO: 42348 - RNA, 42 nt, Mus musculus
cagaugaguuaugcaucauggucacaggucugcgaguccgag

SEQ ID NO: 42349 - RNA, 84 nt, Mus musculus
aaaggccaacuucacaucaauggguggaucguaccucggccuaagcuccaggauugauugugcuguuagagucacagcuacaac

SEQ ID NO: 42350 - RNA, 46 nt, Mus musculus
agcacuaccuauaauuuguacacacacacauacaaaaaaaugccag

SEQ ID NO: 42351 - RNA, 46 nt, Mus musculus
gcucagggaacccaguggaagaggagguggagugugagagccaauu

SEQ ID NO: 42352 - RNA, 84 nt, Mus musculus
cgagacacaagaggacugcugagcucacaaagacugaggcagcacccucaggaccugcacaggucuaagcuugaugcgaucuga

SEQ ID NO: 42353 - RNA, 45 nt, Mus musculus
aauuuuuugcaagguuuuucgacucauaguucuuugucuggguac

SEQ ID NO: 42354 - RNA, 46 nt, Mus musculus
uuucuuugcuucucuuuuuccuauucuuugcuuguauucccugguu

SEQ ID NO: 42355 - RNA, 46 nt, Mus musculus
agauaacuguguuuauucuaauguaugaaugaauaaaugggugugu

SEQ ID NO: 42356 - RNA, 46 nt, Mus musculus
augaaagaugaacgaaaugagacacuguauaaaaugaaggucacca

SEQ ID NO: 42357 - RNA, 46 nt, Mus musculus
ugagagacaccaaguguacagcacccaggaggcagagguagguaga

SEQ ID NO: 42358 - RNA, 45 nt, Mus musculus
accuacuaaaguagggcccugaaaucaacgugcugcaaagacaga

SEQ ID NO: 42359 - RNA, 60 nt, Mus musculus
uuaguggcaggucuuuauuauuguuuaccaguugggaaaguaacagauaaauguagaaga

SEQ ID NO: 42360 - RNA, 46 nt, Mus musculus
gguuugcacagucucacacagagcugagaacuacauuuugccauga

SEQ ID NO: 42361 - RNA, 46 nt, Mus musculus
agugucuuuuuaaaaaaaaauaguuuaugucuaaauaagaucugag

SEQ ID NO: 42362 - RNA, 46 nt, Mus musculus
ugaaauaggaacaaaguaauuuuaugguugggugugucacgagaag

SEQ ID NO: 42363 - RNA, 46 nt, Mus musculus
uucauuuccugggaguugacuguggagugauaguuaccagauggua

SEQ ID NO: 42364 - RNA, 46 nt, Mus musculus
gugcuuagccuauuuccuuugauaugaucaucuccagugccagcag

SEQ ID NO: 42365 - RNA, 45 nt, Mus musculus
aauccucuaguaggucugcauauaaagaaaauggugaugccccug

SEQ ID NO: 42366 - RNA, 45 nt, Mus musculus
auugaucacugcagagaauauggaaggccaggggugugugugugu

SEQ ID NO: 42367 - RNA, 46 nt, Mus musculus
caucuaagagauagaaaaauaaaggaaccuguucuuaggaggagau

SEQ ID NO: 42368 - RNA, 42 nt, Mus musculus
acaaucagucaaagugauuccauauacuauuaaggugcacag

SEQ ID NO: 42369 - RNA, 46 nt, Mus musculus
acaugugcacacauaugcaugcaugaagauacaaccagugcuagaa

SEQ ID NO: 42370 - RNA, 46 nt, Mus musculus
uauauuuuuguccaggagacauugucucguucugacaaaggcucag

SEQ ID NO: 42371 - RNA, 44 nt, Mus musculus
uucagggaagggucggucauaugucccguucaggacagccgcaa

SEQ ID NO: 42372 - RNA, 42 nt, Mus musculus
aucagccccuugcugaugguaugugagcagaugucuggccag

SEQ ID NO: 42373 - RNA, 46 nt, Mus musculus
gcugcuugggaaaccaccgaggacaugacaucuucaccgaagaaag

SEQ ID NO: 42374 - RNA, 46 nt, Mus musculus
uccauaaucuggugugugugugugugugugugugugugugugugug

SEQ ID NO: 42375 - RNA, 43 nt, Mus musculus
ccuagggaucuuguuaaaaagcagagucugauugaggggccaa

SEQ ID NO: 42376 - RNA, 23 nt, Mus musculus
uguagcagugagugguugcuguc

SEQ ID NO: 42377 - RNA, 47 nt, Mus musculus
gggcuagccgguguacccagggacuggaugagccaacaucagaugug

SEQ ID NO: 42378 - RNA, 46 nt, Mus musculus
uaucucagcuaaggcaaugacccuggaugcucugaaaggcugcuaa

SEQ ID NO: 42379 - RNA, 46 nt, Mus musculus
auccaaucugccugcagguuggugguuggaaaccauagcccuugga

SEQ ID NO: 42380 - RNA, 46 nt, Mus musculus
ugugccugcucaguggaccaggaugaacuguggucuuaggggugua

SEQ ID NO: 42381 - RNA, 46 nt, Mus musculus
ggaaacuguggaaccacgcccccucugguccaggaggacuaaccag

SEQ ID NO: 42382 - RNA, 28 nt, Mus musculus
guguaaaaugugucccucaaacauauua

SEQ ID NO: 42383 - RNA, 48 nt, Mus musculus
aaaugacaccaacuauuucggugacucuaucguuguuuggccauggcu

SEQ ID NO: 42384 - RNA, 69 nt, Mus musculus
cuacaagccacucaguuacucauuccuuaccaguuucaccaguccagggaagaucucuaagaaguagaa

SEQ ID NO: 42385 - RNA, 101 nt, Mus musculus
ccuggggaaacaguacucuguagacauggcagccgcaaggggcagcuucaguaguggcggaugcuaugagcaguaauauuugugguagaugaacgcacauu

SEQ ID NO: 42386 - RNA, 114 nt, Mus musculus
gaggaaucaaaucuucguucagauuuuuaaaugggaaagaauugauccuaaugaaaaugauuugaggaaauaacaagggaaauaaaagaaaugaaaauggcccaacagcacagu

SEQ ID NO: 42387 - RNA, 48 nt, Mus musculus
gugugguguuugagauggggaaaucuauggauauagacuagagcuagu

SEQ ID NO: 42388 - RNA, 47 nt, Mus musculus
ugaauaaguaaaagcacacccuuuuugaggaaauuaagaaacaggga

SEQ ID NO: 42389 - RNA, 45 nt, Mus musculus
uuuucaauguucuuucuuggcaaaacagaaagcuggcacccggag

SEQ ID NO: 42390 - RNA, 77 nt, Mus musculus
agcgcuggagacggagucaagguucuacauccagauccacaggcaggaagagagaaaugaaacccaggagcccaccc

SEQ ID NO: 42391 - RNA, 41 nt, Mus musculus
uguucucuguaucauuagaguuggguggauaagauggcuca

SEQ ID NO: 42392 - RNA, 42 nt, Mus musculus
ucauccugucugaagaucccucuucuuguaaaagcugugggg

SEQ ID NO: 42393 - RNA, 87 nt, Mus musculus
cugggauucuuaccuaaaaguuagugagaaaugaagacucuggaaagccggaaaaugcccagguuuuuaaugcacacacacugacag

SEQ ID NO: 42394 - RNA, 46 nt, Mus musculus
gguuucuugccuuaaggaguacagcgcccuucccgcuggagccuag

SEQ ID NO: 42395 - RNA, 46 nt, Mus musculus
cccuucacguugacgggacugcgccugggcaggccaggggugucac

SEQ ID NO: 42396 - RNA, 45 nt, Mus musculus
uacccaaaaacuuauaugccaauaaucuauaaccaacacaugcag

SEQ ID NO: 42397 - RNA, 46 nt, Mus musculus
cagucagaaacaaacaugaagugguuauauacauuuacauaguuag

SEQ ID NO: 42398 - RNA, 46 nt, Mus musculus
agcaacagucaggcaacaaaacaaagccacagacauaaacugacag

SEQ ID NO: 42399 - RNA, 46 nt, Mus musculus
uacuagcccugucccauuucacagacuuuacucacugcuggcccag

SEQ ID NO: 42400 - RNA, 45 nt, Mus musculus
gcccaucauguuuccguccuuauaccgcaacucaaagacccacug

SEQ ID NO: 42401 - RNA, 50 nt, Mus musculus
gagaaguaaagaugggggccaaguuacuccaagaugugcgccaagaucuu

SEQ ID NO: 42402 - RNA, 32 nt, Mus musculus
accguggcugaaugaacacgcacgagacguga

SEQ ID NO: 42403 - RNA, 45 nt, Mus musculus
uauuacagcucaggguuugguuugguuugguuugguuggguuggg

SEQ ID NO: 42404 - RNA, 47 nt, Mus musculus
uucaaaucccagcaaccacaugguggcucacaaccauccuuaaggag

SEQ ID NO: 42405 - RNA, 42 nt, Mus musculus
cuacacucuuguggcuucagcacuggggagguugggcaggag

SEQ ID NO: 42406 - RNA, 44 nt, Mus musculus
agaacgagguuacuucucagaagccucuuguauuuacuguccca

SEQ ID NO: 42407 - RNA, 46 nt, Mus musculus
agcgguugggugcucuuacccacugagccaucucaccagcccguug

SEQ ID NO: 42408 - RNA, 46 nt, Mus musculus
aaggcauagccaccaaaaaauuuuuaauacucaguauucagcccau

SEQ ID NO: 42409 - RNA, 46 nt, Mus musculus
ccuucuaguguuuuuggccacuuguuuucauagcuggucuccauua

SEQ ID NO: 42410 - RNA, 45 nt, Mus musculus
ugucucuugggaauaucagaagcuccauucauaaauccucgccaa

SEQ ID NO: 42411 - RNA, 46 nt, Mus musculus
gaaaaacucaugaggccucagcuucaccaagaauuacaggcagcua

SEQ ID NO: 42412 - RNA, 46 nt, Mus musculus
uuuacauauaauaaauaaauaaauaaauaaauaaauaaauagaaaa

SEQ ID NO: 42413 - RNA, 46 nt, Mus musculus
uguaaaacaauaaucugugugcuuugccacauauaauaaucccaag

SEQ ID NO: 42414 - RNA, 46 nt, Mus musculus
auaaagagauuugucagacagagaaagauaagaguugagggugugg

SEQ ID NO: 42415 - RNA, 42 nt, Mus musculus
uuaauccaccauagaggcugagccaugcugggccagguuggg

SEQ ID NO: 42416 - RNA, 45 nt, Mus musculus
ggggcugcugugcaggaagugcucaguaaagagaacugcugcucu

SEQ ID NO: 42417 - RNA, 44 nt, Mus musculus
ugcuucauguauuugaaggagggaaaguuguggaaaugacaguu

SEQ ID NO: 42418 - RNA, 47 nt, Mus musculus
cuggguugauugggaauaaacuuucccuuugaauugacaguuaaaga

SEQ ID NO: 42419 - RNA, 46 nt, Mus musculus
guuaacagaagcuggaguuggagucauugugggacuuuguguuugg

SEQ ID NO: 42420 - RNA, 45 nt, Mus musculus
uuaugcuuuaaugccagguuggcauuuggagcugaaaauugaaaa

SEQ ID NO: 42421 - RNA, 45 nt, Mus musculus
auuucucaggcacgagggcugcgagaguuucucagaguggcagga

SEQ ID NO: 42422 - RNA, 49 nt, Mus musculus
ugggacagguacauaggaggggaaaaggggggucuucacuuuacagaug

SEQ ID NO: 42423 - RNA, 47 nt, Mus musculus
ucugccugguucagccuggccuucucagcagcucaguuagucaggau

SEQ ID NO: 42424 - RNA, 46 nt, Mus musculus
acauucauccccuggaacugaaguuacagacaguuauuaccaacag

SEQ ID NO: 42425 - RNA, 47 nt, Mus musculus
aaauguguuuuuuuaaauaucacuuuuagaagguggaucguagugaa

SEQ ID NO: 42426 - RNA, 46 nt, Mus musculus
cagaacggggaaccaagacaacggcuucuaggcagagcagugugag

SEQ ID NO: 42427 - RNA, 46 nt, Mus musculus
cuuuggggcgcuuacugugguuccuucuuagaacugaacugaguug

SEQ ID NO: 42428 - RNA, 45 nt, Mus musculus
ccuucuucauuuuggcagagaucgagcgaacaguacacagucuag

SEQ ID NO: 42429 - RNA, 46 nt, Mus musculus
cggacuuguggcauucauaacguuuguauguguccuugcucuugag

SEQ ID NO: 42430 - RNA, 46 nt, Mus musculus
aucaggguugauugauauuauuuuuacauugucuggcaauccacag

SEQ ID NO: 42431 - RNA, 46 nt, Mus musculus
agaguccuggacucucagcugcuguacaagaacaugacggcugugu

SEQ ID NO: 42432 - RNA, 46 nt, Mus musculus
cccugcugggcuucugugcuggggcuuggcugcugugaucaccuag

SEQ ID NO: 42433 - RNA, 46 nt, Mus musculus
auuaagucagguaguaaggaaacccuggaauucugugagggcugag

SEQ ID NO: 42434 - RNA, 45 nt, Mus musculus
auguucaaccuguaguuuaaagugaccucccaauuucccaccaca

SEQ ID NO: 42435 - RNA, 45 nt, Mus musculus
cacucagccccaacauccauaccuuauccuacacuguuuccuuga

SEQ ID NO: 42436 - RNA, 46 nt, Mus musculus
ggacccaacagacccacagggccugucuuagcucuacccugcacag

SEQ ID NO: 42437 - RNA, 62 nt, Mus musculus
uauuggcuuuguauuuauuguaaauuagaauccaacccaaaaccaagaucuagaguauuuug

SEQ ID NO: 42438 - RNA, 24 nt, Mus musculus
uagaucuugguuuuggguuggauu

SEQ ID NO: 42439 - RNA, 51 nt, Mus musculus
uuguguaauuuugaacugaaauauccagcaguuuuggcagcuuuggugaga

SEQ ID NO: 42440 - RNA, 46 nt, Mus musculus
guguggugguacaggccuauaaccccagcacuggggagguggagga

SEQ ID NO: 42441 - RNA, 42 nt, Mus musculus
gugcuguccucaaccuggggcugggugggccagagcugcugg

SEQ ID NO: 42442 - RNA, 46 nt, Mus musculus
cucuguucaccuagcuaauucucagagcauuguacugugccuggau

SEQ ID NO: 42443 - RNA, 45 nt, Mus musculus
uucacagggaaguauugagucucaaucugaucccuuccuuaagga

SEQ ID NO: 42444 - RNA, 46 nt, Mus musculus
uauguguaucugugugugccugaaugaauguauuuggccugcagag

SEQ ID NO: 42445 - RNA, 46 nt, Mus musculus
guugugagccaccaugugguugcugggauuugaacucaggcucuuu

SEQ ID NO: 42446 - RNA, 46 nt, Mus musculus
uuuauauagaggaaaaaauagaccuuuugacaacagguucugauua

SEQ ID NO: 42447 - RNA, 109 nt, Mus musculus
gugaaggcaggugugaaccaaucccguaacuggaacagugugaaggcaggugugaaccaaucccauaacuggaacagugugaaggcaggugugaaccaaggacucuuga

SEQ ID NO: 42448 - RNA, 85 nt, Mus musculus
aggugugaaccaauccuguaacugggacagugugaaggcaggugugaaccaaucccauaacuggaacagugugaaggcaggugug

SEQ ID NO: 42449 - RNA, 160 nt, Mus musculus
aggcaggugugaaccaaucccguaacugggacagugugaaggcaggugugaaccaaucccauaacugggacagugugaaggcaggugugaaccaaucccguaacugggacagugugaaggcaggugugaaccaaucccguaacugggacagugugaaggc

SEQ ID NO: 42450 - RNA, 42 nt, Mus musculus
aacaaaaaacccacagacaccaguaaaagaucuggacaugau

SEQ ID NO: 42451 - RNA, 43 nt, Mus musculus
agaggggugguagcugaucagaacucaugcaggggcccaggga

SEQ ID NO: 42452 - RNA, 46 nt, Mus musculus
gaauuucagauaaaaaugaaacguuuucauuuucaguugccuaaga

SEQ ID NO: 42453 - RNA, 41 nt, Mus musculus
uggcucacaaccaucuguaaucugaucugauguccucuucu

SEQ ID NO: 42454 - RNA, 45 nt, Mus musculus
guugugcauuuuugccuacaucauaguauugagcaagugaacagu

SEQ ID NO: 42455 - RNA, 45 nt, Mus musculus
cccuuggaggauggucugcagggcuggucuuuggaagcccaguug

SEQ ID NO: 42456 - RNA, 45 nt, Mus musculus
aggaggcaaagguguguggaucuccgugaguucgaggccagccug

SEQ ID NO: 42457 - RNA, 45 nt, Mus musculus
ggaaaucaguauggaggcuccucaagcaauuaaauaaauaaauga

SEQ ID NO: 42458 - RNA, 42 nt, Mus musculus
guaaccaagaaaucuugcaauaauagaguuuaagcccaaugg

SEQ ID NO: 42459 - RNA, 47 nt, Mus musculus
acugcacagacaugggugagucaggaaagcaucuuaaugcuaguggg

SEQ ID NO: 42460 - RNA, 91 nt, Mus musculus
uuaaacuuuauuuuuaccuauagacuacaaagcaauuggcaagauaggagaggggacguuuucugaaguuaugaagaugcagagucugaga

SEQ ID NO: 42461 - RNA, 46 nt, Mus musculus
cuaggagaacccagccacaguguugucgugaaauuacgcagaggaa

SEQ ID NO: 42462 - RNA, 42 nt, Mus musculus
acuuauuacauauauguaaguauauuguagaaguccucagac

SEQ ID NO: 42463 - RNA, 42 nt, Mus musculus
agugugugcauugcuauucuuuuauuucacuuggcaccaggu

SEQ ID NO: 42464 - RNA, 41 nt, Mus musculus
accgcgaagguccucgagccggaagccaccucuggaaggga

SEQ ID NO: 42465 - RNA, 25 nt, Mus musculus
ggugcagcagcggaagcccgcgcua

SEQ ID NO: 42466 - RNA, 44 nt, Mus musculus
gaaguagggucgaaugaaucgggucugccagucacugcccccag

SEQ ID NO: 42467 - RNA, 43 nt, Mus musculus
aggugugaaaggagcgcuuuuugaagguuccagggcugcagag

SEQ ID NO: 42468 - RNA, 46 nt, Mus musculus
gaauaccugcaucuacagaacccagggccgccugcaggaaccaggu

SEQ ID NO: 42469 - RNA, 46 nt, Mus musculus
ggaauccuaucagacaaaggaauucgccagauuuuaaugccuauga

SEQ ID NO: 42470 - RNA, 45 nt, Mus musculus
uaaauagaauuacaaguuucauagaagaggaaauuuuggagggac

SEQ ID NO: 42471 - RNA, 46 nt, Mus musculus
agaggacuuuuuagucacccgggacugaaauucuacauggcuccug

SEQ ID NO: 42472 - RNA, 46 nt, Mus musculus
auacauagacauccugucucaagaaaaacaaaaaacaaaaagggag

SEQ ID NO: 42473 - RNA, 41 nt, Mus musculus
accaccaugugguuucugggauuugaacucaggacccccgg

SEQ ID NO: 42474 - RNA, 46 nt, Mus musculus
ggaacaagaguuaaccuuccccggucugaucugcgcagugugaaga

SEQ ID NO: 42475 - RNA, 46 nt, Mus musculus
ggauugucaugugcaccaucauguugaaguuuuaauuuacauuggg

SEQ ID NO: 42476 - RNA, 46 nt, Mus musculus
aguaggugugagcuucaugacuauugguuucauucauucuuuagag

SEQ ID NO: 42477 - RNA, 46 nt, Mus musculus
cacugccugguuucauauguacauauuuacacauaacuaaaaguag

SEQ ID NO: 42478 - RNA, 46 nt, Mus musculus
ggaugggcuugguacuguaggccucuuaccuuguuauacucggcag

SEQ ID NO: 42479 - RNA, 36 nt, Mus musculus
uguguguguguguguguacguaaguguguguaugug

SEQ ID NO: 42480 - RNA, 42 nt, Mus musculus
gcucuguaccauauagaacacugagcaaaauguacacccagg

SEQ ID NO: 42481 - RNA, 46 nt, Mus musculus
cacuaaagagagcaccuuuggcuuucuaaccaguuugaaauacuag

SEQ ID NO: 42482 - RNA, 45 nt, Mus musculus
agcuaauuuaaagcaaugaaauagauagauagauagauagagaga

SEQ ID NO: 42483 - RNA, 46 nt, Mus musculus
gagccaccaagccuggcuauuuaucccuaauagacuuacuuacuug

SEQ ID NO: 42484 - RNA, 44 nt, Mus musculus
ccuccccuauuuaguguggguguguugguguggacaugugugug

SEQ ID NO: 42485 - RNA, 42 nt, Mus musculus
ucaugaauugguucagugucuguauaaaagaggccugggcag

SEQ ID NO: 42486 - RNA, 45 nt, Mus musculus
gagaugaacaguagugauggugaugucacagucuaagacuuagaa

SEQ ID NO: 42487 - RNA, 46 nt, Mus musculus
gaccuauuuuugugucucaucugcucagcuaaaagucagugccaaa

SEQ ID NO: 42488 - RNA, 57 nt, Mus musculus
ccagggcuacguagagagacacugucacaaacaaauagaugaaaaaggaaaggaaag

SEQ ID NO: 42489 - RNA, 60 nt, Mus musculus
gaaaggaaaggaaaggaaaggaaaggaaaggaaaggcaaggcaaggcaaggcuagguugg

SEQ ID NO: 42490 - RNA, 45 nt, Mus musculus
cuguaaaacgccuuaagaggaacauauuugagucuaaaaugggag

SEQ ID NO: 42491 - RNA, 45 nt, Mus musculus
agcauccuaggcaguugguugcugggccugaaaggaaggauuugg

SEQ ID NO: 42492 - RNA, 30 nt, Mus musculus
cuugcuuguuuuauguguguguuuugccag

SEQ ID NO: 42493 - RNA, 46 nt, Mus musculus
cgaacacauaacuggaguuccagugguggggauaggugugauggag

SEQ ID NO: 42494 - RNA, 42 nt, Mus musculus
aacuggaagaaacaaacggcaguaaucccguugacauugaga

SEQ ID NO: 42495 - RNA, 46 nt, Mus musculus
aagaaguauguuucucagugugguaguguauguaggugucugagug

SEQ ID NO: 42496 - RNA, 44 nt, Mus musculus
ggacaagaguguuuucaauuugaaauaauuacucagauuggcag

SEQ ID NO: 42497 - RNA, 46 nt, Mus musculus
uuguaaauuaucgacgccgcuucaacauagaugaaguuuuacaaga

SEQ ID NO: 42498 - RNA, 45 nt, Mus musculus
ccagaaaccugucaaguccccagaaagcuccaucaagaucccgga

SEQ ID NO: 42499 - RNA, 45 nt, Mus musculus
acuaauaaaaaggccugucggucuuaacaguguuuuuccagcuaa

SEQ ID NO: 42500 - RNA, 54 nt, Mus musculus
aguaaaaucaugcuucuuuggaaaucacaagcccuucagcagaccacaucguca

SEQ ID NO: 42501 - RNA, 79 nt, Mus musculus
uggcuucucuccccuuucucucuccccuaacucuuucccuuuucuccuuuccaagugguaaaagcucauuugcagcaac

SEQ ID NO: 42502 - RNA, 89 nt, Mus musculus
ggauguauauucuucuugagaagucuggagaaaggucauuccaaggucaagugcagagggacuuuguccauccugucucacaccggccc

SEQ ID NO: 42503 - RNA, 46 nt, Mus musculus
gcaccaggcuuguucugucuuucucuugguugugagcguggcgugg

SEQ ID NO: 42504 - RNA, 45 nt, Mus musculus
auuuccaauauuugcugaaguuaaauaaaaauuuucaagccauug

SEQ ID NO: 42505 - RNA, 45 nt, Mus musculus
uuguuuugaaacaggggcucucuacuuacuugcuguguagaccag

SEQ ID NO: 42506 - RNA, 41 nt, Mus musculus
aagggaacugacuaguuguugaggcuggaaccgcaccccug

SEQ ID NO: 42507 - RNA, 45 nt, Mus musculus
augcaggcaaaacacucauguacauagaauaagaagaucuuaaaa

SEQ ID NO: 42508 - RNA, 45 nt, Mus musculus
cagauuuuaguuacagaugguuggggguuccaggcauugaaccca

SEQ ID NO: 42509 - RNA, 64 nt, Mus musculus
caugcaaauagauacuuugcaugcacuuuccaaccugaucuaucuacuucccucucccuccccc

SEQ ID NO: 42510 - RNA, 46 nt, Mus musculus
guucuuuaaaaagcuuaguugaaaaaauaauaguggagcuggagag

SEQ ID NO: 42511 - RNA, 44 nt, Mus musculus
gcaggcaagaugucagcuucucuuagggcauggccugagggucu

SEQ ID NO: 42512 - RNA, 45 nt, Mus musculus
uccugugcucuugagaucagcccugagcugugggugcugggccug

SEQ ID NO: 42513 - RNA, 41 nt, Mus musculus
ggucggagggagcaggguugacuggagcgaguggggcagac

SEQ ID NO: 42514 - RNA, 43 nt, Mus musculus
acugcuuccccgcagccauccaagaccacuuuuggagccaggg

SEQ ID NO: 42515 - RNA, 60 nt, Mus musculus
agguagaggccaggccaggccaggccaggcggcagguuggggaauguccucacagugugc

SEQ ID NO: 42516 - RNA, 43 nt, Mus musculus
guccggugcccagguuggaugggcaugugaggauguagcccag

SEQ ID NO: 42517 - RNA, 45 nt, Mus musculus
gggcucugaucugccccugaucccuccccagcaccaacgccccua

SEQ ID NO: 42518 - RNA, 46 nt, Mus musculus
gcuccggggucagcaccuuggccauaugguuguuguggcugcucag

SEQ ID NO: 42519 - RNA, 44 nt, Mus musculus
guauuauggcuguuggagaagggcauggcggcggcagcgggcug

SEQ ID NO: 42520 - RNA, 50 nt, Mus musculus
gcaggauggucuuaacuccccccaacccacuauacacacacacacacaua

SEQ ID NO: 42521 - RNA, 23 nt, Mus musculus
cacgucuccuuacucugugguuu

SEQ ID NO: 42522 - RNA, 30 nt, Mus musculus
uugcucucucucugacacaauuggacacac

SEQ ID NO: 42523 - RNA, 46 nt, Mus musculus
auugucccuuuaguaaaguuguucacuggccuggcaaugguuguag

SEQ ID NO: 42524 - RNA, 42 nt, Mus musculus
uccaaggggcucgggccuauagagaucacauaucgagcgaag

SEQ ID NO: 42525 - RNA, 44 nt, Mus musculus
aacaaucuucgcucgauaugugaucucuauaggcccgagccccu

SEQ ID NO: 42526 - RNA, 46 nt, Mus musculus
cgaagaguugugacccacaggcugagaaccacugcucuaaguagau

SEQ ID NO: 42527 - RNA, 60 nt, Mus musculus
aggccaaagcaccgcagccccagcagguguauacacacugcccacacagggcccgcucgc

SEQ ID NO: 42528 - RNA, 46 nt, Mus musculus
acaguguggacuguuggagcccuaauaaggacucagaaguccagac

SEQ ID NO: 42529 - RNA, 46 nt, Mus musculus
ccuucucucucuuuagugugaacaucuugugcugucuguggccacc

SEQ ID NO: 42530 - RNA, 51 nt, Mus musculus
uggccacagacagcacaagauguucacacuaaagagagagaagguggcuuu

SEQ ID NO: 42531 - RNA, 41 nt, Mus musculus
aaaaugcugaagcugaauguuguaaaaaacgacauggugca

SEQ ID NO: 42532 - RNA, 46 nt, Mus musculus
ucuggacucggcaaugcagaggagcguggagcugccagccgcugcc

SEQ ID NO: 42533 - RNA, 42 nt, Mus musculus
ccuccaaaggguuuguuugauucuuuuaguuuuggggcugag

SEQ ID NO: 42534 - RNA, 51 nt, Mus musculus
gaaauaccuggugucagucucagaggugaccuggggcuugaaaggugggcu

SEQ ID NO: 42535 - RNA, 29 nt, Mus musculus
cugaccuuaucgggugggcacuagcacua

SEQ ID NO: 42536 - RNA, 46 nt, Mus musculus
aaagaaccggugcugcaugaucuccuuggcauccucggagccccca

SEQ ID NO: 42537 - RNA, 42 nt, Mus musculus
gcggccacacaucaucucguacaugaccacgcccagccccca

SEQ ID NO: 42538 - RNA, 44 nt, Mus musculus
aucaagguaccugggaugcugauauuucucccauuaugccccac

SEQ ID NO: 42539 - RNA, 44 nt, Mus musculus
ugaggccguuccuuguagccaauaaaggugccaucguucuugag

SEQ ID NO: 42540 - RNA, 46 nt, Mus musculus
ugucacuugaccccaaaagacucaaugaccaagcgcugggcaaagg

SEQ ID NO: 42541 - RNA, 46 nt, Mus musculus
guucuguucccagucugcggggcuauaaccuacaaaagcaacagag

SEQ ID NO: 42542 - RNA, 42 nt, Mus musculus
aguagcugcugguuggugggaagaaaccaaggagccugagaa

SEQ ID NO: 42543 - RNA, 46 nt, Mus musculus
ugccccccuuggaucuuugagagguccauuucggaguaccccuaga

SEQ ID NO: 42544 - RNA, 46 nt, Mus musculus
cgugugugaacccugcugggcaacccgcagguaccacugagugcag

SEQ ID NO: 42545 - RNA, 84 nt, Mus musculus
cuucuuagugggugaagaggagaacccuaacuugggaaaccggaaccagcccgccuucuccuguuuccugggcaguucgggguc

SEQ ID NO: 42546 - RNA, 46 nt, Mus musculus
ucucuggacucagcagccaucucuuccacggaggaaaacccaauac

SEQ ID NO: 42547 - RNA, 45 nt, Mus musculus
aaggcuccaggagcuaaggggucagcgcuccaccuuuccauccug

SEQ ID NO: 42548 - RNA, 46 nt, Mus musculus
gucuaccggauggcugcaggggaccuucuguucugggugguaccag

SEQ ID NO: 42549 - RNA, 45 nt, Mus musculus
agugaaggcugacuggaggacacacccacaacacuacaagcagca

SEQ ID NO: 42550 - RNA, 46 nt, Mus musculus
gggaacaauacgcgagcaguaaaaggagggaguguacuaccuugag

SEQ ID NO: 42551 - RNA, 48 nt, Mus musculus
gacaaaacuguugcaacagagaggugaacacacaacaggacugagaug

SEQ ID NO: 42552 - RNA, 63 nt, Mus musculus
aaaaagauaucccagguaaaauagauuuaaaaacagacagacaucaaaagaagaaaaagcagg

SEQ ID NO: 42553 - RNA, 126 nt, Mus musculus
ucagagcccagauacaagugagcagaaaggcaaagaccccaaagacaggagaggagaugcuggagcgcuggaugggugcccaacacaggaggaugacacaaaggacagagagguggcaguugaagg

SEQ ID NO: 42554 - RNA, 51 nt, Mus musculus
gaaguccacaggacagcugacagacaggaacggaacacaggggaagggaga

SEQ ID NO: 42555 - RNA, 50 nt, Mus musculus
uacucagaaccauacaaaguucaguucagaaucaaacggaaacucucggc

SEQ ID NO: 42556 - RNA, 46 nt, Mus musculus
gaaggacucgucggcugcaaagcuguucaaccugagagaagguacc

SEQ ID NO: 42557 - RNA, 51 nt, Mus musculus
ucaccuguuuaugaauacacagcugaaggugcaggcuuuggaggccaggua

SEQ ID NO: 42558 - RNA, 45 nt, Mus musculus
gugugaguaugugaaaguugugugagugugugugagugauugaga

SEQ ID NO: 42559 - RNA, 45 nt, Mus musculus
gaguaugugagugaguguaaguguguguaugaguguacgugagug

SEQ ID NO: 42560 - RNA, 42 nt, Mus musculus
ugugugagugaguguaaguguguguaugaguguacaugagug

SEQ ID NO: 42561 - RNA, 45 nt, Mus musculus
gaacucccaguguccgagccgugccgcugucugguguagguagua

SEQ ID NO: 42562 - RNA, 42 nt, Mus musculus
agcagcucagguucaggagacaucauuugccagaggguuagg

SEQ ID NO: 42563 - RNA, 45 nt, Mus musculus
acaaaaggggcugggcucugguagccccaccucagccuggaugga

SEQ ID NO: 42564 - RNA, 41 nt, Mus musculus
ccugacuagcccugcuagcagugggagagugaugaccccac

SEQ ID NO: 42565 - RNA, 41 nt, Mus musculus
gccugcaggcgagggaaggacugaaguaggcagggugacuu

SEQ ID NO: 42566 - RNA, 41 nt, Mus musculus
ucugagacuagccuggacuaaauggugagacccugucuaga

SEQ ID NO: 42567 - RNA, 42 nt, Mus musculus
accgguuuuucucucgaacgcucauucauuagaagucccggu

SEQ ID NO: 42568 - RNA, 45 nt, Mus musculus
cucugggccacgucggcuggaggacgauguaaggaaguuggaagg

SEQ ID NO: 42569 - RNA, 42 nt, Mus musculus
uagcagcauacagaguggcaagcacuguguccgccuccaggu

SEQ ID NO: 42570 - RNA, 67 nt, Mus musculus
ccuuuguggagcaaggcccuuccucuuggucagggggaagucaaggaggggcuuuuuggcagcagug

SEQ ID NO: 42571 - RNA, 46 nt, Mus musculus
ggagggaaauccaaggguccugaagcuugggugucacuggcaggga

SEQ ID NO: 42572 - RNA, 42 nt, Mus musculus
uggacuugugggcuuuggcauuuauucaucugugguugagau

SEQ ID NO: 42573 - RNA, 46 nt, Mus musculus
aagcuucccuucggauuguauuucugagacuuguuacuggaggagg

SEQ ID NO: 42574 - RNA, 46 nt, Mus musculus
cagucuagacaauggcuuggagggggcagggucuuacucuggagaa

SEQ ID NO: 42575 - RNA, 45 nt, Mus musculus
aaaugugcuuauauuuugagauaccugccagugugauguugagaa

SEQ ID NO: 42576 - RNA, 45 nt, Mus musculus
uaugguugggcucugacauuauagaagcccaugccaggcccaguu

SEQ ID NO: 42577 - RNA, 52 nt, Mus musculus
guguagugaugagaaugauguguugguaguauggccauacacaugugggagc

SEQ ID NO: 42578 - RNA, 64 nt, Mus musculus
caguagccauuuuguccucagugaucccagcaagcaugccagugaagaagaacaucccuucugu

SEQ ID NO: 42579 - RNA, 46 nt, Mus musculus
ucuguaguaauauaucaaagggagaauagcauuaggacagacauuu

SEQ ID NO: 42580 - RNA, 45 nt, Mus musculus
uuagccucugggccugucugugagagauugucuuguugguugaga

SEQ ID NO: 42581 - RNA, 46 nt, Mus musculus
gugacagcucaucucaacugaacacaagccuaccguuucuucagag

SEQ ID NO: 42582 - RNA, 46 nt, Mus musculus
guagcgaagaaaaagacuucucugaugucacaguuguaccgaagau

SEQ ID NO: 42583 - RNA, 45 nt, Mus musculus
acucugcaauauuagaauuggaaauggccucugaaggcaguaguc

SEQ ID NO: 42584 - RNA, 45 nt, Mus musculus
acauuuucucuccuggaucuaccaccaguaaaugaguaugacaug

SEQ ID NO: 42585 - RNA, 46 nt, Mus musculus
auauagauagaauuuuaaaaucuacauguaaaacuaagauauauua

SEQ ID NO: 42586 - RNA, 45 nt, Mus musculus
auauauauauaugcuccucaugcaugccuggcauccauggaaguc

SEQ ID NO: 42587 - RNA, 46 nt, Mus musculus
aaccccuguuuguggaauuuuuguggauuuugcaacagccucacau

SEQ ID NO: 42588 - RNA, 97 nt, Mus musculus
ggcgaucagugcagagaaugaaaggguuggcgaguuaucuuugaaaauguuucagaagcaagguuggacggaguauacaaaggagcccuggacaggu

SEQ ID NO: 42589 - RNA, 112 nt, Mus musculus
augacuuugagguuugcgauggagacgaugacagcaauaaugagcaugaagcuagagaaaaggccgaagaacuuccucuggcccagaaaagggaaauacaggaaauucaaaa

SEQ ID NO: 42590 - RNA, 57 nt, Mus musculus
acaacgauuuagaggcuacugggccugaugaauaucugcccaacuuagaagaugauu

SEQ ID NO: 42591 - RNA, 45 nt, Mus musculus
cuuauuuggcccauguucucagagguuucaguucauuaugucagg

SEQ ID NO: 42592 - RNA, 55 nt, Mus musculus
gacugcacuaugaugacgagaggcgccgaagucaugcagauaaaaaagagagauc

SEQ ID NO: 42593 - RNA, 84 nt, Mus musculus
ggagacaguaaggagcacccccucagcuacuggcuguacaaggaggacggcgagaagaagcacaggaaagccaaagacgcagau

SEQ ID NO: 42594 - RNA, 49 nt, Mus musculus
ggaaagagaaaggagagaugaagacucugaaagaauagaugaagauaga

SEQ ID NO: 42595 - RNA, 105 nt, Mus musculus
agaaagacagacgggccaggaaagaagagaucaggcaguccauggccuaccaugaccucuugagucgagauaugcguggccggcagauggcagagaaaguggaaa

SEQ ID NO: 42596 - RNA, 211 nt, Mus musculus
agggacccagaccgagaggcccggcacaaggagaagacagcugagagagaccuguacaccuccacagaacauccucguggggagagagaccgggagaggcacaaggaaaggaggaaagaugcaaaagaccgugagaaagacaagcuaaaagagagacaucgagaccaagaagcagagaaggcucauagucgaggcaaggacagagagagag

SEQ ID NO: 42597 - RNA, 46 nt, Mus musculus
uaggugcagucaggcagucccaaggaggagaagaaacucagagaaa

SEQ ID NO: 42598 - RNA, 46 nt, Mus musculus
auuuauuuauuauuauucauaacuacacuguagcugucuucagaca

SEQ ID NO: 42599 - RNA, 46 nt, Mus musculus
agagaagaaccaaagaugauacuuggaaagcagaugaccucagaaa

SEQ ID NO: 42600 - RNA, 46 nt, Mus musculus
cugugggucaguggggagucacagagggguggaaaugggguagaag

SEQ ID NO: 42601 - RNA, 45 nt, Mus musculus
auggggagagaagggacagaggauaagcaguuaagagggcaagag

SEQ ID NO: 42602 - RNA, 51 nt, Mus musculus
uucccccugagguaaagguauaguauagaauagaguuuacuuagggcaugg

SEQ ID NO: 42603 - RNA, 46 nt, Mus musculus
ucuuuuaguuuacuggguaaaaguuugcccauuuuguugaucuuuc

SEQ ID NO: 42604 - RNA, 45 nt, Mus musculus
gucagucgccaaccggaucccgcucccucguccgcgcccucagga

SEQ ID NO: 42605 - RNA, 41 nt, Mus musculus
cuucuugcuccucaggagggcuggcaaaguucaccggguua

SEQ ID NO: 42606 - RNA, 41 nt, Mus musculus
uggcucuaugaggagaauguguuucuucuauauucggcaca

SEQ ID NO: 42607 - RNA, 46 nt, Mus musculus
uaaagcagggcaaguaaggaugcccagguuucaagacagccgagaa

SEQ ID NO: 42608 - RNA, 36 nt, Mus musculus
cauuacaguaugacuugaauggacauacuucuaaga

SEQ ID NO: 42609 - RNA, 44 nt, Mus musculus
agcaaguaaaagccuuauuacuugccaggugcuauggguggaga

SEQ ID NO: 42610 - RNA, 45 nt, Mus musculus
aaccaauuaccuucucugcuuuggcaucagucuugcgcuggccgg

SEQ ID NO: 42611 - RNA, 47 nt, Mus musculus
caugcuucacugcgucugagaaaccuuaaaaacaagauugagaacaa

SEQ ID NO: 42612 - RNA, 52 nt, Mus musculus
cuuggcaucuacacccugaacguagaggacccccaccccauacccaagacca

SEQ ID NO: 42613 - RNA, 47 nt, Mus musculus
ggccuggccaaaaagagacaccugugauugaucacugcagccccaaa

SEQ ID NO: 42614 - RNA, 46 nt, Mus musculus
agucaccuacuuccagucuugaaacuggauuuuuaagccagagcau

SEQ ID NO: 42615 - RNA, 85 nt, Mus musculus
gccaaaucuugagccuaaugaguccacacugagcccuuaaccucagacgacccuagcccucagcagucccaauagccucccucca

SEQ ID NO: 42616 - RNA, 41 nt, Mus musculus
uuauucucuucggcgucuacggugaugugcagcgggugaag

SEQ ID NO: 42617 - RNA, 41 nt, Mus musculus
aggccucucugucccuaauguccauggagccuuggcucccc

SEQ ID NO: 42618 - RNA, 46 nt, Mus musculus
gagacuacacucgaccugaccugccaucuggagacagccagccuuc

SEQ ID NO: 42619 - RNA, 46 nt, Mus musculus
aggcacgugcccaggcagcccugcaggcuguaaacucuguccauuc

SEQ ID NO: 42620 - RNA, 45 nt, Mus musculus
aaguucaaaggugacaacaggagcgcaggagucccuuccagaguc

SEQ ID NO: 42621 - RNA, 46 nt, Mus musculus
cgcuucagguguuucuugggaccacgagccauggcugcgcuaggaa

SEQ ID NO: 42622 - RNA, 46 nt, Mus musculus
guagcugcuccaaaacauuggaugcuggauaaguugacuggcgugu

SEQ ID NO: 42623 - RNA, 121 nt, Mus musculus
ccauccacugguccucacaagcugagggaaugccugccucucaucauuuuccuaaggaacagacuuaaguaugcccugacuggagaugaaguaaaagagauuugcaugcagcgauucauua

SEQ ID NO: 42624 - RNA, 44 nt, Mus musculus
uaauacgaugaacagcaaagcgacccuuggugucauagaucaga

SEQ ID NO: 42625 - RNA, 71 nt, Mus musculus
augacaccaagggucgcuuugcuguucaucguauuacaccggaggaggccaaguacaaguugugcaaagug

SEQ ID NO: 42626 - RNA, 85 nt, Mus musculus
ugauccccucaucaaggugaacgacaccauucagauugauuuggagacaggcaaaauaacugacuucaucaaguuugacacuggg

SEQ ID NO: 42627 - RNA, 84 nt, Mus musculus
acuggaggugcuaacuugggaagaauugguguaaucaccaacagagagagacaucccggcucuuuugaugugguucaugugaaa

SEQ ID NO: 42628 - RNA, 74 nt, Mus musculus
ccagaggaaaaggaauccgccucaccauugcugaagagagagacaagaggcuugcggccaaacagagcaguggg

SEQ ID NO: 42629 - RNA, 68 nt, Mus musculus
ugaaauggucucuaggggacaugcuggaaaaguguuuguacaagccuuucuaggcaacauacaugcua

SEQ ID NO: 42630 - RNA, 45 nt, Mus musculus
gaccagucccgguuagcuagcaaagucccgaaguuacuuuuucag

SEQ ID NO: 42631 - RNA, 56 nt, Mus musculus
cuccggucuccuccuccuaggugcagagauugugggcagacagcguaaucucugcu

SEQ ID NO: 42632 - RNA, 37 nt, Mus musculus
gagucgcgccgaucagcaguaugagugcguggcggag

SEQ ID NO: 42633 - RNA, 45 nt, Mus musculus
ccagguuacaaaaacaacagacaacauaaaagaggcaggaaaagg

SEQ ID NO: 42634 - RNA, 45 nt, Mus musculus
gucuguacaaguaguaaacugaaggcaauauucacucguuaaaca

SEQ ID NO: 42635 - RNA, 42 nt, Mus musculus
cuugauuucucucuuuguucggaguccccuccauacucagag

SEQ ID NO: 42636 - RNA, 49 nt, Mus musculus
cugauccggucacacggaccggcaccccccaaaaagaccaaagauagca

SEQ ID NO: 42637 - RNA, 46 nt, Mus musculus
cuggcuauccucggaccagagaacucaaaaauugccaaagacccau

SEQ ID NO: 42638 - RNA, 46 nt, Mus musculus
cagaggcucuuaacagcugagccucugagcuaaauuuaaugcggau

SEQ ID NO: 42639 - RNA, 44 nt, Mus musculus
gacagcagugagcaaauuaagccucugaaacauuacuaagccua

SEQ ID NO: 42640 - RNA, 46 nt, Mus musculus
auuugugucucugugugugguacagacgugugugugugugugugug

SEQ ID NO: 42641 - RNA, 45 nt, Mus musculus
accacggaagcucauucguagucucuuagcccagccccaccucau

SEQ ID NO: 42642 - RNA, 46 nt, Mus musculus
cuaugggcauauguauggggaauuaucuugauuauguuaaccaugg

SEQ ID NO: 42643 - RNA, 42 nt, Mus musculus
ccacuggcugacuguuuaaugcggucgcacgucuaguuacag

SEQ ID NO: 42644 - RNA, 42 nt, Mus musculus
aacacugaaaagaaaagugcccauuaacagucaggagggaag

SEQ ID NO: 42645 - RNA, 42 nt, Mus musculus
gccguuuuucucugggggaggccucugugaggagugcugcug

SEQ ID NO: 42646 - RNA, 44 nt, Mus musculus
gucuuauuaacaagauaagagguuuccuucucucuuugccccug

SEQ ID NO: 42647 - RNA, 42 nt, Mus musculus
cagucuaggcagagagaaucuugucauacuagguaccggcag

SEQ ID NO: 42648 - RNA, 45 nt, Mus musculus
gacauaccuagaguauugcaauccauuuaauagucccaugccaag

SEQ ID NO: 42649 - RNA, 46 nt, Mus musculus
uuaagagaugugauguccacagcucuccugcucaggugguacagag

SEQ ID NO: 42650 - RNA, 46 nt, Mus musculus
acacauauugggauacaaaacuccucaugguuguuucgagccucag

SEQ ID NO: 42651 - RNA, 45 nt, Mus musculus
gcaucgaggguuagucauuagauggaacugcugcuccuuucucag

SEQ ID NO: 42652 - RNA, 46 nt, Mus musculus
aggaaaagaggcaugcauuuuacauuaccugcaggucuaccccaag

SEQ ID NO: 42653 - RNA, 45 nt, Mus musculus
cagaccagagccuuuccugugggcugggagagaaugggggccagg

SEQ ID NO: 42654 - RNA, 46 nt, Mus musculus
gauccagcuuggcugguaucugcagaggcccccacuaaacuccaag

SEQ ID NO: 42655 - RNA, 42 nt, Mus musculus
cugcagacuguaacucagcaucugggaugcacaaggcucugg

SEQ ID NO: 42656 - RNA, 40 nt, Mus musculus
gaagcaauaauggcaguugucaaauagcacaugcaacagc

SEQ ID NO: 42657 - RNA, 46 nt, Mus musculus
uuacgucugugauaguguucagagcugugucugccccgaugcugaa

SEQ ID NO: 42658 - RNA, 45 nt, Mus musculus
aauauaugacguuuaaaaaaaaaaaguccgaagagaaacauuaac

SEQ ID NO: 42659 - RNA, 46 nt, Mus musculus
ugaaccaauguccucucuugguccccacuuacccuauuagugggag

SEQ ID NO: 42660 - RNA, 42 nt, Mus musculus
ggucucggggguagcuuccagcaaggcaaugacagccuccac

SEQ ID NO: 42661 - RNA, 46 nt, Mus musculus
uugcaugucgauugcuccuucagacacaaugaugauauucagccuc

SEQ ID NO: 42662 - RNA, 46 nt, Mus musculus
gagagaaaaguaaccuacgcaugaagaucuuugcccgaaagcuaag

SEQ ID NO: 42663 - RNA, 46 nt, Mus musculus
uaacaagcaacuaugcuuucaaagacaacauauaacaaacuccuga

SEQ ID NO: 42664 - RNA, 45 nt, Mus musculus
ugucauaacaccucacaccuuauuugggggcuggggcggggggag

SEQ ID NO: 42665 - RNA, 46 nt, Mus musculus
auuuaaaggagccauccugcuggcccacccccaaaaggccuugugg

SEQ ID NO: 42666 - RNA, 45 nt, Mus musculus
uccucccaaucuuccucagguggagacuccggaaggaacacccag

SEQ ID NO: 42667 - RNA, 25 nt, Mus musculus
aaauuaagagagagagaaugcagau

SEQ ID NO: 42668 - RNA, 45 nt, Mus musculus
uguauguccaugucagcuauaaauaaaauaacugucguccccccc

SEQ ID NO: 42669 - RNA, 46 nt, Mus musculus
uaaaaagcaccaacagagaaaccugaggccgacuacucagagcaag

SEQ ID NO: 42670 - RNA, 42 nt, Mus musculus
aacucacucagccucacugggagugacaauggagauggccaa

SEQ ID NO: 42671 - RNA, 46 nt, Mus musculus
aaaggggaaagggggagcaagaagauaagcuugaagagaggaacag

SEQ ID NO: 42672 - RNA, 46 nt, Mus musculus
acugagaaacuggaacauacauucaacaauguguuuuauaaaaaag

SEQ ID NO: 42673 - RNA, 62 nt, Mus musculus
ccuucccccugagguaccagccacaugaaggguauauauagaauagaguuuauuuagggcgu

SEQ ID NO: 42674 - RNA, 41 nt, Mus musculus
cuuccagagucucagacugaacauuuacucgcuucccccag

SEQ ID NO: 42675 - RNA, 46 nt, Mus musculus
uuaucacaaggcucaaggcaaaagagagugagagagagagagagag

SEQ ID NO: 42676 - RNA, 77 nt, Mus musculus
uucauucccuuccucuccccagaguccucuuaaccccucuugcuaccaccccucccccaacauaucucugcgguccu

SEQ ID NO: 42677 - RNA, 46 nt, Mus musculus
gaugucuuucuaguuucauaucacacgcacacacuuaaaaucuaag

SEQ ID NO: 42678 - RNA, 42 nt, Mus musculus
auucuugcuacuauaguuacucauuaagcucugucacuauau

SEQ ID NO: 42679 - RNA, 46 nt, Mus musculus
gcauccccgccgcuggucaggacaccgauagcuuugccauccccag

SEQ ID NO: 42680 - RNA, 94 nt, Mus musculus
aggcguuuaugcccgagaugaaacggaguucuacuuaggcaagagaugugcuuauguguauaaagcaaaaaacaauacagugacuccuggagga

SEQ ID NO: 42681 - RNA, 73 nt, Mus musculus
ggguuccugcugcugagcuuuggggcccgauugcuggggccugcugggaacaggacuucuaacagcaaguaug

SEQ ID NO: 42682 - RNA, 46 nt, Mus musculus
uaguguuuggaauuaggaacacuauuaugugcuggaguguccagaa

SEQ ID NO: 42683 - RNA, 46 nt, Mus musculus
cuuuccauaccgcccuacggagagugaccauuuagggagaagagaa

SEQ ID NO: 42684 - RNA, 46 nt, Mus musculus
uuaugaacagcaaaggagaauuuguaguaucaguagugccucagag

SEQ ID NO: 42685 - RNA, 49 nt, Mus musculus
ccagauguuuuagggcuuuguuaacugagaggcucugugugcuauugga

SEQ ID NO: 42686 - RNA, 60 nt, Mus musculus
cuuacucaguguguaguauggcaguguagaaagacaagagucggaaaagaccuuugguag

SEQ ID NO: 42687 - RNA, 46 nt, Mus musculus
ggcacguaaagccggggucuuuauuuaacauauuuacaaggagagu

SEQ ID NO: 42688 - RNA, 46 nt, Mus musculus
uucuaguaaugucuugcugggcugucgaggaugauaggacagagua

SEQ ID NO: 42689 - RNA, 30 nt, Mus musculus
ugacugguggaggugguggugugugcacac

SEQ ID NO: 42690 - RNA, 46 nt, Mus musculus
acuccugcauuggcaucuuugaaucugcuaauuugggcguuuggaa

SEQ ID NO: 42691 - RNA, 84 nt, Mus musculus
cagacauagugcaguguuucuaacgcaggugguuuugcaagucauugauugucacauguagggaggagguacccacuggccuca

SEQ ID NO: 42692 - RNA, 46 nt, Mus musculus
gaccagauuucaagaaacacuggauugccccuugauauuggaagaa

SEQ ID NO: 42693 - RNA, 46 nt, Mus musculus
ccucucaaguauuagccguccagcaaccagaaguagacagggagaa

SEQ ID NO: 42694 - RNA, 48 nt, Mus musculus
gggucccaggggaacguacagucagccaggccggggccauugaggaag

SEQ ID NO: 42695 - RNA, 46 nt, Mus musculus
uaauaauuuaguuuuuacccaguaguauaauuuaguagcccaagua

SEQ ID NO: 42696 - RNA, 45 nt, Mus musculus
uccucaguacaaggcacacaagugauggacagacaugcacacagg

SEQ ID NO: 42697 - RNA, 46 nt, Mus musculus
agaauaaauguaucgaauucacaugagccuucucucccacccagcu

SEQ ID NO: 42698 - RNA, 45 nt, Mus musculus
guuucaugcuuugagaggagaauauauuugcauuauugguaacug

SEQ ID NO: 42699 - RNA, 42 nt, Mus musculus
cugucucuaaacauuuugguauguguuuccaaagguguagaa

SEQ ID NO: 42700 - RNA, 48 nt, Mus musculus
uuuacagguuuugcccagaucuaagacaggauguucuaacggcccaua

SEQ ID NO: 42701 - RNA, 54 nt, Mus musculus
cacugaggucagccuuucuuuugauuaacacaaaguugacugauuuagggaccu

SEQ ID NO: 42702 - RNA, 45 nt, Mus musculus
uagugauaaggagauagucccuccugucugucauaguccugagau

SEQ ID NO: 42703 - RNA, 46 nt, Mus musculus
gcugaugguaucuggugugguccaauguggcuuaacugaccuacgu

SEQ ID NO: 42704 - RNA, 42 nt, Mus musculus
ugccagcugagaugacacgguggguucucuguguagggagaa

SEQ ID NO: 42705 - RNA, 41 nt, Mus musculus
uagucuuggaggauauguguuggcuuugaugggccagagau

SEQ ID NO: 42706 - RNA, 47 nt, Mus musculus
gauggggcagaauugaguaagggccaacucaaaacaaaagguaagau

SEQ ID NO: 42707 - RNA, 45 nt, Mus musculus
gccguccucaguucgcaguacacugcuggaauuguuuggccagau

SEQ ID NO: 42708 - RNA, 43 nt, Mus musculus
gaacuaacagcucagaacaagagaggacuggacugccaagaga

SEQ ID NO: 42709 - RNA, 42 nt, Mus musculus
ggagugaccaggacacuaccuucuagaaguaaugcccacaga

SEQ ID NO: 42710 - RNA, 46 nt, Mus musculus
guagaguccguuccaaagcagagacucaagguaagaaucuggagac

SEQ ID NO: 42711 - RNA, 46 nt, Mus musculus
ccuugucacaauauacucaaaugaauuagagaucuucauggaagau

SEQ ID NO: 42712 - RNA, 45 nt, Mus musculus
cugcuguaacaguucccaaggcugauagcauuauguccaaaaggu

SEQ ID NO: 42713 - RNA, 45 nt, Mus musculus
cgggaggagcugguguuccuaguguaggagcuacagguacagaga

SEQ ID NO: 42714 - RNA, 46 nt, Mus musculus
auuucuggggggaaagauagagguuggagguuguaaauauagaggc

SEQ ID NO: 42715 - RNA, 42 nt, Mus musculus
cucugggucugccucgggagccucgucgcggggggaucuacg

SEQ ID NO: 42716 - RNA, 46 nt, Mus musculus
gaaauaaauaccagccaucuugaugaaaaacagguucagcuucuag

SEQ ID NO: 42717 - RNA, 46 nt, Mus musculus
aaauaugauccuacacacacacacacacacacacacacagcaggau

SEQ ID NO: 42718 - RNA, 46 nt, Mus musculus
gugucuucuuguuuaauacugaaaauaagcuccuguuacagcagag

SEQ ID NO: 42719 - RNA, 39 nt, Mus musculus
gcucacuguguagaccaggcuagcccugaacucauagag

SEQ ID NO: 42720 - RNA, 73 nt, Mus musculus
accuugaauccagaucccaacgagauuaaaagcuauugcuauguaucaaaggaagaagucagagaaauuuuga

SEQ ID NO: 42721 - RNA, 46 nt, Mus musculus
uaaguaaaacuuaauuuagccuguccaaauaccuggcuaugacaag

SEQ ID NO: 42722 - RNA, 45 nt, Mus musculus
uugagucccuaacccuaaagauaauuguaacaacagcagcaacag

SEQ ID NO: 42723 - RNA, 45 nt, Mus musculus
guuguacuaugcuuuaugauaaggagacgucugcaugugcggcac

SEQ ID NO: 42724 - RNA, 45 nt, Mus musculus
aacucaagccagacccccuacaacaagaggauccagggccagcca

SEQ ID NO: 42725 - RNA, 46 nt, Mus musculus
gauaauuuaguagcauuagcaccccuuuuuaagacaacaacaacaa

SEQ ID NO: 42726 - RNA, 49 nt, Mus musculus
uccuuuaaucccaguaccugggagucagaggaagguggaucucuggguu

SEQ ID NO: 42727 - RNA, 47 nt, Mus musculus
uuccaccucuaaaauaagcccugaucauagaacagcgagcccguuac

SEQ ID NO: 42728 - RNA, 69 nt, Mus musculus
agagguggaagugggaaggaguagggcugaggaaacauacagugacuagacugaugucccagaauaggc

SEQ ID NO: 42729 - RNA, 45 nt, Mus musculus
agcgucuguauuaggaugcuccaauaaaccucagugcugccacuc

SEQ ID NO: 42730 - RNA, 45 nt, Mus musculus
ccaggccuaaacaaggcuggcaaguuccccucccugcugauacac

SEQ ID NO: 42731 - RNA, 50 nt, Mus musculus; identical to SEQ ID NO: 23563

SEQ ID NO: 42732 - RNA, 46 nt, Mus musculus
uucuuggccagcuucuugaccaacuucuuguucuuguuaagcuucu

SEQ ID NO: 42733 - RNA, 41 nt, Mus musculus
acaaaccuuuguccuucugagggucguaguucuucaggcug

SEQ ID NO: 42734 - RNA, 86 nt, Mus musculus
gcgggaaguccugcacgggaaccagugcaagcgccacaaguuucuggagaugguggagcugcagaucagccugaagaacuacgacc

SEQ ID NO: 42735 - RNA, 45 nt, Mus musculus
ccccggaagugggaucuguguguucucaugcgaacgggaaggagc

SEQ ID NO: 42736 - RNA, 44 nt, Mus musculus
acggcccuggccggggaggacuggagcgaagugagacgugugca

SEQ ID NO: 42737 - RNA, 46 nt, Mus musculus
augcuuugggggcuuguccauuuuguaaaaaagaaaaaauccugag

SEQ ID NO: 42738 - RNA, 45 nt, Mus musculus
aaccuacuguacacuguuucuucauugucugcuccaccuucuaag

SEQ ID NO: 42739 - RNA, 46 nt, Mus musculus
ggcaagugcucuagcguugcuccccgaggaauuuaauaaaccccaa

SEQ ID NO: 42740 - RNA, 41 nt, Mus musculus
gcauucucagaaugacguuguagucauuuugaggugggcag

SEQ ID NO: 42741 - RNA, 46 nt, Mus musculus
uuaaaggugcuuccgccaaaccugacaaacuugaauugacccccag

SEQ ID NO: 42742 - RNA, 46 nt, Mus musculus
agaggcaguaauaagcuuacagacaugaauuuuacuuaggggcaga

SEQ ID NO: 42743 - RNA, 46 nt, Mus musculus
auucccaggacccacauaaugccauccauaaugccaguucuaggag

SEQ ID NO: 42744 - RNA, 46 nt, Mus musculus
gagccagaaggagucagauuucuuggaaccuguggccugcuaugug

SEQ ID NO: 42745 - RNA, 46 nt, Mus musculus
uguuguuugcuuugcuuugcuuugguuuugguuuugguuuuuucag

SEQ ID NO: 42746 - RNA, 46 nt, Mus musculus
gguaguccagacuagccucuaacuuaggaugcuccaccccuuaaua

SEQ ID NO: 42747 - RNA, 42 nt, Mus musculus
acagaagcacauacauuaauuggauugcaacaacagugacag

SEQ ID NO: 42748 - RNA, 46 nt, Mus musculus
gaaacaacuuucucaugauuauugggagaggaacacaauacagagu

SEQ ID NO: 42749 - RNA, 46 nt, Mus musculus
aucagaagcuggggaaaaggaaaucuggccucuggcuggagaggug

SEQ ID NO: 42750 - RNA, 45 nt, Mus musculus
guuuuuaaaaguucacuuagcaaugaaaauuuuaaaaaggauuag

SEQ ID NO: 42751 - RNA, 45 nt, Mus musculus
uccccuccacccaauagcauauguguucuaacacuacccuccuga

SEQ ID NO: 42752 - RNA, 42 nt, Mus musculus
uaggaagauggaaugcaagugauaaagaauacuuugggacua

SEQ ID NO: 42753 - RNA, 46 nt, Mus musculus
gcaugguggugucuuuuugugguuuuaauuagcuuuucccugauga

SEQ ID NO: 42754 - RNA, 46 nt, Mus musculus
gacuugacagaacuggagcaaagcaggccaucagcuaugaccucag

SEQ ID NO: 42755 - RNA, 94 nt, Mus musculus
uauauuuaauuauuccuuguguauguauguguguguguguguguguguguguguguguguguaggauuaguuaggucagagggcaacuuaaggg

SEQ ID NO: 42756 - RNA, 46 nt, Mus musculus
gucaguguuuggaggcugauuaugggauggaucccggauauggcag

SEQ ID NO: 42757 - RNA, 45 nt, Mus musculus
uggccuguuacaaaaauguguggaagagaagaaaccggagaccaa

SEQ ID NO: 42758 - RNA, 45 nt, Mus musculus
augggauugcugaaccugcggcuacaacaguuagcacuugucaaa

SEQ ID NO: 42759 - RNA, 82 nt, Mus musculus
ucuguuuggggaagagaacugagcuuaauccagaaagugauguaugcauauagucaggaaagaaaaaauaagucauauggua

SEQ ID NO: 42760 - RNA, 44 nt, Mus musculus
aauaccaaaguaaagaauugcagguggauacuugcuuaggcauc

SEQ ID NO: 42761 - RNA, 46 nt, Mus musculus
gaaauaaccacugcugagauguuuuauuuuucauuggguuggggga

SEQ ID NO: 42762 - RNA, 42 nt, Mus musculus
uacaguucuaggauuggaugccaauggugauggcgacaaaag

SEQ ID NO: 42763 - RNA, 45 nt, Mus musculus
acaggaggcagagcagacagacaugagcacucuggcucuggacca

SEQ ID NO: 42764 - RNA, 42 nt, Mus musculus; identical to SEQ ID NO: 42762

SEQ ID NO: 42765 - RNA, 42 nt, Mus musculus
ggugaaguguccagacugacagaggaauugagagugaggcag

SEQ ID NO: 42766 - RNA, 46 nt, Mus musculus
uggacuucagauguguuguguccccuuguuacugcagagugacaga

SEQ ID NO: 42767 - RNA, 45 nt, Mus musculus
ggcauugcauaaguggguggugggguccucuaguaaugaaaggag

SEQ ID NO: 42768 - RNA, 45 nt, Mus musculus
cuugccguugugugaauccuuacagaccagcuucguucucuccag

SEQ ID NO: 42769 - RNA, 90 nt, Mus musculus
ccucauagucagcucucauggaucaggagguugaacucaaguccucauuugccuacacaaaaacacauaccaacuaagcugucaccccag

SEQ ID NO: 42770 - RNA, 58 nt, Mus musculus
cuucauccuacuaaaucauucccuucucucacuuccaguccccaucuacuucaaggua

SEQ ID NO: 42771 - RNA, 46 nt, Mus musculus
accaugguggucuuuccaaaauaucacccccccaaauugguuccag

SEQ ID NO: 42772 - RNA, 43 nt, Mus musculus
ggaggaaaugagucucaaccagaaagccaggaagacccucggg

SEQ ID NO: 42773 - RNA, 46 nt, Mus musculus
ucccagauggacagugaucaguaugugccaauuacaacgguagcua

SEQ ID NO: 42774 - RNA, 46 nt, Mus musculus
guuugaacauuuuaauaguucaccaaguguacaguuucucuggugu

SEQ ID NO: 42775 - RNA, 46 nt, Mus musculus
gaugagaagggagagaaaguaaggccaaaucagaaccggugcauag

SEQ ID NO: 42776 - RNA, 46 nt, Mus musculus
gacacauuugugaagugguucagaacagccuucauacagggcacag

SEQ ID NO: 42777 - RNA, 47 nt, Mus musculus
auuuuuuguuugcaaagugaggaaauuugaaccuaacccugaccagu

SEQ ID NO: 42778 - RNA, 52 nt, Mus musculus
uguggcaaagugcuuucaaagguauugagaaguuuugugcucuuaaaggagg

SEQ ID NO: 42779 - RNA, 46 nt, Mus musculus
uggccguggccugccuggugagccagaugggugagcauaggcggaa

SEQ ID NO: 42780 - RNA, 49 nt, Mus musculus
ucuaagaccuuccuuuccuacauuacauaaucucaguugcuaguugggu

SEQ ID NO: 42781 - RNA, 45 nt, Mus musculus
gaguguggcuguggacuagauagagaacaagugggggugcucagg

SEQ ID NO: 42782 - RNA, 46 nt, Mus musculus
aaauaggaagugggacacuugcaagaagagaggauucuggcuaaua

SEQ ID NO: 42783 - RNA, 46 nt, Mus musculus
ucagguagaugaaccuggagagagacugagggagacgcugaagagg

SEQ ID NO: 42784 - RNA, 45 nt, Mus musculus
gggccugggcugcuagaaaguccuucaauauuuaacuucacugca

SEQ ID NO: 42785 - RNA, 47 nt, Mus musculus
guuucuuuguuuuaaaagcauaugcugcuguuuauuuuacucacaga

SEQ ID NO: 42786 - RNA, 45 nt, Mus musculus
cuuguaaggcauugcacaauucauuucaauauuguuguaccccag

SEQ ID NO: 42787 - RNA, 23 nt, Mus musculus
agaccugcaggcgugugcugcaa

SEQ ID NO: 42788 - RNA, 46 nt, Mus musculus
aaaauaauggucuuuugcuuucuucuaggaaaaauuccuuuggcua

SEQ ID NO: 42789 - RNA, 46 nt, Mus musculus
uagcaaacaugagcacuaauuaaguggauuaagacugagauaugag

SEQ ID NO: 42790 - RNA, 48 nt, Mus musculus
uacaucuuguaaccugcuuaucuuuggaauuuuguaagugugugugug

SEQ ID NO: 42791 - RNA, 50 nt, Mus musculus
ccuccaucaccgagcuucgaacugggacuguccaacuuccccccauuacc

SEQ ID NO: 42792 - RNA, 62 nt, Mus musculus
uggagcugcaggcaauuugaagacagaggacuuguuugaaaacaggcuuuccagcuugauca

SEQ ID NO: 42793 - RNA, 68 nt, Mus musculus
uguacagaugccuagacccauaagucugaauuagagcagaaauaagacuugugguaaucuacguagug

SEQ ID NO: 42794 - RNA, 46 nt, Mus musculus
acacuuagcuagcaggcuggaaaugggauuugucccucugccaggg

SEQ ID NO: 42795 - RNA, 62 nt, Mus musculus
gcaagcacaaacacuguuccuguagugggacccagagagcccuccgugccagcgcccugugc

SEQ ID NO: 42796 - RNA, 58 nt, Mus musculus
aucccaagguggcagaaaagcagagggaaacucagaguguggacagacucccuucuac

SEQ ID NO: 42797 - RNA, 49 nt, Mus musculus
cccuacuacaacugcauguaaauccgugcaggugaauggagcagcaaca

SEQ ID NO: 42798 - RNA, 45 nt, Mus musculus
cuuucaguagugugugccuucauuucucuguaugaguucacugag

SEQ ID NO: 42799 - RNA, 60 nt, Mus musculus
gaacgaguaaagacccuucuuccuccucuccauugcaacccccaaaagaacaaaagccaa

SEQ ID NO: 42800 - RNA, 55 nt, Mus musculus
cugagccugucgagagacaccgagagcccccugcccuuaaguccacgccuggagu

SEQ ID NO: 42801 - RNA, 90 nt, Mus musculus
ggaagagcuguacccaccgugagaagcucucccacucaguacggaaugagccgcugguuaggagcuugcagugucuguggggcccguggg

SEQ ID NO: 42802 - RNA, 45 nt, Mus musculus
auacuguuguacaagaacuccagugguuuuuguaacauaccuaca

SEQ ID NO: 42803 - RNA, 23 nt, Mus musculus
auacuaaucauaugugauaugug

SEQ ID NO: 42804 - RNA, 46 nt, Mus musculus
ucagagcaacugucauucaguuacauaggaguauacgcagugcuga

SEQ ID NO: 42805 - RNA, 46 nt, Mus musculus
gaauuuccuuauagaugucagaucacugacaaaaaaaaaaaaaaaa

SEQ ID NO: 42806 - RNA, 46 nt, Mus musculus
augcuuacuuaccauauggaaauacggacuaggaaucuggccccac

SEQ ID NO: 42807 - RNA, 47 nt, Mus musculus
ucgaagauuccaggagugcuaacuaacagcugcaagucacagacggg

SEQ ID NO: 42808 - RNA, 45 nt, Mus musculus
agggcgacauggacagaaaggguaagcagcugaaggagaagugca

SEQ ID NO: 42809 - RNA, 42 nt, Mus musculus
gaagguccugguugccucgguuuaggaccugaagaacagaga

SEQ ID NO: 42810 - RNA, 45 nt, Mus musculus
uugaggcuugcauauucauuagggcugcauuccccgcccccgccc

SEQ ID NO: 42811 - RNA, 54 nt, Mus musculus
acaccuaccuaaacaugcaaggaaaaggaaaaagggagaagagagaagaggaag

SEQ ID NO: 42812 - RNA, 46 nt, Mus musculus
uucuugucuguuguaguuucacagucacuugcucuaagguggggau

SEQ ID NO: 42813 - RNA, 42 nt, Mus musculus
gaugagcgagcggaggguggggcuuugagguucaggcccuua

SEQ ID NO: 42814 - RNA, 46 nt, Mus musculus
gaguuguuagcugucuaauccugcugauauuccgaguucaggguga

SEQ ID NO: 42815 - RNA, 75 nt, Mus musculus
ugagacauccgccuccgugcaagaugacguccuuagcccagcagcuccagcgacucgcccucccucaaacugauc

SEQ ID NO: 42816 - RNA, 46 nt, Mus musculus
ccaaggaggcggccacaaucgacagggacaccgccuuugccaucgg

SEQ ID NO: 42817 - RNA, 45 nt, Mus musculus
ucuaacacaugguaacagaguucaugagcuugggggugaggagaa

SEQ ID NO: 42818 - RNA, 46 nt, Mus musculus
gagcuucuugggauugacccugccuuugaacaguuugaagcgccau

SEQ ID NO: 42819 - RNA, 46 nt, Mus musculus
cucuuuaccagauuauagagcugcgacauacaugauaaucugucag

SEQ ID NO: 42820 - RNA, 43 nt, Mus musculus
gagaagaagcugaagggauugauggucagaucuacaagaacca

SEQ ID NO: 42821 - RNA, 45 nt, Mus musculus
gccaucuuuuugaagaauauauuucauacaguucccaggaggaaa

SEQ ID NO: 42822 - RNA, 41 nt, Mus musculus
ccagagcguuggaugcuguguuagaggagcaccugaaggag

SEQ ID NO: 42823 - RNA, 46 nt, Mus musculus
gcccugggauaugcuuuauuuuuuauuucuuuuuuuaaugcaugag

SEQ ID NO: 42824 - RNA, 46 nt, Mus musculus
guguaggaaaccagaagaugguucagcugcugggcagcaauuuaag

SEQ ID NO: 42825 - RNA, 60 nt, Mus musculus
ucugggaagccauaucaaagaaguccgcagagcugccguccagugucuccaggcccucag

SEQ ID NO: 42826 - RNA, 53 nt, Mus musculus
agggguacccucaaaguuugagcuggugauagaucaccucauuccuaaggcag

SEQ ID NO: 42827 - RNA, 48 nt, Mus musculus
agaaugaagagaaacagaaaucacaucagaaguugucugaaacccuga

SEQ ID NO: 42828 - RNA, 47 nt, Mus musculus
ggcugcccaucuuacauugcaaaaggcuugaugaaaguacuccaagg

SEQ ID NO: 42829 - RNA, 41 nt, Mus musculus
uaaccacgugcucccagggggaugauguucuucacgaaucu

SEQ ID NO: 42830 - RNA, 45 nt, Mus musculus
gugcuugcccagcugcugccuaugguggaacaacuccuagagaag

SEQ ID NO: 42831 - RNA, 90 nt, Mus musculus
aaaggagcuucacccaggaaugccaacuguucggaucacugcucucgaaaaggucaguggcuuccuuuagaaacccaagcuuaaccaagc

SEQ ID NO: 42832 - RNA, 46 nt, Mus musculus
ugaggggcuugauguugcgcaagaugaccuuauuuuacuuaaauag

SEQ ID NO: 42833 - RNA, 45 nt, Mus musculus
cgguauguauguaacaauaacggagcaugugcauacacauaacag

SEQ ID NO: 42834 - RNA, 83 nt, Mus musculus
gauuucugucgaugcugaacaaaucagaauagaacuggagccacgagauaaagcuaaaucuuugggcacaauucagcaaacga

SEQ ID NO: 42835 - RNA, 45 nt, Mus musculus
auccuggaguugcugcagcacaagaagaagcucaagugcccucag

SEQ ID NO: 42836 - RNA, 46 nt, Mus musculus
gauaaaguucuucacaacaucaugucuauuuuuacauucaugggag

SEQ ID NO: 42837 - RNA, 45 nt, Mus musculus
auguuugugcuuuuuuaaauuucucgggaauaaguucaacuugca

SEQ ID NO: 42838 - RNA, 46 nt, Mus musculus
uuugccucuucucgccgggacacuguauggaucagcaguuggucag

SEQ ID NO: 42839 - RNA, 46 nt, Mus musculus
cuguguagcaugaccaagacccuagcugacugcucuacacuggggg

SEQ ID NO: 42840 - RNA, 46 nt, Mus musculus
uguuugauugggccaagacagaagaugcgccgaaggacaggcuguu

SEQ ID NO: 42841 - RNA, 44 nt, Mus musculus
aaggucuuccuuuuugacacccagaauuucaugaguagggagag

SEQ ID NO: 42842 - RNA, 46 nt, Mus musculus
uuccagagggagaaguuggugcuaagggcuuuugcagcuguuugag

SEQ ID NO: 42843 - RNA, 46 nt, Mus musculus
uggaaaacaggcuuggaggagaagaaagguuucaggaacggguaac

SEQ ID NO: 42844 - RNA, 60 nt, Mus musculus
uggccauggcagaugacuccauguggaaaccccugaacuaccagauuuugcugaagacaa

SEQ ID NO: 42845 - RNA, 45 nt, Mus musculus
ggagagcaauggugugugugugugugugugugugugugugugugu

SEQ ID NO: 42846 - RNA, 94 nt, Mus musculus
guuugcagccuugauuacugucuuggcacuggcugagaagcugagagagaauuacauuguucugcuaccagaguccauuccuuuccuagcagag

SEQ ID NO: 42847 - RNA, 41 nt, Mus musculus
gcuucugcaucugaccagaagcauacccuuuuaugucuggu

SEQ ID NO: 42848 - RNA, 55 nt, Mus musculus
accauccagcagcuggaggccgugcugggagagccgcugcagagcuacuucugag

SEQ ID NO: 42849 - RNA, 42 nt, Mus musculus
cuccugccuuuuguacagaguugcuaaggaguaaaccggaug

SEQ ID NO: 42850 - RNA, 46 nt, Mus musculus
acauagcaagacccucucucaaaaaacuaaacaaugaaccagucag

SEQ ID NO: 42851 - RNA, 30 nt, Mus musculus
agggaucauuguuucugaaaggaaauuaga

SEQ ID NO: 42852 - RNA, 46 nt, Mus musculus
auauuugagcaaagaccuuucuaaugugaaaguauaaguggugggg

SEQ ID NO: 42853 - RNA, 49 nt, Mus musculus
gaggaacuagaaggcaacuuaggccacagaaagcaggugaaugagaagg

SEQ ID NO: 42854 - RNA, 45 nt, Mus musculus
ucaccuccagugacacacuuccuccaacaaagccauccaccgaau

SEQ ID NO: 42855 - RNA, 44 nt, Mus musculus
acagcaucuaugaagaaaacugcuucaaguaauugagggccgga

SEQ ID NO: 42856 - RNA, 45 nt, Mus musculus
gaaacugcuggacagaggaagaggggaaagaaaucaacaaagaga

SEQ ID NO: 42857 - RNA, 24 nt, Mus musculus
ugggcaaaagacuaauccucuaga

SEQ ID NO: 42858 - RNA, 41 nt, Mus musculus
gaaggacuggacucaucuaaggggauggguuaagaggccac

SEQ ID NO: 42859 - RNA, 44 nt, Mus musculus
uucgugguuuacugguauaauuaaauacuaugcuuguugccuca

SEQ ID NO: 42860 - RNA, 49 nt, Mus musculus
ucuuuccuaguuugaggauguuuguuucagagccaucugugguaaggag

SEQ ID NO: 42861 - RNA, 44 nt, Mus musculus
gaaguguugugcuuguguguguugugcuuguguguguugugcuu

SEQ ID NO: 42862 - RNA, 45 nt, Mus musculus
ucuggagugucugaagacagcuacaguguacuuacauauaaauca

SEQ ID NO: 42863 - RNA, 44 nt, Mus musculus
guacuccucuuguuuuggauuauguggaggaucagccgaacaac

SEQ ID NO: 42864 - RNA, 46 nt, Mus musculus
gacuugaauucaggcuggcagcaaugugcauagcaguuugguagaa

SEQ ID NO: 42865 - RNA, 46 nt, Mus musculus
ugcuaaugucuuccuguuccacagacaaggaacuugagacauagac

SEQ ID NO: 42866 - RNA, 35 nt, Mus musculus
cugagauagaacacauugcugucucagagaggagg

SEQ ID NO: 42867 - RNA, 47 nt, Mus musculus
ucugggacauccaggcagaccucuuggauccucuucuaaagccagag

SEQ ID NO: 42868 - RNA, 46 nt, Mus musculus
ccauggauucagucccagaucuuacuucuuugacaacccccgaaga

SEQ ID NO: 42869 - RNA, 100 nt, Mus musculus
cgccucucgggccugcuacaaccuguucaucuugucauuuucucagaucaagaacguccauuccuuugauuaugacugguacaauguauccgaccaggua

SEQ ID NO: 42870 - RNA, 46 nt, Mus musculus
uuucccaacuguggucccacaaucccggcgguuuagcagcucaggc

SEQ ID NO: 42871 - RNA, 41 nt, Mus musculus
ugaucguacggacaucacgucggucuaugugaguuggggcc

SEQ ID NO: 42872 - RNA, 42 nt, Mus musculus
gccagggcauuacuaugaucgauucacauuguaaaugagcaa

SEQ ID NO: 42873 - RNA, 46 nt, Mus musculus
aaucauacacuaaaauaaaugaaaauaucuaaaaaguagcagguaa

SEQ ID NO: 42874 - RNA, 46 nt, Mus musculus
gacuugaauucaggcuggcagcagugugcauagcaguuugguagaa

SEQ ID NO: 42875 - RNA, 46 nt, Mus musculus
ugcuaaugucuuccuguugcacagacaaggaacuugagacauagac

SEQ ID NO: 42876 - RNA, 75 nt, Mus musculus
gauagaacacauugcugucucagagaggagggaggagagacccccugaucagauaacaagacaagguagccagua

SEQ ID NO: 42877 - RNA, 45 nt, Mus musculus
gggacauccaggcagacaucuuggauccucuucuaaagccagaga

SEQ ID NO: 42878 - RNA, 46 nt, Mus musculus; identical to SEQ ID NO: 42868

SEQ ID NO: 42879 - RNA, 44 nt, Mus musculus
augaagucucgugacucucuucuccuugcucuggcacaggcaga

SEQ ID NO: 42880 - RNA, 120 nt, Mus musculus
caccucucgggccugcuacaaccuguucaucuugucauuuucucagaucaagaacguccauuccuuugauuaugacugguacaauguauccgaccagguaggugggacaugacaaggugc

SEQ ID NO: 42881 - RNA, 46 nt, Mus musculus
cacucuuugugcugugugcuaucucucucuccaucugccucuacaa

SEQ ID NO: 42882 - RNA, 42 nt, Mus musculus
agcagaccccgaagcccaccaagugcuuuggaggccccacuu

SEQ ID NO: 42883 - RNA, 46 nt, Mus musculus
aacauucuaagaguauuacucuuaacuuauuuaaaugcuuuuaggg

SEQ ID NO: 42884 - RNA, 45 nt, Mus musculus
ucuaauguuucuaaauguauuuccucacaugaucauaguuccaau

SEQ ID NO: 42885 - RNA, 41 nt, Mus musculus
aaaagugcaagccugucuauucaucacacucccaggccagu

SEQ ID NO: 42886 - RNA, 45 nt, Mus musculus
acacccugaagcaaugggaugaugucugguucugggaggcaaugg

SEQ ID NO: 42887 - RNA, 45 nt, Mus musculus
gugacguguguguguguguguguguguguguguguguguuugucu

SEQ ID NO: 42888 - RNA, 46 nt, Mus musculus
augccugcauccccagagauggagguccugagguaggaggcugggu

SEQ ID NO: 42889 - RNA, 36 nt, Mus musculus
gagacuucguggcagccaacucguucagccccuucg

SEQ ID NO: 42890 - RNA, 46 nt, Mus musculus; identical to SEQ ID NO: 42870

SEQ ID NO: 42891 - RNA, 41 nt, Mus musculus
uggaggccggggacgacgugguaucccccucccuggaacug

SEQ ID NO: 42892 - RNA, 45 nt, Mus musculus
cagccccugcaucugugugcguggguucuggcuacgucuuggcag

SEQ ID NO: 42893 - RNA, 45 nt, Mus musculus
cugagaacgcagggcgccccggugauccaauuuccuguggcugag

SEQ ID NO: 42894 - RNA, 46 nt, Mus musculus
uccugugucuagcagacacucaagcuucaagcuaacagucugggag

SEQ ID NO: 42895 - RNA, 45 nt, Mus musculus
auuccaccagggacugaaauauaauugacuaauuauagugaccaa

SEQ ID NO: 42896 - RNA, 45 nt, Mus musculus
uucaaauguuauucccuuuccugguuuccccuccuaaaacccccu

SEQ ID NO: 42897 - RNA, 46 nt, Mus musculus
aauaaaauaaaaaauuauaaaagaucuacauggaaugggugcagag

SEQ ID NO: 42898 - RNA, 27 nt, Mus musculus
aagcagagagaaccuguaaaagagacu

SEQ ID NO: 42899 - RNA, 42 nt, Mus musculus
uguccuagaggacaaaugacugccucuagguaauggauagag

SEQ ID NO: 42900 - RNA, 46 nt, Mus musculus
agucacaugacauugcuaaccuuuuccaauguucauucccagccag

SEQ ID NO: 42901 - RNA, 57 nt, Mus musculus
guggguugaggagcagggggaggggauaggggauuuucggaggggaaacuaggaaag

SEQ ID NO: 42902 - RNA, 53 nt, Mus musculus
gaaggcucuaugccccagcguaggggaaugccagggccaggaagcagaagugg

SEQ ID NO: 42903 - RNA, 45 nt, Mus musculus
uguccaauguaugacugugagcauccacuucuguauuugccaggc

SEQ ID NO: 42904 - RNA, 41 nt, Mus musculus
auaaaucuuuuaaaaacucaucagcaacaagaauaaggaga

SEQ ID NO: 42905 - RNA, 42 nt, Mus musculus
acauaucggagcugcacauaagguuagagagauggcucagug

SEQ ID NO: 42906 - RNA, 28 nt, Mus musculus
gcaguuaugagccaaagugaaggacaca

SEQ ID NO: 42907 - RNA, 45 nt, Mus musculus
guugaaacaauuagaccuaagugauuccagcuguugcucauguag

SEQ ID NO: 42908 - RNA, 45 nt, Mus musculus
ugacacauuuccaaaaauaaaaagcuuaaagggagaagccugaag

SEQ ID NO: 42909 - RNA, 45 nt, Mus musculus
ucaaacgggcugaaggaacagcuuucccaguaauaauaccaagga

SEQ ID NO: 42910 - RNA, 44 nt, Mus musculus
ggucaccacaaaugguaucaucgccaugagcgaacccccagcca

SEQ ID NO: 42911 - RNA, 69 nt, Mus musculus
acacaaccgauggccuggggaauguguauuaucgagaagacuuauccccguucauuauucagauggcag

SEQ ID NO: 42912 - RNA, 47 nt, Mus musculus
ugggaaucuguggccccuuauggagggcccagcagcagcccugccga

SEQ ID NO: 42913 - RNA, 48 nt, Mus musculus
uccuuuauccugaagauggucuacaguucuuuacaacauucucgaaga

SEQ ID NO: 42914 - RNA, 101 nt, Mus musculus
gaugaaagccaaguaccugcugugguugguuucagcaaaggucuaguaggauuucuauggaagagcaacggagccuauaacauauuugccaaugacagaga

SEQ ID NO: 42915 - RNA, 46 nt, Mus musculus
caagcaaacuuuauaugccccaguacaggggaacaccagugcccaa

SEQ ID NO: 42916 - RNA, 41 nt, Mus musculus
uaggagcagcaacgcugggcaccaggguguguggguguuug

SEQ ID NO: 42917 - RNA, 45 nt, Mus musculus
cccuuggcgguagcaggacuuccaaucucaaacacccacacaccc

SEQ ID NO: 42918 - RNA, 52 nt, Mus musculus
cguggugucugcagaugugaaccuggaccuggacgacgauggagcagacuau

SEQ ID NO: 42919 - RNA, 84 nt, Mus musculus
ggucucucuguagccucauagccaggagagaggauccuagguacauugugugggucaggguauccccuucuuggacugugggag

SEQ ID NO: 42920 - RNA, 48 nt, Mus musculus
cucccccucccacaguccaagaaggggauacccugacccacacaaugu

SEQ ID NO: 42921 - RNA, 46 nt, Mus musculus
gguucccucagcaucacccccaggucauugauguggaugaaguaga

SEQ ID NO: 42922 - RNA, 46 nt, Mus musculus
ugccuuuauuuuucaugagauacauacacagagagagagagagaga

SEQ ID NO: 42923 - RNA, 41 nt, Mus musculus
agagagagagagagagagagagagagacagagagaggggca

SEQ ID NO: 42924 - RNA, 70 nt, Mus musculus
cagcuacaacacagguucccagcagacuugugccaacaauagacaccagugcuccgugcaugcagagugc

SEQ ID NO: 42925 - RNA, 45 nt, Mus musculus
cuucuucccccuccccccagcucugucccucucuaucuggcuuag

SEQ ID NO: 42926 - RNA, 34 nt, Mus musculus
caggcucuccacaacgggucaauggcaaggugaa

SEQ ID NO: 42927 - RNA, 46 nt, Mus musculus
ccagggggagcagagaguagccgacgguuucagggauggugcugau

SEQ ID NO: 42928 - RNA, 46 nt, Mus musculus
ggcacccauuggaggcaucaucggauggauguuugcaguggagcag

SEQ ID NO: 42929 - RNA, 46 nt, Mus musculus
ucauuauguauuuaaauacguauuuauagaacacauggaaguagaa

SEQ ID NO: 42930 - RNA, 67 nt, Mus musculus
caggaccagcuugccugggugccccaggaaggucaccucagcuugccggguaaacucgcccccugga

SEQ ID NO: 42931 - RNA, 67 nt, Mus musculus
accuuccuggggcacccaggcaagcugguccugaagcagcaguucagcgguauugaugaacauggac

SEQ ID NO: 42932 - RNA, 24 nt, Mus musculus
uggagccucggugcacauugagcc

SEQ ID NO: 42933 - RNA, 42 nt, Mus musculus
ggcagagaugucugacagaauccagaguggauucagugccac

SEQ ID NO: 42934 - RNA, 50 nt, Mus musculus
ugaucaggcuccaucaccguguacucccggguggaggaggaagugaucac

SEQ ID NO: 42935 - RNA, 51 nt, Mus musculus
gugauggagccugaucaggacggcgcugcacccucacacacccauauuuac

SEQ ID NO: 42936 - RNA, 51 nt, Mus musculus
ggagugugcccacgaugacgccaggccagcccugcccagcacccagcagcu

SEQ ID NO: 42937 - RNA, 42 nt, Mus musculus
ccucacaggcccgauggaguugcugagggcauagcgcaagau

SEQ ID NO: 42938 - RNA, 44 nt, Mus musculus
augcugccugucgcccuggcccuggaacacaguucaccugcgaa

SEQ ID NO: 42939 - RNA, 46 nt, Mus musculus
gaaccaugcggucugcaacaaccucccaggaaccuuccgcugcgag

SEQ ID NO: 42940 - RNA, 45 nt, Mus musculus
aaacugggcauggugauacaugcccgucauuccgguguccuagag

SEQ ID NO: 42941 - RNA, 42 nt, Mus musculus
guggggagcacggagcaaagcugaggaccucacuggcagcua

SEQ ID NO: 42942 - RNA, 25 nt, Mus musculus
cuucaauccccaacacagaugaaga

SEQ ID NO: 42943 - RNA, 31 nt, Mus musculus
uagcuaagaagugccaagucagucgggcggu

SEQ ID NO: 42944 - RNA, 66 nt, Mus musculus
gcugucaucccccugccuccagggacacacuuacucuuugcucagacuggaaagauugaacgccug

SEQ ID NO: 42945 - RNA, 60 nt, Mus musculus
ccccuggagagaaacaccaugaagaagacagaagccaaggccuuucuccauaucccugug

SEQ ID NO: 42946 - RNA, 46 nt, Mus musculus
uucauuuaaaauacuaucugagauguauacgcaagcacugggaaag

SEQ ID NO: 42947 - RNA, 46 nt, Mus musculus
ugacugcguggacaaggugguuuacuggacagacaucagcgagccu

SEQ ID NO: 42948 - RNA, 41 nt, Mus musculus
gauccuggcuaguuggauuccaagugagaacuagggagagg

SEQ ID NO: 42949 - RNA, 41 nt, Mus musculus
cuagguucaguaagagacccuguuucaaagcgggggacagu

SEQ ID NO: 42950 - RNA, 45 nt, Mus musculus
gagcucaucaauugcacuacccugggcagccaaacagccccagag

SEQ ID NO: 42951 - RNA, 46 nt, Mus musculus
caagcggcuugaggugggcugugauuaauuuuauauggccagagac

SEQ ID NO: 42952 - RNA, 133 nt, Mus musculus
caucuuggucgaaccaucuucuggacggacucucaguuggaucgaauagaaguugcaaagauggauggcacccagcgccgagugcuguuugacacggguuuggugaaucccagaggcauugugacagaccccg

SEQ ID NO: 42953 - RNA, 44 nt, Mus musculus
ccucugggauucaccaaacccgugucaaacagcacucggcgcug

SEQ ID NO: 42954 - RNA, 100 nt, Mus musculus
ucaggaaccuuuauuggacagauuggaacagagacaaucccaaaauugagacuucucacauggauggcaccaaccggaggauucucgcacaggacaaccu

SEQ ID NO: 42955 - RNA, 46 nt, Mus musculus
aaagcugagaugagaaugcaucaaaggucagaccauugggcaagcc

SEQ ID NO: 42956 - RNA, 44 nt, Mus musculus
ggcugagcuggguucaggcauucugcccuaugggugccugugug

SEQ ID NO: 42957 - RNA, 57 nt, Mus musculus
cgaagggcuccaguauccuuucgcugugacuagcuaugggaagaauuuguacuacac

SEQ ID NO: 42958 - RNA, 41 nt, Mus musculus
acauaaucaaagagaccuccagccaugugaccccagguagc

SEQ ID NO: 42959 - RNA, 104 nt, Mus musculus
cagugauugccauggaccuugcuauauccaaagagauggauaccuuccacccacacaagcagacccggcuauauggcaucaccaucgcccugucccaguguccc

SEQ ID NO: 42960 - RNA, 46 nt, Mus musculus
guggaagguauccaucucuuuggauauagcaagguccauggcaauc

SEQ ID NO: 42961 - RNA, 79 nt, Mus musculus
auuuccguucaaugcagucaacucccaggguguugucaggacaucggcagguccugcucccuggagugggcaagcagag

SEQ ID NO: 42962 - RNA, 48 nt, Mus musculus
accugccgauguccugacaacacccugggaguugacugcauugaacgg

SEQ ID NO: 42963 - RNA, 53 nt, Mus musculus
gacugaaaaguguccugcaguggaaugaccaccaggcccagaucuagccuagc

SEQ ID NO: 42964 - RNA, 46 nt, Mus musculus
uagggaagguuaaggagagguugugagagcucaggcuaggcuagau

SEQ ID NO: 42965 - RNA, 41 nt, Mus musculus
uaacaugagggcaggacacacacacacacacacacacccuu

SEQ ID NO: 42966 - RNA, 48 nt, Mus musculus
uggcuuuuuauccagaacuuuauaaacuugucuaaagacugagaucaa

SEQ ID NO: 42967 - RNA, 43 nt, Mus musculus
uacaugccugcaacccuagcacuugggaggcagaggcaggaga

SEQ ID NO: 42968 - RNA, 105 nt, Mus musculus
guaauaucugaguuuguaaugccaccaagaaguagccuccuuaggucgcuaaggcucugcuuaccaugggagagucuagaauuaggaagaaguccuauggcucua

SEQ ID NO: 42969 - RNA, 51 nt, Mus musculus
ccuaaggaggcuacuucuugguggcauuacaaacucagauauuacccaguu

SEQ ID NO: 42970 - RNA, 64 nt, Mus musculus
acuacucuccuguuguauaccuucauucugcccaagacugcuuucagugccuucucugccauau

SEQ ID NO: 42971 - RNA, 56 nt, Mus musculus
aaggcacugaaagcagucuugggcagaaugaagguauacaacaggagaguaguuag

SEQ ID NO: 42972 - RNA, 56 nt, Mus musculus
cauagguaagucaaggaaaaguccugagagagggauuugaagucaagauguuugaa

SEQ ID NO: 42973 - RNA, 48 nt, Mus musculus
guagcaaauucuucuucuuugccaaaguaccuguauuaguuucugguc

SEQ ID NO: 42974 - RNA, 46 nt, Mus musculus
gauugugucuucagaugaggaucuagucagaaagggccacagagag

SEQ ID NO: 42975 - RNA, 45 nt, Mus musculus
uuuugaaacaaaucacagacagaaacauggaaggcagcaacaguc

SEQ ID NO: 42976 - RNA, 45 nt, Mus musculus
ccauguuucugucugugauuuguuucaaaaauauccgcuggccag

SEQ ID NO: 42977 - RNA, 46 nt, Mus musculus
uagaugacagauaaguagagagauaggugauagauaauaguagaua

SEQ ID NO: 42978 - RNA, 47 nt, Mus musculus
cuagacacucaaaggauuaauaauuuuggauuggaagucaagcauca

SEQ ID NO: 42979 - RNA, 82 nt, Mus musculus
auggagaacagggauggaaaaucccagaagaaacagcaguggagaggcuuaaaggcagcuaaaacuaaaagccuuaaacaac

SEQ ID NO: 42980 - RNA, 45 nt, Mus musculus
cccccuaccuccuuuucuucuacuuucacuguacucagcccccaa

SEQ ID NO: 42981 - RNA, 53 nt, Mus musculus
ccaauuuagauucccaguccaauguaagcaggucgagguggagguaggagaua

SEQ ID NO: 42982 - RNA, 46 nt, Mus musculus
agcggaagaaaauaguuuuaguuuacucaauauuacaugcuagaag

SEQ ID NO: 42983 - RNA, 46 nt, Mus musculus
acuguauucuucauagcccccauagccugaacuauaggcaccagac

SEQ ID NO: 42984 - RNA, 46 nt, Mus musculus
ugcuucccuaaagcuuucucagcuaacucuuguaaggcaaacugaa

SEQ ID NO: 42985 - RNA, 44 nt, Mus musculus
ugaacaccucaauauaccggugucccaugcuuucccugucuuuu

SEQ ID NO: 42986 - RNA, 47 nt, Mus musculus
guauaaaugaaaugaacaccugcgaccccaucaugaauugugcaguc

SEQ ID NO: 42987 - RNA, 46 nt, Mus musculus
cuuuugggugaaggucuuagucacuguucuauuguugugaagagau

SEQ ID NO: 42988 - RNA, 51 nt, Mus musculus
cuuuuuguuugucacagauguacaaccuguaugaaauagugaaaagugagu

SEQ ID NO: 42989 - RNA, 87 nt, Mus musculus
cguugagacuauggugcuguacacaggagagaaaccaucagaaaaggaucagggcaagaggauuguugaaagaaacauaaagaggcc

SEQ ID NO: 42990 - RNA, 42 nt, Mus musculus
acauguccuuuguggauauugcuaugagaaaguacgccagga

SEQ ID NO: 42991 - RNA, 46 nt, Mus musculus
auaaucucauaaauaauaaaucuuuucuuagaacacagguuaagau

SEQ ID NO: 42992 - RNA, 39 nt, Mus musculus
cuggagucgcuuugucaguccuccgugggguccguaagg

SEQ ID NO: 42993 - RNA, 46 nt, Mus musculus
ugaccucaugagacaagagccggcugacaaaacagaagggacccga

SEQ ID NO: 42994 - RNA, 45 nt, Mus musculus
gcugaagaggagaaggaaaaaaaaaguccaaaaaaaccugugcgu

SEQ ID NO: 42995 - RNA, 66 nt, Mus musculus
ccuugcuuuggcugagaggauuucuguuggcaaguugcuggauuauagugaggaguucccccaccc

SEQ ID NO: 42996 - RNA, 48 nt, Mus musculus
agaugguagaggcugucaagaagcacaucuuaaacaugcugcacuuga

SEQ ID NO: 42997 - RNA, 48 nt, Mus musculus
ucagaaagcuucauguggguaaagugggggagaacggguauguggaga

SEQ ID NO: 42998 - RNA, 46 nt, Mus musculus
accucuggaaaaccuaccucuaugaaaaacccaccgaagaagcaaa

SEQ ID NO: 42999 - RNA, 42 nt, Mus musculus
ggaaggaugugccaagagaugagcacgggguuuugccuguag

SEQ ID NO: 43000 - RNA, 47 nt, Mus musculus
caugcaauacacaaauagcaguuccagaaauggacaccaggagaagg

SEQ ID NO: 43001 - RNA, 45 nt, Mus musculus
aagacacugcacuuugagauuuccaaggaaggcagugaccuguca

SEQ ID NO: 43002 - RNA, 70 nt, Mus musculus
gggggaugaggccgaggaaaugggcuuaaagggggagaggagugaacuguugcuaucagagaaaguaguu

SEQ ID NO: 43003 - RNA, 55 nt, Mus musculus
gaguggugccagucuagugcuucugggcaagaagaagaagaaagagguggaugga

SEQ ID NO: 43004 - RNA, 55 nt, Mus musculus
cugcaggcuaggcaguccgaagaccacccucaucgcaggcguaggcggggcuugg

SEQ ID NO: 43005 - RNA, 46 nt, Mus musculus
gccaauuauugugagggggagugcccaagccacauagcaggcaccu

SEQ ID NO: 43006 - RNA, 59 nt, Mus musculus
ccuagagucgccaggucccagagaaaauggaucuagagaguccagagaagacaguggca

SEQ ID NO: 43007 - RNA, 48 nt, Mus musculus
aacaaaaaucaaaaacuaaacugaaaacaagaccuaaugaaacagaug

SEQ ID NO: 43008 - RNA, 53 nt, Mus musculus
ggguuagcacaacccaaauaauaaugucuagaaagccaugaguuuuaaagggc

SEQ ID NO: 43009 - RNA, 42 nt, Mus musculus
acacacacacacacacacacacgcccccccacacacacacac

SEQ ID NO: 43010 - RNA, 47 nt, Mus musculus
cacuuuugccaccagacaaaaccaacauaaaacauugagaacaagag

SEQ ID NO: 43011 - RNA, 45 nt, Mus musculus
guauuguucaccaucaaugagucagggguacagauuuaagguuga

SEQ ID NO: 43012 - RNA, 45 nt, Mus musculus
uguacacuguuggauuaucaaguucaaauucaugagacuacaugc

SEQ ID NO: 43013 - RNA, 80 nt, Mus musculus
uucuugcuuuuacucuguaguacguggguacauuucaaauguuaggauggggaaagacugaaaaucccagugaguaucca

SEQ ID NO: 43014 - RNA, 65 nt, Mus musculus
uuauuacuacuuaaauaauaaaauaagcaggaaaguauuuaagacagugagaguuaagggagaga

SEQ ID NO: 43015 - RNA, 45 nt, Mus musculus
guauuuuguaaaauauugaagcuuuuagcauuaagucaguccaua

SEQ ID NO: 43016 - RNA, 46 nt, Mus musculus
agucuuguuacugggcaaacauauuuacuguguuccaggggcccuc

SEQ ID NO: 43017 - RNA, 48 nt, Mus musculus
agugggcaagagaucuaacugugccauaucagagaugaucuagaccau

SEQ ID NO: 43018 - RNA, 46 nt, Mus musculus
ggucuccccacuuucucuaggauaauucuuaaauaccugcccacac

SEQ ID NO: 43019 - RNA, 42 nt, Mus musculus
gccuuguguuuucuuaaaaggcagaauaaguaaaauugggag

SEQ ID NO: 43020 - RNA, 41 nt, Mus musculus
auuaaacccuguaucacugagaagcuauuggaggggucaga

SEQ ID NO: 43021 - RNA, 73 nt, Mus musculus
ugaaaucuguuuugaucuaaaacuuuuuauguuaugugguugauguuguuuguuuguuuuuuauuuuuauuuu

SEQ ID NO: 43022 - RNA, 46 nt, Mus musculus
gcugguaauuuuuuauuuacgauauguuuaaagagauaacgguugg

SEQ ID NO: 43023 - RNA, 47 nt, Mus musculus
aguaggcaguauucagcaaugcccgauagcuucuuuggccuuauguu

SEQ ID NO: 43024 - RNA, 45 nt, Mus musculus
aguacacaccagagaaauauuuuccuuguagaagacauggcaacu

SEQ ID NO: 43025 - RNA, 46 nt, Mus musculus
augguuauaagcaacuaccuugguucugggaaacaaaccuaggccu

SEQ ID NO: 43026 - RNA, 46 nt, Mus musculus
uccugcugccuaacaaagcuucccacuagacaguggcacaacuuag

SEQ ID NO: 43027 - RNA, 46 nt, Mus musculus
gauugaaaucaacuuuccagcugaguauccauucaaaccacccaag

SEQ ID NO: 43028 - RNA, 45 nt, Mus musculus
augacccccagccugagcacccacuccgggcugaccgagcugaag

SEQ ID NO: 43029 - RNA, 46 nt, Mus musculus
guacaggggaacaccagggccaaaaagugggaauggguggguaagg

SEQ ID NO: 43030 - RNA, 42 nt, Mus musculus
agagggagagaguagaaaaguagaggccauggccacguggag

SEQ ID NO: 43031 - RNA, 46 nt, Mus musculus
gauacauauacaugaguacaugugguaugugugugagaugggggag

SEQ ID NO: 43032 - RNA, 42 nt, Mus musculus
agagaagaagaaggaagggagggagagggggagaggaagggg

SEQ ID NO: 43033 - RNA, 47 nt, Mus musculus
caaaagaaaauugucuggaacagaacaaacacagagagagagagaga

SEQ ID NO: 43034 - RNA, 45 nt, Mus musculus
guugugaaggugacacugacuccugaggaagaggccugccugaag

SEQ ID NO: 43035 - RNA, 46 nt, Mus musculus
guuuggacuuuugcucuguauuauagugcuaaaugcuggcccccag

SEQ ID NO: 43036 - RNA, 44 nt, Mus musculus
aguuuggguucucaagcuuggggucugagaagaccaggaggugg

SEQ ID NO: 43037 - RNA, 42 nt, Mus musculus
uugagugaccuguuuaccugcccucuugcagaaacuugguga

SEQ ID NO: 43038 - RNA, 42 nt, Mus musculus
caguucggcuacuccccagggcagcagcagaccuacccccag

SEQ ID NO: 43039 - RNA, 45 nt, Mus musculus
cccuuuccguggauuguuuaauccuccgauacuacguuggcccag

SEQ ID NO: 43040 - RNA, 45 nt, Mus musculus
uucguauacaaacuucuuuaauccuccauuucuucucccacccac

SEQ ID NO: 43041 - RNA, 46 nt, Mus musculus
ugaggaaacuuccccucuucuccaugagugaauacaagacaggaag

SEQ ID NO: 43042 - RNA, 46 nt, Mus musculus
gguuaucacauuagaaacugaaagguuuuaagaugauagcagacau

SEQ ID NO: 43043 - RNA, 40 nt, Mus musculus
uuuuccuaaaggguucuccaaggacaucuacaccauuugg

SEQ ID NO: 43044 - RNA, 41 nt, Mus musculus
aaguuauuuuaagccuucaaugcuugaagacccuugggcug

SEQ ID NO: 43045 - RNA, 46 nt, Mus musculus
cauagaacacaguuuucauauuugacauuuccaauauaacagacau

SEQ ID NO: 43046 - RNA, 46 nt, Mus musculus
agucacuuaauaugauuuauacuucuuuauucacaaaaggccagaa

SEQ ID NO: 43047 - RNA, 46 nt, Mus musculus
cugcggauauggcaaaagcuguucaccuuuggcaaccaagcugcag

SEQ ID NO: 43048 - RNA, 46 nt, Mus musculus
cucuuagaaaguauguuauuagcaaaaaugaaaaaauuaaagccag

SEQ ID NO: 43049 - RNA, 46 nt, Mus musculus
uauacucaugcaggcaaauucaacaagucuuaaaagaaaaccagag

SEQ ID NO: 43050 - RNA, 45 nt, Mus musculus
ggggagggcucuggguacuucacucagcugaggggcuaaugacag

SEQ ID NO: 43051 - RNA, 65 nt, Mus musculus
gacuuacugaauuaaaagcaacuuuuaagagacaugaagauaagagauggaaggaaagugauggg

SEQ ID NO: 43052 - RNA, 41 nt, Mus musculus
uugagugaaugacauaaagaauaaaaaauguauugcuugag

SEQ ID NO: 43053 - RNA, 46 nt, Mus musculus
aaauuacuguauuuucacuugcucuuuucuaaaacaccggugagau

SEQ ID NO: 43054 - RNA, 45 nt, Mus musculus
uuuuagaaaagagcaagugaaaauacaguaauuuuaaacaguaag

SEQ ID NO: 43055 - RNA, 46 nt, Mus musculus
uuuaagcauauuauuaauauccucuagggguguuuuagggguagau

SEQ ID NO: 43056 - RNA, 45 nt, Mus musculus
uuacuagaaguuacuaauaguaaacuauuucauggucacccggag

SEQ ID NO: 43057 - RNA, 46 nt, Mus musculus
cuuuuauuugaauacagaguacuaacaacuuaauaaaacaguagag

SEQ ID NO: 43058 - RNA, 42 nt, Mus musculus
uucuauuucugaaaaggaaccaaagguaaauagccagcauca

SEQ ID NO: 43059 - RNA, 45 nt, Mus musculus
gagaagguaacaguggaagucaacacagccaaaagacaggcagaa

SEQ ID NO: 43060 - RNA, 23 nt, Mus musculus
aacuccugagagcggagaagcuc

SEQ ID NO: 43061 - RNA, 46 nt, Mus musculus
uuacguuagcagugauggucuaggaaguagcuccgcugcugcacca

SEQ ID NO: 43062 - RNA, 58 nt, Mus musculus
ugaucccaaaagagaaggugguaucgauuaucccacaggagacacauaugugcccagu

SEQ ID NO: 43063 - RNA, 86 nt, Mus musculus
cucgaauucugccuccugaucaacggccuccugaaccuccugaaccaccaccaguuacugaggaggaccuagauuaucggacagaa

SEQ ID NO: 43064 - RNA, 49 nt, Mus musculus
cagcaccaagacaggaggauauuggagcugacaccagaaccagaccggc

SEQ ID NO: 43065 - RNA, 46 nt, Mus musculus
gacaauaaauaauacuaauuauccuaaaaguggauaaauugccaag

SEQ ID NO: 43066 - RNA, 41 nt, Mus musculus
ucuucucuuuuuacuccauaauucaugacaaucuugccaca

SEQ ID NO: 43067 - RNA, 45 nt, Mus musculus
aaacacaaacacauucccagaaaggaaagucuuuuggaggguuuu

SEQ ID NO: 43068 - RNA, 46 nt, Mus musculus
auacuuaacugauuacuaaauuaguuuuaaaauaucaccugcaguu

SEQ ID NO: 43069 - RNA, 45 nt, Mus musculus
ugauaaggauacagcugcuuagaaucuaauagaaucacagaaaug

SEQ ID NO: 43070 - RNA, 46 nt, Mus musculus
gacauguugguguccaaauuaaaagugaaaaacuuaucggcuagaa

SEQ ID NO: 43071 - RNA, 46 nt, Mus musculus
ggaucuauauguacauuugugcacauaaguauggugcccuguggag

SEQ ID NO: 43072 - RNA, 45 nt, Mus musculus
aaggagggccauaguguccacacuucagucuucauucuucuugag

SEQ ID NO: 43073 - RNA, 45 nt, Mus musculus
caagucucugugaggcuaaguauauccucucccucugagccagac

SEQ ID NO: 43074 - RNA, 41 nt, Mus musculus
auuaaugauaagaacaacuauaaaauacaaacacuggggag

SEQ ID NO: 43075 - RNA, 45 nt, Mus musculus
ggagcagcaaaagaaagcccagggaauaaaugaccacaguacaaa

SEQ ID NO: 43076 - RNA, 45 nt, Mus musculus
aucuguucugagaacugcacuguuuggcggaucauuuaaugugac

SEQ ID NO: 43077 - RNA, 46 nt, Mus musculus
aggaacugacacucccccaauuuuuucagugcuaauuugaacauuu

SEQ ID NO: 43078 - RNA, 42 nt, Mus musculus
gaaguaccucauccagaacgaacacuacuuccaaguccagag

SEQ ID NO: 43079 - RNA, 46 nt, Mus musculus
ugacauggauuaagucaaagaacuuagucucucauaggacugagaa

SEQ ID NO: 43080 - RNA, 45 nt, Mus musculus
aaggaagccaaguuaggggaaccggauccacagacaggcaauaga

SEQ ID NO: 43081 - RNA, 45 nt, Mus musculus
aggugagugaauagcuuuccuggggaacuugcuaccugccuuugu

SEQ ID NO: 43082 - RNA, 42 nt, Mus musculus
agaguauuggugcucaaauuauuuagagaaauuuggccaggu

SEQ ID NO: 43083 - RNA, 50 nt, Mus musculus
guauauuuucuagagcagggagucagaaaccaaguccggggaggugaggg

SEQ ID NO: 43084 - RNA, 46 nt, Mus musculus
augguguaaauaagaucucuaggauguugggaaucuguaaccagau

SEQ ID NO: 43085 - RNA, 45 nt, Mus musculus
gagcugccagugcucuuaacuccugagacaucuucagccccagau

SEQ ID NO: 43086 - RNA, 46 nt, Mus musculus
aaacaguacccuucaacaguauuuacagugccagucuuacucagau

SEQ ID NO: 43087 - RNA, 46 nt, Mus musculus
ugagaaaaggggacccugacgugcagaaugguccuaauguauagca

SEQ ID NO: 43088 - RNA, 42 nt, Mus musculus
uaaugcugaauaauuucuccaaguaccuggacaaauggcaag

SEQ ID NO: 43089 - RNA, 46 nt, Mus musculus
agaacuuuugcuaacaccccucccuucccaagcagaacauguuaaa

SEQ ID NO: 43090 - RNA, 45 nt, Mus musculus
accaucuguaaugagaucugauacccucuucuggagugucugaag

SEQ ID NO: 43091 - RNA, 46 nt, Mus musculus
uaucucauuuuuguguguguguguguguguguguguguguguauau

SEQ ID NO: 43092 - RNA, 45 nt, Mus musculus
uauguguuuguauguucaccauaugcaugucuuguaucuguggag

SEQ ID NO: 43093 - RNA, 46 nt, Mus musculus
cuuuuaugagacagcucauggaaggccuggauuauugucauaagaa

SEQ ID NO: 43094 - RNA, 46 nt, Mus musculus
auacaaauuuuauucaaauuuuuuuuugaaaaacaauuugucagau

SEQ ID NO: 43095 - RNA, 45 nt, Mus musculus
ucugacaaauuguuuuucaaaaaaaaauuugaauaaaauuuguau

SEQ ID NO: 43096 - RNA, 29 nt, Mus musculus
gcccugucuugaaaaaccaaaacagaaaa

SEQ ID NO: 43097 - RNA, 25 nt, Mus musculus
agugaaagcagucuagaaaccucag

SEQ ID NO: 43098 - RNA, 46 nt, Mus musculus
gaaauacaccaguaucuggucucauguauacauacccgcugccacc

SEQ ID NO: 43099 - RNA, 49 nt, Mus musculus
aaugaaaucgcuaguagaagcaauuauuuuuuauuaggagggaagggua

SEQ ID NO: 43100 - RNA, 46 nt, Mus musculus
uuuaaugugaaggacuucuaagauaguaacacacacacacacacac

SEQ ID NO: 43101 - RNA, 41 nt, Mus musculus
uauugcauacuugccagucagagaagucuaauugugcaaag

SEQ ID NO: 43102 - RNA, 45 nt, Mus musculus
agugagugagugagugagugagugagugagugagugugugugugu

SEQ ID NO: 43103 - RNA, 45 nt, Mus musculus
augacaucagcagcacacacagugaaggaaaacaauaguacagaa

SEQ ID NO: 43104 - RNA, 46 nt, Mus musculus
aucucuucugaaccuguuccuucucauucuuaaaaggggauguacg

SEQ ID NO: 43105 - RNA, 46 nt, Mus musculus
gagaagguacuuauggacaaguuuacaaagccagggacaaagacac

SEQ ID NO: 43106 - RNA, 41 nt, Mus musculus
uggggagagagagaauccuugaaugaaaaauuuuguggaga

SEQ ID NO: 43107 - RNA, 47 nt, Mus musculus
cuguguacuuuguugucugucaacauauuauuucuuugcugguacuu

SEQ ID NO: 43108 - RNA, 46 nt, Mus musculus
cuuauaaaauuuauaaaaggugaacucaaaagauuuucucacagaa

SEQ ID NO: 43109 - RNA, 98 nt, Mus musculus
uuuuuucacuuuuugagaaauaucuagcuggccuagaguuugcuauuagaucaggcuggccuuaaacuagauauccaucugucuuugccuccugagug

SEQ ID NO: 43110 - RNA, 46 nt, Mus musculus
gucuugaaguuacauuguuagguuuugugcuuauuugguugcuaau

SEQ ID NO: 43111 - RNA, 46 nt, Mus musculus
gacagugacaguguauuuacauauauaaaauaaauaaaucuuaaaa

SEQ ID NO: 43112 - RNA, 45 nt, Mus musculus
aaggguuauuuuaaagaaccauuauggucuacacagccucaguag

SEQ ID NO: 43113 - RNA, 46 nt, Mus musculus
uuucuauagucuaaguuuuguuagaaguauaauuuuggggcuggug

SEQ ID NO: 43114 - RNA, 45 nt, Mus musculus
agggccuuacacuauguaggcuggucuggagcuuagcguuuagaa

SEQ ID NO: 43115 - RNA, 45 nt, Mus musculus
uaacaaagguagacaauaauuugacaguagagaaagccaccaaga

SEQ ID NO: 43116 - RNA, 53 nt, Mus musculus
caaggggaacacagaaacuggugccagugucucacagacaaaccaugugaagg

SEQ ID NO: 43117 - RNA, 46 nt, Mus musculus
guuagugugcuaggagaaaugcuugaaugacgacuucuugaucuag

SEQ ID NO: 43118 - RNA, 89 nt, Mus musculus
cccauauucaucuaggcacucaagaucucggagcaggcacagauugucuagaucaagaagucgucauucaagcauuucuccuagcacac

SEQ ID NO: 43119 - RNA, 42 nt, Mus musculus
uggugaagagacaacaguuugugccagaaaauauaaccaagu

SEQ ID NO: 43120 - RNA, 79 nt, Mus musculus
auauuuuaauuguauuaacuuaugugaguugugugugugugugugugagagagagagagagugagugugugugugugug

SEQ ID NO: 43121 - RNA, 46 nt, Mus musculus
uauuauccuaggaaguuagacugggagaugauacccagugacagau

SEQ ID NO: 43122 - RNA, 48 nt, Mus musculus
agacaucuaaaguaguuccauuuacuaauuauugugcacuaaacaugg

SEQ ID NO: 43123 - RNA, 31 nt, Mus musculus
ucacuggauuucugucuuaaaacugugagau

SEQ ID NO: 43124 - RNA, 46 nt, Mus musculus
uauaugauugaaugaaagguugagucagaaaugccaugugaugaua

SEQ ID NO: 43125 - RNA, 44 nt, Mus musculus
gguaugauuaaaacguagaugucauuaaguuaaggguuucgaga

SEQ ID NO: 43126 - RNA, 46 nt, Mus musculus
guauugguuugguuauucuaucuacaauaauaaauggagcagagag

SEQ ID NO: 43127 - RNA, 46 nt, Mus musculus
uaccagaagggucaauuauagaaagcagugagguuguauguaaggu

SEQ ID NO: 43128 - RNA, 45 nt, Mus musculus
ugucuacaauuuaaaauaaauguguaugagacuauagguauggau

SEQ ID NO: 43129 - RNA, 45 nt, Mus musculus
guuguaaaauauacuuacuuacuaguuaauuucaaugacuaugag

SEQ ID NO: 43130 - RNA, 46 nt, Mus musculus
caauuuguaaguauaaauuaaaaucugugugagacuaaauauagua

SEQ ID NO: 43131 - RNA, 44 nt, Mus musculus
cucagagcccacuccaguaacacacuuccuccaacaaggccaca

SEQ ID NO: 43132 - RNA, 53 nt, Mus musculus
ugagaguucuacauccugauccauaggcagagagagagaaagagagagagaga

SEQ ID NO: 43133 - RNA, 46 nt, Mus musculus
aucauauccuaauccuaugccaaaauccaucugaugacuaauuugu

SEQ ID NO: 43134 - RNA, 46 nt, Mus musculus
uuaguuguauuguacugagggcuaugaaugguaguuggaagugagg

SEQ ID NO: 43135 - RNA, 45 nt, Mus musculus
guauggggaagaagagaacuuguggaguguacagugacuucagau

SEQ ID NO: 43136 - RNA, 46 nt, Mus musculus
uuggaagguuacucagguagcugcauugagaguaauuaggacaggu

SEQ ID NO: 43137 - RNA, 46 nt, Mus musculus
ggaauuauaguugugcuccaucaugcuugguuuauguuguguggau

SEQ ID NO: 43138 - RNA, 69 nt, Mus musculus
acacgagacaaauaaugugggaggauuauuggacagaaucucucucucucucugucaucauauuaagaa

SEQ ID NO: 43139 - RNA, 70 nt, Mus musculus
gagucaaagcuuugaagauaguuuucuuaguuuaauauggcaagaugguuaaauuauuuuuauuauaaug

SEQ ID NO: 43140 - RNA, 49 nt, Mus musculus
ucccacauaguaccacugugggaacuaaguacauucaaaccgagcagua

SEQ ID NO: 43141 - RNA, 43 nt, Mus musculus
gcugugauacaauaccuugacaaauagcaccuuuggcagaaaa

SEQ ID NO: 43142 - RNA, 45 nt, Mus musculus
uuccauugauuuaccugucuaucucuguaccagugccaugcaguu

SEQ ID NO: 43143 - RNA, 45 nt, Mus musculus
cugcaagacacaauagugccuuaucagcaccuaucuugugaccag

SEQ ID NO: 43144 - RNA, 61 nt, Mus musculus
aaguuaugaaugauggaucuggucacaagauaggugcugauaaggcacuauugugucuugc

SEQ ID NO: 43145 - RNA, 44 nt, Mus musculus
cugucucaguuuccccauuugcuuucuauuauuuucauugcuga

SEQ ID NO: 43146 - RNA, 45 nt, Mus musculus
uggacagaugacagugaacaaacugaucuuugaaagagagcuuag

SEQ ID NO: 43147 - RNA, 46 nt, Mus musculus
uaguggauucuggaauuuuucuauaagcaagauuaugccaucagau

SEQ ID NO: 43148 - RNA, 46 nt, Mus musculus
ucugucuucaaacaaacaacaacaacaacagaaagaaagaaagaaa

SEQ ID NO: 43149 - RNA, 44 nt, Mus musculus
gugugcuccuauucuguugauugauaguaccacacacccagaga

SEQ ID NO: 43150 - RNA, 45 nt, Mus musculus
auucaaagcaacaaguaggaauuaccaagaacugcagaggggcag

SEQ ID NO: 43151 - RNA, 45 nt, Mus musculus
cagacucugaacagccuuuggggggcggggaggggggcacucaga

SEQ ID NO: 43152 - RNA, 47 nt, Mus musculus
cauaaacuuauuaacaauguuuuccagcaaagcaagcacagcccacu

SEQ ID NO: 43153 - RNA, 46 nt, Mus musculus
caauggcauugggcauuaaacagagacaugauagguguggagaagg

SEQ ID NO: 43154 - RNA, 47 nt, Mus musculus
acugagcacagagacucugcaaaucagacuauauucuuugggagagg

SEQ ID NO: 43155 - RNA, 46 nt, Mus musculus
uggaacuguuuuuguagagcaagcuugccauccaauucacagagau

SEQ ID NO: 43156 - RNA, 110 nt, Mus musculus
cugguauaguaguuaccgugcauauuaauagaaagaaauaagaaaugggagacuaguaauuagcauuggggggauagagauaaaagagggucauguucauaauaagggag

SEQ ID NO: 43157 - RNA, 102 nt, Mus musculus
uugauuuccucccuuccuaccuuccaguuaguaucuguaagggucaguaagaauacuuuccgcaguaguugucauuaacuacuuagaguacacccccuguga

SEQ ID NO: 43158 - RNA, 42 nt, Mus musculus
guggaaugguggguaggguaggcagaauggauaugggggacc

SEQ ID NO: 43159 - RNA, 45 nt, Mus musculus
uucuaguguaucuugguaaauggguuugacugguuuggaaguucc

SEQ ID NO: 43160 - RNA, 46 nt, Mus musculus
gucuuuggguagcaggggcuagcuagggucagaguggaaaugagua

SEQ ID NO: 43161 - RNA, 45 nt, Mus musculus
auagaaccauucuguugaugguuaaauagcaugucagguguggua

SEQ ID NO: 43162 - RNA, 46 nt, Mus musculus
auucugcugauccaaacaaaauaaguugggauaacagcaagcaaag

SEQ ID NO: 43163 - RNA, 46 nt, Mus musculus
uccuauauguauaguuacuuuguaauguuccaaauuuccugcuaau

SEQ ID NO: 43164 - RNA, 42 nt, Mus musculus
ugcaccuuggcagcuucucuuuuguuuuuuuggggugaaaau

SEQ ID NO: 43165 - RNA, 46 nt, Mus musculus
ccagacuggccuugaacuugagaucugccuaccucugccuccacag

SEQ ID NO: 43166 - RNA, 46 nt, Mus musculus
accuuuuuuccauccuuuauccuaagucuaucacugauggugagau

SEQ ID NO: 43167 - RNA, 46 nt, Mus musculus
auaaaagcuaaacacaccaaugagugaaaauucuuucuugggggaa

SEQ ID NO: 43168 - RNA, 46 nt, Mus musculus
uaauuuaauguuacacuugaaggucuuggaaaacaaaaaacaccag

SEQ ID NO: 43169 - RNA, 53 nt, Mus musculus
cccucucccccauucccucuccuuacucuacuuucaccccccccacucucccu

SEQ ID NO: 43170 - RNA, 76 nt, Mus musculus
gggugaaaguagaguaaggagagggaaugggggagagggagagagaaagaagagagaagagggaaaggagagggag

SEQ ID NO: 43171 - RNA, 53 nt, Mus musculus
ucucucucuccuuuccccuucucccucccccucccucucccucuccuuucccu

SEQ ID NO: 43172 - RNA, 46 nt, Mus musculus
gauuuuuauuaauuuguauccucuuuugauuaauuuguccaaaggu

SEQ ID NO: 43173 - RNA, 47 nt, Mus musculus
cuuuuucaguuuaguggaauuauaaacuuuuauauuauggccuuagg

SEQ ID NO: 43174 - RNA, 51 nt, Mus musculus
auauggaaguauuccuucauuuucuguuuuguggaauaaauugagagaguu

SEQ ID NO: 43175 - RNA, 110 nt, Mus musculus
augucuugucuuuucugugcguucuugaacucauuuugcaaguuuacugaugauuuuuguauuaguguuucaucagaaagauugguguaucuuuuuuugggggggggucu

SEQ ID NO: 43176 - RNA, 86 nt, Mus musculus
uguccggccugaccuaucuuuuuaucucuuggaugaagcugaucuaacuaugauggaauaucugggauaaagccaauuugaccaug

SEQ ID NO: 43177 - RNA, 45 nt, Mus musculus
aaacuuaauuaugcaagucuuuuuucuuuuuuacuuuuuugagau

SEQ ID NO: 43178 - RNA, 45 nt, Mus musculus
aaacaaauucaguauccugauggcaaggaucaaacuugucccagc

SEQ ID NO: 43179 - RNA, 46 nt, Mus musculus
aggcucauaagagcauaauuuuggggguaugggggcaggggaggac

SEQ ID NO: 43180 - RNA, 47 nt, Mus musculus
cucacucuacauaccaacugaccucaaacucauagagacccaccagc

SEQ ID NO: 43181 - RNA, 46 nt, Mus musculus
cugacauccaugggaggggagggaggcuugaugacccagaguaggg

SEQ ID NO: 43182 - RNA, 80 nt, Mus musculus
ccagaggggaaggagagagaacugaagaggaggaggaggaagccuugaugggccagaagaaacugcaaguaacaaggggu

SEQ ID NO: 43183 - RNA, 46 nt, Mus musculus
ucccuagcuaaaagaccccuuguuacuugcaguuucuucuggccca

SEQ ID NO: 43184 - RNA, 46 nt, Mus musculus
ucuagccuuuauugaccaguuaaaauggggagaagguucccauaag

SEQ ID NO: 43185 - RNA, 45 nt, Mus musculus
accuggcuucuuuauuuuucuuaacugacauguuguacucuuaga

SEQ ID NO: 43186 - RNA, 44 nt, Mus musculus
aaagaagccagguguggugguggaugccuuuaaucccagcacuu

SEQ ID NO: 43187 - RNA, 45 nt, Mus musculus
gugccagugaaugcaugcuuguggaauugggagaacaacuuggau

SEQ ID NO: 43188 - RNA, 46 nt, Mus musculus
ggacagggaagucaccacuugcacagagagaagaggaaggggagga

SEQ ID NO: 43189 - RNA, 23 nt, Mus musculus
auuaggggaaaacuuagggauua

SEQ ID NO: 43190 - RNA, 46 nt, Mus musculus
gagacuuuaguggguaaaaauguacuguacauuuuugaauuugguu

SEQ ID NO: 43191 - RNA, 46 nt, Mus musculus
aucaugaaacuugcuagccauuuugguucacauauucucuaggauu

SEQ ID NO: 43192 - RNA, 46 nt, Mus musculus
cuacuuuaauauaacuguuuucuccuacccauucuagcccaugguu

SEQ ID NO: 43193 - RNA, 44 nt, Mus musculus
uggaacuccauuuguagaccagguuggccucaaacucacugaga

SEQ ID NO: 43194 - RNA, 24 nt, Mus musculus
ugauacuuuuucuaugaagaacau

SEQ ID NO: 43195 - RNA, 45 nt, Mus musculus
guucuguaguccaggcuggccucccaacucagauccaccugccuu

SEQ ID NO: 43196 - RNA, 48 nt, Mus musculus
caugcucuuugccugcauuugugucuucauuucuuagcuccugcauuu

SEQ ID NO: 43197 - RNA, 48 nt, Mus musculus
cuaugguauaagaaacuucaauaugacauuuuccaagcccacauacug

SEQ ID NO: 43198 - RNA, 46 nt, Mus musculus
ugaauagguaagugaagggaugauagauagaguugacugaacauag

SEQ ID NO: 43199 - RNA, 45 nt, Mus musculus
uuguguugcuuguuaaaugcuauucuuaaaauuugaggaccagaa

SEQ ID NO: 43200 - RNA, 45 nt, Mus musculus
auagucauuuaaguauguaauggcaauuuaaauaacgugguuaga

SEQ ID NO: 43201 - RNA, 59 nt, Mus musculus
acggggaugggaaaagcagcuuuuguaaaguuuaauacucaaaauacauguaaguagau

SEQ ID NO: 43202 - RNA, 75 nt, Mus musculus
cuuauauuaaagagcaaucagauucaggaggugaugucaguuagauaaggauugcagauguuucaugugguuaau

SEQ ID NO: 43203 - RNA, 45 nt, Mus musculus
cagccccuacagcccaguacucaggugaguccuguccccccaacc

SEQ ID NO: 43204 - RNA, 46 nt, Mus musculus
uaggggcugcgcgagcgccgccagcugcugcugcuguacgggcugg

SEQ ID NO: 43205 - RNA, 42 nt, Mus musculus
gggcgagcggcgccggcuauaggggcucggggagcgcggcag

SEQ ID NO: 43206 - RNA, 45 nt, Mus musculus
uacacacuggaaaacucuugcaagagaaccuagcagcccccagaa

SEQ ID NO: 43207 - RNA, 44 nt, Mus musculus
ggcugcugcccgggcuuucuaugaggcucuaaucgcagaugaca

SEQ ID NO: 43208 - RNA, 84 nt, Mus musculus
agccccagagagcugaaccuaugagggagaggaagaagaagagaagagugacuagggagccugcagcagcaggaguccccagac

SEQ ID NO: 43209 - RNA, 41 nt, Mus musculus
guauggucagagagagucauggagagacaaggagcccugag

SEQ ID NO: 43210 - RNA, 45 nt, Mus musculus
gggcagagccugggagcgagaucuaagacuguacaugaaccucaa

SEQ ID NO: 43211 - RNA, 46 nt, Mus musculus
agugagagcuuugguuuugcaucagaguaaaauaaacccaucacau

SEQ ID NO: 43212 - RNA, 46 nt, Mus musculus
ggaggcuuagugugguuuugaguagaguaucacuugucccuggaaa

SEQ ID NO: 43213 - RNA, 79 nt, Mus musculus
uccgaccaggagucaaacugacccugucagcuuuaauagauggaaagaacuucaaugcaggaggccacaagguuggauu

SEQ ID NO: 43214 - RNA, 84 nt, Mus musculus
ugggcuguguuggccuuugaaggugggcuugcuggcuaucagaugaguuuugacacagccaaauccaaacugucucagaauaau

SEQ ID NO: 43215 - RNA, 46 nt, Mus musculus
aaggguugaaacugacucuugauaccauauuuguaccaaacacagg

SEQ ID NO: 43216 - RNA, 45 nt, Mus musculus
gaugucuuuaacaaaggguauggguuuggcauggucaagauagau

SEQ ID NO: 43217 - RNA, 45 nt, Mus musculus
aaccggaaacaggcacaugaggccugcucaguucuggcaucuaug

SEQ ID NO: 43218 - RNA, 24 nt, Mus musculus
aaagcuccccaagaggagaaguua

SEQ ID NO: 43219 - RNA, 46 nt, Mus musculus
guucuggaacgauuuauagguggcuuucauagucacagaugcccaa

SEQ ID NO: 43220 - RNA, 46 nt, Mus musculus
ucaauagaguuuguguguaucauugcaucauauuuaaaacauuggg

SEQ ID NO: 43221 - RNA, 42 nt, Mus musculus
uuagaauagugacuucauuguaaaaguggaauguguguguag

SEQ ID NO: 43222 - RNA, 46 nt, Mus musculus
auaguauaaugcaaaauacauuuaguucaacuucaaaaguccccau

SEQ ID NO: 43223 - RNA, 46 nt, Mus musculus
ucuagaauuuaacugaauucuuuucaguuaaagaagugauucugag

SEQ ID NO: 43224 - RNA, 76 nt, Mus musculus
guggugugguguggugugguaugugguauguagaguggugugugugguaugugguauguagagugguguguggugu

SEQ ID NO: 43225 - RNA, 32 nt, Mus musculus
uuuauaagaaaugcaauguuuauuuguuuuag

SEQ ID NO: 43226 - RNA, 46 nt, Mus musculus
gagaugauuuucccaucaaagccaauuuucucaucuugccagccau

SEQ ID NO: 43227 - RNA, 41 nt, Mus musculus
gagaaguagcuuagagcuacauccucauucccaagcagaga

SEQ ID NO: 43228 - RNA, 46 nt, Mus musculus
ccuguguaucauucagccauagguuucucacuguauuuaugaucag

SEQ ID NO: 43229 - RNA, 69 nt, Mus musculus
ggaaugagaccuaugggaagugauuagauuuuguuaaggcugugaaugagagcaaagagguccccugcc

SEQ ID NO: 43230 - RNA, 46 nt, Mus musculus
gaggagagcgagagagagagagagagagagagagagagagcgcaau

SEQ ID NO: 43231 - RNA, 46 nt, Mus musculus
auuauuaaucuuuaacucuucagauuuuuguuucauugaaaggaag

SEQ ID NO: 43232 - RNA, 41 nt, Mus musculus
gugcuuuggagacguugugcuuaaguaaaaagagguuaccu

SEQ ID NO: 43233 - RNA, 24 nt, Mus musculus
acugcaggcauuuuuauacuucuu

SEQ ID NO: 43234 - RNA, 42 nt, Mus musculus
uuggugacagccuuugugguaguuugaauaugcuuggcccag

SEQ ID NO: 43235 - RNA, 24 nt, Mus musculus
guuacuuacugucugguguugugu

SEQ ID NO: 43236 - RNA, 34 nt, Mus musculus
aucuucaucaguauaucaucauguaggaguuagu

SEQ ID NO: 43237 - RNA, 42 nt, Mus musculus
guaugugguacacuccugcuauggaugugagcugacggggag

SEQ ID NO: 43238 - RNA, 63 nt, Mus musculus
agaggaaaaggcagugcagcaugaguauugcugcuucaaugcagaggaaaaggcagugcagca

SEQ ID NO: 43239 - RNA, 109 nt, Mus musculus
ugaguauugcugcugcaaugcagaggaaaaggcagugcagcaugaguauugcugcugcaaugcagaggaaaaggcagugcagcaugaguauugcugcugcaaugcagag

SEQ ID NO: 43240 - RNA, 59 nt, Mus musculus
gaagcaccuaacccuggagagacuugaggccccagggagugaggaugccuggcaggggu

SEQ ID NO: 43241 - RNA, 62 nt, Mus musculus
uguaggguggaggggugaggacauucucuuggagacagggaaaggaggaauagaaugaggaa

SEQ ID NO: 43242 - RNA, 45 nt, Mus musculus
ccuuagggccugcucaggcugcuuccuuauacaacacaggaccag

SEQ ID NO: 43243 - RNA, 45 nt, Mus musculus
ucuacaaagucuuuaauuucuuucuuuauuucuucccugacccag

SEQ ID NO: 43244 - RNA, 46 nt, Mus musculus
uucagagacuguuuggacaggcuauggcccuuuuaguaacaaggau

SEQ ID NO: 43245 - RNA, 46 nt, Mus musculus
uuuguggguuguuaagugagccuguuuucucccgucugagccucag

SEQ ID NO: 43246 - RNA, 45 nt, Mus musculus
ucuaacugcuuaucaucagaggugaggccuguuaugggguuagag

SEQ ID NO: 43247 - RNA, 46 nt, Mus musculus
aauaugaacauaauucuagccugugaguuaauauucccaccccuug

SEQ ID NO: 43248 - RNA, 45 nt, Mus musculus
ugugacaaagucacacauugucaaccucacagcagcgacagagag

SEQ ID NO: 43249 - RNA, 46 nt, Mus musculus
gcagggauagauacgaacuggccuuccaugugggaaagcaugggag

SEQ ID NO: 43250 - RNA, 45 nt, Mus musculus
cuguguccaguaaguggcaggaugucuugcuuagaugugcaugga

SEQ ID NO: 43251 - RNA, 46 nt, Mus musculus
ggguagauaagaucugacacguguuuuagaaagcugacuuugcgag

SEQ ID NO: 43252 - RNA, 46 nt, Mus musculus
ggcagcugccccagugaggcccaaaagauggagucaguagcaccag

SEQ ID NO: 43253 - RNA, 45 nt, Mus musculus
cauaauguccauagacuauguuuugguuaauggaagaauggguag

SEQ ID NO: 43254 - RNA, 45 nt, Mus musculus
ucuaaugugugguucuguguugguaauuaggauggguuagggcag

SEQ ID NO: 43255 - RNA, 46 nt, Mus musculus
agugaauguuugggaaguuucugauuucauggauaguuggggauga

SEQ ID NO: 43256 - RNA, 44 nt, Mus musculus
acaguucgugagauccaguuguaagcaguuugugacuggcggga

SEQ ID NO: 43257 - RNA, 93 nt, Mus musculus
aucugauccauuggaaaaaagaguuacaaacuguauaaaccaccaugaggauguugagacucauacuuguguccucuggaaaaauagccagua

SEQ ID NO: 43258 - RNA, 46 nt, Mus musculus
ugauuuguuugucuacuuauuuuauauaugggcauuuugucugcac

SEQ ID NO: 43259 - RNA, 45 nt, Mus musculus
cucucucucucucucucuccccucuuucucccucucucccucucu

SEQ ID NO: 43260 - RNA, 46 nt, Mus musculus
uguagugcaggaaaguguuagauacaucuaucagcacaaaacauag

SEQ ID NO: 43261 - RNA, 46 nt, Mus musculus
gaucuucuaacgucacacaaucacagagacuauuggcagcuggcaa

SEQ ID NO: 43262 - RNA, 47 nt, Mus musculus
acugcccugcuuaccucugggaaggaucaguaguucagauuuccuaa

SEQ ID NO: 43263 - RNA, 45 nt, Mus musculus
caaaaagcucugauaauuuuuaaggacaugaaaauuugccgggaa

SEQ ID NO: 43264 - RNA, 92 nt, Mus musculus
gaccccuguagucagggguucaguaccacgggccauccccaugcaggaagcgcggcuuuuguauaagagaccuugagugugauaagggaaag

SEQ ID NO: 43265 - RNA, 45 nt, Mus musculus
ggugacaauggcauugagauuaaagaaaaucucugaggguaggag

SEQ ID NO: 43266 - RNA, 60 nt, Mus musculus
uuacauggaucuccugcauucacaaaagauuuccaagcaucagguuuuuauggaagagua

SEQ ID NO: 43267 - RNA, 42 nt, Mus musculus
gggaacgguggcacuccuguaaucucagcacuuaggagguag

SEQ ID NO: 43268 - RNA, 42 nt, Mus musculus
gggugaugggauaagugcacacacccuccccgacuccaggag

SEQ ID NO: 43269 - RNA, 41 nt, Mus musculus
uauuuuuugaaaauacagaaaggcagagguuccugggggag

SEQ ID NO: 43270 - RNA, 48 nt, Mus musculus
gcacgacggcuuuucagagaaagaaggaaguguuagcgugcagcauau

SEQ ID NO: 43271 - RNA, 46 nt, Mus musculus
uagucuaucuaguuaaaguacccgaauuuguuaagccuuuccccaa

SEQ ID NO: 43272 - RNA, 46 nt, Mus musculus
uaagaauuaaauuuuccccaaguacuaggggaugaugauaaacuaa

SEQ ID NO: 43273 - RNA, 46 nt, Mus musculus
agagaaaacaacugucacuaguuuaucuagaagaacuggggcccuu

SEQ ID NO: 43274 - RNA, 45 nt, Mus musculus
uugauggcugcugaaauuagccaaaggaacauuaaacgacauaag

SEQ ID NO: 43275 - RNA, 82 nt, Mus musculus
cguaugaaccuuaauuccuaaagaaugcaaaacaauaaacuaaaagaaggaagagagaaagucugaucuuuuacuuuuaggc

SEQ ID NO: 43276 - RNA, 45 nt, Mus musculus
ucacgguucuggauaauuuaucauagagcuauauuuugagacuug

SEQ ID NO: 43277 - RNA, 45 nt, Mus musculus
ucuguuaguuucucuguuuaguuucuguuuccaugaucuguccau

SEQ ID NO: 43278 - RNA, 25 nt, Mus musculus
uuggugguguguagaguauuuucuu

SEQ ID NO: 43279 - RNA, 46 nt, Mus musculus
cuuauagcuuuaucaucagcccaaguuguuuggggguucccaugag

SEQ ID NO: 43280 - RNA, 62 nt, Mus musculus
ucugucuccacagcuccuaggaugauagccuuccacuucauuuuucuugcaugucuuuaguc

SEQ ID NO: 43281 - RNA, 42 nt, Mus musculus
auuggguuggcauauguaaaccaccugguggagagaggagag

SEQ ID NO: 43282 - RNA, 23 nt, Mus musculus
acuaaagaucagguuguaaaaac

SEQ ID NO: 43283 - RNA, 45 nt, Mus musculus
uuaauggccugcacuggggagugguuaaauaacaaaagagggcag

SEQ ID NO: 43284 - RNA, 43 nt, Mus musculus
ucugguuagggcuuugccacauugaucagagaguggccuggag

SEQ ID NO: 43285 - RNA, 45 nt, Mus musculus
ugaagaaggacagucagaacaaaacguuauugaaaacacuggcag

SEQ ID NO: 43286 - RNA, 45 nt, Mus musculus
ugugaaagccauuguagcuuaaugucaggcacuuuucuugugguu

SEQ ID NO: 43287 - RNA, 45 nt, Mus musculus
ccugucucacaaaaacaggaagaagggaaagcaggcaggcaggca

SEQ ID NO: 43288 - RNA, 42 nt, Mus musculus
ggcuagugguuucuaaauaacuacuuuaaauaugcaacccag

SEQ ID NO: 43289 - RNA, 45 nt, Mus musculus
ucuguggcaauguuugucuccaguccuucaucggguaggaaguag

SEQ ID NO: 43290 - RNA, 46 nt, Mus musculus
gauuauaacuugcagguaaguauucuaacacacaugaccaucugag

SEQ ID NO: 43291 - RNA, 42 nt, Mus musculus
uuaagaaaaugccccaacagaugcgcccauggacugggccag

SEQ ID NO: 43292 - RNA, 46 nt, Mus musculus
cuguaacucgugucaaguugaggggaaagacuuaaaaacuaaccag

SEQ ID NO: 43293 - RNA, 46 nt, Mus musculus
aggcaugaacugcacuacugagaacacugccagcuacagucggcca

SEQ ID NO: 43294 - RNA, 46 nt, Mus musculus
ucaaggaaaugcacccagggacuguggaccuccugccucuggccag

SEQ ID NO: 43295 - RNA, 42 nt, Mus musculus
gguuauggucuucacgugucucaccucuucaguagcggccaa

SEQ ID NO: 43296 - RNA, 45 nt, Mus musculus
aaagcacugggaaacauacuaagauaaucccagugucaaugguga

SEQ ID NO: 43297 - RNA, 46 nt, Mus musculus
uucacaaccaucugcaauggagucugaugcccucuucugguguguc

SEQ ID NO: 43298 - RNA, 45 nt, Mus musculus
cugauccaggggaccaggcuccaguuugugagaaauauuguccag

SEQ ID NO: 43299 - RNA, 46 nt, Mus musculus
ggcuauacuuuuggcaguauagccaaaaggaaacugaccuggccuu

SEQ ID NO: 43300 - RNA, 45 nt, Mus musculus
cuuuguugaucauuucauucuuugagcacuuaaugccgaccagag

SEQ ID NO: 43301 - RNA, 46 nt, Mus musculus
ugggggagggcugugugugugugugugugugugugugugugugugu

SEQ ID NO: 43302 - RNA, 45 nt, Mus musculus
gagaaaacugagucuaaagacaguguguaauuuuccacaggccag

SEQ ID NO: 43303 - RNA, 46 nt, Mus musculus
acuugcugcuaucaaccuguugguugggaguguaucauuuauucag

SEQ ID NO: 43304 - RNA, 46 nt, Mus musculus
cuggcugguaauugcaaaauaugugugccccagagaucagaaagua

SEQ ID NO: 43305 - RNA, 48 nt, Mus musculus
cuccccuuaagauagucuguucuuuagaaauaaauggacaggaagaug

SEQ ID NO: 43306 - RNA, 41 nt, Mus musculus
gguucugauggguguuugauuguucuuuuuauucuggcagg

SEQ ID NO: 43307 - RNA, 46 nt, Mus musculus
uugggccucuagggggucaguuacuauucagaccacaggggcugcu

SEQ ID NO: 43308 - RNA, 46 nt, Mus musculus
ccauccauccauccauccauccauccauccauccauccacccccgg

SEQ ID NO: 43309 - RNA, 44 nt, Mus musculus
uguagucacuagagagaagagagguaccaggcagucucgggcag

SEQ ID NO: 43310 - RNA, 29 nt, Mus musculus
uggggacuuuuaagucucugaagaauucu

SEQ ID NO: 43311 - RNA, 45 nt, Mus musculus
gacucugggaguccucuggagaaagggguuuaugcuggugugugg

SEQ ID NO: 43312 - RNA, 42 nt, Mus musculus
guguguguguguguguguguguguguguguguggucuguacg

SEQ ID NO: 43313 - RNA, 45 nt, Mus musculus
agagagagagacagacagagagacagacagagagagagacagaga

SEQ ID NO: 43314 - RNA, 46 nt, Mus musculus
gucuuuguuaaguauggaaaucccacaccuguccaaaaugggggag

SEQ ID NO: 43315 - RNA, 45 nt, Mus musculus
gggaaagggaccuguaaggugacagaggggcugacagugagggga

SEQ ID NO: 43316 - RNA, 45 nt, Mus musculus
auuauuaucccaggugcaagaagcaaacaaagagaauuggcccua

SEQ ID NO: 43317 - RNA, 45 nt, Mus musculus
cuguccuaugccacucauggugacacgugaaggaagauguuggaa

SEQ ID NO: 43318 - RNA, 67 nt, Mus musculus
agucagaucuuguuuccugauacaaugcaaacuuggcaugagacuuggaaacauacuuucacaugca

SEQ ID NO: 43319 - RNA, 74 nt, Mus musculus
cuccuacugucugccugccccuugcacacuuguuagcagaaauguuggaaagcgcauugcuuccuuuaaaccca

SEQ ID NO: 43320 - RNA, 46 nt, Mus musculus
gguguccuugaaccuugugcuggaauugugcaggaaguuuacccag

SEQ ID NO: 43321 - RNA, 45 nt, Mus musculus
uucugucaacaagggcagggaugcacuuaacauaauaagcaccag

SEQ ID NO: 43322 - RNA, 45 nt, Mus musculus
uucuggaugaaguuuccuccuugauccuagucuacuucuguccag

SEQ ID NO: 43323 - RNA, 23 nt, Mus musculus
augaucucaugguuuguguugca

SEQ ID NO: 43324 - RNA, 42 nt, Mus musculus
ugaugauuuaaauauuaaaagcuaaagggagcugaaguggag

SEQ ID NO: 43325 - RNA, 41 nt, Mus musculus
ugcagcaggcagguggcaaggcagaaacguggacagcaaca

SEQ ID NO: 43326 - RNA, 42 nt, Mus musculus
uaggagccguguguccucauggauguggggcugguggggaag

SEQ ID NO: 43327 - RNA, 45 nt, Mus musculus
gagagagagagagagagagagagagaaacagacagagagacagag

SEQ ID NO: 43328 - RNA, 46 nt, Mus musculus
gcuccuucucugcuaagaccaacucaauuccauaugaaguagagag

SEQ ID NO: 43329 - RNA, 44 nt, Mus musculus
guauuaggaaaacguaggaaaauagaugcaauauuuuccuguag

SEQ ID NO: 43330 - RNA, 41 nt, Mus musculus
aacaggaugauuacauagauggaugccuuguuugccugggu

SEQ ID NO: 43331 - RNA, 60 nt, Mus musculus
uauggggaccuuggcccaguuaugagccuuuccagccccugaaugugagagaaguuaggg

SEQ ID NO: 43332 - RNA, 45 nt, Mus musculus
uuaauuucuuugugcuggauuuuguggaacacaucuuuagcccag

SEQ ID NO: 43333 - RNA, 46 nt, Mus musculus
cagaaagauccugugugugugugugugugugugugugugugugugu

SEQ ID NO: 43334 - RNA, 46 nt, Mus musculus
ggcucucucuuuaaaaagaacaaaaggaagccagaucauagcacug

SEQ ID NO: 43335 - RNA, 23 nt, Mus musculus
acagcuggcgugggaaguguagc

SEQ ID NO: 43336 - RNA, 46 nt, Mus musculus
aacacgaagaagaugauaaguaaauaucacacacacgcacacgcac

SEQ ID NO: 43337 - RNA, 41 nt, Mus musculus
aagaggaggggaaacuguccaacagagggaguacugagagg

SEQ ID NO: 43338 - RNA, 45 nt, Mus musculus
uauaacuagguguuagugcacagcaguuuauauggaaauggaaag

SEQ ID NO: 43339 - RNA, 41 nt, Mus musculus
uuacacauuagugcauugauaaggauagcuuuagaggaaga

SEQ ID NO: 43340 - RNA, 46 nt, Mus musculus
accagacaggcugaaauauuuucaaagaaaagucaaaaaggcccag

SEQ ID NO: 43341 - RNA, 46 nt, Mus musculus
gggugaaaaggaggaggaggaagagaaggaagaggaggagaaggag

SEQ ID NO: 43342 - RNA, 45 nt, Mus musculus
uacaguaaauguaaauggacuauacacuuuauuuaaaaggcuggg

SEQ ID NO: 43343 - RNA, 45 nt, Mus musculus
ugaaucuaacauaagcugcaaaaaugcacgaagcaaagcuacuag

SEQ ID NO: 43344 - RNA, 42 nt, Mus musculus
uuuuugagucagagaaauaaccagacauugguaugugugaag

SEQ ID NO: 43345 - RNA, 45 nt, Mus musculus
uggauuuaaagaaagagaggugcuguucacauugcagauuuugua

SEQ ID NO: 43346 - RNA, 45 nt, Mus musculus
cugagagggacucuguuaugcuguguggcuuguuuuauuuaaaua

SEQ ID NO: 43347 - RNA, 46 nt, Mus musculus
auaguagaauccaucauaaauuaagacuauccuaugacuaacucag

SEQ ID NO: 43348 - RNA, 46 nt, Mus musculus
ucuaauaacccuugacuuuaagacgugcucauuagaacagagauag

SEQ ID NO: 43349 - RNA, 45 nt, Mus musculus
ugucagcuguggcagguguacaccuuuuucugaacuugaccuuag

SEQ ID NO: 43350 - RNA, 46 nt, Mus musculus
aacugacguuagcuauugcaaguccauuugauaaagcuagccccaa

SEQ ID NO: 43351 - RNA, 23 nt, Mus musculus
aacauaaauuuggguaguuagag

SEQ ID NO: 43352 - RNA, 46 nt, Mus musculus
ugauuacauuccacagguaguuaacauccuugauguggagcuuuag

SEQ ID NO: 43353 - RNA, 42 nt, Mus musculus
ccuggauccugagcugugacuacaguagagaaaagggaguag

SEQ ID NO: 43354 - RNA, 45 nt, Mus musculus
auagauguguguucaucuguccuuauguuccuuugaacugcccau

SEQ ID NO: 43355 - RNA, 45 nt, Mus musculus
uaguauugaugaaaauguauucauguuagaauuuccauccucuca

SEQ ID NO: 43356 - RNA, 45 nt, Mus musculus
agccuggcccuggguguagucccagcauggagaggugaugaugua

SEQ ID NO: 43357 - RNA, 45 nt, Mus musculus
ccucuuccuuauuaaggauauuaaaucucuucaaaauagaaagcu

SEQ ID NO: 43358 - RNA, 45 nt, Mus musculus
gagugugaucaugggccauuuauuggguuuugaguuggucaacag

SEQ ID NO: 43359 - RNA, 45 nt, Mus musculus
gacugggagucugugcuaucauuauaauaaacacugaacacuuac

SEQ ID NO: 43360 - RNA, 45 nt, Mus musculus
gaagaaagaaagaaagaaagaaagaaagaaagaaagaaacuagau

SEQ ID NO: 43361 - RNA, 48 nt, Mus musculus
ccuguaaaacccuuuaauuucauacaaacacacacacacacacacaca

SEQ ID NO: 43362 - RNA, 45 nt, Mus musculus
ugcauguagucuguuuucaucacaggaaaacuaguauuuagggag

SEQ ID NO: 43363 - RNA, 42 nt, Mus musculus
uguguaggagggagagagagagagagagagagagagagagag

SEQ ID NO: 43364 - RNA, 43 nt, Mus musculus
gagagagagagagagagaaacagagagaaacagagagaaacag

SEQ ID NO: 43365 - RNA, 46 nt, Mus musculus
uguucugcaauaucaaugcuuuuugugugugggagaggugccucag

SEQ ID NO: 43366 - RNA, 41 nt, Mus musculus
gagugaucugagaauacuuuuaaaauauggugggucuggga

SEQ ID NO: 43367 - RNA, 45 nt, Mus musculus
uucaaaucccagcaaccacaugguggcucacaaucauccauaagg

SEQ ID NO: 43368 - RNA, 46 nt, Mus musculus
aaaugaauuauguuuuauuuacacuguggagaaaacuacuguugag

SEQ ID NO: 43369 - RNA, 41 nt, Mus musculus
ucugugugugugucugugucugugucugugugucucugugu

SEQ ID NO: 43370 - RNA, 46 nt, Mus musculus
cuuuaaauuauggauaacaaggcuuucuaucuaaaacucccugaag

SEQ ID NO: 43371 - RNA, 26 nt, Mus musculus
uaaaggaguuccagagagugaguggc

SEQ ID NO: 43372 - RNA, 46 nt, Mus musculus
guugguugguugguuggucaguugcaguguuggagauuggacccag

SEQ ID NO: 43373 - RNA, 42 nt, Mus musculus
caagcuggcaugggcaucagcuacauggcagggagggggcuu

SEQ ID NO: 43374 - RNA, 45 nt, Mus musculus
aguaugguaaagaguaacccaaggugugugugugugugugugugu

SEQ ID NO: 43375 - RNA, 25 nt, Mus musculus
gcagugcuaaggaccuuggugccag

SEQ ID NO: 43376 - RNA, 46 nt, Mus musculus
uagcuauaguuucauauacauaucugcaaucccagaaucugccaug

SEQ ID NO: 43377 - RNA, 42 nt, Mus musculus
uguguguguguguguguguguguguguguguguuuugcguug

SEQ ID NO: 43378 - RNA, 46 nt, Mus musculus
ugugcugaaauugccucccuggacagcaguuaagcaguaaagguag

SEQ ID NO: 43379 - RNA, 45 nt, Mus musculus
cuccucuaucucucuucuuggggcauuagcauuuuaaaagggcau

SEQ ID NO: 43380 - RNA, 45 nt, Mus musculus
aacucagagugggaaggcuuaauacugaaaaugggauuugugaga

SEQ ID NO: 43381 - RNA, 46 nt, Mus musculus
ugcucugccucuggaaaaacuggagacagugucaucaucuguguga

SEQ ID NO: 43382 - RNA, 46 nt, Mus musculus
cagguucuaucuccuaaaacaguccauucuggauuacuggggggag

SEQ ID NO: 43383 - RNA, 42 nt, Mus musculus
gcugcuguuggaggaggaggaggaggaggaggaggaggagga

SEQ ID NO: 43384 - RNA, 42 nt, Mus musculus
aggagcagcagacgggaaguuuucuuauuuauguaagagaag

SEQ ID NO: 43385 - RNA, 46 nt, Mus musculus
auuaccaauauuuuagaacaugcauuauucauuuguagggguguca

SEQ ID NO: 43386 - RNA, 27 nt, Mus musculus
accuaugagaauauguucuggcugggu

SEQ ID NO: 43387 - RNA, 46 nt, Mus musculus
acuuauaaaaauaaacaauuuuuggccagacucccucagcccacac

SEQ ID NO: 43388 - RNA, 45 nt, Mus musculus
agaucuagcccagaucuuuucauauuuguccaucaucugcucuca

SEQ ID NO: 43389 - RNA, 45 nt, Mus musculus
uuaagagcacuugguuuucuuauauaagaucuaggugucugcugu

SEQ ID NO: 43390 - RNA, 45 nt, Mus musculus
gugagagggucagaguaggucaguguccuuaaaauagaggaguca

SEQ ID NO: 43391 - RNA, 54 nt, Mus musculus
cauguuucugugucaaacaaguuggauauuuggaucuuuucaacaagguaagag

SEQ ID NO: 43392 - RNA, 46 nt, Mus musculus
aggguccauagucuucaaggagcaaaucuaaugugaucaaaggcag

SEQ ID NO: 43393 - RNA, 57 nt, Mus musculus
gggcacgacucuaagucauauuuguggcagcagcuuagacgcaguauaugucguugg

SEQ ID NO: 43394 - RNA, 57 nt, Mus musculus
uagaauguagcuuuguucuauugucugccaagaaagccgaguuggaaggagcacaug

SEQ ID NO: 43395 - RNA, 46 nt, Mus musculus
gggagacugcuucaaaaggcuuccugcuuuguuugauuccggucgg

SEQ ID NO: 43396 - RNA, 45 nt, Mus musculus
uuaaaaccacauuaguaagaauuaacccuguggaguggucaaaag

SEQ ID NO: 43397 - RNA, 30 nt, Mus musculus
caguuucagaaaugugccaccgggcuaggu

SEQ ID NO: 43398 - RNA, 45 nt, Mus musculus
gucagagaugaguugagaugugggcagaaagauuuuagcagccag

SEQ ID NO: 43399 - RNA, 46 nt, Mus musculus
uaccagugaugaaauuugccguguuuagugaucacagacaggcaag

SEQ ID NO: 43400 - RNA, 45 nt, Mus musculus
ugaguuuauaaaggaaaugaugcgaaauaguggcacaugggaaug

SEQ ID NO: 43401 - RNA, 46 nt, Mus musculus
cuuccugaagcuucuugcucuggcccccacuugaggacaggcacag

SEQ ID NO: 43402 - RNA, 46 nt, Mus musculus
cuauuuuuggauccuggaacucuuuuagaaagcuaccugcccccaa

SEQ ID NO: 43403 - RNA, 24 nt, Mus musculus
acucugucauggggcacacaggga

SEQ ID NO: 43404 - RNA, 42 nt, Mus musculus
gcaacucauuucaaaccagagucaacccagaccacaccccag

SEQ ID NO: 43405 - RNA, 46 nt, Mus musculus
uggaaggaggcaagguaaugcaagauuucaaugguggugcacucug

SEQ ID NO: 43406 - RNA, 46 nt, Mus musculus
acauguguuugucuggaaucuucaaaauguugugggaaaauuggag

SEQ ID NO: 43407 - RNA, 45 nt, Mus musculus
cucaccuuuggacagagggauggggaacacauauuauaugcagag

SEQ ID NO: 43408 - RNA, 71 nt, Mus musculus
ugcagcuuuuuaaaggcagauaugauaagacauaugagcugaguaugauagauggggagugggaugaggga

SEQ ID NO: 43409 - RNA, 74 nt, Mus musculus
gaauaaaugaauacagcaccacacuaaguuuaaugacgacagucauugagaugaggacuacugaaggaaagaag

SEQ ID NO: 43410 - RNA, 48 nt, Mus musculus
aguuuggaacuauugguaugaaaugccuaauaaauauccuagagcaga

SEQ ID NO: 43411 - RNA, 48 nt, Mus musculus
cugauuuaaagcaaaacaaacaaacaaaaaaaagacauagcaacggga

SEQ ID NO: 43412 - RNA, 92 nt, Mus musculus
caacaacaaaaaaaugggaaauuaguuuucucaacagcaagagaagaaagguugugggaaccagaccaugaagcacuacugugaaaugaaga

SEQ ID NO: 43413 - RNA, 43 nt, Mus musculus
ucuuggugaaaggagaauuaguuaucuugugaaaacuaaggag

SEQ ID NO: 43414 - RNA, 45 nt, Mus musculus
ggugguacacgugugugguuaaggagagggugguacacaugugug

SEQ ID NO: 43415 - RNA, 46 nt, Mus musculus
gauuuguguuccaugcugagccaaauggcagcccccaggggugcag

SEQ ID NO: 43416 - RNA, 45 nt, Mus musculus
gcguugggguaugaaacccuucaugucagagucauuccaggggga

SEQ ID NO: 43417 - RNA, 42 nt, Mus musculus
agagggagaggaggagggagaaggagagggagagggagggaa

SEQ ID NO: 43418 - RNA, 46 nt, Mus musculus
ucccugaaggauuucgaagcuuaggucagguaaaaaaaaagcccag

SEQ ID NO: 43419 - RNA, 45 nt, Mus musculus
gcuucaucagcucacaccuaaaacacaguuaggcuuuggcucuga

SEQ ID NO: 43420 - RNA, 41 nt, Mus musculus
aggaaggaaggaaggaaggacggaaggaaggaagggaggga

SEQ ID NO: 43421 - RNA, 44 nt, Mus musculus
aucauuugucucaagcucccaugguuuuuccuccgcccaccuuu

SEQ ID NO: 43422 - RNA, 46 nt, Mus musculus
uagcuauaugaaauccuaacucaaaacacaaacaaaaagccccaaa

SEQ ID NO: 43423 - RNA, 24 nt, Mus musculus
uugaucagcccaucucccuuggug

SEQ ID NO: 43424 - RNA, 46 nt, Mus musculus
uaaaaauauuaccacagagcuggguucuggggauggaagaaugaag

SEQ ID NO: 43425 - RNA, 23 nt, Mus musculus
ugcuauugauggaugggugcuca

SEQ ID NO: 43426 - RNA, 46 nt, Mus musculus
aauugauggguagcaauaucuugcuuugcagcauccuggcucagag

SEQ ID NO: 43427 - RNA, 62 nt, Mus musculus
cuaucacagggauuugucccuggucuucacaaagacuggccagaaaucauauuuuucaugua

SEQ ID NO: 43428 - RNA, 42 nt, Mus musculus
guccucuuaccuaucucauccguccucuuugcucaagcccag

SEQ ID NO: 43429 - RNA, 46 nt, Mus musculus
gaacuaaaaggagaacagguauuaaaaggaagguucaauagcagaa

SEQ ID NO: 43430 - RNA, 45 nt, Mus musculus
gagcuacaccgagauccugaaaauccgccagucugagaggaugaa

SEQ ID NO: 43431 - RNA, 46 nt, Mus musculus
acaccaaucauuaaagcauugagauucugagguagcauaaguccua

SEQ ID NO: 43432 - RNA, 41 nt, Mus musculus
ucccuacugugugagugugacccccuuuguuucuaccccug

SEQ ID NO: 43433 - RNA, 28 nt, Mus musculus
ccauuccuucccugaguggugcuuuuac

SEQ ID NO: 43434 - RNA, 46 nt, Mus musculus
auaaggccuagaaacuuagaucaaaguagaagcaagagucauauca

SEQ ID NO: 43435 - RNA, 44 nt, Mus musculus
ggagcugaauuaaggagacaggaaggagcaaucgccacacucau

SEQ ID NO: 43436 - RNA, 46 nt, Mus musculus
auucuugggucaccauaaauuuaaaguacaaaccaauagccccccc

SEQ ID NO: 43437 - RNA, 42 nt, Mus musculus
ucagcuucucuugucccuucucucuccucaucaaggcucaug

SEQ ID NO: 43438 - RNA, 42 nt, Mus musculus
uguguguguguuaggaggcucagagggggacacugcccaaaa

SEQ ID NO: 43439 - RNA, 46 nt, Mus musculus
acauaugauaacagaaguuccuguuucuguuaaauagaagguacag

SEQ ID NO: 43440 - RNA, 44 nt, Mus musculus
uuccuuccuuccuuccuuccuuccuuccuucauucuugccugga

SEQ ID NO: 43441 - RNA, 42 nt, Mus musculus
uaucacacugucuagucuugggcuuccucucuuugccccagc

SEQ ID NO: 43442 - RNA, 42 nt, Mus musculus
guuucuuacucguuggaggccauguaggccaugagguccacc

SEQ ID NO: 43443 - RNA, 42 nt, Mus musculus
cuugcauauggcaauguaacgauccaaagacaucacagccag

SEQ ID NO: 43444 - RNA, 41 nt, Mus musculus
cgcaguaggcagcgcgucagucucauaaucugaagguccug

SEQ ID NO: 43445 - RNA, 41 nt, Mus musculus
uaggcuguacugaauguguucuucuugguaucauggccuua

SEQ ID NO: 43446 - RNA, 46 nt, Mus musculus
auguagauguagaucccugguccauaaaauaaagacaccaccagca

SEQ ID NO: 43447 - RNA, 42 nt, Mus musculus
gcccggaccuaggcacgcugcagaacuuuaaguuagagucac

SEQ ID NO: 43448 - RNA, 46 nt, Mus musculus
gacuuuuggaaauaaaaauggaggaagaauguaaguauaccaccag

SEQ ID NO: 43449 - RNA, 42 nt, Mus musculus
cggagaguguggaggagguggugacugugcuggaggauuuag

SEQ ID NO: 43450 - RNA, 46 nt, Mus musculus
ucacuauccugaaugagugagauaugggagcagaauggagaguuag

SEQ ID NO: 43451 - RNA, 45 nt, Mus musculus
aggucauaucacaggccuuaaguguuaccaggauguacaggguag

SEQ ID NO: 43452 - RNA, 46 nt, Mus musculus
ucuuguauccuaguguaguuuuguaguuuguaguagaaacucugag

SEQ ID NO: 43453 - RNA, 46 nt, Mus musculus
agauuucugaaauuauuuuuauugaaaauaaguguuugguggguag

SEQ ID NO: 43454 - RNA, 60 nt, Mus musculus
acaacaauuaaugaaaaacuaguccaugaauuuaaaugagagaaaggagggguauaugag

SEQ ID NO: 43455 - RNA, 90 nt, Mus musculus
cuagagaaaccaauauagcuuucuaggcaauuauguugauaaaggggagggagauaguaaaaagagguauuaccacuuaaacaggcuuua

SEQ ID NO: 43456 - RNA, 46 nt, Mus musculus
gcuggaucauuuuuuuuuuuuuaaacuaucaaguuuggcccuguua

SEQ ID NO: 43457 - RNA, 39 nt, Mus musculus
uauuaagguauuuauccccaccccgugugugugugugug

SEQ ID NO: 43458 - RNA, 45 nt, Mus musculus
gguaagauuggauucugggaguuugaaguuagcccaaggagaagu

SEQ ID NO: 43459 - RNA, 45 nt, Mus musculus
uagccacgauagauuaugcagguacagagcaggucuugugucagu

SEQ ID NO: 43460 - RNA, 46 nt, Mus musculus
ggcauggaccaagguuagguccucaacaccacccaaaauaacagug

SEQ ID NO: 43461 - RNA, 69 nt, Mus musculus
uccccuuuuaaccaaacuuugcucugcacaaaauaaggcccucuuccuuuguuaagauuugaccuaaga

SEQ ID NO: 43462 - RNA, 45 nt, Mus musculus
cuacuuguuuugauauuauuuugaccaugcaaaucaaaucagcuc

SEQ ID NO: 43463 - RNA, 50 nt, Mus musculus
gaaccuacccuuaggauuagcucaugucauuuuacauuuccugcccauuu

SEQ ID NO: 43464 - RNA, 55 nt, Mus musculus
ucccuguuagguucacacaaacacuggcuucauauccacuuuaccuuuguaccau

SEQ ID NO: 43465 - RNA, 42 nt, Mus musculus
gacacacacacacaacugguaaaauauuuuuaagcccaaaau

SEQ ID NO: 43466 - RNA, 45 nt, Mus musculus
ccagacuagcuguaucagcaaacuuuggacucaggggagggaguu

SEQ ID NO: 43467 - RNA, 46 nt, Mus musculus
gugcugaugagaaacgagcccuugcauccuuuaaccaagaagagag

SEQ ID NO: 43468 - RNA, 46 nt, Mus musculus
auucuagcucugauagugauaaaaagaaaguuaaaaccaagaagaa

SEQ ID NO: 43469 - RNA, 45 nt, Mus musculus
ggucacauuuauuaguuguucauguuaacaucugugccaucagag

SEQ ID NO: 43470 - RNA, 74 nt, Mus musculus
ugacaaaauagaauaugccuugcaagaaauuacaucaauaugaggaaggguaauguuguguacuagauauuaca

SEQ ID NO: 43471 - RNA, 85 nt, Mus musculus
cugcauucaaguucugaugccucuggaaaaacugguugucagucugaacuuugugucaugguucuuugacaaguguauggaaagg

SEQ ID NO: 43472 - RNA, 48 nt, Mus musculus
gccucagaaguagccaguauugcucccagaucaugcuucagagcugau

SEQ ID NO: 43473 - RNA, 58 nt, Mus musculus
ucaccgccauggacguggucuacgcgcucaagcgccagggccgcacccucuacggauu

SEQ ID NO: 43474 - RNA, 48 nt, Mus musculus
accaagcccgccauccgccgccuggcccggcgcgggggagugaagcgc

SEQ ID NO: 43475 - RNA, 46 nt, Mus musculus
aucucuguucugagcuguccugagugcagucaugucuggcagaggu

SEQ ID NO: 43476 - RNA, 61 nt, Mus musculus
aagaaaacuccaaagaaagcgaagaagccugcggcggcuggagugaagaaaguugccaaga

SEQ ID NO: 43477 - RNA, 64 nt, Mus musculus
gcggcuccggcuccuguagagaagucucccgccaagaagaagacaacgaaaaaagcuggcgcgg

SEQ ID NO: 43478 - RNA, 46 nt, Mus musculus
ggccuugugguggcucucggucuucuugggcagcagcacggccugg

SEQ ID NO: 43479 - RNA, 46 nt, Mus musculus
uguggauggcucugaaaagagccuuuuuuuuuuuucuuuucgggug

SEQ ID NO: 43480 - RNA, 46 nt, Mus musculus
acuguggauggcucugaaaagagccuuuuuuuuuuuucuuuucggg

SEQ ID NO: 43481 - RNA, 46 nt, Mus musculus
uuggccuugugguggcucucggucuucuugggcagcagcacggccu

SEQ ID NO: 43482 - RNA, 45 nt, Mus musculus
caugguguagaagucagacugcacaggugaaguacaagcuuugag

SEQ ID NO: 43483 - RNA, 46 nt, Mus musculus
agaggggguccuuguaacccauguccuagguuuuaucaucugugag

SEQ ID NO: 43484 - RNA, 46 nt, Mus musculus
ggaagggagggcugggcuaaagagaaaccaguagagggcgguucga

SEQ ID NO: 43485 - RNA, 46 nt, Mus musculus
ugguuuugcaagcugcuggaacugaaaacugaggaagcuucuagag

SEQ ID NO: 43486 - RNA, 31 nt, Mus musculus
uccuaaggcugguccccauucugcccugauu

SEQ ID NO: 43487 - RNA, 42 nt, Mus musculus
cagcuuagguuuugguaucauucuacacaguggcccccagga

SEQ ID NO: 43488 - RNA, 41 nt, Mus musculus
cccauccugccuagagcccuucuucuucuggggcgcccucc

SEQ ID NO: 43489 - RNA, 45 nt, Mus musculus
aucgauaggagggagaccgauagaggaagagaggugccuagguga

SEQ ID NO: 43490 - RNA, 41 nt, Mus musculus
caugcgcucuccacagggcauccugcggcacuggccccugc

SEQ ID NO: 43491 - RNA, 46 nt, Mus musculus
accagacaugaugaagacaagauuguacugcucuaagacgaagcag

SEQ ID NO: 43492 - RNA, 46 nt, Mus musculus; identical to SEQ ID NO: 43481

SEQ ID NO: 43493 - RNA, 45 nt, Mus musculus
cauuguaaagauuaaacagccuuagugacaacuguacguucccaa

SEQ ID NO: 43494 - RNA, 43 nt, Mus musculus
agucugccaucagaagacugaaggaacugaaagaccaguagaa

SEQ ID NO: 43495 - RNA, 94 nt, Mus musculus
gggacccgcuauggugccucccuccagaaaauggugaagaaaauugaaaucagccagcacgccaaguauacuugcuccuucuguggcaagacca

SEQ ID NO: 43496 - RNA, 42 nt, Mus musculus
uggagcuuaugagaacauuaaagauacaaaggaggaggagag

SEQ ID NO: 43497 - RNA, 46 nt, Mus musculus
gcccaugagacacugaaagaugacaucacgaagagucaugagacgg

SEQ ID NO: 43498 - RNA, 46 nt, Mus musculus
cauauucuuguaaagucaacacugacauguucauuggggcugaucu

SEQ ID NO: 43499 - RNA, 46 nt, Mus musculus
aguguugacuuuacaagaauaugaauucgaaaagcaguucaacgag

SEQ ID NO: 43500 - RNA, 84 nt, Mus musculus
gaacuggugcuuacaugcuguacauucugauguccaaaggccugaagcagucaguuugugaccagaguuuuuacaauggaccug

SEQ ID NO: 43501 - RNA, 44 nt, Mus musculus
ucaggccuuuggacaucagaauguacagcauguaagcaccaguu

SEQ ID NO: 43502 - RNA, 42 nt, Mus musculus
uugcugagcacaaaugcauaaguccagaauuugcugacaggu

SEQ ID NO: 43503 - RNA, 42 nt, Mus musculus
acuaacgccuugcgggcugcggguuuccuagucucccggaag

SEQ ID NO: 43504 - RNA, 41 nt, Mus musculus
uugcuccugaagauguaaguaauaaagcuuuugccgcagaa

SEQ ID NO: 43505 - RNA, 46 nt, Mus musculus
gcuaaugggcugugucauuaacuaccuggucuucaacuggaugcug

SEQ ID NO: 43506 - RNA, 46 nt, Mus musculus
cuuucuucacuuugccgauguaggccucaaagaagaaauggcagaa

SEQ ID NO: 43507 - RNA, 45 nt, Mus musculus
caacucuagaacacacuagauacaaaggcagccacgggcaaagag

SEQ ID NO: 43508 - RNA, 44 nt, Mus musculus
ccccuuuucaaacuaugugagcacacacacacacacacacacac

SEQ ID NO: 43509 - RNA, 45 nt, Mus musculus
uucuuuaaaaggccuagccuuuugcaaaagcauugcuguccuaga

SEQ ID NO: 43510 - RNA, 45 nt, Mus musculus
uuucuucagaauguguuugcauccuguauacaaguuuuucaccua

SEQ ID NO: 43511 - RNA, 46 nt, Mus musculus
cugauuucuggccuggcauuguuugcagaccuggagcuguggaggu

SEQ ID NO: 43512 - RNA, 46 nt, Mus musculus
aguugucaagaacaaggccuacuuuaaaagauaccaagugagauuu

SEQ ID NO: 43513 - RNA, 46 nt, Mus musculus
gaagcgauuggugaucccggacaagaauaaguacaacacacccaaa

SEQ ID NO: 43514 - RNA, 72 nt, Mus musculus
ucagccuggugccuucacuugcuuucuggaugcaggucuugcccaaacuacaacuggcaauaaaguuuuuga

SEQ ID NO: 43515 - RNA, 45 nt, Mus musculus
cuaauggaggaagaugaagauguguauaagaaacaguucucucag

SEQ ID NO: 43516 - RNA, 45 nt, Mus musculus
guguuuaaaugggacacaaauaucuucacauccuuugcccacuug

SEQ ID NO: 43517 - RNA, 43 nt, Mus musculus
gucagccuuggugaguggaagucccuguuguugagcccgagca

SEQ ID NO: 43518 - RNA, 45 nt, Mus musculus
uuggugucuuuuaccuacuuugaacaaauccuguaagugccagcc

SEQ ID NO: 43519 - RNA, 46 nt, Mus musculus
uugccaagaucuuuggagccccucuaccugcagagagcaaggaaaa

SEQ ID NO: 43520 - RNA, 45 nt, Mus musculus
caugggcgcccgcaagcgcagccccuuccguuaugaccuguggaa

SEQ ID NO: 43521 - RNA, 41 nt, Mus musculus
cacuuugugaaacgcaagaagaaggcagccgcggccgcagg

SEQ ID NO: 43522 - RNA, 61 nt, Mus musculus
aaagcgggagaguugguggagcagcaaaaggcugcgauggaggaagaggcgaaugcagagg

SEQ ID NO: 43523 - RNA, 84 nt, Mus musculus
gagguuuuuucuucagcaaguacaccaugucuggucguggcaagggcgguaaaggucuuggcaaaggcggcgccaagcgccacc

SEQ ID NO: 43524 - RNA, 85 nt, Mus musculus
gcaaagugcugcgugacaacauccagggcaucacgaagcccgccauccgccgccuggcccggcgcgggggagugaagcgcaucuc

SEQ ID NO: 43525 - RNA, 60 nt, Mus musculus
ccucuacggauucggcgguuaagcgaaucuugcuucugaccuacaaaaccaaaggcccuu

SEQ ID NO: 43526 - RNA, 56 nt, Mus musculus
uucguauugcuccggagaggcagcagacauucgggguugggagaaaauacaaaggg

SEQ ID NO: 43527 - RNA, 23 nt, Mus musculus
cuaaaacagccacuaaccuguau

SEQ ID NO: 43528 - RNA, 45 nt, Mus musculus
ugcccggggagcuggccaagcacgccgugucggagggcaccaagg

SEQ ID NO: 43529 - RNA, 46 nt, Mus musculus
ugccccgaagaagggcuccaagaaggcccugaccaaggcccagaag

SEQ ID NO: 43530 - RNA, 41 nt, Mus musculus
acaggugucuucuccacaggugcaggggcagcaggcgccgc

SEQ ID NO: 43531 - RNA, 47 nt, Mus musculus
gcggcgccugcugccccugcaccuguggagaagacaccugugaagaa

SEQ ID NO: 43532 - RNA, 43 nt, Mus musculus
cuucuuguugaguuugaaggagccggaggcgccggugcccuug

SEQ ID NO: 43533 - RNA, 41 nt, Mus musculus
aacaagaaggcggcuuccggugaggcuaagcccaaggcuaa

SEQ ID NO: 43534 - RNA, 50 nt, Mus musculus
gaagccugcggcggcugccggcgccaagaaaguuuccaagagucccaaga

SEQ ID NO: 43535 - RNA, 46 nt, Mus musculus
agaaguagaguggugcguccugcuuugaaaaucucaaacggcucuu

SEQ ID NO: 43536 - RNA, 46 nt, Mus musculus
ugaagaugaauguuuuaauaguuguugcuuugggaaaaauagcgag

SEQ ID NO: 43537 - RNA, 46 nt, Mus musculus; identical to SEQ ID NO: 43481

SEQ ID NO: 43538 - RNA, 42 nt, Mus musculus
agccuugccacccuguuugccacguccagacauugacgcaag

SEQ ID NO: 43539 - RNA, 46 nt, Mus musculus
aggagagggcugagggucagucaagauccuuuuuuccaagucccuu

SEQ ID NO: 43540 - RNA, 46 nt, Mus musculus
ccgccccgaagaagggcuccaagaaggccgugaccaaggcccagaa

SEQ ID NO: 43541 - RNA, 57 nt, Mus musculus
caccaaggccgucaccaaguacaccagcuccaagugauccugccaaguaagccuccg

SEQ ID NO: 43542 - RNA, 46 nt, Mus musculus
uuguaggacaggagugacagacuuugaagaggauaauuguugccau

SEQ ID NO: 43543 - RNA, 45 nt, Mus musculus
aaauuuucauaguccaagugacgugaaaguuuagagaaaugagaa

SEQ ID NO: 43544 - RNA, 46 nt, Mus musculus
agaaagcauaauucaagauauacuuuuguuuacuuaucaagaacaa

SEQ ID NO: 43545 - RNA, 45 nt, Mus musculus
uuauuguaaagaaagauagaagugaccuuucuagcagcugccuga

SEQ ID NO: 43546 - RNA, 42 nt, Mus musculus
cagauuaaccaccauaguuucagaacucaaggaacaacugag

SEQ ID NO: 43547 - RNA, 41 nt, Mus musculus
guucaaagagaaaaggagagagagagagagagagagagaga

SEQ ID NO: 43548 - RNA, 30 nt, Mus musculus
cugaagaaagcccuggcugcggcugguuac

SEQ ID NO: 43549 - RNA, 45 nt, Mus musculus
ggcugucaagaagccaaaggcuacgcccacaaaagcuucugggag

SEQ ID NO: 43550 - RNA, 67 nt, Mus musculus
gcaaaaauggucaugcagaagaccgaucugaggaaggcagcagggaggaagugaguuucaaagccag

SEQ ID NO: 43551 - RNA, 42 nt, Mus musculus
uucuuguugaguuugaaggagccggaggcaccggugcccuug

SEQ ID NO: 43552 - RNA, 46 nt, Mus musculus
uucuuggcugcaaccuucuuggccuuggcaaccuugggcuuggcag

SEQ ID NO: 43553 - RNA, 48 nt, Mus musculus
agaagaacaacagccgcaucaaacuggggcugaaaagccuggugaaua

SEQ ID NO: 43554 - RNA, 46 nt, Mus musculus
agcugcagccccagcagucuucuuagguuucuuagcagccccggau

SEQ ID NO: 43555 - RNA, 45 nt, Mus musculus
cccaagaagccugcaguuuccaagaagacuuccaagagccccaag

SEQ ID NO: 43556 - RNA, 46 nt, Mus musculus
ggcagugaagccuaaggcuuccaaggcgaaagugacaaagccaaag

SEQ ID NO: 43557 - RNA, 46 nt, Mus musculus
cggccaagcaacuuguugagcuccucgucguugcggauggccagcu

SEQ ID NO: 43558 - RNA, 50 nt, Mus musculus
cgagagccacaagucccagaccaagugacuccugcacaagacagcaacca

SEQ ID NO: 43559 - RNA, 45 nt, Mus musculus
ugaaaugcuauuaucacaauggccuauagacaaguggggggcggg

SEQ ID NO: 43560 - RNA, 46 nt, Mus musculus
cggguuucucuguguagcuguggcuauccuagaacuuacuauguag

SEQ ID NO: 43561 - RNA, 46 nt, Mus musculus
ggaauuguaagugggaacaaaugcauguguggauaaugguagcccc

SEQ ID NO: 43562 - RNA, 46 nt, Mus musculus
uaaauacucugguccaggcugguagcacaaaccuguaaucccagca

SEQ ID NO: 43563 - RNA, 41 nt, Mus musculus
cuuuuuucucccauugacccuuuguugguaggucugauagu

SEQ ID NO: 43564 - RNA, 47 nt, Mus musculus
uaguaaaggaaaggaaaagggaaaggaaagaaaaaaaaaggaaagag

SEQ ID NO: 43565 - RNA, 46 nt, Mus musculus
acugagaacagcgggaagacccgaagaagcccaacaaugccaagua

SEQ ID NO: 43566 - RNA, 46 nt, Mus musculus
gaucugaccaacaagaccacaggaaaauuaauagcacaaggcagac

SEQ ID NO: 43567 - RNA, 46 nt, Mus musculus
auggguugguggacaagcaucagaaacaacuuguggggcuagagag

SEQ ID NO: 43568 - RNA, 46 nt, Mus musculus
aaccuuaguggacagcaucucgaccauggcucuaaugugcacagaa

SEQ ID NO: 43569 - RNA, 47 nt, Mus musculus
uuaggugacgcuugucucggcugcuccugagaaacuaaucugugaga

SEQ ID NO: 43570 - RNA, 46 nt, Mus musculus
augguugugagccgccaugugguugcugggauuugaacucgggacc

SEQ ID NO: 43571 - RNA, 31 nt, Mus musculus
agugaucugacuuggcugaauucuaugauuu

SEQ ID NO: 43572 - RNA, 45 nt, Mus musculus
gacgugggaggcuggcgcggccacccuuggucguucucuggcagc

SEQ ID NO: 43573 - RNA, 46 nt, Mus musculus
ucggguagggagugcuggaaucagaugcaaugcuagcaaaagggag

SEQ ID NO: 43574 - RNA, 45 nt, Mus musculus
auucccagcaaccauauggugacucacaaccaucuguaauaggau

SEQ ID NO: 43575 - RNA, 45 nt, Mus musculus
guuuauauuuugauguuaauuccacuuucucaagaagggcugcua

SEQ ID NO: 43576 - RNA, 46 nt, Mus musculus
aacucagauaacucuauuuauugcuccaacaauauccaggcacaga

SEQ ID NO: 43577 - RNA, 41 nt, Mus musculus
aauaauaguuuuagucuuuguucauuugggguguguguggu

SEQ ID NO: 43578 - RNA, 45 nt, Mus musculus
aauugaauuauggacuguccaaaaaauaaaguauuguguaacuau

SEQ ID NO: 43579 - RNA, 46 nt, Mus musculus
cucagggaaaggccacugagcuaauagccugucuuaguugugagau

SEQ ID NO: 43580 - RNA, 46 nt, Mus musculus
ccaaaaagugugcuucccaaaguaaugcacuuguaagacuauagug

SEQ ID NO: 43581 - RNA, 42 nt, Mus musculus
uggugcuuguaagcugaagaugucaaauuggcaagggguaau

SEQ ID NO: 43582 - RNA, 47 nt, Mus musculus
auguggauaguucaaaggcuguuauugagaaagcagauagauccaga

SEQ ID NO: 43583 - RNA, 46 nt, Mus musculus
uccagacuuccccgaggaugcagauauagauuuaaaagauguagau

SEQ ID NO: 43584 - RNA, 90 nt, Mus musculus
uuccgacuccucauuuggaugggaaacaugugguauuuggucaagucauaaaacgacuagguguggcaaggacgcuugaaaauguagaag

SEQ ID NO: 43585 - RNA, 86 nt, Mus musculus
uuauggugaaaaauuugaagaugaaaauuuucauuauaagcaugaucgggaggguuugcugagcauggcaaaugcaggccccaaau

SEQ ID NO: 43586 - RNA, 46 nt, Mus musculus
uguucccaaaacugcagaaaauuuucgugcauuguguacaggagaa

SEQ ID NO: 43587 - RNA, 64 nt, Mus musculus
cgagcgaugggcaucucucgggacaacuggcacaagcgccgcaagaccggggguaagcgaaaac

SEQ ID NO: 43588 - RNA, 54 nt, Mus musculus; identical to SEQ ID NO: 29835

SEQ ID NO: 43589 - RNA, 63 nt, Mus musculus
ccuaccacaagaagcgaaaguaugagcugggacggcccgcugccaacacgaagauuggcccuc

SEQ ID NO: 43590 - RNA, 45 nt, Mus musculus; identical to SEQ ID NO: 25387

SEQ ID NO: 43591 - RNA, 45 nt, Mus musculus
ugcuggaacugcuccuccaggaggcugcugauuuuggcauucuuu

SEQ ID NO: 43592 - RNA, 46 nt, Mus musculus
gcaagcuucuagccuguauugccucacgaccaggccaguguggcag

SEQ ID NO: 43593 - RNA, 54 nt, Mus musculus
gaucaaagcccggaaaggcaaaugagccucaugcguaguguaauaaaggugucu

SEQ ID NO: 43594 - RNA, 46 nt, Mus musculus
gaaugucauucaaaccaaaacaacaggaaaucacucucgcucaaag

SEQ ID NO: 43595 - RNA, 59 nt, Mus musculus
gcuuacauuugaacaucaacuuguuuauaguuucugugagugagaaaaagccaccagau

SEQ ID NO: 43596 - RNA, 45 nt, Mus musculus
aagaauccaagcgugugcaugacagguugugugugugagaaggga

SEQ ID NO: 43597 - RNA, 46 nt, Mus musculus
guuucuguccccaaagucuaaugacuaaacucaccuggcucuaggu

SEQ ID NO: 43598 - RNA, 24 nt, Mus musculus
acaccggcacuuuaaacucugugu

SEQ ID NO: 43599 - RNA, 47 nt, Mus musculus
uuguuuaccuuaaagcgaguuuugcaaauucuuauuccuuuagcaga

SEQ ID NO: 43600 - RNA, 46 nt, Mus musculus
guuguggauuucccugucuccauaccccacuuccacugcccccauc

SEQ ID NO: 43601 - RNA, 45 nt, Mus musculus
gccugggggaggaagagggcaucagugaccucuucgaugccuaug

SEQ ID NO: 43602 - RNA, 46 nt, Mus musculus
caaguacccaagggcccauugagguuuacuuguguccagaagagac

SEQ ID NO: 43603 - RNA, 46 nt, Mus musculus
acacuuguugcucugcgagaggacccugguucaauucccagcagcc

SEQ ID NO: 43604 - RNA, 42 nt, Mus musculus
uuggugggcuaagugguggcugaaagcccagaauccugagau

SEQ ID NO: 43605 - RNA, 49 nt, Mus musculus
ugaggaugggggcaugcuggcccagugucaaggccuguccaaagaagug

SEQ ID NO: 43606 - RNA, 46 nt, Mus musculus
gauguuuugaaaacaauauaauuuacgggcuggcaagguggcucag

SEQ ID NO: 43607 - RNA, 46 nt, Mus musculus
caccaacgugcuggaaggcauccaccucauuaagaagaagucuaag

SEQ ID NO: 43608 - RNA, 44 nt, Mus musculus
ggccaucaguaccucucagauggucuaaagacccccaagggcaa

SEQ ID NO: 43609 - RNA, 42 nt, Mus musculus
gugggauagagcaggagaagagaagcacagacggggccacug

SEQ ID NO: 43610 - RNA, 45 nt, Mus musculus
cuuucaugaagguuucucacuuuccaaauauuagugcuguugguu

SEQ ID NO: 43611 - RNA, 45 nt, Mus musculus
acgggaaaaggcugguucuccagagagagggaacagugcccagau

SEQ ID NO: 43612 - RNA, 48 nt, Mus musculus
aagguguggagaagaccaaguauugcuccugaugccugaaccaaguca

SEQ ID NO: 43613 - RNA, 33 nt, Mus musculus
ugcagcagacuuccaggguuucaacccccaacc

SEQ ID NO: 43614 - RNA, 45 nt, Mus musculus
aaguaagguuuuccaucuguagcagcuuuccaauugccacaagaa

SEQ ID NO: 43615 - RNA, 42 nt, Mus musculus
gacgguagccugaacucuuuggguugcacuucauggacauaa

SEQ ID NO: 43616 - RNA, 46 nt, Mus musculus
ucccauucaugaaauagaagaaaggggauacaauaaaccagcagaa

SEQ ID NO: 43617 - RNA, 46 nt, Mus musculus
uucaaccaagaugcucacacugugggcaaaacaaaaccauggcaga

SEQ ID NO: 43618 - RNA, 40 nt, Mus musculus
aagggaggagaggugaguauugcaccacuggaagacagca

SEQ ID NO: 43619 - RNA, 45 nt, Mus musculus
augaacaaaauuucaagaaccguggugugcauaaauggccuauuu

SEQ ID NO: 43620 - RNA, 41 nt, Mus musculus
ugagccacugaguuagcuuuuaacuucaagagcaugggcaa

SEQ ID NO: 43621 - RNA, 44 nt, Mus musculus
gccauguuggggacugggaagcagcccaagggcuaggcagcaga

SEQ ID NO: 43622 - RNA, 45 nt, Mus musculus
acaauucaacagauuucugcaaugccaggaguggauaccauugag

SEQ ID NO: 43623 - RNA, 46 nt, Mus musculus
ucuacacagcaggauucgccuaaaccaucaccacucgccaccagau

SEQ ID NO: 43624 - RNA, 46 nt, Mus musculus
uagauagauagauagauagauagauagacagacagacugacugacu

SEQ ID NO: 43625 - RNA, 46 nt, Mus musculus
gacuugcuucucuccuuucguuacuguauaagugcuggggucaauu

SEQ ID NO: 43626 - RNA, 38 nt, Mus musculus
uggugugcaugcuggaaaucaaacuugggucuccugga

SEQ ID NO: 43627 - RNA, 46 nt, Mus musculus
guacaauaaaccuuccugaggagccguuucuucagccugcaggaug

SEQ ID NO: 43628 - RNA, 45 nt, Mus musculus
aaacauuugcccacauuaguuguaauggggaguuaaagccuugcu

SEQ ID NO: 43629 - RNA, 42 nt, Mus musculus
acaugauuucauauguauucauuaggagucccugccagaggc

SEQ ID NO: 43630 - RNA, 45 nt, Mus musculus
cuccaugcacaagaguaaacaaugaaaagugugaauagaagcacu

SEQ ID NO: 43631 - RNA, 41 nt, Mus musculus
aauggucuuacuuguugauuuugcuggcuacaagcacaggu

SEQ ID NO: 43632 - RNA, 46 nt, Mus musculus
ucaucuucauuaggauggagaguugggggucagagcacagcuacuu

SEQ ID NO: 43633 - RNA, 35 nt, Mus musculus
gcguguuagcccuuuuggaugucaccugcagcuuu

SEQ ID NO: 43634 - RNA, 46 nt, Mus musculus
guggucuggaucagaaccuggcacuuucucugacagacagugaugu

SEQ ID NO: 43635 - RNA, 45 nt, Mus musculus
gcuguggugaguguggcuggcggauaagccagcucuugguggaga

SEQ ID NO: 43636 - RNA, 42 nt, Mus musculus
cuuucuaauuuuucuaacaaaaaaauggaaacuccagcugua

SEQ ID NO: 43637 - RNA, 46 nt, Mus musculus
uuagacugucauuuuaauugagguauucuuguaguaauuuggagau

SEQ ID NO: 43638 - RNA, 46 nt, Mus musculus
ugccucgacaucucauuccauggaguccucauuauuaccggaaguc

SEQ ID NO: 43639 - RNA, 44 nt, Mus musculus
gugauuuguggcuuaauuagaaacccuggugucauggugccaga

SEQ ID NO: 43640 - RNA, 46 nt, Mus musculus
ggaaaacaaccaugagcaagccagugcugucuucucaaacagaggc

SEQ ID NO: 43641 - RNA, 45 nt, Mus musculus
ucacacagaucuguguguggccugcagugcgaagggugaaugaug

SEQ ID NO: 43642 - RNA, 42 nt, Mus musculus
aaugcagugacauuuugagguccggggguuagggcuucagca

SEQ ID NO: 43643 - RNA, 46 nt, Mus musculus
uguguguguguguguguguguguguguguguaugaagaccugaguu

SEQ ID NO: 43644 - RNA, 46 nt, Mus musculus
gagggugagcaugcgcaacugauccccacaacuuacauaaaaagaa

SEQ ID NO: 43645 - RNA, 41 nt, Mus musculus
uauaagaauucuucaguucuguuaacagucuuagggcauca

SEQ ID NO: 43646 - RNA, 46 nt, Mus musculus
augcugcugaaucuccuaagugauagucacaggcuuguccccacug

SEQ ID NO: 43647 - RNA, 44 nt, Mus musculus
uaaucggcaggaauguagagaaguggcccugugugucaccugau

SEQ ID NO: 43648 - RNA, 46 nt, Mus musculus
caaugguguuucuuaggcaccuagacuugggggcucaggaggacag

SEQ ID NO: 43649 - RNA, 43 nt, Mus musculus
ucaaauugaaauuuuuagaugaugaggguguuucgggggauag

SEQ ID NO: 43650 - RNA, 46 nt, Mus musculus
uggcauaagugggaagaggauggaaagcgggcggggauugcuagau

SEQ ID NO: 43651 - RNA, 46 nt, Mus musculus
ugugcugucaccacggauugaaggucauuuuacacguugcuuauaa

SEQ ID NO: 43652 - RNA, 45 nt, Mus musculus
uuugucaaggcccacccuaacuugccuccaugcacgugcugagau

SEQ ID NO: 43653 - RNA, 42 nt, Mus musculus
uacuugcaaggacagagucugaguuuagcagugugcugugua

SEQ ID NO: 43654 - RNA, 42 nt, Mus musculus
cuugggaaaaaagcaccuuuaacuuagucaaagcacccaaac

SEQ ID NO: 43655 - RNA, 46 nt, Mus musculus
aaaagaaauugaaagcaauacguuaauauaucguaacacuaaaaaa

SEQ ID NO: 43656 - RNA, 45 nt, Mus musculus
auuauugccccugccaugggucacacuaugacgccucuggcagga

SEQ ID NO: 43657 - RNA, 25 nt, Mus musculus
cugacguacuggccaugucgaagau

SEQ ID NO: 43658 - RNA, 41 nt, Mus musculus
ccagacuauggagaagggaaguuagaggauaucgacggcau

SEQ ID NO: 43659 - RNA, 46 nt, Mus musculus
ggaaaguggggagggaggaggagagaaggguggagagguggaaagg

SEQ ID NO: 43660 - RNA, 44 nt, Mus musculus
aacacccagaggcugcaaggcuggccccagaccuccccgaugga

SEQ ID NO: 43661 - RNA, 46 nt, Mus musculus
accucucucccuacccucucucucccucuuugaguuuucucaaccc

SEQ ID NO: 43662 - RNA, 45 nt, Mus musculus
uguuguguacgcagaaagccugggaagaugggagacaaggcagag

SEQ ID NO: 43663 - RNA, 27 nt, Mus musculus
gaugaugaugacgacgacgaaguggac

SEQ ID NO: 43664 - RNA, 28 nt, Mus musculus
cuggauggccaugacgaugagcgcgaug

SEQ ID NO: 43665 - RNA, 45 nt, Mus musculus
gccuacgcccugaugcccaggacaaacuugagucaauuacuuaga

SEQ ID NO: 43666 - RNA, 46 nt, Mus musculus
caguguguaggagggagacugacagcuagccuguagggcaggaggu

SEQ ID NO: 43667 - RNA, 42 nt, Mus musculus
uggcugccccucucggaggggagaggagaagaaggcagaaga

SEQ ID NO: 43668 - RNA, 46 nt, Mus musculus
gcagucagcauagggacuggacaacaugagauuucuauuagccaga

SEQ ID NO: 43669 - RNA, 46 nt, Mus musculus
caauaaucaauuauaauaaaauuuugauguuuuugguagcccccag

SEQ ID NO: 43670 - RNA, 42 nt, Mus musculus
aggcgagggcgaggagggcgaugacggcggcgagaccgagag

SEQ ID NO: 43671 - RNA, 57 nt, Mus musculus
ccuuucuggcggggcugcuggagcgggccaccgggaaguccgggauaaggcgcgcac

SEQ ID NO: 43672 - RNA, 44 nt, Mus musculus
gcuccagcagccccgccagaaaggguauggggaagagaccagcg

SEQ ID NO: 43673 - RNA, 46 nt, Mus musculus
cauccuuuuuauugaugagauucaucgcuucaauaaaucucagcag

SEQ ID NO: 43674 - RNA, 46 nt, Mus musculus
cucucauuugcuucugucuuauauuugggaagaacacuaccaccau

SEQ ID NO: 43675 - RNA, 46 nt, Mus musculus
gacugaauggcuagcauuacugacaagaaguuaggagauguuguag

SEQ ID NO: 43676 - RNA, 46 nt, Mus musculus
uguauuugcaaauccgaguucucucucucucucucucucucucucu

SEQ ID NO: 43677 - RNA, 46 nt, Mus musculus
guacauuucugugcuuguagagaacauguagugugauaagagccag

SEQ ID NO: 43678 - RNA, 45 nt, Mus musculus
ggauuagcucuauagccaaacucugggugcaauauagacagcaau

SEQ ID NO: 43679 - RNA, 45 nt, Mus musculus
gguguagucuagauguguggugaaucuucuggugaagugucugcu

SEQ ID NO: 43680 - RNA, 45 nt, Mus musculus
ucugaccagaaugcuucccuguauuggcuggcccggaugcuugag

SEQ ID NO: 43681 - RNA, 44 nt, Mus musculus
cgaggacaucggugaguggaggagaguuuguguggggguggggg

SEQ ID NO: 43682 - RNA, 44 nt, Mus musculus
accaaguucucagcacaaaagcagauuuauuugccauaaggaga

SEQ ID NO: 43683 - RNA, 25 nt, Mus musculus
caaggacuucaagaaggacagcaga

SEQ ID NO: 43684 - RNA, 46 nt, Mus musculus
cguguguggugcuugggaggugggggcuuugaaaagugauuaagau

SEQ ID NO: 43685 - RNA, 43 nt, Mus musculus
ugcuccaguuucuagcuacaccuauguaugagagagagagaga

SEQ ID NO: 43686 - RNA, 42 nt, Mus musculus
uuuguguguauguguguguguguguacauguguguguauuuc

SEQ ID NO: 43687 - RNA, 84 nt, Mus musculus
ugugugguugugcgugguuguguguuggugugucagggugugugugugugguugugugugguuguguguuggugugucagggua

SEQ ID NO: 43688 - RNA, 46 nt, Mus musculus
uguaugugugugugguugugugugguuguguguuggugugucagug

SEQ ID NO: 43689 - RNA, 42 nt, Mus musculus
ugugugguugugugugguuguguguuggugugucagugugug

SEQ ID NO: 43690 - RNA, 46 nt, Mus musculus
gugugugguuguguguguaugugugugugugugugugguugugugu

SEQ ID NO: 43691 - RNA, 45 nt, Mus musculus
ugugugugugguugugugugguuguguguuggugugucagggugu

SEQ ID NO: 43692 - RNA, 45 nt, Mus musculus
gugugugugugugguugugugugguugugugcuggugugucaggg

SEQ ID NO: 43693 - RNA, 45 nt, Mus musculus
gugugugugugguugugugugguuguguguuggugugucagggug

SEQ ID NO: 43694 - RNA, 45 nt, Mus musculus
cuguguuaaccgccccuucauuuucuucauucagcacauuaagac

SEQ ID NO: 43695 - RNA, 46 nt, Mus musculus
ugugcaaaugauguuucagaagucuaccuuuaagaugaccuaugug

SEQ ID NO: 43696 - RNA, 45 nt, Mus musculus
agugucuguuuuuuccucucagauggguuuccuguaagcagcaga

SEQ ID NO: 43697 - RNA, 41 nt, Mus musculus
uuuauugaguauuuuugcaucgauauucauaaggguaauug

SEQ ID NO: 43698 - RNA, 44 nt, Mus musculus
gucaguuaugggaauguuuaggcucucuguauacugcugcuggg

SEQ ID NO: 43699 - RNA, 23 nt, Mus musculus
cuacuucaaaggaaagugggaga

SEQ ID NO: 43700 - RNA, 51 nt, Mus musculus
cuacagagcagucccgacagcacaucaacaccuggguagccaaaaagacag

SEQ ID NO: 43701 - RNA, 41 nt, Mus musculus
cucuuuuucaguuucaagguauuauuacagauccugggagg

SEQ ID NO: 43702 - RNA, 52 nt, Mus musculus
uuaucacccauaagcaucucuucagcgcuggucauggucuuauugggggcaa

SEQ ID NO: 43703 - RNA, 45 nt, Mus musculus
agucgugagugugcugcuuccaggugaaugccuccaagugccaga

SEQ ID NO: 43704 - RNA, 46 nt, Mus musculus
uuccagucuaaaucauuuugacagguuucuuuguguagcccuagcu

SEQ ID NO: 43705 - RNA, 46 nt, Mus musculus
uccccaagugccuagucaguuuuuauguucuuuucuuaucauagga

SEQ ID NO: 43706 - RNA, 45 nt, Mus musculus
gcgaauacagagcuaggaagacaucuuuaagcuguggccaggaau

SEQ ID NO: 43707 - RNA, 46 nt, Mus musculus
gacagucuuuggaaucucagagggcggggaccagggguggggaggu

SEQ ID NO: 43708 - RNA, 44 nt, Mus musculus
uuucucuuuuuguaauaccgauaacaucaauguaacacuugaga

SEQ ID NO: 43709 - RNA, 45 nt, Mus musculus
aggagggggugggggggcuuaaucugugaaaauaccuuggcaguu

SEQ ID NO: 43710 - RNA, 48 nt, Mus musculus
accagcaguaccaggaugccacggcugaugagcagggcgaguucgagg

SEQ ID NO: 43711 - RNA, 46 nt, Mus musculus
cgccucggugaacuccaucucguccaugcccucacccguguaccag

SEQ ID NO: 43712 - RNA, 45 nt, Mus musculus
ugguacacgggugagggcauggacgagauggaguucaccgaggcg

SEQ ID NO: 43713 - RNA, 44 nt, Mus musculus; identical to SEQ ID NO: 39618

SEQ ID NO: 43714 - RNA, 45 nt, Mus musculus
guacugcuggcugccccggcuggucagaggugcaaagccuggcau

SEQ ID NO: 43715 - RNA, 42 nt, Mus musculus; identical to SEQ ID NO: 39620

SEQ ID NO: 43716 - RNA, 45 nt, Mus musculus
augacaucuguuuccgcacccugaagcugaccacacccaccuaug

SEQ ID NO: 43717 - RNA, 46 nt, Mus musculus
agggcuccaccacagugucagagaccuugggugagggcaugacgcu

SEQ ID NO: 43718 - RNA, 46 nt, Mus musculus
cagaccgcaucaugaacaccuucagcgucaugcccucacccaaggu

SEQ ID NO: 43719 - RNA, 47 nt, Mus musculus
ggucuggguacuccucucugaucuugcugaugagcaggguccccaug

SEQ ID NO: 43720 - RNA, 66 nt, Mus musculus
gaaaaggaauccgccucaccauuguugaagagagaggcaagaggcuagcggccaaacagagcagug

SEQ ID NO: 43721 - RNA, 58 nt, Mus musculus
guacccugauccccucaucaaggugaacgacaccauucagauugauuuggagacaggc

SEQ ID NO: 43722 - RNA, 93 nt, Mus musculus
auugauuggaaagucaggaccgauauaaccuacccugcugguuuuauggaugucaucagcauugacaagaccagagagaacuuccgucugauc

SEQ ID NO: 43723 - RNA, 42 nt, Mus musculus
ugagggaaugccugccucucaucauuuuccuaaggaacagag

SEQ ID NO: 43724 - RNA, 47 nt, Mus musculus
aagcuaaaucaucaagcuuaguucuuuuugcaggggacaggccuucu

SEQ ID NO: 43725 - RNA, 48 nt, Mus musculus
gccuuuucgugaaucucuccuucuucuucggagccagacucauagccu

SEQ ID NO: 43726 - RNA, 64 nt, Mus musculus
uuugcacuauuuuuguuguccguaauuucaaguuuuccccgaguacuggaagaccugguacugg

SEQ ID NO: 43727 - RNA, 27 nt, Mus musculus
cuccuucuccuaugaccaccccgugau

SEQ ID NO: 43728 - RNA, 46 nt, Mus musculus
auauucuuuuacaucagcagcaacucgcuccaagaugucgucuggc

SEQ ID NO: 43729 - RNA, 42 nt, Mus musculus
aacauacacaaauagucugacacugaucuaggaagcccauuu

SEQ ID NO: 43730 - RNA, 45 nt, Mus musculus
acaugaccaagacuccugucacaacuaccuucaugccaccugagg

SEQ ID NO: 43731 - RNA, 45 nt, Mus musculus
ugaaggaagaccgcccucccacagaguccacugccuuaaaugaag

SEQ ID NO: 43732 - RNA, 41 nt, Mus musculus
ucuacaaaauaaguggaaaacuuuucuaaacuacaggcaga

SEQ ID NO: 43733 - RNA, 46 nt, Mus musculus
acgcagggcagaucccagaacagaaaggcacaucaaaggggccaug

SEQ ID NO: 43734 - RNA, 45 nt, Mus musculus
augggauacaugugaaacgaaagcagagacuggagcuaucuggga

SEQ ID NO: 43735 - RNA, 45 nt, Mus musculus
gugacaguggugauggugacaguggggaugauggugacaguggag

SEQ ID NO: 43736 - RNA, 46 nt, Mus musculus
gaguucuauaucuuuaucugaaggcugcuagaagauuggcccccac

SEQ ID NO: 43737 - RNA, 46 nt, Mus musculus
auuggcaguagacaagguacugucugggugugagaaucuguccaag

SEQ ID NO: 43738 - RNA, 46 nt, Mus musculus
gggucaugggugggacacauuaaaaggugagcuuugaacuguagau

SEQ ID NO: 43739 - RNA, 46 nt, Mus musculus
uugguuuccuugugaaaacaccuugaacuucucuugguccuuagau

SEQ ID NO: 43740 - RNA, 45 nt, Mus musculus
ccugcucaucgccuuguccuucacucuaguucuccucccaagauu

SEQ ID NO: 43741 - RNA, 49 nt, Mus musculus
caguaggauuuggacugguuuugcaacaagauuauuaaagucgccuaug

SEQ ID NO: 43742 - RNA, 46 nt, Mus musculus
ugcauuaaaguccucauugacuuguuggguauagguggugcccaug

SEQ ID NO: 43743 - RNA, 46 nt, Mus musculus
ccuagcccaaggccauucuacuaacaguaccaucaaggcacagcug

SEQ ID NO: 43744 - RNA, 107 nt, Mus musculus
cggcucgaggaccuuuccgaguccauuguuaaugacuuugccuacaugaagaagcgggaagaggagaugagggacacuaaugaguccacgaacacccggguccugua

SEQ ID NO: 43745 - RNA, 60 nt, Mus musculus
ucuagacaugaagcauggaguagaggcgaaaaauuaugaagagauugcaaaagucgagaa

SEQ ID NO: 43746 - RNA, 94 nt, Mus musculus
uggcggccugcgcccccaccucaagaucacagauucugcuggccauauucuguaugccaaagaggaugcaaccaaggggaaguuugccuuuacc

SEQ ID NO: 43747 - RNA, 46 nt, Mus musculus
ugccgaggaccgagcuggggccgagcagcaacagaaagagccaggc

SEQ ID NO: 43748 - RNA, 42 nt, Mus musculus
auuuuuagagugaguugcuaacuuccucuuaacugcagacaa

SEQ ID NO: 43749 - RNA, 46 nt, Mus musculus
aucucuuucuggcaguguuuauaccuguguaauucaaacccaucaa

SEQ ID NO: 43750 - RNA, 42 nt, Mus musculus
gcuaagaagugccucuuuagcacuaaacaaacaaacaaacaa

SEQ ID NO: 43751 - RNA, 47 nt, Mus musculus
agcuguuacacauacaguaauaccugaauauccaacgguauagauca

SEQ ID NO: 43752 - RNA, 45 nt, Mus musculus
cuauauuaaucauguugauaacaugaagaaugaugggcuccuccu

SEQ ID NO: 43753 - RNA, 45 nt, Mus musculus
gacuaaaaggugagguccgauuuuggcugugcucgcucgcucacu

SEQ ID NO: 43754 - RNA, 41 nt, Mus musculus
cuugcaaggcuuagugcuguuuucuuagcuuucccggagga

SEQ ID NO: 43755 - RNA, 45 nt, Mus musculus
ggagagaagcaaagcgaaggcgagaggaccgcggcgcggagagga

SEQ ID NO: 43756 - RNA, 79 nt, Mus musculus
cugggacgacccgaagcaagugggggaaacgaggaaaggaagagggggaaacggaggguaggggaaaagaaaagugggg

SEQ ID NO: 43757 - RNA, 44 nt, Mus musculus
agcggaggugugugugugugugugugugugugugugugugugug

SEQ ID NO: 43758 - RNA, 46 nt, Mus musculus
cuauuuuagguuuccagaagaaaggugggacaauaagagagagaga

SEQ ID NO: 43759 - RNA, 45 nt, Mus musculus
gcugcugacccuaaucucaggguccgggcgaagugggaaccagac

SEQ ID NO: 43760 - RNA, 45 nt, Mus musculus
agaugccaaccagcagaauauugagcaaauggggcugggggucga

SEQ ID NO: 43761 - RNA, 46 nt, Mus musculus
ugagagacaaggagggagugaggaaaaaaaggguaauaaaggagau

SEQ ID NO: 43762 - RNA, 46 nt, Mus musculus
uauuauuauuauuauuauuacuguuauuuuuauucugauugcccag

SEQ ID NO: 43763 - RNA, 45 nt, Mus musculus
ucucuagcccuucggguacccugggauuuuuguuagccacuagau

SEQ ID NO: 43764 - RNA, 46 nt, Mus musculus
uauccuucucggaguagucugcggugcccggagcaaacgcugcagc

SEQ ID NO: 43765 - RNA, 46 nt, Mus musculus
aaugguuugacuaaacguaggaugggacuuaaguugaacggcagau

SEQ ID NO: 43766 - RNA, 42 nt, Mus musculus
gccuucccagugcauaaagucucugucgcucccggaacuugu

SEQ ID NO: 43767 - RNA, 82 nt, Mus musculus
gagcgacagagacuuuaugcacugggaaggcagagggaggagagaaagagagggagcgaggaagagacagaaagagagugag

SEQ ID NO: 43768 - RNA, 42 nt, Mus musculus
guucuccgagcccaaccugaugacauagauuucgggccaccc

SEQ ID NO: 43769 - RNA, 30 nt, Mus musculus
uaagaagaagaaagaaaaagaaguugaaau

SEQ ID NO: 43770 - RNA, 44 nt, Mus musculus
ucugggugcugaggcugcugcguucacucaguuuuuaugggaga

SEQ ID NO: 43771 - RNA, 25 nt, Mus musculus
ccagccucaaacuuguuaugcaacc

SEQ ID NO: 43772 - RNA, 42 nt, Mus musculus
aguggggugugugugugugugucugugugucugugugucugu

SEQ ID NO: 43773 - RNA, 44 nt, Mus musculus
uguguguguguuugugcaugugugcauguaugugugcguguaug

SEQ ID NO: 43774 - RNA, 51 nt, Mus musculus
accaguucuguuggcccagcucacaguggcuucagcuuagcaucauggucu

SEQ ID NO: 43775 - RNA, 42 nt, Mus musculus
uccaaaacaucaggagcagaggcgccccgccagccuguuaug

SEQ ID NO: 43776 - RNA, 45 nt, Mus musculus
ccaccuuaaaggaggcugaccaucucucuaaugauugagcagugg

SEQ ID NO: 43777 - RNA, 46 nt, Mus musculus
agagguaagccauaacaaaugguacuucugaugugugccccaaaua

SEQ ID NO: 43778 - RNA, 44 nt, Mus musculus
cacagcuuuguucugcgccaggcaaaggaugaacuauaggagac

SEQ ID NO: 43779 - RNA, 42 nt, Mus musculus
aagguacgagguuaucccacguugcugcuuuuccgaggaggu

SEQ ID NO: 43780 - RNA, 42 nt, Mus musculus
aagguggagagaaagagagacgguaaagagauuugggggggg

SEQ ID NO: 43781 - RNA, 46 nt, Mus musculus
ugagaacaaagugggggccccaggggcagcccuauuauccccagag

SEQ ID NO: 43782 - RNA, 45 nt, Mus musculus
guucuugcuggggucuagcuguacgguccuaagaugugacguguu

SEQ ID NO: 43783 - RNA, 83 nt, Mus musculus
ucuaaaaaggaauucccaggcuugucagaugucaccaucgcagaaguggacugcaccgcugagcgcaaugucugcagcaagua

SEQ ID NO: 43784 - RNA, 45 nt, Mus musculus
gugccacacaaugcuauuaaccuuuuaguuuagaagcccccagag

SEQ ID NO: 43785 - RNA, 42 nt, Mus musculus
cuucgaggacacuauugcacaggggauaaccuucgucaaguu

SEQ ID NO: 43786 - RNA, 45 nt, Mus musculus
acccgugcaacaggucccuguuggcuagaagaggaugcuugaaga

SEQ ID NO: 43787 - RNA, 53 nt, Mus musculus
cccagcugcaggguucagaggcagcuccggagacuguugagccgucagaggcc

SEQ ID NO: 43788 - RNA, 57 nt, Mus musculus
agguggaucaguacaagggaaagcgggacuuggagucacugagagacuaugugcagu

SEQ ID NO: 43789 - RNA, 46 nt, Mus musculus
ccuggacgccugugcuccgguaugaacgaccuuuuagcccucagaa

SEQ ID NO: 43790 - RNA, 48 nt, Mus musculus
ucaggucagaggcuauccaacucugcucugguuucgagauggcaagaa

SEQ ID NO: 43791 - RNA, 46 nt, Mus musculus
uggggguggggugaugcugggcacauuguuauucucaccgugaguu

SEQ ID NO: 43792 - RNA, 42 nt, Mus musculus
augucuccccucaguuacuucuuugcagaaaggaaacaagau

SEQ ID NO: 43793 - RNA, 45 nt, Mus musculus
gagcagcuggcucugggccuugaacauucugaaaccgucaagauu

SEQ ID NO: 43794 - RNA, 45 nt, Mus musculus
uuggcaaacaaaugauaaguacaaaaagaauugacagggcucagu

SEQ ID NO: 43795 - RNA, 46 nt, Mus musculus
uagcaauaucuagucgaagcucacuuugucucuucagcaccauuug

SEQ ID NO: 43796 - RNA, 36 nt, Mus musculus
acccuucccccaucacuugccucugcugcugcaauu

SEQ ID NO: 43797 - RNA, 26 nt, Mus musculus
uuaaaaaaaaucucaauuugacuaga

SEQ ID NO: 43798 - RNA, 44 nt, Mus musculus
ggguccuagagacuuugaaacacuggaaaacuggaugcugcaga

SEQ ID NO: 43799 - RNA, 45 nt, Mus musculus
uuaccucgauguauuuuccuugaguaacuucaaaaaugugugaaa

SEQ ID NO: 43800 - RNA, 57 nt, Mus musculus
uguuuugucugcugcaggccuaagagaaaccucaggcaggaggagcuacaagggaga

SEQ ID NO: 43801 - RNA, 53 nt, Mus musculus
ugcaguggauggagggauggagggacggagggaggagcauagacggacugcag

SEQ ID NO: 43802 - RNA, 46 nt, Mus musculus
acugcagaccacacugccuauggcucuccaccuaccugucucaguu

SEQ ID NO: 43803 - RNA, 45 nt, Mus musculus
caaaguggacugcacggcugauuccgacgugugcucugcccaggg

SEQ ID NO: 43804 - RNA, 48 nt, Mus musculus
uuaauguagagaacagugucguugugagguaucugucugcugcagaga

SEQ ID NO: 43805 - RNA, 46 nt, Mus musculus
cuauacguuccaggaaacagaaauaucacacguuuacucggagguc

SEQ ID NO: 43806 - RNA, 46 nt, Mus musculus
ccuagaugcucagagaaagaaguucuccgguccacagcagaaagcg

SEQ ID NO: 43807 - RNA, 45 nt, Mus musculus
cauucuucgguuggggcuuccuggugcaccucacuaccccaagaa

SEQ ID NO: 43808 - RNA, 45 nt, Mus musculus
uuggauuggaaaucuaaggcccccucaagaugugauugcccacuu

SEQ ID NO: 43809 - RNA, 42 nt, Mus musculus
agagagagaaaggcagagagagagagagagagagagagagaa

SEQ ID NO: 43810 - RNA, 46 nt, Mus musculus
uucucacagcaaacacccugaacacaggaaagcauuucacaggcaa

SEQ ID NO: 43811 - RNA, 46 nt, Mus musculus
guguguguguguguguguguguguguaagagagagagaggauagaa

SEQ ID NO: 43812 - RNA, 45 nt, Mus musculus
cuuuguggccaggagcauguuuuuucuugccacuugcucauuggg

SEQ ID NO: 43813 - RNA, 45 nt, Mus musculus
caggaacuuggggaauguguaguucuuaaauuuguucacuguuua

SEQ ID NO: 43814 - RNA, 46 nt, Mus musculus
ucacccuucagguagcuccucuccgagacaguaaacugugugagau

SEQ ID NO: 43815 - RNA, 41 nt, Mus musculus
ccucgauggcgugagguaaggaguggaucgggagguccccg

SEQ ID NO: 43816 - RNA, 45 nt, Mus musculus
guaggggucguugacgugggaguaaggaucuugcgacugggggua

SEQ ID NO: 43817 - RNA, 42 nt, Mus musculus
cuaggggaacacaccgaggugcgccuuucacccccaccccaa

SEQ ID NO: 43818 - RNA, 42 nt, Mus musculus
acgcaaggaaauaaagacgaacccggcgagaaacuggcccaa

SEQ ID NO: 43819 - RNA, 42 nt, Mus musculus
cggcgccuuuuguguguggcucuuucgggccgcggggcagcc

SEQ ID NO: 43820 - RNA, 41 nt, Mus musculus
cgaaaaaagugugugugugugugugugugugugugugcgcg

SEQ ID NO: 43821 - RNA, 44 nt, Mus musculus
aaaagguugcagggccugcaaaagugaaagagaaagaaggcgag

SEQ ID NO: 43822 - RNA, 46 nt, Mus musculus
ggaugugucugcgugcgugugcgagaaagaaagugugggcgacuag

SEQ ID NO: 43823 - RNA, 42 nt, Mus musculus
cggggccugggacucgggacucggcugcccgcugccucgcug

SEQ ID NO: 43824 - RNA, 42 nt, Mus musculus
agcagggauauugguagggaugccugucaccuggugucccag

SEQ ID NO: 43825 - RNA, 41 nt, Mus musculus
gacagacagacagacagaaagaaagaaagaaagaaagagag

SEQ ID NO: 43826 - RNA, 45 nt, Mus musculus
uagggagaaagaaaagaaugaaugaaaaaggggguauuaauguca

SEQ ID NO: 43827 - RNA, 41 nt, Mus musculus
ugcgcggguguuaaguuugucccacucgcauuucgcgugga

SEQ ID NO: 43828 - RNA, 41 nt, Mus musculus
agugcgggcugcgggcggugagcaaaagaggaggagggggg

SEQ ID NO: 43829 - RNA, 41 nt, Mus musculus
aagggggaggaggagguggagguagaggaggaggagggcca

SEQ ID NO: 43830 - RNA, 46 nt, Mus musculus
ucuaauaaaaucggacggggacgaaaggcagauaguggcgguugua

SEQ ID NO: 43831 - RNA, 69 nt, Mus musculus
uuaauaucuuacuuuagaauaauugcaguaagggaggaagggucccgguggagugaguaagccccuggg

SEQ ID NO: 43832 - RNA, 46 nt, Mus musculus
cggggaacucguaaguuucgcuuucuuuuccuucaguugugaccua

SEQ ID NO: 43833 - RNA, 42 nt, Mus musculus
acccaaguuucuguugggaugggggugggaaaauggcuggag

SEQ ID NO: 43834 - RNA, 42 nt, Mus musculus
cgggcaugggcuagagggcucagccgggcccgcucccuggaa

SEQ ID NO: 43835 - RNA, 46 nt, Mus musculus
cuuuugucuggcugucuccuggcuucaaguugcuguauuugugaaa

SEQ ID NO: 43836 - RNA, 45 nt, Mus musculus
uagaucccuuuauuuuacuuaugaccuuguucguauuugcccaca

SEQ ID NO: 43837 - RNA, 46 nt, Mus musculus
uaucuuuuuguuuuauuuuguuuuucuuaacugauuuggcucccaa

SEQ ID NO: 43838 - RNA, 40 nt, Mus musculus
cuaaggauuuagagaagaauuuuuccuucagaaaaggcag

SEQ ID NO: 43839 - RNA, 46 nt, Mus musculus
uuauagucugauaaacucauuguaaauuuuuuuaaauuaugaacag

SEQ ID NO: 43840 - RNA, 42 nt, Mus musculus
acagucauggagacauuuugccccugcuuacagagcaugcag

SEQ ID NO: 43841 - RNA, 46 nt, Mus musculus
aauuucauagcucagaauaaggggcauaucacaggucagcugcuca

SEQ ID NO: 43842 - RNA, 59 nt, Mus musculus
gucgccagcuugaacacuuaaauagguguggggaaagggaaagaagccuucagagggag

SEQ ID NO: 43843 - RNA, 43 nt, Mus musculus
ugucuuuugacuuuauugccuaauaccuuccucaugaacugag

SEQ ID NO: 43844 - RNA, 45 nt, Mus musculus
aaaaguuaaauuugguuauauaacuuuuguauuuaaaaucugaag

SEQ ID NO: 43845 - RNA, 45 nt, Mus musculus
uaguagggacugguuaggaagaagggcagucagaagaagggggag

SEQ ID NO: 43846 - RNA, 45 nt, Mus musculus
ccagguucacugaucccaaggaaguaggccugggaaauugcugcg

SEQ ID NO: 43847 - RNA, 46 nt, Mus musculus
aauacaggaucagaaguuucugcuguuagcaauguagugggagcaa

SEQ ID NO: 43848 - RNA, 45 nt, Mus musculus
ugggggauagaauauguugaauaguggguuuuuaccuguuugcug

SEQ ID NO: 43849 - RNA, 41 nt, Mus musculus
ucugaacgcaaguccucaugcuugcauagcaagcacucuua

SEQ ID NO: 43850 - RNA, 46 nt, Mus musculus
uuucuggcuugcuauguagaccaggcuggcuuugaacucgcaaaga

SEQ ID NO: 43851 - RNA, 64 nt, Mus musculus
ugguagcccacuguuugcaucugugcuacacauuaugacuacuggaaggauuugauagaaauau

SEQ ID NO: 43852 - RNA, 63 nt, Mus musculus
aauugauuaggucuuaccucuagggaauaaguugcuuuuuagguaauucucaggagcagccau

SEQ ID NO: 43853 - RNA, 48 nt, Mus musculus
ccaucuuauguaucugauaccaggucuuugguugguuucuaacaagca

SEQ ID NO: 43854 - RNA, 45 nt, Mus musculus
agaagauagugagugacuugguaacuagggcugaugguugucaca

SEQ ID NO: 43855 - RNA, 54 nt, Mus musculus
ccagaaaauaagcagacacacugcagugacccagaugaaguuggugugagggga

SEQ ID NO: 43856 - RNA, 48 nt, Mus musculus
augcggccucuuuccuuuauugccuaguuggaggagcuagaugggaga

SEQ ID NO: 43857 - RNA, 46 nt, Mus musculus
aggggaauugggaacuuuaguauugugaauacugccugucggccag

SEQ ID NO: 43858 - RNA, 46 nt, Mus musculus
uuauguaaagcaaaguguaagacuauagggagcagaggaagcugag

SEQ ID NO: 43859 - RNA, 45 nt, Mus musculus
uuucuuuauguaggccugcaucagaguaaucagaaauagccacau

SEQ ID NO: 43860 - RNA, 45 nt, Mus musculus
augccagaaaggggcauggauccccugaacuuguauuacagacag

SEQ ID NO: 43861 - RNA, 46 nt, Mus musculus
cucauaaugacuugacagaaaguccgaguagcacaaacggcagaag

SEQ ID NO: 43862 - RNA, 49 nt, Mus musculus
ucaguuagaagcaaacuuuccugaacugguucacaugaagcaggugcua

SEQ ID NO: 43863 - RNA, 46 nt, Mus musculus
ugcacuguguggugaaggaaacagguuuaauuucaguuacccagag

SEQ ID NO: 43864 - RNA, 87 nt, Mus musculus
uucagccccacacagagcagcugcugccucuuggauguggccagggagauggaguuauaccaguaccgagcaucagucucuagggga

SEQ ID NO: 43865 - RNA, 73 nt, Mus musculus
aguguguggauagugagaagcaacagaggccuggaagaaaggaaaugaaggcuggagaggcauaagggggugu

SEQ ID NO: 43866 - RNA, 46 nt, Mus musculus
uaacuggagcaaugauuacuaguaaguugacuuauuuuguuuaaag

SEQ ID NO: 43867 - RNA, 46 nt, Mus musculus
gcuaggugauagcuaugugcugcucacuauagugacauuccaggag

SEQ ID NO: 43868 - RNA, 46 nt, Mus musculus
ccuccaucccaggcaaggugcacaagacucucugugaagcugcaag

SEQ ID NO: 43869 - RNA, 42 nt, Mus musculus
uucuuuguauucuugcuguuuucuaaacuuaaacgugagcau

SEQ ID NO: 43870 - RNA, 46 nt, Mus musculus
ucauuauauauacauauauagauagcuauauaugaauacaguccaa

SEQ ID NO: 43871 - RNA, 45 nt, Mus musculus
uuuuaaaauguaauguuucuugaaugugcaaugccauuuguaaca

SEQ ID NO: 43872 - RNA, 46 nt, Mus musculus
acuaauauauuuagcaguuucucuaacaaucuccuuuccaaagcag

SEQ ID NO: 43873 - RNA, 45 nt, Mus musculus
uguucagaggcuugagagcgccacugauuguaaagguuuugguuu

SEQ ID NO: 43874 - RNA, 42 nt, Mus musculus
ccgggggagaggagaaaguagcacaaaaguggugugugaugg

SEQ ID NO: 43875 - RNA, 46 nt, Mus musculus
cuguguguuccuggugcaugcuuuuacagcuccccuaggcuuggag

SEQ ID NO: 43876 - RNA, 45 nt, Mus musculus
aaguggccaucuggggguguguauggcagugaccacaacaggcau

SEQ ID NO: 43877 - RNA, 24 nt, Mus musculus
ggcuggggcgcuggcggucuggga

SEQ ID NO: 43878 - RNA, 41 nt, Mus musculus
agugcugggauuaaaggcgugcgccaccauguccggccugu

SEQ ID NO: 43879 - RNA, 46 nt, Mus musculus
uaagugacugagaacauuuaguguugcagcaggaacuuaaacccag

SEQ ID NO: 43880 - RNA, 46 nt, Mus musculus
gaaacuccaagaaaguuaaaguacagaaagugcagucugucgggua

SEQ ID NO: 43881 - RNA, 46 nt, Mus musculus
ugguuuacuuguagaaaaguaucaguuuugauaguaacaaagugag

SEQ ID NO: 43882 - RNA, 45 nt, Mus musculus
uugaaagcuacauggcuguaaggcuuaaagaugaagaucugagag

SEQ ID NO: 43883 - RNA, 45 nt, Mus musculus
aacaacaaaaugccaagagguuuaaaaaacgguggauggccaaaa

SEQ ID NO: 43884 - RNA, 45 nt, Mus musculus
ggguucauuucucaaaauuuagucacugauaaaucauuguaacgg

SEQ ID NO: 43885 - RNA, 46 nt, Mus musculus
ugcauuuugcaaguuacacugauugaaugcuuacacaggagcgggg

SEQ ID NO: 43886 - RNA, 42 nt, Mus musculus
uaaacuaggaagcaauguaaagcgacaaaaaccuguccccag

SEQ ID NO: 43887 - RNA, 45 nt, Mus musculus
auacauggucucacuuugcuuuccugucuguccuggaauucagag

SEQ ID NO: 43888 - RNA, 44 nt, Mus musculus
acucuaagacauagugaggugugggagauuugccaccagaccua

SEQ ID NO: 43889 - RNA, 45 nt, Mus musculus
ccugagguuaagugugugugugugugugugugugugugugugugu

SEQ ID NO: 43890 - RNA, 76 nt, Mus musculus
agucucucaugauccugcuucaaaaguaaaagagaagaggaagagagaagaggaaaggagaggaggggagaggaga

SEQ ID NO: 43891 - RNA, 45 nt, Mus musculus
uuaagagauucaaaguaaccaguuugugguuuaaauugguccaag

SEQ ID NO: 43892 - RNA, 91 nt, Mus musculus
aauaaaauagcuguuggccuauuauuagcuuaggcagaaaacaggaggugggaguucuggcagggagagaggauucugggauagagucggg

SEQ ID NO: 43893 - RNA, 29 nt, Mus musculus
gucugauaacucaaucagacucaggcacu

SEQ ID NO: 43894 - RNA, 44 nt, Mus musculus
aaugcaaaagaucagagaggacaauggagaaggaaaucuggggg

SEQ ID NO: 43895 - RNA, 45 nt, Mus musculus
caugaggggcucuauguugguuuguugguuuguuuguuguguuug

SEQ ID NO: 43896 - RNA, 30 nt, Mus musculus
cuucccuuccccuuucccuuccccacucuu

SEQ ID NO: 43897 - RNA, 45 nt, Mus musculus
gugucagugaugacagugaccagugugacucaacucaggacauuu

SEQ ID NO: 43898 - RNA, 46 nt, Mus musculus
cgaagugguugacguccagggacacgcgccagcgaucagccgucug

SEQ ID NO: 43899 - RNA, 42 nt, Mus musculus
ggauacacucgagucuguuuauugaauuuuauggucccuuuc

SEQ ID NO: 43900 - RNA, 45 nt, Mus musculus
aaaaaacaaaaaaacaaaacaaaaaaaacaaaacagaggaggggu

SEQ ID NO: 43901 - RNA, 45 nt, Mus musculus
ccucuguccucuucuccauugcucaugcugaaugaugacuaaggu

SEQ ID NO: 43902 - RNA, 45 nt, Mus musculus
gaugauguccagaacccugaaucccacucuaaggaauaacgacaa

SEQ ID NO: 43903 - RNA, 47 nt, Mus musculus
aacucaacaacccacuuacuccauggcagguguugggagaaaagggc

SEQ ID NO: 43904 - RNA, 46 nt, Mus musculus
gggugaaguuccucauuuuggcugguauguguagauuuccuuguag

SEQ ID NO: 43905 - RNA, 46 nt, Mus musculus
uuacccugaaaacagcacucuauuuuuaauauuuguaugucaccag

SEQ ID NO: 43906 - RNA, 45 nt, Mus musculus
cgcuggcgacugcucccucaaaguguuugauuucuuuggccagau

SEQ ID NO: 43907 - RNA, 60 nt, Mus musculus
gaguuugcuauaacaguugcuuugcgguuacaaaaaggagagagaggagagagagagagg

SEQ ID NO: 43908 - RNA, 42 nt, Mus musculus
agccuggagcuucugacuggaaguugcucccugcuggugggc

SEQ ID NO: 43909 - RNA, 44 nt, Mus musculus
agccugggcuacaaagagaaacccugucugaagguugggaguua

SEQ ID NO: 43910 - RNA, 46 nt, Mus musculus
uccagaaacaggggagaaagaggaugaauuacggacaaccccaggu

SEQ ID NO: 43911 - RNA, 46 nt, Mus musculus
gagcauagaaaacauagcaggaagugggaagagaaucuugcggagg

SEQ ID NO: 43912 - RNA, 45 nt, Mus musculus
gcucagccuucagcaccgcuacagagcaaagagagaaggggagag

SEQ ID NO: 43913 - RNA, 46 nt, Mus musculus
cuaggcccuaaagaaacgguggagguuuaaagaacugcugaggaga

SEQ ID NO: 43914 - RNA, 25 nt, Mus musculus
ccgucccuugggcuuggugggggac

SEQ ID NO: 43915 - RNA, 46 nt, Mus musculus
auaucccuggagccuccagaauccucuccuuccugcucaagccuaa

SEQ ID NO: 43916 - RNA, 46 nt, Mus musculus
ugacuguuacugaggggguaagggggagacccuaugagggugccau

SEQ ID NO: 43917 - RNA, 45 nt, Mus musculus
gccugggcuacaugaaacccgccucccgcucccccuucccccaag

SEQ ID NO: 43918 - RNA, 42 nt, Mus musculus
auuaugacuacuagauuaauagagagagccagccagccacag

SEQ ID NO: 43919 - RNA, 45 nt, Mus musculus
cccaacaugaugccuacccgacacgccccgagaucaggaggagag

SEQ ID NO: 43920 - RNA, 41 nt, Mus musculus
acagccugacgcuaggggcucaggggagcccaggcccggau

SEQ ID NO: 43921 - RNA, 48 nt, Mus musculus
cucucuguguguguguguguguguguguguguguaucaggggugggua

SEQ ID NO: 43922 - RNA, 46 nt, Mus musculus
uuuaaaacauuuauguaucugaagaucuuugauugcuuugugugug

SEQ ID NO: 43923 - RNA, 45 nt, Mus musculus
gcuucuaucuuuuuaaauuaauuuauguaugugucuguauaugug

SEQ ID NO: 43924 - RNA, 41 nt, Mus musculus
acacaugacccuaugggggcagaucacaaacugugggggca

SEQ ID NO: 43925 - RNA, 46 nt, Mus musculus
aguaggcaggagguaggucaggagccuguguugaguacaucaccag

SEQ ID NO: 43926 - RNA, 45 nt, Mus musculus
gccagcuggggguuugauuuccuuuguaugucuuaugguggacag

SEQ ID NO: 43927 - RNA, 46 nt, Mus musculus
gucugagaaugagcgccucacgucuguggcccaggagcuaaaagag

SEQ ID NO: 43928 - RNA, 41 nt, Mus musculus
gcccgguauccacaggaugccuugucauugguugacuguuu

SEQ ID NO: 43929 - RNA, 46 nt, Mus musculus
gguuuaggggacaggggacaagggacaggagggaggguguggcuag

SEQ ID NO: 43930 - RNA, 41 nt, Mus musculus
uuugagggccucaagcaugaaaucaagcgccuggaggagga

SEQ ID NO: 43931 - RNA, 46 nt, Mus musculus
aucucugaacggcaguuggaggaggcgcuggagacacugaagacag

SEQ ID NO: 43932 - RNA, 25 nt, Mus musculus
acggugacuacuaugagguggacau

SEQ ID NO: 43933 - RNA, 46 nt, Mus musculus
ggcaucuuucaugauguggaacaauuacuauccaauauggcccugu

SEQ ID NO: 43934 - RNA, 46 nt, Mus musculus
ugaccuuugcucugguuaaaacaguaauaggcacuugaaagcauaa

SEQ ID NO: 43935 - RNA, 50 nt, Mus musculus
cuggacugugcuuugggaaccaaauggacuucaugggacaagcuaagcaa

SEQ ID NO: 43936 - RNA, 51 nt, Mus musculus
ucaguaaaacuccuuaguaaacuccuugcuaagugagguucaggguguggu

SEQ ID NO: 43937 - RNA, 46 nt, Mus musculus
aaaauauuguuacauuuaagauaacaucaucuguaugggguauuua

SEQ ID NO: 43938 - RNA, 46 nt, Mus musculus
uucuccugccaaggcaccuuacacagacccaaaacaaaacaaugag

SEQ ID NO: 43939 - RNA, 45 nt, Mus musculus
gaaggagaaacccacucagcuuuugaagaggaauggaucugugcu

SEQ ID NO: 43940 - RNA, 45 nt, Mus musculus
accccgaggggaaaggggucccaguuuuuauaggcccucacgggg

SEQ ID NO: 43941 - RNA, 45 nt, Mus musculus
uacacuagauacaaagacccucaggaugaaaauaaaauuggaaua

SEQ ID NO: 43942 - RNA, 46 nt, Mus musculus
aaagacacguggaaucuucuguuagacuucaguucaaugauugcag

SEQ ID NO: 43943 - RNA, 46 nt, Mus musculus
auuucaucuuacaccuguggaccaucuuagucugucuucccauaag

SEQ ID NO: 43944 - RNA, 45 nt, Mus musculus
aaugagaucagauguuagacuccacacuugugcaucacacaccac

SEQ ID NO: 43945 - RNA, 45 nt, Mus musculus
agggagacacacacagacacacacacacagagagagagagagaga

SEQ ID NO: 43946 - RNA, 45 nt, Mus musculus
uagauauuccagaagggagaucccacaguagcaaacaggcugaca

SEQ ID NO: 43947 - RNA, 45 nt, Mus musculus
ucuuuagcccuucccacacagcacugaagaauaugauguugaagg

SEQ ID NO: 43948 - RNA, 44 nt, Mus musculus
aagacagaggaaauagaaagggguugggaagcaagggauaagca

SEQ ID NO: 43949 - RNA, 46 nt, Mus musculus
ccucaaacuccugggcuuaagugacuauccuuucuagcugucccaa

SEQ ID NO: 43950 - RNA, 46 nt, Mus musculus
caacaagcuaacaaagauucacccaaaaaccuuucuaaccacaaag

SEQ ID NO: 43951 - RNA, 41 nt, Mus musculus
cugcccacaagacugaucacaaccccauucugacuucccca

SEQ ID NO: 43952 - RNA, 48 nt, Mus musculus
ucagaauguauucuguaagagaagaaucuauuucaagagagagagaga

SEQ ID NO: 43953 - RNA, 46 nt, Mus musculus
acuuugcuggagcuucauuuagauuuuaauaaaauuucaacggugg

SEQ ID NO: 43954 - RNA, 46 nt, Mus musculus
uuuuucuuuauugcucuuugagauaggaucucauuacguaguccag

SEQ ID NO: 43955 - RNA, 54 nt, Mus musculus
cauuauaauucaauugcaaaagugggagugaaugacuucuguccaacagugcca

SEQ ID NO: 43956 - RNA, 45 nt, Mus musculus
uaaaauucaaaaauguauacauuuggaauacuugaacuguccuag

SEQ ID NO: 43957 - RNA, 46 nt, Mus musculus
augacaaaaaauuucaacagaauuuugccuaauuauugaugcucag

SEQ ID NO: 43958 - RNA, 46 nt, Mus musculus
cucuucaaauaugcacauuggguaaugccuggaaacauagcuaagg

SEQ ID NO: 43959 - RNA, 23 nt, Mus musculus
agcgucccuuuguguuaaugaaa

SEQ ID NO: 43960 - RNA, 46 nt, Mus musculus
ugugaaaucuagaagacaaccucauucauucauuaggcaccuuuua

SEQ ID NO: 43961 - RNA, 42 nt, Mus musculus
gaaauggaaauucuucuagguuauugugcucuagaugaaguu

SEQ ID NO: 43962 - RNA, 45 nt, Mus musculus
agaaugcuugcuucaauuuauuguguccaacguugaguucuauaa

SEQ ID NO: 43963 - RNA, 46 nt, Mus musculus
cgacauagagacauccuggcucaaccccacccucacccaccucccu

SEQ ID NO: 43964 - RNA, 47 nt, Mus musculus
cacucugucaguuuuacaacguggaggagaacuaacagaacgucagu

SEQ ID NO: 43965 - RNA, 46 nt, Mus musculus
cggcacguguuauuagacguuaagugcuacgccgggcuugagcuga

SEQ ID NO: 43966 - RNA, 30 nt, Mus musculus
agcugaacauccgccgagagcuaaacgaga

SEQ ID NO: 43967 - RNA, 46 nt, Mus musculus
auguuuugcuuuauaguuuaugcauaauuuucuguuaguguucaag

SEQ ID NO: 43968 - RNA, 41 nt, Mus musculus
agacucugauggagacgcuugccauuggccugaaaguagaa

SEQ ID NO: 43969 - RNA, 46 nt, Mus musculus
ugcauccuguauaaaugcuaaggauaaacaagcugaagacaaccag

SEQ ID NO: 43970 - RNA, 45 nt, Mus musculus
gagauccuucaggccauggcuuaaaaaauaaauauaaugggguca

SEQ ID NO: 43971 - RNA, 46 nt, Mus musculus
gauuccgcauggacucuagauuuuuagagagugacagugaggacga

SEQ ID NO: 43972 - RNA, 45 nt, Mus musculus
ugugcaucucuuucguguuuuguuuuaaaacauuucuuuguccag

SEQ ID NO: 43973 - RNA, 45 nt, Mus musculus
gaguacacgguagcugucuucagacacaccagaagagggcgucag

SEQ ID NO: 43974 - RNA, 46 nt, Mus musculus
uuuuuuaaauauguauuuauuauauguaaguauaccguagcuucag

SEQ ID NO: 43975 - RNA, 41 nt, Mus musculus
ugccugagguaucccaagacauguauuauaacauugcugca

SEQ ID NO: 43976 - RNA, 46 nt, Mus musculus
gacugacaacuaaauggaauaugaacucaaauacuguaacugugag

SEQ ID NO: 43977 - RNA, 42 nt, Mus musculus
aggaaggaaggaaggaaggaaggaaggaagggagggcagauu

SEQ ID NO: 43978 - RNA, 46 nt, Mus musculus
uuaacccagaaaagcauucacugacaaagaagauauuucauaguag

SEQ ID NO: 43979 - RNA, 54 nt, Mus musculus
gaagugggaggaucauuugagcccagaauuugagaucacacugagcaacacccc

SEQ ID NO: 43980 - RNA, 45 nt, Mus musculus
acauuguugggaaaucagagacugagaagaagaaaagccccagaa

SEQ ID NO: 43981 - RNA, 46 nt, Mus musculus
acucccugaugcaagcggcccugcugugcaucucugugcugcagga

SEQ ID NO: 43982 - RNA, 41 nt, Mus musculus
gaguacagcgugaaggccauaguuacuucaaacugucccua

SEQ ID NO: 43983 - RNA, 41 nt, Mus musculus
gagacacggcagcaugcaaccagcccagaugcgccuugcag

SEQ ID NO: 43984 - RNA, 28 nt, Mus musculus
gacguucagucugucuccaacagugugg

SEQ ID NO: 43985 - RNA, 50 nt, Mus musculus
ccuggagaacuuucccgacugcucuaccaucuugccccucuacuccaaga

SEQ ID NO: 43986 - RNA, 41 nt, Mus musculus
aaguccagcagccgcaggguggccaaccacaacucugagag

SEQ ID NO: 43987 - RNA, 46 nt, Mus musculus
aagccacagaaaagccagccgggaucucucggaaugcaggcaccac

SEQ ID NO: 43988 - RNA, 46 nt, Mus musculus
guuauggacccuguccaggacuauucagugagaggauuccgccagg

SEQ ID NO: 43989 - RNA, 46 nt, Mus musculus
uggaaaaggaaagcauacaagugcuggguuaagggaaaaauaaaua

SEQ ID NO: 43990 - RNA, 45 nt, Mus musculus
cgggaucaggaaaccgggcgcaaggggcucuacguccgccuaggg

SEQ ID NO: 43991 - RNA, 45 nt, Mus musculus
ccgguacucguagugcucaucgaaguacuugucugaguaguagau

SEQ ID NO: 43992 - RNA, 46 nt, Mus musculus
agaagaacccagcgacggaaaggccuuugaaaccacaccccaaguc

SEQ ID NO: 43993 - RNA, 45 nt, Mus musculus
uuaggauagcuagaacagcaagagaaagucagaggcagucuaaaa

SEQ ID NO: 43994 - RNA, 45 nt, Mus musculus
ucucuggguaacaugacaugccuauuaaaauauucagccaaagau

SEQ ID NO: 43995 - RNA, 44 nt, Mus musculus
aaaggcuccuacagacuuacauauuugaauguuuggucccagcu

SEQ ID NO: 43996 - RNA, 46 nt, Mus musculus
uauaauaaauaaauaaaucuuaaaaaaaaaaaaaagaaaaaaaaaa

SEQ ID NO: 43997 - RNA, 44 nt, Mus musculus
guguguguguguguguguguguguguguguggagggugggggua

SEQ ID NO: 43998 - RNA, 24 nt, Mus musculus
cagguggcagguugggucggaguu

SEQ ID NO: 43999 - RNA, 46 nt, Mus musculus
gucuuggaguuuuaaaauaggaauuaggauacauccagugguagaa

SEQ ID NO: 44000 - RNA, 42 nt, Mus musculus
cuguccccucgcucugcccuugcuccuagcugugccugaggu

SEQ ID NO: 44001 - RNA, 46 nt, Mus musculus
gcucacccuuuuguuuugguaggguuuuuuuguuguugcuguuauu

SEQ ID NO: 44002 - RNA, 42 nt, Mus musculus
gucauuuucuuuuuuucuuucucuuuuuuuauuaccagagga

SEQ ID NO: 44003 - RNA, 44 nt, Mus musculus
auucuccuagcagccacucagagauaauuuaauuccagauugga

SEQ ID NO: 44004 - RNA, 46 nt, Mus musculus
uauggaaguuccagaauggcgaguugaaggccgcaagucccaagua

SEQ ID NO: 44005 - RNA, 45 nt, Mus musculus
ggcccuggaugggacuuucuacgacgucauguucaucagcacagg

SEQ ID NO: 44006 - RNA, 47 nt, Mus musculus
uugauggaugacucagugaccccgauagacaacagacccaagcugau

SEQ ID NO: 44007 - RNA, 73 nt, Mus musculus
guaucgacagugaggcccgggcagccaacuacaccagcuccuugaaucucccagacaaaacacugcaguuugu

SEQ ID NO: 44008 - RNA, 25 nt, Mus musculus
cuggggagggcucaucuucucugga

SEQ ID NO: 44009 - RNA, 109 nt, Mus musculus
ccacagagccuagcuucgucuuugcugacgugauccagaaaagcccagaugguccggagggugaagaugacaaggucuacuucuuuuuuacggagguauccguggagua

SEQ ID NO: 44010 - RNA, 41 nt, Mus musculus
aacccaucaucucucgaaacucuucccacagucccuugagg

SEQ ID NO: 44011 - RNA, 35 nt, Mus musculus
gcuguacuuuccaaaaagaauaaauaccgagagau

SEQ ID NO: 44012 - RNA, 46 nt, Mus musculus
agagccuggcucauggugcagugugcccccucuaugggcauagaca

SEQ ID NO: 44013 - RNA, 42 nt, Mus musculus
caaaaaauccaagugugcagagaaggggaaaucaaagcaggu

SEQ ID NO: 44014 - RNA, 45 nt, Mus musculus
acuuacauauaaucaauaaauaaauuauaaaaaaaaaaaaagaga

SEQ ID NO: 44015 - RNA, 45 nt, Mus musculus
cacaagcugaggcucuugcucucugccccuugucaugcaccucca

SEQ ID NO: 44016 - RNA, 25 nt, Mus musculus
gccugucugaaacccaagcgccccg

SEQ ID NO: 44017 - RNA, 48 nt, Mus musculus
agagagagaagagagagagagagagagagagagagagagaguuaacag

SEQ ID NO: 44018 - RNA, 42 nt, Mus musculus
ucauccucagggcuccgaggguccacaugcuaagcuguccag

SEQ ID NO: 44019 - RNA, 50 nt, Mus musculus
gccaccuguccucagugagccaauuaaaaaguaaacaguggugaaaagca

SEQ ID NO: 44020 - RNA, 46 nt, Mus musculus
guauuuggcacccgacagaagagaagucagacccagaagaugcaga

SEQ ID NO: 44021 - RNA, 47 nt, Mus musculus
uggucucuggggccugugaaguaaacagauaagagacggaucaagag

SEQ ID NO: 44022 - RNA, 45 nt, Mus musculus
aggcggguccccugaucugggaugcggagagaggcagguccccug

SEQ ID NO: 44023 - RNA, 42 nt, Mus musculus
ucuuguuucacccaggcacacaucuuaccccccaccccaggc

SEQ ID NO: 44024 - RNA, 41 nt, Mus musculus
ccuguggacagccugcguguggugaugcugucaugcacgug

SEQ ID NO: 44025 - RNA, 93 nt, Mus musculus
ucucugcuuccaguuguguccucugagcuggccaguaaccaagagaauccugcuagagagagagagagagagaaagagagagagagagagaga

SEQ ID NO: 44026 - RNA, 41 nt, Mus musculus
gcagcuacaaacuuagaacaaacccuguggauauuuuugga

SEQ ID NO: 44027 - RNA, 46 nt, Mus musculus
gucugugcugcacaccugcaguacuaaugacuaggaugugugagau

SEQ ID NO: 44028 - RNA, 46 nt, Mus musculus
cugagcgagguuugcuguccccaugauauggggugucuccugggaa

SEQ ID NO: 44029 - RNA, 46 nt, Mus musculus
cuaccauuuucagacaugugucugcuccugauugaugcacgcacgc

SEQ ID NO: 44030 - RNA, 46 nt, Mus musculus
ugugugaguuccuguccugacuucuuuggugaugaacagcaaugug

SEQ ID NO: 44031 - RNA, 46 nt, Mus musculus
aaguaacuucugacccaucuccucugauguccacacacuaguagau

SEQ ID NO: 44032 - RNA, 45 nt, Mus musculus
auaugugugcaccucuaggccuggcuucaauguauuguuuuuaga

SEQ ID NO: 44033 - RNA, 42 nt, Mus musculus
uaaggacuuagagaaaguggaacccugggguugcggagaggg

SEQ ID NO: 44034 - RNA, 46 nt, Mus musculus
uggguuggcaguacugugguugguuugcucaucucucgguagaugu

SEQ ID NO: 44035 - RNA, 46 nt, Mus musculus
uuaauguuucuauuucauacgugccuugugauugcugcugcuguga

SEQ ID NO: 44036 - RNA, 46 nt, Mus musculus
ccaaauauuugagccuaugggggcuguucccaucaagccaccagau

SEQ ID NO: 44037 - RNA, 42 nt, Mus musculus
cacacacauucucagaacaaagccugaaaaugggggcuggag

SEQ ID NO: 44038 - RNA, 45 nt, Mus musculus
ggcucucgggagaaagaugugaagcugcuucaagcaaucguagau

SEQ ID NO: 44039 - RNA, 46 nt, Mus musculus
ucaacgcagauauuuuugcaguuuuaaagaaaaaaugccagaacau

SEQ ID NO: 44040 - RNA, 94 nt, Mus musculus
gcugagucagggugaccuuggagaugaugggcugagucagggugaccuuggagaugaugggcugagucagggugaccuucgagaugaugggcug

SEQ ID NO: 44041 - RNA, 44 nt, Mus musculus
ugugggggaagaacauguaugucacauugcauguguguggaggu

SEQ ID NO: 44042 - RNA, 41 nt, Mus musculus
uuuuggugaagugcaguuugccugccuuguuggucauaaga

SEQ ID NO: 44043 - RNA, 45 nt, Mus musculus
uguccccuuccagaacuggugagucccugcgguagugugcugaug

SEQ ID NO: 44044 - RNA, 55 nt, Mus musculus
ccugcagguucucaggugugauagcuuaguggccuguuggacucgagguauaggg

SEQ ID NO: 44045 - RNA, 46 nt, Mus musculus
uguguugucugcauguauucacaccauguguguucagugccuacca

SEQ ID NO: 44046 - RNA, 45 nt, Mus musculus
ccuguuggcauucucguauccuuuucuacccccauuggccuagau

SEQ ID NO: 44047 - RNA, 46 nt, Mus musculus
ucuccucaccuucaccuuuguuaaaucugacugaugaugaccuuca

SEQ ID NO: 44048 - RNA, 46 nt, Mus musculus
uuuugguuuauacucauuguuuacaggauuggccucucugugcaua

SEQ ID NO: 44049 - RNA, 42 nt, Mus musculus
ugugucaacuuugccuccuuuaacuuccuugggcugcuggcc

SEQ ID NO: 44050 - RNA, 46 nt, Mus musculus
auucaaagauuuaucauucaucuaucuccuuuuuuuaaaaacagau

SEQ ID NO: 44051 - RNA, 45 nt, Mus musculus
ucuucaauggacugcuaaagauaacauuauaaaacacuuuaagau

SEQ ID NO: 44052 - RNA, 45 nt, Mus musculus
cuaccucagcugugcccccauucgguucucagauagccggcugcu

SEQ ID NO: 44053 - RNA, 44 nt, Mus musculus
auuggccucuuucucucuuccuuccucucuuuccuuacccucuc

SEQ ID NO: 44054 - RNA, 42 nt, Mus musculus
gccauugaggaagcucuggcugugagguuugugugguaagaa

SEQ ID NO: 44055 - RNA, 46 nt, Mus musculus
uugcugaguagccuggguucucugugaaugccaaaugcccccggaa

SEQ ID NO: 44056 - RNA, 41 nt, Mus musculus
gaacuacaguuggaacugauggcgagacggggucgguggga

SEQ ID NO: 44057 - RNA, 46 nt, Mus musculus
cuuggguuuauugaggagacucauaguguagguuucgcucgcagau

SEQ ID NO: 44058 - RNA, 46 nt, Mus musculus
uuuuauuucucgcccuuugggcaggguucugcaggccuuugcaggg

SEQ ID NO: 44059 - RNA, 42 nt, Mus musculus
uuguugcugcugcuguuguugcugcuguuguuguugcugcug

SEQ ID NO: 44060 - RNA, 41 nt, Mus musculus
guuuggugaaacuaucccggggugugcagcaaaagcuggcu

SEQ ID NO: 44061 - RNA, 47 nt, Mus musculus
uguaggaggaggaggaguaguaguaguaguaguaguaguaguaguag

SEQ ID NO: 44062 - RNA, 46 nt, Mus musculus
cgauauauucuguuccuuguuggguaguguguuaucauuuuugcag

SEQ ID NO: 44063 - RNA, 46 nt, Mus musculus
cucucuaguccagagccagccuggaaaaacaggccaguagcagcag

SEQ ID NO: 44064 - RNA, 46 nt, Mus musculus
aguguaccucggacacacuaguuuuaccucaacucuguccugucag

SEQ ID NO: 44065 - RNA, 46 nt, Mus musculus
cauguaguguuguaagcacgagcaaucugguuccccuguuaccuag

SEQ ID NO: 44066 - RNA, 41 nt, Mus musculus
agaaauguguucugaugaggcuuccugagccuuggccaaga

SEQ ID NO: 44067 - RNA, 24 nt, Mus musculus
ugccacucgggccgcuaaccccag

SEQ ID NO: 44068 - RNA, 45 nt, Mus musculus
aggaagaucacgaccaggggaguuguaugggcucuagccaagcag

SEQ ID NO: 44069 - RNA, 46 nt, Mus musculus
ucauaaauuugagagggggacguagaggggacacaggacaguuugg

SEQ ID NO: 44070 - RNA, 53 nt, Mus musculus
caacauuaacaucaaggagccucgaugggaccagagcacguucauuggccgag

SEQ ID NO: 44071 - RNA, 46 nt, Mus musculus
guuacugaucccagaaauauccuuuuaacgaacgaacagcuagaga

SEQ ID NO: 44072 - RNA, 46 nt, Mus musculus
augucaagagaggaaggaaggaagggguuaaaaggaacacagcaag

SEQ ID NO: 44073 - RNA, 46 nt, Mus musculus
cuaggcaaggaaucguuccugccggccucacggaaaaugagcuaug

SEQ ID NO: 44074 - RNA, 46 nt, Mus musculus
cgacucggccuuccauccugacaccggugaaaagaugacucugaua

SEQ ID NO: 44075 - RNA, 45 nt, Mus musculus
uucaaagaauauuuuaauaugaguucuacggaaauaaaaugccac

SEQ ID NO: 44076 - RNA, 45 nt, Mus musculus
agaaacccugucucggaaaaaaaaaaaagaaaggaaggaaggaaa

SEQ ID NO: 44077 - RNA, 46 nt, Mus musculus
uuacggugauuucagucucuuagaacggauaggaauaaaaggagaa

SEQ ID NO: 44078 - RNA, 42 nt, Mus musculus
aucacgcagguggucaucuccaggauccucauggcagccccg

SEQ ID NO: 44079 - RNA, 45 nt, Mus musculus
acggaacagcaaacacaauuccccuuugugaaaauugccuucuga

SEQ ID NO: 44080 - RNA, 45 nt, Mus musculus
ugguuuucaacaaguuucugauuugggaagauuucagagcugaga

SEQ ID NO: 44081 - RNA, 46 nt, Mus musculus
ccgggaagacauggugaaucagagguccagcgggcaucagcgggga

SEQ ID NO: 44082 - RNA, 42 nt, Mus musculus
gcaguggaucccuuaggucucgguuacccgcaguccaggaaa

SEQ ID NO: 44083 - RNA, 46 nt, Mus musculus
agugcuuguuucuaaguaucccuuaauuauucaguaauggcuccaa

SEQ ID NO: 44084 - RNA, 47 nt, Mus musculus
uaucuuaaggcauuggcauaaauaagucuaaaaauaacagagaaucg

SEQ ID NO: 44085 - RNA, 52 nt, Mus musculus
acugcucuuguugagaacucaccuccucccaagcacccacauccuuuaaccc

SEQ ID NO: 44086 - RNA, 46 nt, Mus musculus
ggucacccacaguccaaacauauuaaacgggagacuccacagacag

SEQ ID NO: 44087 - RNA, 46 nt, Mus musculus
aggcugagaaucuugucacuuuuaggaaggacauuauucagaagag

SEQ ID NO: 44088 - RNA, 45 nt, Mus musculus
agaaaguuugcaucuuuuugauggaggacaaauggcuaugggggg

SEQ ID NO: 44089 - RNA, 46 nt, Mus musculus
agaaagaaauugagacucacauuaacaucaagaaacauagccacgu

SEQ ID NO: 44090 - RNA, 46 nt, Mus musculus
ugggugcuauccugggagucucaaguccaggaggaucuugggugag

SEQ ID NO: 44091 - RNA, 45 nt, Mus musculus
gguuucuauuccugcauaaacaucaugacuaagaagcaaguuggg

SEQ ID NO: 44092 - RNA, 46 nt, Mus musculus
cacucaaaagccucuacaagaucuucguuaagagucaagcugccgg

SEQ ID NO: 44093 - RNA, 46 nt, Mus musculus
acccuucugguagauuuuaaugaugccauuuuuccaaagcccccac

SEQ ID NO: 44094 - RNA, 46 nt, Mus musculus
gcaaccaccagauuccauuucuacuucucuuccccagaggucucag

SEQ ID NO: 44095 - RNA, 46 nt, Mus musculus
ccaaauuauaaauacuaaggaaacuuuguuuccaguuuggcaauga

SEQ ID NO: 44096 - RNA, 45 nt, Mus musculus
gacuaucuaguuucuguagguuauuuuucccaauaauguuuccag

SEQ ID NO: 44097 - RNA, 45 nt, Mus musculus
ggcagaguuuguuggacaucugcuuaggcgguacugguuuaaagg

SEQ ID NO: 44098 - RNA, 46 nt, Mus musculus
uuggucaggcugaguguaccuuaacccucucugugauacuggagaa

SEQ ID NO: 44099 - RNA, 46 nt, Mus musculus
cuuuuguauaguucaauguagucuuuuggacuuguaggcaccauaa

SEQ ID NO: 44100 - RNA, 46 nt, Mus musculus
guaaauacaugauuuuacguauuuauaaaauuuaggacccccaaau

SEQ ID NO: 44101 - RNA, 45 nt, Mus musculus
ugugaggacuacaaaaugcaucgccacugugaauacgaaagguga

SEQ ID NO: 44102 - RNA, 46 nt, Mus musculus
uuggcacccaagcaacccugaccucuuugucaccgcaucuggagau

SEQ ID NO: 44103 - RNA, 46 nt, Mus musculus
ggguggagaggaaggcuuuauuugaaaaugauagcgcaggacaggu

SEQ ID NO: 44104 - RNA, 44 nt, Mus musculus
ggugagcuuguagggcacgggcuuggcggagaagagggcugugu

SEQ ID NO: 44105 - RNA, 46 nt, Mus musculus
aucauacugaauuagaaguuaaauuaaugucauguuaaaauucagg

SEQ ID NO: 44106 - RNA, 46 nt, Mus musculus
uuucucacucacccaaggacaaucuacacacucacucaggccucag

SEQ ID NO: 44107 - RNA, 46 nt, Mus musculus
uugucugaacugucaguggcuggugauggagucacagcaagggaag

SEQ ID NO: 44108 - RNA, 32 nt, Mus musculus
ugucccucgagccccgcuaggguggaacagag

SEQ ID NO: 44109 - RNA, 46 nt, Mus musculus
cguggauggcgugcaggggcaccguggugcacuucguugucccuag

SEQ ID NO: 44110 - RNA, 48 nt, Mus musculus
ugagugccuacugugugccaagacauugugcugaggcuuuugggggga

SEQ ID NO: 44111 - RNA, 46 nt, Mus musculus
auuucuugugacaaugauggauuacuccaugaaaaaagggugccac

SEQ ID NO: 44112 - RNA, 46 nt, Mus musculus
gguccagaguaguagcugaacauuuaugucuguuaucauacuggga

SEQ ID NO: 44113 - RNA, 67 nt, Mus musculus
ugcuuuuguacuaacugugccaacacccauguuuacacaagucuagagaaggaaggagccggagucc

SEQ ID NO: 44114 - RNA, 44 nt, Mus musculus
aaucacugugcuguuugccaauuguccaacauacagcccaggaa

SEQ ID NO: 44115 - RNA, 46 nt, Mus musculus
gugcccuuggacuccagcccaugagaacagaauuacuacaggacaa

SEQ ID NO: 44116 - RNA, 82 nt, Mus musculus
uugagagaauuucuuuuuccuaacugaaagaccuuugucuaaugcguuuuaucauguacaauugucauauuguccaaggggu

SEQ ID NO: 44117 - RNA, 29 nt, Mus musculus
ccuauagguaagugugugcuguaggaacg

SEQ ID NO: 44118 - RNA, 44 nt, Mus musculus
uacucaggcuugagacuucauagcagaugccgcuaaccccaaca

SEQ ID NO: 44119 - RNA, 45 nt, Mus musculus
ggucuuaaagcgccauggaaaccauuacaaaacccaggaacaaca

SEQ ID NO: 44120 - RNA, 45 nt, Mus musculus
aucggccacuuccucacccaaaugacaauaagguccggucugaaa

SEQ ID NO: 44121 - RNA, 46 nt, Mus musculus
ugauuugcgcuuccaccgcugcccccucccgcucccaaaaucccag

SEQ ID NO: 44122 - RNA, 46 nt, Mus musculus
uccugguccccuggcccagccccucaugacuccugucagcccacuc

SEQ ID NO: 44123 - RNA, 45 nt, Mus musculus
uagugacaacccugaaaaccugucuucucuaccuuuaccuucagg

SEQ ID NO: 44124 - RNA, 42 nt, Mus musculus
accccugagaagccucccaggaaggggagggguaugugagau

SEQ ID NO: 44125 - RNA, 44 nt, Mus musculus
gggcuaauguaagggagaacauucuagaccugggagcaucgugg

SEQ ID NO: 44126 - RNA, 45 nt, Mus musculus
ggacagguugacucaggagcccgagagcauccggaaguggagaga

SEQ ID NO: 44127 - RNA, 42 nt, Mus musculus
ggcucugagagauugauaggccugaggccacauggggagcag

SEQ ID NO: 44128 - RNA, 46 nt, Mus musculus
uaaccccagcauagcagcccacaccuggaugacgcauuuggaagau

SEQ ID NO: 44129 - RNA, 45 nt, Mus musculus
guaguagaaacuuccaaggccuauggugaagauuucaguggcugg

SEQ ID NO: 44130 - RNA, 45 nt, Mus musculus
gaggagggcgguggguaucaguauacccauggguguaugcauagg

SEQ ID NO: 44131 - RNA, 46 nt, Mus musculus
uuugagaugucgagggcacaggcugggcugggcaugggagugaggg

SEQ ID NO: 44132 - RNA, 45 nt, Mus musculus
aaccaauaaauaaaucuuaaaaaaaaaaaaaagaaaagaaaaaga

SEQ ID NO: 44133 - RNA, 46 nt, Mus musculus
aaaaaaaaaaaaaaaaaaaaaaacaaaaaaaaaaaaaaccaagcaa

SEQ ID NO: 44134 - RNA, 46 nt, Mus musculus
ugccaacauacacuuuccagugccagaguggaguucuagagcagau

SEQ ID NO: 44135 - RNA, 42 nt, Mus musculus
gccugaggcggguaauguacuuugucugaacuugcugcuggu

SEQ ID NO: 44136 - RNA, 29 nt, Mus musculus
ggaugcccucgucuggagugccugaagac

SEQ ID NO: 44137 - RNA, 47 nt, Mus musculus
ugguucugaaggagggggaggcagugagggagaagaaaaggaaggag

SEQ ID NO: 44138 - RNA, 46 nt, Mus musculus
cuuuggaguucacaaucagcuauguaucuaauuuccuuaacuagau

SEQ ID NO: 44139 - RNA, 44 nt, Mus musculus
ugaugucuguguacuaugugugugucuggugcuugaggaggcug

SEQ ID NO: 44140 - RNA, 45 nt, Mus musculus
uuaucugggugccagcuguacuauguugcccaggcuggccucaaa

SEQ ID NO: 44141 - RNA, 42 nt, Mus musculus
gugguuugggacaaaaguuccuggaguaugaaaucaggagac

SEQ ID NO: 44142 - RNA, 46 nt, Mus musculus
uuccagacuuccccaaggauacucuaaccuucucaguaaggcagag

SEQ ID NO: 44143 - RNA, 24 nt, Mus musculus
cugaagaaggaguaagcgugccgc

SEQ ID NO: 44144 - RNA, 46 nt, Mus musculus
uuccucucuuucuccugaucugcccugagagaagccagguaggcuu

SEQ ID NO: 44145 - RNA, 32 nt, Mus musculus
ucgcuccuccgccagcuucuguugcugcaccu

SEQ ID NO: 44146 - RNA, 45 nt, Mus musculus
aggacccuuccacccucagaguuuguccugcaaacacccccaguu

SEQ ID NO: 44147 - RNA, 41 nt, Mus musculus
uaguccucuggaaggcaccaagcuuggugagugaggggagc

SEQ ID NO: 44148 - RNA, 45 nt, Mus musculus
gacaaugcuccugucgagucugcaccugugggucagggugcacac

SEQ ID NO: 44149 - RNA, 42 nt, Mus musculus
uuuguuguugagacagggucucacucuagcccauucuggcuu

SEQ ID NO: 44150 - RNA, 45 nt, Mus musculus
gccuuauuauuaucuguaguuuacagauaggggacugaaugaaua

SEQ ID NO: 44151 - RNA, 46 nt, Mus musculus
ucaguuccuugcuuggagagcccugauggucaaggcaagccacccu

SEQ ID NO: 44152 - RNA, 45 nt, Mus musculus
auccaccagagacuccuaaccucuuuccguucaguuuuugccuag

SEQ ID NO: 44153 - RNA, 52 nt, Mus musculus
gauccgagaccaacuuaaucucuucaucaacaacaaugucaaagccuaccgg

SEQ ID NO: 44154 - RNA, 23 nt, Mus musculus
aguacccugaagcugugcaggcc

SEQ ID NO: 44155 - RNA, 42 nt, Mus musculus
gaaccucaauaucuacuucaacugcacugacuugaacccaag

SEQ ID NO: 44156 - RNA, 45 nt, Mus musculus
uggacaguccugagauagcucaggugagagaauuuagaagguuga

SEQ ID NO: 44157 - RNA, 41 nt, Mus musculus
gaaagaugacaaacggauugggaagguaggggaggggcugg

SEQ ID NO: 44158 - RNA, 41 nt, Mus musculus
gcgucgccugugggaagcuguguccggugcgcagccggcgg

SEQ ID NO: 44159 - RNA, 41 nt, Mus musculus
gaucaacuccacucacucagucccuaugugcucaggcccaa

SEQ ID NO: 44160 - RNA, 44 nt, Mus musculus
ggcagcaugggacaaccucaucucacauaacaacaguaugacua

SEQ ID NO: 44161 - RNA, 65 nt, Mus musculus
acaugccaacaaagugaagagauaccuagcaauccauggaauggagacaauaaagggggacguga

SEQ ID NO: 44162 - RNA, 46 nt, Mus musculus
aguggacagaguaaagggacacugcuguucuugaacuguggagaaa

SEQ ID NO: 44163 - RNA, 46 nt, Mus musculus
agugugaaggcagaaaaauguugaagagacaccuuguucagcggac

SEQ ID NO: 44164 - RNA, 46 nt, Mus musculus
gaguaggaauaacccaagaaaauugaggaagugacagaauaaaaug

SEQ ID NO: 44165 - RNA, 46 nt, Mus musculus
gugggaggccacuggugugcaugcaugugugugugugugugugugu

SEQ ID NO: 44166 - RNA, 46 nt, Mus musculus
agaggaggcaggaaggucaggaguucagugccacuuuggcugccag

SEQ ID NO: 44167 - RNA, 46 nt, Mus musculus
cuccugguucaauucccagcacccacuuguguaacucuagccccaa

SEQ ID NO: 44168 - RNA, 46 nt, Mus musculus
agaaagagugcauaugguuaugcacuccuuuaaucccggcacucag

SEQ ID NO: 44169 - RNA, 46 nt, Mus musculus
gugugugugagccaggcgugguggcgcacaccuuuaaucccagcac

SEQ ID NO: 44170 - RNA, 42 nt, Mus musculus
caagucucuccaucccuugacuaagugacuucucugagcagg

SEQ ID NO: 44171 - RNA, 82 nt, Mus musculus
agacacaggaagcaggagacuaagcucaaacucauggcacacuaugggcggcuggcggacccugcugucucugacuuaccag

SEQ ID NO: 44172 - RNA, 46 nt, Mus musculus
uuuuaauccuguaugucuguggguucguaagugcaggugcccaugg

SEQ ID NO: 44173 - RNA, 46 nt, Mus musculus
ucaaaucccaguaaccacaucauggcucacaaccaucuguaaugag

SEQ ID NO: 44174 - RNA, 46 nt, Mus musculus
gaucagaggaggaagauugggagucaaaggucauccuuggcugcag

SEQ ID NO: 44175 - RNA, 46 nt, Mus musculus
uuguauuuuuaaugaugguucuuaaacacuuuaaccucccuuguaa

SEQ ID NO: 44176 - RNA, 45 nt, Mus musculus
ccuucccgccauagauggacggacuccgagagccuucucagucag

SEQ ID NO: 44177 - RNA, 42 nt, Mus musculus
ugcaaacacaacccacuccaaaggacucaagcacagugcaag

SEQ ID NO: 44178 - RNA, 45 nt, Mus musculus
cuagguauagauccugccaaccaugaagucucccagaaaacagag

SEQ ID NO: 44179 - RNA, 46 nt, Mus musculus
ucuucaaaguuaguuguucugacggcaacccagaaguuguacccag

SEQ ID NO: 44180 - RNA, 45 nt, Mus musculus
gggggcuugggggcggguacuaucugccugaguguauuucaaaga

SEQ ID NO: 44181 - RNA, 42 nt, Mus musculus
cguuaaggugguuaugcugggcaaggaauacgugggcaagac

SEQ ID NO: 44182 - RNA, 46 nt, Mus musculus
acuccuguuacugauguuguggaauuguuauuuucagccuccuggu

SEQ ID NO: 44183 - RNA, 46 nt, Mus musculus
uuuguguauuagagccuccuuagcagcugcuguagcauugggagau

SEQ ID NO: 44184 - RNA, 46 nt, Mus musculus
ggcacaggcacuggggacagaggggcaaugacagaaaucuugagau

SEQ ID NO: 44185 - RNA, 46 nt, Mus musculus
gaccuugggccagggcucuuaugugaacuuuuuucuacugggauug

SEQ ID NO: 44186 - RNA, 41 nt, Mus musculus
aguauggacucugaacuccugagcuauucuccagccguaga

SEQ ID NO: 44187 - RNA, 79 nt, Mus musculus
ccacgacaucaucuccaucaagcuguuccagcucacgguggagcggacgccugaggaggagagcaucgacuggaccaag

SEQ ID NO: 44188 - RNA, 45 nt, Mus musculus
cacugcuucgauuuuacaaagaaacuaagccuugaagccucuaga

SEQ ID NO: 44189 - RNA, 41 nt, Mus musculus
auguggaguugcuuggccgggagccacauccuggacucagu

SEQ ID NO: 44190 - RNA, 42 nt, Mus musculus
caguuuuagacgccaggggccugcccacccuggccaccagcu

SEQ ID NO: 44191 - RNA, 46 nt, Mus musculus
caaaaucugaugcccucuucuggaguaucuaaggacagcuacagug

SEQ ID NO: 44192 - RNA, 45 nt, Mus musculus
guuacuauugcagugauaaacgccaugaccaaaagcugccugggg

SEQ ID NO: 44193 - RNA, 45 nt, Mus musculus
ccauggcugcugucagccaugcaggcccccagguugccgccugug

SEQ ID NO: 44194 - RNA, 46 nt, Mus musculus
cucuaggguauucaacauccucugacauuuucuggcaucugcacau

SEQ ID NO: 44195 - RNA, 39 nt, Mus musculus
uucuuguccugccgauuuuucuguccuggucgcacagau

SEQ ID NO: 44196 - RNA, 43 nt, Mus musculus
cgagccaguacgugcgccugaccccggacgagcgcagcaaaga

SEQ ID NO: 44197 - RNA, 41 nt, Mus musculus
ccacgacauuucuacauuugcuucuguugcuggggccggug

SEQ ID NO: 44198 - RNA, 42 nt, Mus musculus
agggcggaaguggccgagagaacaaggagaauggcggccgag

SEQ ID NO: 44199 - RNA, 44 nt, Mus musculus
gguggaaugggggagggcaggugccacugcagaaaggggguuca

SEQ ID NO: 44200 - RNA, 45 nt, Mus musculus
uugaguggucucuccauuggucagcaggugagguucuggcuccag

SEQ ID NO: 44201 - RNA, 46 nt, Mus musculus
uugcaacaggggagguuccugugccugagggggcucugccgcacag

SEQ ID NO: 44202 - RNA, 46 nt, Mus musculus
cauuuuuauuauguauacagcauccugccuacguguacgccuccag

SEQ ID NO: 44203 - RNA, 42 nt, Mus musculus
cugugcuccucaaucugcugcucccgcucccgguagcgccgc

SEQ ID NO: 44204 - RNA, 42 nt, Mus musculus
gcuccauccguuccuguucaaaccugagccuggcguccagag

SEQ ID NO: 44205 - RNA, 66 nt, Mus musculus
cauccucccgaaggcgcaggcggugcaauacugggcuggagagccgugccaguccauuggagagcc

SEQ ID NO: 44206 - RNA, 46 nt, Mus musculus
gagcacauauuuuggcagggcagcuugggaguccuugacgcugcag

SEQ ID NO: 44207 - RNA, 41 nt, Mus musculus
ucacucugccccagucggagguugauagcccccugcugcug

SEQ ID NO: 44208 - RNA, 35 nt, Mus musculus
cuugagugcuggugugcacauggccaguguccuag

SEQ ID NO: 44209 - RNA, 44 nt, Mus musculus
cagacggcucagaaguccauggagcugugggccagguaguccuu

SEQ ID NO: 44210 - RNA, 46 nt, Mus musculus
uuggaaguagcacaggcuagccaggcagggaaggggaaggggauag

SEQ ID NO: 44211 - RNA, 42 nt, Mus musculus
caucugaaaauaaguccaaagaaacccuuccucgccgggcgg

SEQ ID NO: 44212 - RNA, 41 nt, Mus musculus
cacuaguagaagguguggcccuguuggaguagguauggccu

SEQ ID NO: 44213 - RNA, 41 nt, Mus musculus; identical to SEQ ID NO: 44212

SEQ ID NO: 44214 - RNA, 45 nt, Mus musculus
gaaggagagauccuugguccuaugaaggcucaauagaugccccag

SEQ ID NO: 44215 - RNA, 42 nt, Mus musculus
auacaucaauugcagagguaauuaauauugaaaaugggggaa

SEQ ID NO: 44216 - RNA, 33 nt, Mus musculus
accaaacucuuugcagggaguuugacccugcuu

SEQ ID NO: 44217 - RNA, 46 nt, Mus musculus
agggcauggggaaggcaguuaagagaguagcagaggcagagagaag

SEQ ID NO: 44218 - RNA, 41 nt, Mus musculus
agagaggggaagggaauaaagagcaaagggaaagaggcaag

SEQ ID NO: 44219 - RNA, 107 nt, Mus musculus
cgggccuuccugcuacugcuguggcuugcagcccgcggaagcgcgcuguauuuccacaucggagaaacagaaaagaagugcuucauugaggagauuccggacgagac

SEQ ID NO: 44220 - RNA, 45 nt, Mus musculus
ccaggaaauuaccggacgcagcuguaugacaaacagcgggaggag

SEQ ID NO: 44221 - RNA, 56 nt, Mus musculus
ggcagguucaccuucaccucccacaccccuggugagcaccagaucugucuucacuc

SEQ ID NO: 44222 - RNA, 46 nt, Mus musculus
ucagugugugaucugaauuuaacaaaaagaaagagaaaaaagggaa

SEQ ID NO: 44223 - RNA, 82 nt, Mus musculus
cgagcugcagcugagggugcgacagcugguggagcaaguggagcagauccaaaaggagcagaacuaccagcgggugagugcu

SEQ ID NO: 44224 - RNA, 46 nt, Mus musculus
uuuugguuuuuggagacaggguuucucuguauagcccuggcuaucc

SEQ ID NO: 44225 - RNA, 46 nt, Mus musculus
cagcgaaagcaccaaccagcgagugcuauggugguccauccugcag

SEQ ID NO: 44226 - RNA, 41 nt, Mus musculus
caggcugugggaaguaggaggaggacugguuuucagccgca

SEQ ID NO: 44227 - RNA, 45 nt, Mus musculus
ugauuuuccuucugucuuccuuuguuaaugugggauuuugagcag

SEQ ID NO: 44228 - RNA, 81 nt, Mus musculus
uagaaccagccugcuuauauaggguguguuugcugcgugucaguuuaaggguguggagggguugcagugcacaaaaggggc

SEQ ID NO: 44229 - RNA, 48 nt, Mus musculus
augaauguggguuuguuacauugguuucccaauaaaaaagaaaaaaga

SEQ ID NO: 44230 - RNA, 46 nt, Mus musculus
guaagguccacagggagagugggagaucacaggagagcccauaggg

SEQ ID NO: 44231 - RNA, 42 nt, Mus musculus
cuaugcugaagaggccccugugguuguagcacuggcccugag

SEQ ID NO: 44232 - RNA, 46 nt, Mus musculus
cggcccagagggcuucucaccacggccuagaacaguaccuuuccag

SEQ ID NO: 44233 - RNA, 43 nt, Mus musculus
gcaaacagcugaucagcgagaaacccagccaggaagauggaag

SEQ ID NO: 44234 - RNA, 46 nt, Mus musculus
gcucuuggcgucagagccuuuguuugcaaauauuugguaagacaag

SEQ ID NO: 44235 - RNA, 46 nt, Mus musculus
gaccuuuuacaucuuaguaauaauuauguagaauaagugccauauu

SEQ ID NO: 44236 - RNA, 46 nt, Mus musculus
aacaguugggugcucuuacccacugagccaucucaccagcccguua

SEQ ID NO: 44237 - RNA, 46 nt, Mus musculus
cugcuggacccuuuaauacaguuccucauguuguggugacccccaa

SEQ ID NO: 44238 - RNA, 45 nt, Mus musculus
auguggggaccccuuuaaguggguaaaggagccacucugugcuag

SEQ ID NO: 44239 - RNA, 45 nt, Mus musculus
aaacuggggagaagcaagaucaggucugagcaggucugaagggag

SEQ ID NO: 44240 - RNA, 41 nt, Mus musculus
cggagccccgaggcccacgauggcaccugcagugcgcaggg

SEQ ID NO: 44241 - RNA, 46 nt, Mus musculus
ugccaacagcacugacagccucaagucccccaaggugaauugugag

SEQ ID NO: 44242 - RNA, 46 nt, Mus musculus
uauugcagcccugcugucuuaaaagaaaagaugauguuuaggugac

SEQ ID NO: 44243 - RNA, 50 nt, Mus musculus
acaccuggggcaggagcagugcucccuugaccuggcuccaucgacuugca

SEQ ID NO: 44244 - RNA, 46 nt, Mus musculus
agcagacauggcucuggaggaguugagaguucuugaucugaaggca

SEQ ID NO: 44245 - RNA, 45 nt, Mus musculus
acuguaacacacuucuaaaauaccugggguaaccaacuuaacaag

SEQ ID NO: 44246 - RNA, 45 nt, Mus musculus
ggcuccugggagcugguggcguccaguucuguaucaguucuggug

SEQ ID NO: 44247 - RNA, 41 nt, Mus musculus
uuuuuucauuuaugguguauuaggguucucuagaggaacag

SEQ ID NO: 44248 - RNA, 46 nt, Mus musculus
aaggagcuaaaccaauggcaagguuuaaccauacagaucgcacccu

SEQ ID NO: 44249 - RNA, 53 nt, Mus musculus
agugucgucaaacaggaaaguguugucucagaagaggagcuaagaugggaagu

SEQ ID NO: 44250 - RNA, 46 nt, Mus musculus
cucagcuagaacagugagacaagagaggcaaauaaaggagaugcag

SEQ ID NO: 44251 - RNA, 46 nt, Mus musculus
agcaaaaauaaagcaaaccaccccacucccaaccaaaaccguguag

SEQ ID NO: 44252 - RNA, 45 nt, Mus musculus
gagaauccgagucagaaaaagaaaauaaauuuaacuuggggaaga

SEQ ID NO: 44253 - RNA, 51 nt, Mus musculus
gccuggagaaugagcuaggaggucgggggccaauguugggaagauagggga

SEQ ID NO: 44254 - RNA, 45 nt, Mus musculus
gacagauggaggaaagaauccuaaaagaagagguggggucacaga

SEQ ID NO: 44255 - RNA, 33 nt, Mus musculus
cgcaggcugcugucacucagccggccccgaguu

SEQ ID NO: 44256 - RNA, 44 nt, Mus musculus
acagagaauuuaugcuagucucauucuucaauaugcccagaguc

SEQ ID NO: 44257 - RNA, 42 nt, Mus musculus
uaaaccauucuuuugccagauucuauuugacuaagcccagau

SEQ ID NO: 44258 - RNA, 28 nt, Mus musculus
gggggcgggcggggggggggggaggccg

SEQ ID NO: 44259 - RNA, 46 nt, Mus musculus
ggaagaaaguauugauguugccuuacaaaggccuagugguauggga

SEQ ID NO: 44260 - RNA, 45 nt, Mus musculus
caaggcccagaacuugauccuagaguuuauccuacacccccagac

SEQ ID NO: 44261 - RNA, 46 nt, Mus musculus
agagccaggaacugagauggucacguggaagguggcauuuacaggu

SEQ ID NO: 44262 - RNA, 69 nt, Mus musculus
gcagaggcuagcaguguucagaaaggaaaucuaagggcagaugggcaagcuguggggagaggccauagc

SEQ ID NO: 44263 - RNA, 42 nt, Mus musculus
uggcuccucuggcacucucagagaguccucccuggcccccgc

SEQ ID NO: 44264 - RNA, 42 nt, Mus musculus
ggggcucuuaaaaagcuagcaaguuuggccaagauggagaag

SEQ ID NO: 44265 - RNA, 44 nt, Mus musculus
agguccaugaaaggucugagagaggaaggcuaauagguccagag

SEQ ID NO: 44266 - RNA, 33 nt, Mus musculus
ugucuuuuccaaagauacaaaggugccagagag

SEQ ID NO: 44267 - RNA, 27 nt, Mus musculus
cugaugagccuauggcugggcagagga

SEQ ID NO: 44268 - RNA, 41 nt, Mus musculus
ccaaaaccccauagacacaagacacaccaacaggagcagag

SEQ ID NO: 44269 - RNA, 46 nt, Mus musculus
uagauauaagaaguggaggcagggaaauggacaguugguucuagac

SEQ ID NO: 44270 - RNA, 42 nt, Mus musculus
aaguuucagcucucucugcugccgcaacauguaccaccguca

SEQ ID NO: 44271 - RNA, 46 nt, Mus musculus
ggauuaagaagaauccucaccuuuuuggaggaaguuugcccuuggg

SEQ ID NO: 44272 - RNA, 90 nt, Mus musculus
cacggucacgggagagaccaagaggcugagugguucugaugaagauggaggugggcguggcuaaggagcugaguggcuccgauuggagau

SEQ ID NO: 44273 - RNA, 46 nt, Mus musculus
aguccccaugucagccaagaaaguucuacuuccuuucccgggauuc

SEQ ID NO: 44274 - RNA, 42 nt, Mus musculus
gagccgcagagguagaccaccaggagcuucccaccagccagc

SEQ ID NO: 44275 - RNA, 72 nt, Mus musculus
guuggccccagacuguauacuuuucugacacuuuaccugggaagaaaacauguacaaaggucaggguggagg

SEQ ID NO: 44276 - RNA, 46 nt, Mus musculus
ggcuaguucuauuaagaaauaguugaaugucgugcuguucggagcc

SEQ ID NO: 44277 - RNA, 46 nt, Mus musculus
gucgucuacgcagcauugaguuuauugaaaugucgcuuucacugga

SEQ ID NO: 44278 - RNA, 57 nt, Mus musculus
uugggauucugugcuguuauaaaggaaaccaauaggaaguaucuggaggcagagugc

SEQ ID NO: 44279 - RNA, 46 nt, Mus musculus
gcuaguaagucgaguaaugguuuguguauggaauuugcugucagag

SEQ ID NO: 44280 - RNA, 45 nt, Mus musculus
aauauucacuuuugggcuauauaaaaacaaauugugagagccaga

SEQ ID NO: 44281 - RNA, 44 nt, Mus musculus
cugugugccugguuggauguuguaaugaauguccagucagcagu

SEQ ID NO: 44282 - RNA, 45 nt, Mus musculus
ggguccugggacuugaaccugaguccucuggaauagcaaccaacu

SEQ ID NO: 44283 - RNA, 45 nt, Mus musculus
guaauaaaguguggauaacaaaauugagauucuuuucagauaaga

SEQ ID NO: 44284 - RNA, 45 nt, Mus musculus
cccugcuguuguggacugauuucucuagaaucaugagccguaaua

SEQ ID NO: 44285 - RNA, 48 nt, Mus musculus
auuauggccaauccacagaugcaacaguugauacagagaaauccagag

SEQ ID NO: 44286 - RNA, 55 nt, Mus musculus
augcagcggcaacuuuugucuaacccugaaaugaugguccagaucauggaaaauc

SEQ ID NO: 44287 - RNA, 46 nt, Mus musculus
uuaugugguuugcuucuuuaaucauguuuuaaaagugguuugggau

SEQ ID NO: 44288 - RNA, 46 nt, Mus musculus
uugauauuugcuggaaaaauuuuaaaagaucaagauacucugaguc

SEQ ID NO: 44289 - RNA, 41 nt, Mus musculus
uuauccugccuguugugcacaucucuccuguugcucucaga

SEQ ID NO: 44290 - RNA, 41 nt, Mus musculus
ucagccacagccuuagcgcuaguuccucucuuuuuggcagu

SEQ ID NO: 44291 - RNA, 41 nt, Mus musculus
gcggcagccagugagucucuguugugauuuagucuguggac

SEQ ID NO: 44292 - RNA, 54 nt, Mus musculus
cuucuaguccuccuguuugaucucucaaguacugagauugcaaguagugugccc

SEQ ID NO: 44293 - RNA, 45 nt, Mus musculus
gcaagggcucuuagccgcugcacccaucacugucuucugucagua

SEQ ID NO: 44294 - RNA, 46 nt, Mus musculus
gacuggacucagcuccugcacugcuccuacaagagcaacaagagcu

SEQ ID NO: 44295 - RNA, 46 nt, Mus musculus
uaugagauuugugugcgugugaacaugggaggugcccccagaagcc

SEQ ID NO: 44296 - RNA, 46 nt, Mus musculus
ugaaggcacagguugcaaauuccuuauugggaaugguuaagaucag

SEQ ID NO: 44297 - RNA, 75 nt, Mus musculus
auauacgugugaagguauauacaccauggugccaccaaaucuuuggucuaggucuuuccaccuuaauuagccagu

SEQ ID NO: 44298 - RNA, 45 nt, Mus musculus
uuuuuaagagucugugugugagagagagagacagagacagugagu

SEQ ID NO: 44299 - RNA, 45 nt, Mus musculus
gggaaaggaggaaaaagauaauauugaaggcuuaugcuguuaggu

SEQ ID NO: 44300 - RNA, 44 nt, Mus musculus
gcuguuucuguuacaauacuuccgucaucgcuuagcugccaguc

SEQ ID NO: 44301 - RNA, 41 nt, Mus musculus
gcaggacagugcggccgacggcggccccgcagagcccaaga

SEQ ID NO: 44302 - RNA, 43 nt, Mus musculus
auaucccagaagaaacugaagaaacaaaaacucauggcccagg

SEQ ID NO: 44303 - RNA, 45 nt, Mus musculus
cuaacgugcuguuucuccuuaacagggaggcaggaaggggaaaag

SEQ ID NO: 44304 - RNA, 46 nt, Mus musculus
guguugguuuuucuuuaacuuagaagccugguguauuugacuccaa

SEQ ID NO: 44305 - RNA, 78 nt, Mus musculus
gcaaccacaugguggcucacaaccaucuguaacaggcucugaugcacucuucuagugugugucugaagauagcugcag

SEQ ID NO: 44306 - RNA, 45 nt, Mus musculus
gccuugccuccucuguguugggauacagugugcaacuacaucuaa

SEQ ID NO: 44307 - RNA, 46 nt, Mus musculus
ucaccacaucuagaaggauaagccacggguaggguggcaugugucc

SEQ ID NO: 44308 - RNA, 28 nt, Mus musculus
gggguuggaggacagaggaggaggaaga

SEQ ID NO: 44309 - RNA, 66 nt, Mus musculus
uuuuuuuuuuuuaaagauuuauuuauuuauuuauauguaaguacacuguagcuauccucagauacc

SEQ ID NO: 44310 - RNA, 61 nt, Mus musculus
gggcagcgcgagggaggaggcuuuuggauuuggccugggaagaggugggguuuugcgggga

SEQ ID NO: 44311 - RNA, 72 nt, Mus musculus
ccucggggccuuggauggaggccauuggacgcugcguuccacaaugagauuggagguguugacaaguggcag

SEQ ID NO: 44312 - RNA, 63 nt, Mus musculus
uccugcagauguuagagauugaaaacuggcaguccuguguagaccaggcagacgguaauaaca

SEQ ID NO: 44313 - RNA, 46 nt, Mus musculus
ugauugggaagggagaaaugaggucuugagacccgguugcuuguaa

SEQ ID NO: 44314 - RNA, 45 nt, Mus musculus
cccagcacgcacguucacugucgcuaccgucuccaaccagcagaa

SEQ ID NO: 44315 - RNA, 42 nt, Mus musculus
gauccucguggcggacacguggagugugcuggagggcaaggg

SEQ ID NO: 44316 - RNA, 46 nt, Mus musculus
ucuucaucaagaucagauucuaguuaaaccuggaaccgccucagca

SEQ ID NO: 44317 - RNA, 46 nt, Mus musculus
caucauagcggucuccaggccuuccucuucugucauaagccauuag

SEQ ID NO: 44318 - RNA, 46 nt, Mus musculus
cucauaucaucauaaucucuucuagaaggaggcaugggacgcccac

SEQ ID NO: 44319 - RNA, 46 nt, Mus musculus
cacauuuuugggcauagccaaccaggguuuucacaugggcguucag

SEQ ID NO: 44320 - RNA, 45 nt, Mus musculus
auaccuugcucugaagcaaaaugcgcaauucaaccaucucaucag

SEQ ID NO: 44321 - RNA, 47 nt, Mus musculus
gccggcagcaaaugacgaucccucuggggaccacuuuaaaugcagag

SEQ ID NO: 44322 - RNA, 58 nt, Mus musculus
gcgacguccgugcagcggagaagcagaggauaauggcgucugcagcgcugucgccugu

SEQ ID NO: 44323 - RNA, 60 nt, Mus musculus
agcgcccuccuccuuucucguucgcgcacucuguggugagggggaggggaguagugacag

SEQ ID NO: 44324 - RNA, 45 nt, Mus musculus
gcgggaagaagugaaagagggaaaagagaacccagcugggaacgg

SEQ ID NO: 44325 - RNA, 46 nt, Mus musculus
ucguccucccaaagcagggauuaaaggcaagcguaaccauggccag

SEQ ID NO: 44326 - RNA, 42 nt, Mus musculus
acauucuccacccuuuaucuauuugucuguucuaauggccag

SEQ ID NO: 44327 - RNA, 42 nt, Mus musculus
ugauaaagaauagugauggacugacagcaguuuguuggguaa

SEQ ID NO: 44328 - RNA, 46 nt, Mus musculus
gcuaccaagacucucuggauuacuggacaauacauggacuauggca

SEQ ID NO: 44329 - RNA, 45 nt, Mus musculus
gggggagaagauacaccauccaaaggagugauuugguucugcaag

SEQ ID NO: 44330 - RNA, 24 nt, Mus musculus
ugaauaaaugagauuuaugcauuc

SEQ ID NO: 44331 - RNA, 41 nt, Mus musculus
uuucaauaucagguaggagauguacagaagcaguagcccca

SEQ ID NO: 44332 - RNA, 41 nt, Mus musculus
cugaaaaagcgcuuaguguuguuuaucccucugccccuaga

SEQ ID NO: 44333 - RNA, 46 nt, Mus musculus
gauuuuaauagaaagucaacuuaaaagaaaaauaugagggccagaa

SEQ ID NO: 44334 - RNA, 51 nt, Mus musculus
aggacacagugacacagaucaggcuucaacguaacaguugaggggcaucgu

SEQ ID NO: 44335 - RNA, 49 nt, Mus musculus
aguaaauauaugacucaggggagagccucagugaagaggacccagcagg

SEQ ID NO: 44336 - RNA, 46 nt, Mus musculus
auugugugacuuugcucaaacaccauucuuuucguuuauguuggau

SEQ ID NO: 44337 - RNA, 46 nt, Mus musculus
agggagcuagcuuccuucucccccucagaaguuaugggugcaagcc

SEQ ID NO: 44338 - RNA, 49 nt, Mus musculus
ugcagcccauccaagaaauguauagaauacauugcucaccaggaacccg

SEQ ID NO: 44339 - RNA, 46 nt, Mus musculus
gcauuauauuccuaacccuucaccuuuaauuuuccugccaccauuc

SEQ ID NO: 44340 - RNA, 45 nt, Mus musculus
agugcugaacggugggggucuuucaaguuccaauggacuuggaga

SEQ ID NO: 44341 - RNA, 42 nt, Mus musculus
guacgccgaggcuugugcgccggugcuagcgcagcgcggcgg

SEQ ID NO: 44342 - RNA, 45 nt, Mus musculus
aaccagcagaaacugcuuccucaguuuccucuucacuuggacaag

SEQ ID NO: 44343 - RNA, 48 nt, Mus musculus
ugacauggauaaguuaaaaucuacacugaaacaguuuguaagagacug

SEQ ID NO: 44344 - RNA, 46 nt, Mus musculus
aauauaaacuuuaucccuggauccaucaguuuagcaauaaucggag

SEQ ID NO: 44345 - RNA, 41 nt, Mus musculus
uaaaucuugguccucuacuauaccauuuugaaaaucuggca

SEQ ID NO: 44346 - RNA, 51 nt, Mus musculus
cuaugugaacgggaaaacuuuccuugagaaaagauauaaugaagaccuaga

SEQ ID NO: 44347 - RNA, 30 nt, Mus musculus
augagggccuugccaacacccuugaaaggc

SEQ ID NO: 44348 - RNA, 45 nt, Mus musculus
cacugagaacuuccaauucgugcuuugaccacaguggccagcuca

SEQ ID NO: 44349 - RNA, 41 nt, Mus musculus
gacauuugaauuccaauccagaagaagugcuacugggagau

SEQ ID NO: 44350 - RNA, 42 nt, Mus musculus
cuauugagucucaucaugguaagcaugggaacacugccccua

SEQ ID NO: 44351 - RNA, 46 nt, Mus musculus
aagcaggagucuugguaguggguccuccccuggguuagguggaaag

SEQ ID NO: 44352 - RNA, 46 nt, Mus musculus
aucccaucguuugugcugcguagcacuccaaauugaagccgugaua

SEQ ID NO: 44353 - RNA, 78 nt, Mus musculus
ccaggucauaugaaaggagacaaccccgauuaacaaacagccacuuuaacaaacagccacuaggcccauguccagauc

SEQ ID NO: 44354 - RNA, 46 nt, Mus musculus
augcuugagagagcugcuaaugguuuggggcuugguccugugguga

SEQ ID NO: 44355 - RNA, 46 nt, Mus musculus
ugcugacuucauagaagccucccauuucuuuccuuuuccccuguag

SEQ ID NO: 44356 - RNA, 45 nt, Mus musculus
uucauuaaaguuucuaaauucuuaaguuaaagggaaguagcgcaa

SEQ ID NO: 44357 - RNA, 46 nt, Mus musculus
caaguagagcauggcuugugcccucaaaccugaacaggaggaacag

SEQ ID NO: 44358 - RNA, 45 nt, Mus musculus
ucucucauaagauguuucuuguguaucuacaaauaaagccuccag

SEQ ID NO: 44359 - RNA, 46 nt, Mus musculus
ucuuuuuacuugaaaauucaaaagcuguaaaguugcuaacguauag

SEQ ID NO: 44360 - RNA, 45 nt, Mus musculus
aagugaaugagggacaugggcaggccuggcagucagcagcaccag

SEQ ID NO: 44361 - RNA, 50 nt, Mus musculus
cuacaguccuaccauggugaaggugaggaccaaugaccccagaccaggaa

SEQ ID NO: 44362 - RNA, 46 nt, Mus musculus
uuaguuaauguuuucauaguuuaaaauuauuuauuuuuauugucag

SEQ ID NO: 44363 - RNA, 42 nt, Mus musculus
cuuuugccuguaugcaugaauauaaacuucaugugugcccag

SEQ ID NO: 44364 - RNA, 41 nt, Mus musculus
ugccaauuggagaaaaggaccuucagaguuuacaggccaaa

SEQ ID NO: 44365 - RNA, 41 nt, Mus musculus
aaacauauucaagaacauuguccaaguucuagaagacacag

SEQ ID NO: 44366 - RNA, 45 nt, Mus musculus
ugauauucaugagggaaauuguucugaaguucucuuucuuuguug

SEQ ID NO: 44367 - RNA, 29 nt, Mus musculus
guauauuuguaguaacauugcuaaguuga

SEQ ID NO: 44368 - RNA, 46 nt, Mus musculus
ucaugcucaaaggcaugaaagaauucauacagaaaugaacccccuu

SEQ ID NO: 44369 - RNA, 46 nt, Mus musculus
gucuuauagacagggcagauuuuauaacgaaguuugugugugugug

SEQ ID NO: 44370 - RNA, 45 nt, Mus musculus
gagauagacaagggcagagagagaacagaggaguagaggcuggcc

SEQ ID NO: 44371 - RNA, 57 nt, Mus musculus
uggggugaaagggggagcaggagggagaggacagagcuagagcaagaagucaagagu

SEQ ID NO: 44372 - RNA, 44 nt, Mus musculus
augaauaaaccugcucuuaacauaguugagaaaguguccuggug

SEQ ID NO: 44373 - RNA, 46 nt, Mus musculus
uauuuuauguauaugaguacacuauaguuaucuucagacacaccag

SEQ ID NO: 44374 - RNA, 46 nt, Mus musculus
auuauuuuguuuuguguuguaugugugugaugugauaaugggccuu

SEQ ID NO: 44375 - RNA, 46 nt, Mus musculus
ucacagugaaccaaacauuuaccagaaaacauugucuuccuuuuag

SEQ ID NO: 44376 - RNA, 26 nt, Mus musculus
gcccucuggagugcaaugcuuggggu

SEQ ID NO: 44377 - RNA, 44 nt, Mus musculus
accucagccagacaugauggcccaggccuguaaucacagugcuu

SEQ ID NO: 44378 - RNA, 45 nt, Mus musculus
auggaguuggccuaaaagugagacuaugugugcuucagagacaga

SEQ ID NO: 44379 - RNA, 49 nt, Mus musculus
acauguauguaacaagggugaaauuggcagggaagaauuuaggauggag

SEQ ID NO: 44380 - RNA, 44 nt, Mus musculus
gauagaagagggccaccaggaaacccuccacgaagaauggguag

SEQ ID NO: 44381 - RNA, 31 nt, Mus musculus
cugagaagcagacaacuagacauacacacgu

SEQ ID NO: 44382 - RNA, 47 nt, Mus musculus
ugaacgggaaaacuuuccuugagaaaagauauaaugaagaccuagaa

SEQ ID NO: 44383 - RNA, 31 nt, Mus musculus
cucuguguacaaguacucuguaaucgggaac

SEQ ID NO: 44384 - RNA, 46 nt, Mus musculus
gcaguccacuaccaucagcuagauauccgagacucagacgaagaag

SEQ ID NO: 44385 - RNA, 46 nt, Mus musculus
aaguuaucuccuaaugcaggaaggagcacauacaggagagagagag

SEQ ID NO: 44386 - RNA, 46 nt, Mus musculus
ugagcaaccuuuuuacaacaccaucauuucugaauguauaagugaa

SEQ ID NO: 44387 - RNA, 41 nt, Mus musculus
uagaacuugggugugaguaaauaaguuuuacaggccccaga

SEQ ID NO: 44388 - RNA, 51 nt, Mus musculus
auuuaguugagggagggacugccuccuaaacacccacagagaaguaguaua

SEQ ID NO: 44389 - RNA, 46 nt, Mus musculus
uaaacaaggaaaauaucuaauaaaaacaaacaaacaaacaaaagau

SEQ ID NO: 44390 - RNA, 47 nt, Mus musculus
ggccgccauuuaagauccauuuggggccuaacaaacacagaagugga

SEQ ID NO: 44391 - RNA, 51 nt, Mus musculus
ggagcaagggcuugccauguagaaacauccuuagcaagaugccaaauuugg

SEQ ID NO: 44392 - RNA, 42 nt, Mus musculus
gugcuguuaacagaaagcuaggcuauuggaggacaggcacau

SEQ ID NO: 44393 - RNA, 72 nt, Mus musculus
gaaagggaggaagaggaggggugggggaacauuggaaagaagaggacgaggaggaagaacaguaggaugaag

SEQ ID NO: 44394 - RNA, 46 nt, Mus musculus
gaugaauaaugaacugugcaagcuacccaucucgauucuaggagga

SEQ ID NO: 44395 - RNA, 46 nt, Mus musculus
ccacagcuucuggcgguagccuacauuuauaaaggacauugaagau

SEQ ID NO: 44396 - RNA, 42 nt, Mus musculus
ugauuaaugcuauuccugaugugaggauaugggcugcuaguu

SEQ ID NO: 44397 - RNA, 45 nt, Mus musculus
aacaggguaggcaaucagcugcuggaguucccauuaugaacaaga

SEQ ID NO: 44398 - RNA, 46 nt, Mus musculus
uugcugaaucauguauguaaucaacuuuuuuauuacaguaagagga

SEQ ID NO: 44399 - RNA, 42 nt, Mus musculus
gggaaagauguuaauccacaccagcuguaccugcaggcuuua

SEQ ID NO: 44400 - RNA, 46 nt, Mus musculus
aauuauucaaaguguaaccugggggcugauccuacaaggacuuauu

SEQ ID NO: 44401 - RNA, 45 nt, Mus musculus
gaaucacuggccaaucagggcguccaggcaggccaaucaggagaa

SEQ ID NO: 44402 - RNA, 46 nt, Mus musculus
aguacacuguagcugacuuuagacacaccagaagagggcgucagau

SEQ ID NO: 44403 - RNA, 43 nt, Mus musculus
gaccagcccuggccauucuugguuccucuucaggcaguggagg

SEQ ID NO: 44404 - RNA, 46 nt, Mus musculus
ggcugaaagcuuggucugauuuguuuuaaucucugcugccaggggc

SEQ ID NO: 44405 - RNA, 46 nt, Mus musculus
uggucaccuuguagcacugcucugcagagcacuccgcuuugcuggu

SEQ ID NO: 44406 - RNA, 47 nt, Mus musculus
gaagaccuuaucaucgaugugucucaguccgcaggccaccaccccaa

SEQ ID NO: 44407 - RNA, 45 nt, Mus musculus
gauguuaucgguauaacaaaaagagaaaaaaagugacaggcaaca

SEQ ID NO: 44408 - RNA, 42 nt, Mus musculus
cuguuggcugcccuggcuggucagaggugcaaagccuggcau

SEQ ID NO: 44409 - RNA, 42 nt, Mus musculus
gguggucacuucacucaugguggcugacaccaggugguugag

SEQ ID NO: 44410 - RNA, 46 nt, Mus musculus; identical to SEQ ID NO: 43717

SEQ ID NO: 44411 - RNA, 47 nt, Mus musculus; identical to SEQ ID NO: 43719

SEQ ID NO: 44412 - RNA, 42 nt, Mus musculus
agacuguuucaccuuuaucccauguuuguuucagccccagcc

SEQ ID NO: 44413 - RNA, 45 nt, Mus musculus
cggggcggagauguccaucgggcuaggggcaggcacccggcagcc

SEQ ID NO: 44414 - RNA, 44 nt, Mus musculus
gugagggauguugcaugguugugguuuaaguauggagugcccac

SEQ ID NO: 44415 - RNA, 46 nt, Mus musculus; identical to SEQ ID NO: 42732

SEQ ID NO: 44416 - RNA, 41 nt, Mus musculus
gagaaacguuuguccuucugagggucguaguucuucagguu

SEQ ID NO: 44417 - RNA, 45 nt, Mus musculus
gugguugcaguacacaaguaguuaaauuguguagccuuggagagu

SEQ ID NO: 44418 - RNA, 42 nt, Mus musculus
cagcaagacccucuggaguaccuccagucugaugaggaagac

SEQ ID NO: 44419 - RNA, 47 nt, Mus musculus
aagauagguuccuaggguucacucauacauaauauagauagauuaua

SEQ ID NO: 44420 - RNA, 45 nt, Mus musculus
ggacucaacuuggagaccugccugacuccauaccuggcuguugau

SEQ ID NO: 44421 - RNA, 49 nt, Mus musculus
guagcucuaaaucagcuuguuuagucagucaccuuuugauagauguuug

SEQ ID NO: 44422 - RNA, 74 nt, Mus musculus
uaacucagcagcaucauuugagguucaugcauauugaguguuucaagagucucuuccuuuuauuucaggguagu

SEQ ID NO: 44423 - RNA, 46 nt, Mus musculus
caguuugauacaugugacauuugucuacaucauggaacccccauag

SEQ ID NO: 44424 - RNA, 46 nt, Mus musculus
uguacacuuuaauacaaccuaucauacaugccuuuaaucccugcag

SEQ ID NO: 44425 - RNA, 41 nt, Mus musculus
acucaggaugauacuagccuccaucuaugaaguugguccca

SEQ ID NO: 44426 - RNA, 42 nt, Mus musculus
aaaaguauggaacacucaugaauuugcaacaaggaggcaaca

SEQ ID NO: 44427 - RNA, 45 nt, Mus musculus
augcaaaccgccauuguccaaagcacccuuaugcccggcugaaga

SEQ ID NO: 44428 - RNA, 45 nt, Mus musculus
augcccucuucuggugugucugaagacagcuacaaugugcucaca

SEQ ID NO: 44429 - RNA, 47 nt, Mus musculus
cacagacacauauacacacacauuucaguguaguccugcccccuuuu

SEQ ID NO: 44430 - RNA, 44 nt, Mus musculus
agaaaauagccacagaaaguggaaguuggagauaguuuauagau

SEQ ID NO: 44431 - RNA, 45 nt, Mus musculus
ucugacauguaaguguuagaggaaacaaaauucagguagguggag

SEQ ID NO: 44432 - RNA, 45 nt, Mus musculus
aggcccagagcagacacuguucgggauuuaauaaaugaaggagag

SEQ ID NO: 44433 - RNA, 45 nt, Mus musculus
uauccccucuuauuaaugucccuuuuuuagugcagaauacugaga

SEQ ID NO: 44434 - RNA, 45 nt, Mus musculus
ggagaacaguucaccgguguuuaguuuuauauugaggugcucagg

SEQ ID NO: 44435 - RNA, 45 nt, Mus musculus
uuacuaguuuugaguuacuguaaaauguacaaguucugcuagcag

SEQ ID NO: 44436 - RNA, 46 nt, Mus musculus
auuauuuuagguauuuucauuauaugaaaucuaccaugugucagau

SEQ ID NO: 44437 - RNA, 46 nt, Mus musculus
uacaguuacuaaaacagcuaauuauuucuuucuuccccuaugaaag

SEQ ID NO: 44438 - RNA, 45 nt, Mus musculus
cacagauccacuuaccuuugccucccaagugcuaggaucaaaggu

SEQ ID NO: 44439 - RNA, 46 nt, Mus musculus
uuuuacaagaacauguuuguuuuagauuagagaagauagugcaggc

SEQ ID NO: 44440 - RNA, 46 nt, Mus musculus
acaugaaagccaucugaagcauguuuauaacacauugauaggagug

SEQ ID NO: 44441 - RNA, 47 nt, Mus musculus
uuucuuugagucaauagucuugacaacauuuguccuucagucuacag

SEQ ID NO: 44442 - RNA, 34 nt, Mus musculus
ugucuucauauaauuauaaauacuuucuagaggu

SEQ ID NO: 44443 - RNA, 41 nt, Mus musculus
cuuggaaggcagggcaggaaccuggagggcaggagccggau

SEQ ID NO: 44444 - RNA, 45 nt, Mus musculus
acauugacuauugacguagagacuuggaaaguugugaauauagau

SEQ ID NO: 44445 - RNA, 46 nt, Mus musculus
uagauguuuggauauuaaaaguggauacaggucagacaggggcaag

SEQ ID NO: 44446 - RNA, 45 nt, Mus musculus
uacacacucaucuccaucuuccuggaaagugagcagauucagcag

SEQ ID NO: 44447 - RNA, 46 nt, Mus musculus
aauuauuggagugguucaagggcagcuccagaaauucauuuaggau

SEQ ID NO: 44448 - RNA, 46 nt, Mus musculus
uaacgucaauaucuguuuuccccaaugaccuuaggugaucccugug

SEQ ID NO: 44449 - RNA, 45 nt, Mus musculus
gugcugcaucccuguaauacagcuccaguugugaugaccccaacc

SEQ ID NO: 44450 - RNA, 46 nt, Mus musculus
gacacugaagucaguuuuaugaaccacuuugagggugcugggaauc

SEQ ID NO: 44451 - RNA, 46 nt, Mus musculus
aguugaaacuugcaccacagugcauauuugaaagaacaguagagau

SEQ ID NO: 44452 - RNA, 86 nt, Mus musculus
uguuuauggggcuagacuuaauacuggacauucaucagagcucaggaagguaucgguaaaucugugugucgaauacaugguauugc

SEQ ID NO: 44453 - RNA, 39 nt, Mus musculus
uagccccauaaacacacucccgguuccuuccgagcacag

SEQ ID NO: 44454 - RNA, 50 nt, Mus musculus
gcccuacuauacccuuuacauccggagcagcugaggguuagggaguuugu

SEQ ID NO: 44455 - RNA, 79 nt, Mus musculus
cucccuaacccucagcugcuccggauguaaaggguauaguagggcauggugucgcuagccuugaauuccagcacucgga

SEQ ID NO: 44456 - RNA, 100 nt, Mus musculus
aaguagaacucugagagucccaggcaggccagggauacagugcgauacuuggcccccgccccaaugugggcuggagccaaaugcucacauccuuccuucc

SEQ ID NO: 44457 - RNA, 68 nt, Mus musculus
cacaucuaagcaggccgaggccgcgagguuacaagcacagcagugcaaggcaucuggacacagcgagc

SEQ ID NO: 44458 - RNA, 62 nt, Mus musculus
cccgccccgcuggcgagcggcgccguuaacgggccccaggccgccccgcgcccggggccgcc

SEQ ID NO: 44459 - RNA, 46 nt, Mus musculus
cuggccggaugacuccugcgaagguggggagggggaaagaggcugu

SEQ ID NO: 44460 - RNA, 46 nt, Mus musculus
cugugauaacuccaggugagucaaguugaaacaaaacuaggcagua

SEQ ID NO: 44461 - RNA, 46 nt, Mus musculus
gccauugacagccaaugccuucccaagacaggugaaugugucaggu

SEQ ID NO: 44462 - RNA, 45 nt, Mus musculus
gcagcagagggaaaugaaguacacacacugccagaagccuggaga

SEQ ID NO: 44463 - RNA, 45 nt, Mus musculus
agaaaagaaaaauguauauuuuguguauugauaggaagaaccaug

SEQ ID NO: 44464 - RNA, 42 nt, Mus musculus
aaagcagcagaaaaccucuguguguaacaucacagcccagga

SEQ ID NO: 44465 - RNA, 46 nt, Mus musculus
cuggagccggaaaugaaaacuuaaauuuugaacugcaggcaggaag

SEQ ID NO: 44466 - RNA, 46 nt, Mus musculus
gaggccaaaacuggguauguggcacagcacuuggaaggugguggua

SEQ ID NO: 44467 - RNA, 42 nt, Mus musculus
aaugguucagugauuaagagcauuaguuguucuuccagaggu

SEQ ID NO: 44468 - RNA, 45 nt, Mus musculus
acuucuuaguagguuguuuugcccuacauucaugagccagguuag

SEQ ID NO: 44469 - RNA, 46 nt, Mus musculus
uaggcugcuaccucaugaagcauuacaggaugacagcagcugagag

SEQ ID NO: 44470 - RNA, 46 nt, Mus musculus
cgguaagaguaguaaguacucuuagcgcuaagccguuucuccagcu

SEQ ID NO: 44471 - RNA, 42 nt, Mus musculus
ggaaaugaaauagaaaauucccaggaacaaaacaggccaaua

SEQ ID NO: 44472 - RNA, 46 nt, Mus musculus
aagcuuagccacauccccagcccccagccuaccacagcuuauuaca

SEQ ID NO: 44473 - RNA, 46 nt, Mus musculus
ugcuggccuagaacucccaacgcagcugcagacaccacacccagau

SEQ ID NO: 44474 - RNA, 50 nt, Mus musculus
uuugugacaucauuguggcauguguguuuuagagagagagagagagagag

SEQ ID NO: 44475 - RNA, 46 nt, Mus musculus
ugaugcuaagcgcuuuacggaugcuggauucgaucaccaugaucuu

SEQ ID NO: 44476 - RNA, 45 nt, Mus musculus
auaauaccagagcgauuucuugccuucugugggccccauucaaga

SEQ ID NO: 44477 - RNA, 81 nt, Mus musculus
uacucauacuggugggcucuggguuuguugagagauuuuugccucagugaauaagguggaggagcaauugaggaugauucc

SEQ ID NO: 44478 - RNA, 24 nt, Mus musculus
accugacaccuuuucccaagagca

SEQ ID NO: 44479 - RNA, 25 nt, Mus musculus
aaaacaaaacagaaaggugaagccc

SEQ ID NO: 44480 - RNA, 38 nt, Mus musculus
agacgcguauagaacauuaaucuucggagauacagccu

SEQ ID NO: 44481 - RNA, 46 nt, Mus musculus
uuaaagaaggcuaccaggaaguuuauggguuggagagacuccagga

SEQ ID NO: 44482 - RNA, 46 nt, Mus musculus
uaaccuucaggagaucucuugucugaaguguugcacacauucagga

SEQ ID NO: 44483 - RNA, 46 nt, Mus musculus
gcgaacguuuagaagguguggcggagcgcccccgguagucucagua

SEQ ID NO: 44484 - RNA, 46 nt, Mus musculus
cuucucagcacuuuucuguagaaaguuugggaaaacuuggggaggu

SEQ ID NO: 44485 - RNA, 46 nt, Mus musculus
ucugauacaucugagauucuagaauaagguuaagaaauaugcaggu

SEQ ID NO: 44486 - RNA, 42 nt, Mus musculus
cugaccuaccuguuaaguuccaggacagccagggggauauag

SEQ ID NO: 44487 - RNA, 45 nt, Mus musculus
cuuggcucauagggaguugcauuauuaggagguguggccuuguug

SEQ ID NO: 44488 - RNA, 46 nt, Mus musculus
aguggaugccuugggaugaugggauaccuaaaguuugaacugagau

SEQ ID NO: 44489 - RNA, 46 nt, Mus musculus
agaaagaaaagaaaagaaagacaaccaaacaagaaaaacccaagac

SEQ ID NO: 44490 - RNA, 52 nt, Mus musculus
acaaggcuugcaacccuucagugaguaaauucaguuucaagaaaggaaagaa

SEQ ID NO: 44491 - RNA, 50 nt, Mus musculus
caagccuuccugaggaagucaucaaagaaauaauguuuaaaaaggucagu

SEQ ID NO: 44492 - RNA, 42 nt, Mus musculus
cggcccgagcccccggccguccgacaccccccccccgccccc

SEQ ID NO: 44493 - RNA, 46 nt, Mus musculus
ccaccgaggucugauauaggaaucuugcccuugucugcauggaggg

SEQ ID NO: 44494 - RNA, 45 nt, Mus musculus
gaggagaaagagagagagagagagagagagagagagagacugaaa

SEQ ID NO: 44495 - RNA, 46 nt, Mus musculus
uuuagcuaggcaugguagcacacaccuuuaauaccagcaugcagga

SEQ ID NO: 44496 - RNA, 41 nt, Mus musculus
auaacaaaaagaagugugcagccaaauauggugauucacga

SEQ ID NO: 44497 - RNA, 41 nt, Mus musculus
agcccacacucaugaucucagcacaggcagagucaguaaga

SEQ ID NO: 44498 - RNA, 47 nt, Mus musculus
aauuuuuuuuuaaaaagaaaaagucaguuaauugcagggaggaauac

SEQ ID NO: 44499 - RNA, 46 nt, Mus musculus
caaaucccagcaaccacaugguggcuugcaaccacccauaagaucu

SEQ ID NO: 44500 - RNA, 46 nt, Mus musculus
uuaugugccuauagaacuacaugcugagggacaucaguugucagaa

SEQ ID NO: 44501 - RNA, 42 nt, Mus musculus
accaaaaccacagaaucuucacaaucaaaacauggcccugau

SEQ ID NO: 44502 - RNA, 45 nt, Mus musculus
uagcuccccagcuucauauuucuuuaaagguuucuccuugugagg

SEQ ID NO: 44503 - RNA, 45 nt, Mus musculus
uucccgagauuucagugcagcuuagcaaacugugaugcaagagaa

SEQ ID NO: 44504 - RNA, 42 nt, Mus musculus
guguuacgucuguaaagaauaugucgaagaucuggccaaaau

SEQ ID NO: 44505 - RNA, 45 nt, Mus musculus
aggugcucuggagccuucggauuucaccucagugucccaucagau

SEQ ID NO: 44506 - RNA, 46 nt, Mus musculus
aagguuguauaaaacuuucuuuaccucuuaaaaauaaauuuuagcu

SEQ ID NO: 44507 - RNA, 61 nt, Mus musculus
auugaggauccaagucaugauuugaauucuguugccauuuuuacauggguuaaauguuacc

SEQ ID NO: 44508 - RNA, 59 nt, Mus musculus
caucaaaauagccaaagaccgggacaaccacuguggacuugccaccgcggccagcuauc

SEQ ID NO: 44509 - RNA, 90 nt, Mus musculus
caagaaccucgaccaugggguucuguuggugggcuauggcuaugaaggaacagauucaaauaagaauaaauauuggcuugucaagaacag

SEQ ID NO: 44510 - RNA, 45 nt, Mus musculus
uauggacgcaagccauccgucucuccaguucuauaguucagguaa

SEQ ID NO: 44511 - RNA, 100 nt, Mus musculus
guaaauacagagccgaguucgcuguggcuaaugacacaggguucguggauaucccucagcaagagaaagcccucaugaaggcuguggcgacuguggggcc

SEQ ID NO: 44512 - RNA, 94 nt, Mus musculus
ggcuguaacggaggccugauggauuuugcuuuccaguacauuaaggaaaauggaggucuggacucggaggagucuuaccccuaugaagcgaagg

SEQ ID NO: 44513 - RNA, 48 nt, Mus musculus
gccagugcgggucuuguugggcguuuagcgcaucggguugccuagaag

SEQ ID NO: 44514 - RNA, 60 nt, Mus musculus
gauccccaagucuguggacuggagagaaaaggguugugugacuccugugaagaaccaggu

SEQ ID NO: 44515 - RNA, 75 nt, Mus musculus
caggcagguggugaauggcuaccgccaccagaagcacaagaaggggaggcuuuuucaggaaccgcugaugcuuaa

SEQ ID NO: 44516 - RNA, 73 nt, Mus musculus
ugggagaagaacaugagaaugauccagcuacacaacggggaauacagcaacgggcagcacggcuuuuccaugg

SEQ ID NO: 44517 - RNA, 46 nt, Mus musculus
accuuuagugcagaguggcaccaguggaaguccacacacagaagac

SEQ ID NO: 44518 - RNA, 42 nt, Mus musculus
gucagcuacaguguacuuauguauaauaauaaauccuuaaaa

SEQ ID NO: 44519 - RNA, 45 nt, Mus musculus
gacccaaaacgcuccauggcuuccacaauguucaugccuucuuuc

SEQ ID NO: 44520 - RNA, 46 nt, Mus musculus
uagauggaccugccgccagugccauuauggcauguaaagucaccac

SEQ ID NO: 44521 - RNA, 47 nt, Mus musculus
gucuuuggaacuuugucugcaaacagcucgaaggagacgcggcccaa

SEQ ID NO: 44522 - RNA, 45 nt, Mus musculus
cuugagaggcagguuaguaaauaccaauuaggagaaaguagcagc

SEQ ID NO: 44523 - RNA, 42 nt, Mus musculus
ccuuccgguggcccaagacccugcggcuccggaggcagccaa

SEQ ID NO: 44524 - RNA, 46 nt, Mus musculus
auugauguggccaaagucaauacccugauaaggcccgacggagaga

SEQ ID NO: 44525 - RNA, 45 nt, Mus musculus
gaacauaugccaguuccugauagagauugggcuggcuaaggacga

SEQ ID NO: 44526 - RNA, 45 nt, Mus musculus
guguaacuccuucaugcaauaaacugaaaagagucaugcugugua

SEQ ID NO: 44527 - RNA, 46 nt, Mus musculus
ugguacaaagcaauaacaagguuucagccaagccaagaaccccaag

SEQ ID NO: 44528 - RNA, 44 nt, Mus musculus; identical to SEQ ID NO: 37936

SEQ ID NO: 44529 - RNA, 45 nt, Mus musculus
ucagccgcaaucuucuccaugucuacuuccaccuucagaccacau

SEQ ID NO: 44530 - RNA, 78 nt, Mus musculus
ucuucuuuuccuggugucguuccucuaucugaaggagcucggcuucuaguuuccgcugaugaaccauuaaagacugga

SEQ ID NO: 44531 - RNA, 46 nt, Mus musculus
ugagguuucucaaaccacuuuucaugaaccagugaauauucaagag

SEQ ID NO: 44532 - RNA, 57 nt, Mus musculus
ccucucugaacuucauggauuucugucucacaagguuuaacuauuuuauauacacug

SEQ ID NO: 44533 - RNA, 46 nt, Mus musculus
auuguacagguuuauuucucaagacaguuucuaagagccccuaaca

SEQ ID NO: 44534 - RNA, 65 nt, Mus musculus
ggaaaaaucugaugcagcgaauaaggggguggucaaggcugaaaagagcaagaaaaagaaggaag

SEQ ID NO: 44535 - RNA, 41 nt, Mus musculus
gcacgugguagucaugggugacgggaucagggcaugggggc

SEQ ID NO: 44536 - RNA, 48 nt, Mus musculus
aaggggacauaaugaaauggaagguaggaucagguaugggaagagaca

SEQ ID NO: 44537 - RNA, 46 nt, Mus musculus
uagggcgaugcuagagcagugugaaucuggaguggguggaggcaaa

SEQ ID NO: 44538 - RNA, 46 nt, Mus musculus
ucggagacuugaagaguucaccgcuccgaugcucagggccgcagau

SEQ ID NO: 44539 - RNA, 45 nt, Mus musculus
aucucucuucuucuucgauuugcuaucaucagauucacggucaga

SEQ ID NO: 44540 - RNA, 46 nt, Mus musculus
uuugcaagacccgcugaucuccaauaucauaaaagaacccauacug

SEQ ID NO: 44541 - RNA, 46 nt, Mus musculus; identical to SEQ ID NO: 44540

SEQ ID NO: 44542 - RNA, 44 nt, Mus musculus
aagaccugcucauauccaaugucauaaaagaacccauacuggag

SEQ ID NO: 44543 - RNA, 46 nt, Mus musculus
aaugaguguguuaaagcuuucacaugugccaauuaucauucuaggc

SEQ ID NO: 44544 - RNA, 46 nt, Mus musculus
uguucaagcugauacaaauaugucuguaaggaaauuguaauaaguu

SEQ ID NO: 44545 - RNA, 46 nt, Mus musculus
gacacauuugcuauucaaugcuaagcuauuuugcaagccugguggu

SEQ ID NO: 44546 - RNA, 46 nt, Mus musculus
guucacuuuucccauuuauauauguauucaauauacauuccaauug

SEQ ID NO: 44547 - RNA, 46 nt, Mus musculus
uggaaaauaucaaaaauugagaugucaaaagucauagaaagcugua

SEQ ID NO: 44548 - RNA, 42 nt, Mus musculus
aaagugaacuuggaaccaugguacagugggugcccuggagag

SEQ ID NO: 44549 - RNA, 46 nt, Mus musculus
guucuuuguaucaauggcuugucugucacauuuguguugguguguc

SEQ ID NO: 44550 - RNA, 46 nt, Mus musculus
ccgaugccagguugacuggugucagaccuuguuacugagcccauaa

SEQ ID NO: 44551 - RNA, 45 nt, Mus musculus
gcuugucgaugaacaggaguauuuuccaauaauaaugggcucagg

SEQ ID NO: 44552 - RNA, 46 nt, Mus musculus
gcaggcacugauauuagggucugcaguaacagauagugagguaggu

SEQ ID NO: 44553 - RNA, 88 nt, Mus musculus
uagugugguagaucuauggaagcuuacuuuguguccuuucaggcauggcaugagguugagcaguaugugucugcccaagugggggcug

SEQ ID NO: 44554 - RNA, 71 nt, Mus musculus
gagauuaagcugccuuuguucuuugguaaagugcuagggacaacuguguaaauuacaucugggauagcaca

SEQ ID NO: 44555 - RNA, 44 nt, Mus musculus
ugacugaggguugccucuuugauggaccuguuuggaggguaugu

SEQ ID NO: 44556 - RNA, 46 nt, Mus musculus
ucccugucucuguucucugcacaugcuccccccccaacccccauuc

SEQ ID NO: 44557 - RNA, 45 nt, Mus musculus
ugggagccaccaugugguugcugggauuugaacucgggaccauca

SEQ ID NO: 44558 - RNA, 46 nt, Mus musculus
uucuuugcuuuauauguuuagaguuuugacaguuuguggcacaagg

SEQ ID NO: 44559 - RNA, 46 nt, Mus musculus; identical to SEQ ID NO: 44538

SEQ ID NO: 44560 - RNA, 45 nt, Mus musculus; identical to SEQ ID NO: 44539

SEQ ID NO: 44561 - RNA, 65 nt, Mus musculus; identical to SEQ ID NO: 44534

SEQ ID NO: 44562 - RNA, 46 nt, Mus musculus
ugagcacaggaucacugcccacaauggguaggggcagguuguugag

SEQ ID NO: 44563 - RNA, 51 nt, Mus musculus
uuuauauguuuagaguuuugacaguuuguggcacaaagacuuuuuuggucc

SEQ ID NO: 44564 - RNA, 45 nt, Mus musculus
gugcacagcuauaccuucccccauguuuucacuccuuucccuucc

SEQ ID NO: 44565 - RNA, 46 nt, Mus musculus
cuguuuggagguauguucaagggggaaugcuuacuaauguuggaag

SEQ ID NO: 44566 - RNA, 42 nt, Mus musculus
uauuuuguccagugguaagggcaacugauauuagggucuaga

SEQ ID NO: 44567 - RNA, 45 nt, Mus musculus
ccugauaccagguugacuggugucagacccuguuacugagcccau

SEQ ID NO: 44568 - RNA, 45 nt, Mus musculus
ugcauccgugugucuuguuuuuccuauuuuucuugauuauucuug

SEQ ID NO: 44569 - RNA, 46 nt, Mus musculus
ccuguuuuacaggguggaaaggacaaagaccucauuuucccccucc

SEQ ID NO: 44570 - RNA, 46 nt, Mus musculus
uguggaaaauaucaaaaauugagaugucaaaagucauagaaagcug

SEQ ID NO: 44571 - RNA, 46 nt, Mus musculus
uuguucacuuuucccauuuauauauuuauucaaaauacauuccaau

SEQ ID NO: 44572 - RNA, 46 nt, Mus musculus
gcaagagugucaaauaucaauccauuaccuguagcuaugauuauga

SEQ ID NO: 44573 - RNA, 45 nt, Mus musculus
gauacuuauauucuugcagacucauuccuaacuuuauagagguca

SEQ ID NO: 44574 - RNA, 47 nt, Mus musculus
ugcucuuaccaucacagcuguuuucaaagaggcaaaacaaccuauag

SEQ ID NO: 44575 - RNA, 42 nt, Mus musculus
gucaggguggucucagaaaucauaaaagaacccauacuggag

SEQ ID NO: 44576 - RNA, 42 nt, Mus musculus
ggcucagucaucuccaaugucauaaaagaacccauaccugag

SEQ ID NO: 44577 - RNA, 46 nt, Mus musculus
gcagugaaugugaaaaagacuaugaauaucacgauaguuuccaaag

SEQ ID NO: 44578 - RNA, 46 nt, Mus musculus
acccagaccugcaagucaucaccugcagcugguuccaagcaccaag

SEQ ID NO: 44579 - RNA, 48 nt, Mus musculus
auagaaaauauaaacuguguuaauuugaauaugcuuggccauaagcag

SEQ ID NO: 44580 - RNA, 45 nt, Mus musculus
ucugagcaauggaaauucuuucuaagacugaaguuaguaccccag

SEQ ID NO: 44581 - RNA, 45 nt, Mus musculus
uaaguugaauuuaauuggacaugcaaggagaaauguggaacacau

SEQ ID NO: 44582 - RNA, 46 nt, Mus musculus
aauauaagguucaauaagaaaaggcucgcugggugugguggugcac

SEQ ID NO: 44583 - RNA, 51 nt, Mus musculus
gcuauacagauaaacccugucucaaagaaaaaagaaggaaagaaagaaaga

SEQ ID NO: 44584 - RNA, 46 nt, Mus musculus
auuaggaaugauuguuaccugguuauucuuuucauguggacauaag

SEQ ID NO: 44585 - RNA, 43 nt, Mus musculus
auggacugugauuccuguucugaguuuucaauuuaacaucuag

SEQ ID NO: 44586 - RNA, 45 nt, Mus musculus
acugagacaauugauguugguuagcuguagauaaaaaauuagggg

SEQ ID NO: 44587 - RNA, 73 nt, Mus musculus
agcaggaaaacccagcauauugaaggugucagucccaugggaugagcagaaagaacagcaacagcaguagagu

SEQ ID NO: 44588 - RNA, 45 nt, Mus musculus
uugguccaguauuuccucacauugcuauuuaggaauaaaaaagua

SEQ ID NO: 44589 - RNA, 46 nt, Mus musculus
auauaaugugcuauuuguuuuugaaaauguaggggauuacaguuag

SEQ ID NO: 44590 - RNA, 46 nt, Mus musculus
guccccauauacccacguuuuugaacaaucaaaugcaggccagcaa

SEQ ID NO: 44591 - RNA, 45 nt, Mus musculus
cacaccucuauaguuuucaucauuauggaacuauuaauacuggag

SEQ ID NO: 44592 - RNA, 42 nt, Mus musculus
acaacacaguuaucuaugaacauaaaagaauacauaguggag

SEQ ID NO: 44593 - RNA, 46 nt, Mus musculus
uuuaguuaauccuguaccccacaaguuugcugaaaguguuugucag

SEQ ID NO: 44594 - RNA, 46 nt, Mus musculus
uuuguccuucucuggaauucuucauugucuuuuauuuuguccccau

SEQ ID NO: 44595 - RNA, 45 nt, Mus musculus
aacguuuaucuuagcaccacuuucauuuucuuuguguuccauaag

SEQ ID NO: 44596 - RNA, 45 nt, Mus musculus
uauccuugauguugagcuauauuauuuguauacaauagaaggaua

SEQ ID NO: 44597 - RNA, 45 nt, Mus musculus
auggcuaacuccuuguauguugucauuguucuugcugcugguggu

SEQ ID NO: 44598 - RNA, 46 nt, Mus musculus
uggcaugguagccauuuuuacuauauugauccugccaguccaugag

SEQ ID NO: 44599 - RNA, 45 nt, Mus musculus
uucuuuaauuucugucuucaaagacuuaaaguucuuaucauacag

SEQ ID NO: 44600 - RNA, 46 nt, Mus musculus
ccucucaauucccugguuucuuggacuuucuagagccuacccccag

SEQ ID NO: 44601 - RNA, 46 nt, Mus musculus
uuuaaaugcagcaucugcgaugugcugaaaggcaccuccaccagga

SEQ ID NO: 44602 - RNA, 46 nt, Mus musculus
aaaggcuccucccgcuccuccacgccaaagggcgacaugucagcag

SEQ ID NO: 44603 - RNA, 46 nt, Mus musculus
uaugauuuuccuaacaaucauuuauaauuggaugugcuccugaauc

SEQ ID NO: 44604 - RNA, 46 nt, Mus musculus
cugcgugggaacuugacucucucaucugucuuuagaguacuggaua

SEQ ID NO: 44605 - RNA, 46 nt, Mus musculus
cuaauugacaaaugacaagugguucaguuggagggcuuugaccauu

SEQ ID NO: 44606 - RNA, 41 nt, Mus musculus
ucaugaaaauaugguguucuguaucucgaauuccggccuuu

SEQ ID NO: 44607 - RNA, 46 nt, Mus musculus
aguucuuaguuccuugugugggaaaggaucgcaggggugcaugggc

SEQ ID NO: 44608 - RNA, 45 nt, Mus musculus
guguuaaccuuccuuuaguucaucacacucaaggacucauaggag

SEQ ID NO: 44609 - RNA, 89 nt, Mus musculus
aagacauuccuucuaaaguuuuaauauuccuuuuauuaagggucucagggaggguuaauuagucagccauauuuauuuuccagaggugu

SEQ ID NO: 44610 - RNA, 45 nt, Mus musculus
uggugucuuggguuuucaguuuugccuccaugauaaauuaaagaa

SEQ ID NO: 44611 - RNA, 45 nt, Mus musculus
ucuugacacccacgagaauauuuuaaucaaaaccuuucaguuugg

SEQ ID NO: 44612 - RNA, 45 nt, Mus musculus
uauuccuguuauuggcaugugcacgacuguuauuagaagccacuu

SEQ ID NO: 44613 - RNA, 43 nt, Mus musculus
cacugcucaaccaccugccccuaccgauugugggcagugaucc

SEQ ID NO: 44614 - RNA, 43 nt, Mus musculus
uacacugucaaccagagaggcaagguucacccuugguccagga

SEQ ID NO: 44615 - RNA, 53 nt, Mus musculus
acaagaagaccugcagacaggcacacagagagagaccagagagagacagccac

SEQ ID NO: 44616 - RNA, 46 nt, Mus musculus
gaauuuccacacaauagauacaguggaaaaaugguuguuugcagua

SEQ ID NO: 44617 - RNA, 46 nt, Mus musculus
aauaccuaauuaaaaaaaaaagacugaaggaaaaaaaaaaagagag

SEQ ID NO: 44618 - RNA, 45 nt, Mus musculus
aauaaaacagucagaggaggcagauggaagaaagagagaacugga

SEQ ID NO: 44619 - RNA, 46 nt, Mus musculus
uccgcagagucccccuggggcccuucacaaugacugugcgccccuu

SEQ ID NO: 44620 - RNA, 44 nt, Mus musculus
gaggacguugauggggaagugagcguacacagaccgcaucuugu

SEQ ID NO: 44621 - RNA, 74 nt, Mus musculus
cucaccauacuuuuacaaaguuauuucaacccaaaucacaauuuaagaauuauuuguucuaccuaugccacacu

SEQ ID NO: 44622 - RNA, 47 nt, Mus musculus
uaccuugaacccuaucuaaaagagguuauucgggaaagaaaggagag

SEQ ID NO: 44623 - RNA, 89 nt, Mus musculus
aaugacaggauguuucgaauuaagagagcccuggaccugacuaugaggcaucagaucuugccuaaggaucaguggacaaaauaugagga

SEQ ID NO: 44624 - RNA, 45 nt, Mus musculus
ugauaccucagguuuacccuuuggccuccacauguacuggagaua

SEQ ID NO: 44625 - RNA, 46 nt, Mus musculus
uaggguuauagugagguuucagguuaaccuuggcauaucuggacgg

SEQ ID NO: 44626 - RNA, 46 nt, Mus musculus
ggggagcauuuggagucaggcgcaggccacuucagugacagugauc

SEQ ID NO: 44627 - RNA, 70 nt, Mus musculus
uggaaagaaaugaaggaagcuaguuaaugucagauguuccagagugccuagacccgagaggaaaacagca

SEQ ID NO: 44628 - RNA, 60 nt, Mus musculus
uauuuggaccuuccuaugcagagaucauaauguacggaaagaaccgagggagcuuagggg

SEQ ID NO: 44629 - RNA, 48 nt, Mus musculus
uucaucugugccauguucuacuaaaacauucucccugucuacccugga

SEQ ID NO: 44630 - RNA, 46 nt, Mus musculus
gauguuucuuuguaucuuauuagucuuuuaacuacuuggaggcaag

SEQ ID NO: 44631 - RNA, 46 nt, Mus musculus
gcuguaaaacaaacuugcuacaaacaauccugcugcucacucacca

SEQ ID NO: 44632 - RNA, 46 nt, Mus musculus
uuuuaugaauauauuuauaacuuuuaaacauugcuuugcuuugcag

SEQ ID NO: 44633 - RNA, 46 nt, Mus musculus
aagccugauuuguuaggcuaucccugaaagccuuggaaaagcccca

SEQ ID NO: 44634 - RNA, 44 nt, Mus musculus
acauaucuagagguguauuuccaugaugauucuaaaucugguca

SEQ ID NO: 44635 - RNA, 45 nt, Mus musculus
aaucuaaaccagaggucuguccuccuguugaauuguugcaggcca

SEQ ID NO: 44636 - RNA, 43 nt, Mus musculus
ugucucuaaaaaggaggaggaagagaaaaaggaagggggaaga

SEQ ID NO: 44637 - RNA, 45 nt, Mus musculus
uaggggcauuugcauuccccugacaaagguaucauguguacagcu

SEQ ID NO: 44638 - RNA, 86 nt, Mus musculus
uuuuguuuuuguuuguuuguuuguuuuuucuugaagugccaaaggucaauuuuacagaagaugaguuuaaaaauguuuggacauuu

SEQ ID NO: 44639 - RNA, 45 nt, Mus musculus
ggagucguagagguuaguaccuagccaaaacacaaguuaggagcc

SEQ ID NO: 44640 - RNA, 48 nt, Mus musculus
acaccaugaaaacauauguaguccucuugguaagccaucaggccuuuc

SEQ ID NO: 44641 - RNA, 46 nt, Mus musculus
uugucuggugugugugugugugugugugugugugugagagagagag

SEQ ID NO: 44642 - RNA, 46 nt, Mus musculus
ucccauuuguuucucaaggaggaaaaccaagcaucugugccuucag

SEQ ID NO: 44643 - RNA, 46 nt, Mus musculus
ugagaguugaacacuggucuuuguggaugcacuuuacugaccaacc

SEQ ID NO: 44644 - RNA, 45 nt, Mus musculus
ggaguuguugcacauccagucacaaguugaacugcugagauuaga

SEQ ID NO: 44645 - RNA, 45 nt, Mus musculus
ucuagccucccaguaucugcuaauggaauaagagaagccccagca

SEQ ID NO: 44646 - RNA, 46 nt, Mus musculus
cagccuuggaacuguuucagaauguuuacuaaugucuaggccucac

SEQ ID NO: 44647 - RNA, 46 nt, Mus musculus
gucacacggguuuuccgcagaucuucacuguaucagugagucagaa

SEQ ID NO: 44648 - RNA, 42 nt, Mus musculus
ggcuaccacucagcguuagccacuggauagaauggcggagug

SEQ ID NO: 44649 - RNA, 42 nt, Mus musculus
ucggcgggggacggcgggagcgacggaagcggugggggagcc

SEQ ID NO: 44650 - RNA, 45 nt, Mus musculus
cucacgugauggggaaagggaacgucaauguugauaauugcgaga

SEQ ID NO: 44651 - RNA, 45 nt, Mus musculus
agacuaguucuguuucuuauucauggauguuacucuucaaucaga

SEQ ID NO: 44652 - RNA, 45 nt, Mus musculus
uagaacaugaaugugguaaugagcaggacaccauaagccaccaga

SEQ ID NO: 44653 - RNA, 45 nt, Mus musculus
augaaugggaaccagaaauuggauguuuauaaccaagaaaagcag

SEQ ID NO: 44654 - RNA, 46 nt, Mus musculus; identical to SEQ ID NO: 31742

SEQ ID NO: 44655 - RNA, 46 nt, Mus musculus
ccugaagauccugauggagaugggcaaguucuuccagguccaggac

SEQ ID NO: 44656 - RNA, 42 nt, Mus musculus
cuguccucaacagcgccagaucuuagaggagaauuaugggca

SEQ ID NO: 44657 - RNA, 46 nt, Mus musculus
cgucccugcccccauccaucuucauggaacuugcaaacaagaucua

SEQ ID NO: 44658 - RNA, 44 nt, Mus musculus
ugcccuggggaaccucaugccagucugcaaaccacugcccgucu

SEQ ID NO: 44659 - RNA, 45 nt, Mus musculus
gaugacgacguugauggggaagugagcguacacagaccgcaucuu

SEQ ID NO: 44660 - RNA, 46 nt, Mus musculus
ccuccgcagagucccccuggggcccuucacaaugacugugcgcccc

SEQ ID NO: 44661 - RNA, 42 nt, Mus musculus
cuugaugggcugcacgcgacucguguccaugauggcggcgau

SEQ ID NO: 44662 - RNA, 42 nt, Mus musculus
ggaagagaagcguggucauccugugcugcacgucugccaguc

SEQ ID NO: 44663 - RNA, 51 nt, Mus musculus
cuaccugaagaaugucacauaguccucccucccccacccuugccccaaccc

SEQ ID NO: 44664 - RNA, 45 nt, Mus musculus
augcaugcaaacccaccccaaauaaaggaauacucacaaacuaag

SEQ ID NO: 44665 - RNA, 46 nt, Mus musculus
aacacaacugaacagaugaaggaauuaaacaaaaccauccaggauc

SEQ ID NO: 44666 - RNA, 49 nt, Mus musculus
acagaaagaccaacaccagaaauaaccagauggcaaaaggcaagcgcaa

SEQ ID NO: 44667 - RNA, 67 nt, Mus musculus
cccucauggugucuaggcacugcuacacaccaggcuggaaggaagcagaggccagaagaggugaggu

SEQ ID NO: 44668 - RNA, 62 nt, Mus musculus
ucaacagcagggaucgacuggaauccccauguaauaggugugguauguguacucuauuucuu

SEQ ID NO: 44669 - RNA, 42 nt, Mus musculus
cccgugggcaggaauuucacuaaccuuagguucuuacaacag

SEQ ID NO: 44670 - RNA, 46 nt, Mus musculus
aguucccaucauauucaucacuucugguaaccccaccuuucccuag

SEQ ID NO: 44671 - RNA, 46 nt, Mus musculus
agaagcuaggguuugcuaagucaaucuagccuacaaggaucaccgg

SEQ ID NO: 44672 - RNA, 46 nt, Mus musculus
gccaagcugagagggcaguggagcagcuaggcaaggccugcaaaga

SEQ ID NO: 44673 - RNA, 44 nt, Mus musculus
auccuggccaaugggacccccaagaaggaaacaccaaggacaga

SEQ ID NO: 44674 - RNA, 45 nt, Mus musculus
augaacccuguccagacaggucuaugggguguguggguugugugg

SEQ ID NO: 44675 - RNA, 45 nt, Mus musculus
gccaugagagaccauauguagaccauaagguuccugcuuccagag

SEQ ID NO: 44676 - RNA, 46 nt, Mus musculus
gcagagagggacaagagguggaagggcacugaugucggucucucag

SEQ ID NO: 44677 - RNA, 24 nt, Mus musculus
ugcuaccaggccuuccugcucaag

SEQ ID NO: 44678 - RNA, 45 nt, Mus musculus
auaguggguaccuacugagaucacuauaaagauaaaauaggggga

SEQ ID NO: 44679 - RNA, 45 nt, Mus musculus
ccaggggaagggcguggucugugcugggcggggucccgugagaag

SEQ ID NO: 44680 - RNA, 45 nt, Mus musculus
agauuauacagacacgccacuggagaagccucugaagcuggugcu

SEQ ID NO: 44681 - RNA, 106 nt, Mus musculus
ccagcuacuacgacgaucgcucagaccacgaacgggagagacacagagaaaagaagaaaaagaagaagaaaaagucagagaaggagaagcaccucgaugaggagga

SEQ ID NO: 44682 - RNA, 66 nt, Mus musculus
cuggaaagaagguggagguggagccacccccagaccgaccagugagagccugccgaacacagccag

SEQ ID NO: 44683 - RNA, 46 nt, Mus musculus
gcagggugugggcagccugggugcaggucacaacuuuaagggccag

SEQ ID NO: 44684 - RNA, 46 nt, Mus musculus
uauucaaugauaauaaaacauccuauggacuuuggcacgaugaaag

SEQ ID NO: 44685 - RNA, 45 nt, Mus musculus
gcaagaugguuaugaccauguagcaagaugguugcuacaagauag

SEQ ID NO: 44686 - RNA, 46 nt, Mus musculus
acucugucgggugacucaccugaguagcucagaaugaaaugaugag

SEQ ID NO: 44687 - RNA, 46 nt, Mus musculus
caguuuuuucugaauucccagacuucaaaguccaugaaaugcuaca

SEQ ID NO: 44688 - RNA, 46 nt, Mus musculus
cagcuguggcuguuaaagggucauccucuuguugcagcaucucuua

SEQ ID NO: 44689 - RNA, 45 nt, Mus musculus
ccuuucauaccuaugcaauuucugccacuuuuuauuuuucuguuu

SEQ ID NO: 44690 - RNA, 51 nt, Mus musculus
cugagaagggguucuguuuggcuugcacuuuuuuacuucagguagagauca

SEQ ID NO: 44691 - RNA, 45 nt, Mus musculus
cgucacccagugcugccucugcaagggaacuguugauaaaagcua

SEQ ID NO: 44692 - RNA, 42 nt, Mus musculus
acuauauccggcuuggguuggggccacuucugacugacccua

SEQ ID NO: 44693 - RNA, 46 nt, Mus musculus
uguguccuaaggcuugcuuuggugugugcacagguaugcauuggag

SEQ ID NO: 44694 - RNA, 46 nt, Mus musculus
ccugguugguuuugugugucaacuugacacaaguuagagucaucag

SEQ ID NO: 44695 - RNA, 45 nt, Mus musculus
caguccaaagaugaguaaauuuuauuugugugugugugugugugu

SEQ ID NO: 44696 - RNA, 42 nt, Mus musculus
acuuucugagagagaaagcuuugguuuugaaaucugcugugu

SEQ ID NO: 44697 - RNA, 45 nt, Mus musculus
uuguggccuaccucccauauucucacagugcuauuuauaccccua

SEQ ID NO: 44698 - RNA, 46 nt, Mus musculus
cuuuuaggacaaaaaccagaacagucucuggagagagaaggcacag

SEQ ID NO: 44699 - RNA, 42 nt, Mus musculus
gggccacacuuccuaguccuuugcaaacaguuccacugacug

SEQ ID NO: 44700 - RNA, 46 nt, Mus musculus
cacugccuucaggaacuacuuccccuagccugguugcagcugccag

SEQ ID NO: 44701 - RNA, 42 nt, Mus musculus
augucgcccacgacccuuaugaauuccuucagucuccagaac

SEQ ID NO: 44702 - RNA, 45 nt, Mus musculus
cuccugagcaccagcagccaagccuguucaugaugaugugcacac

SEQ ID NO: 44703 - RNA, 46 nt, Mus musculus
gccagaggauggaguugucucccugacaaauaaugaaccaccccac

SEQ ID NO: 44704 - RNA, 46 nt, Mus musculus
ugcgcgaccacguccggcucagugucuauuuuuuaugagcugcugu

SEQ ID NO: 44705 - RNA, 45 nt, Mus musculus
ugauaccaacgagcaggacccuaguuuuaguucucagcaucagag

SEQ ID NO: 44706 - RNA, 46 nt, Mus musculus
cuaaaacuaggguccugcucguugguaucaggaaccagcuugccag

SEQ ID NO: 44707 - RNA, 46 nt, Mus musculus
uuugucucuguccaccccaacccaccccaauaaaccucugccacau

SEQ ID NO: 44708 - RNA, 46 nt, Mus musculus
caagaguuaagagccauuaggaaagaaucagaacacugauccaguu

SEQ ID NO: 44709 - RNA, 44 nt, Mus musculus
cccaauucucugagacuuaccuaagcaauguuuggaucuuccca

SEQ ID NO: 44710 - RNA, 47 nt, Mus musculus
aguugggggagcaucgaaggccuuggugggcaaggugagugagguca

SEQ ID NO: 44711 - RNA, 45 nt, Mus musculus
uccacggcccuuauaggaccauggcauuugcaguggggcucugag

SEQ ID NO: 44712 - RNA, 45 nt, Mus musculus
gcuugaaacuuuggggaacaauuguaaauuuugauuuucuguggg

SEQ ID NO: 44713 - RNA, 46 nt, Mus musculus
accuucuuggugcguuuagccaugucgccggaacccaagcccaagu

SEQ ID NO: 44714 - RNA, 44 nt, Mus musculus
ccagaugccgacggcucgucucuucaucuuggucuugccacaga

SEQ ID NO: 44715 - RNA, 26 nt, Mus musculus
gucuguuuggugguucaguguuuuga

SEQ ID NO: 44716 - RNA, 46 nt, Mus musculus
uccaauuuucugagugcggcaaaaagcuuuauugcuuacuucucag

SEQ ID NO: 44717 - RNA, 46 nt, Mus musculus
guugccgauuugccuuacagaaauuuuccaguuucaugagguccca

SEQ ID NO: 44718 - RNA, 47 nt, Mus musculus
gacaaauauggguguauuuucauuuuuguacauacagacagccaguu

SEQ ID NO: 44719 - RNA, 45 nt, Mus musculus
aacaccaugcagcuuuuauuacuauuacucuguaguaaagcuuga

SEQ ID NO: 44720 - RNA, 45 nt, Mus musculus
uuuguauucucccuuagucuuuuagggauuuaagauuaaugcagg

SEQ ID NO: 44721 - RNA, 46 nt, Mus musculus
auuuuucuuuauagcuguauaguauuccacaguguaccugcaccau

SEQ ID NO: 44722 - RNA, 44 nt, Mus musculus
gcaaacuuuauaugccccaauacaggggaaugccagggccuaga

SEQ ID NO: 44723 - RNA, 46 nt, Mus musculus
agccugagucugagucccugaagcucugguuuucaccagauaccuu

SEQ ID NO: 44724 - RNA, 46 nt, Mus musculus
aguauucuguuucuccuuauucuuuuuccuuucuugugagggacag

SEQ ID NO: 44725 - RNA, 46 nt, Mus musculus
accauguuagucauuaaaauauuuuuauauuuaauguuuaaaauag

SEQ ID NO: 44726 - RNA, 46 nt, Mus musculus
guaauauuuagaaauuuguguggauuaaaaggaugagaucagucag

SEQ ID NO: 44727 - RNA, 46 nt, Mus musculus
uggcucacaaccauccguaaugagaucugauacccucuucuggagu

SEQ ID NO: 44728 - RNA, 35 nt, Mus musculus
cucuuggcaggaagccuccuuuaaaaauguagagc

SEQ ID NO: 44729 - RNA, 104 nt, Mus musculus
uaacaugacuguuccaaaccucgucaacugagaaagagaagacaggaagaaguuggggggagagagggagagagagagggagagggagaaaggaggaagaagag

SEQ ID NO: 44730 - RNA, 27 nt, Mus musculus
uagauaagagaggaaguggggaggaau

SEQ ID NO: 44731 - RNA, 42 nt, Mus musculus
gccuagaagcaaagacagagauaguaauaaucuagggugcua

SEQ ID NO: 44732 - RNA, 46 nt, Mus musculus
uugauuugaggggaauuuuaaagguaguaucacaauguuaaaggag

SEQ ID NO: 44733 - RNA, 46 nt, Mus musculus
gcagggagaccucucacuggagauuagaugugguaauuagaugcag

SEQ ID NO: 44734 - RNA, 45 nt, Mus musculus
gaucugccuugcauguugauaucaucaugaauagauauacccuag

SEQ ID NO: 44735 - RNA, 46 nt, Mus musculus
augucaacaggcaggcauggugcugaagugugggagcuuuagucag

SEQ ID NO: 44736 - RNA, 46 nt, Mus musculus
cagguuguauuuauauauguacaacaauaauaaaaaagagggugag

SEQ ID NO: 44737 - RNA, 24 nt, Mus musculus
caacagaugaaauuaaucuacuag

SEQ ID NO: 44738 - RNA, 45 nt, Mus musculus
uuagaugacacaauuaccaugugugauaggcauucagcugugcag

SEQ ID NO: 44739 - RNA, 45 nt, Mus musculus
ggaaauagaaacaauaaagaaaucacaaagggagacaguccugga

SEQ ID NO: 44740 - RNA, 46 nt, Mus musculus
cauauguuuaugcacucacugauaagugaauauuagcccaugccca

SEQ ID NO: 44741 - RNA, 42 nt, Mus musculus
accaccaaccaaagaauacacguggagggacccauggcucua

SEQ ID NO: 44742 - RNA, 46 nt, Mus musculus
uguuaauuuucuuuagugagauaaagacauuaugguaaugcagaag

SEQ ID NO: 44743 - RNA, 46 nt, Mus musculus
cuuccucaagucucucuucugguguuggaucacuugcugaaaugaa

SEQ ID NO: 44744 - RNA, 46 nt, Mus musculus
acacaacaaaauacuaggccugcuauuuccuugaaccguuugccag

SEQ ID NO: 44745 - RNA, 46 nt, Mus musculus
ccaggauuuuauaucugagagaugaccauguaggacagugagaagg

SEQ ID NO: 44746 - RNA, 45 nt, Mus musculus
ugaguuugauuaguggauuaggagagcaaguaagguaaacaaaau

SEQ ID NO: 44747 - RNA, 46 nt, Mus musculus
augugcaccucuggugugcuggggccucuuuugggucuaugggcaa

SEQ ID NO: 44748 - RNA, 45 nt, Mus musculus
guguuugugagaauuacucccuugucugagugcaucugucagaag

SEQ ID NO: 44749 - RNA, 50 nt, Mus musculus
acagccaaccuuuggacugagcacagggucccagauggaggaauuugaga

SEQ ID NO: 44750 - RNA, 42 nt, Mus musculus
agagacagacuauuugggaagaagggcuucaacaggaguggg

SEQ ID NO: 44751 - RNA, 46 nt, Mus musculus
uucagccuuuuguuggguuuuucgagggacagucccuuucugugag

SEQ ID NO: 44752 - RNA, 46 nt, Mus musculus
ccuuuuuaugagugcuccauaaccucaguaguagugucaugccuag

SEQ ID NO: 44753 - RNA, 46 nt, Mus musculus
auuagaaaauauuauuucuuuuuagauuuaccuguaguggagagag

SEQ ID NO: 44754 - RNA, 46 nt, Mus musculus
uguaaaugaagaaaauaccuaauuaauaaaaaauaugcaugcaguu

SEQ ID NO: 44755 - RNA, 46 nt, Mus musculus
gaguucuguaggcuucuuguaucuauaugggcaucucuuccuuuag

SEQ ID NO: 44756 - RNA, 46 nt, Mus musculus
ucuuguucauucuacccuuaaagaaaacugacaaucccagcagcag

SEQ ID NO: 44757 - RNA, 44 nt, Mus musculus
aagccucgugacuggcgagggggcguggccugcggugcgugaau

SEQ ID NO: 44758 - RNA, 41 nt, Mus musculus
agagcuuuaucuggcuccuuucagcaagcacuuauuggcau

SEQ ID NO: 44759 - RNA, 46 nt, Mus musculus
cuugaguuuuauguguuuugugggaaaaaaaauguucaaccuucuu

SEQ ID NO: 44760 - RNA, 41 nt, Mus musculus
cucaauuaguauaaucaaaauagucugacaacuaggcacag

SEQ ID NO: 44761 - RNA, 46 nt, Mus musculus
ggucaguugaauuaaccauacaugaggcuggggagaauauauccag

SEQ ID NO: 44762 - RNA, 46 nt, Mus musculus
auuuuggaagaccuuuuugaagaauauuuuaauagugagugcccuu

SEQ ID NO: 44763 - RNA, 75 nt, Mus musculus
aacucagcucucagauggggauuagaaagagcauuguuagagaugugauuccuaugaagggcagcagaaagagaa

SEQ ID NO: 44764 - RNA, 41 nt, Mus musculus
aaauauuaaaaacaguaacacaagaaaggaagaaaaggaga

SEQ ID NO: 44765 - RNA, 42 nt, Mus musculus
gacauggggcaauuaaucuuccaguaagcguugucaggcaga

SEQ ID NO: 44766 - RNA, 65 nt, Mus musculus
gucaucaucuucugaugguacagaugagccagcagggaagcgggaaaggagagauaaggucucca

SEQ ID NO: 44767 - RNA, 46 nt, Mus musculus
ugcuugguuaaagucacaccaagguauuuuauaugauugugacuag

SEQ ID NO: 44768 - RNA, 33 nt, Mus musculus
ugggguuuucuuuuuuugguuuguuuuuuuuuu

SEQ ID NO: 44769 - RNA, 46 nt, Mus musculus
aaccgcugaggggugugugugugugugugugugugugugugugugu

SEQ ID NO: 44770 - RNA, 46 nt, Mus musculus
aguguaggugcuuugguccuuagaagggguaauaaaauauccaugg

SEQ ID NO: 44771 - RNA, 42 nt, Mus musculus
aagccaaccaugggacugagcacaggguucccaauggaggag

SEQ ID NO: 44772 - RNA, 42 nt, Mus musculus
auaggggagcacucucauagaagcagggagaaagcugauggg

SEQ ID NO: 44773 - RNA, 41 nt, Mus musculus
gcaugaggggcagaggguuuggagagacagcaagagaggag

SEQ ID NO: 44774 - RNA, 46 nt, Mus musculus
aggggccaagaaagugauuaguuagccaaaauggcugggguuacag

SEQ ID NO: 44775 - RNA, 28 nt, Mus musculus
ugucagaaacuagagauuggagguuggu

SEQ ID NO: 44776 - RNA, 45 nt, Mus musculus
uacccacucauucccacuuuuuggcccugguguuccccuguacug

SEQ ID NO: 44777 - RNA, 46 nt, Mus musculus
caccacccagauuaucuguguuaaaauuaauguuucauaaaauaaa

SEQ ID NO: 44778 - RNA, 41 nt, Mus musculus
gauuuucgguuguguuggggugcucaggacuaggcggggug

SEQ ID NO: 44779 - RNA, 46 nt, Mus musculus
guguaggccuacuggcugucucuacccugggaacaagagggaaggg

SEQ ID NO: 44780 - RNA, 45 nt, Mus musculus
ucaaaagacagucccugguuuaaaggcauuuauuguagaaaggca

SEQ ID NO: 44781 - RNA, 46 nt, Mus musculus
gggaagggaaugcagaaagggggagcaagaaagugagagacaagag

SEQ ID NO: 44782 - RNA, 45 nt, Mus musculus
gaauaugaaguuaaauguauaguaacugagcagaaucugggagga

SEQ ID NO: 44783 - RNA, 46 nt, Mus musculus
cucugugaguguagcagaacuuuauauuguuaauccgaagugggcu

SEQ ID NO: 44784 - RNA, 45 nt, Mus musculus
ccaugaaauaucacaaaaugaguagucuuaaauaucugccccuag

SEQ ID NO: 44785 - RNA, 46 nt, Mus musculus
gccuauaauucacuuuguagaacaggcuagccucaaacucaaagag

SEQ ID NO: 44786 - RNA, 45 nt, Mus musculus
uggcuccuuucauguuucuacacauuguucugcagugcucuguga

SEQ ID NO: 44787 - RNA, 45 nt, Mus musculus
cuugaauaacacagcaccuuuuuuuauccaaauaucuuaucuuca

SEQ ID NO: 44788 - RNA, 42 nt, Mus musculus
aauuuuggaguauauaauuacauuguuaagcacucagcagag

SEQ ID NO: 44789 - RNA, 45 nt, Mus musculus
uuuuuagaauauucaacccuaauaagagagagagagagagagaga

SEQ ID NO: 44790 - RNA, 45 nt, Mus musculus
ccauuuaugggugacacguuuaguuuaauuagguuacaugcaaca

SEQ ID NO: 44791 - RNA, 45 nt, Mus musculus
aguucaucagguuguauuuguauauaauuuugauauaguuuucau

SEQ ID NO: 44792 - RNA, 46 nt, Mus musculus
gugugugugucugugugucugugugucucugugugugugugugugu

SEQ ID NO: 44793 - RNA, 45 nt, Mus musculus
aggaacagcuuaggucuuacaucuugauacucaaguaggaggcua

SEQ ID NO: 44794 - RNA, 42 nt, Mus musculus
acuuccuucacagaauuugguauuuaguaaagguagcaacuu

SEQ ID NO: 44795 - RNA, 41 nt, Mus musculus
aaaaaaggugaaagaaagaaagaaagaaagaaagaaagaaa

SEQ ID NO: 44796 - RNA, 46 nt, Mus musculus
uauagacaguuugauuuagacaugacucaaaagaagaucucagaag

SEQ ID NO: 44797 - RNA, 46 nt, Mus musculus
uuagaauacccaagauacaguuugcaaaacacauuaaacucaagaa

SEQ ID NO: 44798 - RNA, 41 nt, Mus musculus
gggucuccacgaggggauaucuaccccgagucucauaggug

SEQ ID NO: 44799 - RNA, 89 nt, Mus musculus
auagacaaauauuuauuagauagcaguacauacuaagcacaaaguaaaauaugugagaggggaaaccagaguuacaaggacugugguuu

SEQ ID NO: 44800 - RNA, 48 nt, Mus musculus
uauuuaggagaaaacaacagguuuucuucuugaccacuaauuaagaua

SEQ ID NO: 44801 - RNA, 72 nt, Mus musculus
gaggucugugagcaucccuccaugucagcugagagaagcgugggggcugggggagaguuggggcuggcuuug

SEQ ID NO: 44802 - RNA, 118 nt, Mus musculus
ugaagugauaugauuagauuuucugugguuauuugcgauuagguuuggauugcuuugacaugauuauggaagguuaucuguggcagcacuaugaaagaugaaccugaaagggaagcag

SEQ ID NO: 44803 - RNA, 46 nt, Mus musculus
agagcuguaaaccugagcuaggagcaugguagaaagacuuaauaag

SEQ ID NO: 44804 - RNA, 42 nt, Mus musculus
auggucaugugguuuuugucuuucagucuguuuaugugguag

SEQ ID NO: 44805 - RNA, 42 nt, Mus musculus
auagcugaguauuaauuauuccacuguguaaaugagccacau

SEQ ID NO: 44806 - RNA, 42 nt, Mus musculus
uaacaagauuaacagguccucauuucccagggauucaccuag

SEQ ID NO: 44807 - RNA, 49 nt, Mus musculus
uguauuguaauuguucuuauaauauguauuagaaaaggguauguauaac

SEQ ID NO: 44808 - RNA, 46 nt, Mus musculus
guagagcacagugagcuaauacaggguccacaugagguucauagga

SEQ ID NO: 44809 - RNA, 42 nt, Mus musculus
auauccauguaaguaaaaugguucacuuuuuuuauuggcagu

SEQ ID NO: 44810 - RNA, 46 nt, Mus musculus
ccaagaaaguaaucauucaacaaaccaaaaagaagacagucacaag

SEQ ID NO: 44811 - RNA, 46 nt, Mus musculus
ugagaaaggccauugaucuguuugaguugauuuuauauccagcuac

SEQ ID NO: 44812 - RNA, 46 nt, Mus musculus
gugucuaugugucuauguuuaguuuuuguuuccaggaucuguccau

SEQ ID NO: 44813 - RNA, 46 nt, Mus musculus
cugagauggcccccuucucccucauuugauacccugucuuccugcu

SEQ ID NO: 44814 - RNA, 45 nt, Mus musculus
ugaagccuggaaguccgccaaagagagcuauagauaggcagcuga

SEQ ID NO: 44815 - RNA, 46 nt, Mus musculus
acuguuccauaucgcacaccuuuucuccccacccuccaaccccugu

SEQ ID NO: 44816 - RNA, 46 nt, Mus musculus
gggggccuuauaucagcuaguauaugcugucucguugguggcccag

SEQ ID NO: 44817 - RNA, 52 nt, Mus musculus
ggugggagugggugggugguauaaggggaaggagaaggggauagcaggaagg

SEQ ID NO: 44818 - RNA, 45 nt, Mus musculus
uugacuagaauguacaucucugacaccaugagugaucauugacua

SEQ ID NO: 44819 - RNA, 46 nt, Mus musculus
acaauugccugaaaauaauacccuugcuuauuuugucccuucuauc

SEQ ID NO: 44820 - RNA, 45 nt, Mus musculus
gguuucucuguguaguaacgcucacuguucuggacuuguucugua

SEQ ID NO: 44821 - RNA, 46 nt, Mus musculus
gguucccaacacugaccagagugcacaguggaucuugauggagcag

SEQ ID NO: 44822 - RNA, 46 nt, Mus musculus
gaauuguaauccaaauuuggucucuuuuauaucuuauuccugccag

SEQ ID NO: 44823 - RNA, 46 nt, Mus musculus
gccaggaaugggauuggguggguuggggagcagggggagaggagag

SEQ ID NO: 44824 - RNA, 46 nt, Mus musculus
gaaauaugugucuuuaauaugaugcaccauuacuaugguucuaaag

SEQ ID NO: 44825 - RNA, 41 nt, Mus musculus
ucucauccaugaaauucaaggauccagugaaagauggcgag

SEQ ID NO: 44826 - RNA, 42 nt, Mus musculus
uaucugugugugucugugucuguguguguguguguguguuug

SEQ ID NO: 44827 - RNA, 46 nt, Mus musculus
uaagaagaggcaaaauauccacacuuuggucuucauucuucuugag

SEQ ID NO: 44828 - RNA, 28 nt, Mus musculus
gagggagaagaaagcaaucacagugggg

SEQ ID NO: 44829 - RNA, 43 nt, Mus musculus
auucccagcaaccacaugauggcucacaaccauccauaauagg

SEQ ID NO: 44830 - RNA, 42 nt, Mus musculus
ccucguaacccgguguguguuuccgcaggcaccgaccgucac

SEQ ID NO: 44831 - RNA, 46 nt, Mus musculus
ccuauuuuuauucuaggcacacagugguagaaagguaaggugugag

SEQ ID NO: 44832 - RNA, 46 nt, Mus musculus
ccaagaggaucaaugugcggauugagcacagcaagcacucaaagag

SEQ ID NO: 44833 - RNA, 45 nt, Mus musculus
ccagccgguguaucuguuuugagugucuguuuucugaaacgaaca

SEQ ID NO: 44834 - RNA, 46 nt, Mus musculus
auccaucugaguuuauugaauuugugucuugguuucaggguugcga

SEQ ID NO: 44835 - RNA, 68 nt, Mus musculus
aauaaaauaaaauaaacaguauuaauuggucuuuggaacccugcaccuguaguuaggaaucuagugug

SEQ ID NO: 44836 - RNA, 88 nt, Mus musculus
gcuagagaagcccugcuaggcacugauuauaaaugcuguucuuauagggaccagcagcuucucaaaguucuaugguaagggaacagau

SEQ ID NO: 44837 - RNA, 46 nt, Mus musculus
uuacaagagaaauugaaggcuucuccugaauuggagccaccagcua

SEQ ID NO: 44838 - RNA, 45 nt, Mus musculus
ggaguuccuuauguucucucaucagccuacuugggauuacuguca

SEQ ID NO: 44839 - RNA, 46 nt, Mus musculus
cuuacauuauauuuuuauagauuuuguuauaaucauggugcuggga

SEQ ID NO: 44840 - RNA, 41 nt, Mus musculus
gacacugucucaggaaggguaaauuuagaaguuaccgggga

SEQ ID NO: 44841 - RNA, 45 nt, Mus musculus
acggaaucaagaaacgccggcuccaauacugccuauacacagaau

SEQ ID NO: 44842 - RNA, 45 nt, Mus musculus
cuuuguuagaagcgguucaauccuguuucggaccaguucuggggg

SEQ ID NO: 44843 - RNA, 48 nt, Mus musculus
augaaauaagaagagacaaagacuuuugccucgaagaguucagacuug

SEQ ID NO: 44844 - RNA, 45 nt, Mus musculus
gcccuuuccgggccauucugccuguccccuuagcaucugcuccga

SEQ ID NO: 44845 - RNA, 45 nt, Mus musculus
ggggacguccggaggaaagggaaaaauaaaaauaaaagcgagugg

SEQ ID NO: 44846 - RNA, 46 nt, Mus musculus
uccagauuguuuauuuugcuuuccugucauuuuagaggaauagaga

SEQ ID NO: 44847 - RNA, 46 nt, Mus musculus
gauuaagaaaauguuaucucaguuccccccaacccccaacgcccag

SEQ ID NO: 44848 - RNA, 45 nt, Mus musculus
auauuuagcuguggagacuuuuuaacuucuuguuugaugacugag

SEQ ID NO: 44849 - RNA, 46 nt, Mus musculus
gcuguucuucaugaucccuucaugccuucaaaaccaguaccaccug

SEQ ID NO: 44850 - RNA, 42 nt, Mus musculus
gacuugaugacauuguuauauuaaccaaagauauccaggaag

SEQ ID NO: 44851 - RNA, 45 nt, Mus musculus
cucucaguuggacauauccuauucugucacuuuuucugccacuug

SEQ ID NO: 44852 - RNA, 46 nt, Mus musculus
cagagggauuaaaagugugaaugagucacacccuaacuagaagcag

SEQ ID NO: 44853 - RNA, 36 nt, Mus musculus
cccuugugauggaaacucaaccugcaaagaaacauu

SEQ ID NO: 44854 - RNA, 46 nt, Mus musculus
aguccaggaauagagcugugugaggagaauucugagugcuugugag

SEQ ID NO: 44855 - RNA, 46 nt, Mus musculus
uuggcuaauuaguauguauucuaaaaauacacuuuuagggaguggg

SEQ ID NO: 44856 - RNA, 46 nt, Mus musculus
aggaucgagauaaccuuaauauuaagcuuaaguuugggugccuuag

SEQ ID NO: 44857 - RNA, 25 nt, Mus musculus
uucuguuguucaguguucuguaucc

SEQ ID NO: 44858 - RNA, 44 nt, Mus musculus
uaggagaaugacuacauuaacuccuacuucgacaacggcgauga

SEQ ID NO: 44859 - RNA, 68 nt, Mus musculus
agaaaacgaagagaaagaagggagcaaagagaaagauaaagaugaugaggaggauggcgaggaagaug

SEQ ID NO: 44860 - RNA, 46 nt, Mus musculus
agguaggauagaaauccugaaaagaaagcguugcggauuagaauuc

SEQ ID NO: 44861 - RNA, 46 nt, Mus musculus
uacaucacucauuaauucugcagauguguugaaaacgauugaggua

SEQ ID NO: 44862 - RNA, 45 nt, Mus musculus
ucauguaguugagacuauucuugcuucuuggagcuuacaguuagg

SEQ ID NO: 44863 - RNA, 46 nt, Mus musculus
auagcaaacgauacaugaaggucuauaaagaagaauggguaccagg

SEQ ID NO: 44864 - RNA, 41 nt, Mus musculus
auugcauggaaucaucagucaccuccaaaccuugaggggag

SEQ ID NO: 44865 - RNA, 42 nt, Mus musculus
aaagugcugacucacuccuccugccuuaacaaugccaaagag

SEQ ID NO: 44866 - RNA, 96 nt, Mus musculus
acgggagaagaugaggauuacaugcuggccuugaagcaggaguugagggaaacagugaaacgauugccguacuuuauugaaccacccgaagaaaaa

SEQ ID NO: 44867 - RNA, 46 nt, Mus musculus
uuucugacaaguuggcucacaguacugcugccucuguucauuuaga

SEQ ID NO: 44868 - RNA, 46 nt, Mus musculus
gcuuccucagcaguuacuauaguuacuauuauuugacuuaggcaga

SEQ ID NO: 44869 - RNA, 42 nt, Mus musculus
cugguuugaacacagcaacugcuauugcccuugcccccugcu

SEQ ID NO: 44870 - RNA, 45 nt, Mus musculus
ccaaauaaugaagccuuggaaugggucacuuauuguauauagaga

SEQ ID NO: 44871 - RNA, 87 nt, Mus musculus
uuuucuuaauuguuggcacccuugauagugaggagagggguuggugauaaaauuuuucuuuaaaaagaaaaaccuaaauggccguca

SEQ ID NO: 44872 - RNA, 50 nt, Mus musculus
cagugagaaagaagggaguuuauccucuuacaagagaagacuaugcaaau

SEQ ID NO: 44873 - RNA, 46 nt, Mus musculus
cugcugcugcggucuuccaaaccguuuaaaguuuucguagccagau

SEQ ID NO: 44874 - RNA, 86 nt, Mus musculus
uucuugcuuccucugcugcaccgugugcucaagccucgagacuuggcuagcagguaacuggaagcuaucccguucugggcaggagg

SEQ ID NO: 44875 - RNA, 41 nt, Mus musculus
accgggcaaugcugcccugcucgggguucuacugcaggggc

SEQ ID NO: 44876 - RNA, 45 nt, Mus musculus
auuuucagcuuuuguaacgaguaggcuuuuaagcaauggcaccuu

SEQ ID NO: 44877 - RNA, 44 nt, Mus musculus
aucagucaguacucuaacccacugagccaucucucaugccccua

SEQ ID NO: 44878 - RNA, 44 nt, Mus musculus
acuucuugaguucguuauauauuuuggauauuagcccucuguca

SEQ ID NO: 44879 - RNA, 45 nt, Mus musculus
auguugagguccuugauccacuggaacuugaguuuugugcaggga

SEQ ID NO: 44880 - RNA, 93 nt, Mus musculus
uguuuguuuguuuguuuuaucacuacugcucuguaguagagcuugaggucaggaaugguuauuucuccaaagguucuuuucuaguucaagauu

SEQ ID NO: 44881 - RNA, 58 nt, Mus musculus
auuuugguaagauggccauuuuuacuauuuuacuacugauccaugagcaugggagauc

SEQ ID NO: 44882 - RNA, 46 nt, Mus musculus
cuugcuuguuuaguguuacaugaaaaauuuuauauuauuuguggau

SEQ ID NO: 44883 - RNA, 46 nt, Mus musculus
guuguuuauuagcuguaggaguucucugguagaauuuuggggauug

SEQ ID NO: 44884 - RNA, 45 nt, Mus musculus
ggggaucaauuauaucuccuuuaaaggccucuaugaucuucuuga

SEQ ID NO: 44885 - RNA, 46 nt, Mus musculus
acucggcagcuggguugguguugguucaaauuuuaggagucaucaa

SEQ ID NO: 44886 - RNA, 46 nt, Mus musculus
gcuauagggguagaaaguacaauggaaucagacagacaagcucaag

SEQ ID NO: 44887 - RNA, 25 nt, Mus musculus
aacucugaggacaaagaagacccua

SEQ ID NO: 44888 - RNA, 84 nt, Mus musculus
guaacaaaucuaauggacaggagaaucaaaacaaagcaugaggaugauggagucggugcccugaugaugacuguacagguguag

SEQ ID NO: 44889 - RNA, 42 nt, Mus musculus
aauguaggaagcauuuuuaaaacucgagguggaguagagcag

SEQ ID NO: 44890 - RNA, 46 nt, Mus musculus
agccuccuugucuggggaccaccugcucacacaugugaaguaucag

SEQ ID NO: 44891 - RNA, 46 nt, Mus musculus
guguuaggcauggacucuaccacuaacccacaacuucagccuucag

SEQ ID NO: 44892 - RNA, 46 nt, Mus musculus
gaacaugaaaguaagcuuacgucugucuagaagcaucuagcuuggg

SEQ ID NO: 44893 - RNA, 45 nt, Mus musculus
uuacugaauggugcuggauccagcuaccucccugucuucuugcag

SEQ ID NO: 44894 - RNA, 103 nt, Mus musculus
ucuucauccuccuccuccucugcuuucuccuccuccucugccuccuccucuuccucuucuuccucuaccaccaccacuugugccuuguuugccuccagucuca

SEQ ID NO: 44895 - RNA, 46 nt, Mus musculus
ccagaaaaggaaagaaaagcauagagaacaucucucaucauggaag

SEQ ID NO: 44896 - RNA, 44 nt, Mus musculus
ggcaguccgugguuuuaaggcguuuuauuguagauaggcagaga

SEQ ID NO: 44897 - RNA, 46 nt, Mus musculus
cguggucauaacagaaagaauauuugugaguagagagagcacugug

SEQ ID NO: 44898 - RNA, 46 nt, Mus musculus
agggacaagaaacacaaagaaugaaagcaagacaauuagacugauu

SEQ ID NO: 44899 - RNA, 42 nt, Mus musculus
acgucucugguucuguucucaaaaccaaguuuucuggcccug

SEQ ID NO: 44900 - RNA, 44 nt, Mus musculus
guugagcgguucccgugguaaaguccccgaguggaacaucucug

SEQ ID NO: 44901 - RNA, 46 nt, Mus musculus
cagcgagaaacagaagaagcgagggaaagugggagaggcgcuauag

SEQ ID NO: 44902 - RNA, 45 nt, Mus musculus
ggcuuaccccgagggcccguggcuuggugguuuccuggcucgaug

SEQ ID NO: 44903 - RNA, 26 nt, Mus musculus
uagggugggcacaggggcuggcucgc

SEQ ID NO: 44904 - RNA, 46 nt, Mus musculus
guggucacucauggaugaagcuguaccucugcagcagugguugaag

SEQ ID NO: 44905 - RNA, 45 nt, Mus musculus
uaccacaacagaccguggcauagcugguuuaaacacugaacagaa

SEQ ID NO: 44906 - RNA, 43 nt, Mus musculus
uuaaaccagcuaugccacggucuguugugguaagugaugggag

SEQ ID NO: 44907 - RNA, 46 nt, Mus musculus
uuagcuuaggcauuaugaucaaagguuaauaaaugggacuucauga

SEQ ID NO: 44908 - RNA, 46 nt, Mus musculus
gagaaggagaggcugcccauggccaugaggagaagggaggggauag

SEQ ID NO: 44909 - RNA, 46 nt, Mus musculus
cuggguacuaaguagaaccagauguguagugccuacaaucccagug

SEQ ID NO: 44910 - RNA, 46 nt, Mus musculus
agugguuauuuuacuguuaagugauucaauagguaaagauagagag

SEQ ID NO: 44911 - RNA, 81 nt, Mus musculus
gguucaugauuugucaauaaagaagggcaggagccaauugcugggcggaagguacauuugggucuggguaccaagaggaaa

SEQ ID NO: 44912 - RNA, 46 nt, Mus musculus
cucuuuccucuugguacccagacccaaauguaccuuccgcccagca

SEQ ID NO: 44913 - RNA, 55 nt, Mus musculus
aauguuuugcaguggcuaauuggauuaagccacuaaguuuaggguagaaggagag

SEQ ID NO: 44914 - RNA, 46 nt, Mus musculus
auuugcccagagcaauugugcuuaaaggcaaguuaagguaacaaag

SEQ ID NO: 44915 - RNA, 45 nt, Mus musculus
acagcuuguauguauuucaagcguuuuuaucuuaauaacucagua

SEQ ID NO: 44916 - RNA, 46 nt, Mus musculus
auuuuuggccugcaaaguagaugaauucaaugugucuaguccccag

SEQ ID NO: 44917 - RNA, 46 nt, Mus musculus
auaaguaguaguucauauuccaaaaucuguuccagugcccucuccu

SEQ ID NO: 44918 - RNA, 46 nt, Mus musculus
uuauacaacaacuuaauuuucaccuuauuguccacaauccauacag

SEQ ID NO: 44919 - RNA, 25 nt, Mus musculus
ucgagaacugguuauuuucagguga

SEQ ID NO: 44920 - RNA, 46 nt, Mus musculus
uacuuauauagucuagacuuuugccuucaauucaagccaagcacuc

SEQ ID NO: 44921 - RNA, 46 nt, Mus musculus
ugaggugccaacaggccauuuuugcacauugagaacucaaucauac

SEQ ID NO: 44922 - RNA, 45 nt, Mus musculus
ucuggggauuuaauggaaauagucuuauccuuauuaagugcagag

SEQ ID NO: 44923 - RNA, 46 nt, Mus musculus
cuuacuguuuauaugugcacugugcacauauuacacacauucacag

SEQ ID NO: 44924 - RNA, 46 nt, Mus musculus
agaugcuuaucuuuuauacacaccuucacagauugcccugaccgcc

SEQ ID NO: 44925 - RNA, 45 nt, Mus musculus
uguuauaagagagguauacauaccauaaauuuuaaaaggcuaagg

SEQ ID NO: 44926 - RNA, 52 nt, Mus musculus
uguguacuuguaauuauaugccauguguauaggugccauauguauggagacu

SEQ ID NO: 44927 - RNA, 45 nt, Mus musculus
guaacucucuucucuguccugggggucagaagcugauggcccugg

SEQ ID NO: 44928 - RNA, 47 nt, Mus musculus
uaagagagcuacagagccaacacucagcacugcucagcucagaacag

SEQ ID NO: 44929 - RNA, 45 nt, Mus musculus
uacuuaucagagagucuaaugcuaaaagaaaacagaacuugccug

SEQ ID NO: 44930 - RNA, 46 nt, Mus musculus
uugauaacaggcuuaccaaaaacuccuuggugcuaguguugagaaa

SEQ ID NO: 44931 - RNA, 45 nt, Mus musculus
ugcuguauauaauacugguaguaauguuuuccaagugccuccaug

SEQ ID NO: 44932 - RNA, 42 nt, Mus musculus
ccgcauuaagugcaaggucagaagaaugacaccgcuccagcu

SEQ ID NO: 44933 - RNA, 46 nt, Mus musculus
ucuggugaacaaauguacuguuuuagacuuaauuuuuauaaacuag

SEQ ID NO: 44934 - RNA, 46 nt, Mus musculus
aaaaagauguuaauauauaauguauuacaagaauaaaaugccagaa

SEQ ID NO: 44935 - RNA, 48 nt, Mus musculus
acuagaaaaacuacaaauauugguuaaaaaacaaacaagccccccaaa

SEQ ID NO: 44936 - RNA, 45 nt, Mus musculus
aggagauuauuggauaaucauugguuacacugugauaccuggccu

SEQ ID NO: 44937 - RNA, 48 nt, Mus musculus
gaaaggcuaugaagaugaugacuaugugucaaagaaacccaaacagga

SEQ ID NO: 44938 - RNA, 62 nt, Mus musculus
acgaccugguagauucucucuaaccauaauaaaugaccgcagcaguacuuauuaaccaacgg

SEQ ID NO: 44939 - RNA, 46 nt, Mus musculus
cccacauuccagugaugugugagcuaugcaagcaaaaacccaagau

SEQ ID NO: 44940 - RNA, 46 nt, Mus musculus
auguauaguuuuuguuguaaaacaguucuuuuaagguauaugagau

SEQ ID NO: 44941 - RNA, 45 nt, Mus musculus
gcuugccaccaaguuugauguccugauuucaauccuaggcacuca

SEQ ID NO: 44942 - RNA, 42 nt, Mus musculus
ccugcuauccugaauccacggauguuuaauaucaucucaggu

SEQ ID NO: 44943 - RNA, 46 nt, Mus musculus
ggauucaggauagcagggcagauaaggcgaagaaaaacaaaaccac

SEQ ID NO: 44944 - RNA, 46 nt, Mus musculus
uguaagcuucaauagauaucccacucuguauauguugucauguaag

SEQ ID NO: 44945 - RNA, 45 nt, Mus musculus
acagcucaguggugggguacuagcuuaacacuaagagguccugga

SEQ ID NO: 44946 - RNA, 44 nt, Mus musculus
uguuuuauacaucaggucaaaauauauauucagcaaagaagagu

SEQ ID NO: 44947 - RNA, 46 nt, Mus musculus
aagaugacaugggaaucauuaucuagauaauuuaaggcucaaaguu

SEQ ID NO: 44948 - RNA, 45 nt, Mus musculus
uaaaaaauuugaauguucauguaugaaugcugcaacugcggagca

SEQ ID NO: 44949 - RNA, 46 nt, Mus musculus
auggaggacuuuucuaugaccuggaacauuuuuuuaggggucaaau

SEQ ID NO: 44950 - RNA, 46 nt, Mus musculus
cuugaaaauaacgcaauuugcuuuuucuuaguugcuugcggccaac

SEQ ID NO: 44951 - RNA, 45 nt, Mus musculus
auaagucuacaaaaagguuuuaauaguccuuuguaaagaggcagu

SEQ ID NO: 44952 - RNA, 46 nt, Mus musculus
cuugaaauauuuuuauauauuuucugguaaauuuacacauggagau

SEQ ID NO: 44953 - RNA, 45 nt, Mus musculus
ugcauguccaugugugugcuuguguggauguaugcuccugugugu

SEQ ID NO: 44954 - RNA, 46 nt, Mus musculus
uucucucacacauguuugacaguugucagagugaugugucuuggga

SEQ ID NO: 44955 - RNA, 52 nt, Mus musculus
cccuccuggaugcacacaugacugucaacagacccagacuugagaaggccca

SEQ ID NO: 44956 - RNA, 46 nt, Mus musculus
uugguaagguccaaauaguaucacaagguaaccuuccagugcacau

SEQ ID NO: 44957 - RNA, 45 nt, Mus musculus
auaaaagacaaguugcgagguugagagaagcugcacaguuacagu

SEQ ID NO: 44958 - RNA, 27 nt, Mus musculus
aaagaauugcuggucuuuguguuauaa

SEQ ID NO: 44959 - RNA, 42 nt, Mus musculus
aucucugcaaaacaaacccaugccucaacggaggcaccuguu

SEQ ID NO: 44960 - RNA, 41 nt, Mus musculus
gugaucucaguguggugucugguggccaugauggggauaga

SEQ ID NO: 44961 - RNA, 77 nt, Mus musculus
aacaagugucucaaaaaauucuugauaauaguaaccaggcaacagucaguaguacucuggaucuacauacugcacau

SEQ ID NO: 44962 - RNA, 46 nt, Mus musculus
gaucacauuccaggagaaacaguugggaugcuugcugguaucagaa

SEQ ID NO: 44963 - RNA, 46 nt, Mus musculus
aauauugaagaaaccaucaagccauuggguggaaauguccacagaa

SEQ ID NO: 44964 - RNA, 42 nt, Mus musculus
ccccauacaagugcucagccaguuucuacugucaccucauca

SEQ ID NO: 44965 - RNA, 41 nt, Mus musculus
ccuucauuucagccagaauucuuuucaggagugggggaagu

SEQ ID NO: 44966 - RNA, 47 nt, Mus musculus
agaccagagugaaguaauaucaacauuagggcauuuggaaaaaacac

SEQ ID NO: 44967 - RNA, 46 nt, Mus musculus
cauaagcuuuaguuuugccacugggaucccaguuucuagcacagag

SEQ ID NO: 44968 - RNA, 46 nt, Mus musculus
uacugagagugcuauuguugaaauucucccugagcugacaucagau

SEQ ID NO: 44969 - RNA, 52 nt, Mus musculus
guacaagaguucucuguauccaaccagcacacugccaagcacagagccauau

SEQ ID NO: 44970 - RNA, 46 nt, Mus musculus
agcugaagaagcagcaacuucccccacugcuuuucugccucaaacu

SEQ ID NO: 44971 - RNA, 86 nt, Mus musculus
aguuagaaugcucauuuccaaaacaggcagcaucucucaagacagcacagaggcacucgacacaacuuugagucauaccggaacag

SEQ ID NO: 44972 - RNA, 57 nt, Mus musculus
gagacaucucacauggaaagcuuaggaacaagcaucuuaggugauaaaauggaagac

SEQ ID NO: 44973 - RNA, 42 nt, Mus musculus
auaaagagucaaaugcugaucucucauucucuggacugggau

SEQ ID NO: 44974 - RNA, 46 nt, Mus musculus
aucuggagcagcuagaaguguacucauggauuccucaacucaagag

SEQ ID NO: 44975 - RNA, 46 nt, Mus musculus
acuccagguccagggaucaaagacuuggaaucauauacuacccauc

SEQ ID NO: 44976 - RNA, 45 nt, Mus musculus
ggacaaaagacuuuugaaucgcuccacaguucuuuugcaccagaa

SEQ ID NO: 44977 - RNA, 46 nt, Mus musculus
caaauuguggucuaaaccagaagucaaucuugauaaacaagagauu

SEQ ID NO: 44978 - RNA, 49 nt, Mus musculus
aacagagucuccauauuuugaugaagaguuugaagaaguggcugcagug

SEQ ID NO: 44979 - RNA, 46 nt, Mus musculus
caucaucuauaccgacuaccucagacaacaucuaccccgugccuga

SEQ ID NO: 44980 - RNA, 56 nt, Mus musculus
cuucagugaauauccaacagugucuuauccaacgaugaaagaggaaacaguuggga

SEQ ID NO: 44981 - RNA, 46 nt, Mus musculus
uagacauagaaauugcuggaguuaugagccagacaucgcagaagac

SEQ ID NO: 44982 - RNA, 46 nt, Mus musculus
gauuuggcuaccugggaagguuuuauucuagagacaacacccacag

SEQ ID NO: 44983 - RNA, 53 nt, Mus musculus
agagggagcugugaaugcagcccaccaaggagaaguucgagcagcaacagaga

SEQ ID NO: 44984 - RNA, 61 nt, Mus musculus
aauaaaaucuuuaacaugguaacugauuuaccacagagagauccuacagauacacucagcc

SEQ ID NO: 44985 - RNA, 46 nt, Mus musculus
gaaagcuggguagagauaacaccuagccaaacuguaaaguucucgg

SEQ ID NO: 44986 - RNA, 46 nt, Mus musculus
uccaucacagagagcaguccaaaccuugaaaauccagugcacaaac

SEQ ID NO: 44987 - RNA, 47 nt, Mus musculus
ucgucaacuaccaugcaauuuaagaaaucuaaagaaggcacggaauu

SEQ ID NO: 44988 - RNA, 56 nt, Mus musculus
gaggaggacuguguaaaugcaacggauguaacaacuacuccgucagugcaguauau

SEQ ID NO: 44989 - RNA, 57 nt, Mus musculus
gaguuaccagacucauuugaaauagacauauaucacagugaggaagaugaagacgga

SEQ ID NO: 44990 - RNA, 46 nt, Mus musculus
ucgauugagugauaugauuguaaguggucauccaauagauucagaa

SEQ ID NO: 44991 - RNA, 46 nt, Mus musculus
gugauguacuacugaguuguaucaaauaguauggaacuggaaauau

SEQ ID NO: 44992 - RNA, 58 nt, Mus musculus
ccccaaaucacacaacccugcauuugucuccucagcauaggucuccucuucucagcau

SEQ ID NO: 44993 - RNA, 77 nt, Mus musculus
caaugguaacacugaugucaaccauuaggccaacagugguuucaaguacagagccagaaguaauuuaugaagcagaa

SEQ ID NO: 44994 - RNA, 42 nt, Mus musculus
agagggggaggggucaacauauacucccucugaaggcagauu

SEQ ID NO: 44995 - RNA, 48 nt, Mus musculus
cagucaccuuucauacaucuacaucaauuggcagugcagaaaagucag

SEQ ID NO: 44996 - RNA, 45 nt, Mus musculus
aguucauuugacccacaguacuuuaaauguggaaguggucacagu

SEQ ID NO: 44997 - RNA, 51 nt, Mus musculus
ggaauauccacaguuauuuauccaucauuacaaacagaugugacacaagga

SEQ ID NO: 44998 - RNA, 48 nt, Mus musculus
aguccauuucaacaucaacaauaaccaugcuuggcacagauagaucac

SEQ ID NO: 44999 - RNA, 46 nt, Mus musculus
uagccaaauccccgaagucaucacaguaucaaaaacaucagaagac

SEQ ID NO: 45000 - RNA, 46 nt, Mus musculus
gaauauaucagaggcaaccaccaucgaaaugaauauccucgcagaa

SEQ ID NO: 45001 - RNA, 23 nt, Mus musculus
aaaaauuuccaaaagccgagugu

SEQ ID NO: 45002 - RNA, 45 nt, Mus musculus
cuguaagcauguugaugcaaaacaucuguauggcagacagcugca

SEQ ID NO: 45003 - RNA, 46 nt, Mus musculus
aaguuacuaacuuaaggaaggaacaggcuuggguugguggugagaa

SEQ ID NO: 45004 - RNA, 45 nt, Mus musculus
aggucuacuuggggugagaacccuguaucguuuugagaaccagac

SEQ ID NO: 45005 - RNA, 46 nt, Mus musculus
aagcagggaugcgaggcuggcgacuguuggagaacuucaggcagcu

SEQ ID NO: 45006 - RNA, 46 nt, Mus musculus
auguguuccacaucacugcucccaguaaguucaccuucgaggaggc

SEQ ID NO: 45007 - RNA, 46 nt, Mus musculus
gcacacagugauugguaaaucacagcuuuugcguagcuuaugggaa

SEQ ID NO: 45008 - RNA, 46 nt, Mus musculus
ccauacgggcuccccgagagggcuguuacggagacaugauggggaa

SEQ ID NO: 45009 - RNA, 43 nt, Mus musculus
cuuugccgcugcucaacaggcuuguuuggauaucggggcgguc

SEQ ID NO: 45010 - RNA, 51 nt, Mus musculus
guaggugaugcuucccucaccauggucaaacuccgggcuagugaugcaggc

SEQ ID NO: 45011 - RNA, 45 nt, Mus musculus
ccaauuacaacacgagugaauuucucagaaucaaauggucuaaga

SEQ ID NO: 45012 - RNA, 56 nt, Mus musculus
guugauaaauaugaaaggcaucuuauggaugugcucaaccuuauuacuaacccaug

SEQ ID NO: 45013 - RNA, 43 nt, Mus musculus
caugcuagaaacauuugucauuuaguaggacccaaugcagaga

SEQ ID NO: 45014 - RNA, 46 nt, Mus musculus
uuuugaaauacauuuacauuccuaaagaccacauuuagccagagac

SEQ ID NO: 45015 - RNA, 41 nt, Mus musculus
aguaggcgugggcucccccugauggaagaauucagcacaag

SEQ ID NO: 45016 - RNA, 44 nt, Mus musculus
cggagcccuuucucacagcucagcagugaauuuccaccccgaaa

SEQ ID NO: 45017 - RNA, 46 nt, Mus musculus
auccucucuccucuccagcucugucccgcacucgcugcacccuucc

SEQ ID NO: 45018 - RNA, 76 nt, Mus musculus
caucauagcggucuccaggccuuccucuucugucauaagccauuagaucucccccucuggguggugguggaggaag

SEQ ID NO: 45019 - RNA, 46 nt, Mus musculus
cucauaucaucauaaucucuucuagaaggaggcauaggacgcccac

SEQ ID NO: 45020 - RNA, 39 nt, Mus musculus
gguacuggccaguguuccuggaggagaugacgcugacgu

SEQ ID NO: 45021 - RNA, 46 nt, Mus musculus
ccucuucagguuuaugauguagauaccgucaccuuuccuuuuguag

SEQ ID NO: 45022 - RNA, 42 nt, Mus musculus
uggguucccgcagcaaggaauuugaggacauccuccuccuuc

SEQ ID NO: 45023 - RNA, 46 nt, Mus musculus
aauucccagcaaccacaugguggcucauaaccauccguaacaagau

SEQ ID NO: 45024 - RNA, 45 nt, Mus musculus
ggacuuaucaguggguuguucuguucuguuuuagagugcccagau

SEQ ID NO: 45025 - RNA, 42 nt, Mus musculus
aaucacaaugaaguuuacuguccuggaaagccaugcccauuu

SEQ ID NO: 45026 - RNA, 47 nt, Mus musculus
ucccagcaaccacaugguggcucacagccauccacaacaagaucuga

SEQ ID NO: 45027 - RNA, 28 nt, Mus musculus
aguacgcggaggaucaguaucuuuugug

SEQ ID NO: 45028 - RNA, 45 nt, Mus musculus
gaggacaaacgggcuguaaagcaggggaugcccaagcccagagga

SEQ ID NO: 45029 - RNA, 42 nt, Mus musculus
cgaugacuguaaagguagcccgggucaggaagcagggugggu

SEQ ID NO: 45030 - RNA, 42 nt, Mus musculus
gucugcacccugaggaggaugccaguuucuauccaguggccc

SEQ ID NO: 45031 - RNA, 42 nt, Mus musculus
acuuaccaucagcauagacuccuuugguauuaucagggcagg

SEQ ID NO: 45032 - RNA, 45 nt, Mus musculus
ggucuacguuagcucugcacuuggacaucucgugcuccguggacc

SEQ ID NO: 45033 - RNA, 46 nt, Mus musculus
gagagagagagagagagagagauagacagagacagagacagacaga

SEQ ID NO: 45034 - RNA, 45 nt, Mus musculus
cccuauugauuaaaaguguuuuucacaucaguucucuuggucaga

SEQ ID NO: 45035 - RNA, 42 nt, Mus musculus
ugugcgaaagcccuggguucaguugucaguacugcgggaggg

SEQ ID NO: 45036 - RNA, 42 nt, Mus musculus
ugguaauaagaaagcaguuaaauuuguguguuaaucacagug

SEQ ID NO: 45037 - RNA, 46 nt, Mus musculus
ccuuguguaagguggcucuggcgugugugugugugugugugugugu

SEQ ID NO: 45038 - RNA, 45 nt, Mus musculus
ugugucccccauuccucacacacccagccuccguaaccccccuau

SEQ ID NO: 45039 - RNA, 45 nt, Mus musculus
ugugucccccauuccucacacacccagccuccgugacccccauuc

SEQ ID NO: 45040 - RNA, 45 nt, Mus musculus
ugugucccccauuccucacacacccagccuccguaaccccccccu

SEQ ID NO: 45041 - RNA, 94 nt, Mus musculus
ccucacacacacagccucugugacccccauuccucacacacccagccucugugucccccauuccucacacacccagccuccguaacccccccua

SEQ ID NO: 45042 - RNA, 45 nt, Mus musculus; identical to SEQ ID NO: 45039

SEQ ID NO: 45043 - RNA, 45 nt, Mus musculus
acauguggaauuuuauguggacauguuuaacuccuuuggcaagga

SEQ ID NO: 45044 - RNA, 42 nt, Mus musculus
acuaaaagucaucugaauuacucaugaaguuuaauaguuauc

SEQ ID NO: 45045 - RNA, 46 nt, Mus musculus
uugcugcugcugcgucaaugugcugagucaauacuacagacuagag

SEQ ID NO: 45046 - RNA, 42 nt, Mus musculus
uuguuauguauaagcuaagagagugcaggguggcauugagaa

SEQ ID NO: 45047 - RNA, 46 nt, Mus musculus
aaggcuuugucuguagcuugccauugauugacauuuucagggaaua

SEQ ID NO: 45048 - RNA, 44 nt, Mus musculus
gagcuguugguauugucagugauggcaagauuuaggaagcgggg

SEQ ID NO: 45049 - RNA, 41 nt, Mus musculus
auauaaguuuggaccauggggagggggguuuugguggggua

SEQ ID NO: 45050 - RNA, 46 nt, Mus musculus
guguuuaauaauauuauugcacaaauaaucguauuuguucugaggu

SEQ ID NO: 45051 - RNA, 46 nt, Mus musculus
aagaaaugaguaaaguuuggugugccaugccuauuaaacgauagau

SEQ ID NO: 45052 - RNA, 41 nt, Mus musculus
ugucuucuuucauauugguuucuucuuuguaguguguugau

SEQ ID NO: 45053 - RNA, 46 nt, Mus musculus
ugaugucuuaugucauugacauaagaaagaaaauaguugccuagau

SEQ ID NO: 45054 - RNA, 24 nt, Mus musculus
gccuggagcugcaggaugauagau

SEQ ID NO: 45055 - RNA, 45 nt, Mus musculus
ggcuuuuuauaugacaacuguucugaaaguccuauucuguucagg

SEQ ID NO: 45056 - RNA, 46 nt, Mus musculus
gucccaggagaguaacuggagagcuuacuagaaugacagggcagaa

SEQ ID NO: 45057 - RNA, 45 nt, Mus musculus
aauucaggaagucauucacagcauccaaaugcguuuacaggaauu

SEQ ID NO: 45058 - RNA, 46 nt, Mus musculus
ugggagcuggaucuucaguacuucucagaaggcugcugccccagua

SEQ ID NO: 45059 - RNA, 46 nt, Mus musculus
guagaauucucagggaggugcuuucaaggugauaaugauggaagau

SEQ ID NO: 45060 - RNA, 45 nt, Mus musculus
uggcuguuacugugcuuuuauucugucauccacgcaucuggguuu

SEQ ID NO: 45061 - RNA, 49 nt, Mus musculus
gcagggagaaggagagaagguagaagagagacggggcagacuagacaga

SEQ ID NO: 45062 - RNA, 42 nt, Mus musculus
ucuucuccaucuauuguaauugaaauuuuuggaagcuauagu

SEQ ID NO: 45063 - RNA, 23 nt, Mus musculus
guuggggggggggcgggcguccu

SEQ ID NO: 45064 - RNA, 45 nt, Mus musculus
aguucuccacauuaaacagacagagguaaagccaacaucugcugu

SEQ ID NO: 45065 - RNA, 42 nt, Mus musculus
gucuuauaauaguaauaucuuguuagauucagaggcucagau

SEQ ID NO: 45066 - RNA, 46 nt, Mus musculus
uaugacaacucuuauacuggaaaauauuuacgucgggcuggcuuac

SEQ ID NO: 45067 - RNA, 42 nt, Mus musculus
uuguuaucugauuuuuuccagacugauaugaagaccaaagga

SEQ ID NO: 45068 - RNA, 46 nt, Mus musculus
aaacacguuauuugggcauguguauuguuuaaaucaggcgugagau

SEQ ID NO: 45069 - RNA, 46 nt, Mus musculus
ggguggcagaggcacaaggauuacacauuuuaguccagguugagau

SEQ ID NO: 45070 - RNA, 46 nt, Mus musculus
auagguacuuuuaggaccuucugaauuaaacguaaagccacuccca

SEQ ID NO: 45071 - RNA, 45 nt, Mus musculus
ggcgugaugaaaucucaaaguaguuucaguuuguauugcccugau

SEQ ID NO: 45072 - RNA, 45 nt, Mus musculus
agccuuucuuuuggacauggugguggcaggggacgucggcgcuga

SEQ ID NO: 45073 - RNA, 46 nt, Mus musculus
gccaccuugguugagaccaggaugucucuccugggagccaacagga

SEQ ID NO: 45074 - RNA, 42 nt, Mus musculus
auauaaauuuaaacacuucuagaacagaccagaccaggacag

SEQ ID NO: 45075 - RNA, 46 nt, Mus musculus
agcucacuaaaaugcuguuaucugaggucuguguuagucaagggua

SEQ ID NO: 45076 - RNA, 46 nt, Mus musculus
gccuccacuuuuagaguuuccagggaaacagaacuaugagguaaaa

SEQ ID NO: 45077 - RNA, 49 nt, Mus musculus
cugaguacggugaacuggaaacuuguaaggaucaucagagaauagacaa

SEQ ID NO: 45078 - RNA, 46 nt, Mus musculus
uacuaaacaaagacagggaggaaagcauacaaaugagcguguugug

SEQ ID NO: 45079 - RNA, 46 nt, Mus musculus
cgggaagggguacagaaagagaggaaggccaagugagugcuagugg

SEQ ID NO: 45080 - RNA, 46 nt, Mus musculus
agucuguggcuauguucagccuggacucucccgucugccugcuuuc

SEQ ID NO: 45081 - RNA, 45 nt, Mus musculus
gauggcgcacgccuuuaauccuagcacuugggaggcagagguagg

SEQ ID NO: 45082 - RNA, 45 nt, Mus musculus
uuucuaacuuaaaauguaggugucccuaccuagugcagccuggau

SEQ ID NO: 45083 - RNA, 46 nt, Mus musculus
agggacugacggguaggaagugcggguugcuugaaaccgcugaauu

SEQ ID NO: 45084 - RNA, 45 nt, Mus musculus
gagugacagcggggaagguggagauuuguuuguuuguuuguuggu

SEQ ID NO: 45085 - RNA, 46 nt, Mus musculus
ccgugcaguuuucagagaggauuuagucauagggcaaagcugagau

SEQ ID NO: 45086 - RNA, 54 nt, Mus musculus
ugagugugaguaggaggugggcuguggucaugugagugugaguaggaaggaggu

SEQ ID NO: 45087 - RNA, 92 nt, Mus musculus
ggaaagucaguaguugaaaguaggaagaaagagagguaaggccagggcgaguaggaggugggcuguggucauaugugugugaguaggaagga

SEQ ID NO: 45088 - RNA, 101 nt, Mus musculus
agggcuuuaaccaagcaaugcagggaaggagauauauucaugggggagagucagaagaagaggugggugagcuuacugccaggagagacacuagagcuugg

SEQ ID NO: 45089 - RNA, 46 nt, Mus musculus
uggucacagcaggcuguggaggagguggguugcauagggacauuug

SEQ ID NO: 45090 - RNA, 31 nt, Mus musculus
guguuagcucuacaggcaggugccucugugg

SEQ ID NO: 45091 - RNA, 42 nt, Mus musculus
ugucugugccaacagagaugcucauccaaagagccaccaaug

SEQ ID NO: 45092 - RNA, 45 nt, Mus musculus
guucuuuccuucuaccauguaaauccuguggagaucccacucagg

SEQ ID NO: 45093 - RNA, 46 nt, Mus musculus
ggcauguugcuggccugaaugugacauuuauuuauaugcuuuagau

SEQ ID NO: 45094 - RNA, 45 nt, Mus musculus
ucugguuugaccaccuccaacuuuauguacaaaggaagccuacua

SEQ ID NO: 45095 - RNA, 46 nt, Mus musculus
ggucauugacccuaagugguucuggcucucaucguugacuucagca

SEQ ID NO: 45096 - RNA, 47 nt, Mus musculus
uuggccccaucuacaaacaguaaggccauuugcucaucggcguuagc

SEQ ID NO: 45097 - RNA, 45 nt, Mus musculus
augggagcgguuacguggcuaauuagauucugagggauggagagu

SEQ ID NO: 45098 - RNA, 46 nt, Mus musculus
ucuagagagugaaaucaugucuuaugaagugguauuagccuuagau

SEQ ID NO: 45099 - RNA, 46 nt, Mus musculus
gggaagacugaacauuuuaaggcuuuggaaacauuuguguauuaug

SEQ ID NO: 45100 - RNA, 46 nt, Mus musculus
aagaauucugcugugauucugcccucccucaaaacagaguccagac

SEQ ID NO: 45101 - RNA, 64 nt, Mus musculus
cagcaggaagaggucacugggaaauggugggcccacuaagaaaaaagcaaggaaaguuccagag

SEQ ID NO: 45102 - RNA, 44 nt, Mus musculus
cgggaagccuaagauccagcgcguccuccacggagccagcagag

SEQ ID NO: 45103 - RNA, 46 nt, Mus musculus
cuccguggaggacgcgcuggaucuuaggcuucccgcagaccugaag

SEQ ID NO: 45104 - RNA, 46 nt, Mus musculus
acuuugaauagagaccugagccgguauuuagaauuguuacugaaag

SEQ ID NO: 45105 - RNA, 46 nt, Mus musculus
ugaugaacuucuugguccucuuuuugaugaucuugggcuucaccag

SEQ ID NO: 45106 - RNA, 46 nt, Mus musculus
cacauguuuccugacgugguuaucucaggacaaaguagccggccaa

SEQ ID NO: 45107 - RNA, 51 nt, Mus musculus
auguauuuguggaguggcuaaauugagauauaucaccuuaaaaucaacucc

SEQ ID NO: 45108 - RNA, 45 nt, Mus musculus
accuuguuccuaaccacagucgccaugcagugcaguagagcccag

SEQ ID NO: 45109 - RNA, 46 nt, Mus musculus
gagcauagugcuuaucuuauaugguauggcuuucagcucccuggag

SEQ ID NO: 45110 - RNA, 46 nt, Mus musculus
gacauucaaauuagcaucguagacugguuagaaaagucguuaccag

SEQ ID NO: 45111 - RNA, 46 nt, Mus musculus
caauuuacucagagccaauugauauugauauaaauugcccaccuag

SEQ ID NO: 45112 - RNA, 45 nt, Mus musculus
ucuagucuaaguucuugugggaacuugcaauuacaaccaaggcag

SEQ ID NO: 45113 - RNA, 46 nt, Mus musculus
guccucaucuucuguuguaacaacaguaaguguacucuaugucuag

SEQ ID NO: 45114 - RNA, 41 nt, Mus musculus
cucauuccaaagagacucagaucauagugaaaacaggccua

SEQ ID NO: 45115 - RNA, 45 nt, Mus musculus
uggccagagggucugagcagagaccuauguaagaguuaggggaug

SEQ ID NO: 45116 - RNA, 42 nt, Mus musculus
gcuugugagugugguguccaugccauguccagaaggcagcau

SEQ ID NO: 45117 - RNA, 46 nt, Mus musculus
ggaaaaaugauuuuccaaaagucauccaucaagagagagagaccag

SEQ ID NO: 45118 - RNA, 45 nt, Mus musculus
ucaaggucauuaagcagauucccauugacaacccgggaaacugag

SEQ ID NO: 45119 - RNA, 42 nt, Mus musculus
ugaggaaaccaggcacggaccuuggagacacgccgccugcac

SEQ ID NO: 45120 - RNA, 48 nt, Mus musculus
gacagaaaccucauccaaagagagaagagacuaaacccaaguaugaaa

SEQ ID NO: 45121 - RNA, 25 nt, Mus musculus
ugcccugugccugccucacugccac

SEQ ID NO: 45122 - RNA, 48 nt, Mus musculus
ugugaguguguguguguguguauguguguguguguaugugugugccuc

SEQ ID NO: 45123 - RNA, 45 nt, Mus musculus
gugugagugugccucuguguguguguauguguguguguuugugug

SEQ ID NO: 45124 - RNA, 46 nt, Mus musculus
gugacuguacgaugaugcucugagagcuuggucauaaccucugggg

SEQ ID NO: 45125 - RNA, 42 nt, Mus musculus
uuuuuuuguuuuguuuuuuuuuguuuuuuuuuguuuuuuuuu

SEQ ID NO: 45126 - RNA, 45 nt, Mus musculus
cauauauugaccuuuuuuguauggaggcuccuauaauaacaagag

SEQ ID NO: 45127 - RNA, 46 nt, Mus musculus
uauaauggacuccuaagaaaaagaacauuaacuagacagcaagcag

SEQ ID NO: 45128 - RNA, 23 nt, Mus musculus
uuccccccacuuuugugauggau

SEQ ID NO: 45129 - RNA, 42 nt, Mus musculus
gcucagaaguuucaacggauggaaauuccuugaucaaagcag

SEQ ID NO: 45130 - RNA, 46 nt, Mus musculus
cguggggaaaccccuuuaaugauugcuuguaagaccaaacaugucg

SEQ ID NO: 45131 - RNA, 42 nt, Mus musculus
auucuggcuacucagcucugguuuaugcuauaaaugcggaag

SEQ ID NO: 45132 - RNA, 25 nt, Mus musculus
cgcgccaucuccuuccuugcuuuca

SEQ ID NO: 45133 - RNA, 46 nt, Mus musculus
gaaaaagaaagcgcgcgcagaaagauaaguaaagggagagaaauaa

SEQ ID NO: 45134 - RNA, 45 nt, Mus musculus
uaguugggaaaagcugggaaaagauauagcaagagaggaagcaga

SEQ ID NO: 45135 - RNA, 54 nt, Mus musculus
cuuaaagaaagggguuuaaaaauuucagaaagcacagugagcgguuuuuugaga

SEQ ID NO: 45136 - RNA, 46 nt, Mus musculus
aggcaugcucuccuacgaaguagauccauuaauugucgcugggauu

SEQ ID NO: 45137 - RNA, 59 nt, Mus musculus
ucuucagcugaggaacggugguaccgguaaguguaaagaaauuaauguaaaucucugag

SEQ ID NO: 45138 - RNA, 46 nt, Mus musculus
gaaaauguuguagucuguuuagaaagaacaaaaaggguuguugggg

SEQ ID NO: 45139 - RNA, 48 nt, Mus musculus
auucucuugacaaggggagaaccuccccucuaccauguccaagaagug

SEQ ID NO: 45140 - RNA, 46 nt, Mus musculus
uccuaucaaaccgauugggaacaucucaguuuuucuuuggugacac

SEQ ID NO: 45141 - RNA, 45 nt, Mus musculus
cgcacggcaaguugugcuucuaauguacauccaaacccuggagca

SEQ ID NO: 45142 - RNA, 45 nt, Mus musculus
ucuuuaugcauuuaaaggcuuguauacacccguccgccaucagau

SEQ ID NO: 45143 - RNA, 109 nt, Mus musculus
agaggaggagcaugcgccugagcccauaguccacagagaggaggagcaugcgccugagcccauaguccacagagaggaggagcaugcgccugagcccauaguccacaga

SEQ ID NO: 45144 - RNA, 46 nt, Mus musculus
aauguuccaucuucaacagaacacgcauuucccuccagugccagaa

SEQ ID NO: 45145 - RNA, 47 nt, Mus musculus
aauggugguucuaauauaguuccccaaaggaaauuagcccagagccc

SEQ ID NO: 45146 - RNA, 42 nt, Mus musculus
uuaaagaagaguuaauuccucuacaauuuuaugggacguugc

SEQ ID NO: 45147 - RNA, 45 nt, Mus musculus
ugcugagagucuggcccuggagaugguauaaaauaugcagugaug

SEQ ID NO: 45148 - RNA, 45 nt, Mus musculus
aaaccauggggugaguugaacaagaaggaaaagcuugaaggcaga

SEQ ID NO: 45149 - RNA, 46 nt, Mus musculus
aaauugagcauguuugacauuacagaaaggaaaaagaagccaccag

SEQ ID NO: 45150 - RNA, 23 nt, Mus musculus
ugucgccuucuccuuagugcagc

SEQ ID NO: 45151 - RNA, 46 nt, Mus musculus
guaugcacugccaagugugagaccauaauauguaguuuaaugagaa

SEQ ID NO: 45152 - RNA, 46 nt, Mus musculus
uuccuuugucuuuccuaugaagucuuugcaguuaccgguggcauuu

SEQ ID NO: 45153 - RNA, 46 nt, Mus musculus
agauucacuuauaguuaacaguggcccaauuuaggguauuggaaau

SEQ ID NO: 45154 - RNA, 42 nt, Mus musculus
aucccauguguaaacagaagcuuuuaaagguaggaggcaguc

SEQ ID NO: 45155 - RNA, 46 nt, Mus musculus
acugcaggacauuucagacuauugcuuaagaugcaagcacuugaca

SEQ ID NO: 45156 - RNA, 47 nt, Mus musculus
aagaauuagaauucaguaggauauagaaugacagcauccacauggca

SEQ ID NO: 45157 - RNA, 46 nt, Mus musculus
uuaaagguccuaguugguuuuuaguaguaagaaauugcuggcgaau

SEQ ID NO: 45158 - RNA, 46 nt, Mus musculus
cucuggccuucagaguucauucaugugucuaguugucauggcaguc

SEQ ID NO: 45159 - RNA, 42 nt, Mus musculus
caguaaagguccagaaggcagcugggcccgaagccuccagcu

SEQ ID NO: 45160 - RNA, 36 nt, Mus musculus
uuggucccacaauuggauuccauuauguccugagua

SEQ ID NO: 45161 - RNA, 46 nt, Mus musculus
gcuucugagucacacaagcuauguuucagauacucagugcccaugu

SEQ ID NO: 45162 - RNA, 46 nt, Mus musculus
auucagaggcucggguugucuuccuagagucucuuccauaguagau

SEQ ID NO: 45163 - RNA, 44 nt, Mus musculus
cuggcaaaguauuuuauuucucuuuuucagugugugugugugug

SEQ ID NO: 45164 - RNA, 45 nt, Mus musculus
cacgaagcucuaagaagaaucaaagaagcguccccagagucagag

SEQ ID NO: 45165 - RNA, 46 nt, Mus musculus
cuccuuuuccugaugaagaugauaguaauaauauuuuggcgcagau

SEQ ID NO: 45166 - RNA, 45 nt, Mus musculus
uacuuauugagaguuugccugugaaccuggagcuuaccguuucag

SEQ ID NO: 45167 - RNA, 46 nt, Mus musculus
cuccuccacagucagcuccacuguugacuaguauugaccccaaacc

SEQ ID NO: 45168 - RNA, 39 nt, Mus musculus
ucaauuucuguugucuuucuuagucucuuuccauuuuag

SEQ ID NO: 45169 - RNA, 40 nt, Mus musculus
uuccuuuguaaauauuauuacuaaauuauauuauccagau

SEQ ID NO: 45170 - RNA, 46 nt, Mus musculus
uugccuggagaccuugaagaugguguagugagucuguaucugagac

SEQ ID NO: 45171 - RNA, 47 nt, Mus musculus
cggccaccaucuuccugccuuaggugugggacaacccccaaccaaca

SEQ ID NO: 45172 - RNA, 45 nt, Mus musculus
acgcucaugugcauggcucauaaaucucagguugugcaugcuuag

SEQ ID NO: 45173 - RNA, 46 nt, Mus musculus
ggaaacagaaacaagguaagucauuguaaaacauacacagucaggg

SEQ ID NO: 45174 - RNA, 45 nt, Mus musculus
gaaauagcaaauuaauuauugcccuuucauuucuaagucuguggg

SEQ ID NO: 45175 - RNA, 47 nt, Mus musculus
guguacuacgacacuuacgaaagcauggaggccaugcuggagaagga

SEQ ID NO: 45176 - RNA, 45 nt, Mus musculus
ggagagugaggacuguauuuauugaacacuuacuuuguaccagac

SEQ ID NO: 45177 - RNA, 45 nt, Mus musculus
aggaacccuuaaacucaacaguuugggcuacacauggcguuugua

SEQ ID NO: 45178 - RNA, 73 nt, Mus musculus
uacaguuugaaaucuugaagugugaagaguuguuauuaacugcacagcuggagagcaucaagagacuuauauc

SEQ ID NO: 45179 - RNA, 42 nt, Mus musculus
caaacuugagccuguggggccauucauuaucaggggccuauu

SEQ ID NO: 45180 - RNA, 45 nt, Mus musculus
aagaaauuugucuggaacagaagaaacaugcacuaaaagaagagg

SEQ ID NO: 45181 - RNA, 46 nt, Mus musculus
aauuuauguguguguguauguauguauguaugugagucugugaguu

SEQ ID NO: 45182 - RNA, 38 nt, Mus musculus
ucauuugggggagucagugaauauuuugaauauauagg

SEQ ID NO: 45183 - RNA, 46 nt, Mus musculus
uacucuaccuccugagugcugggauuaaaggcauauaccacuauuc

SEQ ID NO: 45184 - RNA, 42 nt, Mus musculus
aaugcauguucucuuuuuacaauaaauucagggccaucagaa

SEQ ID NO: 45185 - RNA, 32 nt, Mus musculus
uugguguaaauagcucuggcugucucgugugu

SEQ ID NO: 45186 - RNA, 46 nt, Mus musculus
ucugaaaagcauuugcagacaccaaaacuagcacuagaagguagga

SEQ ID NO: 45187 - RNA, 31 nt, Mus musculus
agaaauuuuguguccuuuaaccaaaaucuuc

SEQ ID NO: 45188 - RNA, 46 nt, Mus musculus
uuauagcuuugggugucuaacuggaagguggagcauauuaauagau

SEQ ID NO: 45189 - RNA, 46 nt, Mus musculus
cuaaaauagagguagaaacacguuucacucugacccauugguauga

SEQ ID NO: 45190 - RNA, 40 nt, Mus musculus
gagacaugcgagaacuggccaugcuacgaagacagcagau

SEQ ID NO: 45191 - RNA, 46 nt, Mus musculus
gggggucaccucaaaaggaggaacuguauuaaaggaucccagcauu

SEQ ID NO: 45192 - RNA, 46 nt, Mus musculus
ccuagaguacagaauuuagaguacauuccaguacaaagcaacagau

SEQ ID NO: 45193 - RNA, 46 nt, Mus musculus
gaacuggaguuagagaugguugugagugacccugugcugcugggaa

SEQ ID NO: 45194 - RNA, 42 nt, Mus musculus
cccccccccccgcaggcccuuugugucuguguugccggaagg

SEQ ID NO: 45195 - RNA, 48 nt, Mus musculus
ugucuauuuguugaaauauuuacaaguaaaguuuaucuguaagguaca

SEQ ID NO: 45196 - RNA, 42 nt, Mus musculus
uagaacccuggcuuagcaagaagccauccccugcccccuacc

SEQ ID NO: 45197 - RNA, 45 nt, Mus musculus
auugaaggggggcacucugaccucaaguuagaacacugcugggau

SEQ ID NO: 45198 - RNA, 41 nt, Mus musculus
auuguacaccacuugagugacuuccugggaaugacugggaa

SEQ ID NO: 45199 - RNA, 45 nt, Mus musculus
aguccucaguuuagaagccuagcauuugggaaguagagacaggau

SEQ ID NO: 45200 - RNA, 46 nt, Mus musculus
ggaccucuggaagaacacagugcucuuaaccgcugagccaucucuc

SEQ ID NO: 45201 - RNA, 46 nt, Mus musculus
gaauugcugucauuuguauguauauuuaacugauauuaggccagga

SEQ ID NO: 45202 - RNA, 43 nt, Mus musculus
cgcgagaagcacaaguuuguguucauuguggccuggaacgaga

SEQ ID NO: 45203 - RNA, 42 nt, Mus musculus
ccgcagacgucacagccgaauggcaacauuguggcgacgcug

SEQ ID NO: 45204 - RNA, 45 nt, Mus musculus
uuucuguauuuugagcagguuagccauaaaucuuggcagcugccu

SEQ ID NO: 45205 - RNA, 39 nt, Mus musculus
gaagcagguggaucucugaguucauagccagccugucag

SEQ ID NO: 45206 - RNA, 45 nt, Mus musculus
ggggaugacuguacuuauguggugagugugugugugccugccugu

SEQ ID NO: 45207 - RNA, 41 nt, Mus musculus
aggaacacaggcuuuauaucuuauauaaaauauucgaggaa

SEQ ID NO: 45208 - RNA, 51 nt, Mus musculus
accaugugguggcucacaaccauccguaacgaaaucugaugcccucuuuug

SEQ ID NO: 45209 - RNA, 45 nt, Mus musculus
uuugcugcagggcugcagguauucaguccuuucuggaccgcaugu

SEQ ID NO: 45210 - RNA, 45 nt, Mus musculus
agaaaacaaauuuaagcacacuuagaggagaaggugaugauagaa

SEQ ID NO: 45211 - RNA, 45 nt, Mus musculus
gcugcuccuccugagcaaaggcgcuaaaugaacucuggccaauuc

SEQ ID NO: 45212 - RNA, 42 nt, Mus musculus
aacaacaacaacaaaccaaaaaccaaaaauguuagcacugag

SEQ ID NO: 45213 - RNA, 45 nt, Mus musculus
ugcuggcuuauuauuaucaugugggauugguuaauauguugggaa

SEQ ID NO: 45214 - RNA, 41 nt, Mus musculus
ugugccugcagagcauggcgcugucauuuccacugcaccca

SEQ ID NO: 45215 - RNA, 45 nt, Mus musculus
cagaccaugugucgggcaguaaaucucaaacagaauuggagguau

SEQ ID NO: 45216 - RNA, 46 nt, Mus musculus
uuccaaacucagucauucuguguaguuuuaugcucaaaacgucaag

SEQ ID NO: 45217 - RNA, 45 nt, Mus musculus
ccccugucugcuuuaaccuaccaguuaguauuuuauaaaaacaga

SEQ ID NO: 45218 - RNA, 46 nt, Mus musculus
uuccuuuauuacuuuguuguaauuuuguguguuuauuagucaagaa

SEQ ID NO: 45219 - RNA, 46 nt, Mus musculus
gcuggaguuacauucucacaccauuucaucagaacuauuggggauc

SEQ ID NO: 45220 - RNA, 46 nt, Mus musculus
cauucacuccucucucaagucuguaaagucaaucaacuggacugaa

SEQ ID NO: 45221 - RNA, 46 nt, Mus musculus
ccugguagagcuucaguccaguugauugacuuuacagacuugagag

SEQ ID NO: 45222 - RNA, 41 nt, Mus musculus
cugucucugcaccaaucacaagcaugcagcucuccccagga

SEQ ID NO: 45223 - RNA, 67 nt, Mus musculus
ccaggaaguccggcuccuacucuucaagcucaaccaguguuaaaaccuccuacugagcuguaccuga

SEQ ID NO: 45224 - RNA, 36 nt, Mus musculus
ucguagugcauuauuuccuaaucaaaacccagaggc

SEQ ID NO: 45225 - RNA, 42 nt, Mus musculus
cagaagguugcuaggagcaaagcagaugaaguacauggccag

SEQ ID NO: 45226 - RNA, 58 nt, Mus musculus
uuggagucuuccuguucccggcccuccuuacugcaucugccuacgugcucaugaucaa

SEQ ID NO: 45227 - RNA, 49 nt, Mus musculus
aggcagaugcaguaaggagggccgggaacaggaagacuccaauggccag

SEQ ID NO: 45228 - RNA, 42 nt, Mus musculus
augacauacaaagggauggugaccagaaaaaucaggagccag

SEQ ID NO: 45229 - RNA, 45 nt, Mus musculus
ucccaugggguucacgaucacccaguaccucugcacgcugaggca

SEQ ID NO: 45230 - RNA, 46 nt, Mus musculus
ccaguuguugccauguaggugguaggagaucuucagggggaaccag

SEQ ID NO: 45231 - RNA, 46 nt, Mus musculus
uggccuuggccgaccuccucucugucaucugguucccccugaagau

SEQ ID NO: 45232 - RNA, 42 nt, Mus musculus
gucgucuacauuauuguguuugugauugguuugcccaguaau

SEQ ID NO: 45233 - RNA, 46 nt, Mus musculus
acaacaguaaaggaagaagucuuauuggcagauuagaaacccagcc

SEQ ID NO: 45234 - RNA, 46 nt, Mus musculus
cuggccucaaaaucauagaggucuauuugccucugccuccaaaguc

SEQ ID NO: 45235 - RNA, 42 nt, Mus musculus
ggaacuguugauuguagcccuacaaauaagaugcacucagag

SEQ ID NO: 45236 - RNA, 45 nt, Mus musculus
gggccacaccuggugugugugugugugugugugugugugugugug

SEQ ID NO: 45237 - RNA, 39 nt, Mus musculus
uuaaauuauaacauuaauauguggucacugagaagagaa

SEQ ID NO: 45238 - RNA, 45 nt, Mus musculus
guuggaugcccagcauggcaagaaaucaagaaacaaaauauggag

SEQ ID NO: 45239 - RNA, 45 nt, Mus musculus
acuaacucuuuaggaaaguuaccggcaauggagcauaauuaugca

SEQ ID NO: 45240 - RNA, 42 nt, Mus musculus
ucgcauccccggacguggggcgggcgggcaauccgccaccag

SEQ ID NO: 45241 - RNA, 46 nt, Mus musculus
aaaaaguuuuacuuaaguccaauuuuaagaaauauauaggucaguu

SEQ ID NO: 45242 - RNA, 39 nt, Mus musculus
gaauaaccgaguccuguccuuacucaggcaacgcagaga

SEQ ID NO: 45243 - RNA, 31 nt, Mus musculus
uugggaggcaguaacuaugaaagacugacga

SEQ ID NO: 45244 - RNA, 46 nt, Mus musculus
aagccuagacacagccaucugcauggaggccucugagcaccaggua

SEQ ID NO: 45245 - RNA, 39 nt, Mus musculus
uuuuaacuugcaauuuacuuacugaauacauggaccaag

SEQ ID NO: 45246 - RNA, 47 nt, Mus musculus
ccuauauuuuuuuucaaauuauuugauaauaaugguuagugauggaa

SEQ ID NO: 45247 - RNA, 75 nt, Mus musculus
gaaauaaucugauucucugacuuaauaaacaaagucugaguugguggguguuagcacugggcagcuggagauccu

SEQ ID NO: 45248 - RNA, 46 nt, Mus musculus
gcuaucaagagucuagauuggauaauuaccagcaaggugacgggaa

SEQ ID NO: 45249 - RNA, 52 nt, Mus musculus
ggauaccugcucuagucaccugaauaacagcauauacaaaaagcuauuagcu

SEQ ID NO: 45250 - RNA, 93 nt, Mus musculus
uuacucggcaucagcuggccggugcuguugcaacuguugggaucagagcuuucuuugcagcacaagaugcuguagaggugccucuggcacucg

SEQ ID NO: 45251 - RNA, 59 nt, Mus musculus
agaggagguaagcaaaguaggcugccucuguaccaggacugucggagaggaaaagguag

SEQ ID NO: 45252 - RNA, 24 nt, Mus musculus
ggaaggcugacaaugaacacaauc

SEQ ID NO: 45253 - RNA, 42 nt, Mus musculus
uuucuagaugugagauaaguggaaagggggugcccagagauu

SEQ ID NO: 45254 - RNA, 44 nt, Mus musculus
ucccuccaccccaccccacccccgcgcccugcauccagccagau

SEQ ID NO: 45255 - RNA, 46 nt, Mus musculus
cuagaacccacgggguauugaccugaugcuaacaacacuuggaggu

SEQ ID NO: 45256 - RNA, 46 nt, Mus musculus
aaagcacagggauaugcacacuagucuguaagacucuugcccggag

SEQ ID NO: 45257 - RNA, 46 nt, Mus musculus
ucaaauauuuucucuuuucuccaaagcagaggcguagccuguaaag

SEQ ID NO: 45258 - RNA, 42 nt, Mus musculus
ggucccuugcugucuucccgcgucccuaugagccagccaggu

SEQ ID NO: 45259 - RNA, 45 nt, Mus musculus
acaggcugaggccgagggcgacgaucagcaagcgccggggcccca

SEQ ID NO: 45260 - RNA, 42 nt, Mus musculus
aaagaaguaggcgacggcgggcgccgggccgcgcgggcagcc

SEQ ID NO: 45261 - RNA, 44 nt, Mus musculus
ggguuguuaucuuacgugaacagcagcccccaacauuucgggaa

SEQ ID NO: 45262 - RNA, 41 nt, Mus musculus
ugguuuguuuuuucguugucuauuuguuuucuagugagaga

SEQ ID NO: 45263 - RNA, 46 nt, Mus musculus
cuguaacaauuacagcauggaaagugacaaauacuccaggucagac

SEQ ID NO: 45264 - RNA, 43 nt, Mus musculus
ucaagagugaaagcgacagaacaggacguggagagcugccagc

SEQ ID NO: 45265 - RNA, 46 nt, Mus musculus
cagcucugguuauccgacauggagacgcgacagccgagcaggagac

SEQ ID NO: 45266 - RNA, 57 nt, Mus musculus
gguuucugggacuuuacauacauucaaaacacacacacacccggaccccacccucua

SEQ ID NO: 45267 - RNA, 45 nt, Mus musculus
cccccauaccugauccugcuccccuuuccccuucucccacccaaa

SEQ ID NO: 45268 - RNA, 81 nt, Mus musculus
cucaaacaaauuaguaaccuuuauacaaaugauaaacaggcugagaaagaaaguaggaaacaacacccuucacaauaggca

SEQ ID NO: 45269 - RNA, 48 nt, Mus musculus
uucaauacaauccccaucaaaauuccaauacaguucaucacaaacacg

SEQ ID NO: 45270 - RNA, 45 nt, Mus musculus
ccucauaagacugaaaauuuucuguaagguaaaggacacugucag

SEQ ID NO: 45271 - RNA, 46 nt, Mus musculus
uuugauaaaauacuuuauaauucuguccuuuccagacugcacccuu

SEQ ID NO: 45272 - RNA, 26 nt, Mus musculus
uuagcuuccucagggggucagcagag

SEQ ID NO: 45273 - RNA, 42 nt, Mus musculus
ccaagcccaaugaagggaaagucagcuuacagagccaaugau

SEQ ID NO: 45274 - RNA, 45 nt, Mus musculus
aaacuaauaauucauuuggugcuggucuauugauugggggccuac

SEQ ID NO: 45275 - RNA, 46 nt, Mus musculus
acaugcaaucugugaauuaaaaaucucaaugcacugucuaguggaa

SEQ ID NO: 45276 - RNA, 46 nt, Mus musculus
ggaaagacugugguuugugaagccgucauuccagccaaggugguga

SEQ ID NO: 45277 - RNA, 45 nt, Mus musculus
cuggcagucagugggaacuauugcaccgacaagaagccugcugcc

SEQ ID NO: 45278 - RNA, 45 nt, Mus musculus
ccagaguuguuaagugcaugggcaccagucgaguggcacagggac

SEQ ID NO: 45279 - RNA, 41 nt, Mus musculus
uccugaggaggcguggcccugaggguucagcucagugcaga

SEQ ID NO: 45280 - RNA, 68 nt, Mus musculus
auuugcucgucuacagaaacuccacgugacgauggcaggacgcaaccucuauauccguuuccagucca

SEQ ID NO: 45281 - RNA, 45 nt, Mus musculus
uugguggaggugccagcagccggguccuugcagaugggaugacuc

SEQ ID NO: 45282 - RNA, 46 nt, Mus musculus
ggcggcugggcaggggaaggcaaccaggacagauucggggacagac

SEQ ID NO: 45283 - RNA, 53 nt, Mus musculus
gcagggccucugugccuggaugggaaggaguaccaggugccgauggcaacgac

SEQ ID NO: 45284 - RNA, 84 nt, Mus musculus
augaacguggugugucuauucgccggcagcuccucuccacaaagcuugcagagccguccucucuacaguaccugccuuacagag

SEQ ID NO: 45285 - RNA, 77 nt, Mus musculus
uagugaugcagagaucauccaguuggucaaugccaagcauaucccagcuuacaaauuggaaacucuaauggaaacuc

SEQ ID NO: 45286 - RNA, 46 nt, Mus musculus
gauacaguuccauucuaccaucauuuacuaagauauauugacagag

SEQ ID NO: 45287 - RNA, 56 nt, Mus musculus
auacuggagaaugcagaggugagaaaagggugugcucacacgggagaauacagagg

SEQ ID NO: 45288 - RNA, 65 nt, Mus musculus
uggggacacaggagccuggaauugaacuccccaucgagccacgaccuaaugaagaaugucugcag

SEQ ID NO: 45289 - RNA, 49 nt, Mus musculus
aaggaaccagaagcuuucgucaguagaggaggauccaggagcgaaccaa

SEQ ID NO: 45290 - RNA, 69 nt, Mus musculus
auagcugauccuucuccucagaacagcacagcggagcaggcuaagguuuccuugggucuggacgaagau

SEQ ID NO: 45291 - RNA, 44 nt, Mus musculus
cgugagggucguccaauuuggcagcucagccauuuugccagagu

SEQ ID NO: 45292 - RNA, 46 nt, Mus musculus
cguccgccagcuggagaucaugugcugcuucggcugcaugucagug

SEQ ID NO: 45293 - RNA, 45 nt, Mus musculus
ucaacguggacacaugggcuaauuaauugcuuuuaugauaaguga

SEQ ID NO: 45294 - RNA, 42 nt, Mus musculus
ucaaaguggcagagcagcugcuuuuggaacagucaggaagaa

SEQ ID NO: 45295 - RNA, 42 nt, Mus musculus
guauuuuaauugccauguuggagguggugcaagaggccagau

SEQ ID NO: 45296 - RNA, 43 nt, Mus musculus
cauccuguacauuuacuuccaguuccagaaccuacggcagcuu

SEQ ID NO: 45297 - RNA, 61 nt, Mus musculus
uccaugaacauguucaccggcaacaacaagaucuguggcuggaauuaugagugcccuaaau

SEQ ID NO: 45298 - RNA, 56 nt, Mus musculus
uauacauugugcuagugacauucugccuuauucuagagacugaaaugaaaagcagg

SEQ ID NO: 45299 - RNA, 46 nt, Mus musculus
acacauuuaaaugggccuucuugccccuguacuuugccaggagaaa

SEQ ID NO: 45300 - RNA, 46 nt, Mus musculus
uuagcucagaucuugcuauuuauucuguugaauccucuugucagac

SEQ ID NO: 45301 - RNA, 46 nt, Mus musculus
ugcucuauaguuuuaccaugagaaauaucucuguaggccaucagac

SEQ ID NO: 45302 - RNA, 30 nt, Mus musculus
ucagucugcaguguuagaagcagugaggcu

SEQ ID NO: 45303 - RNA, 46 nt, Mus musculus
uuuuccccucagauuauuuaauaauaauaaaaaaagacaauguacg

SEQ ID NO: 45304 - RNA, 46 nt, Mus musculus
gauggauggguagguuaagaaugcugaguguucauccuguugggau

SEQ ID NO: 45305 - RNA, 63 nt, Mus musculus
uaauacuuuggucagagaacuugaccaugaagaggagauggacuuagaaacugguaauguaug

SEQ ID NO: 45306 - RNA, 42 nt, Mus musculus
auuuuugucuaauuuguagacugugagcuauauucugggauc

SEQ ID NO: 45307 - RNA, 58 nt, Mus musculus
acuugugauuuauuuguauuuuauuuaucguagggcaaaagucuuggaucuacauugg

SEQ ID NO: 45308 - RNA, 50 nt, Mus musculus
agacuucugagguugggcgaaguuaauagucuuucaucgaaagcggacag

SEQ ID NO: 45309 - RNA, 49 nt, Mus musculus
ugaugucaauuuaccuuaugcaccuauuggaauuauuugguuugaauga

SEQ ID NO: 45310 - RNA, 42 nt, Mus musculus
agcgggucucgcgcuccgccugggcucacgaggcggcugcga

SEQ ID NO: 45311 - RNA, 56 nt, Mus musculus
gagagaggggcaacgugguggcagaaagagaaggggggaagagaaagagagagaug

SEQ ID NO: 45312 - RNA, 46 nt, Mus musculus
uauaaagagaaguggggggaaagggagggggaagcugauggugaaa

SEQ ID NO: 45313 - RNA, 46 nt, Mus musculus
ccaggaguuaggacuggauguccauagaugaguccaaagggugagg

SEQ ID NO: 45314 - RNA, 45 nt, Mus musculus
auaggauuugagaaacuugggaaguaaauucggaaccauugucug

SEQ ID NO: 45315 - RNA, 45 nt, Mus musculus
cuguagguaggucuuaacaaaauaagacaaugcugggcuguuagg

SEQ ID NO: 45316 - RNA, 42 nt, Mus musculus
cuggugggaucugcaguggacaaucccaauagcuguggggag

SEQ ID NO: 45317 - RNA, 46 nt, Mus musculus
guuuggaguaauuguuagccccaaauaggugaccugagggguggag

SEQ ID NO: 45318 - RNA, 46 nt, Mus musculus
aaguaggucaucagaaguugcuuaccuuuggguuuccaggguccag

SEQ ID NO: 45319 - RNA, 45 nt, Mus musculus
gggucuggagagguagagcuagcaggcucugggguauccugguga

SEQ ID NO: 45320 - RNA, 45 nt, Mus musculus
agcacaccaggucaaagcaguuccaccuguaagagguuuauuggg

SEQ ID NO: 45321 - RNA, 61 nt, Mus musculus
cccacauaagcuacaaaaugagugacccacuacaaauaaccuuuuucucugugugggguga

SEQ ID NO: 45322 - RNA, 46 nt, Mus musculus
uuuaugggugugccuagauuccccuuugcucugcaguaccagcagc

SEQ ID NO: 45323 - RNA, 44 nt, Mus musculus
ucuagguucaaucucuuguaccauaagcacuuucaaugggguca

SEQ ID NO: 45324 - RNA, 46 nt, Mus musculus
cucaggaggcagaggcagguggaucccugugaguuugaggccaggg

SEQ ID NO: 45325 - RNA, 45 nt, Mus musculus
caucguagccaaagagcaacguagcaaguaagcccaguaucccag

SEQ ID NO: 45326 - RNA, 46 nt, Mus musculus
cuuggacugacuucuucagaucccucauagcaaccauccuguaccu

SEQ ID NO: 45327 - RNA, 46 nt, Mus musculus
agaagucaguccaaggccaguugaugaaugauaucuuggagugcag

SEQ ID NO: 45328 - RNA, 41 nt, Mus musculus
uagagggcggaaggugcuuauggagcuuuuguaagcuggga

SEQ ID NO: 45329 - RNA, 46 nt, Mus musculus
cacucgaggcucaacguuugccaggauaaugaaggaagccaaagaa

SEQ ID NO: 45330 - RNA, 30 nt, Mus musculus
cuggccggacuuccagcuccgcacucacca

SEQ ID NO: 45331 - RNA, 45 nt, Mus musculus
uaacaucaaggcagagugcacagugcacgcuaguacgcccaagau

SEQ ID NO: 45332 - RNA, 46 nt, Mus musculus
cacauccuggacuggggauccgagcagagguccuggguggggagaa

SEQ ID NO: 45333 - RNA, 45 nt, Mus musculus
ugacauugggcuuuaauguaaaggacaauggaaaucuaaugugaa

SEQ ID NO: 45334 - RNA, 46 nt, Mus musculus
cuuauuuggacaaauucaaauauuugaaauuaaagguuugagagau

SEQ ID NO: 45335 - RNA, 46 nt, Mus musculus
gggacucaccaccaccuucucuucuguggucuaagauaauccccaa

SEQ ID NO: 45336 - RNA, 42 nt, Mus musculus
agaggagaagaggaggaagaagaggaaaaagaagaggaugag

SEQ ID NO: 45337 - RNA, 46 nt, Mus musculus
cuuguucuauaaaugacuuuucucauugauauaauaaaagacccaa

SEQ ID NO: 45338 - RNA, 70 nt, Mus musculus
aguagugugcugucccacuacuuuccacagaacagucucaggaucuguuuuuagagguuuggagugcugc

SEQ ID NO: 45339 - RNA, 46 nt, Mus musculus
aaaaccaucgauuuggguccuggcuaauuucaucaacgcgagguaa

SEQ ID NO: 45340 - RNA, 45 nt, Mus musculus
aacacuuggaacacuuaaaaaaagaaguuggcucuccuaugggug

SEQ ID NO: 45341 - RNA, 24 nt, Mus musculus
ugccuucugggggaggcuggagca

SEQ ID NO: 45342 - RNA, 55 nt, Mus musculus
guuuugagaacugugugcuuguccuuuugucugaaucugaagagaacguggcgug

SEQ ID NO: 45343 - RNA, 47 nt, Mus musculus
ucacucgcuccaccucguccuccgugaguucuccagcccucuuggug

SEQ ID NO: 45344 - RNA, 57 nt, Mus musculus
cucgcaaaaugugcuggaacuucucagggaucacuagagacauggcggcggcacaga

SEQ ID NO: 45345 - RNA, 53 nt, Mus musculus
uaacugggcaguggaagggaagcguggggcuggagguuuuagagaauggggga

SEQ ID NO: 45346 - RNA, 45 nt, Mus musculus
aagccacuugcugcccagccugaugacuugaguucaguuccugag

SEQ ID NO: 45347 - RNA, 45 nt, Mus musculus
acaucaacuucuaauacuguaauucaaugaucugucagcaugcua

SEQ ID NO: 45348 - RNA, 44 nt, Mus musculus
ccuuuccagagugagggagaauugggacugaggcagcuggagga

SEQ ID NO: 45349 - RNA, 45 nt, Mus musculus
aacuccagacauaggcuuuaaugaagugccaaguaaacagacccc

SEQ ID NO: 45350 - RNA, 45 nt, Mus musculus
gguuuacaaaaucaugucuaaauaaaauacuuugucuguuugcau

SEQ ID NO: 45351 - RNA, 42 nt, Mus musculus
gccucgaucuggggaacacgagaaaaagagaaguaaggggag

SEQ ID NO: 45352 - RNA, 45 nt, Mus musculus
aacaugcagacgaauacucauacacguaaaauuuuaaagcgcuau

SEQ ID NO: 45353 - RNA, 46 nt, Mus musculus
uucaguuugccucauucuuagaagccucaucaaaauucuccaccag

SEQ ID NO: 45354 - RNA, 46 nt, Mus musculus
ucaucaucauccucuccaguagcaaggggugcuuuuccauccacag

SEQ ID NO: 45355 - RNA, 116 nt, Mus musculus
uuaaacuagucaggcugucugcaccaagcugguugaggaugcugggaagcauuucugucagcugcuuugucucagcguggccuguaauggugaagguguuugcugccagggaugcc

SEQ ID NO: 45356 - RNA, 46 nt, Mus musculus
uuaaaauggaucacuguuccuugguuuguaaacauguucaccuaua

SEQ ID NO: 45357 - RNA, 45 nt, Mus musculus
cccuaugggagcaagaggggaaacgacacauugacacagcagcag

SEQ ID NO: 45358 - RNA, 46 nt, Mus musculus
aaugcgcacuugugccugcaguuuggcgaguuucuccugguucaug

SEQ ID NO: 45359 - RNA, 46 nt, Mus musculus
agaggaaaaaaaaaaauccucagccaagaacaagaacggccgggcc

SEQ ID NO: 45360 - RNA, 64 nt, Mus musculus
gcagaccagcugagagaaggcgcacacacgcggggacgcaagauggcagcuagagggaggccgg

SEQ ID NO: 45361 - RNA, 44 nt, Mus musculus
ucccagacaaauuuuaagauaaccuuagaaaaucccuauaugaa

SEQ ID NO: 45362 - RNA, 46 nt, Mus musculus
gccuuuuuccaaucuuagcuacgaaauguuuuugaauauuccaaag

SEQ ID NO: 45363 - RNA, 48 nt, Mus musculus
ccuuuuuacacaagaguuucuugcaacagcgaugagucauuuaaaaaa

SEQ ID NO: 45364 - RNA, 68 nt, Mus musculus
ccaucucuccagcccuagcugucagaucuuuauuacagccagucagauacaauucuagauuaccuuag

SEQ ID NO: 45365 - RNA, 42 nt, Mus musculus
agaauuugcuuugucuucuacaguguuauacuuugcuggcug

SEQ ID NO: 45366 - RNA, 46 nt, Mus musculus
ugugccucccacccuauuaguacuauuggggaguaguaaggcuuug

SEQ ID NO: 45367 - RNA, 81 nt, Mus musculus
gcgaucguagauugggcuacauccaucugucaucugaagaagaagaagaaggaaaaaaacccaacaaaucuuggaccaaaa

SEQ ID NO: 45368 - RNA, 46 nt, Mus musculus
agcacuggcgagaacacauuggaaaaucugaggcagacccggagga

SEQ ID NO: 45369 - RNA, 45 nt, Mus musculus
ugaauagacuugaaauacaguaugaaggagagaauagcccaauag

SEQ ID NO: 45370 - RNA, 42 nt, Mus musculus
cuucaccgucuccugaguuuuccaagcaugccuuuacccaag

SEQ ID NO: 45371 - RNA, 46 nt, Mus musculus
uaucugcuucuccgauguuuucuuuacuauaaugcaagcucaggag

SEQ ID NO: 45372 - RNA, 45 nt, Mus musculus
gccagcucccaggaaugacacaaaggacacuuguugccugggcaa

SEQ ID NO: 45373 - RNA, 31 nt, Mus musculus
gaagggaauggauuuuugaggguccucaaag

SEQ ID NO: 45374 - RNA, 42 nt, Mus musculus
aauuuucuuuugaauuccauggaaaaugguguuugggcgagg

SEQ ID NO: 45375 - RNA, 42 nt, Mus musculus
cucuguagaauuuuguuuacaaauacuacuaaaaaggucaug

SEQ ID NO: 45376 - RNA, 24 nt, Mus musculus
gaugagcuucugguaccuucccuc

SEQ ID NO: 45377 - RNA, 47 nt, Mus musculus
gacuugguguggacuuggguagacaaaugcugggagcaugccuuaga

SEQ ID NO: 45378 - RNA, 46 nt, Mus musculus
ucggucuugcaugggggcuggagguggguccauguguuuguaugug

SEQ ID NO: 45379 - RNA, 48 nt, Mus musculus
ucaucgcauugccugcccuguuguuuuccuccugaaggugggggggcu

SEQ ID NO: 45380 - RNA, 45 nt, Mus musculus
acauccuggcgugccucugagggggacuucuuuuccguaguguag

SEQ ID NO: 45381 - RNA, 67 nt, Mus musculus
cuauucaaggccagaugauguugcauuguaucaaauagcauugaggagcggaagccauagggcucug

SEQ ID NO: 45382 - RNA, 45 nt, Mus musculus
cuucaguuggcccguuuucagugauaugaagcacacuggcaccca

SEQ ID NO: 45383 - RNA, 42 nt, Mus musculus
agaucggugaucuugaacugguguccuggauuuggcugucuu

SEQ ID NO: 45384 - RNA, 46 nt, Mus musculus
agucaucaacuucuguggaauguggagaacccaccucggcaugcag

SEQ ID NO: 45385 - RNA, 42 nt, Mus musculus
cuuuucucuuccuguuugucuugguaaagaccaguggaaguc

SEQ ID NO: 45386 - RNA, 55 nt, Mus musculus
gugacuucuguggguaggugacuggacuucucaucggugggagauugguaguaag

SEQ ID NO: 45387 - RNA, 44 nt, Mus musculus
ugaauuugucuucuuccauggacgaagguggugauaugguggag

SEQ ID NO: 45388 - RNA, 95 nt, Mus musculus
ugaccacagacucccucuucuccuugaggugcacguccgccucagccuuugcgcuuucgucaucuucuguggggcugugcuuagaggcacucccg

SEQ ID NO: 45389 - RNA, 46 nt, Mus musculus
uucuuaguggacucuucuuucuucgcuacuuuugguuuuaacgcag

SEQ ID NO: 45390 - RNA, 45 nt, Mus musculus
uguuuucuccacuugacuagucuuugugacuucagggguuuccuc

SEQ ID NO: 45391 - RNA, 45 nt, Mus musculus
cccgcuguuucaguuugaccuguuucacugggggggugggcaccu

SEQ ID NO: 45392 - RNA, 45 nt, Mus musculus
ugggucuuucagguuuucagguacguugagaaacacaacccccag

SEQ ID NO: 45393 - RNA, 44 nt, Mus musculus
ucauccccaaugugggugagcaggauggaguccacacgguccaa

SEQ ID NO: 45394 - RNA, 46 nt, Mus musculus
aaggcuuggagagcuucagaaagccgcccgagguuggggguuccag

SEQ ID NO: 45395 - RNA, 46 nt, Mus musculus
ugagagauacucggugaacucagaaagucccuccauuucuggcaag

SEQ ID NO: 45396 - RNA, 42 nt, Mus musculus
guuuuuucugaguuugaggccagccuggucuacaaagcaagu

SEQ ID NO: 45397 - RNA, 46 nt, Mus musculus
agggaggcauucuaaagggauaaauguaagggccagcagccagcag

SEQ ID NO: 45398 - RNA, 46 nt, Mus musculus
uguaguuauuggggacuagcaaaacguaaagaaauacagcugccag

SEQ ID NO: 45399 - RNA, 42 nt, Mus musculus
cuacaaauaaaccagccuugguaugguagagaaaagccugag

SEQ ID NO: 45400 - RNA, 41 nt, Mus musculus
gaagagaaagacaaaucugugcaaaaagaccucagcaaaca

SEQ ID NO: 45401 - RNA, 23 nt, Mus musculus
acagucaaaugaggggggcucug

SEQ ID NO: 45402 - RNA, 45 nt, Mus musculus
gauuguggggugaagaaaucaacuacacuuuacauuacacuuuca

SEQ ID NO: 45403 - RNA, 46 nt, Mus musculus
ugaguuccugguccaaguugcacucaaucagguuugugucccacga

SEQ ID NO: 45404 - RNA, 45 nt, Mus musculus
uauugcuuuuuaaaauauuuuguuucuauuauuuuuaauuaugua

SEQ ID NO: 45405 - RNA, 45 nt, Mus musculus
acaccagcuacucaaacugcacugugagccuccccaugagagagu

SEQ ID NO: 45406 - RNA, 45 nt, Mus musculus
ugaagcauuuuauaaauggcuuuugauaauugacugggcugaaca

SEQ ID NO: 45407 - RNA, 61 nt, Mus musculus
aagaggauggugggagauuaugacagacggaaaccuuagagagaugccaguugcgggagaa

SEQ ID NO: 45408 - RNA, 64 nt, Mus musculus
gucugcagauuauaaaaguaagaggaauuacugcaagcaguugaagagcaaauuaucgcacauc

SEQ ID NO: 45409 - RNA, 41 nt, Mus musculus
uaggcugcugcugaugaauauaauagacuaaagcaaguuaa

SEQ ID NO: 45410 - RNA, 42 nt, Mus musculus
acaacucuacaagagaaauuuugaugcaggucugcaggagua

SEQ ID NO: 45411 - RNA, 45 nt, Mus musculus
ucagucuguguguguguguguguguguaugugugugugugugugu

SEQ ID NO: 45412 - RNA, 45 nt, Mus musculus
aaucauaaaccuagagauaaaacuuagcuucuggauucuguagau

SEQ ID NO: 45413 - RNA, 45 nt, Mus musculus
cuggucuacagagugaguuccaggacagacagagcuacacagaga

SEQ ID NO: 45414 - RNA, 45 nt, Mus musculus
ccacgcccccugguuucugauucagugguuuuagagcugauguug

SEQ ID NO: 45415 - RNA, 45 nt, Mus musculus
acagacagacaaacagagccuguuuuagagaggucugugggaaga

SEQ ID NO: 45416 - RNA, 46 nt, Mus musculus
aaugcccaguauauguguguguguguguguguguguguguguguga

SEQ ID NO: 45417 - RNA, 45 nt, Mus musculus
uaccacauuugcuuuauccauucucuaguugauggacccauaggu

SEQ ID NO: 45418 - RNA, 46 nt, Mus musculus
uauguaguuaccuuaugauaagugacggguauuucagccucaagca

SEQ ID NO: 45419 - RNA, 45 nt, Mus musculus
guuaggaaaucuacaagcuuagaugaaacuuaguucuaguuagug

SEQ ID NO: 45420 - RNA, 42 nt, Mus musculus
auuuacucuuuaacuaaacaggcuucccaaguagccaggauc

SEQ ID NO: 45421 - RNA, 42 nt, Mus musculus
cuauagccauuguccugggguucaugauuaucguggcuuuug

SEQ ID NO: 45422 - RNA, 46 nt, Mus musculus
ccagcaaucauguccagcagcucacaacugccuguaacugggagau

SEQ ID NO: 45423 - RNA, 57 nt, Mus musculus
auuagcaucauggagcaucaaccuuauuaacccagcauguaacgcuaaggaccagua

SEQ ID NO: 45424 - RNA, 69 nt, Mus musculus
cucaauuugauacauuuacuauucauuuguguaguuuaagaucuccacugccagacuaagucgcaaguu

SEQ ID NO: 45425 - RNA, 45 nt, Mus musculus
gcccaccucccggccccucuuuccuuaggcgacagcgguggaguu

SEQ ID NO: 45426 - RNA, 46 nt, Mus musculus
gauguucaaaauuaaagguguguuuuaaaaagaauuugcccccaag

SEQ ID NO: 45427 - RNA, 42 nt, Mus musculus
acagugaagacucccugcuuccuguuaugcagcaccuggcua

SEQ ID NO: 45428 - RNA, 45 nt, Mus musculus
ucagugcuguagcuaacuucagucuuuaggauaacacccuuugga

SEQ ID NO: 45429 - RNA, 46 nt, Mus musculus
cccucugccucugcacuuccuccguagagcaucuaaagucggagag

SEQ ID NO: 45430 - RNA, 46 nt, Mus musculus
gcaucacaaaacuuaguugugagugaaaagaucugaggugaugaug

SEQ ID NO: 45431 - RNA, 54 nt, Mus musculus
uaucugugucaggcuuucucugauguaauccuugcagugagugacguagacgca

SEQ ID NO: 45432 - RNA, 46 nt, Mus musculus
ggagccucucuuuuuuaagguugauaaucccucuccaagcccgaug

SEQ ID NO: 45433 - RNA, 46 nt, Mus musculus
uuuaagccuaaaaaugaaguuugccugaguuuguagccuguuagau

SEQ ID NO: 45434 - RNA, 46 nt, Mus musculus
gggaugguauauucaaaaacuauuuuuaaaaagauuucaggcagag

SEQ ID NO: 45435 - RNA, 45 nt, Mus musculus
acucuggggugaguauuagcacccugcgucaaaugguggcagaua

SEQ ID NO: 45436 - RNA, 46 nt, Mus musculus
gcaaaaacgcuagguacuggaaaagguacuguuaaagcccuaccaa

SEQ ID NO: 45437 - RNA, 42 nt, Mus musculus
gugaaagauuuggguggaaacuugcuugucacggcuggaggc

SEQ ID NO: 45438 - RNA, 60 nt, Mus musculus
uuauggagggugaaaaagaccucuggaccuaucugggcugcaggacuuguggggaguggg

SEQ ID NO: 45439 - RNA, 41 nt, Mus musculus
uuaguguuuagcuguggauagccagagguuagggugucuuc

SEQ ID NO: 45440 - RNA, 45 nt, Mus musculus
ugggcucgggacgcacugccugccagguuccagucccuagagaga

SEQ ID NO: 45441 - RNA, 46 nt, Mus musculus
agagcccgcggcgcgggcagcggcuccugagccugcauggaggaga

SEQ ID NO: 45442 - RNA, 46 nt, Mus musculus
acaaagagauuauuauuuuuggauuucugaugauacgauaacgcag

SEQ ID NO: 45443 - RNA, 45 nt, Mus musculus
gggcaggaguacaggcuaaccugcucaagugugugagagggaaca

SEQ ID NO: 45444 - RNA, 49 nt, Mus musculus
aggaggaggacgauacaaacgaugaggacuucaccguggagauaaggca

SEQ ID NO: 45445 - RNA, 45 nt, Mus musculus
auguaugaagauaggaugcccuacggagugucaaaugcagccaaa

SEQ ID NO: 45446 - RNA, 47 nt, Mus musculus
uuaugaccagcaagugccuuacguggucaccaacagucagcguggga

SEQ ID NO: 45447 - RNA, 54 nt, Mus musculus
gcggcgaaaucugugguccaugggguaggugcugucugguauggacugagaagg

SEQ ID NO: 45448 - RNA, 72 nt, Mus musculus
uugguacauaggacgcccuucccuuggcauugucggcaaaggaggaaaagaauuacaggguucagaaagcug

SEQ ID NO: 45449 - RNA, 46 nt, Mus musculus
ggcacuguucaaaaagaaaugccccauaaguacuaccacagcaaaa

SEQ ID NO: 45450 - RNA, 46 nt, Mus musculus
aaagagcagagacagcuuccugaagugggugaaggagaacaaccag

SEQ ID NO: 45451 - RNA, 47 nt, Mus musculus
auaauggaccuugugguuagagggaagaaccacuguacagaagauga

SEQ ID NO: 45452 - RNA, 46 nt, Mus musculus
uucuucauaagcacuauagacaaaaacaaugggggaagauagcaag

SEQ ID NO: 45453 - RNA, 46 nt, Mus musculus
cagaaagagaagaaaaaugaaauacugguaguagacaaaauuagau

SEQ ID NO: 45454 - RNA, 46 nt, Mus musculus
uccucaugacuggcgggaacaaguacuacgacacauugaggccaaa

SEQ ID NO: 45455 - RNA, 55 nt, Mus musculus
ucucggugaccccacaaggcguacugaaggagauuacuuaucguacagagaguua

SEQ ID NO: 45456 - RNA, 43 nt, Mus musculus
uacaaaggcaguuuucaaguuugauucaaaucacaacccugaa

SEQ ID NO: 45457 - RNA, 45 nt, Mus musculus
gaauauuaauaaacuugugaccaauaauauuuuucaaccagaagu

SEQ ID NO: 45458 - RNA, 42 nt, Mus musculus
uggggaaaguuuauuauggcuuaugguugcaaagggcgaguu

SEQ ID NO: 45459 - RNA, 98 nt, Mus musculus
uuaagaauauggucaagacuguucaaaccauuguacauagauuaaaagaugaagagacuaaugaagagucugggagagauuugaagcagcaugaagau

SEQ ID NO: 45460 - RNA, 46 nt, Mus musculus
gaagugagugagugugugugugugugugugugagagagagagagag

SEQ ID NO: 45461 - RNA, 67 nt, Mus musculus
gagaaaacagcgggcucaaguggcauuugaaugugaugaagacaaagaugaaagagaggcaccaccc

SEQ ID NO: 45462 - RNA, 46 nt, Mus musculus
guguguguuuugcguguggcaugugcgugugugugugugugugugu

SEQ ID NO: 45463 - RNA, 88 nt, Mus musculus
ccacaaguguguacuuguggauuagugugugaagauagaggaccaaauuauuuuuaguauaucuaauauacaucagaaaucauuagau

SEQ ID NO: 45464 - RNA, 45 nt, Mus musculus
cuauauguuacugcuaaguuacuuccugaguuuugcccagcaaga

SEQ ID NO: 45465 - RNA, 41 nt, Mus musculus
aauggugcuuacuaauuacauguucccucagcagccacgga

SEQ ID NO: 45466 - RNA, 46 nt, Mus musculus
ugccacuugcuuauguagacuaggcuagucaugaauuuguagagau

SEQ ID NO: 45467 - RNA, 46 nt, Mus musculus
uuuugugcuugaaccagcaugucccaguacacucccaucccaaguc

SEQ ID NO: 45468 - RNA, 45 nt, Mus musculus
uccucaauuggccagcucacaaacaugagaacauuugcugcagau

SEQ ID NO: 45469 - RNA, 42 nt, Mus musculus
aaugguugaagaaggaauuucaacaugugaaaaccuccagga

SEQ ID NO: 45470 - RNA, 46 nt, Mus musculus
gugugugugugggugugugugugugugugugugugugugggugugg

SEQ ID NO: 45471 - RNA, 46 nt, Mus musculus
acagauuaacuaaacuccagauucuagaacuuagagaaaaccaguu

SEQ ID NO: 45472 - RNA, 46 nt, Mus musculus
cugaaugaugcuuuccuugaauucuuaccagcuaauuuuggcaggu

SEQ ID NO: 45473 - RNA, 46 nt, Mus musculus
gacucauucaugguauaucauauauugauauuccauagugugacua

SEQ ID NO: 45474 - RNA, 47 nt, Mus musculus
accugaacaaaaccuaguacuuaaaaaguauuaauaugaaguuuaga

SEQ ID NO: 45475 - RNA, 45 nt, Mus musculus
cuacuuauuuuuuuuugaaauaaggugauuaacugagccuggaac

SEQ ID NO: 45476 - RNA, 46 nt, Mus musculus
gaagaaguauaagugauguuguugauuuuaucaugcaacuggaaag

SEQ ID NO: 45477 - RNA, 42 nt, Mus musculus
cuuggaaggaagaggcauucaggucucuugaguuucagacca

SEQ ID NO: 45478 - RNA, 46 nt, Mus musculus
agauuuccguuuccuugguaacuuagggagggucuaaggacaagau

SEQ ID NO: 45479 - RNA, 41 nt, Mus musculus
gcagggggggggggggagagagagagagagagagagagaga

SEQ ID NO: 45480 - RNA, 46 nt, Mus musculus
guuuugaugaagagugaggacuguacuaaccuguaggcauagagac

SEQ ID NO: 45481 - RNA, 66 nt, Mus musculus
cuuuuuaauugucagucucuacauaaacuaaguuugccagacaaugauuuaacaacauuaccagcc

SEQ ID NO: 45482 - RNA, 59 nt, Mus musculus
uccauagaauacccaaagaaaugugaaagauaaucagaucccuuuuucacuuuuuuccc

SEQ ID NO: 45483 - RNA, 44 nt, Mus musculus
aauaauguggagaagucuagaacuuucuuauuugugcacaguaa

SEQ ID NO: 45484 - RNA, 46 nt, Mus musculus
aaugaagacaguagucacuuguauuguaaauuaggaauuaggagag

SEQ ID NO: 45485 - RNA, 45 nt, Mus musculus
acuccuuaguuacauuccuggcccuucucucuguccuucucuauu

SEQ ID NO: 45486 - RNA, 45 nt, Mus musculus
agcauaauauuuuuuguuuguauguacacguggggugcugucaga

SEQ ID NO: 45487 - RNA, 45 nt, Mus musculus
guggcccagcauuuaguuuuuaaugucuuagaauauccuccagau

SEQ ID NO: 45488 - RNA, 45 nt, Mus musculus
ggcaagauagccauuuuuacuauauuaccugccaauccaugagca

SEQ ID NO: 45489 - RNA, 72 nt, Mus musculus
ugggauuguauugaaugugcaaguagcuuuugguagaauggaagauaagcuggccuuaccaggcagggccug

SEQ ID NO: 45490 - RNA, 46 nt, Mus musculus
ugucugagagagacagagauacauagagacagagagggaaggggag

SEQ ID NO: 45491 - RNA, 46 nt, Mus musculus
cccucaccguagaauuaauagguuggccuuuacuauccuuggagau

SEQ ID NO: 45492 - RNA, 46 nt, Mus musculus
cucuguagauacauacucuucccagguuuuuaaaauggcugcagac

SEQ ID NO: 45493 - RNA, 46 nt, Mus musculus
auaagauggauucuuauuguggaguuuaguauauuuauuaccaaga

SEQ ID NO: 45494 - RNA, 46 nt, Mus musculus
uacagguguuuccuguucuucaggagaugccuuccucuguccagca

SEQ ID NO: 45495 - RNA, 46 nt, Mus musculus
gacugaugaguauuacagcgagaggaugggaaaauggaaagaagau

SEQ ID NO: 45496 - RNA, 45 nt, Mus musculus
ucaagccaaauauuuuuggagacuuguuuaaaaugaagcaacgga

SEQ ID NO: 45497 - RNA, 47 nt, Mus musculus
augacugguggacuuuaugauuuggggacguauaauuaggcagcaaa

SEQ ID NO: 45498 - RNA, 46 nt, Mus musculus
uuguuuuccgugagcuuuaaaucuuggauucaguaaagcuaagcag

SEQ ID NO: 45499 - RNA, 66 nt, Mus musculus
uucuagaacaccuccuuauuccuugcuuaucuucucauccaaucucucauucuuucucucuauggc

SEQ ID NO: 45500 - RNA, 43 nt, Mus musculus
acccacauuuguaugcugauaguucucagcacugugcccccag

SEQ ID NO: 45501 - RNA, 45 nt, Mus musculus
agccauccagaggcaaauuguacgcuuuguaauuggagcagcuuc

SEQ ID NO: 45502 - RNA, 42 nt, Mus musculus
aggaggagcggaagguccgguccagcucaaggugguagcuaa

SEQ ID NO: 45503 - RNA, 55 nt, Mus musculus
gugguuuggaaagacacggaauuugaauagagugaggaagauggaagacauuuca

SEQ ID NO: 45504 - RNA, 23 nt, Mus musculus
uuccaugggugcacuugcccuca

SEQ ID NO: 45505 - RNA, 69 nt, Mus musculus
aaacuugguucguaucccaucacugcauuagagaggaaauaaguaggaacagagaguagaugccccaug

SEQ ID NO: 45506 - RNA, 46 nt, Mus musculus
aaccagagcgccugggaacacagaucagugcauagugcuugcccag

SEQ ID NO: 45507 - RNA, 46 nt, Mus musculus
ggcuacaggaccccugucucgaaaacaaaaacccccaaacacccca

SEQ ID NO: 45508 - RNA, 45 nt, Mus musculus
auaccaucacauuccuaaaaugagcaugucauuacucagccuaag

SEQ ID NO: 45509 - RNA, 46 nt, Mus musculus
cggugugguggcacacgccuuuaaucccagcacucccagcacucgg

SEQ ID NO: 45510 - RNA, 46 nt, Mus musculus
uagcucuggccguccuggaacgacacagccaagggguaacucacag

SEQ ID NO: 45511 - RNA, 45 nt, Mus musculus
augcagagacccacaaucaaacaguggauggagcuuggggacucu

SEQ ID NO: 45512 - RNA, 42 nt, Mus musculus
cgcuguggagaggaguggggauaacugacugguuaucuggga

SEQ ID NO: 45513 - RNA, 43 nt, Mus musculus
gaaaaaaggaucaagggaggaacaaaaaguaggaaguugggag

SEQ ID NO: 45514 - RNA, 24 nt, Mus musculus
cucuaccauaccuuccugcaacuc

SEQ ID NO: 45515 - RNA, 42 nt, Mus musculus
aggacuuaaauucucuugucacuaaauccuuuacggccccag

SEQ ID NO: 45516 - RNA, 46 nt, Mus musculus
caggcguuacuuacuugacuugguuguauuaaacacuuauugcaau

SEQ ID NO: 45517 - RNA, 46 nt, Mus musculus
aucuaaaauaugugaauauuguuucaguaguguuuacagggcacau

SEQ ID NO: 45518 - RNA, 45 nt, Mus musculus
ccuagguccuugcauguuuuuacaacuacuugggaaucaguguug

SEQ ID NO: 45519 - RNA, 45 nt, Mus musculus
aauaaaggagagcugaugauuggacagauaaaagggaagguggag

SEQ ID NO: 45520 - RNA, 73 nt, Mus musculus
acauggccuagagaaacugcaaguucuaaggggucucauaaauguggaagaugguaguguagugguagaucug

SEQ ID NO: 45521 - RNA, 45 nt, Mus musculus
cacaauuuaguuauguguaaggaaaaaccuuuaagguagggcauu

SEQ ID NO: 45522 - RNA, 51 nt, Mus musculus
guugucaaacuaguccacucaugugcugugucugcaaagaauauggaaagc

SEQ ID NO: 45523 - RNA, 45 nt, Mus musculus
ugggauuguucagcacauugaaggaggagaacaaauaguagaaga

SEQ ID NO: 45524 - RNA, 46 nt, Mus musculus
uguaguuuauggauguuuaaacucagauuugaaggaauuccgucaa

SEQ ID NO: 45525 - RNA, 45 nt, Mus musculus
uuguugcuguuaaauauagaaagugaacuggaaggaaguagcgug

SEQ ID NO: 45526 - RNA, 46 nt, Mus musculus
guugaaaucaucuaauuuaagaugcuuauguccugcaguacuggag

SEQ ID NO: 45527 - RNA, 46 nt, Mus musculus
cuauaauuguacucauauauauaaaauaaguaaauaaauauuucaa

SEQ ID NO: 45528 - RNA, 46 nt, Mus musculus
uguguucacaauauucagcagaaauaaacugcggaagucaaggcag

SEQ ID NO: 45529 - RNA, 45 nt, Mus musculus
uucauucuugaucucuuuugcuuucucuuucuuacuugucacaga

SEQ ID NO: 45530 - RNA, 46 nt, Mus musculus
gcuauucaggugacucuuuucuggcgcuaagacauuauuguuucag

SEQ ID NO: 45531 - RNA, 46 nt, Mus musculus
aaucucaaagcuagccugaguuaugcaucaagaccuugucucagaa

SEQ ID NO: 45532 - RNA, 46 nt, Mus musculus
gaguugguauauucagggcugugaugcucgaaguggaauggggcuc

SEQ ID NO: 45533 - RNA, 46 nt, Mus musculus
uggacuauuugugauucucagggguaacaaauugaaaugcacuaaa

SEQ ID NO: 45534 - RNA, 45 nt, Mus musculus
uggagguugugcagaggauuucuaacguuaaagucaaccccaaaa

SEQ ID NO: 45535 - RNA, 46 nt, Mus musculus
cauagauaaauucuuuaacaugagaauuuuucuuacacuuucagaa

SEQ ID NO: 45536 - RNA, 45 nt, Mus musculus
uugcccaggagaugccauaucuucaguugcugcuucugagaagag

SEQ ID NO: 45537 - RNA, 46 nt, Mus musculus
cuuacuaugcaaaaggcccuggauucaauuccuaguacugcaagaa

SEQ ID NO: 45538 - RNA, 46 nt, Mus musculus
agcucuuugagaauacucaaaagagucuauuucagaacugauagaa

SEQ ID NO: 45539 - RNA, 55 nt, Mus musculus
gucugugugugugugucugugugucuguguguguguaugugugugugucugugug

SEQ ID NO: 45540 - RNA, 60 nt, Mus musculus
ugugugugugugugucuguguguguguaugugugucugugugugugugugugugucugug

SEQ ID NO: 45541 - RNA, 45 nt, Mus musculus
ggcagcuguuguagaaauguggaugaguuuuaauuagggcuuaga

SEQ ID NO: 45542 - RNA, 46 nt, Mus musculus
gaauuccuaauauugauugagcaggugugggaaggagcucucagaa

SEQ ID NO: 45543 - RNA, 46 nt, Mus musculus
agcacgcccacgggcgggagugagauuguggguuugugcacuuaga

SEQ ID NO: 45544 - RNA, 44 nt, Mus musculus
accggcccuggcaguggcggggagcgaagaaaaugaugaugaga

SEQ ID NO: 45545 - RNA, 46 nt, Mus musculus
aagguucaagggccagauccugaugcccaacaucgguuaugggagc

SEQ ID NO: 45546 - RNA, 40 nt, Mus musculus
gcaucauggcugcccuccggccucuggugaaguccaagau

SEQ ID NO: 45547 - RNA, 46 nt, Mus musculus
ccaaccccggccgggagcgcggcgcuuguggaugcauuggagcaga

SEQ ID NO: 45548 - RNA, 46 nt, Mus musculus
aaggcugcuucguguuuuauuucaggacucauguucaacacaggga

SEQ ID NO: 45549 - RNA, 46 nt, Mus musculus
uuucuaucaaagaaaacaaaaucuacacuugauguauuggugggug

SEQ ID NO: 45550 - RNA, 45 nt, Mus musculus
agacuacuuacuguuuauaaaauaaguucauaaauugugggggcc

SEQ ID NO: 45551 - RNA, 42 nt, Mus musculus
uugaguuccaggcuggccuugaacuugcaauucccccgccug

SEQ ID NO: 45552 - RNA, 42 nt, Mus musculus
uccuccaacaaugccgcaucuccuaacuucccaagggccaag

SEQ ID NO: 45553 - RNA, 45 nt, Mus musculus
guguguguguguguuggcuuuuaagcauucuaaauucgacagcag

SEQ ID NO: 45554 - RNA, 80 nt, Mus musculus
uuccugguuauuccugacuucuagauaauuaaaauucuacuaccugguguuucuuuuuaagcuauuuaaaaauugucaga

SEQ ID NO: 45555 - RNA, 42 nt, Mus musculus
uccagacaguaaaucaguauuucuacagacaaauggcgaaau

SEQ ID NO: 45556 - RNA, 46 nt, Mus musculus
uaguuauagaagauuuguggaagcaaaauuuucagaagccaggaaa

SEQ ID NO: 45557 - RNA, 42 nt, Mus musculus
gccagccugagccugcucaccuucagagucuaugcagcaccc

SEQ ID NO: 45558 - RNA, 45 nt, Mus musculus
uaaaaguguaacgcuucaugacauaucaaucugaaaugccaagag

SEQ ID NO: 45559 - RNA, 30 nt, Mus musculus
gaggcugagcuucaccccccaccucuaaga

SEQ ID NO: 45560 - RNA, 24 nt, Mus musculus
caccaugccaugacugacuggcag

SEQ ID NO: 45561 - RNA, 45 nt, Mus musculus
acacuugaccagacucgggguagaucuuuucuguaagguuguagg

SEQ ID NO: 45562 - RNA, 44 nt, Mus musculus
gguauggugucucaugcguguaacccuagcacuuaggaggcaga

SEQ ID NO: 45563 - RNA, 46 nt, Mus musculus
agcguggcugccuccgacuuuucuaccuuuauauaagugcccaugg

SEQ ID NO: 45564 - RNA, 42 nt, Mus musculus
uguucugaauaucccugguuggaccaauagaagccccaagug

SEQ ID NO: 45565 - RNA, 46 nt, Mus musculus
cuccccagcacuuagauuacaaguaccucccaccgugccugcauuu

SEQ ID NO: 45566 - RNA, 45 nt, Mus musculus
cgaaguuuauguagugcuuuccaaguauguaaaauuaucuacagg

SEQ ID NO: 45567 - RNA, 69 nt, Mus musculus
aauuaaguccuggguguuugugaagcuuuuguuaagugcugaggguuggaagauuuugacagcgauaaa

SEQ ID NO: 45568 - RNA, 46 nt, Mus musculus
gugccagucucauugaaaccacaguguauugcuaaguuggccaguc

SEQ ID NO: 45569 - RNA, 45 nt, Mus musculus
gagaggguuacuccaccaucagcauagcagggaccuggagaagua

SEQ ID NO: 45570 - RNA, 52 nt, Mus musculus
aaacaagggauuucaguuguuguucuauugauguggagagaaaccgagacca

SEQ ID NO: 45571 - RNA, 71 nt, Mus musculus
uaauacguucugccuuguucuuaagaagcagauuuuagccagguguaaccccgagacuugagaggugaaga

SEQ ID NO: 45572 - RNA, 54 nt, Mus musculus
cucgguaaagaaaccagugaagaacucuugccuucaccuacugcaacucaaguu

SEQ ID NO: 45573 - RNA, 64 nt, Mus musculus
aaagaaugaaaaguacagagaagaaauuaaaauaaaaagccaagauuuuuaugaaaaagauaaa

SEQ ID NO: 45574 - RNA, 46 nt, Mus musculus
gaacacuugugugauggauuucuuuuugggcuaguuugcugcagag

SEQ ID NO: 45575 - RNA, 46 nt, Mus musculus
acugacuucagucugucuccauugucaguaggguuucuucuuugag

SEQ ID NO: 45576 - RNA, 45 nt, Mus musculus
ucccugauggccaaacagagcuuucaguccuugacaccaucuaga

SEQ ID NO: 45577 - RNA, 42 nt, Mus musculus
agaucugagaaagagagacagagacagagacagagacagaga

SEQ ID NO: 45578 - RNA, 46 nt, Mus musculus
aguagccaagaugugggacuggcugggaugcuccucagugcaagag

SEQ ID NO: 45579 - RNA, 45 nt, Mus musculus
gaaugggcaagugugauugcaugagauucagaagguccuggcagu

SEQ ID NO: 45580 - RNA, 46 nt, Mus musculus
cucacguagguuuggaagccugccuuagauccagauugggaaaggu

SEQ ID NO: 45581 - RNA, 46 nt, Mus musculus
aauaacagauguaauaaacuacccccaaaccuucuggccaguucca

SEQ ID NO: 45582 - RNA, 52 nt, Mus musculus
ggggugccacugucauacagaacucugaaaggacaggaggaucugaagguca

SEQ ID NO: 45583 - RNA, 45 nt, Mus musculus
uagaaugacaggcaggaaccagagggcaacuguugcugaaggaga

SEQ ID NO: 45584 - RNA, 23 nt, Mus musculus
uuaaaaggccaagauggcaucua

SEQ ID NO: 45585 - RNA, 44 nt, Mus musculus
ugcucuggccuauaauauguugauuuugcaguuuaacauucaga

SEQ ID NO: 45586 - RNA, 45 nt, Mus musculus
guuucucacuaaggggcgggaccacagggugagagcagcccaguc

SEQ ID NO: 45587 - RNA, 42 nt, Mus musculus
gauuagaagaacaaggaagacuccacccacuauggagguaag

SEQ ID NO: 45588 - RNA, 46 nt, Mus musculus
aggccuauugcaacagugcgauuauauaucaauuuaaagcaaagau

SEQ ID NO: 45589 - RNA, 46 nt, Mus musculus
agcucucuuuaaaccaugguggcaguauaaagaagacagugcagaa

SEQ ID NO: 45590 - RNA, 46 nt, Mus musculus
cauaguggugagaaugcacuugugcacugaggaaagacugcuagac

SEQ ID NO: 45591 - RNA, 24 nt, Mus musculus
gaagaaaaugugccucaugaagua

SEQ ID NO: 45592 - RNA, 45 nt, Mus musculus
agauuagacagagauuccccaccccccaaaaacauucaguggacu

SEQ ID NO: 45593 - RNA, 46 nt, Mus musculus
guuuagaaccauggagacgagcagggugacaagaaaauuaggagaa

SEQ ID NO: 45594 - RNA, 63 nt, Mus musculus
uguaaagucaagggagucacccaugccuugcccugccccugcccucccacccgcacccacacc

SEQ ID NO: 45595 - RNA, 45 nt, Mus musculus
uugugaagcuccagcaggacuuggguuggggugaaacaggcagau

SEQ ID NO: 45596 - RNA, 36 nt, Mus musculus
gcaagccacuuaaggcgaucugggaacuuagcaaga

SEQ ID NO: 45597 - RNA, 58 nt, Mus musculus
acuauucgagagaaaaggauuguagaagcagcgaacagaaaagagguagacuaugaag

SEQ ID NO: 45598 - RNA, 46 nt, Mus musculus
uaauuuauacgaacuaauaguuuuauuuaauacuuccaaaauagau

SEQ ID NO: 45599 - RNA, 46 nt, Mus musculus
auggcaggguuggaacucaaaaccagagaaaagaacacgcggaaua

SEQ ID NO: 45600 - RNA, 41 nt, Mus musculus
gaagggaagaagagaaauugaggaagggaauucggugagaa

SEQ ID NO: 45601 - RNA, 47 nt, Mus musculus
gagaguguguugugugaguaugugugugugugugagugugugagugu

SEQ ID NO: 45602 - RNA, 46 nt, Mus musculus
guguccagugaugcugugcccgcuccuuuuuacauuggauugcacu

SEQ ID NO: 45603 - RNA, 46 nt, Mus musculus
ucauacagagaaacccugucucgaaaaaaaaaaaaaaaucuguucu

SEQ ID NO: 45604 - RNA, 44 nt, Mus musculus
cuucaguuuaaacaggcucugucuuacuucuuccuccuugcucg

SEQ ID NO: 45605 - RNA, 46 nt, Mus musculus
guauaauguuacacauauguauauuuuuaggacugaccaccuagua

SEQ ID NO: 45606 - RNA, 51 nt, Mus musculus
cuaacugggggagccauccuuugauagccccaucaaagcaaacaugcccca

SEQ ID NO: 45607 - RNA, 89 nt, Mus musculus
acagacaggaguuggugauaauagaaguuaugauuuuuggaaaaguuuuucauagcucaucaggaguaaaauauuuggaaaggcauuug

SEQ ID NO: 45608 - RNA, 46 nt, Mus musculus
aaguuuucuggucacacacaaacagaaaguuaauucagaccgagug

SEQ ID NO: 45609 - RNA, 29 nt, Mus musculus
gucacaucacugccaaccauuacucacac

SEQ ID NO: 45610 - RNA, 45 nt, Mus musculus
uacaguaagaaaauugaauuuagggaccaguguuauguuaaaaga

SEQ ID NO: 45611 - RNA, 46 nt, Mus musculus
auccuucuguuccccccagaauucuuucuuaaaugcacccacuccu

SEQ ID NO: 45612 - RNA, 46 nt, Mus musculus
cauccugguuaacagucacucccuauguuuuguucaaggaccagug

SEQ ID NO: 45613 - RNA, 46 nt, Mus musculus
cuaaaaucagcauuguuaccaccaccugcguuuucaucagccaggu

SEQ ID NO: 45614 - RNA, 46 nt, Mus musculus
auagcccuuuuaucccauuuguuuuguaaaauuugaugucgaaaac

SEQ ID NO: 45615 - RNA, 108 nt, Mus musculus
ggaaacauuuauaaacaaaacagucuguggcucuugauauuucuuuuucuuuuacaauggggaaacaguagguaagauagugaagcuauguagaaagacagaguggug

SEQ ID NO: 45616 - RNA, 46 nt, Mus musculus
cuaaaacacugugcagauguacaguuggauacaaugaugccaauau

SEQ ID NO: 45617 - RNA, 47 nt, Mus musculus
aaggggcagcuuccuacuuacaggguuugcuuuagggacgacgacaa

SEQ ID NO: 45618 - RNA, 44 nt, Mus musculus
gaaaggcucacacuguaugauuuaauuauauaaaguguccagag

SEQ ID NO: 45619 - RNA, 72 nt, Mus musculus
uguguauguauaaugcagcccacacucaggcaggaaaaggaauaaagcgcugauuuaugcaugcugaguggg

SEQ ID NO: 45620 - RNA, 45 nt, Mus musculus
uacugugcauagcuucaguguaucccaaguggccgucgcagaaga

SEQ ID NO: 45621 - RNA, 46 nt, Mus musculus
ugcgaaggauagagcugcaaaaacucacacugugcgccacggagau

SEQ ID NO: 45622 - RNA, 45 nt, Mus musculus
aaggacaugaaccaaugguuacauuugauuauaaaugguggcuug

SEQ ID NO: 45623 - RNA, 45 nt, Mus musculus
agcaaaacuaguccguuuauuucacugguauucauaguucuggga

SEQ ID NO: 45624 - RNA, 42 nt, Mus musculus
ugacacauuuuaaccccuagaaaauuguggcaacggccuuga

SEQ ID NO: 45625 - RNA, 46 nt, Mus musculus
cuccugcacuccccuccuguccccuugugucucuucgccccuugcu

SEQ ID NO: 45626 - RNA, 26 nt, Mus musculus
cccaccacuuucucauauucaugacc

SEQ ID NO: 45627 - RNA, 46 nt, Mus musculus
uuguguuugaggguuuugacauuugcuuuagcuuaggacaguaagg

SEQ ID NO: 45628 - RNA, 42 nt, Mus musculus
uucaucgaauguugaguuuuaauauuuucacagccaccaacu

SEQ ID NO: 45629 - RNA, 60 nt, Mus musculus
caucuggggaacaaauacuacuacgucgccgaguacaagaacuggagaggugagagcgag

SEQ ID NO: 45630 - RNA, 42 nt, Mus musculus
uguguggcgcucuguuuggagcgccuuguccagggaggugag

SEQ ID NO: 45631 - RNA, 45 nt, Mus musculus
cagaggugucggcaagccacacgugugacgguggacugggaccaa

SEQ ID NO: 45632 - RNA, 78 nt, Mus musculus
uaugaguguuggcgguggcucuacuaauaauugccaguaacugauacagccuaaauaucccaggauuggauaaacaag

SEQ ID NO: 45633 - RNA, 64 nt, Mus musculus
uacaauucauguauaaaauagaacacugucagguuggggaaggguguucuacuguacagugaga

SEQ ID NO: 45634 - RNA, 46 nt, Mus musculus
ggaugcaauuauaguacacccucacaucaacuuuucuguaagccua

SEQ ID NO: 45635 - RNA, 41 nt, Mus musculus
ugugucuccccucuucaaaaugagcauuauaaugaagccaa

SEQ ID NO: 45636 - RNA, 45 nt, Mus musculus
gacaagauugcugaguagaauguagaccucccucagcuugcagau

SEQ ID NO: 45637 - RNA, 45 nt, Mus musculus
gguuuucucuuuaacaguccaguucauugaaauuauugccuagca

SEQ ID NO: 45638 - RNA, 44 nt, Mus musculus
uagaacccaggcauccacaagagggaaugaagcacggugugagg

SEQ ID NO: 45639 - RNA, 50 nt, Mus musculus
gcacaagcgaagcaggacgucagacuagagaguagggagagagacuggug

SEQ ID NO: 45640 - RNA, 46 nt, Mus musculus
ugucggguggcgaggcaacgauggagcuccugcggacuaucaccua

SEQ ID NO: 45641 - RNA, 44 nt, Mus musculus
auuauuccucacagcagaguagcuaaaccucaucagagggaaaa

SEQ ID NO: 45642 - RNA, 45 nt, Mus musculus
aguguugacuccugggucagcgagcuugccgacaggaagccggag

SEQ ID NO: 45643 - RNA, 46 nt, Mus musculus
gugucaggacucaaguaucuucacgaacaagaaaucuugcacaggg

SEQ ID NO: 45644 - RNA, 41 nt, Mus musculus
ggaacuuuuuuauuaaugaagccauggagcugaagguggga

SEQ ID NO: 45645 - RNA, 46 nt, Mus musculus
cuugauauauacauacacacacauacacauguacacacgcacacac

SEQ ID NO: 45646 - RNA, 61 nt, Mus musculus
guugccacacaguuccagauuuccacuugucaagcccagccaagaauuucuuuaagaaagc

SEQ ID NO: 45647 - RNA, 51 nt, Mus musculus
ucggcaugauuugaagaaagugucgauaacccagcagccuagcaaacacag

SEQ ID NO: 45648 - RNA, 46 nt, Mus musculus
ccccagccgccucccacuacuguugccagaucuggaacguccgcag

SEQ ID NO: 45649 - RNA, 45 nt, Mus musculus
agagauguaacugaaaacauuauuauuauuauuauuauaauuauu

SEQ ID NO: 45650 - RNA, 46 nt, Mus musculus
aagugcauuccuuguuaauaaacuuuuuauuuauuacagccccaag

SEQ ID NO: 45651 - RNA, 29 nt, Mus musculus
aucuagucguagaauggcaugaggcagag

SEQ ID NO: 45652 - RNA, 44 nt, Mus musculus
uaacuggugccaaaguggugguaucugguggucggggcuugagg

SEQ ID NO: 45653 - RNA, 45 nt, Mus musculus
caccaaguucuucaucagugggaauaucagaguggcuugaccaga

SEQ ID NO: 45654 - RNA, 46 nt, Mus musculus
ugagaucaagucaccugacacauuugugagaacuaccuaugcagga

SEQ ID NO: 45655 - RNA, 45 nt, Mus musculus
agacaggaaaaauaguagcuccagaacguuauauugcuguuggaa

SEQ ID NO: 45656 - RNA, 46 nt, Mus musculus
acaaacaaaaaaccaaaacaaaaccuauaaugguauccagcgagua

SEQ ID NO: 45657 - RNA, 45 nt, Mus musculus
auuuggaauguacaacacaaauuggaaguaaaauaaguuccaaga

SEQ ID NO: 45658 - RNA, 37 nt, Mus musculus
agacugggcugauaaacucacucaucuaccgaucgau

SEQ ID NO: 45659 - RNA, 45 nt, Mus musculus
cauugaaaucuuucucucugucacgacccaucacucaccccgcug

SEQ ID NO: 45660 - RNA, 45 nt, Mus musculus
agaaauagaaauaggugugaaguaguucauuaagucugugucuau

SEQ ID NO: 45661 - RNA, 33 nt, Mus musculus
ucagcucuaauggagacaggauaugcaacgcgg

SEQ ID NO: 45662 - RNA, 46 nt, Mus musculus
gcaguuacuccguggccuuuccuaucuccacgagaaccagaucauu

SEQ ID NO: 45663 - RNA, 45 nt, Mus musculus
ggucaccucaaccauccaaacaucauccggaugcugggggccacg

SEQ ID NO: 45664 - RNA, 46 nt, Mus musculus
cagguggaaaauggagaagauauuaucaucauucagcaggacguga

SEQ ID NO: 45665 - RNA, 46 nt, Mus musculus
cgacaccuacaaagacgacgucaaucauaaucaaaagugcaaagaa

SEQ ID NO: 45666 - RNA, 67 nt, Mus musculus
gcggcggcggcaacaguggcaacgccgucauacccagcgaagagacaguguucacgccgguggagga

SEQ ID NO: 45667 - RNA, 80 nt, Mus musculus
uaagucacucgcugcugcuuugguuugaacagccccaguuauccauuccuguuauuacuuguuuucccagcuuggcucag

SEQ ID NO: 45668 - RNA, 46 nt, Mus musculus
auagauggauagauagauauacagacagacagauagauggggagga

SEQ ID NO: 45669 - RNA, 45 nt, Mus musculus
ugugagccaccaugugguugcugggauuugaacucgggaccccug

SEQ ID NO: 45670 - RNA, 46 nt, Mus musculus
gucgucuuagacauuaagcuuacuuuuugcuaauuggucaugaggu

SEQ ID NO: 45671 - RNA, 46 nt, Mus musculus
gcuggcucauucuccuuagaguuucuuuguaacagaacacauguaa

SEQ ID NO: 45672 - RNA, 56 nt, Mus musculus
cagcgaaggaaucaggagagcaguuuuaaccuuacucauuuuggaacccagcagau

SEQ ID NO: 45673 - RNA, 51 nt, Mus musculus
cugcgagcuguccagcagccauccuccccacagcagcccguggccggauca

SEQ ID NO: 45674 - RNA, 46 nt, Mus musculus
gaagaaauagagagccuuuaauauguccccuuuguagaucuaagug

SEQ ID NO: 45675 - RNA, 45 nt, Mus musculus
ggcuuuccagagggugagucugcaaggcuagccacagaauggagu

SEQ ID NO: 45676 - RNA, 74 nt, Mus musculus
cugaaaaaugcuuaauaaaaagcacagcagagagacgagggaggaaggaaagggugaguccgagcacaguagga

SEQ ID NO: 45677 - RNA, 39 nt, Mus musculus
cgucagggcgcucggugaagccggaauccccaggaguga

SEQ ID NO: 45678 - RNA, 45 nt, Mus musculus
uuggggcuaaagauaaaauuuauggagucacaagaguagccaggu

SEQ ID NO: 45679 - RNA, 46 nt, Mus musculus
gccuggaagcacgagugguuggagaggaggaacaggagaggcccug

SEQ ID NO: 45680 - RNA, 46 nt, Mus musculus
cgagagauggagaauaaagaaacccucaaaggacugcacaagaugg

SEQ ID NO: 45681 - RNA, 70 nt, Mus musculus
aggaacacgcagacuugaucguguugucucaggauaucggcaugaguccuuagaaaaucuaaaauaaggg

SEQ ID NO: 45682 - RNA, 45 nt, Mus musculus
ugaugcacaguggaucgaugaagcgugugccuccgcgugaggaga

SEQ ID NO: 45683 - RNA, 42 nt, Mus musculus
uguaagaucucccagugcugugaggaaaccaggaauuuagau

SEQ ID NO: 45684 - RNA, 42 nt, Mus musculus
ccacaggcaugaagagucuccuuaguacagccacccagaguc

SEQ ID NO: 45685 - RNA, 46 nt, Mus musculus
ggcucggcugucuguugcgcugguaucuccuggucugcacacagau

SEQ ID NO: 45686 - RNA, 46 nt, Mus musculus
ggugguuucuugcuaauccugccuugguguuuuccuggggccaaau

SEQ ID NO: 45687 - RNA, 46 nt, Mus musculus
aaguaucacaccacugagcuauauaccccagcuccaaagugcaguc

SEQ ID NO: 45688 - RNA, 42 nt, Mus musculus
uccaaacucugacucucaugcggcucacucuggugucacaga

SEQ ID NO: 45689 - RNA, 44 nt, Mus musculus
cuucugcaagcccgccccucaguguugcaauguugccaucagau

SEQ ID NO: 45690 - RNA, 45 nt, Mus musculus
cagccccucuccaugagccuggggcagcggucuuagaggaacaga

SEQ ID NO: 45691 - RNA, 46 nt, Mus musculus
uuuuguuuucaaguuaauuauuaaauuaauuuaugaacuuuaagaa

SEQ ID NO: 45692 - RNA, 45 nt, Mus musculus
cggggcgcuucccugagcugaggggaaagcuguguuaaaggaagu

SEQ ID NO: 45693 - RNA, 44 nt, Mus musculus
gaagucgucagggagaauggauuauucugaggaaaucugaggga

SEQ ID NO: 45694 - RNA, 28 nt, Mus musculus
ucuuggaaaggcaggcuccaaccgaaag

SEQ ID NO: 45695 - RNA, 46 nt, Mus musculus
aaagaaaaagaaaaagaaaaagaaaaaagaaaaaagaaaaaaggaa

SEQ ID NO: 45696 - RNA, 42 nt, Mus musculus
uggaaaacgaccuuaaggcugcaaugugcgugagugcacgug

SEQ ID NO: 45697 - RNA, 42 nt, Mus musculus
gccccgcugggccucgggugccagguggcggccgcuccaggc

SEQ ID NO: 45698 - RNA, 41 nt, Mus musculus
ggugacaacaucagggaagucggagcccggagcggggaggg

SEQ ID NO: 45699 - RNA, 42 nt, Mus musculus
ccaggacgcgcgaucccgagaggacuuuggggcgggggcuuc

SEQ ID NO: 45700 - RNA, 67 nt, Mus musculus
ucccugcucuugauguuucuuaauccagagcgaacuuuucacccagacaucuuaacauuuaggcguu

SEQ ID NO: 45701 - RNA, 46 nt, Mus musculus
auuuaaccgacuagcagauuaguccuacaaauguagcauuccagau

SEQ ID NO: 45702 - RNA, 81 nt, Mus musculus
acagguuucugggggugggguguguguguguucauuugcuucuacucacaagagaaagagagagaaaaaauuacagugggg

SEQ ID NO: 45703 - RNA, 72 nt, Mus musculus
gaaaggucagcuaaggauaaacuuuauaguagaaauuuguauuguuggcauuagugauuuagaauauuacaa

SEQ ID NO: 45704 - RNA, 43 nt, Mus musculus
uuaugacuuuguguuuucauuuugaaauaguuuuuccuaagag

SEQ ID NO: 45705 - RNA, 45 nt, Mus musculus
aaguagcugaagucgagaaccaccuacauuguauuuaaaccagaa

SEQ ID NO: 45706 - RNA, 48 nt, Mus musculus
auaguauaugugaauauaguaucugugaguagaguauaugugaguaga

SEQ ID NO: 45707 - RNA, 45 nt, Mus musculus
agcaagaacucaaauuccuuuugguaaaacaaacgaguggcccug

SEQ ID NO: 45708 - RNA, 46 nt, Mus musculus
ucacguaagaaauuuaaugcuacaaguacaauugaugccaacaguu

SEQ ID NO: 45709 - RNA, 46 nt, Mus musculus
uuuaucagaguucucauaaaacucucauuugacugaaauaggcaag

SEQ ID NO: 45710 - RNA, 46 nt, Mus musculus
acucugagcugcaucccaggccuguaagcgauuauguguacuggag

SEQ ID NO: 45711 - RNA, 42 nt, Mus musculus
gcacucaggcaggaagagguagaggcagagaccagaggacag

SEQ ID NO: 45712 - RNA, 46 nt, Mus musculus
gccagagcuagcuacacagagaaagccugccaugaaaaagauagag

SEQ ID NO: 45713 - RNA, 45 nt, Mus musculus
cgauguaacaccagugaaggauuuaaagcgcagguguccgggugg

SEQ ID NO: 45714 - RNA, 46 nt, Mus musculus
uuuuuuaaauguaaaaucauaccuacuuacguacaaguaacgugag

SEQ ID NO: 45715 - RNA, 45 nt, Mus musculus
gguugggggaugugaaaaaugcuguuuuugaauaaaggacuggga

SEQ ID NO: 45716 - RNA, 45 nt, Mus musculus
uuuuuaauguuuucuuuuguuggggagguugguugccagggcaga

SEQ ID NO: 45717 - RNA, 46 nt, Mus musculus
gauugagugauugauugauugauugagacacaaucucacuguguag

SEQ ID NO: 45718 - RNA, 48 nt, Mus musculus
cuagaguaaagacuuuaacuauaagccuugaaccucugaaguccugga

SEQ ID NO: 45719 - RNA, 80 nt, Mus musculus
acuggagcagguggggaguuucucagugggaucccgaagcacagagaggaaugcaugcaacaugagcagacagacagaca

SEQ ID NO: 45720 - RNA, 41 nt, Mus musculus
cucaguagaaaaauauaaauaauguuuaaaggcuagcagac

SEQ ID NO: 45721 - RNA, 49 nt, Mus musculus
uaaucucacuggugaaaucuaaaaaaaaaaaauuauucauagaaaguug

SEQ ID NO: 45722 - RNA, 42 nt, Mus musculus
uacauuauaacuuguauaguucaccacaauuuuuccaggcuu

SEQ ID NO: 45723 - RNA, 46 nt, Mus musculus
ccucccgagcgugcagcucaccugcaacauccuguccuuugggcag

SEQ ID NO: 45724 - RNA, 42 nt, Mus musculus
gauaaaccuacaaauuugacuugcauugugaaugaggggaag

SEQ ID NO: 45725 - RNA, 41 nt, Mus musculus
agugagagaacacugacuaagaaacagcaugugguuguguu

SEQ ID NO: 45726 - RNA, 46 nt, Mus musculus
cucaacaugcccagugucucucucucucuuccugcugccugcugau

SEQ ID NO: 45727 - RNA, 46 nt, Mus musculus
gaagagagagagagacacugggcauguugagcaucugaaaccccag

SEQ ID NO: 45728 - RNA, 46 nt, Mus musculus
uuuuaaaaauuucaauucuagaacauuuuuguaagacagcauuuua

SEQ ID NO: 45729 - RNA, 80 nt, Mus musculus
augucaucugauguguggguuuuagaggucugagguaagagcccaugcuugugcagugagcacccuaugacaaccaccuc

SEQ ID NO: 45730 - RNA, 67 nt, Mus musculus
cagggaacacaugaguucugcagggguacgcccuugucaaaacuccugcguugccgacaccucagau

SEQ ID NO: 45731 - RNA, 46 nt, Mus musculus
auccuacgaacuguaaaauaaaauacauaaacaaaacaaaggagau

SEQ ID NO: 45732 - RNA, 41 nt, Mus musculus
aagcaguuuuaaaauugcuuuucuccacaaauauguauggu

SEQ ID NO: 45733 - RNA, 28 nt, Mus musculus
uaaaagauaagaagauaaagcaagcucu

SEQ ID NO: 45734 - RNA, 45 nt, Mus musculus
cucuucugcauagcuuaaugagauuucagauccuucucaguccgg

SEQ ID NO: 45735 - RNA, 67 nt, Mus musculus
augaauuaagaagacuuaaagucuaacagcagauggcacauccaacuguuaccaaggugucaaguag

SEQ ID NO: 45736 - RNA, 45 nt, Mus musculus
cacucauggaauugcagugggugaaugcaaacuggaaauggcaga

SEQ ID NO: 45737 - RNA, 47 nt, Mus musculus
aauaucggccccagggccuggcugcucccaagaaugagagaaucugc

SEQ ID NO: 45738 - RNA, 48 nt, Mus musculus
gguuuggugcuccugggcuuagagccuaaggagaaccacaaggagcgg

SEQ ID NO: 45739 - RNA, 46 nt, Mus musculus
gucauauuguggggagauugucagggaaguagacauacuagcaaag

SEQ ID NO: 45740 - RNA, 47 nt, Mus musculus
gaggaaugcuaaugguccaccucauugagucaccuacagaagaugaa

SEQ ID NO: 45741 - RNA, 42 nt, Mus musculus
aauaguaggagguguagccuuguuagagugggcguggcauug

SEQ ID NO: 45742 - RNA, 42 nt, Mus musculus
caaagcauggcacuucauguauggucagcuacaugcccaccu

SEQ ID NO: 45743 - RNA, 46 nt, Mus musculus
uuauaacuaauagcccacuuuuguguuuguugauugaucgguccau

SEQ ID NO: 45744 - RNA, 46 nt, Mus musculus
guauugcaggucucauagaaggaaagacuagguggguggggccuau

SEQ ID NO: 45745 - RNA, 41 nt, Mus musculus
ggcuacuggagugacuggagugaggaggcuagugggaccac

SEQ ID NO: 45746 - RNA, 46 nt, Mus musculus
guaagacacucauacacauacaaaugaauauauacggaaaagauag

SEQ ID NO: 45747 - RNA, 42 nt, Mus musculus
gcacaggccuguagucccaacugcagaaagccaaggcaggag

SEQ ID NO: 45748 - RNA, 42 nt, Mus musculus
ugccgagacagaggcuaggccacacugcagagcauugccgag

SEQ ID NO: 45749 - RNA, 44 nt, Mus musculus
ugguguguguugucagagaacgcacccuguguugaagacuggca

SEQ ID NO: 45750 - RNA, 41 nt, Mus musculus
gacaaacagccugggacggacacugucuccugggggcagac

SEQ ID NO: 45751 - RNA, 44 nt, Mus musculus
uuuuccccacuuucuuuguccgaacagucgguccucuggcagga

SEQ ID NO: 45752 - RNA, 32 nt, Mus musculus
gaaagagagagagagagagaaagguaggggag

SEQ ID NO: 45753 - RNA, 46 nt, Mus musculus
guguacgcggccauucggaccauguacaacguaucacuacucagag

SEQ ID NO: 45754 - RNA, 50 nt, Mus musculus
uacaugguccgaauggccgcguacacagaugaaggugggaaagaugggcc

SEQ ID NO: 45755 - RNA, 42 nt, Mus musculus
cucagugaacagucaccauguacaucuguacgcugggcagcg

SEQ ID NO: 45756 - RNA, 28 nt, Mus musculus
aacaagacgcccagcaggguugucagga

SEQ ID NO: 45757 - RNA, 41 nt, Mus musculus
aagagucauauugcccaguggucaccucacacccccccaag

SEQ ID NO: 45758 - RNA, 44 nt, Mus musculus
guccgugcaaguguucucaagguccgaguccacccagccccugc

SEQ ID NO: 45759 - RNA, 46 nt, Mus musculus
ggaaggcucuacagcggaugcucuuggcacgggggcugauggacag

SEQ ID NO: 45760 - RNA, 77 nt, Mus musculus
cuuucagaauguuugcacugccgaaaacaaagugugucugaguuuauaaagcuguugguuugcuacauagaaaacgg

SEQ ID NO: 45761 - RNA, 45 nt, Mus musculus
gcaggccaugcuucucugacagacccagaaacgagccaccccucc

SEQ ID NO: 45762 - RNA, 65 nt, Mus musculus
agaagcauggccugcuccuugcuguugguaucgaugccgguuacuacugaggaagaggauaaacu

SEQ ID NO: 45763 - RNA, 60 nt, Mus musculus
uuaaagagaagcaacauagaagcacccgcuuucuuauagucaccuacagccucccaagaa

SEQ ID NO: 45764 - RNA, 42 nt, Mus musculus
ccgguacucuggaggcagaggcagaggcagaggcagacagau

SEQ ID NO: 45765 - RNA, 46 nt, Mus musculus
ccuccagaguaccgggaugaaaggcagugcaccaccacugcuccac

SEQ ID NO: 45766 - RNA, 46 nt, Mus musculus
gacagcacacauccacagucccagacagucaggaagcugggccagg

SEQ ID NO: 45767 - RNA, 67 nt, Mus musculus
uuuagcacuaaagccauuaauguauuugugccuaacuucccagugugacauggaggugggggcuaaa

SEQ ID NO: 45768 - RNA, 46 nt, Mus musculus
gugaucagccucuaacggcgcucagccaauuccugucugcccagug

SEQ ID NO: 45769 - RNA, 45 nt, Mus musculus
agaggcugaucacuaagugugcucacaggaaaaggguugaaguuu

SEQ ID NO: 45770 - RNA, 41 nt, Mus musculus
ccuccuuggcaaaaccagccuggaauugccaaaaugccgga

SEQ ID NO: 45771 - RNA, 95 nt, Mus musculus
gccugaucccaguuaggacugaguuuucuauguauauaucugccaggaaguuaacacuugcugaauuucucaucuucucacaguaagcagucuag

SEQ ID NO: 45772 - RNA, 46 nt, Mus musculus
cugugagaagaugagaaauucagcaaguguuaacuuccuggcagau

SEQ ID NO: 45773 - RNA, 45 nt, Mus musculus
cacugucugauaugagggaagucacagcugaacauggauagaguc

SEQ ID NO: 45774 - RNA, 46 nt, Mus musculus
ggaugguagcccagcgugaguucaggcaugaacauagaggccacug

SEQ ID NO: 45775 - RNA, 46 nt, Mus musculus
gacaggauuuuuccguguugccuuggcuguccuggauccgccugcc

SEQ ID NO: 45776 - RNA, 46 nt, Mus musculus
aucaauaagcugcaaaaaaaaaaguaaauaaaaaguaaaggucaau

SEQ ID NO: 45777 - RNA, 50 nt, Mus musculus
acugcaagugcugcuacguaagcaggacaaugugacgugccagaaagaaa

SEQ ID NO: 45778 - RNA, 45 nt, Mus musculus
agaguuaccauugacuuacacgugcaggguuuucuauggagaugg

SEQ ID NO: 45779 - RNA, 46 nt, Mus musculus
cagugcuugccuagcauguacaagcuuaaaauuugaucccuggcag

SEQ ID NO: 45780 - RNA, 42 nt, Mus musculus
ggcagccccgccgcgggagccgggaggcgagacagccaccag

SEQ ID NO: 45781 - RNA, 24 nt, Mus musculus
cucccaggcuagcucgcucucucc

SEQ ID NO: 45782 - RNA, 45 nt, Mus musculus
cacugaccuauuuagauggagaaagguuguggguggagaggugga

SEQ ID NO: 45783 - RNA, 45 nt, Mus musculus
agaggaguuuuauuauaacgcaguucgacagcuucuacgucagau

SEQ ID NO: 45784 - RNA, 23 nt, Mus musculus
guggguggggggagagguuucag

SEQ ID NO: 45785 - RNA, 41 nt, Mus musculus
ccuggucccugcuccgugccuuaaggagaauaugcaguaca

SEQ ID NO: 45786 - RNA, 46 nt, Mus musculus
gaauacgcuccaggagcugugggaggagcgagggucucggggguag

SEQ ID NO: 45787 - RNA, 44 nt, Mus musculus
cacucggagauggaguggaaacugcaacgcaccgcccggaggaa

SEQ ID NO: 45788 - RNA, 46 nt, Mus musculus
cgguacaaaaaagauguuuaaggccaucuuacuauacuacucagau

SEQ ID NO: 45789 - RNA, 53 nt, Mus musculus
ggaaucuaaaaccucuguccuguuguacuggccugacuccacggugguuucau

SEQ ID NO: 45790 - RNA, 46 nt, Mus musculus
ucacaaaugauugggcaaauuauucuuaaaaagaaagaggaucuau

SEQ ID NO: 45791 - RNA, 42 nt, Mus musculus
gccaagguggaauuuuuggaaguaucuggucaacccugaggg

SEQ ID NO: 45792 - RNA, 49 nt, Mus musculus
gagucacauuccccaucuuccacaagauuaagauuuuagggccggaagc

SEQ ID NO: 45793 - RNA, 49 nt, Mus musculus
ucgggcccuaucacuucaacguccuggcuuuuccgugcaaucaguuugg

SEQ ID NO: 45794 - RNA, 42 nt, Mus musculus
gacucccaggaucguccaaaauggagccuuucgcugccuacc

SEQ ID NO: 45795 - RNA, 42 nt, Mus musculus
ucugaggugucgcugggguguaacgaugaguuuuuugcuggg

SEQ ID NO: 45796 - RNA, 45 nt, Mus musculus
ucaccgggaggcacguggacaucaugguggaugaacacagggaaa

SEQ ID NO: 45797 - RNA, 46 nt, Mus musculus
ccacgaccauucccaguucuccucugaaaauucaaaguggcagcuu

SEQ ID NO: 45798 - RNA, 46 nt, Mus musculus
aggaaauggagaggacuuuuacucugucagauuugaggcaugggaa

SEQ ID NO: 45799 - RNA, 50 nt, Mus musculus
agaccuuaaagcagauaagacacaugucacuauaaccaacacuggacugu

SEQ ID NO: 45800 - RNA, 46 nt, Mus musculus
agaacuccacccguacacggauaccuccaaauauccacagcagaag

SEQ ID NO: 45801 - RNA, 88 nt, Mus musculus
guugaugauggccauguccucuauguccagacagcucccggccagcaaaaggaccaguucacccucgaugugacaaaggacucccggg

SEQ ID NO: 45802 - RNA, 45 nt, Mus musculus
ugaggaugcucucuucuugucucucauguuguauuucacgguagu

SEQ ID NO: 45803 - RNA, 45 nt, Mus musculus
ugcuuccaauaucacaggauauuaaauuaccauuccaaaacagau

SEQ ID NO: 45804 - RNA, 45 nt, Mus musculus
augggcaguagauaugacuagcccaaauaacaacauuaagcagag

SEQ ID NO: 45805 - RNA, 41 nt, Mus musculus
aucucagggagagagagagagagacagagacagugagagag

SEQ ID NO: 45806 - RNA, 42 nt, Mus musculus
ggauguggccaccagucucccugcauagagaucuugccccug

SEQ ID NO: 45807 - RNA, 42 nt, Mus musculus
cuagcauagauuuuguuuguuuaacuuuagugauggcauaug

SEQ ID NO: 45808 - RNA, 42 nt, Mus musculus
ucaaaauuagaugccuccaaccucuuacuucagcuaccccaa

SEQ ID NO: 45809 - RNA, 46 nt, Mus musculus
caauguagaagauauagauaguccuccaaaugaaauccaauaugag

SEQ ID NO: 45810 - RNA, 49 nt, Mus musculus
cuugugaaccucacagaccugcuucucccacaaggccagaacacugucc

SEQ ID NO: 45811 - RNA, 112 nt, Mus musculus
uucuggaagacucucuuaccacaugaccaaucucacagccuccgaagaucagcugagggucucacuguuuacaacggagugcaacuugacggagcagacacugaacaucagg

SEQ ID NO: 45812 - RNA, 49 nt, Mus musculus
uugaaagugaccaacagaguggcucaccagcuuaggacagaggaucuag

SEQ ID NO: 45813 - RNA, 65 nt, Mus musculus
gcuaacaggacuaauagugaucccauguuugaagugauacaaccccuaguccauggacgacucgu

SEQ ID NO: 45814 - RNA, 46 nt, Mus musculus
ugcagccagcagcagguuaucuagccuuuaccauagugccaccaga

SEQ ID NO: 45815 - RNA, 45 nt, Mus musculus
cagugggaccucauuggaagcagugccuuuaacuuggagcucgga

SEQ ID NO: 45816 - RNA, 46 nt, Mus musculus
uaaguuugaauugguguugaagaagcaagcucucugcguuucagau

SEQ ID NO: 45817 - RNA, 25 nt, Mus musculus
agggucaagcaaggaaaggcgagug

SEQ ID NO: 45818 - RNA, 45 nt, Mus musculus
uuuuguaguugcugagcuaaauaaugugauucuugaguuuacaga

SEQ ID NO: 45819 - RNA, 62 nt, Mus musculus
agaaaaaaaaaauacugauuuauacuguuuuuaaaaacuaaguauugauaaagccccccuca

SEQ ID NO: 45820 - RNA, 87 nt, Mus musculus
cuuaaucaaaaaaaauuucagggaugucuguaaauuucaguguuguacgcgaugagaagugcuguugguugauuuaaggagggacca

SEQ ID NO: 45821 - RNA, 85 nt, Mus musculus
aauuuuaauguucagcuuuuuguuucgguuucaaauggaucuacacuguuaacugaaugagacuccacugugauucacucguuua

SEQ ID NO: 45822 - RNA, 47 nt, Mus musculus
gauugggccugaggauuucggcagugcccugagcacguggagaagga

SEQ ID NO: 45823 - RNA, 45 nt, Mus musculus
acuuugcacaggaagcaucgccugguaagaugcuggcaguuacag

SEQ ID NO: 45824 - RNA, 46 nt, Mus musculus
uggcuggauaaaagccugcuguggaugccuuuuuagucucagagau

SEQ ID NO: 45825 - RNA, 46 nt, Mus musculus
aaaccugccuucucagagcuguugccaacucuaggugguacaagga

SEQ ID NO: 45826 - RNA, 33 nt, Mus musculus
acagcgucuaaugacugcacaugggaccgcgcu

SEQ ID NO: 45827 - RNA, 53 nt, Mus musculus
agaguaggcgacacguggaagaagggaagauggagguccaaaaagcugacggc

SEQ ID NO: 45828 - RNA, 46 nt, Mus musculus
aguuuguuuugucuuuaaucaucuugcuuucuuuugacaaguaguu

SEQ ID NO: 45829 - RNA, 41 nt, Mus musculus
gauuaggaaaguaacugguaauauuuaaucuuggucauaga

SEQ ID NO: 45830 - RNA, 49 nt, Mus musculus
aauguguuugcucugcucagugagugcagguugggcacucugggaccau

SEQ ID NO: 45831 - RNA, 42 nt, Mus musculus
gagauucgguuuuagcccaagcuccauuuuaucuucccagaa

SEQ ID NO: 45832 - RNA, 52 nt, Mus musculus
ccucagguggugagcaggagcaacccucauggagugggcacagugaaagaag

SEQ ID NO: 45833 - RNA, 65 nt, Mus musculus
gucucugguugguugguuguucuuuuguuaucuuacccaaggacgugccagaggaaagaguaaag

SEQ ID NO: 45834 - RNA, 44 nt, Mus musculus
guguuaaguuggaaacgcugaagccagcaguagggacagaugag

SEQ ID NO: 45835 - RNA, 46 nt, Mus musculus
gcuccuguauugguuuccucgggcggcuuuaacagguuccugagau

SEQ ID NO: 45836 - RNA, 45 nt, Mus musculus
aggauggagaagagacaggaacuugugucugcagaaguggagaga

SEQ ID NO: 45837 - RNA, 45 nt, Mus musculus
gguuugguuuuugguuuuagagcuuuauuguagaaaggcagagag

SEQ ID NO: 45838 - RNA, 46 nt, Mus musculus
ugauauuucuuugugugggcugcuggguguuugaacauggagagac

SEQ ID NO: 45839 - RNA, 46 nt, Mus musculus
gauacauugggcccugcaucuccuuuccacacaagcgcaggcagaa

SEQ ID NO: 45840 - RNA, 44 nt, Mus musculus
gcuuugugggucauugucgggaccuguuaaaaauucaagcaaga

SEQ ID NO: 45841 - RNA, 46 nt, Mus musculus
ucuuaaauaggguggggggaugggaggaaguucaaagguccugagu

SEQ ID NO: 45842 - RNA, 56 nt, Mus musculus
aggacgcaaacagaacaaaucugugucaagccuucagccguuuggaaauagcgguc

SEQ ID NO: 45843 - RNA, 53 nt, Mus musculus
acucacuagcuggccuucugauauaauggcuccauugauugagagagagagag

SEQ ID NO: 45844 - RNA, 96 nt, Mus musculus
acauuuggacuguucuuuaggaaagugaugugggagacuagcugggugaaguaggaguguugugucugagagcacgaauucgcugucccagcgaca

SEQ ID NO: 45845 - RNA, 60 nt, Mus musculus
cucucgaccuucaggaacucagcucuccuuucucuggguuuggaguuuauuaaccagcug

SEQ ID NO: 45846 - RNA, 48 nt, Mus musculus
agccagacuaggcagcccuuugaacacugcagggcuggcagagauggg

SEQ ID NO: 45847 - RNA, 63 nt, Mus musculus
agaccguguugucacuucagaauuugaauaggcagaggaaucagcuguucugauguauaagcu

SEQ ID NO: 45848 - RNA, 81 nt, Mus musculus
caggaccuggacccagucauggaccuguuagcacuguaucaggggcaccuggccaacuucccagacaucauccauguucag

SEQ ID NO: 45849 - RNA, 45 nt, Mus musculus
agccgcggcgaccgcggccucuucccggccuccuacgugcaggug

SEQ ID NO: 45850 - RNA, 41 nt, Mus musculus
ccgggcgcucuacgacuuuaaguccgagaaccccggugaga

SEQ ID NO: 45851 - RNA, 46 nt, Mus musculus
gacugcucagaaaguagagacugugacaagcuggaggggcuaagau

SEQ ID NO: 45852 - RNA, 64 nt, Mus musculus
uauaauuuauacauaaaaugucugguugacuguacaccuuguuuuuuugaagaaauuuauucgu

SEQ ID NO: 45853 - RNA, 45 nt, Mus musculus
aacaaaauaaauaauaauaauaaauaauaaaggaaagaaaaaaga

SEQ ID NO: 45854 - RNA, 46 nt, Mus musculus
guuuuucuuaaaaguaaacuuauugcguaacugcagaggcccaaac

SEQ ID NO: 45855 - RNA, 46 nt, Mus musculus
gcgcuggaguaagucacuccaucauuuccacaaagguacuguucag

SEQ ID NO: 45856 - RNA, 70 nt, Mus musculus
gcagcuccacuugugugguggaucagaccaauaaugccuacugugugaccuguaaucggauuugcccaga

SEQ ID NO: 45857 - RNA, 45 nt, Mus musculus
agcuaguggaaucugccucugcucgcgcuggaggcaaaacaaggu

SEQ ID NO: 45858 - RNA, 42 nt, Mus musculus
ggaaggaaggcugcuuagagcugggcaaagaggccugguggg

SEQ ID NO: 45859 - RNA, 42 nt, Mus musculus
agagggagagagggaugugggaggaagggagggagggaggga

SEQ ID NO: 45860 - RNA, 46 nt, Mus musculus
agagaauuauuugugacagggguuaagaaaguaagagaggggagac

SEQ ID NO: 45861 - RNA, 46 nt, Mus musculus
acuugugaaaaaugaaaggaaaaaaaaaagcagucgggcccagccu

SEQ ID NO: 45862 - RNA, 46 nt, Mus musculus
uucugcugucuccacuuggucuguucugaccuacgcugcucucgga

SEQ ID NO: 45863 - RNA, 44 nt, Mus musculus
ggugacauuucccaccuucuggaaacccuucccaauuaucuguc

SEQ ID NO: 45864 - RNA, 23 nt, Mus musculus
ucucacuggccccugaaaaucug

SEQ ID NO: 45865 - RNA, 45 nt, Mus musculus
gcuagguugugaugaauacugucuaccgucucccaugaccccuag

SEQ ID NO: 45866 - RNA, 41 nt, Mus musculus
ucagcuguguggucgugggacucucgggucaacuuagucca

SEQ ID NO: 45867 - RNA, 46 nt, Mus musculus
uuguuuuauuuuuguuuuuuguuuuuguucuuuuuuuuagcuggag

SEQ ID NO: 45868 - RNA, 46 nt, Mus musculus
gugggggaagugucacaguuggugguguccccucuguguggugcag

SEQ ID NO: 45869 - RNA, 48 nt, Mus musculus
gaaagucauuagcuuagaauaugaagcguauguaccgauggcagaaaa

SEQ ID NO: 45870 - RNA, 42 nt, Mus musculus
gggcacugcacagagguccuaccagacugaagcacaggccuc

SEQ ID NO: 45871 - RNA, 45 nt, Mus musculus
caagugcaugagugugugggaugaggggcugccuaggacuuaaag

SEQ ID NO: 45872 - RNA, 46 nt, Mus musculus
uacugagagcaucacuaucaggcauguguuaccaaaaaacuggcag

SEQ ID NO: 45873 - RNA, 46 nt, Mus musculus
aaaaacaaucaaacuguaguaauugacauaaagaaaagcccaagag

SEQ ID NO: 45874 - RNA, 42 nt, Mus musculus
caccugugugauuauacaccccuaaacuuuagggagcuaguu

SEQ ID NO: 45875 - RNA, 42 nt, Mus musculus
cuucccauagaaauuccuaggauuggcugccaggggacagca

SEQ ID NO: 45876 - RNA, 23 nt, Mus musculus
ggggugguagaagaugacaggga

SEQ ID NO: 45877 - RNA, 45 nt, Mus musculus
gacaaguacuccuuuugcugcaaaugccaacuucacugaacagau

SEQ ID NO: 45878 - RNA, 42 nt, Mus musculus
agcaauugcuaaccauguaaaaggcucuaguuucacccacag

SEQ ID NO: 45879 - RNA, 77 nt, Mus musculus
ucgaaccccuggcaacaggauuguuuaccucuacaccaagaagguugggaaagcaccuaaauccgcauguggcgugu

SEQ ID NO: 45880 - RNA, 74 nt, Mus musculus
ugacaggaucaagggggcuuuccuuauugaggagcagaaaaucguugugaaaguguugaaggcacaagcacaga

SEQ ID NO: 45881 - RNA, 45 nt, Mus musculus
gucaguaguaagcaugaauauaacauuuaucauccacacacugaa

SEQ ID NO: 45882 - RNA, 42 nt, Mus musculus
ugcuguaguagcugugagugagugugagugaguaugugugug

SEQ ID NO: 45883 - RNA, 41 nt, Mus musculus
gcgccuaggggcugcuggaaaaggcgggcagccagcgcaga

SEQ ID NO: 45884 - RNA, 30 nt, Mus musculus
cagagcaaauaaacggauacuauaacucca

SEQ ID NO: 45885 - RNA, 25 nt, Mus musculus
cggcugggggaggggccggggcccg

SEQ ID NO: 45886 - RNA, 49 nt, Mus musculus
cgggccccaggcgagcauccacuucuuaaccaacuccuuacgagagaga

SEQ ID NO: 45887 - RNA, 42 nt, Mus musculus
agagagggagagagagagagagagagagagggagggagcggg

SEQ ID NO: 45888 - RNA, 45 nt, Mus musculus
uguggcuccuguguuaaugucuaagcugucugcgaacgcccccga

SEQ ID NO: 45889 - RNA, 45 nt, Mus musculus
aaauguguaggaagaaauuuguugugcuuguugaacucaggugag

SEQ ID NO: 45890 - RNA, 46 nt, Mus musculus
ccccuuuaaugacuuauuuuuaugugaauuaguuuuuggccugcau

SEQ ID NO: 45891 - RNA, 50 nt, Mus musculus
ucuaaugcuuuccacuuuacuaccuccuuugugaguccugccugcuccca

SEQ ID NO: 45892 - RNA, 45 nt, Mus musculus
agacauuuucuaauuguuuucugguaaccucagguaaaugaggaa

SEQ ID NO: 45893 - RNA, 45 nt, Mus musculus
uaaauuacauuuggggaaagucagaauuuauauaaaguaaaauua

SEQ ID NO: 45894 - RNA, 53 nt, Mus musculus
ucgaaaacgauuucaugcauuuguucuguuucugggagaacuauaucuuaacc

SEQ ID NO: 45895 - RNA, 47 nt, Mus musculus
cuuaguugacaggaucaguuuuagaagauacuuggaaggaaaagggg

SEQ ID NO: 45896 - RNA, 42 nt, Mus musculus
uucgaucaaguaacugggguaggguccaugcaacuucaacau

SEQ ID NO: 45897 - RNA, 45 nt, Mus musculus
caacauuuuauacaucugaugguguuccuuucacugcagcggacc

SEQ ID NO: 45898 - RNA, 34 nt, Mus musculus
cuugcucuagccaaccccacuugcuccggccaaa

SEQ ID NO: 45899 - RNA, 46 nt, Mus musculus
aaaaagaauaucuuuuauaucuuaccacaagaacuuauagcaggac

SEQ ID NO: 45900 - RNA, 59 nt, Mus musculus
aaaguaucaagaguuacuugaaagagaggacuuuuuuccagauuaugaagaaaauggaa

SEQ ID NO: 45901 - RNA, 76 nt, Mus musculus
uucauagcagcugcucuacucugaacgauccuucucugccccuuauugcucacuuuuuaaaugaagguuuugugcc

SEQ ID NO: 45902 - RNA, 42 nt, Mus musculus
gacccgucuuugugagaaauagccuugcagaaaucguagcag

SEQ ID NO: 45903 - RNA, 59 nt, Mus musculus
uggacccagaaauugaagaagcuuaugaaaaguuuuguuuggaaucagagcgcaagcga

SEQ ID NO: 45904 - RNA, 46 nt, Mus musculus
ucuuuggguaauucuguaaguaucccauuaaaucuuaccugcaagg

SEQ ID NO: 45905 - RNA, 42 nt, Mus musculus
uuguuuguguuuuguuccucgcgucgccgaugcugccccaga

SEQ ID NO: 45906 - RNA, 45 nt, Mus musculus
ccguagaugugauuauuuuucuuccucaagaaaugcuucucggua

SEQ ID NO: 45907 - RNA, 80 nt, Mus musculus
guucagcuuccaacaaaaggagauaaagggccaaauucaagcgagauuuuaaaaagcaauagaaagcuaguuacaggcag

SEQ ID NO: 45908 - RNA, 47 nt, Mus musculus
uaugaggacaaaagauauguuaggauagcaauuauggauggaguagu

SEQ ID NO: 45909 - RNA, 45 nt, Mus musculus
ugauuaaaaugaucagaacaagggaauuaggaagugacauuugga

SEQ ID NO: 45910 - RNA, 41 nt, Mus musculus
ugggcuccagcuaaagaauggauuuaggggaugcugcagaa

SEQ ID NO: 45911 - RNA, 44 nt, Mus musculus
ucugauauuuguauauuuucauggucuuuucuuuuggccugugg

SEQ ID NO: 45912 - RNA, 46 nt, Mus musculus
uauguauuauuauuacucuauguauguaugauguaugagugcgggc

SEQ ID NO: 45913 - RNA, 67 nt, Mus musculus
ccagagaugcaguucaguucaucagaccugcaugccaagaaucuucacgugcugaaccaucaugccu

SEQ ID NO: 45914 - RNA, 46 nt, Mus musculus
cacaaaauguuuguuugugauuuugugagcuguccgcgccucccag

SEQ ID NO: 45915 - RNA, 42 nt, Mus musculus
cucucuccuugcggcucugaauuucucuuugaaaaggcacuu

SEQ ID NO: 45916 - RNA, 48 nt, Mus musculus
aucaggaccccaaaaauaaacuaguugagaagaccagaaaagucugca

SEQ ID NO: 45917 - RNA, 46 nt, Mus musculus
acaaaguucgugcugcaucugaaauugaugcagauuucccugcgag

SEQ ID NO: 45918 - RNA, 41 nt, Mus musculus
guaaccuuggccucuaauucauagaggcccuccugccccug

SEQ ID NO: 45919 - RNA, 46 nt, Mus musculus
ggaagguuaacucuacacuagauucuucauuagguguaauacagag

SEQ ID NO: 45920 - RNA, 46 nt, Mus musculus
gcucaugaaggccgcugucccuacaaggcucaguaaaguacagaag

SEQ ID NO: 45921 - RNA, 46 nt, Mus musculus
ggaccugcagaguuuugauuauggcuucuuugauaucaguccaaag

SEQ ID NO: 45922 - RNA, 53 nt, Mus musculus
ccuucagguucaguuuuaaagauuaggaaagcuuuuaauuguauagcuugcca

SEQ ID NO: 45923 - RNA, 46 nt, Mus musculus
agccaucucuccagcccuguuuguuuauuucuuaacucacaguggg

SEQ ID NO: 45924 - RNA, 67 nt, Mus musculus
cuuacccauaaaaauguaaacucaauagagauuuuuccuggagacggaucgguuuucaagucagaag

SEQ ID NO: 45925 - RNA, 42 nt, Mus musculus
agagagaagagaaaacuuacucuguaaauaaccuuccuccag

SEQ ID NO: 45926 - RNA, 45 nt, Mus musculus
gauuguucaucaugguuuucccagccugcuuucuuauaaaaccca

SEQ ID NO: 45927 - RNA, 46 nt, Mus musculus
uucaacuuguggcaaguuaacauaaagccagccagcauaaacccug

SEQ ID NO: 45928 - RNA, 46 nt, Mus musculus
acacugaauuggcaucucagcuccucugcugagaagaaacaaguga

SEQ ID NO: 45929 - RNA, 46 nt, Mus musculus
gguggcugugaguuaccaugugguugcuaagauuugaacucagaac

SEQ ID NO: 45930 - RNA, 45 nt, Mus musculus
ccuaggaccuuauguccucuucuucucuccacacauaugcaggca

SEQ ID NO: 45931 - RNA, 42 nt, Mus musculus
aaucaaaugaaaacaguagaugugauuuuagugugccugccu

SEQ ID NO: 45932 - RNA, 46 nt, Mus musculus
aaacuuuaguguuuguguguguauacauuuuuuaaauaaagaacag

SEQ ID NO: 45933 - RNA, 45 nt, Mus musculus
uccccagacaccugcgacaaccuggaauccaucccagguccccca

SEQ ID NO: 45934 - RNA, 46 nt, Mus musculus
ggcuggcacacccaccaaagucagacacguggacugccaaguggag

SEQ ID NO: 45935 - RNA, 45 nt, Mus musculus
uuagugugagguaaguaucuuagcacaugcucugugagagcugag

SEQ ID NO: 45936 - RNA, 76 nt, Mus musculus
gcucgaggugcucagccagaagcgcaugcaccacaaguaccaucagcggcccaccuucagacagaugaagcuggag

SEQ ID NO: 45937 - RNA, 71 nt, Mus musculus
uuccuagcucuggcucagcgcuggccgguuccuucagguugagauaauuuagugguugauaauaauuaaug

SEQ ID NO: 45938 - RNA, 46 nt, Mus musculus
agaaguaaagcaguccccacccccuuuuccugggucuuccugagag

SEQ ID NO: 45939 - RNA, 44 nt, Mus musculus
uuuaggcuucuaaagagaaaacagggcucuugagaauguguuuu

SEQ ID NO: 45940 - RNA, 42 nt, Mus musculus
uuuuuuuuuccguacacagugggugugcaaaguauuauguag

SEQ ID NO: 45941 - RNA, 45 nt, Mus musculus
uaaaccaggaguuaaaccugacagaacugcuuuuagaagaagaag

SEQ ID NO: 45942 - RNA, 45 nt, Mus musculus
ggagaaggagaaggagaaaagaaagaaaagaaaucacagccccag

SEQ ID NO: 45943 - RNA, 46 nt, Mus musculus
gguccucaugauuuccacucgaaccugcugaggccugagcccccca

SEQ ID NO: 45944 - RNA, 42 nt, Mus musculus
cuagagcucaauuggaagaauucuugccuaggauaugcagag

SEQ ID NO: 45945 - RNA, 47 nt, Mus musculus
acuuacauauaauaauaaauaaaaaaucuuuaaaaaaaaaaaaaaga

SEQ ID NO: 45946 - RNA, 42 nt, Mus musculus
uuugugcacauuugccuuaccggccaccacaccagggagcag

SEQ ID NO: 45947 - RNA, 46 nt, Mus musculus
caagaaugauucggcaucccacagccugucaagcauuuuuggagaa

SEQ ID NO: 45948 - RNA, 46 nt, Mus musculus
auguguauauguguaugugagucacaccccauguguaaaggucaga

SEQ ID NO: 45949 - RNA, 46 nt, Mus musculus
ccagaagggggaggggagggagguaacauuugagagucugaggcag

SEQ ID NO: 45950 - RNA, 41 nt, Mus musculus
aaaguagcaaagugagccaucuguuuccacccagcacccgg

SEQ ID NO: 45951 - RNA, 45 nt, Mus musculus
caguaaugcucgggaacuacccugaagaucccugaagguugcugg

SEQ ID NO: 45952 - RNA, 42 nt, Mus musculus
aucuguuuaagcacaggaaggaaugagucagucaacggggca

SEQ ID NO: 45953 - RNA, 42 nt, Mus musculus
aguauagauucuuacaccacccacgucauccuuccgggacag

SEQ ID NO: 45954 - RNA, 46 nt, Mus musculus
cgucccauuuauuuauucuaagucugcuuuguaaaacaugauguag

SEQ ID NO: 45955 - RNA, 44 nt, Mus musculus
aauuuggguccaugaaaagcaucaagcaccccaccccaacuuaa

SEQ ID NO: 45956 - RNA, 46 nt, Mus musculus
gauuguuucggacccacugccuguaagcuucuuaauuaaugggcag

SEQ ID NO: 45957 - RNA, 67 nt, Mus musculus
ucuguugcuuuguugcccucucuccuuucuauuugccaaggaugguauuauuauugguggguaggug

SEQ ID NO: 45958 - RNA, 45 nt, Mus musculus
guggugcagagacaauccugccuccuucccaacacacacagacac

SEQ ID NO: 45959 - RNA, 37 nt, Mus musculus
gcagcaaaagcaaacugccagaaacugguacucagga

SEQ ID NO: 45960 - RNA, 45 nt, Mus musculus
uuuuuuuuggucugguugagggcauuaaguacuuuuucaguccaa

SEQ ID NO: 45961 - RNA, 46 nt, Mus musculus
gcuuucaggcaggcugaguauacacauuguauauacuuacuccaag

SEQ ID NO: 45962 - RNA, 46 nt, Mus musculus
uguuuaaauccauugacuguuuuauaaugauggauggauggaugaa

SEQ ID NO: 45963 - RNA, 46 nt, Mus musculus
acacaggcuguggaugaagaacuggcaauaaggagauuuggcgcac

SEQ ID NO: 45964 - RNA, 46 nt, Mus musculus
uuuugccaagaccgguugucaugggacaaaauucaagggcgcgaug

SEQ ID NO: 45965 - RNA, 41 nt, Mus musculus
gaaccugaccagcagaguggguguggccaagagaggcgaug

SEQ ID NO: 45966 - RNA, 60 nt, Mus musculus
auauacuguguacacuuggaggucagaaguugugucagaucccagaaacuagaauuggcg

SEQ ID NO: 45967 - RNA, 46 nt, Mus musculus
cuuagacuagcaggaugaagguaucauauaucccaggaaggccaua

SEQ ID NO: 45968 - RNA, 42 nt, Mus musculus
agaaccaccggacuucagguuaugagauaaauaugcccacac

SEQ ID NO: 45969 - RNA, 44 nt, Mus musculus
gcaaaucuaaagguaguguuuaaauguuggugaguacaggcaga

SEQ ID NO: 45970 - RNA, 45 nt, Mus musculus
gucugugcccagacugggaauccugggacccacggaagccggugg

SEQ ID NO: 45971 - RNA, 45 nt, Mus musculus
ggacacuauaaaauuauuauaggaguuucuggagagagcuaccag

SEQ ID NO: 45972 - RNA, 46 nt, Mus musculus
gagggggugcaggugugugugugugugugugugugugugugugugu

SEQ ID NO: 45973 - RNA, 42 nt, Mus musculus
uucauuuguuuccauuuauuuguagcauuuggcuuaagggag

SEQ ID NO: 45974 - RNA, 44 nt, Mus musculus
acauuacagggcguuuuaggggcucugugugaggaaccauguua

SEQ ID NO: 45975 - RNA, 54 nt, Mus musculus
ugacaggaaucgaaccuacuggaaacauggugaagcagccagccaaauucacgg

SEQ ID NO: 45976 - RNA, 57 nt, Mus musculus
uagauaccaucagcgcuggacaaggagaugugaugguguuuguugaggacccagaag

SEQ ID NO: 45977 - RNA, 42 nt, Mus musculus
guguugccauccaccauuggguauacaaucccgaggaaggug

SEQ ID NO: 45978 - RNA, 48 nt, Mus musculus
agcacauuucuaagagcccauuugaagugaauguugacaaagcccaag

SEQ ID NO: 45979 - RNA, 52 nt, Mus musculus
gggggacaucggcauugagguggaggauccccagggcaagaacagcguggag

SEQ ID NO: 45980 - RNA, 46 nt, Mus musculus
agugcuaacacaaguuguguuccucugcuuuccucccugugucaaa

SEQ ID NO: 45981 - RNA, 42 nt, Mus musculus
gaauaaaggcuguuguaugugcuguuuagagaggaaaagcca

SEQ ID NO: 45982 - RNA, 46 nt, Mus musculus
gaagucauguuagccauggcauuuucugcugaggcuugcuuuguag

SEQ ID NO: 45983 - RNA, 45 nt, Mus musculus
uuuaagguggacaccaaggcugcuggaagcggagagcuuggugua

SEQ ID NO: 45984 - RNA, 42 nt, Mus musculus
ggaaggauuugccccaagggcagccaagguucuacugcccag

SEQ ID NO: 45985 - RNA, 48 nt, Mus musculus
gggucuacucauuugaguacuaccccagcacaccagggaaauacagcg

SEQ ID NO: 45986 - RNA, 45 nt, Mus musculus
cauggggcccuggacuccacggcggcauuguuggucggucagcag

SEQ ID NO: 45987 - RNA, 62 nt, Mus musculus
gauggcucgugugaugucaaauacuggcccaaggagccuggagaauacgccguucacaucau

SEQ ID NO: 45988 - RNA, 55 nt, Mus musculus
uggucugaaggcaaaugagccuacucacuuuacaguggauugcacggaggccggg

SEQ ID NO: 45989 - RNA, 46 nt, Mus musculus
guugguaucaagugcgaugcccgaguuuuaagugacgaugaggaag

SEQ ID NO: 45990 - RNA, 46 nt, Mus musculus
gauuuuuaucagagaaauacuaacuucuuauauacaaaacuaccag

SEQ ID NO: 45991 - RNA, 46 nt, Mus musculus
ccuuuaacaaaaugcaggaauucugaagaauuuugcugucuaggca

SEQ ID NO: 45992 - RNA, 46 nt, Mus musculus
ugaguucgccaugucccuggggggaaugaagguucuuggggggcau

SEQ ID NO: 45993 - RNA, 45 nt, Mus musculus
uaaaaguccuuucacugugggcguugcugcgccacuggaucugag

SEQ ID NO: 45994 - RNA, 42 nt, Mus musculus
acauauaagauuaucaccucaaggaaaugaggaagcaggcag

SEQ ID NO: 45995 - RNA, 44 nt, Mus musculus
gugacgggaccugcuccgucuccuaccuucccacaaaacccgga

SEQ ID NO: 45996 - RNA, 46 nt, Mus musculus
cauagacacuagugggaucaaagccuuugggccaggaaucgaaggc

SEQ ID NO: 45997 - RNA, 46 nt, Mus musculus
ugagccaccuacuguaggugcugggaccuucccacugguccacugc

SEQ ID NO: 45998 - RNA, 48 nt, Mus musculus
aauuaauugauuaagcaaagaaaaaauaguuuauaagucugaggccaa

SEQ ID NO: 45999 - RNA, 46 nt, Mus musculus
ggagcaauaaaugcuuuuacucacuaauccauuccuucagccccaa

SEQ ID NO: 46000 - RNA, 41 nt, Mus musculus
ugugucucugugugugugugugugugugugugugugugggu

SEQ ID NO: 46001 - RNA, 45 nt, Mus musculus
uccguaacaagaucugaugcccucuucuggugucugaaaacagcu

SEQ ID NO: 46002 - RNA, 46 nt, Mus musculus
guauucaguggugugcuuagcuaaggagucuuuuguugguaacagg

SEQ ID NO: 46003 - RNA, 49 nt, Mus musculus
cugcagggaaggggaaaguaaccugcgugauucugaccccagauggcac

SEQ ID NO: 46004 - RNA, 45 nt, Mus musculus
uacuguguuguguuuauccccuaguagguaugaucuuguuaguua

SEQ ID NO: 46005 - RNA, 46 nt, Mus musculus
cuuccaaaggacgaccuaaauccaauucccagcacccacucagcag

SEQ ID NO: 46006 - RNA, 65 nt, Mus musculus
uuaaaaucuaccuaacaaaucuuaaagccucuauauccugaagaaagaaagaaagaaagaaagaa

SEQ ID NO: 46007 - RNA, 42 nt, Mus musculus
accucugcuggcaccaggcacacacgugguguacauacccag

SEQ ID NO: 46008 - RNA, 46 nt, Mus musculus
cuuacaggauauuauaacacgugccuauuaucccagcacuugggag

SEQ ID NO: 46009 - RNA, 46 nt, Mus musculus
gaggaggcaccgguaaaugcaugucccccuggauucaggcccuggg

SEQ ID NO: 46010 - RNA, 45 nt, Mus musculus
gcuaggcuucaagcccuuugacuuggugauuccauuugccgucag

SEQ ID NO: 46011 - RNA, 42 nt, Mus musculus
uaagugggguacagcggcucgcuagccucaggcaucugggag

SEQ ID NO: 46012 - RNA, 43 nt, Mus musculus
cauuuuuuuuucuguuuaaggauucuaaugauaauaggugcag

SEQ ID NO: 46013 - RNA, 46 nt, Mus musculus
cgucucagaugccugcuauguacuuaagauacaucuuagcgcacuu

SEQ ID NO: 46014 - RNA, 42 nt, Mus musculus
ugaacuaccccaacagugggagugugucugcuuaugguccag

SEQ ID NO: 46015 - RNA, 49 nt, Mus musculus
cuggcucuguucugccugcugaguuaagaacacaugguggguucucugg

SEQ ID NO: 46016 - RNA, 42 nt, Mus musculus
aucccccgagaagugggugagcaucuagucagcaucaagaaa

SEQ ID NO: 46017 - RNA, 46 nt, Mus musculus
gccacaagcuccggagccaagcuggauauuguguugcaggcuaugg

SEQ ID NO: 46018 - RNA, 46 nt, Mus musculus
uaauuacuuaaaagggggaggggcagggucucaauauguagcacag

SEQ ID NO: 46019 - RNA, 51 nt, Mus musculus
gccauuuuagucuuauuucuaggauuaacuugugauguggaguuugcuuug

SEQ ID NO: 46020 - RNA, 51 nt, Mus musculus
gcaucuuaacgacuaguauacuucccuccucccggcuggagaggcugugag

SEQ ID NO: 46021 - RNA, 46 nt, Mus musculus
uuugcucacgcaugguuccuccuuugcgguugaaauggccuguguu

SEQ ID NO: 46022 - RNA, 46 nt, Mus musculus
uuguguucacuuuuguaucuuaaugccuuugaccuuguugcccgaa

SEQ ID NO: 46023 - RNA, 46 nt, Mus musculus
uacauacguauauaagcucauauaaauguaagagagacacagguag

SEQ ID NO: 46024 - RNA, 42 nt, Mus musculus
accauaaaaaugggucaugcggugugucuuauauugcccaag

SEQ ID NO: 46025 - RNA, 46 nt, Mus musculus
aggugucuaucaaguucaacgacgagcacaucccggacagcccuua

SEQ ID NO: 46026 - RNA, 45 nt, Mus musculus
guuagggucagguaguuuguccauuuugcaaacaaggaaauuuga

SEQ ID NO: 46027 - RNA, 44 nt, Mus musculus
agcaaugacauaaaauccagcucaugucaugaacacugcaccca

SEQ ID NO: 46028 - RNA, 64 nt, Mus musculus
aaccagccagcguccuuugcuauaagguugaauggugcgaaagggaagauugaugcaaaggugc

SEQ ID NO: 46029 - RNA, 46 nt, Mus musculus
aucccaggggauauggggagagaccagaggcuugcuagcuagccag

SEQ ID NO: 46030 - RNA, 42 nt, Mus musculus
ugcagugccaaaagauaagaguagcugacuacuacuguccag

SEQ ID NO: 46031 - RNA, 63 nt, Mus musculus
guucgcuucaucccgcaugagaauggcauccacacgaucgaugucaaguuuaacgggagccac

SEQ ID NO: 46032 - RNA, 42 nt, Mus musculus
cauuacaguuuguuuguagcccagaugucuuucuacagcaag

SEQ ID NO: 46033 - RNA, 45 nt, Mus musculus
gucagcuugagguaggccucagcucggcccaucacgucagcauua

SEQ ID NO: 46034 - RNA, 46 nt, Mus musculus
cacuaagacaugguuugcuguacuuagagcaaacccaacccugaag

SEQ ID NO: 46035 - RNA, 46 nt, Mus musculus
cugacucccugcuucccucugagccaguacuuugcucuuggaugag

SEQ ID NO: 46036 - RNA, 45 nt, Mus musculus
gcugggcuagcaucugcagcucugucagagguauugugcccccag

SEQ ID NO: 46037 - RNA, 46 nt, Mus musculus
uauggcgggcccaaccacaucucgaggaguccauucaaggccaagg

SEQ ID NO: 46038 - RNA, 45 nt, Mus musculus
auagccaaugcuggacgugucccuuccgguugcuuuuguugcuag

SEQ ID NO: 46039 - RNA, 46 nt, Mus musculus
agcccucugcccaaaucaagacucuuaauuucaaaggucauugcag

SEQ ID NO: 46040 - RNA, 46 nt, Mus musculus
acaggacugacuggcucuccuaagcuucuggucuacucaagcgaua

SEQ ID NO: 46041 - RNA, 46 nt, Mus musculus
cccacuuuccucaagacuagacaacaaauaagaaagucugacccag

SEQ ID NO: 46042 - RNA, 46 nt, Mus musculus
ccuggagcagcugaagccggaugugaaaggcggaauagacacggag

SEQ ID NO: 46043 - RNA, 45 nt, Mus musculus
augacagaguccuuguccugugaggcucuggaagacaggaggggg

SEQ ID NO: 46044 - RNA, 45 nt, Mus musculus
cauucaacaggucuaguagaaaaugaaguuuauuuggggcaugag

SEQ ID NO: 46045 - RNA, 45 nt, Mus musculus
ccucuccguccugggccgaggcgguuuagccucgcggggcaggug

SEQ ID NO: 46046 - RNA, 44 nt, Mus musculus
uaauggagcaagguugggaacaaucuuacucuucggcaguaggg

SEQ ID NO: 46047 - RNA, 46 nt, Mus musculus
aggggagaacuugcaagaacuaggcaaggaggguaugguaccauaa

SEQ ID NO: 46048 - RNA, 58 nt, Mus musculus
cucucugacuccuguagguguccauguuggaagaugccagcgacugcauaugaaagag

SEQ ID NO: 46049 - RNA, 83 nt, Mus musculus
aguuucaagaacaugggguuggacugaacguggcacaguucaaacagcugcucgucucagcccugagagaccuguuuggggag

SEQ ID NO: 46050 - RNA, 46 nt, Mus musculus
acagaauuuuagaaaagggacugagcguauaacucacugggggaau

SEQ ID NO: 46051 - RNA, 45 nt, Mus musculus
cuaguguauccuguauuugacaagaaaucuaucagacaccagcuu

SEQ ID NO: 46052 - RNA, 46 nt, Mus musculus
uuugaaaacuguaugucugacaaagaaguauuaucuaggguauuag

SEQ ID NO: 46053 - RNA, 72 nt, Mus musculus
cgaugagaagacacugucggccaucuugagaauaugcagcagguaugaccccaagacaguuggagaguaaca

SEQ ID NO: 46054 - RNA, 46 nt, Mus musculus
gcucagcccucagcacacaccuuuaaucucuguggcugaaauacag

SEQ ID NO: 46055 - RNA, 46 nt, Mus musculus
agagaaaaaagagauuauguaagagagcagcacagaagaaagggaa

SEQ ID NO: 46056 - RNA, 46 nt, Mus musculus
agucuguugcuguuguugcaguguccuguuguguaauagaaaguaa

SEQ ID NO: 46057 - RNA, 46 nt, Mus musculus
caagcaaaauacaaauacaauaauaguaagauaaaaaucuuuuuaa

SEQ ID NO: 46058 - RNA, 25 nt, Mus musculus
agaaaggcuguuccaucccugccua

SEQ ID NO: 46059 - RNA, 45 nt, Mus musculus
ugccccgugauaguggguggaccuuacauacaucuuggcugacug

SEQ ID NO: 46060 - RNA, 73 nt, Mus musculus
guuuuaucauuggaaguaaagccguuuaguccccuugugcugccagauauauuagcuugaaaggguguuaugc

SEQ ID NO: 46061 - RNA, 46 nt, Mus musculus
auguuugggggugacuuccccacagcccgagacccucaaggcaauu

SEQ ID NO: 46062 - RNA, 45 nt, Mus musculus
uuuuuugauucagucuuuguauuuauuugaaggcauugaggacca

SEQ ID NO: 46063 - RNA, 46 nt, Mus musculus
agaauaucauguagggcgaccuaguuuccagaccaguaggcaguau

SEQ ID NO: 46064 - RNA, 42 nt, Mus musculus
cguaguguuaacagaagugugcacgcgcauguauuuccacac

SEQ ID NO: 46065 - RNA, 43 nt, Mus musculus
acgucgaagcuuugagaugaugggaagaagaaacuuggcgaua

SEQ ID NO: 46066 - RNA, 46 nt, Mus musculus
gauccauaguuccccacucacacgguuacaaggugaggcguggcag

SEQ ID NO: 46067 - RNA, 24 nt, Mus musculus
auacauuuguaguuccagugccag

SEQ ID NO: 46068 - RNA, 72 nt, Mus musculus
gucccucuugcucugaggcuuccagcugccuggugggagcagcuacugauuccucaaccuauccaagcacag

SEQ ID NO: 46069 - RNA, 41 nt, Mus musculus
ccuauuauuaacaaaauaaaaaaaaagaaaaagcuggccug

SEQ ID NO: 46070 - RNA, 46 nt, Mus musculus
aauaacacuaaguugaauuccuccacauuuuuggaagauagguggg

SEQ ID NO: 46071 - RNA, 46 nt, Mus musculus
ggccaauuggcuuuuuuauuugggugggaggcagugaaaggcuugc

SEQ ID NO: 46072 - RNA, 41 nt, Mus musculus
cauugugaaaugcaggagucaauuacagaacagaagcaaga

SEQ ID NO: 46073 - RNA, 46 nt, Mus musculus
ugucaaagaaaagaggacugaguggggaggaaaagagaacccggau

SEQ ID NO: 46074 - RNA, 44 nt, Mus musculus
aggcucugaacucucagcugucagagggaagccagaagcaugca

SEQ ID NO: 46075 - RNA, 74 nt, Mus musculus
uugugaauaugucaagguuuaaacagcuaacuaauguuacccaguuaucaucuaucugcuaauuguuuaucauu

SEQ ID NO: 46076 - RNA, 28 nt, Mus musculus
ccugaccacgcccaggucuugcgcaggc

SEQ ID NO: 46077 - RNA, 44 nt, Mus musculus
ggacuugggguggccguugggcgcuuccucgcuucaaaaggcag

SEQ ID NO: 46078 - RNA, 46 nt, Mus musculus
guauccagaauaucagucuuaagaaacaaucaucaugguugugcag

SEQ ID NO: 46079 - RNA, 44 nt, Mus musculus
agcucuuugugacuuuuuauuccucauacugggauuaggccauu

SEQ ID NO: 46080 - RNA, 49 nt, Mus musculus
aacuucuuugauuuuccuuuuugagauaagauacaacaagaacuccuau

SEQ ID NO: 46081 - RNA, 63 nt, Mus musculus
accuguaaucuugggaggugaaggaggauggcugugaguuugacacaagccugagccgcagau

SEQ ID NO: 46082 - RNA, 50 nt, Mus musculus
cacacuuguaaugaggcuuaauguauaaauaaggcacagaaaagaaucag

SEQ ID NO: 46083 - RNA, 46 nt, Mus musculus
cuagcccuucgcuacaauggugcuggaagcuggguaagaggcaguc

SEQ ID NO: 46084 - RNA, 46 nt, Mus musculus
cagaaguaccaccauguucucagguuaaaugaaaaacccugcacuu

SEQ ID NO: 46085 - RNA, 46 nt, Mus musculus
ccuugaagucacagccauucuccuguuuuagccucugauaacugag

SEQ ID NO: 46086 - RNA, 46 nt, Mus musculus
gagaggagacagagaggaggcaauggaacacugacuuagcggccag

SEQ ID NO: 46087 - RNA, 44 nt, Mus musculus
ucugcagacacaaaauuauccauacccagguacguggccccuag

SEQ ID NO: 46088 - RNA, 45 nt, Mus musculus
guaaaaucgccacacaguugacaaaaggacuugcuggcuucagau

SEQ ID NO: 46089 - RNA, 45 nt, Mus musculus
uuucgaaaaccuuccagccacuugcuugaugcugaaacagcagau

SEQ ID NO: 46090 - RNA, 45 nt, Mus musculus
gaauuuguccuccucauauuuuguccacugauccuuaggcaagau

SEQ ID NO: 46091 - RNA, 46 nt, Mus musculus
aaacacccauggaaggaguuacagagacaaaguuugguggugagau

SEQ ID NO: 46092 - RNA, 46 nt, Mus musculus
uuuugaaauaagaaguugagaagugguuacacauuggucuggagag

SEQ ID NO: 46093 - RNA, 45 nt, Mus musculus
cuuuccaaagaacccuuaaguuuccacuucaaccugugucccagg

SEQ ID NO: 46094 - RNA, 45 nt, Mus musculus
gaagcccucagguguguguguguguguguguguguguguguguau

SEQ ID NO: 46095 - RNA, 24 nt, Mus musculus
uccucucccuucuccuguguguca

SEQ ID NO: 46096 - RNA, 46 nt, Mus musculus
cuuugaggugguagcgcucuauuccuugacaauauaugccaaagac

SEQ ID NO: 46097 - RNA, 45 nt, Mus musculus
cauauauaacaaucccuaagaauagcacaccccuuuggagcagau

SEQ ID NO: 46098 - RNA, 43 nt, Mus musculus
ugaggugcuuaaugacucuuugcucugaacacauugugauuuu

SEQ ID NO: 46099 - RNA, 47 nt, Mus musculus
aguuaaagacaagagucaguugaaauuaggaaagaaaacgaggaaag

SEQ ID NO: 46100 - RNA, 47 nt, Mus musculus
ccaugaggucuucaggggguggaccugaaaugguaaugcuaagaggg

SEQ ID NO: 46101 - RNA, 42 nt, Mus musculus
acugggaagauucagaacucaaguauuuggggagcacaauuu

SEQ ID NO: 46102 - RNA, 46 nt, Mus musculus
aggcagggacaguuggagaaagaaaaaaggagagagaaggagcaca

SEQ ID NO: 46103 - RNA, 46 nt, Mus musculus
guuaaauaaaauggcuacaauuaauuauaggggagaauagagagau

SEQ ID NO: 46104 - RNA, 45 nt, Mus musculus
auguggcuuuacuauuaugauaacacugguuucacaaagagagua

SEQ ID NO: 46105 - RNA, 46 nt, Mus musculus
uaccccucccauacccauuucuugagaauagacauuguuagaucug

SEQ ID NO: 46106 - RNA, 45 nt, Mus musculus
aacuggugggauguaaacuguuauaaccacuguagcaaucaggau

SEQ ID NO: 46107 - RNA, 46 nt, Mus musculus
uaauaacaucugacacccucuccuggugugucugaagacagcuaca

SEQ ID NO: 46108 - RNA, 41 nt, Mus musculus
ucauugaguauucacaaagguccaaauuaauguagggcaga

SEQ ID NO: 46109 - RNA, 45 nt, Mus musculus
aagugaggcaguaugacugccugccuuagagaacugcagccauuu

SEQ ID NO: 46110 - RNA, 46 nt, Mus musculus
guuaggcaugaauucaauucccagaaccacaaaaaagaaaaaagaa

SEQ ID NO: 46111 - RNA, 45 nt, Mus musculus
guauugucacagguggcuaucacacuguacacuuaauacacagua

SEQ ID NO: 46112 - RNA, 42 nt, Mus musculus
aguucuauaggaugcagagaaaugagauuauuugguucauaa

SEQ ID NO: 46113 - RNA, 46 nt, Mus musculus
uagaaaucagcaucugaaaauauuuaauaaaaugucucaaggugga

SEQ ID NO: 46114 - RNA, 46 nt, Mus musculus
gcuuucaaguauucaugugucguucauauuucuucacagaacggaa

SEQ ID NO: 46115 - RNA, 42 nt, Mus musculus
ugucuucauggggcagggccuaugcucgggccacgcccccca

SEQ ID NO: 46116 - RNA, 66 nt, Mus musculus
acccccgggugucucacaagacucaggcccagcccccuggcgaaggauggugucaccugucaguca

SEQ ID NO: 46117 - RNA, 64 nt, Mus musculus
uccugucacgaaggaugaugucauucucacccccagaugucaaucaaaacccaaaucccgcccc

SEQ ID NO: 46118 - RNA, 45 nt, Mus musculus
aucucagcucaagcccugcccacuaacuuccugucauggcgaaug

SEQ ID NO: 46119 - RNA, 45 nt, Mus musculus
accucccacaacuguggaugaugucaccugucacucaagccccac

SEQ ID NO: 46120 - RNA, 44 nt, Mus musculus
gcgguccgugaggcuccacccacugcugugaccacgcccaucca

SEQ ID NO: 46121 - RNA, 45 nt, Mus musculus
cuggggaaggacagggcuguggcaggauccauccaguucccccca

SEQ ID NO: 46122 - RNA, 54 nt, Mus musculus
ggaagaggaagugaccacagagggacaggaagugacuuugaggggacaggaaga

SEQ ID NO: 46123 - RNA, 45 nt, Mus musculus
acagacgccugagaacugugugggggcuggggcauagggagcggu

SEQ ID NO: 46124 - RNA, 46 nt, Mus musculus
gucuauccucacagggaaacacacagcaggguugugggcagugggg

SEQ ID NO: 46125 - RNA, 46 nt, Mus musculus
ugcuuauccucuuuaagccucucaucaguuucaaguuuggauggaa

SEQ ID NO: 46126 - RNA, 45 nt, Mus musculus
uuccccagcacagaugcccagggggucugagcucaccaccuccag

SEQ ID NO: 46127 - RNA, 44 nt, Mus musculus
gcccgcgauggggcgcggcuaggagugcugcgcgcagcggucag

SEQ ID NO: 46128 - RNA, 38 nt, Mus musculus
gcuugugcaacacuuaagugucuggugccuaggcaagg

SEQ ID NO: 46129 - RNA, 45 nt, Mus musculus
auaagauuauuuagcuaggugaaaaguuagauuuucauuguggga

SEQ ID NO: 46130 - RNA, 46 nt, Mus musculus
ucuggauuguagauuaauauagugggagaacaugguauggguuaga

SEQ ID NO: 46131 - RNA, 46 nt, Mus musculus
ucucuggaacauagccucugugcucucagaaaacacuucccagaag

SEQ ID NO: 46132 - RNA, 45 nt, Mus musculus
uguucucaacauuaucuuccaagcuccuauacaucaucccacaga

SEQ ID NO: 46133 - RNA, 45 nt, Mus musculus
gagacagcaaacaaaaaugacucuacuaagaaguugucuguugag

SEQ ID NO: 46134 - RNA, 45 nt, Mus musculus
agacccaacuggagcacauucuccuucguccugauacauacauug

SEQ ID NO: 46135 - RNA, 25 nt, Mus musculus
ugauuaagaaggacagaggagcuaa

SEQ ID NO: 46136 - RNA, 46 nt, Mus musculus
acuuuuguucuuuuuuguauauuuguagguccauaaacacccccug

SEQ ID NO: 46137 - RNA, 46 nt, Mus musculus
ggaauaaugggaaaggcauuccaguaguagaacacaaaguagagaa

SEQ ID NO: 46138 - RNA, 45 nt, Mus musculus
acaguagaaacggcuugcaaagaauacaaacauaguuuuaaacag

SEQ ID NO: 46139 - RNA, 45 nt, Mus musculus
aacauuuugauggugaagauuauacaugcauaacauuccagccag

SEQ ID NO: 46140 - RNA, 45 nt, Mus musculus
auaauuauauuucgauuuuuaaaauuuauuuugguauuccuaaaa

SEQ ID NO: 46141 - RNA, 46 nt, Mus musculus
ggcugaaauuuccuguuacuauuagagccuuauuagucugggggua

SEQ ID NO: 46142 - RNA, 46 nt, Mus musculus
agacuucagaauggcaguuauuuuagucuaaguuguuuuggggggu

SEQ ID NO: 46143 - RNA, 46 nt, Mus musculus
aaauaagcaggaacuuuccuuuuauaguauuccugaauuugaugag

SEQ ID NO: 46144 - RNA, 66 nt, Mus musculus
uguaagcaaaauuuuaaacucccacaaauaguaguaguaguaguaguaguaguaguaguaguggug

SEQ ID NO: 46145 - RNA, 46 nt, Mus musculus
ggggaaagaggugagacugaugagauucaugcagugaugguauuuu

SEQ ID NO: 46146 - RNA, 50 nt, Mus musculus
auaggcuucaagccaggucaacgaaaaguuuuguuuaccuguuucaagag

SEQ ID NO: 46147 - RNA, 46 nt, Mus musculus
gagaugucugcuuaccaccauggagaaguaagcacugaagauggga

SEQ ID NO: 46148 - RNA, 34 nt, Mus musculus
acuugcuuaaguuccuuuaugaugauaaucaacg

SEQ ID NO: 46149 - RNA, 46 nt, Mus musculus
cauauauauaauacauacacacacacacacacacacacacacacac

SEQ ID NO: 46150 - RNA, 46 nt, Mus musculus
aauaagugaugugauuaggaaugaguaaaguuauguuggugaauaa

SEQ ID NO: 46151 - RNA, 41 nt, Mus musculus
gauuuaaaggauauuaagcuaacauggaaggaauuugguca

SEQ ID NO: 46152 - RNA, 46 nt, Mus musculus
auuacaaagaauaucauacugacacaacugugaaguuuguggugaa

SEQ ID NO: 46153 - RNA, 46 nt, Mus musculus
cucuuugaucauauggguugucugaagaaguaugaaacugugcaag

SEQ ID NO: 46154 - RNA, 54 nt, Mus musculus
ggagcagaaucuacaaagcuuaauaaucaagcccguuucauuuuagagaagaua

SEQ ID NO: 46155 - RNA, 48 nt, Mus musculus
agaauaggucaaagaaagauuugauucaaauguuaguccagagagguu

SEQ ID NO: 46156 - RNA, 45 nt, Mus musculus
aacaugaugacaguuccucugauucaggaacuccuucaggcccug

SEQ ID NO: 46157 - RNA, 47 nt, Mus musculus
uucagaucuuuggaaagaagacuuagcagcauuuguugaagaauugg

SEQ ID NO: 46158 - RNA, 46 nt, Mus musculus
gaagaauuguuccagagauuacugcuaugaaggcagaugccagcag

SEQ ID NO: 46159 - RNA, 101 nt, Mus musculus
ugaaaguagaauuugaugaagaauuuaguggaacaccagcagaagguacaggagaggagacauugaccccaucugcuccuguaaauaaaggccccaaaccc

SEQ ID NO: 46160 - RNA, 47 nt, Mus musculus
ggguuagaaaaacaccuacaucaacugguaaaacuaaugcgaagaaa

SEQ ID NO: 46161 - RNA, 45 nt, Mus musculus
cucauaggaguguuaauuggauuuaguggguuauaaaaacugaag

SEQ ID NO: 46162 - RNA, 49 nt, Mus musculus
gugucuugguuauugaguaugcaagacaaaagaaagcaccaacauacag

SEQ ID NO: 46163 - RNA, 45 nt, Mus musculus
ugagucacuuuguaucacugugaccauguauauggcaaauaacuu

SEQ ID NO: 46164 - RNA, 45 nt, Mus musculus
ccagggccaggaagugggaguggguggguuggugagcugggggag

SEQ ID NO: 46165 - RNA, 47 nt, Mus musculus
agguugacauaagaggccucugugaguggcugauggucagcccuggg

SEQ ID NO: 46166 - RNA, 46 nt, Mus musculus
uuucauaucuacauuguaagaaauuaccauugugauugggucagaa

SEQ ID NO: 46167 - RNA, 46 nt, Mus musculus
uuccugugcuuuuaguaugugauaugagaggauuccagcuucuaga

SEQ ID NO: 46168 - RNA, 40 nt, Mus musculus
ccacauguaguauuucuguauuugaaaguagcccaaagau

SEQ ID NO: 46169 - RNA, 45 nt, Mus musculus
gccuuugaacaugaacugaugcuaauguacauuuuaugcugagau

SEQ ID NO: 46170 - RNA, 46 nt, Mus musculus
aaaugaggccuccauuuuuacaaaauuacuucuaaaguugccagau

SEQ ID NO: 46171 - RNA, 46 nt, Mus musculus
cagugauggccaacuaggccaucuucuccuacauaugcagcuagag

SEQ ID NO: 46172 - RNA, 45 nt, Mus musculus
uucaauucugugaccccagcauguaaguuacagguucugccggua

SEQ ID NO: 46173 - RNA, 46 nt, Mus musculus
agcccugacuguccuggaacucauuuuuuagacaaggcuggccucg

SEQ ID NO: 46174 - RNA, 42 nt, Mus musculus
cgagaaaacucaucugagagcaugccaccucagagaggagaa

SEQ ID NO: 46175 - RNA, 46 nt, Mus musculus
uuugcaaaggaggaagugauugguauggugaccagagcccacaagg

SEQ ID NO: 46176 - RNA, 46 nt, Mus musculus
guaaaaaaagcuuuuauuucuuacuacuuaucuaauucugggagua

SEQ ID NO: 46177 - RNA, 45 nt, Mus musculus
ggugaccauugucucuugugucugcuguucaucgaggaaccagug

SEQ ID NO: 46178 - RNA, 41 nt, Mus musculus
ugcaauauauaauguauguaauuuguuuguuugagagaggu

SEQ ID NO: 46179 - RNA, 45 nt, Mus musculus
ucucugaaaaaggggggugauuagcuuuccaguuauagaggucag

SEQ ID NO: 46180 - RNA, 45 nt, Mus musculus
uaagcugagaauuucuucuuuauuuuugauaucuuugccagcaga

SEQ ID NO: 46181 - RNA, 42 nt, Mus musculus
cagccuguuaacauuuaacuuaggucagagggguggggaguu

SEQ ID NO: 46182 - RNA, 45 nt, Mus musculus
ccagaagaggacuuagauuccucuggaauuggaguuagagguagu

SEQ ID NO: 46183 - RNA, 46 nt, Mus musculus
uucuuuuauguauacuuucguuucagucuugcaguuacuggcagau

SEQ ID NO: 46184 - RNA, 46 nt, Mus musculus
uauccugcauauuauauuuacauuacaauucauaauaguagcaaga

SEQ ID NO: 46185 - RNA, 45 nt, Mus musculus
uucuuugcuuuggauccuguugcaaauuaauauccccccccuccc

SEQ ID NO: 46186 - RNA, 48 nt, Mus musculus
aaaaaccaucgcaguucuaacauauguuuuaugaauuuuuagaccagu

SEQ ID NO: 46187 - RNA, 46 nt, Mus musculus
caaaauaaccccuuuuguuuucaggacugacuuugaacccccaaaa

SEQ ID NO: 46188 - RNA, 48 nt, Mus musculus
cguuaaaaacguuuuagcuucgcgcccaagaguuugaggcagauggcg

SEQ ID NO: 46189 - RNA, 45 nt, Mus musculus
agagcaauucgcuuccagggggacuuagccuagaaguccuuuuaa

SEQ ID NO: 46190 - RNA, 78 nt, Mus musculus
cggagccuguauagaggaagugggcggagccaaggguaggagcgggagagucgaggagaggaggagcgggcggccuga

SEQ ID NO: 46191 - RNA, 42 nt, Mus musculus
uaauaaaagcaucaauuagauuuugagaccaagccagcuguu

SEQ ID NO: 46192 - RNA, 46 nt, Mus musculus
ugacuggaauagagaaaauuucucuauauuguagguaguccuggaa

SEQ ID NO: 46193 - RNA, 47 nt, Mus musculus
aauuguuuauuggauaugaauuuuacaaauaucacguguauuagcgg

SEQ ID NO: 46194 - RNA, 41 nt, Mus musculus
guaugcacccaucuuggcucaccuuuugagaggaagaagca

SEQ ID NO: 46195 - RNA, 41 nt, Mus musculus
gccacgcuuccaucccacgccuccuucaguccccggcccag

SEQ ID NO: 46196 - RNA, 46 nt, Mus musculus
acauaaacuggguuuucaguucuuacaugacuugucugucacagaa

SEQ ID NO: 46197 - RNA, 30 nt, Mus musculus
acucaguacaugaccaacagagcagaacac

SEQ ID NO: 46198 - RNA, 46 nt, Mus musculus
ccagauguuacuaguagcacauaucuggaaacagaagcaggcagag

SEQ ID NO: 46199 - RNA, 34 nt, Mus musculus
agcccuguccccaggucucacccuggccugggug

SEQ ID NO: 46200 - RNA, 71 nt, Mus musculus
ggaguuuaaaacucugccaaguacuuuaguuagggcaaaaauucuuguuauuuaccagaaaugaugcagca

SEQ ID NO: 46201 - RNA, 45 nt, Mus musculus
acaucauugacauucgccucucucacucacuaauuuuuauaaggu

SEQ ID NO: 46202 - RNA, 42 nt, Mus musculus
uuugggccuaagaaacaggagugagugugucuuaccucagau

SEQ ID NO: 46203 - RNA, 45 nt, Mus musculus
ugguccucucaguggaauguccagagcagcuuacauguuccagag

SEQ ID NO: 46204 - RNA, 45 nt, Mus musculus
ggcugcaggcuuaagacuaucuagauaccucauuagcauggaaaa

SEQ ID NO: 46205 - RNA, 45 nt, Mus musculus
gucucuuaagccugcaguccaaaacuggcugucauguguccucuu

SEQ ID NO: 46206 - RNA, 46 nt, Mus musculus
acagcaccucucuccucauccauauuaaugaccuugguauugaguc

SEQ ID NO: 46207 - RNA, 46 nt, Mus musculus
ugagugcucuaauuuuaucacuuuagcagugucuugccugguaguc

SEQ ID NO: 46208 - RNA, 45 nt, Mus musculus
gaaauuuuuuuucauuuaccuuucuuuauacaaagguuugucagu

SEQ ID NO: 46209 - RNA, 42 nt, Mus musculus
ugugucaccaugucuggcuuuuauucagagggagaggagagg

SEQ ID NO: 46210 - RNA, 42 nt, Mus musculus
gcaacucuuauaaaggaaaacauuuuguuuaggcuggcuuac

SEQ ID NO: 46211 - RNA, 47 nt, Mus musculus
gugugagguccuaaguucaaugcuuaccaccaccaccaccaccacca

SEQ ID NO: 46212 - RNA, 46 nt, Mus musculus
uauaauagcauuuuccuuugugcuuggaaucuuugucaaccaugcu

SEQ ID NO: 46213 - RNA, 45 nt, Mus musculus
agucugaguaugguacauuugcuuacugccauuuuaccuaaagaa

SEQ ID NO: 46214 - RNA, 41 nt, Mus musculus
uccuaccaggcauccagacuaaggugucuagauagaggggu

SEQ ID NO: 46215 - RNA, 45 nt, Mus musculus
gggguguguucuaaauacacuuaagcagcauacucggaugaaaag

SEQ ID NO: 46216 - RNA, 46 nt, Mus musculus
aauauaguaaggacuuuaagaguuugugccuguuuaaaugauagau

SEQ ID NO: 46217 - RNA, 42 nt, Mus musculus
cacuugagauucccagaugauucuagguugucagccccacag

SEQ ID NO: 46218 - RNA, 41 nt, Mus musculus
ugaaacaauuugacagagacaagaacagcuugaggcugagu

SEQ ID NO: 46219 - RNA, 45 nt, Mus musculus
acaugguggguggaccuuuggcugcagaauacaaaacaaggggga

SEQ ID NO: 46220 - RNA, 46 nt, Mus musculus
ugcugugcuggaccacuuagucaucugggaagauuacaagagaugg

SEQ ID NO: 46221 - RNA, 45 nt, Mus musculus
agguaucuuuauuuuucaaaaguguauauauuaagcugcacuuua

SEQ ID NO: 46222 - RNA, 45 nt, Mus musculus
gacucacuucaggauaaugacuuuacuauucauucacgggugaga

SEQ ID NO: 46223 - RNA, 41 nt, Mus musculus
uccuccaaccagcagaccgagaaagaaggcagcacccccaa

SEQ ID NO: 46224 - RNA, 42 nt, Mus musculus
gcuguugcugcacuuccgcuucucucccagugagagcgagac

SEQ ID NO: 46225 - RNA, 45 nt, Mus musculus
acucagcagcagcuugaagaccugcuacaaguaucucaaucagac

SEQ ID NO: 46226 - RNA, 46 nt, Mus musculus
augcucaugucauccuccacuguauccagggcucggagaaccaggu

SEQ ID NO: 46227 - RNA, 45 nt, Mus musculus
cacuguuugauauuucucagccaaauuucuaaacuccagggagau

SEQ ID NO: 46228 - RNA, 46 nt, Mus musculus
gaggacuuccccacgaucucccuggaguuuagaaauuuggcugaga

SEQ ID NO: 46229 - RNA, 45 nt, Mus musculus
ggaugugaccuccaaacaggacugggacaaguacugccacuacuu

SEQ ID NO: 46230 - RNA, 52 nt, Mus musculus
ggucuguuccugcagaaaacaaauaucauucgugauuaucuggaagaucaac

SEQ ID NO: 46231 - RNA, 45 nt, Mus musculus
uuaaguuggaagacuuugcuaagccagagaacguagauguggccc

SEQ ID NO: 46232 - RNA, 46 nt, Mus musculus
gguaauggccauugccacacuggcugccuguuacaauaaccagcag

SEQ ID NO: 46233 - RNA, 31 nt, Mus musculus
gccaucaaagcuaucauauaccaguacauag

SEQ ID NO: 46234 - RNA, 33 nt, Mus musculus
ugguuuugcuugaugaugggucugaguugggga

SEQ ID NO: 46235 - RNA, 58 nt, Mus musculus
ugauaaaugacagguaaaugggggaguaguggcuucaggagaugagcuggcaguuggg

SEQ ID NO: 46236 - RNA, 94 nt, Mus musculus
uggcugcccugagcuggcaguaccugagcacccugucccaggucacagaagacuauguccagagagaacacugauuuuguuuagccggaagugg

SEQ ID NO: 46237 - RNA, 48 nt, Mus musculus
uuuugacuucccuuguuuuuccuccuacucuaaaaucuuugggagaac

SEQ ID NO: 46238 - RNA, 96 nt, Mus musculus
ccacaugugauggucacaagagccuagugaaccuggcuagaaugcugauuggauuuauuuaauuugaaacagccuuugaauaccuaugacaauaga

SEQ ID NO: 46239 - RNA, 45 nt, Mus musculus
gagucuggcgggcaguguggcccgcagagacuugcggaguggagg

SEQ ID NO: 46240 - RNA, 72 nt, Mus musculus
uacggggagucguggggagaccagcugcugccggagggcgacgacgaaagcucagcagcugugaagcuggca

SEQ ID NO: 46241 - RNA, 84 nt, Mus musculus
auaccccugcguuucuacgaugcccaguucagcagccucuacguaaguucagcucccggaggugcgcgguugggugugggacuc

SEQ ID NO: 46242 - RNA, 50 nt, Mus musculus
uucaagggcgagcuggaaccgugccccucuacuuugacauucuaggcagg

SEQ ID NO: 46243 - RNA, 42 nt, Mus musculus
ggaccgguucgagagcagccgcaccugugggucgcagugcac

SEQ ID NO: 46244 - RNA, 80 nt, Mus musculus
gcaucaucuccacccaggacuuccccagggagacucaauauguagaugaugauuuuccuacugacuucccagccaucgcc

SEQ ID NO: 46245 - RNA, 75 nt, Mus musculus
ccuuuccuggcugacaucgacacuagucacagcaggggccggauccuguaccgcgaggacaccuccggagcugug

SEQ ID NO: 46246 - RNA, 42 nt, Mus musculus
gugcgcacguagcgggcagccaggcucagcacagcuccggag

SEQ ID NO: 46247 - RNA, 46 nt, Mus musculus
agcacgugggcgccuacgaggaggucagucgcggggcugcgccguc

SEQ ID NO: 46248 - RNA, 46 nt, Mus musculus
agauaccaagaaccaccuauaaguacacaaauauuucuaaugauag

SEQ ID NO: 46249 - RNA, 45 nt, Mus musculus
gggccuaccauauugccauaacaaaacguaaaugaggccuuucag

SEQ ID NO: 46250 - RNA, 45 nt, Mus musculus
uccccagccugcgcacugucauucuggugacauuaguuaguaagg

SEQ ID NO: 46251 - RNA, 45 nt, Mus musculus
cuggcaaugacaccgugacuguuuuuguucagugcauaucuagag

SEQ ID NO: 46252 - RNA, 46 nt, Mus musculus
gggacuugaacauagguccucaugaagucucucaugacugagcaac

SEQ ID NO: 46253 - RNA, 42 nt, Mus musculus
acugacuuuacagggucgucauaagaauuaccauggugccgu

SEQ ID NO: 46254 - RNA, 46 nt, Mus musculus
ugaaucacuuuuuuaucuuuguuuaucuuuucuuuuuguuggggaa

SEQ ID NO: 46255 - RNA, 62 nt, Mus musculus
acugaguuaugcaguacguugaugaggaauuucauuuggguuggaaggaccacaggaauggg

SEQ ID NO: 46256 - RNA, 45 nt, Mus musculus
acaugggaugauggguguugaguuggugcaaagauggcggguguu

SEQ ID NO: 46257 - RNA, 46 nt, Mus musculus
cuacaguccacauacaggguguguggauaauuaaccacauggcagu

SEQ ID NO: 46258 - RNA, 41 nt, Mus musculus
uagagaaauuccauaugauaagggcugucugcaugcggaga

SEQ ID NO: 46259 - RNA, 46 nt, Mus musculus
ggacuggaauuuuaggagagugacugcgacaagcaugguggcagag

SEQ ID NO: 46260 - RNA, 59 nt, Mus musculus
ccaggcuguucuggcauccgaugaaucugauaccuacgcccucuuucucuacccugcca

SEQ ID NO: 46261 - RNA, 53 nt, Mus musculus
ggaagcggacgaccugaagagagaagcacuguauuucagccugacuaacaccg

SEQ ID NO: 46262 - RNA, 46 nt, Mus musculus
acccacuggaaugacauuuaggagggacaugaucucaagugaccag

SEQ ID NO: 46263 - RNA, 41 nt, Mus musculus
gaaacccuuacccguuugcaugcauuugugcuuaucaacua

SEQ ID NO: 46264 - RNA, 46 nt, Mus musculus
ucauuuccuccuucgaugcuuucuagaaauuucagauuugccagag

SEQ ID NO: 46265 - RNA, 46 nt, Mus musculus
cuaguagagaaacacaacugcuucuccucacaaacuuuuugcacag

SEQ ID NO: 46266 - RNA, 42 nt, Mus musculus
cacagaaaauuagaaugagaauuggcaucugcauggccauag

SEQ ID NO: 46267 - RNA, 46 nt, Mus musculus
agcccuccuuccaagggcucuaugcacagcauucuuuccuguuccg

SEQ ID NO: 46268 - RNA, 45 nt, Mus musculus
cucacaagagccaugcaaacaugaauaauggaugacccuuguuug

SEQ ID NO: 46269 - RNA, 46 nt, Mus musculus
uaagcaaccuggggauuccuggagugugggcuuuucacaucggcag

SEQ ID NO: 46270 - RNA, 84 nt, Mus musculus
ccguuccucagcacuggagcaccccuucagccaugcugcagcccuggagagcuacaccgaggacaguuuccauuacuacgauga

SEQ ID NO: 46271 - RNA, 46 nt, Mus musculus
auggccaguuaccaggugcuggauauggccaaggagaagcgcgguc

SEQ ID NO: 46272 - RNA, 41 nt, Mus musculus
gaaauccagaaccucucccucucccaccggccgccccuguu

SEQ ID NO: 46273 - RNA, 45 nt, Mus musculus
ggaccagauggguaccagagccccagcuccuccagaggcagaugc

SEQ ID NO: 46274 - RNA, 46 nt, Mus musculus
auaggacuggguguuucugcccccaaggucuucguugacuggaguu

SEQ ID NO: 46275 - RNA, 44 nt, Mus musculus
acccaguccuauccagaggcagggccagugccuucagagccaga

SEQ ID NO: 46276 - RNA, 41 nt, Mus musculus
cagacuggggcaggcugggcagacuggggcaggcuggggca

SEQ ID NO: 46277 - RNA, 46 nt, Mus musculus
gcugugguuuucuucugagugaauaggugaaaaguuuagcaagcag

SEQ ID NO: 46278 - RNA, 42 nt, Mus musculus
gugcagacuuaggcaaacaugcuaaagagucugcaggggaag

SEQ ID NO: 46279 - RNA, 29 nt, Mus musculus
aaauggguuggaggauggguagagaguga

SEQ ID NO: 46280 - RNA, 46 nt, Mus musculus
uaaaggcaugaaucaaagguuuucucaaugagauuuugugguacag

SEQ ID NO: 46281 - RNA, 46 nt, Mus musculus
guugucaagccaagaaauuaccuaagccccggcaugcuucucugag

SEQ ID NO: 46282 - RNA, 41 nt, Mus musculus
gaugcuucaagucggucuuggggaccugaaucuaaggcauu

SEQ ID NO: 46283 - RNA, 45 nt, Mus musculus
agaagagguuuuuuaaaaaaacauugaauggggaaaaaaagugag

SEQ ID NO: 46284 - RNA, 42 nt, Mus musculus
uuuuaacggacauagcugaaaaugacuccccuguccaccaag

SEQ ID NO: 46285 - RNA, 46 nt, Mus musculus
gguuuaggaauggugugugugugugugugugugugagagagagaga

SEQ ID NO: 46286 - RNA, 40 nt, Mus musculus
gagcuaacauuuaagcaggcugaaauacaccaucggcuuu

SEQ ID NO: 46287 - RNA, 45 nt, Mus musculus
acagccuaguccacagaaucuccacaaaaccacccugcaccagag

SEQ ID NO: 46288 - RNA, 42 nt, Mus musculus
ucagucuucacguauaauggcgccaaccuggaaaccugcgaa

SEQ ID NO: 46289 - RNA, 46 nt, Mus musculus
cccucuuucuagcuugguagagcuaaaggggagggugaagaagggg

SEQ ID NO: 46290 - RNA, 56 nt, Mus musculus
ggcuucuccaaagcaaagagccagccaaacagaccuccaaugggcaggacagggag

SEQ ID NO: 46291 - RNA, 46 nt, Mus musculus
gcuuucugcucuuacagaaagaaacauaaugguuuaaugacuggua

SEQ ID NO: 46292 - RNA, 46 nt, Mus musculus
guaucaaguuaguguaauuuuggaauggacucuguuaauaugcuag

SEQ ID NO: 46293 - RNA, 103 nt, Mus musculus
cacucaaacugccgaggggcuugacccagaaaacuaucugagcauuaagaccaacauugaaggccaggugcccuucaucccagcgaauuucacagcccacauu

SEQ ID NO: 46294 - RNA, 46 nt, Mus musculus
gaguaaugugggcugugaaauucgcugggaugaagggcaccuggcc

SEQ ID NO: 46295 - RNA, 42 nt, Mus musculus
uaacuguuucagcugaugauuuugguuugcuuuaggggucac

SEQ ID NO: 46296 - RNA, 44 nt, Mus musculus
acagugaggaugagggcgugcugagguuugcugugaccaaucag

SEQ ID NO: 46297 - RNA, 45 nt, Mus musculus
cucggaaacacuggagaagggagaacuguagaguugguaaaaaag

SEQ ID NO: 46298 - RNA, 42 nt, Mus musculus
agauaaaaacaccugugucacacaaaccaccucuccaugcac

SEQ ID NO: 46299 - RNA, 56 nt, Mus musculus
auacugugagguucccaugugaucugggucuauacugugagguucccaugugaucu

SEQ ID NO: 46300 - RNA, 133 nt, Mus musculus
caguauagacccagaucacaugggaaccucacaguauagacccagaucacaugggaaccucacaguauagacccagaucacaugggaaccucacaguauagacccagaucacaugggaaccucacaguauaga

SEQ ID NO: 46301 - RNA, 59 nt, Mus musculus
cugugagguucccaugugaucugggucuauacugugagguucccaugugaucugggucu

SEQ ID NO: 46302 - RNA, 46 nt, Mus musculus
ccccacucuaucccauuuagcucccaaguacacacaaacacuucag

SEQ ID NO: 46303 - RNA, 42 nt, Mus musculus
uccucauggucccuacucgagaucuccucacucagacccaag

SEQ ID NO: 46304 - RNA, 32 nt, Mus musculus
agagagaggaaggcagaacuugggucugagug

SEQ ID NO: 46305 - RNA, 42 nt, Mus musculus
gugcgcuguguauucagaugcugaguucugugcuccagaguu

SEQ ID NO: 46306 - RNA, 41 nt, Mus musculus
caacacuggcuuugcaagaugcagauagugcaauaccccaa

SEQ ID NO: 46307 - RNA, 42 nt, Mus musculus
ugaaauggcuuaagaagggcaugaccgaccuuggcuuacagu

SEQ ID NO: 46308 - RNA, 45 nt, Mus musculus
ggacgggucucagcuguagaagguggcugaggagucaugggugag

SEQ ID NO: 46309 - RNA, 45 nt, Mus musculus
caaauccaggagauacaaacaaugcccauuggauucugcacugaa

SEQ ID NO: 46310 - RNA, 44 nt, Mus musculus
uaugacuuguaugacucuccagaagugauuuagagauggauuca

SEQ ID NO: 46311 - RNA, 46 nt, Mus musculus
gugggaagcuacaggugugaaugccgcaguggcuaugaauuugcag

SEQ ID NO: 46312 - RNA, 46 nt, Mus musculus
gccagacuggugaacacccaugguugucuuggaguguugccaucag

SEQ ID NO: 46313 - RNA, 45 nt, Mus musculus
aggagggcccaagucuacuggggcuauaugccugggcaguagaag

SEQ ID NO: 46314 - RNA, 45 nt, Mus musculus
gcuuugcaucucuucaggagcacaaacaccaugggauuugcagag

SEQ ID NO: 46315 - RNA, 46 nt, Mus musculus
ucauuuuuauagcuuuggcuccuuggucaguuuagagccccucuag

SEQ ID NO: 46316 - RNA, 45 nt, Mus musculus
uuguggguaugacacaugcuuuguuuugguuuuggucaagcugag

SEQ ID NO: 46317 - RNA, 24 nt, Mus musculus
gcuucagagaguuucuuggggguu

SEQ ID NO: 46318 - RNA, 24 nt, Mus musculus
aaaacaaaacagaaagcguguacu

SEQ ID NO: 46319 - RNA, 37 nt, Mus musculus
cagagguccuaaaaauucaauuccuaacaaccacaug

SEQ ID NO: 46320 - RNA, 46 nt, Mus musculus
auuuuaaagauuucuuuauuuauuuuauguaugugaguacaaugaa

SEQ ID NO: 46321 - RNA, 57 nt, Mus musculus
cuucaacauucguaacucaguauuuguaagauucauguauauaaaaguuaggggcau

SEQ ID NO: 46322 - RNA, 48 nt, Mus musculus
cugguaauggauugcuccacacugauuuugggacacacacacacacac

SEQ ID NO: 46323 - RNA, 46 nt, Mus musculus
uggccccgccugccaucucugacuagucucauuugcauaaccaggc

SEQ ID NO: 46324 - RNA, 46 nt, Mus musculus
aauaagcaagcccaugauuggauaacuuagcuuauagcaguggggg

SEQ ID NO: 46325 - RNA, 27 nt, Mus musculus
uacguaggcuuugaggugcagcgauga

SEQ ID NO: 46326 - RNA, 45 nt, Mus musculus
cgagggcgguuggggguguggaguccuagagaaaacaggauggua

SEQ ID NO: 46327 - RNA, 41 nt, Mus musculus
auguggcugggccucugugccagguccuccuggccuuggga

SEQ ID NO: 46328 - RNA, 41 nt, Mus musculus
gagggaaaggaaggcuaggagaucaggaguugggaccugga

SEQ ID NO: 46329 - RNA, 45 nt, Mus musculus
gauuucuucucugaaguggggaccagagagacggauagcuaccau

SEQ ID NO: 46330 - RNA, 46 nt, Mus musculus
acagaucuggugaauccacgagccaucacuguggauccaauccgag

SEQ ID NO: 46331 - RNA, 46 nt, Mus musculus
caucaucuuuagauggcgaaaacagaaggauucugaucaacaaaga

SEQ ID NO: 46332 - RNA, 42 nt, Mus musculus
aauucuuaucuuuaaugaccccccuuggaaagacacugccag

SEQ ID NO: 46333 - RNA, 46 nt, Mus musculus
aaaacuagaguucugcuguaccagguggagaggaaucguaggccag

SEQ ID NO: 46334 - RNA, 46 nt, Mus musculus
auccaaaaccaccucaauuaccccuucagcaucgucagcuaugcag

SEQ ID NO: 46335 - RNA, 42 nt, Mus musculus
uagaagugaucugcauagcugacgaugcugaagggguaauug

SEQ ID NO: 46336 - RNA, 48 nt, Mus musculus
guaaacaguuauuuaaaaggccaaauucauucaacauagaaccaauga

SEQ ID NO: 46337 - RNA, 49 nt, Mus musculus
uugccauggauucuaccuggccaagaaaaguaaagcaaacagauggcua

SEQ ID NO: 46338 - RNA, 45 nt, Mus musculus
guaucccucaaaaguacuccggguaaaacaccaaagaugcagcag

SEQ ID NO: 46339 - RNA, 31 nt, Mus musculus
uuaccgccugugucaaagccaagaauauguu

SEQ ID NO: 46340 - RNA, 46 nt, Mus musculus
ucaggaauggcuacaaagaauaguaauaugaaguuauaaacugcag

SEQ ID NO: 46341 - RNA, 42 nt, Mus musculus
ggcuuaacccuuuagcagcagagccagcucccuaggccccag

SEQ ID NO: 46342 - RNA, 46 nt, Mus musculus
acaguggguggaacuguuugggaaggauuaggagguguggccuugc

SEQ ID NO: 46343 - RNA, 46 nt, Mus musculus
cuggcaugcuagagauacacugugagguucuuugguuuacugagug

SEQ ID NO: 46344 - RNA, 47 nt, Mus musculus
cuagauacaauucucagucagaggaauuuccauauaugcccccaugu

SEQ ID NO: 46345 - RNA, 25 nt, Mus musculus
cauaaggaagaaaccauguugaaaa

SEQ ID NO: 46346 - RNA, 45 nt, Mus musculus
ggcuuugccagacccagaaacugcuuuucuggguaaacugcuuuu

SEQ ID NO: 46347 - RNA, 41 nt, Mus musculus
gguggcaguaauuaaggcugcacuuuauucacaccuugggu

SEQ ID NO: 46348 - RNA, 43 nt, Mus musculus
uucaggguuggggguaggguaugcuagguagggacugagagau

SEQ ID NO: 46349 - RNA, 47 nt, Mus musculus
gggagacagaggggagggagaagagaaagagagaaggaaaaggaaga

SEQ ID NO: 46350 - RNA, 44 nt, Mus musculus
cccgcaaacgggccagucugguagcccagccuuccacguccagu

SEQ ID NO: 46351 - RNA, 46 nt, Mus musculus
gguaggacgcauccugccuuucugacacgggaaacuucccagagau

SEQ ID NO: 46352 - RNA, 45 nt, Mus musculus
ccguuuugauaaagcaucauuuauggcuuggauuuaagcuugaga

SEQ ID NO: 46353 - RNA, 29 nt, Mus musculus
accugugcuaucuguagggccaggccaca

SEQ ID NO: 46354 - RNA, 45 nt, Mus musculus
ucucuguguguauauaugaguaugugugucugucucugugugugu

SEQ ID NO: 46355 - RNA, 46 nt, Mus musculus
uggggagacccaucaagagauggcccugauuucauguagugcagau

SEQ ID NO: 46356 - RNA, 42 nt, Mus musculus
gaaaaaggaggauaagaagaggagaaggaggagucgggaaga

SEQ ID NO: 46357 - RNA, 45 nt, Mus musculus
gaaugugcguuugcaugugugugugugugugugugugugugugug

SEQ ID NO: 46358 - RNA, 46 nt, Mus musculus
gagggggucaccacagcaugaggaacuguauuaaagggucauagca

SEQ ID NO: 46359 - RNA, 54 nt, Mus musculus
aaagcagagcuaagaaguuugagggagacauucagagaaaggagagugggugag

SEQ ID NO: 46360 - RNA, 45 nt, Mus musculus
uucugcuuuagauuuuaagcucccaggaugggacagugguggaug

SEQ ID NO: 46361 - RNA, 41 nt, Mus musculus
gaaggagaaggagaaggagaaggagaaggagaagguagcag

SEQ ID NO: 46362 - RNA, 42 nt, Mus musculus
ggagaaggagaaggagcaggaggagcaggaggagcaggagga

SEQ ID NO: 46363 - RNA, 41 nt, Mus musculus
aggaggaggaggaagaggaggaggaggaagagggggagaag

SEQ ID NO: 46364 - RNA, 42 nt, Mus musculus
ccagaacagucccuuauaagagagaguccccagccccaagug

SEQ ID NO: 46365 - RNA, 46 nt, Mus musculus
aucucucacucaguacuuagcugagaugugucuauuugcaguagau

SEQ ID NO: 46366 - RNA, 46 nt, Mus musculus
aaaaaaacuaugcagcuacuuuuggaucagauuuaaggcccacucc

SEQ ID NO: 46367 - RNA, 48 nt, Mus musculus
ucagucaguuagucugucugucugugucugagugcgagguggagguag

SEQ ID NO: 46368 - RNA, 46 nt, Mus musculus
ggaaagcauuuaauuggggcuugcuuacaguuucagagguuuaguc

SEQ ID NO: 46369 - RNA, 45 nt, Mus musculus
ugaugaaucagagaaagauuugacagacuaggauaugcccaacuc

SEQ ID NO: 46370 - RNA, 47 nt, Mus musculus
cuucaagguggauagcaucacaugagaaggagguggagagagagaga

SEQ ID NO: 46371 - RNA, 41 nt, Mus musculus
uauaauaggaagaccugaugcuucuguccucugggggaaga

SEQ ID NO: 46372 - RNA, 31 nt, Mus musculus
acugcccucuggcaguuaugaaucugauagg

SEQ ID NO: 46373 - RNA, 45 nt, Mus musculus
ucuuccuaccccuaauucuucccagaucuauuccacacccccacc

SEQ ID NO: 46374 - RNA, 46 nt, Mus musculus
aaacgaaacaaaacaagaaauauuauuuuauuaauucuuugggaau

SEQ ID NO: 46375 - RNA, 46 nt, Mus musculus
auuuuaacauuuuuuuacaauaaaacacaugaacaagcccacuugg

SEQ ID NO: 46376 - RNA, 42 nt, Mus musculus
auuaucaaagcgguuguagaggccacagcagccucggugggg

SEQ ID NO: 46377 - RNA, 45 nt, Mus musculus
ccuauccaaaaaggaggagaccuacaaugaccucaucaaacagau

SEQ ID NO: 46378 - RNA, 46 nt, Mus musculus
aacuggaaggugagcauguuuguggaaguacacaaagccauuaaaa

SEQ ID NO: 46379 - RNA, 46 nt, Mus musculus
uaguuuugccuggauguauaucugugugccacaugugugccuagug

SEQ ID NO: 46380 - RNA, 44 nt, Mus musculus
auucaacaguugccucaaagagccccccuggggggagggaggga

SEQ ID NO: 46381 - RNA, 44 nt, Mus musculus
uaauucuagaagggagaagcagcucuggagcuguggggugaagg

SEQ ID NO: 46382 - RNA, 46 nt, Mus musculus
uauccuggugguuaaaugaggacacuugagauguguggcugcugcu

SEQ ID NO: 46383 - RNA, 25 nt, Mus musculus
aaguuccagaccagccacaaccaua

SEQ ID NO: 46384 - RNA, 42 nt, Mus musculus
uugucaucgccgcaguggacugucugugacuaggggugagug

SEQ ID NO: 46385 - RNA, 46 nt, Mus musculus
auaugugccugaguuucuuccugccacgacaccuaacuauggagac

SEQ ID NO: 46386 - RNA, 42 nt, Mus musculus
cuuaguugaauggcagacacacuauuagggauggcccagaac

SEQ ID NO: 46387 - RNA, 41 nt, Mus musculus
acuuuuguugacugugaagcuugaaacaguagggggguggg

SEQ ID NO: 46388 - RNA, 45 nt, Mus musculus
uaaaacccugccgcucccuuuuggcacagaugugcucccgggagu

SEQ ID NO: 46389 - RNA, 46 nt, Mus musculus
uugaagggucuugugcuguagagagagaggacuggugucugcugua

SEQ ID NO: 46390 - RNA, 46 nt, Mus musculus
uauuuuauguguaugauguuuugccugcauguaugucuguguaccu

SEQ ID NO: 46391 - RNA, 60 nt, Mus musculus
ugguggggugggaauggggaggugaucuguugaucuuuagaucuuaggauucuuucugcu

SEQ ID NO: 46392 - RNA, 46 nt, Mus musculus
gaggaccccucucuuucccggcaacaaaacuuaaaaacuguaaggc

SEQ ID NO: 46393 - RNA, 48 nt, Mus musculus
acuccccaaggauuuuguccagcauugggcucagcuccccgagaaucu

SEQ ID NO: 46394 - RNA, 45 nt, Mus musculus
gggggcggggcuucccugcugaugagcguugguggaagaaaggua

SEQ ID NO: 46395 - RNA, 41 nt, Mus musculus
cuugugugauaagacccaguucucaagauguucagugcgga

SEQ ID NO: 46396 - RNA, 41 nt, Mus musculus
uguauaagaguuuggagcuacaagcuagagaagcccgagga

SEQ ID NO: 46397 - RNA, 45 nt, Mus musculus
gcaugggccagggggagacuguuacuaagaauguccuuggccagg

SEQ ID NO: 46398 - RNA, 46 nt, Mus musculus
gggacuggcccauuuucuguaucucuagaacuaugggcugggacuu

SEQ ID NO: 46399 - RNA, 46 nt, Mus musculus
aaucagacucugaagaaacaaaacaaacaaacaaacaaccccagcc

SEQ ID NO: 46400 - RNA, 45 nt, Mus musculus
gugacagaugguggaggccagaggggaggacacgguugcagggcc

SEQ ID NO: 46401 - RNA, 42 nt, Mus musculus
aauuuagcaccauggugcuugaggugcagccacaggccagag

SEQ ID NO: 46402 - RNA, 46 nt, Mus musculus
gcuggccgcggauauuuuuuuaguuauaaaaaacaaauauggaguc

SEQ ID NO: 46403 - RNA, 44 nt, Mus musculus
cucccgagugcugggauuaaaggcgugcccggcuaaggcagggu

SEQ ID NO: 46404 - RNA, 42 nt, Mus musculus
gucucagccucuguauucggugaguuuguguuuagugguagg

SEQ ID NO: 46405 - RNA, 46 nt, Mus musculus
gguggcacacgccuuuaaucccaguccuugggaggcagaggcaggc

SEQ ID NO: 46406 - RNA, 45 nt, Mus musculus
ucucaggaggucaggucagaguggagaauagagaauagugggggg

SEQ ID NO: 46407 - RNA, 73 nt, Mus musculus
uuggggguuccccuacagcaauauccaccuuugccagcccaccgcaggagacuugcugucucuaagugaccug

SEQ ID NO: 46408 - RNA, 48 nt, Mus musculus
uuauuucaggugcuuuauggugaccucaugcuuuaagauaaggcaacu

SEQ ID NO: 46409 - RNA, 45 nt, Mus musculus
ugcaaaaugagcaguuugguagggcucccgguaagaggguaugaa

SEQ ID NO: 46410 - RNA, 85 nt, Mus musculus
cugaggaggaagaagguggucaguuugugauagcccugacaggaucucuggaggagaguuuugugugugugugugugugugugug

SEQ ID NO: 46411 - RNA, 24 nt, Mus musculus
cacuugucucaugccucucacuuu

SEQ ID NO: 46412 - RNA, 25 nt, Mus musculus
gcgaggauagugugggugaggggau

SEQ ID NO: 46413 - RNA, 42 nt, Mus musculus
caucuacucaaggaguuuccgugccugagucaggagggacug

SEQ ID NO: 46414 - RNA, 42 nt, Mus musculus
ggguccuuuacucaccucggccaucauauucuaccuggccau

SEQ ID NO: 46415 - RNA, 52 nt, Mus musculus
cuccaaauucaaacagcuguguccagggcugcaggacgagugaacccggagc

SEQ ID NO: 46416 - RNA, 79 nt, Mus musculus
gauccacgcaguuccccgcguucagggagccaacuuggccaagcaacugucccgggagcggcgcgcggggguaccgggc

SEQ ID NO: 46417 - RNA, 42 nt, Mus musculus
acccuacccuucaggaucgagagauugggguggccccaaccc

SEQ ID NO: 46418 - RNA, 46 nt, Mus musculus
acgguuacauccacguuuguggaugaggagagggugaggaggcuag

SEQ ID NO: 46419 - RNA, 44 nt, Mus musculus
gccaagaacaucccagacacacagaaaacaaugagucagccaca

SEQ ID NO: 46420 - RNA, 42 nt, Mus musculus
caccccaucccuuuccacuaccaacccacucacagcccagca

SEQ ID NO: 46421 - RNA, 46 nt, Mus musculus
aggcaucucacuuuuccacugccuagagugauucagagcaggacag

SEQ ID NO: 46422 - RNA, 51 nt, Mus musculus
aggauuagagguaaguggguuuugaguuacaagguuggggguagagaagag

SEQ ID NO: 46423 - RNA, 46 nt, Mus musculus
gaaccccaaaauaaacacagaagagaaaauaaaauuagcaggcauc

SEQ ID NO: 46424 - RNA, 46 nt, Mus musculus
cuacaucugggcaugugcccuaccuauccucaaaagcaguguuuag

SEQ ID NO: 46425 - RNA, 45 nt, Mus musculus
aauaaaucuuuaaaacuaaaauccaacgaggaguauagcagaaug

SEQ ID NO: 46426 - RNA, 46 nt, Mus musculus
cggggauuacagacccucaguuguauccaacuuuuacacggaugag

SEQ ID NO: 46427 - RNA, 46 nt, Mus musculus
gggaacauggugugcauguauaagaaggacagacagacagacagac

SEQ ID NO: 46428 - RNA, 44 nt, Mus musculus
uuaaccucaaaggcuagugagagucucaaaacuggggugggagu

SEQ ID NO: 46429 - RNA, 42 nt, Mus musculus
cuccuucaccuacccacuggguuuccagcccuggcccauccc

SEQ ID NO: 46430 - RNA, 45 nt, Mus musculus
agccagcauucuuacagugaaguguguguaguaggggugggggca

SEQ ID NO: 46431 - RNA, 45 nt, Mus musculus
agggcacaguacccacaguccacagguccucaucacugccuccuc

SEQ ID NO: 46432 - RNA, 29 nt, Mus musculus
uccuucaaggggaguccagcuugggggag

SEQ ID NO: 46433 - RNA, 45 nt, Mus musculus
guuuccaauauuucaccuuuucucuuaauuuuuuaaaugguggcg

SEQ ID NO: 46434 - RNA, 42 nt, Mus musculus
cauuuuguuauuguucuaugagugugaugccugugccugcag

SEQ ID NO: 46435 - RNA, 46 nt, Mus musculus
auuaggcuaaugccacugagccauaauaaaugucaguagucaggag

SEQ ID NO: 46436 - RNA, 45 nt, Mus musculus
uauuguuaagugccgugcauggccuacuuagggaccuuagaggag

SEQ ID NO: 46437 - RNA, 45 nt, Mus musculus
ugaagaccaggggugguuuugcacaucuaaaaccccagcacucag

SEQ ID NO: 46438 - RNA, 42 nt, Mus musculus
ggagacaaugaacaaauggugcaaugacaugcagagggacag

SEQ ID NO: 46439 - RNA, 47 nt, Mus musculus
acauacacauaugcauacauacacaauacauaaaacuacaggagaau

SEQ ID NO: 46440 - RNA, 46 nt, Mus musculus
gacugcuggguguguaugugugugugugugagagagagagagagag

SEQ ID NO: 46441 - RNA, 45 nt, Mus musculus
gaaccuaugucauuucccgaaaccuagaugagucucuugggcaag

SEQ ID NO: 46442 - RNA, 46 nt, Mus musculus
gggguuauauucugcccuggcagguuucugugacauagguaaggag

SEQ ID NO: 46443 - RNA, 42 nt, Mus musculus
acgguaaaauauuuaaguuuaaauuuccaggaaaaugugcag

SEQ ID NO: 46444 - RNA, 42 nt, Mus musculus
ugcgugcgugcgugcgugcgugcgugugugugugcguguguc

SEQ ID NO: 46445 - RNA, 45 nt, Mus musculus
uagcugagacucaagccccagacucgggaagagauccugccucag

SEQ ID NO: 46446 - RNA, 46 nt, Mus musculus
ugugaguguguguuuguguguguaucugugucuguaugugugugug

SEQ ID NO: 46447 - RNA, 36 nt, Mus musculus
gagcagcagcugagcgcacacacacagggccugcag

SEQ ID NO: 46448 - RNA, 46 nt, Mus musculus
gggguuuucuucuuugagacagagucucacugugaaacauuggcug

SEQ ID NO: 46449 - RNA, 42 nt, Mus musculus
aacucaaaauuccaccugccucugccucccgagugcugggau

SEQ ID NO: 46450 - RNA, 46 nt, Mus musculus
gucagucgggacauuccagagaaccuuucuuuugaaaggugugugu

SEQ ID NO: 46451 - RNA, 39 nt, Mus musculus
ucugcugugucagcuucacaugaagcaaccuugucucaa

SEQ ID NO: 46452 - RNA, 46 nt, Mus musculus
uugaccacauuuuguucuuggagguaucagagaaguguguccugag

SEQ ID NO: 46453 - RNA, 44 nt, Mus musculus
guaggucaaaaugguagcccaggaaguuaaagcauaagccagaa

SEQ ID NO: 46454 - RNA, 45 nt, Mus musculus
uucuuauaaaccaucccccaccaucaaagccuccggcuugugugc

SEQ ID NO: 46455 - RNA, 45 nt, Mus musculus
ucugaagggguaaucgaggaguaccuagcuuuugaccacacggau

SEQ ID NO: 46456 - RNA, 45 nt, Mus musculus
uuaaaauauacaucaauaagaaaagaacuaaggauuaaucaggaa

SEQ ID NO: 46457 - RNA, 46 nt, Mus musculus
gggaagagggauuucauggaaacaaaucagaagcagcuacagagaa

SEQ ID NO: 46458 - RNA, 46 nt, Mus musculus
uagaagucacgggaacccuuucuuagguuugaucaauuugcuggag

SEQ ID NO: 46459 - RNA, 46 nt, Mus musculus
uauggaugaacagccaaacaagaggugcaaaggacaguaagggaga

SEQ ID NO: 46460 - RNA, 63 nt, Mus musculus
aacucuucaaacucucccaaccaccauccauauuuucagaacauaggaagauacuauugcauu

SEQ ID NO: 46461 - RNA, 52 nt, Mus musculus
gaagacuccaaggguuuuaggaacuaugugccagaaacuagguagagaccag

SEQ ID NO: 46462 - RNA, 46 nt, Mus musculus
uaacacacgugacaccucacguacaugaaguggaaaguuugggaag

SEQ ID NO: 46463 - RNA, 46 nt, Mus musculus
uuuuugaauuuuaaaauacuuaaaauacgucuuuuauuaagacuag

SEQ ID NO: 46464 - RNA, 38 nt, Mus musculus
ugccacgcagccugugaucuuguuaaagcaacccugag

SEQ ID NO: 46465 - RNA, 46 nt, Mus musculus
guauuguuuaauucauguaagacauucagagcagacaaaagcacag

SEQ ID NO: 46466 - RNA, 42 nt, Mus musculus
ggaauagccucugucucucuccuccucccccuuaaugcccau

SEQ ID NO: 46467 - RNA, 46 nt, Mus musculus
uguccaggagcaaacgucuagcaaauagguuuuugaaaccauacag

SEQ ID NO: 46468 - RNA, 37 nt, Mus musculus
aauucaaggauacaaagauacuaucucaaaaauaaaa

SEQ ID NO: 46469 - RNA, 42 nt, Mus musculus
cgguuaucucugcgccgccaagugccagacacauccagggag

SEQ ID NO: 46470 - RNA, 46 nt, Mus musculus
cucugaugagucugugucuagggauucagaugaucaagaguuggag

SEQ ID NO: 46471 - RNA, 46 nt, Mus musculus
acuuaaaggucaccuagcaagagauggcaguugaacccacagacag

SEQ ID NO: 46472 - RNA, 24 nt, Mus musculus
ugccaggaggcgcaaucccccacc

SEQ ID NO: 46473 - RNA, 76 nt, Mus musculus
ucaaauggaagcaaaauacugcaaaccuuccaaaggagggaaaagaacagcacucaagaaggaaaagaaaugaugg

SEQ ID NO: 46474 - RNA, 45 nt, Mus musculus
gaaauacauuccaaacaguguacaaauaacugugagaggggccug

SEQ ID NO: 46475 - RNA, 45 nt, Mus musculus
aggaagaggcuaaagaagcagaguugagcagaaaggagcugggac

SEQ ID NO: 46476 - RNA, 45 nt, Mus musculus
auagcagucucuucucuguaaagcaggcccuuaaacucaccccaa

SEQ ID NO: 46477 - RNA, 41 nt, Mus musculus
cuggagagcuggcaauuuaagauguuaggugucuggugggu

SEQ ID NO: 46478 - RNA, 67 nt, Mus musculus
aagagauuccagccuacagcgccuucgucaaagagucuaaacaaaagaugaaugcaaggaaaaggag

SEQ ID NO: 46479 - RNA, 46 nt, Mus musculus
aaaguacagacuccaugaucugguccaugucgcccuugaaguccag

SEQ ID NO: 46480 - RNA, 49 nt, Mus musculus
acgauauuaagcaggccuaucuggacuucaagggcgacauggaccagau

SEQ ID NO: 46481 - RNA, 59 nt, Mus musculus
ggacaguggacgaagacucugcuggccucaaccaagaccgggacugggaugcauauugg

SEQ ID NO: 46482 - RNA, 45 nt, Mus musculus
gcuuucuguuccuugucacucagaaccgcguagacucuucccaag

SEQ ID NO: 46483 - RNA, 56 nt, Mus musculus
aagagucuacgcgguucugagugacaaggaacagaaagcaguguacgaugaacagg

SEQ ID NO: 46484 - RNA, 45 nt, Mus musculus
agugccuacuacaucauguuucuuggaaguuccccugccaauuag

SEQ ID NO: 46485 - RNA, 45 nt, Mus musculus
ugagaacuaaacucagguucuuuccaggagcagugugcccucuuc

SEQ ID NO: 46486 - RNA, 45 nt, Mus musculus
aggggaaaaugagaaacugugagaaggaaugcagauacuuauagu

SEQ ID NO: 46487 - RNA, 46 nt, Mus musculus
aaaucccagcaaccacaugguggcuuacaaccauccauaauaagau

SEQ ID NO: 46488 - RNA, 24 nt, Mus musculus
aaaaagaguaugucuuaacaaacu

SEQ ID NO: 46489 - RNA, 45 nt, Mus musculus
ugugaaggugacuagagccaugccacuaguuuagaagggcggaga

SEQ ID NO: 46490 - RNA, 42 nt, Mus musculus
guaaucccacagcucccugggaguaaaccaccaaccaaagaa

SEQ ID NO: 46491 - RNA, 85 nt, Mus musculus
guggaugcucacagucauccaguagauggagcacagaguccccaaugaaggagcuagagaaaguacccauggagucgaaggggcu

SEQ ID NO: 46492 - RNA, 46 nt, Mus musculus
aaauacccauggaaggaguuacagaaacaaaguucggugcagagac

SEQ ID NO: 46493 - RNA, 46 nt, Mus musculus
cugacaaaauuagaagguucuuugaucuagaaaaagaaauagagau

SEQ ID NO: 46494 - RNA, 42 nt, Mus musculus
ggagggcuugugcacccaaagagguuugcacuaucuggcaag

SEQ ID NO: 46495 - RNA, 41 nt, Mus musculus
cuuaccccuccuuugcauuugcuagcaaacuguggcuguca

SEQ ID NO: 46496 - RNA, 46 nt, Mus musculus
gccuggaaugcgccugcuguccuucagaaacccuacaaugcccaca

SEQ ID NO: 46497 - RNA, 45 nt, Mus musculus
cacugagguggagaaccagcccugguucgcagccaucuaccagaa

SEQ ID NO: 46498 - RNA, 44 nt, Mus musculus
agucaacucccaaagaaggaaaacuacguugucuaccuggguca

SEQ ID NO: 46499 - RNA, 46 nt, Mus musculus
ugugcacagccauccagguccauacagaccaucugccugcccccaa

SEQ ID NO: 46500 - RNA, 47 nt, Mus musculus
guccgucguaaagcuuguuucucaugaacaguguaugcagccccacu

SEQ ID NO: 46501 - RNA, 88 nt, Mus musculus
aacagaugggucacuuguucccaugcugaccguccucucugcaacagagucgucaaauggagggaagaagcugaaaagacagguuuug

SEQ ID NO: 46502 - RNA, 67 nt, Mus musculus
gcaguuuagaaaacaucuccugggcaaguguaggaggagagcuguuucccuuaaugggucauucaug

SEQ ID NO: 46503 - RNA, 55 nt, Mus musculus
gaagugcaacagcugagguauugugagggugcuuguccaauaugagaacgguagc

SEQ ID NO: 46504 - RNA, 46 nt, Mus musculus
uaaaugucgguuucacuuuuuauauagauguccacuucuuggccag

SEQ ID NO: 46505 - RNA, 46 nt, Mus musculus
auuauguucugcuauuuuuauuuauaucuauuuuuauaauucugag

SEQ ID NO: 46506 - RNA, 41 nt, Mus musculus
cgccgcuccgagucagucacucgccgccggcucccggcccu

SEQ ID NO: 46507 - RNA, 42 nt, Mus musculus
ucugccugccccuagcuauuuaucgaucuuuguagcccacuu

SEQ ID NO: 46508 - RNA, 44 nt, Mus musculus
uuauuuaauaagaugcacaaguugguugggagugggagggaaga

SEQ ID NO: 46509 - RNA, 42 nt, Mus musculus
guguguguguguguguguguguguguguauucauacugugug

SEQ ID NO: 46510 - RNA, 45 nt, Mus musculus
uccucuuguauuguuuccuguauccuuuuaccugcaugaccccuu

SEQ ID NO: 46511 - RNA, 44 nt, Mus musculus
aggaaaggaaaggaaaggaaaggaaaggaaaggaaaggggucau

SEQ ID NO: 46512 - RNA, 45 nt, Mus musculus
ggaaaucauuucaaacacaaaaagcaaauucagugcauuaguaaa

SEQ ID NO: 46513 - RNA, 46 nt, Mus musculus
uagccauuuauaccucauaaaauuuuuuuuuucuguaugugcgugg

SEQ ID NO: 46514 - RNA, 44 nt, Mus musculus
aggacagcuuuguacaugaauaguggagagcugaugcuugcuca

SEQ ID NO: 46515 - RNA, 46 nt, Mus musculus
ugaggcugggggugaagcuccaauccacaucacaucaccccccaug

SEQ ID NO: 46516 - RNA, 42 nt, Mus musculus
uucccucccuuuucuaucucaggaauuaaagaguaggugcag

SEQ ID NO: 46517 - RNA, 42 nt, Mus musculus
aauacuuuauauacuuacuuaauaaaguauuuagaggcugau

SEQ ID NO: 46518 - RNA, 45 nt, Mus musculus
uugcuuucuggcugauucaaauccaaccucuuuuauucaggucgu

SEQ ID NO: 46519 - RNA, 41 nt, Mus musculus
uauggagcuguaugagauaaagugugugugugugugugugu

SEQ ID NO: 46520 - RNA, 46 nt, Mus musculus
uaaagcucuguguugaggacuccugaugagaagaguauucugucag

SEQ ID NO: 46521 - RNA, 44 nt, Mus musculus
ggaagugcagccagguaacuacagccuagcuuccuagacagcgu

SEQ ID NO: 46522 - RNA, 42 nt, Mus musculus
gcuggguggugauggcacacaccuuuaaucccagcacuuggg

SEQ ID NO: 46523 - RNA, 46 nt, Mus musculus
aaaguuuauauuauucuggcagaggacccaaguuugauuccuagcc

SEQ ID NO: 46524 - RNA, 41 nt, Mus musculus
gagagagagagagagagagagagagaggcaggccguggaga

SEQ ID NO: 46525 - RNA, 42 nt, Mus musculus
caaaaguaggccaaaggcuguuuuggggaauguggugggaag

SEQ ID NO: 46526 - RNA, 45 nt, Mus musculus
aaaucccagaaaccacaugauggcucacaaccauccauaaugaga

SEQ ID NO: 46527 - RNA, 45 nt, Mus musculus
ggguuucuauuccuguacaaacaucaugaccaagaagcaagcugg

SEQ ID NO: 46528 - RNA, 41 nt, Mus musculus
ggaagacuuuagaaaaaguggguuugauuagaaggcagcag

SEQ ID NO: 46529 - RNA, 45 nt, Mus musculus
uuucacauuucuucucugcucaguaccccauguuucuucccugua

SEQ ID NO: 46530 - RNA, 46 nt, Mus musculus
cuguuuucagaugcaccagaagagggcgucagaucucauuacggau

SEQ ID NO: 46531 - RNA, 23 nt, Mus musculus
ggaaacuuacuaucugcuucauc

SEQ ID NO: 46532 - RNA, 45 nt, Mus musculus
cacacacacauaugugugugugugaaaauaacauucuuuuccaga

SEQ ID NO: 46533 - RNA, 46 nt, Mus musculus
gcauaucucucuucagaaucugauccucaguggucugaacagucuc

SEQ ID NO: 46534 - RNA, 45 nt, Mus musculus
gaaaaccaguguguuaggaugaacugaaaauuacugagccguuua

SEQ ID NO: 46535 - RNA, 45 nt, Mus musculus
gucucaaaaucaaauuauagguuuacuuguaaacaauucagggaa

SEQ ID NO: 46536 - RNA, 41 nt, Mus musculus
uuaagagaaaaaauuaaaauaaguccauugaaacuggccaa

SEQ ID NO: 46537 - RNA, 46 nt, Mus musculus
aagaaaaagucucacacuuagcucaucuggcaucaaauucaagauc

SEQ ID NO: 46538 - RNA, 109 nt, Mus musculus
cgugacuaguagaaggagguggugucauguucagugugugacuugggagaacagagaaggcaagcuaguguggaugcaguaagacguggauguaagucauggaggugua

SEQ ID NO: 46539 - RNA, 48 nt, Mus musculus
agccuggcuggggaauuuccagcuggcaggaaagaagcuuuguaguuu

SEQ ID NO: 46540 - RNA, 46 nt, Mus musculus
guuuuauucuuucauuguuguuguuuugucugguuuuuaacuugag

SEQ ID NO: 46541 - RNA, 45 nt, Mus musculus
cauuacuagcauguauauacauaauauuaccauguuugcuggcua

SEQ ID NO: 46542 - RNA, 41 nt, Mus musculus
ucccuuuucugugcacuggugccagauuugaaaaggggugg

SEQ ID NO: 46543 - RNA, 32 nt, Mus musculus
acaccuguagauuugagagacaaguaacaguu

SEQ ID NO: 46544 - RNA, 46 nt, Mus musculus
guguguauguuuuacuugcauguauguguuucuggugcucuuggag

SEQ ID NO: 46545 - RNA, 25 nt, Mus musculus
cccugccugguuuugaacuugugcu

SEQ ID NO: 46546 - RNA, 46 nt, Mus musculus
guugugagccaccaugugguugcugggaauugaacuauaaccucug

SEQ ID NO: 46547 - RNA, 46 nt, Mus musculus
cgucaaugagguaaucccgcgcaggaaccgaguaugggucugacug

SEQ ID NO: 46548 - RNA, 46 nt, Mus musculus
cgggauuaccucauugacggcucuaggggaauccuuucuggcacau

SEQ ID NO: 46549 - RNA, 42 nt, Mus musculus
cuauggaagacuuggucacuuacacaaagaaucuugggccag

SEQ ID NO: 46550 - RNA, 45 nt, Mus musculus
uacauaaaugcuaguuaguuagcaaugucugucuuuaaguaggua

SEQ ID NO: 46551 - RNA, 45 nt, Mus musculus
uccuucucaaucagcagcaucgugaguauagcauggccuccagac

SEQ ID NO: 46552 - RNA, 50 nt, Mus musculus
caaggaauagaagaagcuuugaaaaaucgaaauuuuacuguagaaaagau

SEQ ID NO: 46553 - RNA, 90 nt, Mus musculus
ccaccaucaagaaaugcuucuuaaagaacaaacaagcaaaacccagauaaguuuaguugguuucaguaauaggaucauagacuugggcag

SEQ ID NO: 46554 - RNA, 46 nt, Mus musculus
cugugugaugaguuccagggaacuagggcuacacaguuauacccuu

SEQ ID NO: 46555 - RNA, 42 nt, Mus musculus
uuuuuaagcuuuuugcaauuuuagcauugaagacaccaggag

SEQ ID NO: 46556 - RNA, 46 nt, Mus musculus
ugaagagagcgcuggcguccauagacuccaaauugaaccaggccaa

SEQ ID NO: 46557 - RNA, 57 nt, Mus musculus
aacuuugugcaggcaaggaacgcagggagauccuaggaaccugcaaaaugcuagggc

SEQ ID NO: 46558 - RNA, 37 nt, Mus musculus
gcccucuuuuaaaaauccaccuauaccaacaccauau

SEQ ID NO: 46559 - RNA, 46 nt, Mus musculus
aaauguuguuuucaugguuuuagagcuuuauuguagaaaagcagag

SEQ ID NO: 46560 - RNA, 45 nt, Mus musculus
acagaggcacacaugcuaaugaaaauuacacauacuagguaaaug

SEQ ID NO: 46561 - RNA, 46 nt, Mus musculus
aaggcccagcaagugucucaggggcucgacgugcuuaccgccaaag

SEQ ID NO: 46562 - RNA, 45 nt, Mus musculus
gguggaccugagggagaagaacagauucgaggggcuuuggcugaa

SEQ ID NO: 46563 - RNA, 46 nt, Mus musculus
ccucuguauaugugugugugugugugugugagagagagagagagag

SEQ ID NO: 46564 - RNA, 46 nt, Mus musculus
aaaaaucacaucaacaacagcaccaugggcuggggauacagcuuaa

SEQ ID NO: 46565 - RNA, 46 nt, Mus musculus
uuuuauuucugugucaauucacuaguucaaguucucuggcugcuag

SEQ ID NO: 46566 - RNA, 46 nt, Mus musculus
gcaggucugcuguuggccacggcccuguugguuuuggucugcaggu

SEQ ID NO: 46567 - RNA, 42 nt, Mus musculus
gacggcacuacagaaccugcagaccaaaaccaacagggccgu

SEQ ID NO: 46568 - RNA, 45 nt, Mus musculus
ggagucaaggaauaaagguuaggcuugguuauaggucaguguuag

SEQ ID NO: 46569 - RNA, 46 nt, Mus musculus
cuuguggcugaggggcaucggcuggccaaugucaugaugggaccuu

SEQ ID NO: 46570 - RNA, 46 nt, Mus musculus
uguagaccagcuaacagcucagcuggcugaccuggcugcccgaggg

SEQ ID NO: 46571 - RNA, 54 nt, Mus musculus
augcaagugcucucgccugaggacucucccccuccccucgggcagccaggucag

SEQ ID NO: 46572 - RNA, 42 nt, Mus musculus
uuuaaggaucuuaaagcccagaugcaggaagcuaugacucaa

SEQ ID NO: 46573 - RNA, 45 nt, Mus musculus
cggauaccucuugagucauagcuuccugcaucugggcuuuaagau

SEQ ID NO: 46574 - RNA, 45 nt, Mus musculus
aagcuguuggcaguagccgccacugcuccuccugaugcacccaau

SEQ ID NO: 46575 - RNA, 46 nt, Mus musculus
ucaagaggcaaccgaggaaaugucaggaagcauugcauuuuuggaa

SEQ ID NO: 46576 - RNA, 46 nt, Mus musculus
acccacagccuucgaugcuuucucuugagacucguuacugggcauc

SEQ ID NO: 46577 - RNA, 45 nt, Mus musculus
gagaguucaugaagcccugaucuccugaucucucaguggcaccag

SEQ ID NO: 46578 - RNA, 28 nt, Mus musculus
uggcugcccuuucaucaaauaccuugag

SEQ ID NO: 46579 - RNA, 46 nt, Mus musculus
ggcuuggagccacagcagagaaggcggcugcuguugguacugccaa

SEQ ID NO: 46580 - RNA, 46 nt, Mus musculus
gcugucuucacagaugccugaaugccuuccacugucgauuuauugg

SEQ ID NO: 46581 - RNA, 46 nt, Mus musculus
aggcauucaggcaucugugaagacagcccgagaacucacuccccag

SEQ ID NO: 46582 - RNA, 46 nt, Mus musculus
cauuuauaugugugaguggguacauguguagcacaaauguguaugg

SEQ ID NO: 46583 - RNA, 45 nt, Mus musculus
uuuuuuauuaaacgagugugacuuuuccacauggacugaggcaug

SEQ ID NO: 46584 - RNA, 42 nt, Mus musculus
ugaaaugguagccuggacaaucuacauaccaaggccagaggg

SEQ ID NO: 46585 - RNA, 46 nt, Mus musculus
ugaguacacuauagcugucuucagacacuccagaagagggugucag

SEQ ID NO: 46586 - RNA, 45 nt, Mus musculus
gugugugugugagagagagagagagagagagagagagugcacaca

SEQ ID NO: 46587 - RNA, 24 nt, Mus musculus
gaagucagguugguuaaugacuaa

SEQ ID NO: 46588 - RNA, 47 nt, Mus musculus
gccugagggugaagucccuccacccaggcccccaccaccagaagaga

SEQ ID NO: 46589 - RNA, 42 nt, Mus musculus
caacuacucauuuccagugaugggaaaaggugagcaugcagu

SEQ ID NO: 46590 - RNA, 46 nt, Mus musculus
ccuuaaauaacauucuguauaaacauucauuuccuccuggucacag

SEQ ID NO: 46591 - RNA, 46 nt, Mus musculus
acuuuggaagaguugucucugaagacauuuuuaaggaggaagacag

SEQ ID NO: 46592 - RNA, 46 nt, Mus musculus
gaguggggagggagggaacaagagagacagcaccuacgugggaagc

SEQ ID NO: 46593 - RNA, 46 nt, Mus musculus
gagcgaaucccaacuauaagcacccagcucaaaauccuauccacag

SEQ ID NO: 46594 - RNA, 46 nt, Mus musculus
aguggccuucacuguggauaggauuuugagcugggugcuuauaguu

SEQ ID NO: 46595 - RNA, 46 nt, Mus musculus
aagaugguucucuucucuuuagcagagguguauguaccagccagau

SEQ ID NO: 46596 - RNA, 45 nt, Mus musculus
gaguugucaggaauggaaacaucaaucccuggcuucacacaccag

SEQ ID NO: 46597 - RNA, 46 nt, Mus musculus
aaugugucucucuauaaacccuguacuuucaguuacuaugcgcacu

SEQ ID NO: 46598 - RNA, 43 nt, Mus musculus
ggaguuggugaaccguaaacacagaaaugacccccggggcaga

SEQ ID NO: 46599 - RNA, 45 nt, Mus musculus
aaaauaacuuuggaagcacaguuauuuagacuugccucagcucua

SEQ ID NO: 46600 - RNA, 42 nt, Mus musculus
gaaaaaguggucucuggagaguucuagcuugugcggccugga

SEQ ID NO: 46601 - RNA, 127 nt, Mus musculus
aaaguugguuucccauugugaggaacuaggguuacacugggagaaagcaggaaaugaauccaggccgcacaagcuagaacucuccagagaccacuuuuuccugcagcaaugaugcacagcccagaga

SEQ ID NO: 46602 - RNA, 55 nt, Mus musculus
uuuaccaugccacuaacuaguauguguuauggaaacuuccugucucacauccugc

SEQ ID NO: 46603 - RNA, 47 nt, Mus musculus
uguuuacaggaugguuaccuuggcaaccaaacaaggcaggaugugag

SEQ ID NO: 46604 - RNA, 47 nt, Mus musculus
cugggguguuauccugcccauccucccaguggggccacucccagauu

SEQ ID NO: 46605 - RNA, 42 nt, Mus musculus
uggcagugacaaagcauagaaaaucugggaguggccccacug

SEQ ID NO: 46606 - RNA, 46 nt, Mus musculus
agcauuucccaguauacaaaugcuucuuucagaaaucaggaaccag

SEQ ID NO: 46607 - RNA, 46 nt, Mus musculus
uaaaggcauugauaugcauuuauaucagguaagcaacuauacagau

SEQ ID NO: 46608 - RNA, 45 nt, Mus musculus
gauauaaaugcauaucaaugccuuuaaaguaugaaucuaugccaa

SEQ ID NO: 46609 - RNA, 46 nt, Mus musculus
ggcaaaaggaaacagucccugaaugacguguuagagaugccaccac

SEQ ID NO: 46610 - RNA, 46 nt, Mus musculus
cguggucuguuaccagaagaugaaugguuguaaauaugcucuauuc

SEQ ID NO: 46611 - RNA, 46 nt, Mus musculus
ccuuucucuaguucuggcuaucaugucaauaaauauaugagcaacc

SEQ ID NO: 46612 - RNA, 46 nt, Mus musculus
ugggggagcgccuuuccauacuacauauaucuccaggccauuguga

SEQ ID NO: 46613 - RNA, 45 nt, Mus musculus
ugguauuauauuuuuuauaaauaagauuuuuauguaaagcucaga

SEQ ID NO: 46614 - RNA, 46 nt, Mus musculus
accuucugaucuuagccaucucagugucugucccaagagaggagau

SEQ ID NO: 46615 - RNA, 29 nt, Mus musculus
aggcuacagugauauccucucuccuaaag

SEQ ID NO: 46616 - RNA, 46 nt, Mus musculus
gaaguuccaagugaggacaugagaagaggccaaacuugcucaagau

SEQ ID NO: 46617 - RNA, 45 nt, Mus musculus
acacagcucagguauuuucucuuguguuuuuaagguacuagcaug

SEQ ID NO: 46618 - RNA, 42 nt, Mus musculus
aucgugucagcucacaaaaguaaauugacgcaucagccagaa

SEQ ID NO: 46619 - RNA, 47 nt, Mus musculus
guuguaagccagucagugugugacuauuucuuugaagcucaggagaa

SEQ ID NO: 46620 - RNA, 46 nt, Mus musculus
cuuccaagaauauuuugacuguaauugucaggaagaaugcacacau

SEQ ID NO: 46621 - RNA, 45 nt, Mus musculus
ugagugccaugcccauagaaacaaaaggcaauagauccccuggag

SEQ ID NO: 46622 - RNA, 44 nt, Mus musculus
caagcaccuuuucuguucuaaguaauuaauguuaugggggcuga

SEQ ID NO: 46623 - RNA, 46 nt, Mus musculus
gcgcacccacacacauaaacauguacacccccacacuccaccauua

SEQ ID NO: 46624 - RNA, 46 nt, Mus musculus
acuuggagaucucucagaucuggucuacacagugagucccagccag

SEQ ID NO: 46625 - RNA, 46 nt, Mus musculus
aguacucaggaggcagaggcagauagaucucugaauuggaggcuag

SEQ ID NO: 46626 - RNA, 66 nt, Mus musculus
uacccaaaucaaccccauucaaaccaaccccaaaaccagcaacaaauguaaguuauuaaaaggaga

SEQ ID NO: 46627 - RNA, 46 nt, Mus musculus
cacuaaaauuguuacaaaaguggaggcacugaucugcaccggagag

SEQ ID NO: 46628 - RNA, 46 nt, Mus musculus
agucaaaaacucaugauauggcugaagaugaucuugauggagugag

SEQ ID NO: 46629 - RNA, 40 nt, Mus musculus
gcaaccuggggguagcauaggugcugggugucaguucugg

SEQ ID NO: 46630 - RNA, 42 nt, Mus musculus
ucuuccagguauagacagggucucuucaaggguccuuggauu

SEQ ID NO: 46631 - RNA, 54 nt, Mus musculus
auuucaacagugcagugucucauagcaacagaaaaagcaauugcagagcaccua

SEQ ID NO: 46632 - RNA, 45 nt, Mus musculus
uaaaauuaauuacgugugugugugugugugugugugugugugugu

SEQ ID NO: 46633 - RNA, 46 nt, Mus musculus
ucaaaauucaauuugcauuucuuugacuagaacuuggguguuccuu

SEQ ID NO: 46634 - RNA, 46 nt, Mus musculus
uuucuaaaaaaagcauugacaauauuuuuaauguuuauuaaucuag

SEQ ID NO: 46635 - RNA, 42 nt, Mus musculus
ugcauaagaguacaggcgcuuggaggccagaaggcaucugau

SEQ ID NO: 46636 - RNA, 42 nt, Mus musculus
cuccagaggaucagaugccuucuggccuccaagcgccuguac

SEQ ID NO: 46637 - RNA, 41 nt, Mus musculus
aguagagaccagccaugaguacauggaagggggcugggaga

SEQ ID NO: 46638 - RNA, 46 nt, Mus musculus
auggaguuuauucagggcauggggaagagaguuaagaggcagagaa

SEQ ID NO: 46639 - RNA, 46 nt, Mus musculus
uauacuaaaaaacaaaacaaaacaagagaaaaugaaaaaccccaaa

SEQ ID NO: 46640 - RNA, 45 nt, Mus musculus
ucucugugcagugcccucccucccuacuguaucugacagagaccu

SEQ ID NO: 46641 - RNA, 41 nt, Mus musculus
gagacuuagaaaacccaacgagggugggguugggggcggca

SEQ ID NO: 46642 - RNA, 42 nt, Mus musculus
cgaucaguggcugaguuuaccuuguuucguuuccuugggcug

SEQ ID NO: 46643 - RNA, 45 nt, Mus musculus
auuaaaaaaaaaagaggggagagcagauuaaaaaaaaaaaaagag

SEQ ID NO: 46644 - RNA, 42 nt, Mus musculus
gggguggugccggagguggggggggggaaaugaugggucgag

SEQ ID NO: 46645 - RNA, 42 nt, Mus musculus
gcaccuccuccaggcggcagccguagcuucuuucucaggcag

SEQ ID NO: 46646 - RNA, 42 nt, Mus musculus
gccccgcccuuccauuccugagccccgccccuugccccguag

SEQ ID NO: 46647 - RNA, 46 nt, Mus musculus
gauggauggaggggucggacgagggcgugggcaagauuaaaagaac

SEQ ID NO: 46648 - RNA, 46 nt, Mus musculus
ucucucauuuaccacacccaaauucauccuuaguguguccccaguu

SEQ ID NO: 46649 - RNA, 57 nt, Mus musculus
uggggacacacuaaggaugaauuugggugugguaaaugagagaguauugcugaguug

SEQ ID NO: 46650 - RNA, 87 nt, Mus musculus
gauagugguuugcuggcccaugguaaaugaaacauuaagaaaacagaaggaaggauggauuaguuaaguuugggagauuuucuaagg

SEQ ID NO: 46651 - RNA, 96 nt, Mus musculus
uuguaauuugcagcaguauauuagaacaucucaucaggacaggugauucaaaguuaggggaaggcuguggcugugaacgagggcagcacugagcaa

SEQ ID NO: 46652 - RNA, 46 nt, Mus musculus
uuguuuggaguaaacuucaagccuagucuugaagguguggcaggaa

SEQ ID NO: 46653 - RNA, 65 nt, Mus musculus
ggcaaauuagugaccugcaccauggaggaguuugaacaauugcaguugggagaaagaauguucau

SEQ ID NO: 46654 - RNA, 84 nt, Mus musculus
gugagaguaguggaaguuaugaaggagcagugauaaggaauuacaguugucagcaauagcuagagacccagugaacuuggggug

SEQ ID NO: 46655 - RNA, 46 nt, Mus musculus
gucuggcuuguaguuucuaagcuaguuuugugaguaauuggccuuu

SEQ ID NO: 46656 - RNA, 46 nt, Mus musculus
ccagguaaauauuugauuacagaguuacacccucauuccuaaccag

SEQ ID NO: 46657 - RNA, 46 nt, Mus musculus
ggcucacaaccauccacaacaagaucugacgcccucuucuggugug

SEQ ID NO: 46658 - RNA, 42 nt, Mus musculus
uucucaucuucuuucucuuuuucucacucucauccccccucc

SEQ ID NO: 46659 - RNA, 46 nt, Mus musculus
cuguugaguuacacagcaaagacaacacaaaucaaaggguggaggg

SEQ ID NO: 46660 - RNA, 46 nt, Mus musculus
gguccugugguuguaagaauggcccccauaggcuccuguguuugaa

SEQ ID NO: 46661 - RNA, 46 nt, Mus musculus
guagcccauacuggcuuggaacuuucaaucuuucuggcugccuggg

SEQ ID NO: 46662 - RNA, 42 nt, Mus musculus
ugagugcuaggauuacagguuuguguuagcaagcuuggcuuu

SEQ ID NO: 46663 - RNA, 51 nt, Mus musculus
gugccaccacacccggcuagcuguuaaguuuuuaaaagggaaaaaaaggca

SEQ ID NO: 46664 - RNA, 46 nt, Mus musculus
cacacccugugaggggauucuuuuuaagaggcugucacaaaccuag

SEQ ID NO: 46665 - RNA, 46 nt, Mus musculus
agaucugggcaugugcucagcauggucagcauggcuaugugugugu

SEQ ID NO: 46666 - RNA, 84 nt, Mus musculus
uguuagcaguaaugugcagcagacagauggcugugguuagagaucuaggauguaaaagguugaaggagcuaggauagcaguguu

SEQ ID NO: 46667 - RNA, 46 nt, Mus musculus
caguuccaacuauuaucauagaugucuacuaaguucagugucuaca

SEQ ID NO: 46668 - RNA, 46 nt, Mus musculus
acauuuauaguuaugcuggcgauuacaugauguuuuuggguggugg

SEQ ID NO: 46669 - RNA, 64 nt, Mus musculus
uguaauauaauagcauaagcaugggaucuuagcauuuaagagguugcaggaagacugagaguuu

SEQ ID NO: 46670 - RNA, 46 nt, Mus musculus
cacauuccaaagucacaauucaacacaagggcagaggaucccagcc

SEQ ID NO: 46671 - RNA, 46 nt, Mus musculus
guucucaaagucaccaacaaaggccuugcuucauauaaggacccag

SEQ ID NO: 46672 - RNA, 44 nt, Mus musculus
aaugaucuacgcaauguggauuggaauaaacuuuuaaagagagc

SEQ ID NO: 46673 - RNA, 46 nt, Mus musculus
gggacaguugcagguguucuuuccuuccacucgguagguccuggag

SEQ ID NO: 46674 - RNA, 41 nt, Mus musculus
ucugccucugcuacccucuuaacucccguccccaugcccua

SEQ ID NO: 46675 - RNA, 44 nt, Mus musculus
guaauuuuuuaaaaguauagaauaguuuaucuagggcaugggga

SEQ ID NO: 46676 - RNA, 45 nt, Mus musculus
ucuggaauccuaucucugagaagguggguauauuacuuggcagcc

SEQ ID NO: 46677 - RNA, 46 nt, Mus musculus
ugagugcuggggaucugaacucagauucucgugcuugugaggugag

SEQ ID NO: 46678 - RNA, 24 nt, Mus musculus
uagcuccugacucauaguuacugg

SEQ ID NO: 46679 - RNA, 46 nt, Mus musculus
auuaaaccacugaagauaaaacuuuaucuuugacugggcacgggaa

SEQ ID NO: 46680 - RNA, 45 nt, Mus musculus
ucaaauauucugagagacuucaguuaucacacuuuguagcaguaa

SEQ ID NO: 46681 - RNA, 46 nt, Mus musculus
uuucacuuuguugagaguaucauccuaaaauuuauugaaggucaaa

SEQ ID NO: 46682 - RNA, 45 nt, Mus musculus
gagacacagucccauccuaugucagauucagucaccagaccacag

SEQ ID NO: 46683 - RNA, 47 nt, Mus musculus
uauuacaguguaaaagaucagguggaucaaugcucacaguuccaagg

SEQ ID NO: 46684 - RNA, 46 nt, Mus musculus
cauaaggucuucuauucuauucccagcaacacacacgcgcgcaguu

SEQ ID NO: 46685 - RNA, 85 nt, Mus musculus
ggccuuuuccugucuagcuagacuggcaguucaaaagagcaaccuaauuucauuuacaaguucaguuuuuauuccuuggugcuau

SEQ ID NO: 46686 - RNA, 45 nt, Mus musculus
uggauucuuccacaauucaagggaaggagugggaacagucuggag

SEQ ID NO: 46687 - RNA, 41 nt, Mus musculus
auaagaauguaaagauuauauggaacaagagaaauggcaga

SEQ ID NO: 46688 - RNA, 45 nt, Mus musculus
caaacagaagauaaguuuggaugaauuauuggaauauaaauggca

SEQ ID NO: 46689 - RNA, 46 nt, Mus musculus
uuuugaaguguuuacgugagugauggugcugaucuauacaggaggu

SEQ ID NO: 46690 - RNA, 46 nt, Mus musculus
cacugaaccaaagguuagucacauggccucaagccugcacugagca

SEQ ID NO: 46691 - RNA, 46 nt, Mus musculus
gaaccaagggcaaaccaagcaaacagccuaggagcugggaacagaa

SEQ ID NO: 46692 - RNA, 42 nt, Mus musculus
uaacuuuucaaaccagccuccuuaccugggaguggcggggca

SEQ ID NO: 46693 - RNA, 45 nt, Mus musculus
aauucagagcaaaaugaaauaaauaguuaugacugagagcaccac

SEQ ID NO: 46694 - RNA, 97 nt, Mus musculus
gcuacacagaaaauacccugucaugaaaaacaaacaaacaaggaaggaaggaagcaagcuagcuagcuuacaaaauaauuuuacaugaauccugagu

SEQ ID NO: 46695 - RNA, 25 nt, Mus musculus
uuucaaaguucaauucucaggcuuc

SEQ ID NO: 46696 - RNA, 52 nt, Mus musculus
ccaugauugagguguggguggguggguaagggugagagagggugagagaggg

SEQ ID NO: 46697 - RNA, 41 nt, Mus musculus
ccucugagguucauuuugugcauaggccuguucuuccgcaa

SEQ ID NO: 46698 - RNA, 46 nt, Mus musculus
cagugcaugcaccuucaccacaggguuuuagcuacuguagcuucag

SEQ ID NO: 46699 - RNA, 46 nt, Mus musculus
aacuuaaauaauuaaaauaaaauaaacauuuuaaagccccuaggaa

SEQ ID NO: 46700 - RNA, 45 nt, Mus musculus
ugcgcauauuuugaguaacagugccugcaaagaacagaagcacag

SEQ ID NO: 46701 - RNA, 42 nt, Mus musculus
ccacugagccauguauauacaacguauaaacaacguuuaggu

SEQ ID NO: 46702 - RNA, 37 nt, Mus musculus
acacgaauaagugaugggugugagcauaagauagaaa

SEQ ID NO: 46703 - RNA, 46 nt, Mus musculus
uccaaaaaguuguuauucuaaggccacuaagguucaccagccagau

SEQ ID NO: 46704 - RNA, 42 nt, Mus musculus
ugaacuuaagagagaaagagggggaaaaagaaagagggggag

SEQ ID NO: 46705 - RNA, 46 nt, Mus musculus
gcuuguuuugguuuuagucugucacuucuaucuggagucugcucag

SEQ ID NO: 46706 - RNA, 41 nt, Mus musculus
ugauguuucaauuugucuucuccacgucuuaauuaggguga

SEQ ID NO: 46707 - RNA, 46 nt, Mus musculus
aacaaaacuaucaaauggaucaauuuacaaguggcuguuaucagau

SEQ ID NO: 46708 - RNA, 60 nt, Mus musculus
ggguuaguacacgcgagggaagaauaaagaggcucuaugggagaagagaacgguggggcc

SEQ ID NO: 46709 - RNA, 45 nt, Mus musculus
ggguggcaguucuuuuagcaagaaaggacaacaaauucuugaauc

SEQ ID NO: 46710 - RNA, 46 nt, Mus musculus
ccaugugauuucacagaauucacauucaggauaugauaggugguag

SEQ ID NO: 46711 - RNA, 46 nt, Mus musculus
aggggaacccuucuggaggaagacuugagagguuugcagggucgag

SEQ ID NO: 46712 - RNA, 46 nt, Mus musculus
aucaacuugccacuguacugcucugguccacucuggcauggccaca

SEQ ID NO: 46713 - RNA, 46 nt, Mus musculus
gccaugccagaguggaccagagcaguacaguggcaaguugauuaag

SEQ ID NO: 46714 - RNA, 46 nt, Mus musculus
uuauauuuuaauuacaacauuuauccuuuuccuuccucugaaccuu

SEQ ID NO: 46715 - RNA, 46 nt, Mus musculus
aguugcaaauacucuugucuuaauuaacaccucuuaaaaauaagau

SEQ ID NO: 46716 - RNA, 45 nt, Mus musculus
aaaaaagaguaucugcaacuuaaucucaaauggaagguagggcag

SEQ ID NO: 46717 - RNA, 45 nt, Mus musculus
uucagaguugcccuuagucuucaguuuggugcuguauguucugua

SEQ ID NO: 46718 - RNA, 46 nt, Mus musculus
gauauggugacacacaucuguaaucugaucucucaaggggcugagg

SEQ ID NO: 46719 - RNA, 45 nt, Mus musculus
cugcuauaguaguuaucauaaagaauaauuuuuuuguucugacag

SEQ ID NO: 46720 - RNA, 46 nt, Mus musculus
gagguggggaucuugcugacugccagccuggcaggaaaaaugugau

SEQ ID NO: 46721 - RNA, 46 nt, Mus musculus
caguuccaggccaccugugaauauucaaaacuaaacccuguccuag

SEQ ID NO: 46722 - RNA, 42 nt, Mus musculus
agcuaagcuuuuucaaaaccucaaaaauaauuaagaugcaag

SEQ ID NO: 46723 - RNA, 60 nt, Mus musculus
aauaauuauauauaaauauauaauaaaauauggugcuacugaaaaaggaaaacuguaaac

SEQ ID NO: 46724 - RNA, 42 nt, Mus musculus
uguauucaguugggauuaggauaaagauguagcucagaggag

SEQ ID NO: 46725 - RNA, 42 nt, Mus musculus
acagagaaagguaacuuauggauaagguucuagguagaggaa

SEQ ID NO: 46726 - RNA, 46 nt, Mus musculus
guguguuucaaaaguaaaaaguguaaagaguuugugcaggcuugag

SEQ ID NO: 46727 - RNA, 59 nt, Mus musculus
agugugaguuucaucacugggguguugaccuugggggagagagagaggcagucugcuga

SEQ ID NO: 46728 - RNA, 28 nt, Mus musculus
aguuuaacacaauugucccucuccagaa

SEQ ID NO: 46729 - RNA, 46 nt, Mus musculus
ccugcuaugguuaaaaguaugagacuaauguaccauuccagcuguu

SEQ ID NO: 46730 - RNA, 45 nt, Mus musculus
acugucuuuugcagagaaguuucccucauaccacacuucgcccag

SEQ ID NO: 46731 - RNA, 46 nt, Mus musculus
uaucuuuuaaggcaggaacaaccaagagagacugaagaguagguaa

SEQ ID NO: 46732 - RNA, 46 nt, Mus musculus
uccugugucacccaccagagacuugguguauggcuguucucaagcc

SEQ ID NO: 46733 - RNA, 46 nt, Mus musculus
caagucucuggugggugacacaggauggagagauagggucucagag

SEQ ID NO: 46734 - RNA, 42 nt, Mus musculus
ccccuauaggccucagcuucagguaaagacuaggagggagac

SEQ ID NO: 46735 - RNA, 45 nt, Mus musculus
cccuucuucaggaugaccccugccucccacccuuucugcccagag

SEQ ID NO: 46736 - RNA, 47 nt, Mus musculus
acauuagccaaaaaggcaaauacguaucagacacuuaggaugguguu

SEQ ID NO: 46737 - RNA, 45 nt, Mus musculus
guaacaacucauuacagaugcacaguucuagucgaauaccgagua

SEQ ID NO: 46738 - RNA, 44 nt, Mus musculus
aaaugacuaacuaugaaauaggccuggaaauaugcggccugugg

SEQ ID NO: 46739 - RNA, 46 nt, Mus musculus
uuucuaaauuuuaagaaauucagaucagauuuaguaaugugccuau

SEQ ID NO: 46740 - RNA, 47 nt, Mus musculus
uucaaagacaaauagugucaaguacaaaggauuaucagccuuaggac

SEQ ID NO: 46741 - RNA, 31 nt, Mus musculus
gaaggacagagauaagacuuucagauuucaa

SEQ ID NO: 46742 - RNA, 42 nt, Mus musculus
ccaaugagcuacucaaggcauaucaaaauuagcuggugugug

SEQ ID NO: 46743 - RNA, 42 nt, Mus musculus
uuuguuuauuuuguguguauguguguggauagacacaggcug

SEQ ID NO: 46744 - RNA, 46 nt, Mus musculus
uauccacuaacaacauucuuuaacauauaaaauacauaaguaagaa

SEQ ID NO: 46745 - RNA, 43 nt, Mus musculus
aaguagccaagaaaauguuauguaagaaugcaggggcgggaaa

SEQ ID NO: 46746 - RNA, 89 nt, Mus musculus
cuguuguuuuaauuaaacgaacgguuuaaaaauuaauuaugacauuuugaugaucugauacuggcugggaguaaggauauuuucucagg

SEQ ID NO: 46747 - RNA, 46 nt, Mus musculus
uuuuuuguuuuguuuuugagggggcguguugaaaguuugggcuggu

SEQ ID NO: 46748 - RNA, 46 nt, Mus musculus
guaucucacaauacuguucauuguuuacucuuaaccagcccaaacu

SEQ ID NO: 46749 - RNA, 42 nt, Mus musculus
ugaucaugugcgggagggaggggcuagcuaucagucucagau

SEQ ID NO: 46750 - RNA, 31 nt, Mus musculus
cauagauaagaauugaguacaucugcuugaa

SEQ ID NO: 46751 - RNA, 46 nt, Mus musculus
agccaucacauggaaccuuacguagcuccuaaaaacuguaguguag

SEQ ID NO: 46752 - RNA, 55 nt, Mus musculus
uuauguuaggaaagaauuuucucaaugcugcacagagacgugcaugaagggaaag

SEQ ID NO: 46753 - RNA, 45 nt, Mus musculus
gaaguagggagaguuggguaaacagcagaugcgagaguuucacaa

SEQ ID NO: 46754 - RNA, 46 nt, Mus musculus
ccugacaauugcuggcauguagugaguggagcauaaugcacaugag

SEQ ID NO: 46755 - RNA, 45 nt, Mus musculus
aagggacaggaugaggcugaggagguguccacagaggcuuggcgu

SEQ ID NO: 46756 - RNA, 44 nt, Mus musculus
cagagaugacuacuuagaaaggcucuggugagacacccagggcu

SEQ ID NO: 46757 - RNA, 85 nt, Mus musculus
uuuuaugaggaggugaaauugaauguugacacgaacauaggcgagcucugagccaugagccacacacacacacacauacacccca

SEQ ID NO: 46758 - RNA, 54 nt, Mus musculus
ucuugugcaguggggcuggauuguauggugacuugaacauuuaauagcauuccc

SEQ ID NO: 46759 - RNA, 51 nt, Mus musculus
ucuuacuguuuagugcuaccgugguaagaagccucuagcuccuuccugcau

SEQ ID NO: 46760 - RNA, 92 nt, Mus musculus
ugugcuuguuuugccauuacuguaaguucuuagaucuugguuuguuguuuuuccacccuaaguaguacaagggguuacucauuuaugucugc

SEQ ID NO: 46761 - RNA, 75 nt, Mus musculus
ucauaagugucacagcauguauuugucauuuuaguaaauggauauuuuaauaggcagcaauuugcaaauucaaac

SEQ ID NO: 46762 - RNA, 42 nt, Mus musculus
gugcacacacacacacacacacacacacacacacccaaaugc

SEQ ID NO: 46763 - RNA, 46 nt, Mus musculus
gcugcccucuuuacacuuggucccagucacacugccacuuucagau

SEQ ID NO: 46764 - RNA, 46 nt, Mus musculus
ugccuguaccagacagccuggagguccagccaacgugcucccacua

SEQ ID NO: 46765 - RNA, 46 nt, Mus musculus
cuacagagcuacaugugacacuaaccugcaauccugguggugggga

SEQ ID NO: 46766 - RNA, 46 nt, Mus musculus
cucagcagguacacuuucacaaagcaaagccuuccacaggagaggg

SEQ ID NO: 46767 - RNA, 46 nt, Mus musculus
gcuggcuggucgacuggaaaaucuucaugucugagcugucucugga

SEQ ID NO: 46768 - RNA, 45 nt, Mus musculus
gaaguauugcaaggcguuuuauaacccucccucaccacaccccag

SEQ ID NO: 46769 - RNA, 45 nt, Mus musculus
cacugagcuggggauuccaggagcucacagugcugggguguggug

SEQ ID NO: 46770 - RNA, 45 nt, Mus musculus
cagacaagcguaggcagaacccagggaagugcuguucacugacug

SEQ ID NO: 46771 - RNA, 46 nt, Mus musculus
cacugagucuauguuuaguaaauaaagaauaacaaaguaccuauag

SEQ ID NO: 46772 - RNA, 46 nt, Mus musculus
uuaugccagccauggucuuguucuucacuuuuaaaaaacagugugu

SEQ ID NO: 46773 - RNA, 32 nt, Mus musculus
agagauuugccaggguuaaagucaugagucac

SEQ ID NO: 46774 - RNA, 46 nt, Mus musculus
ugagugcuguguugaggcaggaagagaaaaagaaaucauaaagcag

SEQ ID NO: 46775 - RNA, 46 nt, Mus musculus
uuggguuccccagcugaaagugggcuccauguaccagaagcgggaa

SEQ ID NO: 46776 - RNA, 23 nt, Mus musculus
uaccagcccuuccacugcagggg

SEQ ID NO: 46777 - RNA, 42 nt, Mus musculus
guggaagggcugguagugaguguugaacaugaaaugggagga

SEQ ID NO: 46778 - RNA, 42 nt, Mus musculus
ugggcaaauccuuucugccugggauuguucuaugugggcgcu

SEQ ID NO: 46779 - RNA, 46 nt, Mus musculus
aaguugugugugugugugugugacuauauauaguaagaaauuguau

SEQ ID NO: 46780 - RNA, 80 nt, Mus musculus
aagaggcaaacuugcuaauagcagugacuacagcuggaagauaccagaauucaaacuaauaaaggcgugugggagagaug

SEQ ID NO: 46781 - RNA, 43 nt, Mus musculus
agaggagaggagaggagagggaagagagaagggggggagggag

SEQ ID NO: 46782 - RNA, 47 nt, Mus musculus
caaauuguuuuaaagcacagaggguuuggauaugauaggaggaggga

SEQ ID NO: 46783 - RNA, 46 nt, Mus musculus
uuuggaacugugaggaaugcauugauaagguucaaguucaguugaa

SEQ ID NO: 46784 - RNA, 42 nt, Mus musculus
ggugguugagucaccaugugggggcuagggauugaaccuggg

SEQ ID NO: 46785 - RNA, 45 nt, Mus musculus
aaaaaaaaaaaaaccaaaaaccccaaaaaaagaaagagccaggca

SEQ ID NO: 46786 - RNA, 35 nt, Mus musculus
ccacuguauaggcaggcucugagugcuccuugucc

SEQ ID NO: 46787 - RNA, 46 nt, Mus musculus
cacagacagucacuguggccugaggcgaucaucucucaccguagac

SEQ ID NO: 46788 - RNA, 46 nt, Mus musculus
ccagccgucagccucaguagcaggagucauaauuguuuagaacugc

SEQ ID NO: 46789 - RNA, 46 nt, Mus musculus
aaagcagacacuucauugucacuauuuuaaaauccucuccggccgg

SEQ ID NO: 46790 - RNA, 42 nt, Mus musculus
cgaugugauggcgcgaugugauacagcaaggaccggccggag

SEQ ID NO: 46791 - RNA, 46 nt, Mus musculus
ugguaccgccucaguggagagcggagaagacaggcagcaagguagg

SEQ ID NO: 46792 - RNA, 41 nt, Mus musculus
aggcauaaaucaaaacaaguuuagaauaaacugguggguac

SEQ ID NO: 46793 - RNA, 24 nt, Mus musculus
ccuggcugaccuuuaaccuguggu

SEQ ID NO: 46794 - RNA, 46 nt, Mus musculus
acaugaggacuuuguuaccucugcccccuccagccuguccaugcag

SEQ ID NO: 46795 - RNA, 41 nt, Mus musculus
ucuuacucuguagcccaaguagaccuagaacuuuggcccau

SEQ ID NO: 46796 - RNA, 46 nt, Mus musculus
uuuuaaauuaaccaacuuacuaauuuaucauuucuugugacugugg

SEQ ID NO: 46797 - RNA, 46 nt, Mus musculus
uuauaaagcagagucuaugguuuagugcuauuucuuuaguuugugu

SEQ ID NO: 46798 - RNA, 45 nt, Mus musculus
ucuguggaacuauuucauuacaagcucagcuaauggcccauguag

SEQ ID NO: 46799 - RNA, 104 nt, Mus musculus
cccugugauggagcgaacugauggcacuggccugguaagcauucucugacccaguucgcccagcagcagccccagggaagccaggagcuuagaaaauuuguuga

SEQ ID NO: 46800 - RNA, 55 nt, Mus musculus
acaaauaagugucaaguauugaauuugggaauuaaaaagugggagagguuuaaua

SEQ ID NO: 46801 - RNA, 34 nt, Mus musculus
acaaguguugcugcuuucugugaagagagugcac

SEQ ID NO: 46802 - RNA, 46 nt, Mus musculus
agcccauuuguaacacagcacuguacuugucugugcuuaagccuag

SEQ ID NO: 46803 - RNA, 46 nt, Mus musculus
caugucaaguauaauuaagaaaaagccaaguaacgaacugugagaa

SEQ ID NO: 46804 - RNA, 46 nt, Mus musculus
ucuuagcaaacaauuuuggaucggguaauaguguugagagcuuuca

SEQ ID NO: 46805 - RNA, 46 nt, Mus musculus
ucccaguuccccacagcaguccuucccugcucuuuaaggcccagau

SEQ ID NO: 46806 - RNA, 48 nt, Mus musculus
uuuauuuauuuuuauaugcauuaauguuuugccugccuguggaucugu

SEQ ID NO: 46807 - RNA, 34 nt, Mus musculus
ugccuguuaacuccaguuccaggaaauccgacac

SEQ ID NO: 46808 - RNA, 44 nt, Mus musculus
uuuccuuuauuacucuuugcuuaacuuuuuuugggggaggggua

SEQ ID NO: 46809 - RNA, 50 nt, Mus musculus
cucucugcagcuuuguuaucuuccauucaacucaguaagggguuccugac

SEQ ID NO: 46810 - RNA, 44 nt, Mus musculus
accaacuguauugcuguaauagggcuugaccaugguuuugccug

SEQ ID NO: 46811 - RNA, 24 nt, Mus musculus
aacauuucggcugggcaguggugg

SEQ ID NO: 46812 - RNA, 45 nt, Mus musculus
agaggugugggacguggagcagucagaugguggauggggguugga

SEQ ID NO: 46813 - RNA, 45 nt, Mus musculus
cucagaacucuugcacacuauuggugcuuuggcaauuuucuagga

SEQ ID NO: 46814 - RNA, 46 nt, Mus musculus
aguuacaaacuaaaagccaucuuuacauugaaacaugcuuuaagac

SEQ ID NO: 46815 - RNA, 45 nt, Mus musculus
agcucucaucugaugugacuugcauuguuaauuuacauggcuaaa

SEQ ID NO: 46816 - RNA, 42 nt, Mus musculus
ucucugucuucaaugucaggcagucucagacacugggggauu

SEQ ID NO: 46817 - RNA, 75 nt, Mus musculus
gauaauaacaaguaauuauaucauauaucagcuggcaauaacugcggugggaaaaaagcaguggaagagagguau

SEQ ID NO: 46818 - RNA, 42 nt, Mus musculus
ugcuacaagcuacaagguggcagcuaggaagcagccagggag

SEQ ID NO: 46819 - RNA, 47 nt, Mus musculus
agugcaguuauuuauugaaauggacaaaaauuaguaugugaguaaag

SEQ ID NO: 46820 - RNA, 46 nt, Mus musculus
aaaacauaucuacaguaaaaauucaaaguaaauucagguaccaggu

SEQ ID NO: 46821 - RNA, 44 nt, Mus musculus
acccaacuauaaacuuauaacccaacuagucaaacuggcagcca

SEQ ID NO: 46822 - RNA, 45 nt, Mus musculus
guuguuuugucauccucaggcuauuguguaggcguggauaugcug

SEQ ID NO: 46823 - RNA, 41 nt, Mus musculus
gaauuauuuuauuguuucuguugugcuuauauaugggggga

SEQ ID NO: 46824 - RNA, 46 nt, Mus musculus
aggcucuguaucuggcagguagagggggcaggagccagagcagcag

SEQ ID NO: 46825 - RNA, 45 nt, Mus musculus
uccaacaggcguguuuacacaugccaguaauuccggcacuugaga

SEQ ID NO: 46826 - RNA, 49 nt, Mus musculus
gccaagcacuuuaccuuuguauaguuucuuucuuauguugauuuggugu

SEQ ID NO: 46827 - RNA, 42 nt, Mus musculus
guguggcagucaagugcaucuugcugcccaggguuauuuuag

SEQ ID NO: 46828 - RNA, 45 nt, Mus musculus
uauauaucuggucugccuguguucuggcgugugugugugugugug

SEQ ID NO: 46829 - RNA, 46 nt, Mus musculus
caugggucacauguucuuacucuuugacucuuuuguaccauagcag

SEQ ID NO: 46830 - RNA, 41 nt, Mus musculus
agcccuuguaggguggagaugggaggagauggagacaggag

SEQ ID NO: 46831 - RNA, 45 nt, Mus musculus
acaccauaguccuauuuuuuaaaguaucuuuuuaacuugggagau

SEQ ID NO: 46832 - RNA, 45 nt, Mus musculus
guuuugcugucucauguuuguaacuuucaucucucaucaagugua

SEQ ID NO: 46833 - RNA, 45 nt, Mus musculus
aauuuuaacaguuuuguuuuaacuguuaacuagaaagaaaugcca

SEQ ID NO: 46834 - RNA, 42 nt, Mus musculus
ugcccuggugggcaguguaguccugcuguaauccugggggag

SEQ ID NO: 46835 - RNA, 46 nt, Mus musculus
ugagggugguguugcuauaggagaauguucgguaugucaccucugg

SEQ ID NO: 46836 - RNA, 46 nt, Mus musculus
cgagaagcauaaugagcaggagaggugagacaguggaaauccauag

SEQ ID NO: 46837 - RNA, 46 nt, Mus musculus
ggcaggaggaucaggagaugaaggccagccuaagauauaccaugug

SEQ ID NO: 46838 - RNA, 46 nt, Mus musculus
agucuucuaaguuccaagucuugcucaccugcuuccucugcccccu

SEQ ID NO: 46839 - RNA, 45 nt, Mus musculus
uugucugcauguauguauguguaacguguguguuugguguuuuaa

SEQ ID NO: 46840 - RNA, 42 nt, Mus musculus
auggcuauguugcugccagcaacccuccaccccgccccagag

SEQ ID NO: 46841 - RNA, 82 nt, Mus musculus
gcggaaucaaauugcuauuuaaccagaccucauucugacuagaauccauuuuacuuuaagggauuauuuuuuaaaagccaag

SEQ ID NO: 46842 - RNA, 45 nt, Mus musculus
guaguggugaguuugguuugugugcguucuacaugguguccacug

SEQ ID NO: 46843 - RNA, 45 nt, Mus musculus
gaagaucccaauuauggaauacuguguagacauguacgcccucug

SEQ ID NO: 46844 - RNA, 46 nt, Mus musculus
gagggacagaaccucucugcagaacaugagcaggaucuguagguag

SEQ ID NO: 46845 - RNA, 45 nt, Mus musculus
aagguggaguacacagagguggagaagaacuccauggacuuggag

SEQ ID NO: 46846 - RNA, 48 nt, Mus musculus
uagaucuguuagugugcaggcuuggguuagacaugcuacuuauuggga

SEQ ID NO: 46847 - RNA, 47 nt, Mus musculus
ccuuaaagcuaaauaaagggaagauugcuuccuaaaaaagaugggcu

SEQ ID NO: 46848 - RNA, 45 nt, Mus musculus
gaaagaaagagagagggaugggggaagaagaagaaggauaggagg

SEQ ID NO: 46849 - RNA, 46 nt, Mus musculus
uuuuuaauauucuagacauguaacuucaauuauuauagugccagag

SEQ ID NO: 46850 - RNA, 44 nt, Mus musculus
gggcauguacacauggcauucauucacacacagacagacaggca

SEQ ID NO: 46851 - RNA, 46 nt, Mus musculus
cagaauuguccuuugagcucaggaauuuuuaagacagucuggggag

SEQ ID NO: 46852 - RNA, 41 nt, Mus musculus
caaaaaaacugaagaaaugauuaaagagaagcugcagcagg

SEQ ID NO: 46853 - RNA, 46 nt, Mus musculus
aauuacuucuaccuagaaaugaguauauucuucuacuuuggaucag

SEQ ID NO: 46854 - RNA, 46 nt, Mus musculus
aaggacauuucaggaaaucauaauuacuuguaacaacacuggggau

SEQ ID NO: 46855 - RNA, 47 nt, Mus musculus
cugguaggagccugacacacaaauagaaucuguuuuccagccaagaa

SEQ ID NO: 46856 - RNA, 75 nt, Mus musculus
ucuguuauuuaaugcugauacuauucucuaaauucuugccuaggucuguaaccagugaugaaggauccaugagug

SEQ ID NO: 46857 - RNA, 31 nt, Mus musculus
ugagugcuucccagacgcagcaugaccagau

SEQ ID NO: 46858 - RNA, 53 nt, Mus musculus
cccacccggccuggugccaccaccaaaaccaccaccuccuccaccuacauuuc

SEQ ID NO: 46859 - RNA, 46 nt, Mus musculus
cuuugguuuucuuguuaacuuuaaguguagaggcagaaauguaggu

SEQ ID NO: 46860 - RNA, 46 nt, Mus musculus
cucagaaacagucaugcacuucucauguguuggcuacagguaccac

SEQ ID NO: 46861 - RNA, 45 nt, Mus musculus
uuguuaguaagacugcuaaaggagggcucaccggacuggcuggaa

SEQ ID NO: 46862 - RNA, 46 nt, Mus musculus
cagggacagucucgaaaaaagggacacccaagcuaugcaccaccca

SEQ ID NO: 46863 - RNA, 45 nt, Mus musculus
aauggcuuuaaaaauauguccucuagucaucccccagcuacagga

SEQ ID NO: 46864 - RNA, 54 nt, Mus musculus
uugcucacuucaagcgaacaacuuuucuuaaaaagcacaggaugcuaggcagau

SEQ ID NO: 46865 - RNA, 47 nt, Mus musculus
accccucagauggggaccccgucaucagggaaggggagcuuggcaga

SEQ ID NO: 46866 - RNA, 48 nt, Mus musculus
gccccucucccaccccaaagagccaggaaaucagcucugcccgggaca

SEQ ID NO: 46867 - RNA, 95 nt, Mus musculus
uaaaccuccaaaaaaguguuuuuucaacuaauaucuccagccuccuauuauuuauuuccauucguaguggcacuaggcacuucccccuccagaua

SEQ ID NO: 46868 - RNA, 46 nt, Mus musculus
ugcggacuacaaagcugggagcaacgcuaugaagguaucuggaggg

SEQ ID NO: 46869 - RNA, 73 nt, Mus musculus
cugccgugcucucuccugugccgccucaaguagccagugcugccuuguugugugcuggcaaugcuuccagcca

SEQ ID NO: 46870 - RNA, 42 nt, Mus musculus
cagcacacaacaaggcagcacuggcuacuugaggcggcacag

SEQ ID NO: 46871 - RNA, 79 nt, Mus musculus
cauuggauuugaguguguuugcauguuuacccauucaccuuaggaaggagaccgauuucaaaaguucagugaacaaguu

SEQ ID NO: 46872 - RNA, 46 nt, Mus musculus
gaauagguagauuuugugagcucaaaacuaaugaugguaauguugu

SEQ ID NO: 46873 - RNA, 51 nt, Mus musculus
uauuaaaauaagcaucaaacaagaaagugcagaugugagucuggugggaaa

SEQ ID NO: 46874 - RNA, 46 nt, Mus musculus
ggcauuugcuuugcaaaccugacagccgaguucaaaacacagguau

SEQ ID NO: 46875 - RNA, 47 nt, Mus musculus
ggaguggaagacuguggucgguaccccucaguaauagaguucgggaa

SEQ ID NO: 46876 - RNA, 42 nt, Mus musculus
ucucacuuuguaguuuugguugggaggguaaagccccaagau

SEQ ID NO: 46877 - RNA, 50 nt, Mus musculus
uuuuguuaaagaagaaggagaaggagaaggagaaggagaaggagaaggcg

SEQ ID NO: 46878 - RNA, 43 nt, Mus musculus
cagcccuuuguuggugcuauguaaacaguucuguuacuuucug

SEQ ID NO: 46879 - RNA, 46 nt, Mus musculus
agacaaaaacccaaaacacuucuuaauuuaagaauuaaagcagcag

SEQ ID NO: 46880 - RNA, 46 nt, Mus musculus
uaccaaagcuuuaccugugugaauucugucuuaaauauaugaagag

SEQ ID NO: 46881 - RNA, 45 nt, Mus musculus
auauuauucagcuugaaaugccaguaguacucaggcugagcagcc

SEQ ID NO: 46882 - RNA, 46 nt, Mus musculus
auuuuugguugucacgaauggacaggaggcaccagcagcagcagcc

SEQ ID NO: 46883 - RNA, 47 nt, Mus musculus
caugucuaacaagacugauuauccugcccagaugacuuccugauaga

SEQ ID NO: 46884 - RNA, 46 nt, Mus musculus
uuuugugagucucuucuguaccugucucuuuuccuagacuucugau

SEQ ID NO: 46885 - RNA, 47 nt, Mus musculus
augggaauaugaguaaaauuuauugccaaaaccuuugcuuguuagcc

SEQ ID NO: 46886 - RNA, 46 nt, Mus musculus
cauaaaaaaggaauggcucaacaucauaauacaauguuuugugguc

SEQ ID NO: 46887 - RNA, 42 nt, Mus musculus
aaauaaacaaugaagaaagaaagaaagaaagagagagagaga

SEQ ID NO: 46888 - RNA, 45 nt, Mus musculus
cagcaggcuuuuuacuuacuuacugggcuagguccaucuauuaag

SEQ ID NO: 46889 - RNA, 46 nt, Mus musculus
acuggguggacuaggugguguuuucuccguuucugcaguuguguga

SEQ ID NO: 46890 - RNA, 39 nt, Mus musculus
cagaaguauaauguguccugcauaaugaucaugccccag

SEQ ID NO: 46891 - RNA, 46 nt, Mus musculus
gaguuuucgcuuucucagauuuugcccaguagucuuuguggagcag

SEQ ID NO: 46892 - RNA, 46 nt, Mus musculus
cucuauaagucucuaucauuagauucugaaauguugaagucugcag

SEQ ID NO: 46893 - RNA, 46 nt, Mus musculus
uauacuagcucacugucguuccuuuccacauccucgcuguaaucag

SEQ ID NO: 46894 - RNA, 46 nt, Mus musculus
gcuuaagcaccaugaugaaagauuuuaguauaguugaaaggugggg

SEQ ID NO: 46895 - RNA, 42 nt, Mus musculus
ccgguacaguaagagaacugaugggguuguccacaggcccaa

SEQ ID NO: 46896 - RNA, 24 nt, Mus musculus
gucauuguaauagugucugguaag

SEQ ID NO: 46897 - RNA, 46 nt, Mus musculus
uuuuaugcaaagaggaggaggaggaagaagaagaggaagaggagga

SEQ ID NO: 46898 - RNA, 42 nt, Mus musculus
gucaggcucauacagcaagugcuuuuaaucccagccccagau

SEQ ID NO: 46899 - RNA, 30 nt, Mus musculus
gcacgcgcgcgcguauguacaaauguguua

SEQ ID NO: 46900 - RNA, 46 nt, Mus musculus
cgauccuuccuguugcaacuuaaguaagugaacucaagaaacagcc

SEQ ID NO: 46901 - RNA, 46 nt, Mus musculus
gacaucuuguuucucuuuaaugauugccuugguugcacugacuggg

SEQ ID NO: 46902 - RNA, 41 nt, Mus musculus
ucgcuuucacuggccccguuaugguauuuguaaggcagagc

SEQ ID NO: 46903 - RNA, 45 nt, Mus musculus
gcuugcagggcaaugguggcgcacgccuuuaaucccagcacuugg

SEQ ID NO: 46904 - RNA, 46 nt, Mus musculus
ccauguaccugggaacuaaguaggguuccuuaugugaaaauggauu

SEQ ID NO: 46905 - RNA, 46 nt, Mus musculus
gaacauggugaacgauaauacaagcacaccacgagaaagccccaag

SEQ ID NO: 46906 - RNA, 46 nt, Mus musculus
aauuuggagcccaucuggucuacagauccagcuccaggacagccag

SEQ ID NO: 46907 - RNA, 79 nt, Mus musculus
cugggcacucaugcuuuguucuccuacuguugauuacacuccagagugaacgaauauaguucugucagacacugcaagu

SEQ ID NO: 46908 - RNA, 77 nt, Mus musculus
gggagugggaugcccucuccuuccagggcuaaugcacuugugaaauuuggauauuuaaaaaacagugcuuacagaag

SEQ ID NO: 46909 - RNA, 46 nt, Mus musculus
cucuccccaucucucccccuccucccucucuucucucucccccucc

SEQ ID NO: 46910 - RNA, 42 nt, Mus musculus
agucaagccgguuuguucccagaggcaacuucacugggagau

SEQ ID NO: 46911 - RNA, 42 nt, Mus musculus
gcuuucuccucucuaguuuguuuauauuuuuaaaaaugcagg

SEQ ID NO: 46912 - RNA, 46 nt, Mus musculus
uucugaagccaagaugucuuagaaccccaccaguguaucucagcag

SEQ ID NO: 46913 - RNA, 45 nt, Mus musculus
auucauguuguagccagaauucuuuuguagugacauccaggcaua

SEQ ID NO: 46914 - RNA, 45 nt, Mus musculus
uugcucggcgauuagucuaguugcuauguaauuacacugggccca

SEQ ID NO: 46915 - RNA, 41 nt, Mus musculus
cuaaaggcauuggcuuaccuccuaaguuaacaugagcccau

SEQ ID NO: 46916 - RNA, 46 nt, Mus musculus
ugugugucugaggagguucagaugguuuggaagcagacaaugacag

SEQ ID NO: 46917 - RNA, 46 nt, Mus musculus
gugaagaucucugucacacccuugccucuuuuuacucuugcuccac

SEQ ID NO: 46918 - RNA, 88 nt, Mus musculus
agucccugccucuucacagccucugagugcacacacaacaggagggugcuuugcugggagagaccagugggcucaauguccaugacac

SEQ ID NO: 46919 - RNA, 45 nt, Mus musculus
gcaguccugcgcugcagucaaaaggccaaggaauugucaggaguc

SEQ ID NO: 46920 - RNA, 47 nt, Mus musculus
ugcuggcucgccuaaauuaccgcaugcuuuuuagacucgggguacaa

SEQ ID NO: 46921 - RNA, 80 nt, Mus musculus
ggagggugggaaugcuucccucuuaggucaaagugugggaacauagagacauaauaaaaaccgugccuccaggguaaggu

SEQ ID NO: 46922 - RNA, 47 nt, Mus musculus
uaugaugacauucaaauaaaagcugucaagaugcagcaugcuguuga

SEQ ID NO: 46923 - RNA, 88 nt, Mus musculus
aaauggauccaaggcauugauuucucuuuguaacaacaacagaaaaacuaaaacagaaaauucuugcaagugcagccauuuuggaacu

SEQ ID NO: 46924 - RNA, 50 nt, Mus musculus
uccaagaugacacuuuuccaguaggccagguaggagagccggcccagguc

SEQ ID NO: 46925 - RNA, 70 nt, Mus musculus
ccuggccuacuggaaaagugucaucuuggaauaccucuaccgccaccacgagaggcacaucagcaucaag

SEQ ID NO: 46926 - RNA, 79 nt, Mus musculus
gccauuagcagagccacaggcaugugcccacaugacaucgccaccacucugcagcaccuccacaugauugacaggaggg

SEQ ID NO: 46927 - RNA, 46 nt, Mus musculus
guuuuccauuuucauaaccugggucaaaggaaucuggauuggccag

SEQ ID NO: 46928 - RNA, 45 nt, Mus musculus
cauguggcccaauaucaacuuuucccuucuaaugaugacaaaccu

SEQ ID NO: 46929 - RNA, 66 nt, Mus musculus
gucaucauuagaagggaaaaguugauauugggccacauggaaaagcugaagaacuguucccgaccc

SEQ ID NO: 46930 - RNA, 63 nt, Mus musculus
aaugaacuugauccggagagucuaagauggaccccaauguuaauuucuaaugcugugguuucu

SEQ ID NO: 46931 - RNA, 45 nt, Mus musculus
uaacucuggacgacaggaucucuugcuccuccuucucccagcagc

SEQ ID NO: 46932 - RNA, 75 nt, Mus musculus
uccugucguccagaguuagcaguaggcaaucgucugcaaaaguacaaucaaagaauaaguaccugcacuccccag

SEQ ID NO: 46933 - RNA, 32 nt, Mus musculus
ucucuuuggacagcucuaacaacuguccucgc

SEQ ID NO: 46934 - RNA, 84 nt, Mus musculus
agaggcggccaguggccggggagcgaggacaguuguuagagcuguccaaagagagcagugaggaagaggaggaggaggaggagg

SEQ ID NO: 46935 - RNA, 59 nt, Mus musculus
ggaggagagcauucagacaucucccccucgguugacuaagccacagucaguuuccauua

SEQ ID NO: 46936 - RNA, 42 nt, Mus musculus
gguaccagguagucuccucagacagcgccaguuccugcccag

SEQ ID NO: 46937 - RNA, 45 nt, Mus musculus
acagagaagucagucuuguguuauggguagaaugagaggaaggag

SEQ ID NO: 46938 - RNA, 46 nt, Mus musculus
gcccuggcccgaagcugacauucacguagacauacugagcccucac

SEQ ID NO: 46939 - RNA, 56 nt, Mus musculus
uuuguaguaaagaagaaaaggggucguaaacgcaggaggaucaacagcagugucac

SEQ ID NO: 46940 - RNA, 46 nt, Mus musculus
guucugaggaaagcauucccacaucagccagggaagaaaaggcaga

SEQ ID NO: 46941 - RNA, 49 nt, Mus musculus
auuuuauccuuuccuuuuuuaaagacaggcucucacuauguagccccag

SEQ ID NO: 46942 - RNA, 51 nt, Mus musculus
accagcauaccugacccauucucccucuccuucucuccucuuuucaucuca

SEQ ID NO: 46943 - RNA, 42 nt, Mus musculus
acagagacagagagagacagagacagagacagacaagaagag

SEQ ID NO: 46944 - RNA, 41 nt, Mus musculus
aaacagguugaauucuaaguaaaacuggagagggagggagg

SEQ ID NO: 46945 - RNA, 45 nt, Mus musculus
agaauucaaccuguuugugccggucuuguaccuggugagccccca

SEQ ID NO: 46946 - RNA, 41 nt, Mus musculus
uugcccguauguguguaugaggaaucugaaugcaagccuuc

SEQ ID NO: 46947 - RNA, 29 nt, Mus musculus
ugccucugucucugccugaguauugggau

SEQ ID NO: 46948 - RNA, 45 nt, Mus musculus
cuggagcuuguacagaguccucucuaaaucaaguacaugcuguca

SEQ ID NO: 46949 - RNA, 46 nt, Mus musculus
cccagcaaaaauaguguuuuaauaagaaaugucuuaaggccccagu

SEQ ID NO: 46950 - RNA, 46 nt, Mus musculus
cuguucaaauauaagaucugauuuagaaugacaaucagcaaccaga

SEQ ID NO: 46951 - RNA, 45 nt, Mus musculus
uucuuaaugaggagacaaaaagacagaaaaacacacauuuuagga

SEQ ID NO: 46952 - RNA, 41 nt, Mus musculus
gacaauccugagccucuaaagugcagacaaguguggccaaa

SEQ ID NO: 46953 - RNA, 45 nt, Mus musculus
guacaccccaccagagacacccauggagccagaggaccaggugac

SEQ ID NO: 46954 - RNA, 79 nt, Mus musculus
aaagguagaugaggaggaccucaucagaggugaggaggagggagaggaagagggagaggaggagggagaacgagaagaa

SEQ ID NO: 46955 - RNA, 107 nt, Mus musculus
aacuacagaaaaagaccuagauggugcuaaaaguaaagagaacccggagccugagaucuccauggaaaaggaagacccugugcaucugggugaccaugaagaggacg

SEQ ID NO: 46956 - RNA, 42 nt, Mus musculus
gaccucccaagagaaaccuucaaagacgcacuagagggccag

SEQ ID NO: 46957 - RNA, 49 nt, Mus musculus
aaagacugaacagccugggcggucucggagucaauuuccacagcggcug

SEQ ID NO: 46958 - RNA, 46 nt, Mus musculus
uauaguucugcaggcuucuacaggccucuugagucucagcacaauc

SEQ ID NO: 46959 - RNA, 46 nt, Mus musculus
ccaaaguccucaaauugccaccacgcuggacgagugccaacaguca

SEQ ID NO: 46960 - RNA, 65 nt, Mus musculus
cccugcccuagagaauagcuaugcccaaaucagccccgaucagacugccaucacagugccaccuc

SEQ ID NO: 46961 - RNA, 45 nt, Mus musculus
gccagcagcuggcucagugcagcauggccgccaauuucaccccac

SEQ ID NO: 46962 - RNA, 45 nt, Mus musculus
aaggcaaugaaugaucaauaaguguauuaguuaacugcugcaguu

SEQ ID NO: 46963 - RNA, 46 nt, Mus musculus
ucccuggagggccccaagcacaagcuaccaugaccccacccccuaa

SEQ ID NO: 46964 - RNA, 64 nt, Mus musculus
gccaauauuugaugcagccauguuccgcugcaggagaggugguggcagauucaugggaggagga

SEQ ID NO: 46965 - RNA, 46 nt, Mus musculus
auacaguaauugaaaugcuaaaggcauuuccauggaguagacagga

SEQ ID NO: 46966 - RNA, 46 nt, Mus musculus
caggcuccuuuggggggaggcagcuuucuguuuuauaaaugcacac

SEQ ID NO: 46967 - RNA, 45 nt, Mus musculus
caaaagcuguacauuuuaacauaaaauaaauuaugaugagccauu

SEQ ID NO: 46968 - RNA, 42 nt, Mus musculus
gaugggggaaauaaauuauuuaguguaaauugaaguuaugag

SEQ ID NO: 46969 - RNA, 85 nt, Mus musculus
gaggugagcgggcgccgaggcugaugagaggggagauuggggggcgccugcaaccaagggugaguggagagucgggggcgccaag

SEQ ID NO: 46970 - RNA, 42 nt, Mus musculus
uggguccuugcuacccggcuaggggagaaggaacgugcaaga

SEQ ID NO: 46971 - RNA, 49 nt, Mus musculus
ccagaccuggaggaggaggugcccuggguuguagccauagagaugaggg

SEQ ID NO: 46972 - RNA, 44 nt, Mus musculus
augguggcugguuucgcagggcgggaguuaggguugccuggaaa

SEQ ID NO: 46973 - RNA, 39 nt, Mus musculus
augcaucgcugauucucguacagggacugggggaggcga

SEQ ID NO: 46974 - RNA, 42 nt, Mus musculus
uugguucagaauauucuguuacauugacuagcuuuggggaga

SEQ ID NO: 46975 - RNA, 45 nt, Mus musculus
uuuaguguuagggauccaguucaggccuucuucaagucagucaag

SEQ ID NO: 46976 - RNA, 46 nt, Mus musculus
uagcuaccaucugagcagagaaauugacuuuuguaaaacugagcag

SEQ ID NO: 46977 - RNA, 45 nt, Mus musculus
auugccugagcuaucuuuccaguuccccaugacuuuaaacauuaa

SEQ ID NO: 46978 - RNA, 42 nt, Mus musculus
augcugugucuguguguuguguguguguguguguguguguga

SEQ ID NO: 46979 - RNA, 45 nt, Mus musculus
auugccugagcuaucuuuccaguuccccaugucuuuaaacauuaa

SEQ ID NO: 46980 - RNA, 46 nt, Mus musculus
guguguguguguuguguguguguguguguguguguguguguaugug

SEQ ID NO: 46981 - RNA, 45 nt, Mus musculus
guccaggaacucacucuguagaccaggcuggcaucagacucagag

SEQ ID NO: 46982 - RNA, 42 nt, Mus musculus
uuagcaucaggaaccggccuuauaguugcaggucgccucuga

SEQ ID NO: 46983 - RNA, 46 nt, Mus musculus
acauagauuuaaaacaagauggcuaagagaaagaaggaaggagggg

SEQ ID NO: 46984 - RNA, 45 nt, Mus musculus
ucugcccuaggguaauuuuucucauuagcagcaaaauaacauuua

SEQ ID NO: 46985 - RNA, 46 nt, Mus musculus
uaacuauucuguaguagcgcacaauuaaaggacaugcacuaaccug

SEQ ID NO: 46986 - RNA, 42 nt, Mus musculus
agguuaaaucaggagaccagaggaucaucugauugggaggag

SEQ ID NO: 46987 - RNA, 46 nt, Mus musculus
ugggcccaucccugacuugaguucugaucaguaccaguacaugaau

SEQ ID NO: 46988 - RNA, 45 nt, Mus musculus
uucaugagcgugugccugacaugcagaccuacccaccacucccag

SEQ ID NO: 46989 - RNA, 42 nt, Mus musculus
cuagauucuccagaaaugucauaauaaaacccagggggaauc

SEQ ID NO: 46990 - RNA, 26 nt, Mus musculus
ccguugugccaggaggaguaauggga

SEQ ID NO: 46991 - RNA, 45 nt, Mus musculus
uggaagaucuccuucuauucagugacauaggaaaauuggguuuag

SEQ ID NO: 46992 - RNA, 46 nt, Mus musculus
ugagacuugcaucucaaagccagauugugguccuccauggcugcug

SEQ ID NO: 46993 - RNA, 45 nt, Mus musculus
aguauaucuuuaaugcuccuaugcauauuagauagcuuguugcag

SEQ ID NO: 46994 - RNA, 46 nt, Mus musculus
gcaugcagagaauucuuuucuucuggaaaaaaacaaaacagaacag

SEQ ID NO: 46995 - RNA, 42 nt, Mus musculus
cauucccgaccauggaaaguacacagucugagacaugggugg

SEQ ID NO: 46996 - RNA, 99 nt, Mus musculus
cuaaccauaaugaagauagaauuuauguuuacauuuugggcaugauguggcugcgugcagucuccacgcuuuugaaccccguauuugauucugcagucg

SEQ ID NO: 46997 - RNA, 46 nt, Mus musculus
gucgcugcccucccugugguguuaagcccagggcugugugugcgag

SEQ ID NO: 46998 - RNA, 46 nt, Mus musculus
gacaagaacggucuuuagaauaguccacuugcuuuccuucagacag

SEQ ID NO: 46999 - RNA, 41 nt, Mus musculus
cauacaccaguuacuuuuuguacaauaaagaaauggggaca

SEQ ID NO: 47000 - RNA, 42 nt, Mus musculus
agucccagcaggggaggacauggcggugggcggugaaccgag

SEQ ID NO: 47001 - RNA, 42 nt, Mus musculus
gcgagccgagcgguggcggcagcgccccucaggacacccgca

SEQ ID NO: 47002 - RNA, 45 nt, Mus musculus
agacauagaugguuguauuuuuugcccgugucucaauugugccag

SEQ ID NO: 47003 - RNA, 46 nt, Mus musculus
gggaaagccuguacuuuauucuuuuaagugacaguucagaccaugg

SEQ ID NO: 47004 - RNA, 45 nt, Mus musculus
gcacuguucuccuucuucucuagaaguuuuuauugugagauugga

SEQ ID NO: 47005 - RNA, 46 nt, Mus musculus
guugcauuuguggcuuuuauauuugucuuguccugugguuucuuug

SEQ ID NO: 47006 - RNA, 46 nt, Mus musculus
uaaaacaaacaaaaacacccuuucuauuggaaagacaaacuguaag

SEQ ID NO: 47007 - RNA, 47 nt, Mus musculus
auggugugaguauggucugacuuucacagagaaguggaacaccgaua

SEQ ID NO: 47008 - RNA, 45 nt, Mus musculus
guguacuuacauauaaauaaauaaaucuuuaaaaaaaaaagaaaa

SEQ ID NO: 47009 - RNA, 46 nt, Mus musculus
ucuaacaccauuuuuacaggugaagagacucuaguuugaccgaaag

SEQ ID NO: 47010 - RNA, 47 nt, Mus musculus
acucuucucagcacaguggucucuuuuacauuaaguguucuugucag

SEQ ID NO: 47011 - RNA, 100 nt, Mus musculus
aacgaauaucagaagauuuggccuuaauauauuuccaugcgaccagcaggcuccccuuccuucccccagaaggugaucacaucaaaggaugaugaagcaa

SEQ ID NO: 47012 - RNA, 45 nt, Mus musculus
gugcuacccaccaaugaugaaauagacguuuaugaaaaccgugcc

SEQ ID NO: 47013 - RNA, 46 nt, Mus musculus
uagcagcugcuaagugcacaucacuugggccuuucuuaccccagag

SEQ ID NO: 47014 - RNA, 43 nt, Mus musculus
uugcaaggucaggcugagaacaucucgccacccgguggcugca

SEQ ID NO: 47015 - RNA, 45 nt, Mus musculus
cauguuccaccagaggauaccggagccacucaguacucacugcga

SEQ ID NO: 47016 - RNA, 46 nt, Mus musculus
ggcaacacccaaagugcuucaguuuccuccucguuugagaggccag

SEQ ID NO: 47017 - RNA, 45 nt, Mus musculus
cuguacuuguguggggagccuucucugagagacuagggacucugg

SEQ ID NO: 47018 - RNA, 46 nt, Mus musculus
uucuauaaaaagucaaaugauuuuuuuucaacuuuuauaaaguuug

SEQ ID NO: 47019 - RNA, 46 nt, Mus musculus
gaagcgcuugucgcacggcccauuagcagacacccaguugcagaug

SEQ ID NO: 47020 - RNA, 42 nt, Mus musculus
guguggcaagaacuggggcggguagccagcguaggccccagc

SEQ ID NO: 47021 - RNA, 45 nt, Mus musculus
cuugaggauguccaguugucgaccucgguaguguucccaccccag

SEQ ID NO: 47022 - RNA, 45 nt, Mus musculus
cucuucuuuuguugucaaguccuuuugauaaaugguggggcuggg

SEQ ID NO: 47023 - RNA, 46 nt, Mus musculus
uucacagaguuuugauuuuauuccuugauuccuuagguuggcaaag

SEQ ID NO: 47024 - RNA, 42 nt, Mus musculus
uaggccuggagagugagaguugacgcuguggacagaacugag

SEQ ID NO: 47025 - RNA, 46 nt, Mus musculus
gguacccauaugcagaggucagccuacaacacauucauuaagggaa

SEQ ID NO: 47026 - RNA, 46 nt, Mus musculus
ggagcaaaccaagcugauaugauuaggacagaauaucuuuuuagua

SEQ ID NO: 47027 - RNA, 46 nt, Mus musculus
ucacaucccagugggauguauugguuugacucuugccgugugugac

SEQ ID NO: 47028 - RNA, 45 nt, Mus musculus
uuuauuuuuguuucaugugcauugguguuuugcccgcuuguguau

SEQ ID NO: 47029 - RNA, 46 nt, Mus musculus
uguuuguuugugguccucuggcuucacagcccacuguugccaaggu

SEQ ID NO: 47030 - RNA, 46 nt, Mus musculus
accaccaggugucugggguaggccgguuuucccaaaggggccccua

SEQ ID NO: 47031 - RNA, 46 nt, Mus musculus
gauauuucuggucaggguuugaaaauaaacacucaguuccccacuc

SEQ ID NO: 47032 - RNA, 32 nt, Mus musculus
aggacaaaaggauccacacauaggcagcagag

SEQ ID NO: 47033 - RNA, 46 nt, Mus musculus
gacuccuucuguaguugucccucauuacaaaguucuagacgcagau

SEQ ID NO: 47034 - RNA, 46 nt, Mus musculus
ccaacaccaauauugguuuaaucucuaucauacaaaacuucuuguu

SEQ ID NO: 47035 - RNA, 45 nt, Mus musculus
auccucaggcuuugcagguagcagccagagccagcucggcagcaa

SEQ ID NO: 47036 - RNA, 46 nt, Mus musculus
gcugcuguuacuaauauauuauucugacacacaaugaacugcaaaa

SEQ ID NO: 47037 - RNA, 46 nt, Mus musculus
cuacacaauacccuggaccaucgguguguuuauuaugcauagcagg

SEQ ID NO: 47038 - RNA, 51 nt, Mus musculus
cuaauguucagaaggauaaguaaugggagauugccucaccucuauccccga

SEQ ID NO: 47039 - RNA, 24 nt, Mus musculus
caggagaaagcuguggccccgacc

SEQ ID NO: 47040 - RNA, 45 nt, Mus musculus
caguacaguagagcuggcccugaauguggggcuuguaggugagcc

SEQ ID NO: 47041 - RNA, 56 nt, Mus musculus
gacccaagguuuccauucaaaggaugcagaacaucugcgugauggugcuacuccac

SEQ ID NO: 47042 - RNA, 41 nt, Mus musculus
ugucugucugucugucugucugucugucugucggaucuuac

SEQ ID NO: 47043 - RNA, 46 nt, Mus musculus
agugacugaucccagggagggagaaagaagagguggagccagggga

SEQ ID NO: 47044 - RNA, 46 nt, Mus musculus
uggcacaggagggagguccaucuacggaagccgcuuucccgacgag

SEQ ID NO: 47045 - RNA, 42 nt, Mus musculus
aguucaggggucgcagugggggcgcugauugaaaccccagcu

SEQ ID NO: 47046 - RNA, 41 nt, Mus musculus
cuggguguuuucuuacuuggcucaacccuccccacaggcua

SEQ ID NO: 47047 - RNA, 45 nt, Mus musculus
augucuugauucacccagguucuccaaagaacaguuugcacccac

SEQ ID NO: 47048 - RNA, 45 nt, Mus musculus
ugguccucccagaccaggcugcucuccacuguccauccugccuca

SEQ ID NO: 47049 - RNA, 46 nt, Mus musculus
caucggcugaggguacauggcccgauggccauacugaugcccagaa

SEQ ID NO: 47050 - RNA, 46 nt, Mus musculus
uuuaauguugucuuccuccuugcaauaauuuaacauagaauucaag

SEQ ID NO: 47051 - RNA, 41 nt, Mus musculus
uuucgaugagaucuugaauucuauguuaaauuauugcaagg

SEQ ID NO: 47052 - RNA, 42 nt, Mus musculus
ggagucaauguuccaugccuguaaucccaacagcauugagga

SEQ ID NO: 47053 - RNA, 46 nt, Mus musculus
ccaucaggucccuuugacugugcuccauagauaguccuaguagacc

SEQ ID NO: 47054 - RNA, 42 nt, Mus musculus
uucccagcaaccacauggugucucacaaccaucuguaauugg

SEQ ID NO: 47055 - RNA, 45 nt, Mus musculus
gucucugucugaguguguaugugcacauguguguucaagugccca

SEQ ID NO: 47056 - RNA, 46 nt, Mus musculus
cuccuguccuuggaaggaggcucugucagccuccuggggccaucag

SEQ ID NO: 47057 - RNA, 46 nt, Mus musculus
ucagcccuguuugggaagagggcagcuuuucugacugcuaccccag

SEQ ID NO: 47058 - RNA, 46 nt, Mus musculus
cuggcucauugcuggcuugauguccgguaaugcuuaguuuucugaa

SEQ ID NO: 47059 - RNA, 46 nt, Mus musculus
aguaaggauugucagugccgggugauuugaacuguuuauuuacgug

SEQ ID NO: 47060 - RNA, 42 nt, Mus musculus
gggcacacgccacaugcagauuuaggugcuuucccaaccuuc

SEQ ID NO: 47061 - RNA, 44 nt, Mus musculus
cuuuuguuguuguuaaagcuauaaaaauugcuuaaauaccagga

SEQ ID NO: 47062 - RNA, 46 nt, Mus musculus
aagugauucuguauuuuauuugagacaggaauaacaaucuccaaag

SEQ ID NO: 47063 - RNA, 45 nt, Mus musculus
auaggaaauuuauguggauacauacaaaccacaugcaaacagcag

SEQ ID NO: 47064 - RNA, 45 nt, Mus musculus
ccugacaugguugcauggcugcuggaaaucaaacucggguccuuu

SEQ ID NO: 47065 - RNA, 46 nt, Mus musculus
aauauaauuuaggcugaaggcaugugaauagcuaguuugggcauag

SEQ ID NO: 47066 - RNA, 42 nt, Mus musculus
auguguguguguguguguguguguguguguaagagguaagca

SEQ ID NO: 47067 - RNA, 45 nt, Mus musculus
uccuccaacaccaccaccaccaccaacaaauaaccaccaccacca

SEQ ID NO: 47068 - RNA, 42 nt, Mus musculus
caccaaauaaccccucuccuccaacaccaccaccaccaacag

SEQ ID NO: 47069 - RNA, 45 nt, Mus musculus
caacaacaaauaaccccuuuccuccaacaccaccaccaccaacag

SEQ ID NO: 47070 - RNA, 41 nt, Mus musculus
gcacaugugccagugugcugccaugcauguguggaggccag

SEQ ID NO: 47071 - RNA, 45 nt, Mus musculus
ucuaccgguucugggaguugaacucaguucaucagauuugaguag

SEQ ID NO: 47072 - RNA, 41 nt, Mus musculus
ugccuuuaaucucagcacuugggaggcagaggcaaggggaa

SEQ ID NO: 47073 - RNA, 47 nt, Mus musculus
caagaaguaguuguagaugugugugugugugugugugugugugugag

SEQ ID NO: 47074 - RNA, 45 nt, Mus musculus
auuuugaugugcaguauuaaaguguuuuauguuguuaugacugga

SEQ ID NO: 47075 - RNA, 46 nt, Mus musculus
ugccacacacgugugagugccugaguggaggccugagagggcauca

SEQ ID NO: 47076 - RNA, 45 nt, Mus musculus
acauuucuuguuagaaauguuguuacuaccucaguagguccugga

SEQ ID NO: 47077 - RNA, 42 nt, Mus musculus
cgugagcacucuguugcccuauuugugugugugugugggggg

SEQ ID NO: 47078 - RNA, 45 nt, Mus musculus
uaaaagcuccuauaguaaugacuggaauauaucuuuguaccuuag

SEQ ID NO: 47079 - RNA, 42 nt, Mus musculus
uguucucuaucuuugauaacucugucuuuuaaacccuggcag

SEQ ID NO: 47080 - RNA, 46 nt, Mus musculus
ugauaauucagggaacagcuuacucuacucacaaaagagaugggag

SEQ ID NO: 47081 - RNA, 45 nt, Mus musculus
aguguacuuacauauaauaaauaaauaaaucuaaaaaaauuaaaa

SEQ ID NO: 47082 - RNA, 46 nt, Mus musculus
aaccuccaccauccagaaugcauagaguuaaacugauuggcgucgg

SEQ ID NO: 47083 - RNA, 42 nt, Mus musculus
uccuaaugcuacuauugguuccucaaggucuuguugccccag

SEQ ID NO: 47084 - RNA, 46 nt, Mus musculus
gggcacagugccauguaccggcuacuugggaacccaugaguucaag

SEQ ID NO: 47085 - RNA, 45 nt, Mus musculus
aaauuuuguugaaacaugacuucccaauucauuuuaacuggagca

SEQ ID NO: 47086 - RNA, 46 nt, Mus musculus
uguggcaagcuugaugccuuugcagaaaaguauuucuccuuggaag

SEQ ID NO: 47087 - RNA, 45 nt, Mus musculus
auacauaauuucaaaggcauuaugucaaguaaucacuugcccaaa

SEQ ID NO: 47088 - RNA, 46 nt, Mus musculus
cgugcccagcccuaacuuggauuucuuauauuugcaauacuuggag

SEQ ID NO: 47089 - RNA, 46 nt, Mus musculus
agcguuuucuccuccgcccacucgguugugagccggaaccgugaag

SEQ ID NO: 47090 - RNA, 46 nt, Mus musculus
gucgauguuacugucauugucagagucuugugauggcuaaagggau

SEQ ID NO: 47091 - RNA, 45 nt, Mus musculus
aacacuguauacauaauaaauaaauaaaucuuaaaaaaaaaaaaa

SEQ ID NO: 47092 - RNA, 45 nt, Mus musculus
aaauaaauaaaucaaaaaaagaacucuucauagaagaauugaaag

SEQ ID NO: 47093 - RNA, 44 nt, Mus musculus
ucuaguuggauuggaugcugcuggcaagacgacaauucuguaua

SEQ ID NO: 47094 - RNA, 46 nt, Mus musculus
guacuggcuuaaaauucagacugagucaaugggacaagcuucuuag

SEQ ID NO: 47095 - RNA, 52 nt, Mus musculus
aauuguaauauuugcagauaucuucuaaauucuuacugccaccuuuuuguua

SEQ ID NO: 47096 - RNA, 44 nt, Mus musculus
cgugaauuuaaaagagagcagagaguuugggguuacaugggaga

SEQ ID NO: 47097 - RNA, 42 nt, Mus musculus
gggucucauuuuugugguagauagcaaugaucgugaaagaau

SEQ ID NO: 47098 - RNA, 46 nt, Mus musculus
cuuucuuagaggcaaaucuuuauuugcucaaacugagggauaugag

SEQ ID NO: 47099 - RNA, 42 nt, Mus musculus
ucagcugucuguuaguauuguuguaguuguuacuguuuggag

SEQ ID NO: 47100 - RNA, 46 nt, Mus musculus
cucaaagacaucuggucaccucugcauaugccauguuggcccaguu

SEQ ID NO: 47101 - RNA, 46 nt, Mus musculus
cuggauaucuaaccaaggacauguuugauagaauuggucuaggcuu

SEQ ID NO: 47102 - RNA, 47 nt, Mus musculus
guuugcaucuugguuauuaaaggauaucugagacagguuugggcaga

SEQ ID NO: 47103 - RNA, 47 nt, Mus musculus
aaccuaaaugccuggauacagagcuauccugacaccuuuagacagau

SEQ ID NO: 47104 - RNA, 41 nt, Mus musculus
cacuauucaguuuucuuguacugaggauccccccaccccac

SEQ ID NO: 47105 - RNA, 46 nt, Mus musculus
cugguugcaaagaguucauauugagauaacuuuuaauacucagcag

SEQ ID NO: 47106 - RNA, 45 nt, Mus musculus
ggacucugggggcccuguacauguggugaacagacauacaugaag

SEQ ID NO: 47107 - RNA, 45 nt, Mus musculus
gauauaauuugugaggauggagggaaccugaaccuguauauggca

SEQ ID NO: 47108 - RNA, 42 nt, Mus musculus
gauccccaggaagagcagagaaaagaaagguggugccucccc

SEQ ID NO: 47109 - RNA, 42 nt, Mus musculus
aaagauggugcucggugccccucuuuucccccaagccccgaa

SEQ ID NO: 47110 - RNA, 45 nt, Mus musculus
gagaaaccaugcagagaaggaugaaguugaucuuugccggcugaa

SEQ ID NO: 47111 - RNA, 46 nt, Mus musculus
uuuuuacugaaaauaauucuuaauaucuuacuguaaaucaggcagc

SEQ ID NO: 47112 - RNA, 46 nt, Mus musculus
uuugaauuucaauuuuauaguuaaaaacauugucacuuuagaacag

SEQ ID NO: 47113 - RNA, 45 nt, Mus musculus
cucucucucucuuuaaacaucacuuaauuggauauagugugcaac

SEQ ID NO: 47114 - RNA, 46 nt, Mus musculus
cgauucuuugugguagguauauguccauuuuacagaaaaacugaag

SEQ ID NO: 47115 - RNA, 46 nt, Mus musculus
guauaguugauuaugcugagaagucauaacagcacaagccuggcag

SEQ ID NO: 47116 - RNA, 42 nt, Mus musculus
uugaaagcaguaauuuuucuacauagacguaaaccugggcag

SEQ ID NO: 47117 - RNA, 45 nt, Mus musculus
agucagugcucuuaagcgcugagccaucucuccaguucccgcgaa

SEQ ID NO: 47118 - RNA, 48 nt, Mus musculus
gaaacauuuagucccauccauuggcuacuuaaguuauaguuacuuuua

SEQ ID NO: 47119 - RNA, 46 nt, Mus musculus
guuuagcauaucauguauauauaguauauaagaacuacacugacac

SEQ ID NO: 47120 - RNA, 46 nt, Mus musculus; identical to SEQ ID NO: 47119

SEQ ID NO: 47121 - RNA, 46 nt, Mus musculus
uuuagagcuacuauugugauacaugccuaguuaguuaaagauccag

SEQ ID NO: 47122 - RNA, 46 nt, Mus musculus
auuuucaguggaacccaaggguuacuuuuaauauuuauugaccuug

SEQ ID NO: 47123 - RNA, 46 nt, Mus musculus
accaaagaaugguaccccagacucaaauauguacacaaaggcaaag

SEQ ID NO: 47124 - RNA, 46 nt, Mus musculus
uaaagaaaauaaaaaugugacgguuuaauguaguuucaugguauag

SEQ ID NO: 47125 - RNA, 46 nt, Mus musculus
ggaacuuucagaaucuuaugcauuucucaugguugaucgguaccag

SEQ ID NO: 47126 - RNA, 46 nt, Mus musculus
uauagacauucccuguaaccuaacguuuuuauuaauguauaaguag

SEQ ID NO: 47127 - RNA, 46 nt, Mus musculus
ucaaauuauuuuuuucuuuuagguaucuaucuuuguagguaugcag

SEQ ID NO: 47128 - RNA, 48 nt, Mus musculus
acuuuaaaacauaagcagucuuuucguucccccaauuucucucagauc

SEQ ID NO: 47129 - RNA, 58 nt, Mus musculus
auauuaucuguggauuuguguggauguuuuauaugcugccaaucucuuuuauaugcua

SEQ ID NO: 47130 - RNA, 42 nt, Mus musculus
cacuaagagggauuuuauuuuauuaauauguucgguucgcag

SEQ ID NO: 47131 - RNA, 41 nt, Mus musculus
agguuguauagggcaaccaguaaccauggcaauagccugug

SEQ ID NO: 47132 - RNA, 46 nt, Mus musculus
aaauaaauacuuaagaaaaaaaaaacuaaaauagaaaucaguuuuc

SEQ ID NO: 47133 - RNA, 29 nt, Mus musculus
aaaaugagaacaaauuauaaacaacuaga

SEQ ID NO: 47134 - RNA, 46 nt, Mus musculus
aaauuccuccuucauucuuuuauaaagacacauaugugggucccaa

SEQ ID NO: 47135 - RNA, 46 nt, Mus musculus
gaauggaauguauuguagccuuuaugaaguuguagaaaagacaaga

SEQ ID NO: 47136 - RNA, 45 nt, Mus musculus
acaugaaagcugaacagcgcucuacucaaugauaacuuggucaag

SEQ ID NO: 47137 - RNA, 46 nt, Mus musculus
aggaggaaaacuuauaguucuaagugccuccaaaaagaaacugaag

SEQ ID NO: 47138 - RNA, 45 nt, Mus musculus
cuacaucacaguccuuucagcaaaaucuugcugguguaugcaaua

SEQ ID NO: 47139 - RNA, 44 nt, Mus musculus
guucuuuugugauugggcuaccucacucaggaugauacccucca

SEQ ID NO: 47140 - RNA, 46 nt, Mus musculus
gacugauuuccagggugguuguacaaacuugcaaucccaccaacaa

SEQ ID NO: 47141 - RNA, 46 nt, Mus musculus
ucuucauuuguuuguacaagcauuaaaauucuuaucaaugcccuga

SEQ ID NO: 47142 - RNA, 48 nt, Mus musculus
guacagagagaauaccuaguuuugguagagucagguuagaugucagau

SEQ ID NO: 47143 - RNA, 23 nt, Mus musculus
uaucuuguagugauaucagucuu

SEQ ID NO: 47144 - RNA, 46 nt, Mus musculus
aauauaccuuuauauuuagaucucuuacuugccucugaaugcccaa

SEQ ID NO: 47145 - RNA, 46 nt, Mus musculus
gaagcuaacuauuuagaguuuguacaguaagagguuaugguaucug

SEQ ID NO: 47146 - RNA, 46 nt, Mus musculus
acagagaaacccugucuaaaaauaaaacaaagcaaaacagccccac

SEQ ID NO: 47147 - RNA, 46 nt, Mus musculus
ucaucucuccagccuccucccugaacuauucuugaaacucugccuu

SEQ ID NO: 47148 - RNA, 46 nt, Mus musculus
uucaguauuuuuuguugguagguugaccccuaaccccuugugccga

SEQ ID NO: 47149 - RNA, 66 nt, Mus musculus
cuuagugauuuuaaaguaucauauacgauauuuagcaugaggccuuucagaguuaacuagaauuug

SEQ ID NO: 47150 - RNA, 46 nt, Mus musculus
aaacauguuauaccuggagcagguacaacuguagcuacucgaugcg

SEQ ID NO: 47151 - RNA, 48 nt, Mus musculus
aaagguauaaugaauacaacaccacuggagaagccugagaacuuagca

SEQ ID NO: 47152 - RNA, 46 nt, Mus musculus
aaaaguauguaagugaauuuuuuaagcgagguuuugguucggguaa

SEQ ID NO: 47153 - RNA, 44 nt, Mus musculus
aaaucccauauugaugacugcuuacauaccuacauuuaccagcc

SEQ ID NO: 47154 - RNA, 45 nt, Mus musculus
uuauuugaggaaaauuggagacgccagcaguuuaguccacuguca

SEQ ID NO: 47155 - RNA, 46 nt, Mus musculus
guggagauccagauccagaagauacaaaaagcaaaaaugucuugaa

SEQ ID NO: 47156 - RNA, 50 nt, Mus musculus
acagcagggaagucauugcaguggcuuuauacuuucuccugauauccacu

SEQ ID NO: 47157 - RNA, 46 nt, Mus musculus
uucuuuuacaacaaguuaugcucuucaaguguauguuaggccucag

SEQ ID NO: 47158 - RNA, 46 nt, Mus musculus
uaguuauuuacuauguuguuugugaugaugacaaugccucaagcag

SEQ ID NO: 47159 - RNA, 44 nt, Mus musculus
aaguuagcuccuauacuuuaaauuuuguuuaugcagugagagau

SEQ ID NO: 47160 - RNA, 45 nt, Mus musculus
acaguuuuacuucucugcuuuucuaaugcguuuguuucguacuag

SEQ ID NO: 47161 - RNA, 46 nt, Mus musculus
ccacuaaguuacccagauuggcuuuuaacucauuccuuaguccaac

SEQ ID NO: 47162 - RNA, 46 nt, Mus musculus
acaguccauuggcuuacuuggacaggauccuaacuugagagugcag

SEQ ID NO: 47163 - RNA, 46 nt, Mus musculus
ccacuacuacucaauccuaaagccuuguugacugucucggucagga

SEQ ID NO: 47164 - RNA, 45 nt, Mus musculus
cgagacagucaacaaggcuuuaggauugaguaguaguggugccua

SEQ ID NO: 47165 - RNA, 45 nt, Mus musculus
agaggguuuagguguacuucagggagugcauuuuccuucccaaaa

SEQ ID NO: 47166 - RNA, 46 nt, Mus musculus
uuuguagacaaaucauuuccuguauuagucuuucuuaaacgaguag

SEQ ID NO: 47167 - RNA, 41 nt, Mus musculus
ggauccgaauuuaauuaaugucaauaauuuugaagggugca

SEQ ID NO: 47168 - RNA, 69 nt, Mus musculus
uuguggacuugagcgggauauuaucaauugaaaacuguugacagcaauuuggagaaggagguguuggaa

SEQ ID NO: 47169 - RNA, 45 nt, Mus musculus
uuucauuuuucaaucuuauaauuguguugauaaauuuuuaggcaa

SEQ ID NO: 47170 - RNA, 46 nt, Mus musculus
ucagugcuguuacugaaauccaaagcguagccuauaaguagagcag

SEQ ID NO: 47171 - RNA, 46 nt, Mus musculus
gagcuuccuagagugagcgagauuacagaaaauacaguguuaggag

SEQ ID NO: 47172 - RNA, 45 nt, Mus musculus
cuucugaucacacuguaccuggugauacaguccuggaacccacag

SEQ ID NO: 47173 - RNA, 54 nt, Mus musculus
uuugguuaaaaucaugaaagacguccagaaaaauacugugaaguuuuacauuca

SEQ ID NO: 47174 - RNA, 46 nt, Mus musculus
gggcacuauauggugcauguauggaaguccuaagauaauuugcgag

SEQ ID NO: 47175 - RNA, 76 nt, Mus musculus
uccauuuucagugacaaguuucugccuguuuuguuagaggaagcagaaggauuaaaaauaacuuaaaauaguucag

SEQ ID NO: 47176 - RNA, 29 nt, Mus musculus
ggaguaucuuaccaaauuaggaaauacag

SEQ ID NO: 47177 - RNA, 46 nt, Mus musculus
ccauucauggggaacuggcuuauuucuguauuuuccugagccucug

SEQ ID NO: 47178 - RNA, 46 nt, Mus musculus
gacacauccagcuguguguguugggggugugaauuggguccucaug

SEQ ID NO: 47179 - RNA, 46 nt, Mus musculus
aagugcuguauaggcauauaccaucaaaauuggugcuaggucacag

SEQ ID NO: 47180 - RNA, 47 nt, Mus musculus
cuggacacucacaccuagugugaguguugugacuaagugaccuugug

SEQ ID NO: 47181 - RNA, 45 nt, Mus musculus
uugugugaguaguguguaauuaauaacuaaacaaauuguauuaca

SEQ ID NO: 47182 - RNA, 85 nt, Mus musculus
gaagaggauaugucccuggauucaggggaugaaaucucacauauagaaguauucagcaauguucauucagaaauauuggcgggag

SEQ ID NO: 47183 - RNA, 47 nt, Mus musculus
aucaguuacaaaugucccaucaguguagucauuuuaauguucucacg

SEQ ID NO: 47184 - RNA, 93 nt, Mus musculus
agacguuucuggggacaccauaugcccuuucaucaacucggucucaagaaaaugaaaauuacuuuuuaucugcuuacaaaaacucggguacag

SEQ ID NO: 47185 - RNA, 46 nt, Mus musculus
uuaguaccucaagcuauauuuaacaguacaguugaauucuagguag

SEQ ID NO: 47186 - RNA, 45 nt, Mus musculus
guguugucuagcuagaacauuuucuacuaugagaacaacagggau

SEQ ID NO: 47187 - RNA, 45 nt, Mus musculus
ccacuauuggauuucuaaagugaaaucuacucucaagugcucuaa

SEQ ID NO: 47188 - RNA, 46 nt, Mus musculus
uucuucggguuaaccuucuucuuuccacccccccgccuuuccagag

SEQ ID NO: 47189 - RNA, 45 nt, Mus musculus
ccacaggcuagcuguccaucaaccgcucaagccaccaagcggcag

SEQ ID NO: 47190 - RNA, 46 nt, Mus musculus
gcagcucugauggcgacuugugcgauuucagcggcaucucccggag

SEQ ID NO: 47191 - RNA, 44 nt, Mus musculus
cacacacacacacagacacacacacacacacacagagcagcagc

SEQ ID NO: 47192 - RNA, 66 nt, Mus musculus
ugagcgcgugucucugugucugcgugugugugcguuuguguguguguauguguguguguuugggug

SEQ ID NO: 47193 - RNA, 46 nt, Mus musculus
cccagagaggaggagcugacaaucaggaggcgugagccgccuggag

SEQ ID NO: 47194 - RNA, 42 nt, Mus musculus
cgcagcgacccggagcggaagcgagcacuggcgcccggacuc

SEQ ID NO: 47195 - RNA, 45 nt, Mus musculus
agcuuucuccaggcaguuagagaaauggagaggauagggauagau

SEQ ID NO: 47196 - RNA, 46 nt, Mus musculus
gagucaaccuagugcuuuggagacucuagggccucugcguuucgag

SEQ ID NO: 47197 - RNA, 45 nt, Mus musculus
gggggggggggauuuggaggagacaauguuguaaguacccagcaa

SEQ ID NO: 47198 - RNA, 41 nt, Mus musculus
acacagauuguccccuggcggagaccuuagaagggucuugg

SEQ ID NO: 47199 - RNA, 42 nt, Mus musculus
agcuacaggacacacauaaaagugcucagcucccaacuagag

SEQ ID NO: 47200 - RNA, 46 nt, Mus musculus
cgcauccuggagagaauggaaauguggaguuuccccagucuaagag

SEQ ID NO: 47201 - RNA, 44 nt, Mus musculus
cugcucccacuggugauuuuuccaccugcaggcggcggcggaga

SEQ ID NO: 47202 - RNA, 42 nt, Mus musculus
gggaccagagggagaguaaaaagucagaauaaugggguccaa

SEQ ID NO: 47203 - RNA, 46 nt, Mus musculus
auuuccuuuaggaucugcuucagccaguuuggggcggggaguagau

SEQ ID NO: 47204 - RNA, 44 nt, Mus musculus
auaaucaguuuacggggccgauuuugggaaagccacuuccagau

SEQ ID NO: 47205 - RNA, 51 nt, Mus musculus
cucccgggcuuaauauuccaaugggcuucuggagaggaaagaaaggagcag

SEQ ID NO: 47206 - RNA, 46 nt, Mus musculus
ccuucacguacgcggugagcgcagcugggguggugaacgccaugag

SEQ ID NO: 47207 - RNA, 86 nt, Mus musculus
ugcggagacaacaucgacuauggcuaccgcuucgccaaggaguucguggacgcuagagaaagggaacgaauccacgcuaaggguuc

SEQ ID NO: 47208 - RNA, 45 nt, Mus musculus
agaaagaaagaaagaaagaaagagaaaaagaaaagaaaagaaaag

SEQ ID NO: 47209 - RNA, 105 nt, Mus musculus
ugcaaguuucacuggugcugcuaugucaaaugcaagaagugcacggagauuguggaucaguucgugugcaaauaguggugugccugcccuucacccagucccacu

SEQ ID NO: 47210 - RNA, 46 nt, Mus musculus
aaacaaaacaaaacacaugguuccagcugcaauucuugggggagaa

SEQ ID NO: 47211 - RNA, 96 nt, Mus musculus
uuguuuuauuuuguuuuuucuuuucuguuaccaucuaagaacucugugguuuauuauuaauauuauaauuaauauuuggcaauagugggggaaacu

SEQ ID NO: 47212 - RNA, 65 nt, Mus musculus
ggauaaaggggaaaaacuauguauucgaacuuagcugugcaguuggggguucacaucuagaaggu

SEQ ID NO: 47213 - RNA, 46 nt, Mus musculus
ccaaaaauacagaauaugagacacucccuaacccagagguuaccag

SEQ ID NO: 47214 - RNA, 46 nt, Mus musculus
aaugaaaaauuacccaugaaucccauuugcaaccccucacccccac

SEQ ID NO: 47215 - RNA, 40 nt, Mus musculus
cucucagggcucauguccugaauguauguugguuagaaag

SEQ ID NO: 47216 - RNA, 42 nt, Mus musculus
ugguuaaaaaaaagaacauugaaaggcuuaugccaauggaag

SEQ ID NO: 47217 - RNA, 42 nt, Mus musculus
acaugcauguguauauaagcugaaaagcugcuccugggugag

SEQ ID NO: 47218 - RNA, 46 nt, Mus musculus
uuuuguuguccaagcugggguagaaaccaaagauauuuaugcuuga

SEQ ID NO: 47219 - RNA, 46 nt, Mus musculus
ggaaugagaugaguuacuggcauuugaaaaacaaguuaguggagaa

SEQ ID NO: 47220 - RNA, 44 nt, Mus musculus
gcugccuuuuuuaaaaaagagaaacagaaggaguugaucugggg

SEQ ID NO: 47221 - RNA, 45 nt, Mus musculus
acggcgacaacaggggcguccggucuucucugucgcuaggaagca

SEQ ID NO: 47222 - RNA, 45 nt, Mus musculus
uuacaagaaugugccaccacuccugguucugaacuuuuaaugaag

SEQ ID NO: 47223 - RNA, 46 nt, Mus musculus
auugaguaaauauuugaaugucuccuguuuggaaagucaugaguag

SEQ ID NO: 47224 - RNA, 46 nt, Mus musculus
ggaucagucaccuucguggccccagcccuccuccaauggcuggugg

SEQ ID NO: 47225 - RNA, 45 nt, Mus musculus
aacauaaauguacuguauauguuggagggguggaggcaaggagga

SEQ ID NO: 47226 - RNA, 33 nt, Mus musculus
cugagaagcagacaacuagacauacacacgugu

SEQ ID NO: 47227 - RNA, 47 nt, Mus musculus
gcaaaacuuaauuguucgucuuuauaugaucauacccaaaaucuuug

SEQ ID NO: 47228 - RNA, 75 nt, Mus musculus
acgguggcagagaugacccaagccgagaagggggacgcggagaacgggaaggagaagggcggggagaaggagaag

SEQ ID NO: 47229 - RNA, 45 nt, Mus musculus
guuaaaagguugcagcguuaggaagguucuggggaagagagacuu

SEQ ID NO: 47230 - RNA, 47 nt, Mus musculus
cucugggugauguuuaauucauuccugaggggaggaguuagauggag

SEQ ID NO: 47231 - RNA, 45 nt, Mus musculus
aacuuggggucuggguugagaggguuugguagacugaaaggacaa

SEQ ID NO: 47232 - RNA, 42 nt, Mus musculus
uguucuggaaacaaauggacaaacacaucucagcagccugag

SEQ ID NO: 47233 - RNA, 49 nt, Mus musculus
aauaucugauuuccuuaucauagcggugcgugaguugaguguugaguga

SEQ ID NO: 47234 - RNA, 46 nt, Mus musculus
gcgugcgccaccacaccuggcuuaacaucucaguuuuaaagcgcac

SEQ ID NO: 47235 - RNA, 38 nt, Mus musculus
cucuggacuuauggcuagauugcuucugguuugguguu

SEQ ID NO: 47236 - RNA, 46 nt, Mus musculus
aggucccagcgcaggucaggccgcucccaaccaucuguagcuccag

SEQ ID NO: 47237 - RNA, 46 nt, Mus musculus
cauaauuaaaaauacauaguuuuuaaaaguguuugcuacuuaccgg

SEQ ID NO: 47238 - RNA, 47 nt, Mus musculus
gauuauucauuaacagauuaaaauguuacaaaacggucuacgugcag

SEQ ID NO: 47239 - RNA, 46 nt, Mus musculus
ccuggggccaugcccugguccuuccagccccaccccacucacauag

SEQ ID NO: 47240 - RNA, 63 nt, Mus musculus
ucaccagcaucgcagaccucacgggccaggucgcccuguacacuuucugccccaaagccaacc

SEQ ID NO: 47241 - RNA, 45 nt, Mus musculus
uguguguguguguguguguguguguauguauguauguguguguuu

SEQ ID NO: 47242 - RNA, 46 nt, Mus musculus
gugugacugaggacaggacaguuugcuuauuguugacccaggagag

SEQ ID NO: 47243 - RNA, 51 nt, Mus musculus
ucuaaugaguccugagcguagaacauggcuuugucagaucugggagcuggu

SEQ ID NO: 47244 - RNA, 56 nt, Mus musculus
aacucaaacuaugcuuucgcauccagcuuucuuucccucgugucagguuuuagcau

SEQ ID NO: 47245 - RNA, 46 nt, Mus musculus
cuucucaugaaucuuugagaaauacuguauuuucauccucucuaag

SEQ ID NO: 47246 - RNA, 46 nt, Mus musculus
gagcucagauguucaaaaacuuguugaggagcgaugaaggaaauag

SEQ ID NO: 47247 - RNA, 45 nt, Mus musculus
gacaugcuuuuaugccuccuguuuagucauucaaaugcugcagag

SEQ ID NO: 47248 - RNA, 56 nt, Mus musculus
aauaaaugggucacugaaggaacagauacguauggaauguguauauguugcuggaa

SEQ ID NO: 47249 - RNA, 46 nt, Mus musculus
uuuuaaccaggaaaaguuaagguaacuauauuaagaauacaugacu

SEQ ID NO: 47250 - RNA, 45 nt, Mus musculus
uuugucugggcagugguaaugaacaccuuuagucacagcacucag

SEQ ID NO: 47251 - RNA, 46 nt, Mus musculus
cuguuuuccaaccacaaaaaugcauaacacagucugaacaguccag

SEQ ID NO: 47252 - RNA, 45 nt, Mus musculus
ccaaucucaaagaacaaaagcagauuugucucuauaaggggggaa

SEQ ID NO: 47253 - RNA, 46 nt, Mus musculus
cuugcagaggacccagguucaauuccuggcucccaccuagugguuc

SEQ ID NO: 47254 - RNA, 45 nt, Mus musculus
uccauggucacaagguaugcacacaguguacauacacacaugcag

SEQ ID NO: 47255 - RNA, 45 nt, Mus musculus
aacgucuuuuuuucuuuuaacacuuuccauguguaucuaccccug

SEQ ID NO: 47256 - RNA, 46 nt, Mus musculus
agguuucugaacaguacaauauuaagaaaauuacuuuugagggagu

SEQ ID NO: 47257 - RNA, 51 nt, Mus musculus
ggauaagguucguacaguuaaagcccuagcuuugucaaaauagcagaacag

SEQ ID NO: 47258 - RNA, 46 nt, Mus musculus
gaaacucugaugcggauuaugcaguagccuccucucugguccccua

SEQ ID NO: 47259 - RNA, 46 nt, Mus musculus
aguaauggacccugcuuccggcccgccccucucccugagccaucaa

SEQ ID NO: 47260 - RNA, 45 nt, Mus musculus
acucauacuuaauucauaauagccaaaaaccugcauacaacccag

SEQ ID NO: 47261 - RNA, 45 nt, Mus musculus
cccaccccagaaucuuuuaaaauccaaugugaggccacaaaugaa

SEQ ID NO: 47262 - RNA, 41 nt, Mus musculus
gcguguugacacacgccuuuaaucccagcacuugggaggca

SEQ ID NO: 47263 - RNA, 60 nt, Mus musculus
aaaaauaauaauaaaguaacaaaauacaacaaaaaggaaaaagggagaaaugaaaaagau

SEQ ID NO: 47264 - RNA, 37 nt, Mus musculus
cagucugcuccgucuggucauaaacaucugacaguag

SEQ ID NO: 47265 - RNA, 59 nt, Mus musculus
gggucuagagucagaggacacagacaagcugcugggagaugcaucacagaaagagccca

SEQ ID NO: 47266 - RNA, 123 nt, Mus musculus
cuggguauccauucugccgcucaccacacaguucagccugaagucagcaccccagugcugaucacucccgccuccauugcacagucgggugacaaacaucccccaagcuacacacucccacug

SEQ ID NO: 47267 - RNA, 60 nt, Mus musculus
agcccuguccucagccccacucugccagcugaagcuccuaccacacaaguuccccacuua

SEQ ID NO: 47268 - RNA, 47 nt, Mus musculus
uaagccacagcagucugguugcuagccagagccccuucagagccccg

SEQ ID NO: 47269 - RNA, 46 nt, Mus musculus
ccucccaagcguugaucugcuucagaaacucagguugaccccacag

SEQ ID NO: 47270 - RNA, 42 nt, Mus musculus
gucugucuccauggucuauaacuaaauuugcucuguggggug

SEQ ID NO: 47271 - RNA, 46 nt, Mus musculus
uggguugagcacuguggacaaggagauuuuuaaaguauccggucag

SEQ ID NO: 47272 - RNA, 42 nt, Mus musculus
uaaaggagagguuugcccuucaauagcaaguuuaccagggag

SEQ ID NO: 47273 - RNA, 46 nt, Mus musculus
ucucuuucucuguuuuccccauuaaacauuucagucuaugcagcaa

SEQ ID NO: 47274 - RNA, 45 nt, Mus musculus
gccagcucccccucuccccucacuguugggacagcagagagucag

SEQ ID NO: 47275 - RNA, 41 nt, Mus musculus
gaacaaagacaaccacaaccuaugacugcagugaaggcaau

SEQ ID NO: 47276 - RNA, 46 nt, Mus musculus
agauuuauaugcuccaagcauuuacuuaaaauucagaagccagaag

SEQ ID NO: 47277 - RNA, 46 nt, Mus musculus
uuaucugugaaucuuuaagacacguguuguugcuguacgugcugag

SEQ ID NO: 47278 - RNA, 44 nt, Mus musculus
acagccaaucgccugcgcaucagcuccauccaggccaccaccgc

SEQ ID NO: 47279 - RNA, 46 nt, Mus musculus
aguuguccaaagucacagugagagcuggaauuucagcccuugcaau

SEQ ID NO: 47280 - RNA, 46 nt, Mus musculus
cagggugggggcagggaggugacgaugcaacaccaagagaggcuua

SEQ ID NO: 47281 - RNA, 46 nt, Mus musculus
agagagaucugggcuucuuggaaugguuugggguucuggggaggga

SEQ ID NO: 47282 - RNA, 44 nt, Mus musculus
cuggccuaucagaaaguccucuugggcacaugggcggcaucagg

SEQ ID NO: 47283 - RNA, 46 nt, Mus musculus
gcuaaguguacggguugccaguucgguauauauauuucccuugcag

SEQ ID NO: 47284 - RNA, 42 nt, Mus musculus
cagcuagucccuuagacuuugaggagagugaguaccugggag

SEQ ID NO: 47285 - RNA, 42 nt, Mus musculus
gagccaucaugugggugcuaggaauaggacuuaggucccuga

SEQ ID NO: 47286 - RNA, 98 nt, Mus musculus
cagaaugaaagguuuuaaauguacacuucuguuuucgugguacuagagaauggacccagagccaagcaaguaccuaccacugaauuauauucucagcu

SEQ ID NO: 47287 - RNA, 42 nt, Mus musculus
aguggcuuuaucacaucuaacuuuaggacauuuuuccagccu

SEQ ID NO: 47288 - RNA, 90 nt, Mus musculus
gcaguuuccgucucaucccauacugggucugauuuccugucucuauaaauuuaauucaucuggauacuuuaucauaaugcaacuggacag

SEQ ID NO: 47289 - RNA, 46 nt, Mus musculus
ggcuggcuccuugcacgugauauaagaugucgauguguucaugugg

SEQ ID NO: 47290 - RNA, 46 nt, Mus musculus
ggacaggucgccuggcuucugagaacccagacagucccagccccaa

SEQ ID NO: 47291 - RNA, 47 nt, Mus musculus
uugaucugugaugacaucagugcaacuauuaacuuagcugguucaga

SEQ ID NO: 47292 - RNA, 44 nt, Mus musculus
ugcagguucaaugaaagauugucucacaaaauaagauggggagu

SEQ ID NO: 47293 - RNA, 46 nt, Mus musculus
gauugucaaccuccauugugggugcugggaauugaaccuggguccu

SEQ ID NO: 47294 - RNA, 45 nt, Mus musculus
gaggaaagaccaccaaugcuaccugcaugcauguauguaccccug

SEQ ID NO: 47295 - RNA, 56 nt, Mus musculus
cccugccuuuccucuucuaguaaaaaucacagccacagaccauaccacaauugccc

SEQ ID NO: 47296 - RNA, 44 nt, Mus musculus
agagagagagggagagagagagagagagagagagagagcaugca

SEQ ID NO: 47297 - RNA, 46 nt, Mus musculus
uuucugaucauccugcuucaguuucuuuucuuaaccccuugcccua

SEQ ID NO: 47298 - RNA, 65 nt, Mus musculus
ccgucugggaggccauggccuuugcuggaauuuacaagcuggacaaccucguugccauuuuugac

SEQ ID NO: 47299 - RNA, 63 nt, Mus musculus
aucaaccgccugggccagagcgacccagccccgcugcagcaccagguggacaucuaccagaag

SEQ ID NO: 47300 - RNA, 45 nt, Mus musculus
gguuguacagccuaccaccuagacacaguuguauacaggcuccgu

SEQ ID NO: 47301 - RNA, 45 nt, Mus musculus
ugaggggccacacugccugagggggauuuaaaggacaggguuuga

SEQ ID NO: 47302 - RNA, 45 nt, Mus musculus
uguugugacuguugggggguacagccaucaagguaucuugaccuu

SEQ ID NO: 47303 - RNA, 61 nt, Mus musculus
cuuuggucaggccaagcaccaaccaacagccaucauugccaagaccuucaagggccgaggg

SEQ ID NO: 47304 - RNA, 82 nt, Mus musculus
gcguggcacgggaagccccuccccaaaaacauggccgagcagauuauccaggagauuuacagccagguucagagcaaaaaga

SEQ ID NO: 47305 - RNA, 61 nt, Mus musculus
agauccuggccacgcccccucaggaggaugccccauccguggacauugcuaacauccgaau

SEQ ID NO: 47306 - RNA, 45 nt, Mus musculus
cccucgcuaagcugggccacgccagugaccguaucauugcccugg

SEQ ID NO: 47307 - RNA, 46 nt, Mus musculus
uaaaggggaccugcuggucuauagagccuuuaaaaaaagggaggag

SEQ ID NO: 47308 - RNA, 32 nt, Mus musculus
ucuuuuacccaagcgauggaguugcaacagag

SEQ ID NO: 47309 - RNA, 42 nt, Mus musculus
gaucagauaucugaagucuuccuuuuaucuucaaaggcauag

SEQ ID NO: 47310 - RNA, 45 nt, Mus musculus
agaucagcauccgggugcuggaucccuucacuaucaagccccugg

SEQ ID NO: 47311 - RNA, 58 nt, Mus musculus
aaguggcaagccagcugagcuacugaagauguucgguauugacaaggacgccauugug

SEQ ID NO: 47312 - RNA, 60 nt, Mus musculus
ggugggugaacuacacauuccagggagguucuggcagagguggcgaagguguacugagug

SEQ ID NO: 47313 - RNA, 45 nt, Mus musculus
gauauaaacauauccagugccaguaugagaaggagacuggggaga

SEQ ID NO: 47314 - RNA, 45 nt, Mus musculus
gauauggaccgaacaucauguuauuuagcagaaaagagguaagag

SEQ ID NO: 47315 - RNA, 42 nt, Mus musculus
aacguucgacgcccacaucuaugaaggccguguuauccagau

SEQ ID NO: 47316 - RNA, 46 nt, Mus musculus
caugugacccugaggcaggaggcaugugacccugaggggcucuugg

SEQ ID NO: 47317 - RNA, 46 nt, Mus musculus
gagggguuggagguggggagugccuauauagaacugugcgccuuug

SEQ ID NO: 47318 - RNA, 45 nt, Mus musculus
ugcuggcuuaguguguccugauguguacacauuuguaaucuggag

SEQ ID NO: 47319 - RNA, 46 nt, Mus musculus
aucuuaggaguggcuccggugagggugaggggcuuagaagucgcua

SEQ ID NO: 47320 - RNA, 42 nt, Mus musculus
guaaaguuugcgggggucgauaucgagagcaaggccgaccag

SEQ ID NO: 47321 - RNA, 45 nt, Mus musculus
ugacugcaugcacagcagaguccacagaggcagcgggccccagag

SEQ ID NO: 47322 - RNA, 46 nt, Mus musculus
gagauacaacccugaggaaugagagccuauucauauguacuaagga

SEQ ID NO: 47323 - RNA, 46 nt, Mus musculus
agauucacagcucacagaugcacacaugcgaucauuccauaacugg

SEQ ID NO: 47324 - RNA, 59 nt, Mus musculus
gaaggaaacacacagagagaagaguauuucagcucauuugagacauuuagugugaggga

SEQ ID NO: 47325 - RNA, 34 nt, Mus musculus
ugugauccaccaggaauggcgagaaguuggugcu

SEQ ID NO: 47326 - RNA, 45 nt, Mus musculus
accagugggaauccuuccauggauaucugugcuccauauuguaug

SEQ ID NO: 47327 - RNA, 46 nt, Mus musculus
aucuuaagaaaaauguauucuguuuauuguuucagccuuuucuuuc

SEQ ID NO: 47328 - RNA, 45 nt, Mus musculus
uauuaauggguaauauauguccuggguuuccuguauguguguuug

SEQ ID NO: 47329 - RNA, 72 nt, Mus musculus
aaguucucaaaauuucauauauacuguguguauggagaaagaagaagaggagggaggaggagggaggacuag

SEQ ID NO: 47330 - RNA, 45 nt, Mus musculus
cuuacauauaauaaauaaauaaaucuuaaaaaaaaaaguuuuuug

SEQ ID NO: 47331 - RNA, 46 nt, Mus musculus
gucaaaauuuacaauuuuguaccugaugcuuuucaaggaaccacug

SEQ ID NO: 47332 - RNA, 49 nt, Mus musculus
ccucaaacauaaagugaacuacaauuuaagcuaauugcgucacucagga

SEQ ID NO: 47333 - RNA, 71 nt, Mus musculus
gcaguuaaaugcuggaguucucuguccuucaagucagcaguauaguaaagcaaacauuugguaaggcagau

SEQ ID NO: 47334 - RNA, 42 nt, Mus musculus
aaauguagauuuuauuuacaaaccaggccacaagguacaaaa

SEQ ID NO: 47335 - RNA, 42 nt, Mus musculus
aaauguagauuuuauuuacaaaccaggccacaagguacaaag

SEQ ID NO: 47336 - RNA, 42 nt, Mus musculus
gcucacucagccuaggcacgaagucaagucacgccuguuccc

SEQ ID NO: 47337 - RNA, 60 nt, Mus musculus
cuuucuugcucuuuuugccuaucaaguuucugcugcuguuuuaguucuucaagcuguguc

SEQ ID NO: 47338 - RNA, 46 nt, Mus musculus
cuuuaaagggagcacuauuuggaacaccuggguccuuccuaggcuu

SEQ ID NO: 47339 - RNA, 46 nt, Mus musculus
uaauuuucgaugauguucucggaccuauuaaaaacagcucuaugag

SEQ ID NO: 47340 - RNA, 99 nt, Mus musculus
acuuaccuuuuuuugaauuuuauaucgcuuauggcaggucauacguuuacucgcuuucuuuaacucugccaaaacaaagaaagagaaagacugcacaca

SEQ ID NO: 47341 - RNA, 42 nt, Mus musculus
cuuagauuaucuguucuuguuuggaaucucagaggguuggag

SEQ ID NO: 47342 - RNA, 46 nt, Mus musculus
uagauagugauugggcuugaaaggaaaucauagugggguugagcag

SEQ ID NO: 47343 - RNA, 46 nt, Mus musculus
guguaaauccagcaaggagauuaaaauggagcaugaugaaagugag

SEQ ID NO: 47344 - RNA, 46 nt, Mus musculus
ugcaacuuuucaaaugacuuuuuuaccuuuuauucuuuaacaguag

SEQ ID NO: 47345 - RNA, 46 nt, Mus musculus
cuugcauauaugucuguguaccacguguguuucccauggaggcaag

SEQ ID NO: 47346 - RNA, 45 nt, Mus musculus
uagagaagcuauauucugagcaacaauagucaucuaugucuccac

SEQ ID NO: 47347 - RNA, 46 nt, Mus musculus
caaaacuguugcugaagccaagaaaaaaaaguguguguguaugugu

SEQ ID NO: 47348 - RNA, 46 nt, Mus musculus
ccaauuugaaucccuuugaccuccuuuuguugucuuaauugcucug

SEQ ID NO: 47349 - RNA, 42 nt, Mus musculus
cauuuugguuuguugaaauuacuuucuugcuuuucuagggag

SEQ ID NO: 47350 - RNA, 46 nt, Mus musculus
gacuuuggugguguuugucuaaaaucccagcauuuggaagguagag

SEQ ID NO: 47351 - RNA, 46 nt, Mus musculus
aagcuaaauuugcagaguuagaaggaggagaugaugauauugagga

SEQ ID NO: 47352 - RNA, 86 nt, Mus musculus
uagaucuugaguucuguucugaggaacuccaaggaaaauauaacagcagucguuaggugguauugauucucugucucaugccaguu

SEQ ID NO: 47353 - RNA, 61 nt, Mus musculus
acugcuaaauagggggaaguccuuguucaauucauugugcccacucuguaaugcuuuucua

SEQ ID NO: 47354 - RNA, 64 nt, Mus musculus
uuuaauuacauuaaacugcauuuucuguuaguaucccagucacauauuuaaauaaaugaauaag

SEQ ID NO: 47355 - RNA, 45 nt, Mus musculus
guggggacacuguuuuuguuuuugcuguuuuuuguuguugccauu

SEQ ID NO: 47356 - RNA, 42 nt, Mus musculus
acaguaaaaagccuuugguccaaaaugagaacuuugcagcag

SEQ ID NO: 47357 - RNA, 46 nt, Mus musculus
ccagcucaaaccuuaacauaauccauucuuaacagcagugguggag

SEQ ID NO: 47358 - RNA, 45 nt, Mus musculus
ccaaacuggagaaccaugccuugugaucaggacugugcaccucau

SEQ ID NO: 47359 - RNA, 46 nt, Mus musculus
uuccauaauuuucaucauaugcaaaagaacuuacuuuuggcuauaa

SEQ ID NO: 47360 - RNA, 46 nt, Mus musculus
ugcaaaucugugauacagccaguuuugggagccucccagucgguag

SEQ ID NO: 47361 - RNA, 46 nt, Mus musculus
ugaugaaucaaggaguagcccccaugguagggacuccagcaccagg

SEQ ID NO: 47362 - RNA, 46 nt, Mus musculus
aaggaugauaauuuuuauugcauuuuauuguacaucacacagccau

SEQ ID NO: 47363 - RNA, 46 nt, Mus musculus
aagugugcauggaggugguuuaagcauaauacuuaacccaagaaag

SEQ ID NO: 47364 - RNA, 46 nt, Mus musculus
guuuaauugccaugcuuaauaaaucaugagaacaaaagaguauaga

SEQ ID NO: 47365 - RNA, 45 nt, Mus musculus
uucaucaaagcuuuuuaauccaaauaaaaacaacaguuugcaaag

SEQ ID NO: 47366 - RNA, 47 nt, Mus musculus
gugugaucaguuaauccuaacgcugggaagacauaugccagccccac

SEQ ID NO: 47367 - RNA, 45 nt, Mus musculus
aggucuuucuccucucccuugguuccuacauugauugcccguggc

SEQ ID NO: 47368 - RNA, 46 nt, Mus musculus
auuuggaccgggugcucaugggcuacuaucccuacccacaggcccu

SEQ ID NO: 47369 - RNA, 76 nt, Mus musculus
cuccuggaugaggacuacauccacuauccauugccugaauuugccaaagagccaccgcagagggacagauaccggc

SEQ ID NO: 47370 - RNA, 46 nt, Mus musculus
ugacucgcgacagcuaccugacgcacugcuuccuccagcaucugau

SEQ ID NO: 47371 - RNA, 43 nt, Mus musculus
acugcaugauggucuccgccgcuacuucucugaaccacugcag

SEQ ID NO: 47372 - RNA, 43 nt, Mus musculus
agucccugcccaguacccaagugagcgccuaauccaguccaca

SEQ ID NO: 47373 - RNA, 45 nt, Mus musculus
cucugagccuuugccuccaugaacuuagugcuaagugcuccagau

SEQ ID NO: 47374 - RNA, 41 nt, Mus musculus
gacuguggucaucuccaagaauccuucagcuaagccaagaa

SEQ ID NO: 47375 - RNA, 49 nt, Mus musculus
gcucgagcugcucgugggcuaccgcuucguuaccgccaucuuugugcug

SEQ ID NO: 47376 - RNA, 50 nt, Mus musculus
cugcgcgcccucggaggccgucaaguccgcugccauccccuacuggcugc

SEQ ID NO: 47377 - RNA, 79 nt, Mus musculus
gcugagaaccgcuacuuugaaaugggacccccagacgcagaggaagaggaggggaguggccagggagaagaggaugagg

SEQ ID NO: 47378 - RNA, 44 nt, Mus musculus
gcgcgaggaagcccauggugagcagggcgaggaggaagaagagg

SEQ ID NO: 47379 - RNA, 42 nt, Mus musculus
gcgccucagcacacugauccgccaggccauugaacggcaacu

SEQ ID NO: 47380 - RNA, 46 nt, Mus musculus
aucaugcagagccagagguucagguggugccuggguccggccagau

SEQ ID NO: 47381 - RNA, 45 nt, Mus musculus
aacaagaucugacucccucuucuggaaugucugaagacaguuaca

SEQ ID NO: 47382 - RNA, 42 nt, Mus musculus
agguggccucugaugaucugagggaugugccaggagcuguug

SEQ ID NO: 47383 - RNA, 46 nt, Mus musculus
acaggcucugguccaugguugugcauguaagucaggucagacaggu

SEQ ID NO: 47384 - RNA, 45 nt, Mus musculus
gaggcccuggccagcagccucucauccacggauagucugccaccc

SEQ ID NO: 47385 - RNA, 77 nt, Mus musculus
accagcuagcagcaauuugaaacgcguugguuguuguuuuugcuguuuguuguuguuuuuaaagucagggguugggg

SEQ ID NO: 47386 - RNA, 45 nt, Mus musculus
uaucuggggggcucuugggaguacagucauuuaauugggccaugg

SEQ ID NO: 47387 - RNA, 52 nt, Mus musculus
augcauggaugcaugggugcugugugcaugcaugaacaagcaagugaagagc

SEQ ID NO: 47388 - RNA, 45 nt, Mus musculus
ugaagucacagcugugauguacagaagagaaaucaugaaagcaga

SEQ ID NO: 47389 - RNA, 46 nt, Mus musculus
acgcagaacuuggugugaggucuugggaaacuaguuuggcccuagg

SEQ ID NO: 47390 - RNA, 102 nt, Mus musculus
gugaggacuuccggcucccgccugcacccugcaucagacccggcggcuccccuccugcagcucccgccucagccucccugccucagccgauccucuccaacc

SEQ ID NO: 47391 - RNA, 64 nt, Mus musculus
gacacuguggaagugcugaaggcaauucagaaagccaaagaugucaaguccaaacugagcaaca

SEQ ID NO: 47392 - RNA, 46 nt, Mus musculus
guccugacuacacuggucacuggugcaugacuacaagucuugagau

SEQ ID NO: 47393 - RNA, 45 nt, Mus musculus
augucuaaaauuauauguaggcuuuuuauuuaauuuaugugagau

SEQ ID NO: 47394 - RNA, 45 nt, Mus musculus
ccaggacuucaagcuuggaggguuucaggaacacaugggcacaga

SEQ ID NO: 47395 - RNA, 45 nt, Mus musculus
cccgugggaguaccccugcagaccccaccucucuccuggcgcucu

SEQ ID NO: 47396 - RNA, 86 nt, Mus musculus
gaacaacccuuugagcaucaucccugacuaccggaccaaggugcuuucccaguuuggagaacgagccucugagguaagccccagaa

SEQ ID NO: 47397 - RNA, 59 nt, Mus musculus
caguuggaugaggucaagagcauuggcagccugccaugucuggagcguuugaccuugcu

SEQ ID NO: 47398 - RNA, 50 nt, Mus musculus
ucugcacaaacucuacuccuugguuaauguggaccuacgagacaaccgga

SEQ ID NO: 47399 - RNA, 45 nt, Mus musculus
gcaccuauacaaccucgugcaccuugaccuguccuacaacaagcu

SEQ ID NO: 47400 - RNA, 49 nt, Mus musculus
auggcaagcacugacuacucuagaccugagccacaacagcaucugugag

SEQ ID NO: 47401 - RNA, 46 nt, Mus musculus
auauacacacacacacauacaccaugcuugugucuguaucugaggu

SEQ ID NO: 47402 - RNA, 25 nt, Mus musculus
ugcccaggaggggaaggugagcugg

SEQ ID NO: 47403 - RNA, 45 nt, Mus musculus
guuugacgcauggccucggagcuguuuggacauacuugacuuugu

SEQ ID NO: 47404 - RNA, 46 nt, Mus musculus
aauugcaaaguaagacuugugggcauuauuagccugagauuggggu

SEQ ID NO: 47405 - RNA, 46 nt, Mus musculus
augucaggauucagagcaagauacugaagacaagaugagaacacug

SEQ ID NO: 47406 - RNA, 58 nt, Mus musculus
agugggaccaugucucaaaaaugguaaguaaguaaaaaguaauuuaguugucagaccu

SEQ ID NO: 47407 - RNA, 46 nt, Mus musculus
ggaaagccaacaaaaaaggaggguaguuucugugauggcguuagac

SEQ ID NO: 47408 - RNA, 48 nt, Mus musculus
ucgaugggaccaagggccagggcuagagaucaucagguggugaaggag

SEQ ID NO: 47409 - RNA, 41 nt, Mus musculus
gaagaaugccagccuaagagaccuucaugggaagucuggga

SEQ ID NO: 47410 - RNA, 46 nt, Mus musculus
agguucugcgagguagcgacgagggagcccgaaaaaaaugggggau

SEQ ID NO: 47411 - RNA, 45 nt, Mus musculus
acagagcacgaugucucggaccugaugaaagucucuggcagaagg

SEQ ID NO: 47412 - RNA, 41 nt, Mus musculus
gcagggccuggacauggcgcugagaggccgcuccgcgggaa

SEQ ID NO: 47413 - RNA, 35 nt, Mus musculus
cuaggccuguguauggauuuaucuuccuguucaaa

SEQ ID NO: 47414 - RNA, 46 nt, Mus musculus
ccacgucaccuuccugagaaacagaauggccucagugcagugcgga

SEQ ID NO: 47415 - RNA, 46 nt, Mus musculus
cugggcugggcuggaggagggacaagccuugugugugugugugugu

SEQ ID NO: 47416 - RNA, 45 nt, Mus musculus
agugcucccugucucuccuacauuuuauuuaguaucugucucuaa

SEQ ID NO: 47417 - RNA, 44 nt, Mus musculus
gaugaggacgaggacgugcagaacaccaacccugccaucagguc

SEQ ID NO: 47418 - RNA, 45 nt, Mus musculus
cagcuguggcugugcccacacacucgcaaccuucacccaccccua

SEQ ID NO: 47419 - RNA, 42 nt, Mus musculus
gaggagaaggaggugguggaagucacagagagcagagacaag

SEQ ID NO: 47420 - RNA, 83 nt, Mus musculus
uggcaggagcugcuagcacugcuaaaguguguagaagccgagauugcaaacuaugaggccugucucaaggaggagguggagaa

SEQ ID NO: 47421 - RNA, 46 nt, Mus musculus
ugaauaaaaaugugcuaauaaaugaucuucugguugcuaucucgag

SEQ ID NO: 47422 - RNA, 46 nt, Mus musculus
caaaacuguccuaauaaagccccgaauaccacgaagcugucgauuu

SEQ ID NO: 47423 - RNA, 46 nt, Mus musculus
aguguuuuucaguacucugaaguccaguuugcuucauaaccuuaaa

SEQ ID NO: 47424 - RNA, 45 nt, Mus musculus
cuagaagauucugcugccgacgccugggcuugacugacgggugag

SEQ ID NO: 47425 - RNA, 46 nt, Mus musculus
acugucucgaacagcaacaacaacaaaaucagugucauaagcagag

SEQ ID NO: 47426 - RNA, 41 nt, Mus musculus
gcugcaauagucucuuaaaaucuaauuaguguucugugaga

SEQ ID NO: 47427 - RNA, 45 nt, Mus musculus
cgguuacagguccagccuauaagggacgucaccgaggcaggagcu

SEQ ID NO: 47428 - RNA, 45 nt, Mus musculus
gaagauuaccaggagggagacuauucaccauguaagaguccaggg

SEQ ID NO: 47429 - RNA, 47 nt, Mus musculus
ccaucuacagaaggaccuguggugcuggguaagccgggugacuagau

SEQ ID NO: 47430 - RNA, 46 nt, Mus musculus
uuuaaauauauuuugaucauauuuccccugcccuauaucuuuccag

SEQ ID NO: 47431 - RNA, 43 nt, Mus musculus
guuguauuggguuuuugcaaaagaacuugaaguagggugcaua

SEQ ID NO: 47432 - RNA, 45 nt, Mus musculus
caauacaacccccaccacccugccaaaaacaaaauaaugcccaag

SEQ ID NO: 47433 - RNA, 46 nt, Mus musculus
agcaagguaaacaaacccuuagccaaucuaacuaaaaugcagagag

SEQ ID NO: 47434 - RNA, 42 nt, Mus musculus
gggggagaaggaggaagaggaggagaaggaggaggaggaaga

SEQ ID NO: 47435 - RNA, 46 nt, Mus musculus
gcauuaagguagagcaaucaguggagcagugaaaacacgugaagau

SEQ ID NO: 47436 - RNA, 46 nt, Mus musculus
ccugaaauacggagcucaccauuagacuguauuauaaacuggagua

SEQ ID NO: 47437 - RNA, 46 nt, Mus musculus
gugauagcaugggccacagaaauugacacaguccccagccucagua

SEQ ID NO: 47438 - RNA, 45 nt, Mus musculus
aggugcucuugcuugcauucugaguccagcagagauagugguaag

SEQ ID NO: 47439 - RNA, 51 nt, Mus musculus
cccaggguucaagggagauauaaacaagggagagauauaaacaagggagau

SEQ ID NO: 47440 - RNA, 60 nt, Mus musculus
ggcgagggggcguggccugcugugcauggaugggaacugagaguauaagagagugagagg

SEQ ID NO: 47441 - RNA, 45 nt, Mus musculus
gcugcugaauaaguagaacaacauucgagcaaacucguggguagu

SEQ ID NO: 47442 - RNA, 45 nt, Mus musculus
uggagagagcacaucaagcuaaagacucagcuguuuacguuacaa

SEQ ID NO: 47443 - RNA, 46 nt, Mus musculus
ucuuugaaaucaucucugcagguaacaguaauagaaaaggccagua

SEQ ID NO: 47444 - RNA, 46 nt, Mus musculus
guuacagaaauaccagcuuuugcucagaaacaacuuugggggagau

SEQ ID NO: 47445 - RNA, 44 nt, Mus musculus
uggugugcacuggaagagggaaauuuugaaguacuaucccagaa

SEQ ID NO: 47446 - RNA, 64 nt, Mus musculus
acucaucuuuuaauuuauccucauauguauguagagaccaagauccugcaucacuuuaaguaaa

SEQ ID NO: 47447 - RNA, 46 nt, Mus musculus
aacaguauuuugaucuauuugauaauuuuguggguuuuuugaagaa

SEQ ID NO: 47448 - RNA, 46 nt, Mus musculus
cuuacugucagagcuugccugccaaauugaagacugccuuucaggu

SEQ ID NO: 47449 - RNA, 46 nt, Mus musculus
acagauuuuuuuauuagaacuccauuuuguggaaacggaaauagau

SEQ ID NO: 47450 - RNA, 77 nt, Mus musculus
aacuucaaaucgggcuuuuucgggaaaaaggcacuuucuuaucauacacagauucaaccugaagaaagaucaugcag

SEQ ID NO: 47451 - RNA, 41 nt, Mus musculus
caacaccucaaaaacaguuagcuuugaagccuugccuauca

SEQ ID NO: 47452 - RNA, 45 nt, Mus musculus
gcccauggcuuaaaacaagggcaacccaaacuugaugugggauag

SEQ ID NO: 47453 - RNA, 46 nt, Mus musculus
aaacaaguuaugucuuuuaaaguacguauuaugugacugcuaaaac

SEQ ID NO: 47454 - RNA, 45 nt, Mus musculus
gggucaugaaacuagugccuuguuaauucuggaaaagauaacaga

SEQ ID NO: 47455 - RNA, 45 nt, Mus musculus
ugcagaucugacauuacaagauaagaguaaaaacaccgcccuuca

SEQ ID NO: 47456 - RNA, 41 nt, Mus musculus
gagcauuacccuuucuuuaucaggguaguuuaaccucagga

SEQ ID NO: 47457 - RNA, 46 nt, Mus musculus
aaugaaggugcagcugagaugcugauugauuccuuaggagccagca

SEQ ID NO: 47458 - RNA, 45 nt, Mus musculus
cauguguggagcuacuuuuagaacaggauguuuuccagaaaauag

SEQ ID NO: 47459 - RNA, 46 nt, Mus musculus
gccagggcuacacagugaaacccugucuugaaaaaauaaaacagaa

SEQ ID NO: 47460 - RNA, 46 nt, Mus musculus
uuacaggaauuacuauacagcaguacccauuuucaauagccaagac

SEQ ID NO: 47461 - RNA, 46 nt, Mus musculus
cuuauuuccagagugguuguacaagcuugcaaucccaccagcaaug

SEQ ID NO: 47462 - RNA, 46 nt, Mus musculus
ugauaguaccagcgcaaagggaaaagaaaagggcuuguguguagua

SEQ ID NO: 47463 - RNA, 46 nt, Mus musculus
uuucuacaguaauauaauucauuuguuuauuucucaugugccagua

SEQ ID NO: 47464 - RNA, 44 nt, Mus musculus
uaauaguauuuucauuucuuuuaaaagaugcaggggggcguuac

SEQ ID NO: 47465 - RNA, 46 nt, Mus musculus
auaaguaugcagugaguuuauaaugaugauagugcugagguuagac

SEQ ID NO: 47466 - RNA, 43 nt, Mus musculus
ugucucaagagaaagaaagagagagagagagagagagagagag

SEQ ID NO: 47467 - RNA, 46 nt, Mus musculus
guuuagaacuucugguuggcaauggagcugaugucaauaugaaggu

SEQ ID NO: 47468 - RNA, 46 nt, Mus musculus
aaaugaacuauagauuuguauauagcccaguuuuauggaggcaguu

SEQ ID NO: 47469 - RNA, 46 nt, Mus musculus
uuucaaaaauaaucugaauucgucuugaauucauuaugcauuagaa

SEQ ID NO: 47470 - RNA, 45 nt, Mus musculus
ggucaaacuacucuuguccagaggugccaauauaaaugcuuuuga

SEQ ID NO: 47471 - RNA, 46 nt, Mus musculus
ugugcagcuggaagcucugaauccuugcaucaacugcagcguagau

SEQ ID NO: 47472 - RNA, 46 nt, Mus musculus
ugucuuuaccuguuuugggaagcagaguaauacugaacuuacagaa

SEQ ID NO: 47473 - RNA, 46 nt, Mus musculus
cuguuucagaaaggucucucugagccuaguaucuugacgaguauca

SEQ ID NO: 47474 - RNA, 46 nt, Mus musculus
ccaaugagccacccugugguugcugggauuuaacuucaggaccucu

SEQ ID NO: 47475 - RNA, 109 nt, Mus musculus
ccucagcccuguuagauuucuugauguuagggcauucugaauuggguaagaguaguuuucauuuguauuucccugauggcuagaaauauugaacacuuuuuaaaaucag

SEQ ID NO: 47476 - RNA, 51 nt, Mus musculus
uauuuacuuugauuuaaugugucuugaguguuuugccugcagagccagacu

SEQ ID NO: 47477 - RNA, 45 nt, Mus musculus
gguuuuacagaaaaugguuuucguuaauguccuaucgugucagau

SEQ ID NO: 47478 - RNA, 48 nt, Mus musculus
uacuaucagggcucacagcuuaggguugguucauuaacauaucagaga

SEQ ID NO: 47479 - RNA, 46 nt, Mus musculus
guacaaacuaagcuaauugucgcauuucuccuuuuaugugucagau

SEQ ID NO: 47480 - RNA, 25 nt, Mus musculus
ccuuuacacagagcaguugcaucgu

SEQ ID NO: 47481 - RNA, 46 nt, Mus musculus
agauagucuugcuagcauauaggaucuguuugagugaccgggaagu

SEQ ID NO: 47482 - RNA, 45 nt, Mus musculus
uuaaaagauaauaauugcuacuguggaaaaaugaaaaacauagau

SEQ ID NO: 47483 - RNA, 46 nt, Mus musculus
uucuuuugugauuaaguuaccucacucaggaugauauccuccagau

SEQ ID NO: 47484 - RNA, 45 nt, Mus musculus
uagugauuuaucugauuauuugacauuuguguuuaguguguuaag

SEQ ID NO: 47485 - RNA, 46 nt, Mus musculus
cuucuuuaaaacagacaugaaaguauucuggaugugaaaggaaaaa

SEQ ID NO: 47486 - RNA, 85 nt, Mus musculus
cagcacugcagucagauucugcaguauagucuguuucucucggaagaaggggaagggguagagcugacaacagugaacggcagac

SEQ ID NO: 47487 - RNA, 45 nt, Mus musculus
guguuuuguuauuuacucucauucaucggggcgggggcggggcgg

SEQ ID NO: 47488 - RNA, 46 nt, Mus musculus
uuuagagaaggcaggagagucucacuugagaccaauagggguaguc

SEQ ID NO: 47489 - RNA, 47 nt, Mus musculus
guccgagcacuaauauuuaagaaagaagauguuaacuuucagguaaa

SEQ ID NO: 47490 - RNA, 68 nt, Mus musculus
aaauauauaguucauauuccauaccccucaaaaauauuacggcugcagggaagaaaaaagccacuagg

SEQ ID NO: 47491 - RNA, 46 nt, Mus musculus
uuugaauagauuagguaggcuuuuuuuuauggcucccacccaggau

SEQ ID NO: 47492 - RNA, 46 nt, Mus musculus
uaugucuuuucaucauuuauaagcaaaaggcuuuuacuuaagaaau

SEQ ID NO: 47493 - RNA, 46 nt, Mus musculus
gaauaaaaaccacaugcaugugauuaucaugaccugaauagaccuu

SEQ ID NO: 47494 - RNA, 46 nt, Mus musculus
cugugacuuuuaucacauagcuuggaguuuaauguuuuaaaagagc

SEQ ID NO: 47495 - RNA, 45 nt, Mus musculus
cacccaaaacaaugauuguuuuguacaaguaaauuucagagcuca

SEQ ID NO: 47496 - RNA, 46 nt, Mus musculus
ccucugaaugaagacuguuuaauggaagcuguauucauguagagau

SEQ ID NO: 47497 - RNA, 45 nt, Mus musculus
cuuuaagccucuuuucauucuagaaaauaacacacauccaaagga

SEQ ID NO: 47498 - RNA, 45 nt, Mus musculus
ugcagcugcuuaauggguucuuaaggcguuagaauauacucagau

SEQ ID NO: 47499 - RNA, 45 nt, Mus musculus
gguuuccacacuuaauuguagcuuuuggaaauucauuugaucagg

SEQ ID NO: 47500 - RNA, 46 nt, Mus musculus
gggggauuccccccaacccugguaaauauauucuuagucugggcaa

SEQ ID NO: 47501 - RNA, 45 nt, Mus musculus
uaaacagcaaguagagucuuuuagaaaauaccuaauaugccaaaa

SEQ ID NO: 47502 - RNA, 46 nt, Mus musculus
uuaagugcaacaaguuggcauauucgaaacuuaagacaggguagua

SEQ ID NO: 47503 - RNA, 28 nt, Mus musculus
ccacaggcugggaagcacuuguuuagag

SEQ ID NO: 47504 - RNA, 46 nt, Mus musculus
uguauguagagagaccaugucuaaauaaaaccaacaaaagagaaga

SEQ ID NO: 47505 - RNA, 46 nt, Mus musculus
cgaccacauuugaaauagaaacauucuaaagacuuuguagucauca

SEQ ID NO: 47506 - RNA, 42 nt, Mus musculus
aaauauggcauguauauucauaguuggaaauuggaggcaggu

SEQ ID NO: 47507 - RNA, 42 nt, Mus musculus
ucauauguaucagaggauggccuuguggaacaucuaugagag

SEQ ID NO: 47508 - RNA, 55 nt, Mus musculus
uaguguuaauaaaggugauuaaacauuggacuagcacaggguccccaguggaaga

SEQ ID NO: 47509 - RNA, 67 nt, Mus musculus
uucuuggcacagaacaucauuucuguguucccgguauuuugcagaggccucuuaggacauuagcaac

SEQ ID NO: 47510 - RNA, 45 nt, Mus musculus
augaagcuccuuauucauuagaaacuucuguuuaaaauauaagau

SEQ ID NO: 47511 - RNA, 50 nt, Mus musculus
caaaguugaguauguuagcuggcacaugccaguaaucuuaauaaagggga

SEQ ID NO: 47512 - RNA, 46 nt, Mus musculus
aauaaaauaaaaguagaggagcuuuugacaauucuuaugacaagau

SEQ ID NO: 47513 - RNA, 46 nt, Mus musculus
uagaaggaaacagaauuacugggaucucucucgccuacccccauuc

SEQ ID NO: 47514 - RNA, 46 nt, Mus musculus
guuuucucucaaguugagaauuuaaaguaaaauaauauauucagua

SEQ ID NO: 47515 - RNA, 46 nt, Mus musculus
aaaaccaauuuauauaugcaguggugguuugccuuuauggaugucc

SEQ ID NO: 47516 - RNA, 46 nt, Mus musculus
aaaaaaaaaaaguaaaauguuuuguaaagcuaaaagucacuuagag

SEQ ID NO: 47517 - RNA, 41 nt, Mus musculus
uggaacuguuugggaaggauuaggaaguauggcuuugaggg

SEQ ID NO: 47518 - RNA, 46 nt, Mus musculus
uucucuucucuucucuucucuucucuucucuuucuuuaguccaguu

SEQ ID NO: 47519 - RNA, 47 nt, Mus musculus
acuuacauuaaagagagagagagagagagagagagagagagagagag

SEQ ID NO: 47520 - RNA, 42 nt, Mus musculus
agaguacuauaugugugccuggugcuuacagaggccagaaaa

SEQ ID NO: 47521 - RNA, 46 nt, Mus musculus
ccuagaaggaagacuuagucacugcuacugaaauagugcuuguaug

SEQ ID NO: 47522 - RNA, 47 nt, Mus musculus
aagcacaugauaaauacugucuuuacugaaagaucacuguuagaugu

SEQ ID NO: 47523 - RNA, 42 nt, Mus musculus
aaaaaaauuuucauuuuuaaguguauguguauauaugugugu

SEQ ID NO: 47524 - RNA, 46 nt, Mus musculus
aaaauguacugauucuuuguuaauuuugcaucaugcacuccaauuc

SEQ ID NO: 47525 - RNA, 44 nt, Mus musculus
ccacaggagguaggaaaaagccucuagagauugcuugucacagg

SEQ ID NO: 47526 - RNA, 45 nt, Mus musculus
uuagagaaggauucuuucuagcuucuauaaaacaaucugccaggu

SEQ ID NO: 47527 - RNA, 46 nt, Mus musculus
augaaauuaaaacuaugaaagaagaguuaauaaaagaaugaaaaga

SEQ ID NO: 47528 - RNA, 46 nt, Mus musculus
aucuugaguuuucuaguggagugucgggcaucuuuuaaguauagau

SEQ ID NO: 47529 - RNA, 46 nt, Mus musculus
ugcuucuuucauucucuucauuauuuauacuuuucauuguagagau

SEQ ID NO: 47530 - RNA, 59 nt, Mus musculus
uaagagccugccuuuuugcuaauguaugucuuggccccaguguugagaaucacauggcg

SEQ ID NO: 47531 - RNA, 47 nt, Mus musculus
uuuugaauugauuuuuauacacaaagugacugaguggggucuaguug

SEQ ID NO: 47532 - RNA, 45 nt, Mus musculus
uucuuuagcugcacacaagcuuuuaaauuuuaugcaaucccauuu

SEQ ID NO: 47533 - RNA, 46 nt, Mus musculus
auuagcuuguguugugcaaauuaauacauuucauuguggcccuuuu

SEQ ID NO: 47534 - RNA, 47 nt, Mus musculus
auauuuuaugagaaacugaaaacuuuaaauaugaaaacagaauuaga

SEQ ID NO: 47535 - RNA, 58 nt, Mus musculus
ugcuuguaauaccagcacuuggaacguggaagcaaguuuugggaaggcauauuacaaa

SEQ ID NO: 47536 - RNA, 46 nt, Mus musculus
aaugaggugguaggccaagaaagaagaugcaggauaaugaggagac

SEQ ID NO: 47537 - RNA, 46 nt, Mus musculus
uuuucuccucuacucugcacaagugugcgugcuccucugugugugu

SEQ ID NO: 47538 - RNA, 42 nt, Mus musculus
uauuagcuagacaaaguaguuuuuggaggaaaggugagaaga

SEQ ID NO: 47539 - RNA, 45 nt, Mus musculus
guuuuuagaaaucaguuuauugauauguuucaagacauuagaagu

SEQ ID NO: 47540 - RNA, 46 nt, Mus musculus
uguuaccuguaaacuugagaauccgugaugaguaaguuaaugagau

SEQ ID NO: 47541 - RNA, 46 nt, Mus musculus
gaauaacuuuacuguucaacauguuccauuagcuacacauagaauc

SEQ ID NO: 47542 - RNA, 71 nt, Mus musculus
uugccauuguuuuucugaauaggagauacugaacagauuugaagggaaaccaaucagaaagugggcacaag

SEQ ID NO: 47543 - RNA, 49 nt, Mus musculus
uguuugucucuuuuaaagaaaagggaaaguaacgaguggauuuuacgga

SEQ ID NO: 47544 - RNA, 41 nt, Mus musculus
ggcgugggccgcccgggcgcccugucggcgcgguggcagcg

SEQ ID NO: 47545 - RNA, 45 nt, Mus musculus
gacggaagaaagagggcgggaguccuuggaggaggcgggaccggc

SEQ ID NO: 47546 - RNA, 46 nt, Mus musculus
uggaaugaagcacuaaagagaucauucgcaaacagugucggggcac

SEQ ID NO: 47547 - RNA, 24 nt, Mus musculus
uguggccuguccugcccuccccuc

SEQ ID NO: 47548 - RNA, 41 nt, Mus musculus
agauaauggguagcugcuggcacuaacagucccugcauuua

SEQ ID NO: 47549 - RNA, 45 nt, Mus musculus
uuucuaugcuugucucuuagaggggcugucaguuguccucagcuu

SEQ ID NO: 47550 - RNA, 46 nt, Mus musculus
acugucuuccuccagguuggcuuugcuuggcuugauugcgcgguag

SEQ ID NO: 47551 - RNA, 46 nt, Mus musculus
cuuucuuuguuuacaaauuaucucguguguauggguggguguuuug

SEQ ID NO: 47552 - RNA, 46 nt, Mus musculus
aaauuuguaagacuauauuuuaaaguucauggaaagcugaggggaa

SEQ ID NO: 47553 - RNA, 46 nt, Mus musculus
cuuuuucuuuugauugcugauaccccagauaagucuaguucucuca

SEQ ID NO: 47554 - RNA, 45 nt, Mus musculus
gucugguaauucucuugugucuugauauccauuuuuuuuuuuuaa

SEQ ID NO: 47555 - RNA, 46 nt, Mus musculus
ggcauaguguggggcaguagcugagaguucacauuuuaucugcaag

SEQ ID NO: 47556 - RNA, 46 nt, Mus musculus
agacuucugccagagccugcaguuucuucagcgaugccuggggcaa

SEQ ID NO: 47557 - RNA, 46 nt, Mus musculus
uggagauugagaaccugggcaaucugaaaugccuaaaugaccacuu

SEQ ID NO: 47558 - RNA, 46 nt, Mus musculus
cgacggcuggcuugcccagaaccaucaggacacauggaaaguagag

SEQ ID NO: 47559 - RNA, 40 nt, Mus musculus
uuuuaucuucaugcaggaagcauuucuuaauucaccccua

SEQ ID NO: 47560 - RNA, 46 nt, Mus musculus
agauuuuuuaaaugaauuaacaugguaauaaaaaguauggccugaa

SEQ ID NO: 47561 - RNA, 46 nt, Mus musculus
gguuucguaaaacauuuaucauuucuuucuagaaaaaccagugaag

SEQ ID NO: 47562 - RNA, 42 nt, Mus musculus
cccauaguuucacuugugacacaugagcaccccguuuuggaa

SEQ ID NO: 47563 - RNA, 41 nt, Mus musculus
ucacuagagaaaccaacagcugggaagugcugcaugcagaa

SEQ ID NO: 47564 - RNA, 31 nt, Mus musculus
gaaggagcaguuggggcauugucccaaggag

SEQ ID NO: 47565 - RNA, 46 nt, Mus musculus
ugcuguaacaggugcaacuauugaggaucucugugggaaccagugg

SEQ ID NO: 47566 - RNA, 48 nt, Mus musculus
agugugcugucuccagcuaggcauccucugugugggagcguggaaugg

SEQ ID NO: 47567 - RNA, 46 nt, Mus musculus
ggacccaggggcuucaugcagcacaguaacuguuauaccagcugag

SEQ ID NO: 47568 - RNA, 45 nt, Mus musculus
agcccuuucuccaacauaugccauuauguguguaaauauccccaa

SEQ ID NO: 47569 - RNA, 45 nt, Mus musculus
cgcucaguccuuuccguucugugcaugugagugugcaggagugug

SEQ ID NO: 47570 - RNA, 46 nt, Mus musculus
gugggguucugagccucacauggaacaaauaucuguccagccuuau

SEQ ID NO: 47571 - RNA, 45 nt, Mus musculus
uguagcucuaggaaugacaugauagaauacuguccccggcaugug

SEQ ID NO: 47572 - RNA, 46 nt, Mus musculus
agcauacuagauucagugugugggaggugccuauauaaugggcugg

SEQ ID NO: 47573 - RNA, 45 nt, Mus musculus
cuugggcaccaucaggaaggguuccaauagguucaauggcaggua

SEQ ID NO: 47574 - RNA, 43 nt, Mus musculus
uuauaccaccaauggcacagugcacguuguggucaacaaccag

SEQ ID NO: 47575 - RNA, 45 nt, Mus musculus
aaaagaauacacagagggacacaucuggcuucuccugaccuugca

SEQ ID NO: 47576 - RNA, 33 nt, Mus musculus
gcagguacccgugcugaagaaguaugcagacaa

SEQ ID NO: 47577 - RNA, 42 nt, Mus musculus
gcagguguaggugcuauggccgaaccuuuucaucuguggcag

SEQ ID NO: 47578 - RNA, 45 nt, Mus musculus
agaucucagccuggcacccuugguguacugugugggucgcuggca

SEQ ID NO: 47579 - RNA, 32 nt, Mus musculus
aacuugcuuuauuuucuaugugauaccuaaac

SEQ ID NO: 47580 - RNA, 46 nt, Mus musculus
gagugaucuucugaaggagguuauaucuggaaacucugggccccag

SEQ ID NO: 47581 - RNA, 52 nt, Mus musculus
augcagugagaugcagcacacgugugcgaaccuaagcaggagaccaaagcgc

SEQ ID NO: 47582 - RNA, 41 nt, Mus musculus
ccaaggcuccaagucagcacguggaaucucuauugggcuuc

SEQ ID NO: 47583 - RNA, 46 nt, Mus musculus
guauguguauuuguauguuucucugugucaggguauauguggugug

SEQ ID NO: 47584 - RNA, 46 nt, Mus musculus
ugauuguguuuguguguacauggugugugugugugguaugugugag

SEQ ID NO: 47585 - RNA, 42 nt, Mus musculus
ugcugggggugagcuuuuggguuagaaggaacaaggcaucag

SEQ ID NO: 47586 - RNA, 46 nt, Mus musculus
ggacauaguuuccugggcugcuacuggguugucuauucaaagaaag

SEQ ID NO: 47587 - RNA, 57 nt, Mus musculus
gcaugcaauacacacacacacacacacacacacagagagagagagagacaugagauu

SEQ ID NO: 47588 - RNA, 41 nt, Mus musculus
caaacaaacaaacaggcaugagagugaguaaauuagaagcu

SEQ ID NO: 47589 - RNA, 43 nt, Mus musculus
cgggaaggcuuccuggggaaggagguacuuuacuggggucuga

SEQ ID NO: 47590 - RNA, 42 nt, Mus musculus
gggcaguggcagcagugagcccaaugacccaggcagccccac

SEQ ID NO: 47591 - RNA, 48 nt, Mus musculus
agggcagugcugaccugcggaagcagaugucucgguuggaagaggagc

SEQ ID NO: 47592 - RNA, 46 nt, Mus musculus
agcccgggaggaugcggagcgcaggaaccagcugcugcagagggag

SEQ ID NO: 47593 - RNA, 41 nt, Mus musculus
aagggacuccacaaaagagaagaaagaauugaaagggggaa

SEQ ID NO: 47594 - RNA, 46 nt, Mus musculus
ugaacagaucauuaaucuccccuggucucaguuuucucauugagag

SEQ ID NO: 47595 - RNA, 32 nt, Mus musculus
cugcagccaacagcuggauugaucuccaaaca

SEQ ID NO: 47596 - RNA, 41 nt, Mus musculus
aaagcuaagaaggcggugcugaaaggcguccacagccacaa

SEQ ID NO: 47597 - RNA, 57 nt, Mus musculus; identical to SEQ ID NO: 28956

SEQ ID NO: 47598 - RNA, 42 nt, Mus musculus
ccuuccggcggcccaagacccugcggcuccggaggcagccaa

SEQ ID NO: 47599 - RNA, 46 nt, Mus musculus; identical to SEQ ID NO: 28958

SEQ ID NO: 47600 - RNA, 46 nt, Mus musculus; identical to SEQ ID NO: 28959

SEQ ID NO: 47601 - RNA, 45 nt, Mus musculus
gcaggcaaacuauaagucuugagagguugccagguggagggagau

SEQ ID NO: 47602 - RNA, 45 nt, Mus musculus
ugagcccccuuugguggugacuagaagagacagaccgggugggca

SEQ ID NO: 47603 - RNA, 41 nt, Mus musculus
aaagaaacagacaagauccuuguguuucacagagcuucaau

SEQ ID NO: 47604 - RNA, 46 nt, Mus musculus
auuagaaugugcuguccuaaaaggcaguuguuuaggggcccaagac

SEQ ID NO: 47605 - RNA, 28 nt, Mus musculus
gaccuguuuaaguucccagcacccaccu

SEQ ID NO: 47606 - RNA, 23 nt, Mus musculus
cuagaggcacaaggauuaggagu

SEQ ID NO: 47607 - RNA, 45 nt, Mus musculus
ccucccgagugcugggauuaaaggugugugucaccacgccuggcg

SEQ ID NO: 47608 - RNA, 48 nt, Mus musculus
cuggagauuggggagcccacuuacaagugucaagagcauuggaagagu

SEQ ID NO: 47609 - RNA, 45 nt, Mus musculus
ucugguagguggcugguaggauauugcaaaagugaugcgcuaagg

SEQ ID NO: 47610 - RNA, 42 nt, Mus musculus
uguuacuauguaacaggugcuaaagugaggauuaggggagga

SEQ ID NO: 47611 - RNA, 46 nt, Mus musculus
aauaaggaaaagugauuguuauuuucuguuauuuuuguuguuagag

SEQ ID NO: 47612 - RNA, 40 nt, Mus musculus
uuggagaaaggucagagucaauuauuaauuucucagagau

SEQ ID NO: 47613 - RNA, 45 nt, Mus musculus
cucacuggagaacggaauuaacaccaaauauaauuagccccacaa

SEQ ID NO: 47614 - RNA, 42 nt, Mus musculus
uuuugaaacugcauaagccaauuguuauugaugguagcccaa

SEQ ID NO: 47615 - RNA, 46 nt, Mus musculus
guacagggacaaagccagagccgacaggacaucgugaaagacagag

SEQ ID NO: 47616 - RNA, 46 nt, Mus musculus
ugggcuuggggacggaguucagcauuuacccgaagaagaaaaagau

SEQ ID NO: 47617 - RNA, 42 nt, Mus musculus
auuaaguuuuaaauguauuaucuuuauuaugugagugugugc

SEQ ID NO: 47618 - RNA, 46 nt, Mus musculus
gcaauguagaacuuuguuuuuuccuuuaacagauucuaggcuaacg

SEQ ID NO: 47619 - RNA, 25 nt, Mus musculus
uggggaugaaucugggcucuacuuc

SEQ ID NO: 47620 - RNA, 48 nt, Mus musculus
cacagagcaggggaguguuuuacauucuuucuguauaucuuggagaua

SEQ ID NO: 47621 - RNA, 59 nt, Mus musculus
aucagaucaguggaggagcucauugggaaagagcaguguccugaaacuaaggaacagag

SEQ ID NO: 47622 - RNA, 59 nt, Mus musculus
ucucuauaguugugugaaguaacaagacagcccaagaaacagcagaauggaaaaauaaa

SEQ ID NO: 47623 - RNA, 45 nt, Mus musculus
ucugugauacuaucaaguguaguaaugcuacaaauaugaauaggu

SEQ ID NO: 47624 - RNA, 46 nt, Mus musculus
ugaggguagaaggaagaccaccagggcagaugagccugugggagau

SEQ ID NO: 47625 - RNA, 45 nt, Mus musculus
accccugugcuguagucuagcuuagguuagauuucugcaggagau

SEQ ID NO: 47626 - RNA, 46 nt, Mus musculus
uaaagaaucauagcucaugccaaugccaguugucucgcccccacca

SEQ ID NO: 47627 - RNA, 42 nt, Mus musculus
uuccuuccucuguguguaugugugugugugagugugagagag

SEQ ID NO: 47628 - RNA, 45 nt, Mus musculus
accuaaucuuuagugaaggacauagguaaagaacagaggcucaga

SEQ ID NO: 47629 - RNA, 42 nt, Mus musculus
ggagugacccuaguggucugaucuuccugcuuucacccagua

SEQ ID NO: 47630 - RNA, 46 nt, Mus musculus
uuuuuugacuucagagaucucaucucugagacgugaggacagagau

SEQ ID NO: 47631 - RNA, 41 nt, Mus musculus
gaaguuaguucagaaucagaaucuuguuuacaguugaacag

SEQ ID NO: 47632 - RNA, 45 nt, Mus musculus
gugagcaggucaguagguaauagaagcccauuucaggguaggagc

SEQ ID NO: 47633 - RNA, 45 nt, Mus musculus
uguggcgagaagaguaaguacagaguacauuuuuaaagugaugag

SEQ ID NO: 47634 - RNA, 45 nt, Mus musculus
cuuuggagacaacaugaggcaaguggaaugcgacuaucuaggaga

SEQ ID NO: 47635 - RNA, 45 nt, Mus musculus
cuuuucccagucaaguuuaagaugacagcagcugaguagcugaga

SEQ ID NO: 47636 - RNA, 45 nt, Mus musculus
ugaagaaucuuccaauguugguucuaaguugcagucugugugugu

SEQ ID NO: 47637 - RNA, 42 nt, Mus musculus
auuuggagaugcuguacaggagguauauauauauaaggagua

SEQ ID NO: 47638 - RNA, 46 nt, Mus musculus
aaguugcuaaaugggaguacuaucaauaaaagaguuugcaacagau

SEQ ID NO: 47639 - RNA, 42 nt, Mus musculus
acugucauagguuguuccacagugaaagcacaguugaaagau

SEQ ID NO: 47640 - RNA, 46 nt, Mus musculus
cacuugcucccuaggagcacuuagaguuuccaaaggcaggaaagau

SEQ ID NO: 47641 - RNA, 47 nt, Mus musculus
ucaauuuaauauuguguugacauuugaauaguaauaaagcggaguug

SEQ ID NO: 47642 - RNA, 41 nt, Mus musculus
uugaguuugaucuguagcauagucuaaccuccagccagaga

SEQ ID NO: 47643 - RNA, 46 nt, Mus musculus
uaauaaaaauaagaucugaucuuugaguuuccgugugugugugugu

SEQ ID NO: 47644 - RNA, 45 nt, Mus musculus
uuuguagaaguuuuuguguagaaaucuuuucucuguucucuuagg

SEQ ID NO: 47645 - RNA, 46 nt, Mus musculus
uuuaggccacaacauucaugucacauaaugaacucaauagccagaa

SEQ ID NO: 47646 - RNA, 45 nt, Mus musculus
ccgcggcgccagcaucguagaggacaagcugguggaagaccugaa

SEQ ID NO: 47647 - RNA, 46 nt, Mus musculus
cuaggcucaauauuuugcuauuaaaacuucugugacaagagcacuu

SEQ ID NO: 47648 - RNA, 46 nt, Mus musculus
aaaacacuaugagaagacaauucacuuaggcaugggacagggggcg

SEQ ID NO: 47649 - RNA, 46 nt, Mus musculus
uuuuaggaaacucagguguaaggucgcuguggaggaaagguuagau

SEQ ID NO: 47650 - RNA, 77 nt, Mus musculus
cccaguccuuguaacuaauuucugaaaaagguugaucuugugagauuguugagcuuuuauuuaaccugugagaugaa

SEQ ID NO: 47651 - RNA, 66 nt, Mus musculus
gcuuucgaugguuaguguuagaugggaauuaagugagggaaugcccucucugugggcagagaacua

SEQ ID NO: 47652 - RNA, 51 nt, Mus musculus
ugauaaaccuaauggauuacagaaaauaacaucagaacuaagaaugaaggu

SEQ ID NO: 47653 - RNA, 46 nt, Mus musculus
uaaaguauuuugaaacaaugguauucuucagagauaugggaugaag

SEQ ID NO: 47654 - RNA, 46 nt, Mus musculus
uauuuauuauauguaaguacacuguagcuuuauucagacaccccag

SEQ ID NO: 47655 - RNA, 46 nt, Mus musculus
gcucacaaucaucuguaaugagaucugauguccucuucuggggugu

SEQ ID NO: 47656 - RNA, 46 nt, Mus musculus
uuauuuauuauuauauauaaguacacuguagcuguagaugcgccag

SEQ ID NO: 47657 - RNA, 36 nt, Mus musculus
auguaaggggccggagagguggcucaguguuuaaga

SEQ ID NO: 47658 - RNA, 42 nt, Mus musculus
aaaaaauauuagugguggcaugcaccuuuaaucccaguacuc

SEQ ID NO: 47659 - RNA, 50 nt, Mus musculus
uuaugugugugaaugcauuguugauaucuucaagcacaccagaagagagc

SEQ ID NO: 47660 - RNA, 46 nt, Mus musculus
gagcagucaguauucuuaaccacugagccaucucuccagcccccca

SEQ ID NO: 47661 - RNA, 47 nt, Mus musculus
accacagcacauguguaucaguuaucuacuaccagauaugucccagg

SEQ ID NO: 47662 - RNA, 25 nt, Mus musculus
aagagucaguguuccuaaccacccg

SEQ ID NO: 47663 - RNA, 42 nt, Mus musculus
cuuuuuaaaauucuccuuauuaccuuguuuauaaugaugugu

SEQ ID NO: 47664 - RNA, 42 nt, Mus musculus
ccguuuggaggugcuaaagcaggcguuaagaucaaccccaag

SEQ ID NO: 47665 - RNA, 46 nt, Mus musculus
auaaggguuaagagagcagcaguuaaaaaagagaagacauauauau

SEQ ID NO: 47666 - RNA, 45 nt, Mus musculus
aaucuggguuaggucgugaaucccuaucucaaaaacaaaacaaga

SEQ ID NO: 47667 - RNA, 91 nt, Mus musculus
aaaaucuuaguuauauuuuacccuugaguuuuucagauuucaugcagucauauuuauugccauauuuucauacguuuuuuccagcguaguu

SEQ ID NO: 47668 - RNA, 46 nt, Mus musculus
gacucacuggaacucugaaggacagucugaguaauuuggccccuuu

SEQ ID NO: 47669 - RNA, 50 nt, Mus musculus
cuugagucugaauucuuaccguuagcccugggaguuuagggucagauaug

SEQ ID NO: 47670 - RNA, 46 nt, Mus musculus
aguccuuuugaugcuauuguaagggauaaugauauauuaggggguu

SEQ ID NO: 47671 - RNA, 46 nt, Mus musculus
auacucacucacauacacacaaacauuucuaggcuuuuccaagaau

SEQ ID NO: 47672 - RNA, 62 nt, Mus musculus
ccuaucaacuguaacuuugcccugcagguuucucauguuccuuugucuccauacaccagaac

SEQ ID NO: 47673 - RNA, 46 nt, Mus musculus
ugcuucccuuguugaacuugugaaaugcaagcuuaucagccaacag

SEQ ID NO: 47674 - RNA, 29 nt, Mus musculus
uagaaaguuugcaaaccagacaaguagac

SEQ ID NO: 47675 - RNA, 47 nt, Mus musculus
gguuaaccauucugagagugaaagaugccuaaaauacagagacaagg

SEQ ID NO: 47676 - RNA, 46 nt, Mus musculus
agaguuagcucccuguuggcugaggucuucucacuaaguaggaagg

SEQ ID NO: 47677 - RNA, 45 nt, Mus musculus
agguccuggcauugaugugccugccccagacaugagcacggguga

SEQ ID NO: 47678 - RNA, 46 nt, Mus musculus
cagagggggcaaguaauacgcauaccaaauguauauaaagggagau

SEQ ID NO: 47679 - RNA, 42 nt, Mus musculus
ucuuagcuccucuuucagugaaagcacuuuugaggcgaaggc

SEQ ID NO: 47680 - RNA, 45 nt, Mus musculus
aaagcuccagauguugacauucaaccagauuuuacagguccagcc

SEQ ID NO: 47681 - RNA, 48 nt, Mus musculus
agaggaagagaacagcugagauuacagguaagacaugcauguguaaag

SEQ ID NO: 47682 - RNA, 46 nt, Mus musculus
aggaaagagagagagaacacaacauaaaguugggugaauggguuag

SEQ ID NO: 47683 - RNA, 42 nt, Mus musculus
aguucaaggccagcccagucuacagaguucuaagacagccag

SEQ ID NO: 47684 - RNA, 46 nt, Mus musculus
gcacacuacaaauggcauaaauguggaagcuguuucaaaacuauag

SEQ ID NO: 47685 - RNA, 52 nt, Mus musculus
agaagcuuauaaugaguguguuucacuguguauagcggagauggaauugguc

SEQ ID NO: 47686 - RNA, 61 nt, Mus musculus
cucugucuuagcuuccucauauguaagauaacaauaucuucuucccaagacuguuaggaug

SEQ ID NO: 47687 - RNA, 46 nt, Mus musculus
aagagcaguuaaugcucuuaaugcugagccaucucuccagcccgag

SEQ ID NO: 47688 - RNA, 46 nt, Mus musculus
caaacgcuggguuacaggcagugccacaacaccaacaugcacacac

SEQ ID NO: 47689 - RNA, 45 nt, Mus musculus
ucauugaugaaguuuucaauuccauggaagacaccccggccagua

SEQ ID NO: 47690 - RNA, 45 nt, Mus musculus
gaggcuucuuacaugagcauuuuaggaaugacaccaggcuuuggc

SEQ ID NO: 47691 - RNA, 53 nt, Mus musculus
ucuaugagauauuuacaucguuuuggugcuaaauguguugguguuggagaguc

SEQ ID NO: 47692 - RNA, 57 nt, Mus musculus
ugaugggaguauauggaauccggaugggauugacccaaaagaacuggaagacuucaa

SEQ ID NO: 47693 - RNA, 80 nt, Mus musculus
uggaggcugacugugacauucugauuccugccgccagcgagaagcaguugaccaaauccaaugcacccagagucaaagcc

SEQ ID NO: 47694 - RNA, 46 nt, Mus musculus
acuuaagaauauaagucuccacaggggcuggagagauggcuuagug

SEQ ID NO: 47695 - RNA, 43 nt, Mus musculus
cuguguucagaguuuggggugaagcagagggguuaucgggacu

SEQ ID NO: 47696 - RNA, 46 nt, Mus musculus
cacucaaaguaagacacuguuacuccuccagcauuuaaguagagau

SEQ ID NO: 47697 - RNA, 45 nt, Mus musculus
uugaccuucaaauaugaaagggacucuaacuaccacuugcucagu

SEQ ID NO: 47698 - RNA, 54 nt, Mus musculus
cacaaccaucuguaacaagugacucccucuucuggagugucugaagacagcuac

SEQ ID NO: 47699 - RNA, 45 nt, Mus musculus
gaugguugugagccacaaugugguugcugggauuugaacuccaga

SEQ ID NO: 47700 - RNA, 45 nt, Mus musculus
ugagaaagacauugugcacucuggcuuggccuacacaauggagag

SEQ ID NO: 47701 - RNA, 45 nt, Mus musculus
ccugggauuggaccugagaacagcugccuaugucaaugcuaucga

SEQ ID NO: 47702 - RNA, 46 nt, Mus musculus
acuguucugaacaagucaguuggaaucagccccuuaagagaaagag

SEQ ID NO: 47703 - RNA, 42 nt, Mus musculus
agguuaggcuuaagugguugaaggcaauuuauuacagcagca

SEQ ID NO: 47704 - RNA, 25 nt, Mus musculus
gcagugaacaccuaaaauagaagaa

SEQ ID NO: 47705 - RNA, 46 nt, Mus musculus
uggacugcauuaccaguucccaagagucccuugucccuugcagguc

SEQ ID NO: 47706 - RNA, 89 nt, Mus musculus
uauuggccagggcuuuugaacaggaaugucccacagaaguaccagacauuauuuauauaaggaugaacgcuuuuuuuuaacaguacccu

SEQ ID NO: 47707 - RNA, 52 nt, Mus musculus
uaaucacuucuggggguccaguuggugauccagggcggcugggcuggggcgu

SEQ ID NO: 47708 - RNA, 44 nt, Mus musculus
gggacaccugcaggcgguacugaugaacccccaaagcugaccaa

SEQ ID NO: 47709 - RNA, 52 nt, Mus musculus
gugagccugccuaccagcauggcuggcccuuccugaaggucaauaaagagug

SEQ ID NO: 47710 - RNA, 65 nt, Mus musculus
aaggucacccacaccaucacugaugcuguuacccaugcggcagaaggccugggaagacugggaca

SEQ ID NO: 47711 - RNA, 42 nt, Mus musculus
agaucaugaggaggauuacaacauggacuuuugggaacagug

SEQ ID NO: 47712 - RNA, 49 nt, Mus musculus
uuggagaugggagaugggagcauguaagaaggagagaagcggggaagga

SEQ ID NO: 47713 - RNA, 67 nt, Mus musculus
aagagguggugagcgagguggugggccacgccaaggagguuggagagaaggguaaggcugagguugc

SEQ ID NO: 47714 - RNA, 46 nt, Mus musculus
ggcauggagggcuuuguacaucuccagcagccaggggucuugaggg

SEQ ID NO: 47715 - RNA, 24 nt, Mus musculus
acaucagaagacggcaucagaucc

SEQ ID NO: 47716 - RNA, 47 nt, Mus musculus
uaagggccaucaggaaacuugaccugcuggccccaccaggagauagc

SEQ ID NO: 47717 - RNA, 46 nt, Mus musculus
gagggccuggcccaccgcacagagaaagccacugagggagcaggua

SEQ ID NO: 47718 - RNA, 35 nt, Mus musculus
uuggaacccccugcacaggaccaagaagccaaaga

SEQ ID NO: 47719 - RNA, 46 nt, Mus musculus
ccuugaaagacugaguauggacugugcaugaauggggauuccagaa

SEQ ID NO: 47720 - RNA, 44 nt, Mus musculus
agccccuucaaaaggccauuuccugcugugucugaaggacagag

SEQ ID NO: 47721 - RNA, 45 nt, Mus musculus
guggaccccgcuuucuccaaugggaguugcugcaucugagccagg

SEQ ID NO: 47722 - RNA, 25 nt, Mus musculus
cuuggucuuuucuacagcacccaca

SEQ ID NO: 47723 - RNA, 45 nt, Mus musculus
ccagggugggggcagggagggcgggccagagagaaggcaugccuc

SEQ ID NO: 47724 - RNA, 42 nt, Mus musculus
gcggcugcugcggggacugggucucgggacccugcuagagaa

SEQ ID NO: 47725 - RNA, 46 nt, Mus musculus
auccugagugaacacagugggguucagaagaaggaaccuggugucc

SEQ ID NO: 47726 - RNA, 42 nt, Mus musculus
ucucaaauuguucauaauaaaguuuugguuugggggggacgg

SEQ ID NO: 47727 - RNA, 46 nt, Mus musculus
aaaaugauccaauacguuuauuuuguuuuagacuaagccucuggaa

SEQ ID NO: 47728 - RNA, 42 nt, Mus musculus
gggcccuguucaaacuccagcgcugaccauucaccggcggag

SEQ ID NO: 47729 - RNA, 42 nt, Mus musculus
cuaggcccuguccggccggcgcgccugagguggggagggaag

SEQ ID NO: 47730 - RNA, 41 nt, Mus musculus
uccuauuuaccgaagcggagccgcggacugugacggcagca

SEQ ID NO: 47731 - RNA, 45 nt, Mus musculus
agcuuccggggcguccgaagcgacaucccuuuccuaggcuguggg

SEQ ID NO: 47732 - RNA, 80 nt, Mus musculus
uuucacagggaauaugaaacaggugucaaaaugacauccagauuuggaaaaacuuacaguaggaaaggaggaaauggcag

SEQ ID NO: 47733 - RNA, 49 nt, Mus musculus
gauauucaagaaauuccgaagaaaccuaaaguagaagaagaagauacug

SEQ ID NO: 47734 - RNA, 67 nt, Mus musculus
augagucucuaccuguuucuucaaaaaauuuagcccaggguaaggguucaucuuacucagaaucuag

SEQ ID NO: 47735 - RNA, 45 nt, Mus musculus
cuuccgacagaugcuuacuuguggaggauacuuuaauugggaaag

SEQ ID NO: 47736 - RNA, 46 nt, Mus musculus
caacuuuguauaguuguuucuuuccauguuuuuguggguucuagag

SEQ ID NO: 47737 - RNA, 45 nt, Mus musculus
cuagaguuagacaccauguguguacugggaacugaacccaggucc

SEQ ID NO: 47738 - RNA, 42 nt, Mus musculus
uguagagagcagaauaggguguuggauccccugggacuggag

SEQ ID NO: 47739 - RNA, 46 nt, Mus musculus
ccaauaaauuuuuuucguuugcuuaaagcuguauugagugugugag

SEQ ID NO: 47740 - RNA, 46 nt, Mus musculus
gagcuacaaacuuaucugaggugauagucuuaauaauaucaggaag

SEQ ID NO: 47741 - RNA, 46 nt, Mus musculus
ugcucaaauuagauaauaugagaaggguuuauuuacaaagguauag

SEQ ID NO: 47742 - RNA, 46 nt, Mus musculus
gaacccugugucagccuaaagauaagggcuguuuuguugauuggaa

SEQ ID NO: 47743 - RNA, 46 nt, Mus musculus
ucuauagcagaaaaugaccuugaauuucuuauccuccuauccccau

SEQ ID NO: 47744 - RNA, 45 nt, Mus musculus
gugguucugagucaccugauuuauguugggguuagaauuuggguc

SEQ ID NO: 47745 - RNA, 45 nt, Mus musculus
agcccuggauguauacagcuuaaauuuuaauugauaaugccacau

SEQ ID NO: 47746 - RNA, 57 nt, Mus musculus
cgagugcugggauuaaaggcgugcccggcuaaggcugacaguuuuuaaggagcuuua

SEQ ID NO: 47747 - RNA, 47 nt, Mus musculus
guugagacuuucagagauacuccuaccugaaaccucuuaaagaaggg

SEQ ID NO: 47748 - RNA, 65 nt, Mus musculus
ugggaggaggaggugguggguuugugggguggaccuggaaggagauguaggaugaagggacugag

SEQ ID NO: 47749 - RNA, 64 nt, Mus musculus
uauuguaugaaagaauaaaauaaaauaaaaaaaaaaccaaaaauaucuagccgucauacugccc

SEQ ID NO: 47750 - RNA, 42 nt, Mus musculus
auuccagcagaggcagguggaucuauaugauuuuagggccag

SEQ ID NO: 47751 - RNA, 45 nt, Mus musculus
cacuuucacaaaaaugcugaagauaguacuaagaaacccaaugca

SEQ ID NO: 47752 - RNA, 46 nt, Mus musculus
guccagucaaaggaucuguaagaacugguuuauaugaaugggauaa

SEQ ID NO: 47753 - RNA, 48 nt, Mus musculus
uuggauaaugagucucuuuuggagaugaaagacgaggauuuaaaaaau

SEQ ID NO: 47754 - RNA, 46 nt, Mus musculus
caaagcaaacagugaaucaaguaaagauggccugaaucaggcaaag

SEQ ID NO: 47755 - RNA, 46 nt, Mus musculus
acuauggaacggaguauggaugaguucaccgcauccacuccugcag

SEQ ID NO: 47756 - RNA, 45 nt, Mus musculus
aaaggauguuaaacuugaauuuuuugguuuugaagaucaugauga

SEQ ID NO: 47757 - RNA, 66 nt, Mus musculus
aaaauuaaauauuuuggcuuugacgaucucagcgaaagugaagaugaugaugaugacgacugucaa

SEQ ID NO: 47758 - RNA, 84 nt, Mus musculus
accaggaggauucuccauugaggucucuugagagagcagccaugaggacaaacauggacuagagugagccaaggcaagacucag

SEQ ID NO: 47759 - RNA, 44 nt, Mus musculus
agaaaacuuggauuuuacagaggacuugccuggugugccugaga

SEQ ID NO: 47760 - RNA, 42 nt, Mus musculus
ugaucugaugcccucuucuggggugucugaagacagcgacag

SEQ ID NO: 47761 - RNA, 46 nt, Mus musculus
uaaagaaaacuaugauaaaaaauuucaggaaaauagauggacuuag

SEQ ID NO: 47762 - RNA, 24 nt, Mus musculus
uuuuuugugaccucugcucccuuc

SEQ ID NO: 47763 - RNA, 46 nt, Mus musculus
uuauuauuauauauaaguacacuguagcugacuucaaaugcaucag

SEQ ID NO: 47764 - RNA, 46 nt, Mus musculus
agaagaguagucagugcucuuaccggcugagccaucucaccagucc

SEQ ID NO: 47765 - RNA, 46 nt, Mus musculus
ucaaaucccagcaaccacauaguggcucacaaccauccguaacgag

SEQ ID NO: 47766 - RNA, 45 nt, Mus musculus
caaucaaauauucauguuaauaucaagccaaaaaauuuugucagu

SEQ ID NO: 47767 - RNA, 43 nt, Mus musculus
uuuguguuuugcuuugugugugugugugugugugugugugugu

SEQ ID NO: 47768 - RNA, 41 nt, Mus musculus
ucuggauuagauuuaaguuaauuuuuuuuccagagccagag

SEQ ID NO: 47769 - RNA, 47 nt, Mus musculus
uguauugcaacucuuugaacauuauucagauggacuuaugcugguag

SEQ ID NO: 47770 - RNA, 45 nt, Mus musculus
acuaaaauagcuauaguacuuaaaauaauaauuaguguuuugccu

SEQ ID NO: 47771 - RNA, 46 nt, Mus musculus
cagcuaagcuacugaaugaaaaagacaugaacaagaucaaagaaaa

SEQ ID NO: 47772 - RNA, 45 nt, Mus musculus
uuuauagaaaaaguuuauugugagcucacaguuucagaggaugag

SEQ ID NO: 47773 - RNA, 46 nt, Mus musculus
gaguucagaucuugccgggcgugguggcacacaccuuuaaucccag

SEQ ID NO: 47774 - RNA, 47 nt, Mus musculus
gaugaugaggacgaagagaaacuaguagccucauuauggggagcaga

SEQ ID NO: 47775 - RNA, 46 nt, Mus musculus
ucugccuccugagugcuaggauuaaagcucguacuaccaugcccag

SEQ ID NO: 47776 - RNA, 46 nt, Mus musculus
uauggauuguuagagucauuuuauauccaucccuucuagguaacag

SEQ ID NO: 47777 - RNA, 46 nt, Mus musculus
uaaaaaguuaagagugaagauucuugaaguaaaaugguuuggugag

SEQ ID NO: 47778 - RNA, 46 nt, Mus musculus
cuaccauauauacauuuuuuacaguguauauauaauacaugcaaag

SEQ ID NO: 47779 - RNA, 45 nt, Mus musculus
gguucugucugauuacaacagcugcuucuugcuaucacuguccua

SEQ ID NO: 47780 - RNA, 46 nt, Mus musculus
ggccuuuaucuuagccauuaugccaccgggauuuaacuuucucugg

SEQ ID NO: 47781 - RNA, 46 nt, Mus musculus
uuguuagugugugucagacuugggaaucauuggauguagcugccag

SEQ ID NO: 47782 - RNA, 72 nt, Mus musculus
auuacagcauugugaagaccugauucagcaguacaaccgugcugagaacagcaucuguguagcagacaguaa

SEQ ID NO: 47783 - RNA, 57 nt, Mus musculus
cuucagaguggggcagcacaaagacaggagaacaagaaggacucauaggcacagcga

SEQ ID NO: 47784 - RNA, 44 nt, Mus musculus
aaaacauuuuucauagacauagaaguauaaaugaaauggugguu

SEQ ID NO: 47785 - RNA, 46 nt, Mus musculus
ccuucucuaguggagaaggcgaucauaguuuaaggcuagccggaca

SEQ ID NO: 47786 - RNA, 42 nt, Mus musculus
aucagcuauuucucgaacgagagagagcagcacaauuggcag

SEQ ID NO: 47787 - RNA, 48 nt, Mus musculus
aaauacaguggguaucaacugaaaagacugauggugcagaggagaagc

SEQ ID NO: 47788 - RNA, 46 nt, Mus musculus
agaagagcggcugacuguuuagacaguuuuauuuauuucccuguag

SEQ ID NO: 47789 - RNA, 46 nt, Mus musculus
gaagcacuguuaguguucccuuuggaauaugugccacagguaguag

SEQ ID NO: 47790 - RNA, 45 nt, Mus musculus
uuacgggcaguaagcugucccuguucuguggccccaugcuuagga

SEQ ID NO: 47791 - RNA, 46 nt, Mus musculus
gguucuugccucucuguauucuuugacucuagcacaguuucacaag

SEQ ID NO: 47792 - RNA, 46 nt, Mus musculus
uuuauuucaaaccuuucucugcauuuucaaaacuaaauauucacag

SEQ ID NO: 47793 - RNA, 46 nt, Mus musculus
gaagucuaucucuagagugauugaauauuuggaacauugcuagcug

SEQ ID NO: 47794 - RNA, 46 nt, Mus musculus
gauauauuuucuaauguucaguucaguaaauauaauaaggaagcua

SEQ ID NO: 47795 - RNA, 46 nt, Mus musculus
uaugccaguguaaugugggaaccauugagacuguauuugcccugag

SEQ ID NO: 47796 - RNA, 46 nt, Mus musculus
uauuuauuaaucauuggauuuggggacagauuuuugacuguggcag

SEQ ID NO: 47797 - RNA, 46 nt, Mus musculus
caguauuucucagcugugaucuuuggagcaaaagccaacggcagga

SEQ ID NO: 47798 - RNA, 43 nt, Mus musculus
aucccagaagaaacugaagaaacaaaaacucauggcccaggaa

SEQ ID NO: 47799 - RNA, 45 nt, Mus musculus
cacagugagaugauccucacugagaaggaacagaucguuccaaag

SEQ ID NO: 47800 - RNA, 46 nt, Mus musculus
acugcccaggccaucaaggguaugcauauccgcaaagccaccaagu

SEQ ID NO: 47801 - RNA, 46 nt, Mus musculus
cuuugcggauaugcauacccuugauggccugggcaguuucccgggu

SEQ ID NO: 47802 - RNA, 45 nt, Mus musculus
caagagaguagcgaaccaucuucacaggucaccucuggccgcuuc

SEQ ID NO: 47803 - RNA, 46 nt, Mus musculus
uggggaggugcucagcuuccuugugacauaagauuuuaauacagau

SEQ ID NO: 47804 - RNA, 45 nt, Mus musculus
cuccaaagcucaagacuccuuugcugucagaugugugguguauau

SEQ ID NO: 47805 - RNA, 47 nt, Mus musculus
uauuucaguggcaucaugagugacaaguuuuuguauagaggucagag

SEQ ID NO: 47806 - RNA, 45 nt, Mus musculus
auauuuuagaagauuucaaguauuguuuuauguauuggauaagua

SEQ ID NO: 47807 - RNA, 49 nt, Mus musculus
ucauuacaguuugcaucagcagaauuccuugagguuuagaagauagccu

SEQ ID NO: 47808 - RNA, 46 nt, Mus musculus
gacacucccuauguuguauaucugucuuuuaauaaggccaccagac

SEQ ID NO: 47809 - RNA, 42 nt, Mus musculus
gcucauuuauucauuuucauucaaacccaguugggcccagcu

SEQ ID NO: 47810 - RNA, 45 nt, Mus musculus
auguuccuucuguaugauacucagaaaguaaucaaacgugcagaa

SEQ ID NO: 47811 - RNA, 45 nt, Mus musculus
uccugagagccgcaugguacaccgcugguauugugggaggccucu

SEQ ID NO: 47812 - RNA, 46 nt, Mus musculus
augcaggcuacuguuggaauugugacccaguauugaugugguagag

SEQ ID NO: 47813 - RNA, 45 nt, Mus musculus
aaagaaaaauaaaucaaaccaacaaacaaaaaacauccuggcaga

SEQ ID NO: 47814 - RNA, 46 nt, Mus musculus
agagugggguggcuggggaaaaugugguucuguugaguguuaagaa

SEQ ID NO: 47815 - RNA, 45 nt, Mus musculus
aaagauuucuuaaauagggucauuaguauauuucagcagcacuau

SEQ ID NO: 47816 - RNA, 45 nt, Mus musculus
ugaacuucaugaugacaggcucuugggugguaaguuagcuacuug

SEQ ID NO: 47817 - RNA, 46 nt, Mus musculus
ucaguauguaaaggauagaauucauucuacuuacauguacuuagca

SEQ ID NO: 47818 - RNA, 55 nt, Mus musculus
gcuguuggucuuggagcgcucugcuacuauggcuugggaaugucuaaugagauug

SEQ ID NO: 47819 - RNA, 41 nt, Mus musculus
ggcagccuuggaaccaucaauggaaaaaaucuuuaaaagua

SEQ ID NO: 47820 - RNA, 46 nt, Mus musculus
caggaauaugcuaccaagacaagaauuaggacucaccgugggaaaa

SEQ ID NO: 47821 - RNA, 46 nt, Mus musculus
cuccacuugugaagaauuccaucacaaagaaccaauggcucguaac

SEQ ID NO: 47822 - RNA, 46 nt, Mus musculus
uguuuuaacagggaaaccuagcagggcaauuuuguuuauuuugauu

SEQ ID NO: 47823 - RNA, 54 nt, Mus musculus
uuuaucgauauagucuaacuggaacugagacaauucaauuuuagaauguugggg

SEQ ID NO: 47824 - RNA, 46 nt, Mus musculus
uuggccaaguuuucuuguauuuaaauauuuuacaaauggggagaaa

SEQ ID NO: 47825 - RNA, 184 nt, Mus musculus
aauauauggcagauaacccucuuggcuguuccacgacauaaggccacgcagacuagguaggcucuguucgggucaguaagcugaagccauagguugagaugauguaauggcaugaaaguaccaaaagggcuccggguuuuuuccgcaaggucagaugccuagagcugugugcacuucguaguuc

SEQ ID NO: 47826 - RNA, 76 nt, Mus musculus
gaacacucaagcucaaggaagcguuaggaagggucgccacuaguucguagagacccagcccaggagccgguuucag

SEQ ID NO: 47827 - RNA, 68 nt, Mus musculus
gccguggggguggugcguggacgcggaggcagcgggcuagcggugagaggggaggaccgggcgcaucc

SEQ ID NO: 47828 - RNA, 45 nt, Mus musculus
cagcuguccaagggaucgcugaugauuacgauaaaaagaaacuag

SEQ ID NO: 47829 - RNA, 46 nt, Mus musculus; identical to SEQ ID NO: 44527

SEQ ID NO: 47830 - RNA, 46 nt, Mus musculus
aagucauggacauuuaguucaucaccaggguggucuuuugaagcag

SEQ ID NO: 47831 - RNA, 45 nt, Mus musculus
aucaacacugaugcauagugggaggaguucacaagcaccaccccu

SEQ ID NO: 47832 - RNA, 45 nt, Mus musculus
acuuuaaaaugcaugucuuugcuaguucuaagaacugggcugcag

SEQ ID NO: 47833 - RNA, 46 nt, Mus musculus
aaaccucaaaaugcagcuguguucgaaaagagauucuaccauggau

SEQ ID NO: 47834 - RNA, 45 nt, Mus musculus
aaaucuuuuuuaaaaagaggcaaaauccugggagagcuuuaggag

SEQ ID NO: 47835 - RNA, 47 nt, Mus musculus
ugaugaugauguuauaauuuucuaaauaauucucuauagacuagagg

SEQ ID NO: 47836 - RNA, 45 nt, Mus musculus
uuguaucuguccuuaccguucagggauugaguacuaccuucaguu

SEQ ID NO: 47837 - RNA, 47 nt, Mus musculus
uguguggaaugcucagugcaucuuaucucuaacuuccguggugacuc

SEQ ID NO: 47838 - RNA, 45 nt, Mus musculus
acagcuucucccucugguucacauccccuccaugcgccccugcuu

SEQ ID NO: 47839 - RNA, 45 nt, Mus musculus
acccagugucugggaccaagcuguccuuuucaguuccccgagugu

SEQ ID NO: 47840 - RNA, 46 nt, Mus musculus
uagccgguccuggggagcacaucaccacugccuuccaagccuacac

SEQ ID NO: 47841 - RNA, 46 nt, Mus musculus
cauggccaggaacuggcccacuuugcggucccacccuuuuggcaga

SEQ ID NO: 47842 - RNA, 45 nt, Mus musculus
cuacauuguggcuggugucuucauugccaucucacugcugcaggu

SEQ ID NO: 47843 - RNA, 45 nt, Mus musculus
agcaaaaagucgugaacacacaguguggcuaugauguccggauuc

SEQ ID NO: 47844 - RNA, 46 nt, Mus musculus
ugugauaaaacauuagguggucauuaagucauuaaagcauccugca

SEQ ID NO: 47845 - RNA, 46 nt, Mus musculus
ccggauuauuggaauuggaggaaugugcucuaccgugcccagcuuc

SEQ ID NO: 47846 - RNA, 75 nt, Mus musculus
uucaaauggccuugggucugcuaguuucucgaacuuuccccugcucuuuccuaagagaagucaucccugccaccg

SEQ ID NO: 47847 - RNA, 62 nt, Mus musculus
gacucccuaauccuagugaccucgcuacgccuugucuguucaguucuuucuucucuuuugug

SEQ ID NO: 47848 - RNA, 47 nt, Mus musculus
ccaaggaacacuugguuccaaagagaaaauaaaccagcaagcacuaa

SEQ ID NO: 47849 - RNA, 47 nt, Mus musculus
gucccucagccuuccugccccuuccccuugcuugcagcugcaccugg

SEQ ID NO: 47850 - RNA, 42 nt, Mus musculus
acuguagagcuauuccuguauucuuccucucugggaccuuuu

SEQ ID NO: 47851 - RNA, 45 nt, Mus musculus
gaccuuacccaugguagguuaaugcuaguagcuuaggugcugaga

SEQ ID NO: 47852 - RNA, 45 nt, Mus musculus
uccuauggauggguccaguucucuuggcuguagugagugcccgua

SEQ ID NO: 47853 - RNA, 45 nt, Mus musculus
gggucagcuucacauaagaaggcaaagguggacaucucagggaga

SEQ ID NO: 47854 - RNA, 42 nt, Mus musculus
uacccgaagugggugguuaggcaggcaggcuugguuuugaau

SEQ ID NO: 47855 - RNA, 23 nt, Mus musculus
uggaggccaaucugaccccaagu

SEQ ID NO: 47856 - RNA, 50 nt, Mus musculus
uugucauuucuugagccuauuuuuuugugcuauuacaguucuacccagaa

SEQ ID NO: 47857 - RNA, 67 nt, Mus musculus
aguuggggugugugugugugugugugugugugugugugugagagagagagagagagagagagagauu

SEQ ID NO: 47858 - RNA, 46 nt, Mus musculus
uuucacugcaguuuaaaaagaaaggucucauuuuagcaggcagagg

SEQ ID NO: 47859 - RNA, 42 nt, Mus musculus
caguccaaccacagcaggagauuauuguuuaaggggucuggu

SEQ ID NO: 47860 - RNA, 24 nt, Mus musculus
cccccccuaaugcgggggggcggg

SEQ ID NO: 47861 - RNA, 42 nt, Mus musculus
uaugugacaaaaugccagagauagcuaacuuauaagagagag

SEQ ID NO: 47862 - RNA, 44 nt, Mus musculus
gccuuguguggguacacccugggggugcauuuucggacgguaug

SEQ ID NO: 47863 - RNA, 45 nt, Mus musculus
uggccaggaagccaagccguguucaugguggguagcaguaggaga

SEQ ID NO: 47864 - RNA, 46 nt, Mus musculus
cuuucuaaccuugacaguguccuugucugcaucuaugugugcagug

SEQ ID NO: 47865 - RNA, 45 nt, Mus musculus
cugucucacccaugccuccuggcagcugccccagcuagggugagg

SEQ ID NO: 47866 - RNA, 44 nt, Mus musculus
ugaagaaaggcugaauuuuuuuuauuucccuugaaaguuucuug

SEQ ID NO: 47867 - RNA, 25 nt, Mus musculus
cacagcucauccugcaccccaccua

SEQ ID NO: 47868 - RNA, 46 nt, Mus musculus
ugagccaccauaugguugcugggauuugaacucuggaccuccggaa

SEQ ID NO: 47869 - RNA, 45 nt, Mus musculus
aggauuguuaacugugaagcugggcagguaguuauagcuugggag

SEQ ID NO: 47870 - RNA, 49 nt, Mus musculus
uaaacauuuuugaaccauaaucauuaugacuuuuaggcaggaaaagugg

SEQ ID NO: 47871 - RNA, 46 nt, Mus musculus
uuggggacaaaguguuugauauauauugguguucaaauaaguagcu

SEQ ID NO: 47872 - RNA, 36 nt, Mus musculus
cugucuuccucagccuguaccagcuggaggacagcg

SEQ ID NO: 47873 - RNA, 44 nt, Mus musculus
guauaggggguuuacauuuuauuucuguuugauuagcaagaggc

SEQ ID NO: 47874 - RNA, 46 nt, Mus musculus
ggucauugcucuuugugugugugugugugugugugugugugugugu

SEQ ID NO: 47875 - RNA, 49 nt, Mus musculus
uguacuauugcuuuuguaaggcauuuguugaacuuuacugucuggagag

SEQ ID NO: 47876 - RNA, 42 nt, Mus musculus
uaggaccugccuugaccuugcacugggcccugucaagggaac

SEQ ID NO: 47877 - RNA, 48 nt, Mus musculus
aguuugggggagggggggcaguugccaagaaaagucagugguagugga

SEQ ID NO: 47878 - RNA, 42 nt, Mus musculus
cacugucaguaaggcuucagaacuaaaggaagguggucgcca

SEQ ID NO: 47879 - RNA, 45 nt, Mus musculus
cauugacccaggcucacggcugcucacguuuguuuuucuggagug

SEQ ID NO: 47880 - RNA, 45 nt, Mus musculus
auguuaaggcagaguauuuaggacuguugcagcaggguuuuuaag

SEQ ID NO: 47881 - RNA, 46 nt, Mus musculus
aggcuucuuaguauuuauggaaacauaucaagcuacuaucccagcc

SEQ ID NO: 47882 - RNA, 45 nt, Mus musculus
gucugucugucuggguaucccacuuagggccaugugcauguuagg

SEQ ID NO: 47883 - RNA, 77 nt, Mus musculus
uacugcugaagcuucuuucaaaggaauauguccuaagugccgguauuugaagugaaguuuauuuucaugccuaguua

SEQ ID NO: 47884 - RNA, 87 nt, Mus musculus
uaacauuccguuuaggcccaguagggcaaauagggucccagacagaacagaguucaaucuaacaaaccagugagaguuauuugagga

SEQ ID NO: 47885 - RNA, 49 nt, Mus musculus
gcuuuccccagggccccaagagccagaaggcccuugcaccauauuuacu

SEQ ID NO: 47886 - RNA, 81 nt, Mus musculus
guucuggaggcuguaaagaaaaucaagcuacagacuccagcguccgggagaagcugauccuguacagcugcuggcugggag

SEQ ID NO: 47887 - RNA, 59 nt, Mus musculus
agggcauccuucuugagcaccgagaaaaagaauuuggagacagagugaacccacucucu

SEQ ID NO: 47888 - RNA, 41 nt, Mus musculus
gagucguggcaaugaggacccagaaucaauguggggacccu

SEQ ID NO: 47889 - RNA, 48 nt, Mus musculus
uagaaggcgaaggcuucauccuuggaggaguuuuugugauaggaucug

SEQ ID NO: 47890 - RNA, 48 nt, Mus musculus
ccagagaagccuccauuccaggcucgaaaggaguuauaccacaccccc

SEQ ID NO: 47891 - RNA, 70 nt, Mus musculus
agcagaccugauguccuugaagcccaaguuggaugagcuaggugucccucucuaugcgguggugaaggag

SEQ ID NO: 47892 - RNA, 41 nt, Mus musculus
ugugcucagugggugagggagcugcccuagaaaggcaggag

SEQ ID NO: 47893 - RNA, 45 nt, Mus musculus
uccaagccccgaaaagcagcacuggaauauuuggaagacauagac

SEQ ID NO: 47894 - RNA, 44 nt, Mus musculus
uguguuggccaggagcagugccacagcagcggcccccacagcuc

SEQ ID NO: 47895 - RNA, 44 nt, Mus musculus
ccgucacacacagguuugugucccaaggagcucacuagggcgug

SEQ ID NO: 47896 - RNA, 45 nt, Mus musculus
uuucccagccuccucucagucuuuggagaaacuuccaggucagau

SEQ ID NO: 47897 - RNA, 46 nt, Mus musculus
aauuaaccaauuaauuaaaagagaacuccaggaaagggauggccaa

SEQ ID NO: 47898 - RNA, 45 nt, Mus musculus
gcuggaugaagcaugaaugagcaggugggccaaagugggguuagu

SEQ ID NO: 47899 - RNA, 46 nt, Mus musculus
cuugccagugcucuuaacugcugagccaucucucuagccccuaguc

SEQ ID NO: 47900 - RNA, 45 nt, Mus musculus
uaagagcacuggcaaggcuucuagaggccuggguucgagucccag

SEQ ID NO: 47901 - RNA, 25 nt, Mus musculus
gauguuuaaaauuuuuugcuguccc

SEQ ID NO: 47902 - RNA, 46 nt, Mus musculus
uacugaaguagaacuuuaggagcaaaggacauuaagaacaggagau

SEQ ID NO: 47903 - RNA, 41 nt, Mus musculus
cacaggacaccccaauaccgaaacuggauagccacggccac

SEQ ID NO: 47904 - RNA, 86 nt, Mus musculus
auuuuauuuuauuuuguuugugugugugugugugugugugugugugugugugugaguuugugugugucauggcuuggcuuggcuga

SEQ ID NO: 47905 - RNA, 41 nt, Mus musculus
aucagggccaaugaugaaggaaugguccuuggcggaauggg

SEQ ID NO: 47906 - RNA, 45 nt, Mus musculus
gugagccaccaugugguugcugggauuugaacuccggacccucag

SEQ ID NO: 47907 - RNA, 45 nt, Mus musculus
ggagacagcaguguuugugugaguggggaacucucauagaugcag

SEQ ID NO: 47908 - RNA, 45 nt, Mus musculus
cuuuccugggcgaucugcuucaaccaucuugccuuccagcugaga

SEQ ID NO: 47909 - RNA, 50 nt, Mus musculus
uuggcaaguauggacgaauaguggaaauacuuuugaugaaagaccgggaa

SEQ ID NO: 47910 - RNA, 45 nt, Mus musculus
uuuguuaccuucgaaagcccagcagaugcuaaagaugcagcuaga

SEQ ID NO: 47911 - RNA, 44 nt, Mus musculus
gaagcgggggucccccuccuaaaagaucaacaccuuccggacca

SEQ ID NO: 47912 - RNA, 43 nt, Mus musculus
gguaaguauaaucucuugguggcggugcauaaucucugguguc

SEQ ID NO: 47913 - RNA, 36 nt, Mus musculus
gaagugaucucuacucaaguggccgugaucgaguug

SEQ ID NO: 47914 - RNA, 27 nt, Mus musculus
caagaggagguggccguggagggagcc

SEQ ID NO: 47915 - RNA, 46 nt, Mus musculus
auuauaaauagagacggaggcuggaacgcugcucccauugccauug

SEQ ID NO: 47916 - RNA, 46 nt, Mus musculus
agugagaacucuuggagcuacuucguccagauucaugcugggcauc

SEQ ID NO: 47917 - RNA, 46 nt, Mus musculus
acuuugacagcccaccucgcucccagacaccacaagauaccaacag

SEQ ID NO: 47918 - RNA, 53 nt, Mus musculus
gagaaaaagagcacucugucugaggaagauuauauugagagaagaagagaagu

SEQ ID NO: 47919 - RNA, 42 nt, Mus musculus
auuccccccaaggaguuccuuuuuaaacacccgaagcgcaga

SEQ ID NO: 47920 - RNA, 46 nt, Mus musculus
caucucuguuacugucucaucugcuggccauuggcuuggggaucua

SEQ ID NO: 47921 - RNA, 45 nt, Mus musculus
cuucuguucacacagugaggauucaugucugagcugugacagcua

SEQ ID NO: 47922 - RNA, 44 nt, Mus musculus
aauacaaacaggagaauucagcagagugauaaaggugccugcaa

SEQ ID NO: 47923 - RNA, 42 nt, Mus musculus
auugccauugcugaagugcaguucuacccaggagcccugcag

SEQ ID NO: 47924 - RNA, 46 nt, Mus musculus; identical to SEQ ID NO: 47916

SEQ ID NO: 47925 - RNA, 47 nt, Mus musculus
ccaagaguucucacugugacagcccaccucgcucccagacaccacaa

SEQ ID NO: 47926 - RNA, 45 nt, Mus musculus
uuggcgagaaaaacagcacucugucugaggaagauuauauugaga

SEQ ID NO: 47927 - RNA, 42 nt, Mus musculus
auuccccccaaggaguuccuuuuuaaacacccgaagcgcaca

SEQ ID NO: 47928 - RNA, 46 nt, Mus musculus; identical to SEQ ID NO: 47920

SEQ ID NO: 47929 - RNA, 45 nt, Mus musculus; identical to SEQ ID NO: 47921

SEQ ID NO: 47930 - RNA, 44 nt, Mus musculus; identical to SEQ ID NO: 47922

SEQ ID NO: 47931 - RNA, 45 nt, Mus musculus
aaaagacuggaaaugaaaaacaaaaucuuugccaaauccauugga

SEQ ID NO: 47932 - RNA, 47 nt, Mus musculus
gggauguugugaaggagcuuggaagauaaugaugagaacagugcagg

SEQ ID NO: 47933 - RNA, 46 nt, Mus musculus
uggcuccuaucaccagauugggcuuucuagaaaccuucagccuaau

SEQ ID NO: 47934 - RNA, 46 nt, Mus musculus
aaucccuauuccuuuguguccuuguguuuggauuacuccuggguau

SEQ ID NO: 47935 - RNA, 46 nt, Mus musculus
agugaagucuaauaccuaauucuaaguuuauaguuaacaagcaguu

SEQ ID NO: 47936 - RNA, 45 nt, Mus musculus
uggugauguagcuuguuuaguaauguauccuauuucccccucccu

SEQ ID NO: 47937 - RNA, 46 nt, Mus musculus
gcaugaaacucuguuuuucuccacaggauggagcuguaacguagau

SEQ ID NO: 47938 - RNA, 86 nt, Mus musculus
agacugcccaguuagauuuaaguuuuagaaaagcaaccaguuuuccuuucaauguuaaguguguugaaguuuauuagggccuauuu

SEQ ID NO: 47939 - RNA, 89 nt, Mus musculus
cauuuuuaaaaauuguguucauguuuaauauuauugugaauagaaguaguauuuugauaauauacaaauuuuaauacuaagcaaaagua

SEQ ID NO: 47940 - RNA, 50 nt, Mus musculus
ugcaaugacuguccuaagccaaacguuuauauaaagcugcuuuuguaaaa

SEQ ID NO: 47941 - RNA, 48 nt, Mus musculus
gagaacuagagaacuucaggcacuuguuacagaauguucacugaggag

SEQ ID NO: 47942 - RNA, 45 nt, Mus musculus
cuuacaaauuauuuuuucuaucgaaacugaguuaaagggagagau

SEQ ID NO: 47943 - RNA, 52 nt, Mus musculus
aagcggaccaaguuaugaguuccagcuaaccagacaagaaauaguaucacug

SEQ ID NO: 47944 - RNA, 62 nt, Mus musculus
uccggcuacacuuuaggaacauuucaagaaucauggacuguguuggcugcuucaagugccgc

SEQ ID NO: 47945 - RNA, 46 nt, Mus musculus
uuaaucugccuuguaugaauaugcauucagggcugaccaguuggau

SEQ ID NO: 47946 - RNA, 45 nt, Mus musculus
uuggaagugggacuguguaccuggaguuccugucuggcugggagg

SEQ ID NO: 47947 - RNA, 46 nt, Mus musculus
auccccacagcuuccaggagacuggaagacagacagacagacagac

SEQ ID NO: 47948 - RNA, 125 nt, Mus musculus
ugauuguaacagagcaguagcauuggaaguugaguaaaaggaugcuuuugagaggcugaggacagagcugggauaggugggagaucuugaccagagcggaguucccauuggaggaggcugcagug

SEQ ID NO: 47949 - RNA, 84 nt, Mus musculus
ugcaggucauuuccuuugcacuucgaugagaauucuuuuuuugcuggggauaaaaacgaagcacauaaacuaaagguaauuaau

SEQ ID NO: 47950 - RNA, 46 nt, Mus musculus
acuguguacuacauuuuuguuuuuuauguucuuaauaccagcauua

SEQ ID NO: 47951 - RNA, 46 nt, Mus musculus
auuauaacauagauauuaacauauaggugagggguggugcccagag

SEQ ID NO: 47952 - RNA, 45 nt, Mus musculus
aauaaaguucaggaugcagaaaacaaagcguuacuucuggagaua

SEQ ID NO: 47953 - RNA, 42 nt, Mus musculus
agucuucuucugacgcaugagggcacacacauacaugcagau

SEQ ID NO: 47954 - RNA, 88 nt, Mus musculus
uuguaggccacagacaauucaaaggccuuuggcuucugggcgaggugaguuauuugcaucuucucuucuuuauuggcaaguggauuug

SEQ ID NO: 47955 - RNA, 46 nt, Mus musculus
uuuauccucuucaaccuaaauugauuuccaagaauagcuccaaggu

SEQ ID NO: 47956 - RNA, 45 nt, Mus musculus
gaaaacuguuuuaaguauguacuguuggucuagaccugugcagau

SEQ ID NO: 47957 - RNA, 45 nt, Mus musculus
gacuuaacaaugacauuccuuggaauguaacucaaaagaauugga

SEQ ID NO: 47958 - RNA, 46 nt, Mus musculus
auacuuccaugggccuuggauucuacuuacuuguuuuaugggagaa

SEQ ID NO: 47959 - RNA, 42 nt, Mus musculus
accaaagagcaucucaaggguucuggaauauuugccacagau

SEQ ID NO: 47960 - RNA, 45 nt, Mus musculus
ccucaaaauauucucauuuuguaaauauauguaacauuggcagag

SEQ ID NO: 47961 - RNA, 46 nt, Mus musculus
agaaauuacuauauuauucucaaaauuguuucgucagccaucagau

SEQ ID NO: 47962 - RNA, 45 nt, Mus musculus
uggaauguucuggaagcucccaggagaggcaguugagcccacagu

SEQ ID NO: 47963 - RNA, 69 nt, Mus musculus
uugggaacuugaguaaaacuaagacuuuaggcagagauaguugacaguaugguacggggggcaguggac

SEQ ID NO: 47964 - RNA, 46 nt, Mus musculus
gaugauuuguuuguugguggguggguguauuaaauccuagucagag

SEQ ID NO: 47965 - RNA, 46 nt, Mus musculus
acuguuucaaaccacaaaauaagauuuuuuuuuccaguuuguagug

SEQ ID NO: 47966 - RNA, 47 nt, Mus musculus
ccaacugguaccuauuaguccaacauugguagguggggauaggcaga

SEQ ID NO: 47967 - RNA, 46 nt, Mus musculus
augaggaggaagaagagaaggaagaggaagaagaggaggaggagga

SEQ ID NO: 47968 - RNA, 46 nt, Mus musculus
cuagaguagguaauuuaccaagauguaucucaaaagacaaagugaa

SEQ ID NO: 47969 - RNA, 42 nt, Mus musculus
guuuuauuuucuccuucccccaugaucccagagggcuagaga

SEQ ID NO: 47970 - RNA, 46 nt, Mus musculus
ugcaauccugaaacucucucuuccuuaaaucucuguggacccuggc

SEQ ID NO: 47971 - RNA, 42 nt, Mus musculus
agccgugcugugucauacuugcauguaaaugcucugccaguc

SEQ ID NO: 47972 - RNA, 46 nt, Mus musculus
accuuaugagcauaugaagccaaauuuucucaacccagcaaaagaa

SEQ ID NO: 47973 - RNA, 46 nt, Mus musculus
cacaccugucaacuugagauuacuccccagcacccacgugaugaaa

SEQ ID NO: 47974 - RNA, 45 nt, Mus musculus
aagagaggaucuucuauuguacugguaacaucagagacuggagag

SEQ ID NO: 47975 - RNA, 42 nt, Mus musculus
cgcggcauccgaccaggaaauucuggaagucaagaccacauu

SEQ ID NO: 47976 - RNA, 45 nt, Mus musculus
caaucaaaaugauuuuuaaaucuugucauuauuuagcagucauaa

SEQ ID NO: 47977 - RNA, 44 nt, Mus musculus
ccuagugaccugacaucaacccugcaacccacauucagguagaa

SEQ ID NO: 47978 - RNA, 46 nt, Mus musculus
gucaaagaaaagagaaaauaaaaguaaggagaggagaaguugaggc

SEQ ID NO: 47979 - RNA, 46 nt, Mus musculus
gagcuacauagaccagguagguagauagauagguagguagguagau

SEQ ID NO: 47980 - RNA, 41 nt, Mus musculus
aguuggagcugaagcuuuguaaucagcuagaaggagcagug

SEQ ID NO: 47981 - RNA, 45 nt, Mus musculus
guagcguaaaagaagaggaggcuagaaauggauucaguuucagug

SEQ ID NO: 47982 - RNA, 46 nt, Mus musculus
aaguccugggucagaaguucgagcgaggagcuccgcugcuacagug

SEQ ID NO: 47983 - RNA, 45 nt, Mus musculus
uaaauauauacucagagguuaagaugugacauuuaacguugaaga

SEQ ID NO: 47984 - RNA, 45 nt, Mus musculus
aaaaaaaaaagaaagaaagaaaagaaaaagaaagagagagagaga

SEQ ID NO: 47985 - RNA, 46 nt, Mus musculus
gacagacaggcaggcagguagacagacagacaaagauggagaagag

SEQ ID NO: 47986 - RNA, 42 nt, Mus musculus
ucugaauuauuuuacuuaguauauauauuuuacugcacaaua

SEQ ID NO: 47987 - RNA, 46 nt, Mus musculus
cuauaaacguaaguaauugauauugcugguaacucuaguaauaggc

SEQ ID NO: 47988 - RNA, 45 nt, Mus musculus
auuuuaaucucuuuuguguuaacauucuaaauucuaauugucagg

SEQ ID NO: 47989 - RNA, 46 nt, Mus musculus
gaauaaaacaguauugagaaaauaaguguaauuguuauguccagau

SEQ ID NO: 47990 - RNA, 45 nt, Mus musculus
aaugucccagcaccagucaccaguugcaggccugggauugguaaa

SEQ ID NO: 47991 - RNA, 49 nt, Mus musculus
guucacagaguggccacacagcgaccuaagagacugaagaagagaggag

SEQ ID NO: 47992 - RNA, 42 nt, Mus musculus
ucaacaguacauaguguugagcaguaguuguaaaaagcaauu

SEQ ID NO: 47993 - RNA, 45 nt, Mus musculus
uucaagauaaacacugacagaucuguauagcauuacuccaguaga

SEQ ID NO: 47994 - RNA, 42 nt, Mus musculus
ggacggacggacggauggauggauggauggauggauggaugg

SEQ ID NO: 47995 - RNA, 48 nt, Mus musculus
gagggaagggguauguguguauguauaugugugucagagagagaggga

SEQ ID NO: 47996 - RNA, 44 nt, Mus musculus
gcagcacacaucuucccauguacccccuagguaccugugccaga

SEQ ID NO: 47997 - RNA, 45 nt, Mus musculus
guccauugugugagcauguggcuuuccuuuccccguuggucaugu

SEQ ID NO: 47998 - RNA, 42 nt, Mus musculus
ggcacuuuggacuuacuguagcuauguguauaaagggcuguu

SEQ ID NO: 47999 - RNA, 46 nt, Mus musculus
uccaaaugguuggggcaggggcgggaaggugauagaaagcacagag

SEQ ID NO: 48000 - RNA, 46 nt, Mus musculus
ucuuucaacaauucguaauucaacuauuucaauuucagcuacuggu

SEQ ID NO: 48001 - RNA, 47 nt, Mus musculus
cauguaugcacuugaaccaugucugugcauggugcccauagaaguca

SEQ ID NO: 48002 - RNA, 46 nt, Mus musculus
ugcuaaagcaugcaugcauuaggugcaaguaacuaugauggcagau

SEQ ID NO: 48003 - RNA, 41 nt, Mus musculus
ucacguuuuuucuguccaacacgggggaggggagagggcug

SEQ ID NO: 48004 - RNA, 25 nt, Mus musculus
guaaagguggguauuauuaaaugca

SEQ ID NO: 48005 - RNA, 46 nt, Mus musculus
uuuuugguccaccucuuuaccccaucauaacccuugguacggaguu

SEQ ID NO: 48006 - RNA, 45 nt, Mus musculus
cugccuggccacauucauuuugaaauaaccuuuccagcccugaug

SEQ ID NO: 48007 - RNA, 70 nt, Mus musculus
ucacguucucgauggugucacugggcuccaccucuagggugauggucuugccggucagggucuucacgaa

SEQ ID NO: 48008 - RNA, 50 nt, Mus musculus
gugauggucuugccggucagggucuucacgaagaucugcaugccaccccu

SEQ ID NO: 48009 - RNA, 46 nt, Mus musculus; identical to SEQ ID NO: 35696

SEQ ID NO: 48010 - RNA, 46 nt, Mus musculus; identical to SEQ ID NO: 35699

SEQ ID NO: 48011 - RNA, 46 nt, Mus musculus; identical to SEQ ID NO: 35696

SEQ ID NO: 48012 - RNA, 45 nt, Mus musculus; identical to SEQ ID NO: 35703

SEQ ID NO: 48013 - RNA, 45 nt, Mus musculus
ccaagggcgcgcgcgcgcgcgcgcgcacacacacacacacacaca

SEQ ID NO: 48014 - RNA, 81 nt, Mus musculus
agcgacaggcagccgaccccuagcggaucuaacuuccagccagaagacucugaccccgucgccaacucaguccgccgcggg

SEQ ID NO: 48015 - RNA, 41 nt, Mus musculus
agaaggagcggcuucugaaguacugucuaguagccccgcca

SEQ ID NO: 48016 - RNA, 46 nt, Mus musculus
cacguguauacaaaaauauuaguuuuaaagaaugucaaaaggagaa

SEQ ID NO: 48017 - RNA, 45 nt, Mus musculus
uaugcacugagccacccgucagcucaccaagaucugcccucauau

SEQ ID NO: 48018 - RNA, 79 nt, Mus musculus
uaauauauaauguaauauagauaauauauaugauaggaaaguagaacagagauuaugugggggaaggaaaagaucuaaa

SEQ ID NO: 48019 - RNA, 48 nt, Mus musculus
uuuugucaguugaaguacacuucauacaccuuguuuuaacggcaaaga

SEQ ID NO: 48020 - RNA, 46 nt, Mus musculus
aguacacuguagcugucuucagagacuccagaagagggcaucagau

SEQ ID NO: 48021 - RNA, 46 nt, Mus musculus
gaagguuugggacucuauauuuugacagcuccccucuggugcagaa

SEQ ID NO: 48022 - RNA, 45 nt, Mus musculus
aagcuggugauauuaaugcuuacuguucuaauccaguggccaagg

SEQ ID NO: 48023 - RNA, 46 nt, Mus musculus
cauuuugguuuuauugaaaugccaucuaaauauguuagcuguagau

SEQ ID NO: 48024 - RNA, 30 nt, Mus musculus
uuagaacaacacagaagaaucgguccaguu

SEQ ID NO: 48025 - RNA, 46 nt, Mus musculus
ugguuugcuuacggcuuaaagacacauaaacuuguaaaugggagau

SEQ ID NO: 48026 - RNA, 47 nt, Mus musculus
uguaaauaggauagauuuugugguaauugaaugguugaaaagcucug

SEQ ID NO: 48027 - RNA, 42 nt, Mus musculus
ugguucaguacuaaucauuucagccauguuuugcaugaggua

SEQ ID NO: 48028 - RNA, 46 nt, Mus musculus
ugugaccauggcuaaugucagagagguuaaggcagagaccauaguu

SEQ ID NO: 48029 - RNA, 46 nt, Mus musculus
uuacuuagcacaauguuugaaaguuggucaauauaaaaucacauca

SEQ ID NO: 48030 - RNA, 57 nt, Mus musculus
uucgcucagugugcuugcauugccuguugagauuaugaguccaugaaacuucacauu

SEQ ID NO: 48031 - RNA, 46 nt, Mus musculus
uugaugagcugaagaccgacuacaagaacccuauagaccagugcaa

SEQ ID NO: 48032 - RNA, 46 nt, Mus musculus
ucguuggccacaucuccgaguuuuccccugaagucauacuuuggau

SEQ ID NO: 48033 - RNA, 46 nt, Mus musculus
aguggccuaagaacagggaagccagugguguaaauaccagcccaag

SEQ ID NO: 48034 - RNA, 46 nt, Mus musculus
gcuucccguuccuuuauuucugauuuggagcuggcucucgugucug

SEQ ID NO: 48035 - RNA, 42 nt, Mus musculus
gaagguuccaguuagguugucaggccugguagcaagugccuu

SEQ ID NO: 48036 - RNA, 42 nt, Mus musculus
cguguaucugaggaucugcauuaacuuaaauuuuggccccag

SEQ ID NO: 48037 - RNA, 45 nt, Mus musculus
gaagcacuuaucaaauauagagcauuaugcuggucacagagggau

SEQ ID NO: 48038 - RNA, 42 nt, Mus musculus
uccccacagacacacccuuugcagccugaccaauucucuaac

SEQ ID NO: 48039 - RNA, 42 nt, Mus musculus
guggauggauggguagguaggguaggugaaugggugggugug

SEQ ID NO: 48040 - RNA, 93 nt, Mus musculus
uuacagucaaguaggccucaaguuaccgucuucgaccaugaggugggaggaguguguggauggguuugaaggauaaggauguggcugagauga

SEQ ID NO: 48041 - RNA, 46 nt, Mus musculus
agccuaggccugggagucuuaucucuucucacuccaucucugccaa

SEQ ID NO: 48042 - RNA, 46 nt, Mus musculus
ggugacccagucuugaagaugcaaauucacgugcagaaagaggcag

SEQ ID NO: 48043 - RNA, 46 nt, Mus musculus
cagguuaaaaugucgaaggccaaagggaaggccagagggucugagg

SEQ ID NO: 48044 - RNA, 45 nt, Mus musculus
ugagcugcagugccuuuuuuuguauuuacccauugaccaccccgc

SEQ ID NO: 48045 - RNA, 42 nt, Mus musculus
cgacgcugcugaugguuuguuuuguguguuccccacccccac

SEQ ID NO: 48046 - RNA, 42 nt, Mus musculus
ggucccuggaaaagccuccucauucaccauuccuugccccuu

SEQ ID NO: 48047 - RNA, 46 nt, Mus musculus
cagagacugaguuguauaaguuggaauuucaguacuguggaaagau

SEQ ID NO: 48048 - RNA, 46 nt, Mus musculus
ggaguccauggaauuuguggacccuggaguugcuggagaaucagac

SEQ ID NO: 48049 - RNA, 45 nt, Mus musculus
guuugcaacaucuacaguagagaaaauaaaaaucuagagucaguc

SEQ ID NO: 48050 - RNA, 46 nt, Mus musculus
uaucguucucucagcuaagacaaggccagcaagaacuucagcagau

SEQ ID NO: 48051 - RNA, 23 nt, Mus musculus
ggcugagccuagcaugugcagag

SEQ ID NO: 48052 - RNA, 46 nt, Mus musculus
guguuuguuacuacaguauauuaaaugagguuuugagcuggcugag

SEQ ID NO: 48053 - RNA, 41 nt, Mus musculus
aaggaagaaaacuguaagcagagaaggcacagagucccagg

SEQ ID NO: 48054 - RNA, 46 nt, Mus musculus
aauuggguagaagagaagaaaacaacccaaggaccuggugagaagc

SEQ ID NO: 48055 - RNA, 42 nt, Mus musculus
ucuuaucuuccucagcuaacaguaaauaaaagggaggcaguc

SEQ ID NO: 48056 - RNA, 46 nt, Mus musculus
uggguggcacuuaagugagauguaaucagaaggaacgguggggaug

SEQ ID NO: 48057 - RNA, 46 nt, Mus musculus
ucuggaaauuggggaaaauaggaccaaauccggcacauuagcagau

SEQ ID NO: 48058 - RNA, 45 nt, Mus musculus
ugugauccaccaugugguugcugggaauugaacucaagaccucug

SEQ ID NO: 48059 - RNA, 42 nt, Mus musculus
cagagauucacaagccucuucucaucucuagugccaccgugu

SEQ ID NO: 48060 - RNA, 45 nt, Mus musculus
auucccagcagccacaugguggcucacaaccauuuguaaugggga

SEQ ID NO: 48061 - RNA, 46 nt, Mus musculus
aguacuaaaagcuauggaaggaaagcggcuuacagaucaguuggua

SEQ ID NO: 48062 - RNA, 46 nt, Mus musculus
uauuuugggaaacagguacaggacagaaucuacaagcacuggagug

SEQ ID NO: 48063 - RNA, 45 nt, Mus musculus
uuacuugcaugugugaucuaagaguuggucucagucgguuacagg

SEQ ID NO: 48064 - RNA, 46 nt, Mus musculus
agaagucagugcucuuaccugcugagccaucucuccagcccccaag

SEQ ID NO: 48065 - RNA, 46 nt, Mus musculus
cuuccuuauuaagggagaaaaugguuuccuggcuucccugucaguu

SEQ ID NO: 48066 - RNA, 46 nt, Mus musculus
cuuguuccaaggccccaaacaguuaaaacccagacauccuggaucc

SEQ ID NO: 48067 - RNA, 46 nt, Mus musculus
ugcuuccugagcgcugggaaaagugugugugcuauuauguccagau

SEQ ID NO: 48068 - RNA, 42 nt, Mus musculus
uuugaauuaagauauuagaaaacugaaugcuuagcugaagaa

SEQ ID NO: 48069 - RNA, 46 nt, Mus musculus
cuacauggcuacugacccuguccuuucuaaggcagacuucagucuc

SEQ ID NO: 48070 - RNA, 48 nt, Mus musculus
aggguugaauggaugaagggauuccgcagggacuuccaggcggagggu

SEQ ID NO: 48071 - RNA, 42 nt, Mus musculus
aaggggccggucuccgggccccucuggccgcgacgcccggac

SEQ ID NO: 48072 - RNA, 42 nt, Mus musculus
ccugagcuacugcggcggggccugggagcgcgcugaccagga

SEQ ID NO: 48073 - RNA, 42 nt, Mus musculus
cuuagcagcuauguggauuagcauagcuucagaagcugcggg

SEQ ID NO: 48074 - RNA, 46 nt, Mus musculus
gcaguggcucugguguggguaaaagcauuuggugaugagaccugag

SEQ ID NO: 48075 - RNA, 46 nt, Mus musculus
uauaauccuuucuugauucauugucagcauuauggaaagccguugg

SEQ ID NO: 48076 - RNA, 46 nt, Mus musculus
uuaagucauugacuaaguucuggaugcuaauccucuguugaaugag

SEQ ID NO: 48077 - RNA, 45 nt, Mus musculus
uuuuucaagacaaggcuucucuguguagccaaggcuggccuugaa

SEQ ID NO: 48078 - RNA, 41 nt, Mus musculus
accaaaaaaggaaaccaaaacaaaugaauaucuuugggaca

SEQ ID NO: 48079 - RNA, 46 nt, Mus musculus
auucaaaccaccacacccaugaaaauccaaaggaagacagcaccau

SEQ ID NO: 48080 - RNA, 46 nt, Mus musculus
uugggcacuuggugccuuucauuucugucucggugaaccuggucag

SEQ ID NO: 48081 - RNA, 48 nt, Mus musculus
cauccauccauccauuguuuacuuaaaaacaaaaacaaaaagacaaaa

SEQ ID NO: 48082 - RNA, 104 nt, Mus musculus
uuuucaugaaagaaacauuauaugaugaaguucuugcaaaacaaaaaagagagcaaaaguugauuucuacaaaaacagauaaaaagaaggcagaaaagaagaag

SEQ ID NO: 48083 - RNA, 71 nt, Mus musculus
ggaggaugaacaguuuguaccugcuccacugaauguggcagaaacuuccaguaguguuagggaaagaaaga

SEQ ID NO: 48084 - RNA, 123 nt, Mus musculus
agaaggagaagaaacaaaaaccuucccuugaagagcaggucaucaaagaaagugaugcaucaaagaucccaggcaaaaaaguggaaccuguccuaguuaccaaacagccggccccacccccac

SEQ ID NO: 48085 - RNA, 27 nt, Mus musculus
cagaagaagucuaaaaauggaagcggu

SEQ ID NO: 48086 - RNA, 45 nt, Mus musculus
uacaggagaagucuguggguuauacugaaauacaugucauuuucu

SEQ ID NO: 48087 - RNA, 46 nt, Mus musculus
uauuguagaguaagaaagcugggaugagaugcuuguagugacagag

SEQ ID NO: 48088 - RNA, 92 nt, Mus musculus
aucucaugauggauaagagagaaauuauugauaugauuaaaccugaucauguugaaggaauccagaaaucuggaacaaaaaagcugaagauu

SEQ ID NO: 48089 - RNA, 46 nt, Mus musculus
cauuuguucaaauuauuguuuguguuucuaauucuaacuuugccau

SEQ ID NO: 48090 - RNA, 45 nt, Mus musculus
ggugaauuugugcagugucgucuuuggggcuguucaggccgugag

SEQ ID NO: 48091 - RNA, 45 nt, Mus musculus
cucagagaacggcacugguggcaucuuggcauguugugacagagu

SEQ ID NO: 48092 - RNA, 46 nt, Mus musculus
uucuuggugagaggucauguaauuucauagucucuuaauccugugg

SEQ ID NO: 48093 - RNA, 46 nt, Mus musculus
gaaggaagaugcugcugccucaaaggagcgcuguaagcaguugacu

SEQ ID NO: 48094 - RNA, 62 nt, Mus musculus
gaugacagagaaagaaagaagcaguguuguuauagcaagaaugaaagaucggauuggaacac

SEQ ID NO: 48095 - RNA, 62 nt, Mus musculus
uagaaaaggaacacaauauauuucaaaacaaaaugcaugccaguuaccaagagacucagcag

SEQ ID NO: 48096 - RNA, 46 nt, Mus musculus
cacggugcucaggcuguguugcaccuucugaaucaacacuguccag

SEQ ID NO: 48097 - RNA, 46 nt, Mus musculus
aguaggcccauccugucuaccuagcuuuggauguaugaguggucag

SEQ ID NO: 48098 - RNA, 42 nt, Mus musculus
augucuuucaaguagauuuuaugaugucucuuaguuaugcuu

SEQ ID NO: 48099 - RNA, 45 nt, Mus musculus
ucuuuguuuccuaaucuuuuauauuuuuaaaauaguuucagcaag

SEQ ID NO: 48100 - RNA, 46 nt, Mus musculus
uuggguaguuacuggcuugagcuuugcuuccuccauuugccucgaa

SEQ ID NO: 48101 - RNA, 79 nt, Mus musculus
uaaauaaacugcgccaagacugugggaggcuggugagugaacugaacgagaagacaggaaagcugcagcaagagggagu

SEQ ID NO: 48102 - RNA, 46 nt, Mus musculus
agugggucagauaaguuuguaggagcagcugucugucaugaucuaa

SEQ ID NO: 48103 - RNA, 55 nt, Mus musculus
aauaucaagguucaacugcaagaagcugagaggcgcugggaagaaguucagagcu

SEQ ID NO: 48104 - RNA, 43 nt, Mus musculus
cuaugcagacugggacacuuccacucugcugucgggggagaaa

SEQ ID NO: 48105 - RNA, 44 nt, Mus musculus
gcaaagacuaaugcaguugauggaauccgagcaaaagagggcga

SEQ ID NO: 48106 - RNA, 42 nt, Mus musculus
gucugaucaugaaggggauccugucagacacuuuugcugagg

SEQ ID NO: 48107 - RNA, 45 nt, Mus musculus
aagccugauugauguaaauacuauacccuggucucacaugcugga

SEQ ID NO: 48108 - RNA, 42 nt, Mus musculus
auucauuagcgaaugaacaggaucacuuagcaagcaaggagg

SEQ ID NO: 48109 - RNA, 46 nt, Mus musculus
cuaggauguacagaauaugaauuucuuauuaaaagcugaagugcag

SEQ ID NO: 48110 - RNA, 25 nt, Mus musculus
cgguuuucugugucuaugcugguua

SEQ ID NO: 48111 - RNA, 41 nt, Mus musculus
agacugcuugaggagcagcugcagcacgaaguugccagcaa

SEQ ID NO: 48112 - RNA, 46 nt, Mus musculus
gaaacugcagaccgcuguuucucagcaggugagcuuguguggguag

SEQ ID NO: 48113 - RNA, 41 nt, Mus musculus
uuccaacuuucuuuaaccuccuuuuuccuauaaagcaguua

SEQ ID NO: 48114 - RNA, 46 nt, Mus musculus
aaaagagaacagguuugugauguaaaaauuucaggucucuugccag

SEQ ID NO: 48115 - RNA, 48 nt, Mus musculus
ggacuguggaagaauuacuggagacuggacucauucagguggccacca

SEQ ID NO: 48116 - RNA, 45 nt, Mus musculus
agagaacuccacccugaccagagaaguucaagaguugaaggcuaa

SEQ ID NO: 48117 - RNA, 42 nt, Mus musculus
guugugaaccaccaugugguagcuggaauuugaacuuaggac

SEQ ID NO: 48118 - RNA, 46 nt, Mus musculus
cuugauuuguuuauuuaaggauccaugagaaagauggacagaucaa

SEQ ID NO: 48119 - RNA, 46 nt, Mus musculus
gaacagcaugaaggcugccuuagaagacagggacagagaccugaga

SEQ ID NO: 48120 - RNA, 59 nt, Mus musculus
ggacaaugaaauuaagagaauagaaguuaaauuaaaggacacggagagugauguuucua

SEQ ID NO: 48121 - RNA, 45 nt, Mus musculus
aaguuccaguguucagacuuguauagaagugccucucuacucucu

SEQ ID NO: 48122 - RNA, 46 nt, Mus musculus
gguacaagaggaaaauaaauuccuuaagugccagcucagucaccag

SEQ ID NO: 48123 - RNA, 46 nt, Mus musculus
auucuaucagugcuccagcuccguuauaauauacaugugugugcag

SEQ ID NO: 48124 - RNA, 46 nt, Mus musculus
ucuuacauaaugcuuuucuuagaaagucagcuaauaucuuguagag

SEQ ID NO: 48125 - RNA, 45 nt, Mus musculus
uauuaagcugggcagugguggcucacaccuuuaaucccagcacuu

SEQ ID NO: 48126 - RNA, 42 nt, Mus musculus
cguugucauuagcuuuacugacucugggcuguaacagggaga

SEQ ID NO: 48127 - RNA, 23 nt, Mus musculus
gggcucucugagccaaacaguag

SEQ ID NO: 48128 - RNA, 47 nt, Mus musculus
ucugcaaugaguuagagucuuugaagaaugcuguugaacaccagagg

SEQ ID NO: 48129 - RNA, 76 nt, Mus musculus
ugagaggcaguacacauauugguaauuaugucugcuagggucuuagaacuuggauagauuuauacuaggaugggaa

SEQ ID NO: 48130 - RNA, 46 nt, Mus musculus
acaaagaguagaugcagcuggauuuuguaaaucucucuuaccaaaa

SEQ ID NO: 48131 - RNA, 29 nt, Mus musculus
ugggaugcauaguaaagugggguucccag

SEQ ID NO: 48132 - RNA, 46 nt, Mus musculus
cuucuuguacuuacaggcaguggggagcagggucauaauggaggag

SEQ ID NO: 48133 - RNA, 46 nt, Mus musculus
uuuacacugaaguguagguaucuuaaaccaguaccagguuucacag

SEQ ID NO: 48134 - RNA, 27 nt, Mus musculus
ggcaacacguggaagcuauugaguuag

SEQ ID NO: 48135 - RNA, 46 nt, Mus musculus
aguguccacuguuuugugagacucuuuuacucuaaauaggggcuuu

SEQ ID NO: 48136 - RNA, 49 nt, Mus musculus
aaaagaaggcaaaagcgugcguagcuggaacuucagacgcagaggcggu

SEQ ID NO: 48137 - RNA, 65 nt, Mus musculus
agcacagauugaaagaagcuagugagaugcacacuuugcuacagcuggaaugugaaaaauacaag

SEQ ID NO: 48138 - RNA, 60 nt, Mus musculus
caaaaacuucagcgaaguguggagcaagaagaaaguaaauggaaaauuaaagcugacgag

SEQ ID NO: 48139 - RNA, 46 nt, Mus musculus
gcaggcuguagguugcuggccuugcucuguguuaauacccuuggag

SEQ ID NO: 48140 - RNA, 45 nt, Mus musculus
gagcgagagcuagagcgacuaagacaagaaaacaaagauauggag

SEQ ID NO: 48141 - RNA, 93 nt, Mus musculus
ggaaggaaaauguaaauggcuuaacugcccuuuguuguguugacagcugagaagagaaagagagcauuuggaaauggagcuagagaaggccga

SEQ ID NO: 48142 - RNA, 46 nt, Mus musculus
cgugagcugugugggcgcugggaaaugaaccuuuggaauugaacag

SEQ ID NO: 48143 - RNA, 46 nt, Mus musculus
caguuaaaugaaacacacucaaaacuucaaaaugaacaaacggaga

SEQ ID NO: 48144 - RNA, 45 nt, Mus musculus
caauucccagcaaccacaugguggcucacaaccaucuauaaaaug

SEQ ID NO: 48145 - RNA, 45 nt, Mus musculus
ugcuaauuuucucuaaauaugcuuuauguucaaaaaagguuccag

SEQ ID NO: 48146 - RNA, 42 nt, Mus musculus
ugaacucuauccacucaaaaaucucacugaaagcugcuggag

SEQ ID NO: 48147 - RNA, 47 nt, Mus musculus
ucugcuucaguaaaggguacuggcagugucaccuguccuguaggguu

SEQ ID NO: 48148 - RNA, 47 nt, Mus musculus
auuguuuucugaaaggaaaaaaauacauuguuuacaacauucacaga

SEQ ID NO: 48149 - RNA, 96 nt, Mus musculus
augucuguaagucucaaucagacugugacacaguuacagcaauugcuucaggaaguaaaucaacaacucacaaaggagacauaauccagguguggg

SEQ ID NO: 48150 - RNA, 46 nt, Mus musculus
acauggcacucaagaaauguuccuucucacaaguucuagguggcag

SEQ ID NO: 48151 - RNA, 46 nt, Mus musculus
gcagagugaaguaauugggaaauuacucguuagaaguuaacagaag

SEQ ID NO: 48152 - RNA, 46 nt, Mus musculus
aaauguaaacuuuuaccuuauuuugcucaauuaaauuguucagaag

SEQ ID NO: 48153 - RNA, 82 nt, Mus musculus
cccuauuauaugucccuauauaauccuauuaauguuugucccuaguacaucuaucagucuagccagcuucuucacuuuggag

SEQ ID NO: 48154 - RNA, 123 nt, Mus musculus
ugcauuugggaacagacuuguugauacuccaaaagagaaugaagagacauggaagggagugauggaaaugccacgaaacagcccauuccucuuggugugugagaguucaucaguuuugcagaa

SEQ ID NO: 48155 - RNA, 46 nt, Mus musculus
agagagcacaguagcugugcugcccacagcacugaagccaugccag

SEQ ID NO: 48156 - RNA, 45 nt, Mus musculus
uuguuuguuuguugguuuuagaggccaugaguuggguggguguug

SEQ ID NO: 48157 - RNA, 23 nt, Mus musculus
gacugggaaauauacauguugau

SEQ ID NO: 48158 - RNA, 46 nt, Mus musculus
aguggcaacagccuauggguguccuugaaaagaaguaaauggucua

SEQ ID NO: 48159 - RNA, 46 nt, Mus musculus
aaguagguaaguagaagccagccauggccauguggaaagagggaag

SEQ ID NO: 48160 - RNA, 33 nt, Mus musculus
cuuccucggucccgucuccugagcugugccgag

SEQ ID NO: 48161 - RNA, 45 nt, Mus musculus
aacuggaaguuauauaugcauaaacccuuccuggauuuggcagau

SEQ ID NO: 48162 - RNA, 54 nt, Mus musculus
gcaaccaaauaccacucaaaacaaaaauccagcaaaacugaguugugagggaag

SEQ ID NO: 48163 - RNA, 46 nt, Mus musculus
gaaaaaggaaggggccuuagaaggguccaucaaccagcaaccugaa

SEQ ID NO: 48164 - RNA, 45 nt, Mus musculus
auggguaccaaugcuguuaccagccaucucaaucaguccccagcu

SEQ ID NO: 48165 - RNA, 75 nt, Mus musculus
guccaucuccccacugucugaccccuuguccacuuccuccuccugcaugcagagguccuaucccaugaccuauac

SEQ ID NO: 48166 - RNA, 46 nt, Mus musculus
uccccccucuaguaccucagucccaaccauugccagcagcagugcu

SEQ ID NO: 48167 - RNA, 45 nt, Mus musculus
gcagcagcagaauggaggucagaacaaagugaggccugccaagaa

SEQ ID NO: 48168 - RNA, 45 nt, Mus musculus
acuggcucagaucuccucuccacaggagcaugucuucuuggagau

SEQ ID NO: 48169 - RNA, 46 nt, Mus musculus
ggcccugggcuucuuguccugcagccaccccccggaaacagcgaag

SEQ ID NO: 48170 - RNA, 45 nt, Mus musculus
gaugugugugaucuagagguuguuauuugcuuguucguuuccaga

SEQ ID NO: 48171 - RNA, 42 nt, Mus musculus
ugcccagcgucucccggguucuuuuuaguuagugcuggaacg

SEQ ID NO: 48172 - RNA, 46 nt, Mus musculus
ucacauuuuaggguggggaaauaagacuuguguucugaauguaaau

SEQ ID NO: 48173 - RNA, 46 nt, Mus musculus
cuauucauggcuucuccucgcgagcuuugcauuuuggccccuagau

SEQ ID NO: 48174 - RNA, 41 nt, Mus musculus
gggaagagaaagagacuuuucucgaaagaauugcgcuguau

SEQ ID NO: 48175 - RNA, 46 nt, Mus musculus
gcuauuagguuuuccuaaagaacuucucacaucucaagaggauccc

SEQ ID NO: 48176 - RNA, 46 nt, Mus musculus
cacuccuuuguacaacuucgugcugacuauagaucugcccgccugg

SEQ ID NO: 48177 - RNA, 46 nt, Mus musculus
uacaucucaauaugaacauuuuuccaguugggacuucauuuuagau

SEQ ID NO: 48178 - RNA, 45 nt, Mus musculus
uguuuauguaagaaaacaaguugagaagauuaaaaauuccaugga

SEQ ID NO: 48179 - RNA, 46 nt, Mus musculus
cugaaugccuccagaagaaaaaagagauaauugagcagauggagau

SEQ ID NO: 48180 - RNA, 53 nt, Mus musculus
gaacaucaaaaacaaacaaacaaacaaaaagaauagagagauugguaagaauu

SEQ ID NO: 48181 - RNA, 47 nt, Mus musculus
cccuagcugucauuucaacaguagagagugccucaaagccccagucu

SEQ ID NO: 48182 - RNA, 46 nt, Mus musculus
guauuaacucuuuuaaugcuuuccuacaggucuguaugcuuuagau

SEQ ID NO: 48183 - RNA, 45 nt, Mus musculus
cuauuaugauucaaaaaaccaccaaaagagauccauuggcacagg

SEQ ID NO: 48184 - RNA, 46 nt, Mus musculus
ucuugucuaagcuuaucaaauccauuuucauuuccuaucuggagaa

SEQ ID NO: 48185 - RNA, 46 nt, Mus musculus
uauaggguuauucccauuguauugauguuuauauaaagcagugcca

SEQ ID NO: 48186 - RNA, 47 nt, Mus musculus
ucacugaaaauuccuuuuaauuuaaucauggaaaauaggacaagaua

SEQ ID NO: 48187 - RNA, 46 nt, Mus musculus
ugaggaagcgggggcaauaccaauuaauucuucccguccuagaguu

SEQ ID NO: 48188 - RNA, 46 nt, Mus musculus
guaaggggguagagaaugugugugugugugugugugugugugugug

SEQ ID NO: 48189 - RNA, 46 nt, Mus musculus
agcagauacauuucuuugguuuuugaaaaacaaaauugauggagau

SEQ ID NO: 48190 - RNA, 46 nt, Mus musculus
aggaagcagcagacgucauucaaaaacugcaucugauugcccagga

SEQ ID NO: 48191 - RNA, 47 nt, Mus musculus
aguuggaagggguaaacacaccuaggcaacgugcaguggaggcacag

SEQ ID NO: 48192 - RNA, 84 nt, Mus musculus
uuguuuugugguccucuuauaaaaguuuuguuauuguuaguaguggugagguugguaugugaucuaccauuaaugcccugagcu

SEQ ID NO: 48193 - RNA, 44 nt, Mus musculus
guuagaagcuugguuaagaguuuuuagauuguguugugcuagug

SEQ ID NO: 48194 - RNA, 97 nt, Mus musculus
uagguuauuagaagaauuugugaaucauauucaagaacugcagauaauggaugaaaggauucaaaggaaaguggagaaauuagaacaacagugucag

SEQ ID NO: 48195 - RNA, 68 nt, Mus musculus
gccgaugaauacauugaacgucucguguggagaaccccaggaggugguucuagggguggaccugaagc

SEQ ID NO: 48196 - RNA, 46 nt, Mus musculus
uucacucugauaccuaaugaacaucuguaguaugauacauccagaa

SEQ ID NO: 48197 - RNA, 58 nt, Mus musculus
acucugguuucuuugaguguaugggucguuugcacauuauauugaucuauuuuggagg

SEQ ID NO: 48198 - RNA, 45 nt, Mus musculus
ggaguugaauuuacaguuuuguuggccuaaaagaauaccaaaaua

SEQ ID NO: 48199 - RNA, 45 nt, Mus musculus
uugagcuacauggugagguguuaaaaaaaagaaggaaaaaugaga

SEQ ID NO: 48200 - RNA, 46 nt, Mus musculus
aaggcauuuuggaaaagaacaaagagaauuugguuacagaggaguu

SEQ ID NO: 48201 - RNA, 46 nt, Mus musculus
uuauuuaaccuagaagguaaaauucuuaaacuaauuuauuggagac

SEQ ID NO: 48202 - RNA, 42 nt, Mus musculus
agagggagaauuugaggaaguuuuaagaaaguuuuuguagau

SEQ ID NO: 48203 - RNA, 59 nt, Mus musculus
ugugcgcgugcacguuugugugugaagaaaguagugguucaggacaaguguuugagagg

SEQ ID NO: 48204 - RNA, 60 nt, Mus musculus
gguaacuccagcuuguaaggggaaggguagaccaguuuggucuacagagugaguuccagg

SEQ ID NO: 48205 - RNA, 70 nt, Mus musculus
gaaagucccacauacuaauaguaucccaaguuagguguuaauagaugagaguagaaacuucaagcaggag

SEQ ID NO: 48206 - RNA, 42 nt, Mus musculus
gucuugcugugcggauccucgcgacggugcuacagggggcau

SEQ ID NO: 48207 - RNA, 42 nt, Mus musculus
ugggccggcucggguggcagggcggccagacgucccggagac

SEQ ID NO: 48208 - RNA, 42 nt, Mus musculus
uggugagcggcgccgcugaggcgcagcaugugaagcggagac

SEQ ID NO: 48209 - RNA, 117 nt, Mus musculus
ucauguuuaaccuuccucauccuuagagcacuuugcugugauugaauuggaacaugguuuugauccgauacaggccuuaguaauaacucaguuacagccauggucggggaagaauau

SEQ ID NO: 48210 - RNA, 62 nt, Mus musculus
acauggcugucagcaaacuugcuguggccacacaggagaaugaaaucgcaggcccuguucau

SEQ ID NO: 48211 - RNA, 49 nt, Mus musculus
aaaacagucuaaaaacuaguaccauugguuaguguggguauagcugcgu

SEQ ID NO: 48212 - RNA, 45 nt, Mus musculus
gucugucggguaagaugaauaauuaaguuuacauugccagcauca

SEQ ID NO: 48213 - RNA, 46 nt, Mus musculus
gccguguguggcgagcacaggcuuagauguuuacuaaaggcacaua

SEQ ID NO: 48214 - RNA, 46 nt, Mus musculus
uguuuaaacuuuagguacuauuuuguauuucaguaccccgccccgg

SEQ ID NO: 48215 - RNA, 46 nt, Mus musculus
ucuauuaaaauaugaauaagucauuauucuauuacacuaaugaaag

SEQ ID NO: 48216 - RNA, 46 nt, Mus musculus
aaaaaaaaucuuagguacuuuuuucuugaucaaaauuaauugccag

SEQ ID NO: 48217 - RNA, 47 nt, Mus musculus
ggcaaugugucuucauaacuguuuguuuauuuucaaggccaugguag

SEQ ID NO: 48218 - RNA, 45 nt, Mus musculus
uuucauuuuuguguuuugaaacaaaagauuuaaaugugacuggag

SEQ ID NO: 48219 - RNA, 41 nt, Mus musculus
aggagggggagagggaguccguguguaucuguuugccagug

SEQ ID NO: 48220 - RNA, 46 nt, Mus musculus
ggaggauccuuuguagaaagugggagacuucuugagcugguggcag

SEQ ID NO: 48221 - RNA, 45 nt, Mus musculus
agucaauagaaaaggcaaauagagcagcauauauaaaaguuagga

SEQ ID NO: 48222 - RNA, 45 nt, Mus musculus
aaaagucuccuaaguauacuaacauuucacacaaaaccugccaua

SEQ ID NO: 48223 - RNA, 46 nt, Mus musculus
ucaauauuaaauuuuccaucuugaauauugguaccucagugauuag

SEQ ID NO: 48224 - RNA, 42 nt, Mus musculus
uggaugcacuuuuuuguuuuuguuuuuuugagaaugggggaa

SEQ ID NO: 48225 - RNA, 50 nt, Mus musculus
gauuugaaaugugcaagcugucugaauaagauacagucaaauaaaguaug

SEQ ID NO: 48226 - RNA, 45 nt, Mus musculus
ugguccaaagaacaugagcaccacugugaaaugagaugugcaggu

SEQ ID NO: 48227 - RNA, 46 nt, Mus musculus
accagcauguugggaacugugcaggucacguaccagauuucuagga

SEQ ID NO: 48228 - RNA, 46 nt, Mus musculus; identical to SEQ ID NO: 48227

SEQ ID NO: 48229 - RNA, 45 nt, Mus musculus
gcagaaguuaggugugaagguuuauuuaugcauguagucucagca

SEQ ID NO: 48230 - RNA, 42 nt, Mus musculus
uucccaccaaccacaugguggcucacaaccaucuguaacgga

SEQ ID NO: 48231 - RNA, 23 nt, Mus musculus
uaugugaaugcaaagcucuagca

SEQ ID NO: 48232 - RNA, 46 nt, Mus musculus
aguacaaaugugagccagaagagggcaucaaauacccuggagcuag

SEQ ID NO: 48233 - RNA, 48 nt, Mus musculus
guagucauauaaagacugaaaaguagccaggcauuguaguggcgcaca

SEQ ID NO: 48234 - RNA, 47 nt, Mus musculus
ucccugcauggccugccuuuuucagaaggggcuggggaaugggagga

SEQ ID NO: 48235 - RNA, 46 nt, Mus musculus
gacugcucuucuucugaagguccugaguucaaaucccagcaaccac

SEQ ID NO: 48236 - RNA, 55 nt, Mus musculus
ucaaagacuguuaggugugguggcccacgccuuuaaucccagcagucaggaggca

SEQ ID NO: 48237 - RNA, 46 nt, Mus musculus
guaacuaaguuuaaugguuaagaaacuaaauguaggggcuggagag

SEQ ID NO: 48238 - RNA, 46 nt, Mus musculus
ugggaaaggcaccguuacuaccccggcgcuaaccugggcggucucg

SEQ ID NO: 48239 - RNA, 51 nt, Mus musculus
gcgagggaggcauccgccccgacucggggcuucuccugcccagucugccca

SEQ ID NO: 48240 - RNA, 41 nt, Mus musculus
acucagcacguggccccgcugaugagcuuccuccgcccacu

SEQ ID NO: 48241 - RNA, 45 nt, Mus musculus
aguuccugaggagaucugacagaauuccagaguccaagucuggau

SEQ ID NO: 48242 - RNA, 74 nt, Mus musculus
gaagaugcgcacgugccagagaaaagggccuauggcuggagggaaggacgcagacaggacaaaagacaaucgag

SEQ ID NO: 48243 - RNA, 24 nt, Mus musculus
cggcccuuuugauucccacaucag

SEQ ID NO: 48244 - RNA, 47 nt, Mus musculus
uauugugaaggagaugaugucuaugaugucaugcuaaaucaaguaag

SEQ ID NO: 48245 - RNA, 46 nt, Mus musculus
cuuuuaaaaauuauaucuguuuagugaauuuguauguaucuaugug

SEQ ID NO: 48246 - RNA, 46 nt, Mus musculus
uugacauuggcuuuugauuauauuaugaucuacuuuuugcccaugg

SEQ ID NO: 48247 - RNA, 55 nt, Mus musculus
aacaacaacaaguacuaccuuauucagcuguuagaagaugaugcccagaggaacu

SEQ ID NO: 48248 - RNA, 42 nt, Mus musculus
agcccuuucaccuuucucuccucuuuccugccuauuagucag

SEQ ID NO: 48249 - RNA, 46 nt, Mus musculus
aaaguugaucuguaacgugcagaccauggaagaaaugaugauugag

SEQ ID NO: 48250 - RNA, 42 nt, Mus musculus
gugaagucagagcgccaaggccuagaacacccacuggaccaa

SEQ ID NO: 48251 - RNA, 42 nt, Mus musculus
aaggacuauacuaugaccuugcuggauguuuucgaaguagag

SEQ ID NO: 48252 - RNA, 46 nt, Mus musculus
auuuaacuuccugcagcuauggugaauguugaucagacaagccaga

SEQ ID NO: 48253 - RNA, 45 nt, Mus musculus
aagaauagagguaaguaggcagaauaccuacuuaggaugcaggaa

SEQ ID NO: 48254 - RNA, 46 nt, Mus musculus
ccuccuucccuccucaguuugcuuuucuuccuuuucuccccaucuu

SEQ ID NO: 48255 - RNA, 46 nt, Mus musculus
gcuuuguuuuaaauccuuauuuuuaggugugugugugugugugugu

SEQ ID NO: 48256 - RNA, 46 nt, Mus musculus
acagacuugcaccaccaugccuggcucaccuuuuucuauuucugac

SEQ ID NO: 48257 - RNA, 49 nt, Mus musculus
ucagaaguuggcuacgaccuguauacugagaacaguuguggaagcggac

SEQ ID NO: 48258 - RNA, 52 nt, Mus musculus
uaaacaauaaaaaauggaaucaagucauuuacucugaguuuagagagggagg

SEQ ID NO: 48259 - RNA, 45 nt, Mus musculus
aagccaggugugggagcauaaaccuggaauuccaguacuccagga

SEQ ID NO: 48260 - RNA, 46 nt, Mus musculus
aacuuuaaugagcuaagcauccgaaaauauguguuccgaggcagcg

SEQ ID NO: 48261 - RNA, 42 nt, Mus musculus
uccuggagcaccgaagcaguguuuacugcgcugccugcagau

SEQ ID NO: 48262 - RNA, 41 nt, Mus musculus
cugaucuggaggguccucguacaggacagggcccucucccg

SEQ ID NO: 48263 - RNA, 46 nt, Mus musculus
guuacugggauugaggauaugcuaaguaacccaaaagcgggggggg

SEQ ID NO: 48264 - RNA, 45 nt, Mus musculus
gagacccuugccuuauaaaauaaaaaccuaaaaugagucugguga

SEQ ID NO: 48265 - RNA, 41 nt, Mus musculus
gggcuguagcugagaacugggaacuuaucagccugggccca

SEQ ID NO: 48266 - RNA, 46 nt, Mus musculus
caauuuuaucacaucauacugcaaagaucaaagauugcuccuagga

SEQ ID NO: 48267 - RNA, 46 nt, Mus musculus
agcuggucguggugaggcagaucuuuaaaaucccagcauuaggagg

SEQ ID NO: 48268 - RNA, 46 nt, Mus musculus
cuaaacuuuuuucuuuuucuuucucuccuuuuguguguguguguau

SEQ ID NO: 48269 - RNA, 41 nt, Mus musculus
aaauuuucaaauuaaaaauuaauuaauuaaauaugggccca

SEQ ID NO: 48270 - RNA, 42 nt, Mus musculus
cugccacgggcacuaauagaugagaaagugagagauggagag

SEQ ID NO: 48271 - RNA, 46 nt, Mus musculus
agcuguagacucagccaccacccaggcucacauccagagcuuugaa

SEQ ID NO: 48272 - RNA, 45 nt, Mus musculus
aguugaaacuuuuaguaaauauuuaaaagcccuuugggguaagaa

SEQ ID NO: 48273 - RNA, 46 nt, Mus musculus
gagcucccucgcuggaauaaggagacacacaguuuaguuagcagag

SEQ ID NO: 48274 - RNA, 45 nt, Mus musculus
uuuggaguucguuuuccugccaugucugaugcuuaugaccgggau

SEQ ID NO: 48275 - RNA, 65 nt, Mus musculus
ggccccaacuuugagacuguggcagagagucgucugcuaaagaugcugggggcagaugcuguugg

SEQ ID NO: 48276 - RNA, 46 nt, Mus musculus
gauuaugagaacuuggagaaggccaaucacauggaaguucuggaug

SEQ ID NO: 48277 - RNA, 46 nt, Mus musculus
cuuacccuucacuuuccagauguuguucuacuguucuaaugcccag

SEQ ID NO: 48278 - RNA, 46 nt, Mus musculus
gaagagcuggagcccauuccucccacacuugagauauaugccuuca

SEQ ID NO: 48279 - RNA, 47 nt, Mus musculus
aauaccucuuggauuuuauuuaguaucacaauguuuugagaauaaag

SEQ ID NO: 48280 - RNA, 41 nt, Mus musculus; identical to SEQ ID NO: 48265

SEQ ID NO: 48281 - RNA, 42 nt, Mus musculus; identical to SEQ ID NO: 48270

SEQ ID NO: 48282 - RNA, 45 nt, Mus musculus
cucauuggcugcagcacucaggagaucuggccccaacccucaccu

SEQ ID NO: 48283 - RNA, 46 nt, Mus musculus; identical to SEQ ID NO: 48271

SEQ ID NO: 48284 - RNA, 28 nt, Mus musculus
auuuaaaagcccuuugggguaagaaugg

SEQ ID NO: 48285 - RNA, 45 nt, Mus musculus; identical to SEQ ID NO: 48274

SEQ ID NO: 48286 - RNA, 64 nt, Mus musculus
gucccaacuuugagacuguggcagagagucgucugcuaaagaugcugggggcagaugcuguugg

SEQ ID NO: 48287 - RNA, 46 nt, Mus musculus
gauuaugagaacuuggagaaggccaaucacaaggaaguucuggaug

SEQ ID NO: 48288 - RNA, 47 nt, Mus musculus; identical to SEQ ID NO: 48279

SEQ ID NO: 48289 - RNA, 64 nt, Mus musculus
ggaaguggaccuggccaacuuggcaccccggaaaccugauugggaucucaagagagauguggcc

SEQ ID NO: 48290 - RNA, 44 nt, Mus musculus
ccuucaccuucuccuccacugccacugguuuggccugggggacc

SEQ ID NO: 48291 - RNA, 46 nt, Mus musculus
gaagaggaggcgggucccccaggccaaaccaguggcaguggaggag

SEQ ID NO: 48292 - RNA, 67 nt, Mus musculus
ugaaggcccuccgggagaaaaccgggcgcaaggacagggaagauggggagccacagaccaagcagcu

SEQ ID NO: 48293 - RNA, 41 nt, Mus musculus
ccucuuccucuaggcggcccacaccggcaggagcagccgcc

SEQ ID NO: 48294 - RNA, 45 nt, Mus musculus
cggaguuuguccuggcaggcuucccgaaucucaacagcacaggag

SEQ ID NO: 48295 - RNA, 45 nt, Mus musculus
cgagauuccaaaggaaauuucauucuucuauucgccaucccaaca

SEQ ID NO: 48296 - RNA, 57 nt, Mus musculus
uguacugaugcaggcugguaaaacaugucuugagaucuuccauuguguacacauuug

SEQ ID NO: 48297 - RNA, 46 nt, Mus musculus
gacagagggaggaggagcccaggaagugcuguguguauuucugggg

SEQ ID NO: 48298 - RNA, 46 nt, Mus musculus
cccacaagucauuggcucucagcuccuguguuaugauccaucuugc

SEQ ID NO: 48299 - RNA, 42 nt, Mus musculus
gugcuuuucugucuuucuuucuucuuccuugaccacccccuu

SEQ ID NO: 48300 - RNA, 45 nt, Mus musculus
caagccaaagggccgggacgacagauacugugaacguaugaugaa

SEQ ID NO: 48301 - RNA, 46 nt, Mus musculus
caggugacagguggcaaugacaacuacugcaacgugaugaugcaga

SEQ ID NO: 48302 - RNA, 46 nt, Mus musculus
gcugauaguugaccucugagucagugagaccaacaaugaguggugg

SEQ ID NO: 48303 - RNA, 46 nt, Mus musculus
caacugucuguaacccaguucuaggugauuugauacccucacacag

SEQ ID NO: 48304 - RNA, 46 nt, Mus musculus
uuugccuugaugugucaggccucucugaaggcaauagucccaaaug

SEQ ID NO: 48305 - RNA, 66 nt, Mus musculus
uccaucacucccccucuuuagcccauauuugcaaggguaggagagagaguguguguguguugugug

SEQ ID NO: 48306 - RNA, 47 nt, Mus musculus
uagaaccuaggucagggagagaacauacaagccuucucaacaccaaa

SEQ ID NO: 48307 - RNA, 45 nt, Mus musculus
ccagaagggagagucccagacucgcuacucugcgacagggugcgg

SEQ ID NO: 48308 - RNA, 42 nt, Mus musculus
ggaguugaaugcuucggggugacuuccuuaguuggcacagga

SEQ ID NO: 48309 - RNA, 54 nt, Mus musculus
aaugaguuccuuacuaagcagggguguguguguauguugguguguguguugggg

SEQ ID NO: 48310 - RNA, 41 nt, Mus musculus
uuccuuaaucucuggucuuucaugauuuuucuacccucaga

SEQ ID NO: 48311 - RNA, 46 nt, Mus musculus
cagacacacacagacacacacggacagagacagacagcaaauggag

SEQ ID NO: 48312 - RNA, 41 nt, Mus musculus
uuuuguguccgucucuccauuugcugucugucucuguccgu

SEQ ID NO: 48313 - RNA, 46 nt, Mus musculus
gggacgaggucuggcgggcucccuuguacagugucuaggccgagag

SEQ ID NO: 48314 - RNA, 45 nt, Mus musculus
cuguggggagccagagcuagggcggaccuaagucaaaggcaagug

SEQ ID NO: 48315 - RNA, 46 nt, Mus musculus
gguuggucagggugcuguuauagcuacagcugguuggugccuguug

SEQ ID NO: 48316 - RNA, 34 nt, Mus musculus
auuauggcagcuuccuaacguuuaugcacgcgug

SEQ ID NO: 48317 - RNA, 42 nt, Mus musculus
gugagaggaggcagaugugaaaugaagcuggauggagaggca

SEQ ID NO: 48318 - RNA, 48 nt, Mus musculus
caucccgggcacuaugugaauuuggggugaguucucuuaggccuaguc

SEQ ID NO: 48319 - RNA, 46 nt, Mus musculus
gguacauaaaaaguguugugccaaaaaagaagcacacagcagugag

SEQ ID NO: 48320 - RNA, 46 nt, Mus musculus
auugagaaacccugcuccauaggagcccccaaucagagaggcacag

SEQ ID NO: 48321 - RNA, 46 nt, Mus musculus
aacuuuaucugcauuuauuuaugcugaauuuauucccgggccauga

SEQ ID NO: 48322 - RNA, 46 nt, Mus musculus
uguaucaguauuuugccugcauguaugucuuuuugagggugucaug

SEQ ID NO: 48323 - RNA, 84 nt, Mus musculus
agcgcaucauuaggacgggccggacgggucacugguuaaaccacgggaaggaacacugcuuggugaggaacaggaggaagaggg

SEQ ID NO: 48324 - RNA, 46 nt, Mus musculus
cggcuuucuuuuccucugggucacaggaagguaauauaauccagau

SEQ ID NO: 48325 - RNA, 44 nt, Mus musculus
aggccuaagccgcugcccccagaucaagucuuuagucaggagaa

SEQ ID NO: 48326 - RNA, 46 nt, Mus musculus
cucuggaguaaggaggccuuccuggacgauauccuucccuuuagua

SEQ ID NO: 48327 - RNA, 42 nt, Mus musculus
aacgcaugcccaccugcgggaaagcuugcagugccuccuccc

SEQ ID NO: 48328 - RNA, 46 nt, Mus musculus
ugcaggaaugucacagaagaaguaaucuaccugauugggaccacag

SEQ ID NO: 48329 - RNA, 46 nt, Mus musculus
ccccaaaugggaugggcuuaaugccuggagugaaguucaucaugag

SEQ ID NO: 48330 - RNA, 46 nt, Mus musculus; identical to SEQ ID NO: 48328

SEQ ID NO: 48331 - RNA, 46 nt, Mus musculus; identical to SEQ ID NO: 48329

SEQ ID NO: 48332 - RNA, 46 nt, Mus musculus
gguuccccagcugugucaggauguaaaugaggaagaagaccaggaa

SEQ ID NO: 48333 - RNA, 45 nt, Mus musculus
gguaaggugaugcuuuuguuugaugaccaguggcuagcaggagag

SEQ ID NO: 48334 - RNA, 42 nt, Mus musculus
aggaccauucucccgacuuguauucauuggagcuggcagguu

SEQ ID NO: 48335 - RNA, 44 nt, Mus musculus
gcaaacucggcguuugaagaccuuucagucacauugcggcagcu

SEQ ID NO: 48336 - RNA, 46 nt, Mus musculus
uauuuucggaggaaacaccuguaguuuugcaguuggcucccaguga

SEQ ID NO: 48337 - RNA, 46 nt, Mus musculus
ggagaaacuggaggccacggccauggugcuggauguaccaggagag

SEQ ID NO: 48338 - RNA, 46 nt, Mus musculus
gauggaaggccauuggagaggcuggcgacaguuaauccagaaaaga

SEQ ID NO: 48339 - RNA, 48 nt, Mus musculus
gcagauuugaagaggcauguggaguuccuuguggcugagaaugaaaga

SEQ ID NO: 48340 - RNA, 46 nt, Mus musculus; identical to SEQ ID NO: 48338

SEQ ID NO: 48341 - RNA, 48 nt, Mus musculus; identical to SEQ ID NO: 48339

SEQ ID NO: 48342 - RNA, 49 nt, Mus musculus
ccucacuguagcccuuacuuuccauauuaaaaacauuucagccuccaag

SEQ ID NO: 48343 - RNA, 42 nt, Mus musculus
uugacguccccuggaucagcauucuugagcuggcagcuuguu

SEQ ID NO: 48344 - RNA, 46 nt, Mus musculus
gaaaaaaaaauuguuguuuaaaauuuauuagauuuuauugaggggg

SEQ ID NO: 48345 - RNA, 46 nt, Mus musculus
ccaguugacagaugggcauuuuaaaaaauuuaaugaauuugaaggu

SEQ ID NO: 48346 - RNA, 41 nt, Mus musculus
cauucagcugugugcucuaauggucacacuaacucagaagg

SEQ ID NO: 48347 - RNA, 41 nt, Mus musculus
uuugcugacuuccucuuugccagcacgauccugcaccuugu

SEQ ID NO: 48348 - RNA, 41 nt, Mus musculus
ugccugagaauacagaucaacccccagaacaaggcggacuu

SEQ ID NO: 48349 - RNA, 46 nt, Mus musculus
gcugugcugcuuucauuuuauuagagacuuuccaucacgggauaua

SEQ ID NO: 48350 - RNA, 46 nt, Mus musculus
acuccugaucucugccguguaucuucugguagaagaugauuaagau

SEQ ID NO: 48351 - RNA, 46 nt, Mus musculus
cgccucguuagagacuucagggauacagaaacgugggaguagagau

SEQ ID NO: 48352 - RNA, 46 nt, Mus musculus
gagcuggguccuuccauauuagucauuaauuaggaaaaugcaggag

SEQ ID NO: 48353 - RNA, 45 nt, Mus musculus
aguggcaagacuguuuuuacuaucuguauugcucugccccagauc

SEQ ID NO: 48354 - RNA, 45 nt, Mus musculus
uagcuuugcagcccgugcgugguaucucuuuuagcuugaucugau

SEQ ID NO: 48355 - RNA, 48 nt, Mus musculus
ucuuuccucucuggcuucaucucuugugugggcagcuucauccuagcg

SEQ ID NO: 48356 - RNA, 51 nt, Mus musculus
gccgcugcggaguggagcucaaguacuccuccaggaaccgggagaugacgg

SEQ ID NO: 48357 - RNA, 46 nt, Mus musculus
uggugucgcuguaaaguggaacagccaccaggaagauggugcagag

SEQ ID NO: 48358 - RNA, 46 nt, Mus musculus
aucuuucgucaaaaucugaguaguagcugaggguguggcuugguug

SEQ ID NO: 48359 - RNA, 45 nt, Mus musculus
acauucuaaagugaaacuuauaucucuccccacuuuuggcuagca

SEQ ID NO: 48360 - RNA, 46 nt, Mus musculus
gagcagcgguucucaaccuuccuaaugcugagacccuuuaaugcag

SEQ ID NO: 48361 - RNA, 44 nt, Mus musculus
cugucucaaagacagagagagagagagagagagagagagagaga

SEQ ID NO: 48362 - RNA, 24 nt, Mus musculus
ucacucagcccaucucccuuguuu

SEQ ID NO: 48363 - RNA, 46 nt, Mus musculus
guucaagaguuugaguacauuccuauucucaaauuagagacaucag

SEQ ID NO: 48364 - RNA, 46 nt, Mus musculus
caguucccagcaaccacaugguggcucacaaaccaucuguaauaag

SEQ ID NO: 48365 - RNA, 46 nt, Mus musculus
auccguaacaagaucugacuccucuucuggugugucugaagacagc

SEQ ID NO: 48366 - RNA, 81 nt, Mus musculus
uuugcuugccauagccuuuccuagauggcuucugacagagaaggaggaggaagaagaggaggaagaggaaaaagagguaga

SEQ ID NO: 48367 - RNA, 46 nt, Mus musculus
ccuacaagaagcagcuuaucuggugagaguugaaagaugcaugcag

SEQ ID NO: 48368 - RNA, 46 nt, Mus musculus
agcuucaauccagguucagaaagucaccuugucccagugggucuca

SEQ ID NO: 48369 - RNA, 56 nt, Mus musculus
aaagaaaaaggaggaagagggcucccagaaccugagaggggugaggaaggcagggu

SEQ ID NO: 48370 - RNA, 41 nt, Mus musculus
ucggccauuaaaggcuaggcucacaaccaaaaauauaaagu

SEQ ID NO: 48371 - RNA, 42 nt, Mus musculus
ugagcagccacuucauacuuggugcuguugaccauggcgaag

SEQ ID NO: 48372 - RNA, 44 nt, Mus musculus
aaaggcaggaagguuagagaaugggacgcauuguucacaggcug

SEQ ID NO: 48373 - RNA, 42 nt, Mus musculus
acaaaaaaaagagagagagagagagagagagagagagaagug

SEQ ID NO: 48374 - RNA, 47 nt, Mus musculus
acagauacaugcuaguguaguuggauuccucaccaggccuccauagc

SEQ ID NO: 48375 - RNA, 41 nt, Mus musculus
ugggcaagugcagggaggagggggcuagcagcacacugggg

SEQ ID NO: 48376 - RNA, 42 nt, Mus musculus
aaauggaaaacaggaaaacacaugugugacucuggccggcgg

SEQ ID NO: 48377 - RNA, 46 nt, Mus musculus
aaagaaaagagagagaagaaagaaagaaagaaagaaagaaagaaag

SEQ ID NO: 48378 - RNA, 44 nt, Mus musculus
agaaaagaugaaggaaaaacugaaaagagggaaggaugccggga

SEQ ID NO: 48379 - RNA, 46 nt, Mus musculus
gccacacagaaacacacacacucauacacacacacacacacacaca

SEQ ID NO: 48380 - RNA, 48 nt, Mus musculus
uggaugcuggaauacaggcauggaagcucaggcagcagaaauugcagg

SEQ ID NO: 48381 - RNA, 46 nt, Mus musculus
ggauucgagcugaaacaccacguccccaccgaaaaaggagggcauu

SEQ ID NO: 48382 - RNA, 26 nt, Mus musculus
uuagucggcgaacugaguuggaagcc

SEQ ID NO: 48383 - RNA, 47 nt, Mus musculus
gcgccuuugucuucuaaaggaacggaauguggauuccuagagcgcgg

SEQ ID NO: 48384 - RNA, 46 nt, Mus musculus
ccaagcgugagcagggggagcaggaggcugcgggagggucgagggg

SEQ ID NO: 48385 - RNA, 45 nt, Mus musculus
aggcucugaccccggcugggcuaucagcugcuucgggcuugggga

SEQ ID NO: 48386 - RNA, 42 nt, Mus musculus
cccuccuccgggguacaggauuuuaaccucuugugugucaga

SEQ ID NO: 48387 - RNA, 42 nt, Mus musculus
cuaacaagcccaaggcccuggguucgguccucagcucugggg

SEQ ID NO: 48388 - RNA, 27 nt, Mus musculus
accuccaggggaccugcguacccacac

SEQ ID NO: 48389 - RNA, 52 nt, Mus musculus
cacuuguaaaccauagaacuuuugcauggcggcaauggcagcugagagugac

SEQ ID NO: 48390 - RNA, 45 nt, Mus musculus
gacagaguguagugcuguaguugacccagggucuuggccucuggu

SEQ ID NO: 48391 - RNA, 50 nt, Mus musculus
aggcgcccucgcugugguguuccggauaaguuugggacugagaucaaggc

SEQ ID NO: 48392 - RNA, 24 nt, Mus musculus
ugccacauucgaggccauucggaa

SEQ ID NO: 48393 - RNA, 69 nt, Mus musculus
cguggaaacccucagcaaacaagaucaugaugucagccugcuucucaugucccucccggauguaggcau

SEQ ID NO: 48394 - RNA, 83 nt, Mus musculus
gaaggaggguuccuggcucaugccuacuucccaggccccaauauuggaggggauacccacuuugauucugccgagcccuggac

SEQ ID NO: 48395 - RNA, 70 nt, Mus musculus
ccaauauuggggccugggaaguaggcaugagccaggaacccuccuucaccaucaaaggguguacugucgc

SEQ ID NO: 48396 - RNA, 86 nt, Mus musculus
aucuucuugguggcugugcaugaguuggggcaugcccuaggccuggaacauuccaaugaucccuccgccaucauggcccccuuuua

SEQ ID NO: 48397 - RNA, 102 nt, Mus musculus
caacacgaaguucucuguguccauccacugguaaaagggggccaugauggcggagggaucauuggaauguuccaggccuagggcaugccccaacucaugcac

SEQ ID NO: 48398 - RNA, 45 nt, Mus musculus
aggaagagaacaauagggggugcuuuagacuuuggagcaaagagg

SEQ ID NO: 48399 - RNA, 60 nt, Mus musculus
ucagggucacccacaaagaugcccccucaacccagaacuaccucucggcccucuguccca

SEQ ID NO: 48400 - RNA, 76 nt, Mus musculus
ccaauucuggaggggccugccugcauccaucaauacugccuacgagaggaaggauggcaaauuugucuucuucaaa

SEQ ID NO: 48401 - RNA, 45 nt, Mus musculus
cccaagcacauuaaggagcugggccgagggcugcccacggacaag

SEQ ID NO: 48402 - RNA, 46 nt, Mus musculus
uccuuaacccuaagccucuccacucagaaacuacugccacugccac

SEQ ID NO: 48403 - RNA, 46 nt, Mus musculus
ggucaugguuggggacagggauuuugaguaaugagggccugcagug

SEQ ID NO: 48404 - RNA, 57 nt, Mus musculus
ccgguucaaugaagaauucagggcaguggacagcgaguacccuaaaaacaucaaagu

SEQ ID NO: 48405 - RNA, 51 nt, Mus musculus
acaagggaaacaaauacuggaaguucaacaaccagaagcugaagguagagc

SEQ ID NO: 48406 - RNA, 61 nt, Mus musculus
ccuucggggggccggcccgaugaggggacugaggaggagacggaggugaucaucauugagg

SEQ ID NO: 48407 - RNA, 42 nt, Mus musculus
ccucaaugaugaucaccuccgucuccuccucaguccccucau

SEQ ID NO: 48408 - RNA, 45 nt, Mus musculus
ccgccgugguccugccgguacuacugcugcuccugguacuggcag

SEQ ID NO: 48409 - RNA, 42 nt, Mus musculus
cauggcgucugaagaagaagacagcgaggcccacugccagua

SEQ ID NO: 48410 - RNA, 42 nt, Mus musculus
ccaccacuggcccacccgcuucuaccacaaggacuuugccuc

SEQ ID NO: 48411 - RNA, 105 nt, Mus musculus
caagggaaucucacagcucgguguguguucagcccuaguugaauguugucaaggcucugcacuugaaggcaagacccucugaccuuauaggcaacggccaaaugg

SEQ ID NO: 48412 - RNA, 46 nt, Mus musculus
ucagagauuuaagguauguaguuagggggauggaaaagaagcagau

SEQ ID NO: 48413 - RNA, 44 nt, Mus musculus
cgccacucugacuaaaaggaaucuuaagaguguacguuuggagg

SEQ ID NO: 48414 - RNA, 51 nt, Mus musculus
uggaaagauuguucaguuuacccuaaagacuuugauaagaaagagaaagaa

SEQ ID NO: 48415 - RNA, 45 nt, Mus musculus
aggcuccuuuggaaguucuccagacuggguuggauagaggcagau

SEQ ID NO: 48416 - RNA, 45 nt, Mus musculus
cagggggaaaggucccggguggagugaggucaaggggagacagca

SEQ ID NO: 48417 - RNA, 54 nt, Mus musculus
guucaaaugcaagucacuggggcugggacccaaagagagcagucagagagggca

SEQ ID NO: 48418 - RNA, 47 nt, Mus musculus
cuugcucacaguguagaaggcaaggguaggaauugauacaggaguga

SEQ ID NO: 48419 - RNA, 41 nt, Mus musculus
uggcugaaggagacuucaaaugggucaacugggcggggaag

SEQ ID NO: 48420 - RNA, 87 nt, Mus musculus
ccauuugaagucuccuucagccacugaaggcggucaugguacuggggacuugggagagugagacccuguggagggagaggcgaggag

SEQ ID NO: 48421 - RNA, 45 nt, Mus musculus
auaauuauuauauaugaaugccauucaaaucguuccuuuuuguua

SEQ ID NO: 48422 - RNA, 44 nt, Mus musculus
uguucaaccuuuccaagaagaauaaacuguguuucacauucuuu

SEQ ID NO: 48423 - RNA, 46 nt, Mus musculus
augaguacacuguagcugucagacacaccagaagaaggcaucagau

SEQ ID NO: 48424 - RNA, 46 nt, Mus musculus
ugggggcugcauagccccggugcgacccaggcucggggugccaggg

SEQ ID NO: 48425 - RNA, 28 nt, Mus musculus
gaagggggaggggagaguaaggauggag

SEQ ID NO: 48426 - RNA, 46 nt, Mus musculus
gugcagccgagagcgaugaccagcaacaggccacacaccaggcugc

SEQ ID NO: 48427 - RNA, 45 nt, Mus musculus
uaggaagggggugccuguugcugcacaaucucagccuccauccgg

SEQ ID NO: 48428 - RNA, 42 nt, Mus musculus
cugggaaaccuacguucucugcuucagaucuuacgccaggau

SEQ ID NO: 48429 - RNA, 44 nt, Mus musculus
ggcccccugaaguaccaccuggagucauauccuggcguaagauc

SEQ ID NO: 48430 - RNA, 34 nt, Mus musculus
gucuccgucguuggggccugcuuccucgaacuaa

SEQ ID NO: 48431 - RNA, 45 nt, Mus musculus
gcaggcuccuccacugcccaucaagacccccaucccaaccccaag

SEQ ID NO: 48432 - RNA, 46 nt, Mus musculus
cccacuuggacccaaacuggaacucacacaacaguccuguccccag

SEQ ID NO: 48433 - RNA, 42 nt, Mus musculus
aucaagaugacaaaaauaaaggaaucauaaacuucagcccuu

SEQ ID NO: 48434 - RNA, 43 nt, Mus musculus
ggugggggagcugaagcuuuggugggaaggucugggcaggauc

SEQ ID NO: 48435 - RNA, 46 nt, Mus musculus
agcuucccaacucacuaggccuaauguaggggcgugccuaugacgg

SEQ ID NO: 48436 - RNA, 75 nt, Mus musculus
auauaucucacccauggcuuccuucucucccccucccuagaagcagauacuacacuucugaaacagaagccagag

SEQ ID NO: 48437 - RNA, 46 nt, Mus musculus
cccucuaccaacuauaucugagcugacguuacugcugccaccacca

SEQ ID NO: 48438 - RNA, 42 nt, Mus musculus
ugggguuggugguggaaaggaacgugauggguagcuggagag

SEQ ID NO: 48439 - RNA, 46 nt, Mus musculus
guccagguccaaauguccugucaggauuggggagcaggggccagaa

SEQ ID NO: 48440 - RNA, 46 nt, Mus musculus
ccaaagaugcccugaccaccacagaggcuagacagacgcgugagaa

SEQ ID NO: 48441 - RNA, 46 nt, Mus musculus
uguucacguggcccaucuacauaaaaaacccauugcuaggccagau

SEQ ID NO: 48442 - RNA, 46 nt, Mus musculus
ggucuuagcccucagucaugggccuggaauuggggaguggagggaa

SEQ ID NO: 48443 - RNA, 46 nt, Mus musculus
uuccuuggcuucggcucugcccagcugccagagggugggagcagaa

SEQ ID NO: 48444 - RNA, 55 nt, Mus musculus
agaaagugcuguaaaguggcaggaagaagcuagguguggaugcucugugagugga

SEQ ID NO: 48445 - RNA, 58 nt, Mus musculus
gagcugggaaaagaagccucacuggcuaagccaucagagcccaaaguaagaaaggcuc

SEQ ID NO: 48446 - RNA, 43 nt, Mus musculus
cccuagcauucaaguuccuuugccccuccccccacggcuaguc

SEQ ID NO: 48447 - RNA, 46 nt, Mus musculus
aaguuuuaccugucugagucccuccauaacuugaccagcauccaga

SEQ ID NO: 48448 - RNA, 42 nt, Mus musculus
aggaaagcaaggauucaaguccugcccggucccgccccaguc

SEQ ID NO: 48449 - RNA, 42 nt, Mus musculus
gauacgggagccagaggccagagaagauuacuuugguaagua

SEQ ID NO: 48450 - RNA, 62 nt, Mus musculus
ccugggcagccccggagcucuaaccggagccguggugggaacagcggguccuuuggagagac

SEQ ID NO: 48451 - RNA, 47 nt, Mus musculus
uccgugggauucggcugccaggagagccgucacucguaccccccggc

SEQ ID NO: 48452 - RNA, 84 nt, Mus musculus
gagccggggccagcggagccggagguagccggccgugcagcaaucggaccagcggcaucagcaugggcuacgaccagcgccacg

SEQ ID NO: 48453 - RNA, 55 nt, Mus musculus
ccagcccuuagcccucgcuccagcuucgccaguagcucggccagcgaugcgagca

SEQ ID NO: 48454 - RNA, 65 nt, Mus musculus
acaccguggagcgaauggggggccuggagaugaaccuuuggaaccggccagggagcaagggcccc

SEQ ID NO: 48455 - RNA, 69 nt, Mus musculus
ugggucugaugggacccccggagcaggcaagggacgcuuaagcggguuggggggaccuaggaagucagg

SEQ ID NO: 48456 - RNA, 41 nt, Mus musculus
ggggcugcaggccccagauccgugggcauggaacgguuagg

SEQ ID NO: 48457 - RNA, 42 nt, Mus musculus
agcggauugcagcuucugggagcgguuguuggcucggcagug

SEQ ID NO: 48458 - RNA, 45 nt, Mus musculus
aggugcuuauauugcuucccagacggugaagaaaguaauagagau

SEQ ID NO: 48459 - RNA, 46 nt, Mus musculus
caaaaaagaagucgauuccaaaaucccaaaagaugcaaagccaggu

SEQ ID NO: 48460 - RNA, 45 nt, Mus musculus
auccaccuccagccccuccaagcccauaaaucucaggucggccaa

SEQ ID NO: 48461 - RNA, 85 nt, Mus musculus
ggggaccagagagguaggcgggacgaagaggagagaaggaaggaaacggaggaguggggaaacaggauagcaggagggaacgagg

SEQ ID NO: 48462 - RNA, 49 nt, Mus musculus
aaggagagcgggaaaagaggagaaagguaaaggaagaaaaaggcagaag

SEQ ID NO: 48463 - RNA, 42 nt, Mus musculus
gggaggcaaagggagagaggugugugagaugggagagagcag

SEQ ID NO: 48464 - RNA, 44 nt, Mus musculus
acuuggcucucagucagagggagccaauagaugcagggagcugc

SEQ ID NO: 48465 - RNA, 38 nt, Mus musculus
gcucuuuccggcggcggucacgggaccgugaucgggag

SEQ ID NO: 48466 - RNA, 54 nt, Mus musculus
gcucucgaacagcccuuuccugcucccgcugcucagcccggggguggggcggug

SEQ ID NO: 48467 - RNA, 46 nt, Mus musculus
uacgcucugucucauccucagagauucgggagucaucggcaugaag

SEQ ID NO: 48468 - RNA, 46 nt, Mus musculus
cuuggauuucuaagaagcuacacuuccguaauuagaccacuggggg

SEQ ID NO: 48469 - RNA, 79 nt, Mus musculus
caagucagcaaugaugagcgcccagaggguggugcugaagaagaggaaaagaaagagguaacuagccaagccaccuguu

SEQ ID NO: 48470 - RNA, 45 nt, Mus musculus
ugaccauggacaccagugaaaacagaccugaaaaugaggugccug

SEQ ID NO: 48471 - RNA, 23 nt, Mus musculus
aaacaaaaaagcuaaaaaaccca

SEQ ID NO: 48472 - RNA, 46 nt, Mus musculus
ugagugcuaacuugugagcgaguggguuccauguuuugggggaguu

SEQ ID NO: 48473 - RNA, 45 nt, Mus musculus
uaguuuuagggagugucaggguuagaaguuagggaugguggcaga

SEQ ID NO: 48474 - RNA, 43 nt, Mus musculus
aauggaaggggagguggugguggagcggggaggcuaaaauaga

SEQ ID NO: 48475 - RNA, 69 nt, Mus musculus
aagagauaagcguuuaaguccucacggcaaaccccgaguucggcuggacuggucucucuggaggaagag

SEQ ID NO: 48476 - RNA, 44 nt, Mus musculus
ugccgcuuuaccaauacaauagagucugcuuacuaccagcaacc

SEQ ID NO: 48477 - RNA, 44 nt, Mus musculus
agagagccagaguucccagucguuaacaagcccacucagccuca

SEQ ID NO: 48478 - RNA, 42 nt, Mus musculus
cucaccuacccugaccccaaggaacaccuuucaccugcagca

SEQ ID NO: 48479 - RNA, 46 nt, Mus musculus
ucccagcaaccaucuguaaugggaucugaugccuucuucugauaug

SEQ ID NO: 48480 - RNA, 28 nt, Mus musculus
ucuugaacaaguaucucugaccugucaa

SEQ ID NO: 48481 - RNA, 47 nt, Mus musculus
ugaggguuggcaugaacucgugcuugggcuccaucucucugcuuaga

SEQ ID NO: 48482 - RNA, 45 nt, Mus musculus
uuucucuaacucacccuuuuccugggaucugauguuuagggguuu

SEQ ID NO: 48483 - RNA, 46 nt, Mus musculus
ugauccucuuccuccucagcagucugacuguacucagggaguuuag

SEQ ID NO: 48484 - RNA, 41 nt, Mus musculus
ccuacugacuuucauauuuaaaagauucggggugugugugc

SEQ ID NO: 48485 - RNA, 46 nt, Mus musculus
cggcuucucaucaucagauucuccuuuuucuucagaaaaagaggag

SEQ ID NO: 48486 - RNA, 71 nt, Mus musculus
aaccuaacuguguauaugugugugugugagagagaacacacacacacacacacacacacagaggauuagaa

SEQ ID NO: 48487 - RNA, 46 nt, Mus musculus
uacaaauggcuguuaguugucuugugaauguugggaauaaagccag

SEQ ID NO: 48488 - RNA, 45 nt, Mus musculus
cuguucaggcugcucugaaaaucaggaggcagcagggaagccacu

SEQ ID NO: 48489 - RNA, 46 nt, Mus musculus
aaguuugauauguucaaauguuuuaaagauaauuaugagggcugga

SEQ ID NO: 48490 - RNA, 46 nt, Mus musculus
guaucugaaggacgucacuuuaaagaagcaaugugugccauuccgg

SEQ ID NO: 48491 - RNA, 42 nt, Mus musculus
gccucgcugcuccagugcggccuucaggucggucacccgcag

SEQ ID NO: 48492 - RNA, 46 nt, Mus musculus
aauuccccggguuucuccggagcuguucggucguuuccguccccac

SEQ ID NO: 48493 - RNA, 46 nt, Mus musculus
ccugggggccggggcgcuggggcacuuggguauuuggggcugguuc

SEQ ID NO: 48494 - RNA, 44 nt, Mus musculus
gaccuggcccaagcucauacucacccacucaauacuaccaggag

SEQ ID NO: 48495 - RNA, 42 nt, Mus musculus
ggaaccauucuugaggaaacaucaaauaauuuaccugggcaa

SEQ ID NO: 48496 - RNA, 47 nt, Mus musculus
aacgagccccaaacugaauucugaguguacguauagguaccuggcag

SEQ ID NO: 48497 - RNA, 42 nt, Mus musculus
aggaaggaaggaagggagggagggagagagggagagagagag

SEQ ID NO: 48498 - RNA, 42 nt, Mus musculus
aagaaaauaagggaaaaguagccuuaagagagagaggaggag

SEQ ID NO: 48499 - RNA, 41 nt, Mus musculus
uccacccaucugccaauugugacucccugguuccuggcgcc

SEQ ID NO: 48500 - RNA, 46 nt, Mus musculus
gcuugguggcacacaccuuuaaucccagcacucaggaggcaggcag

SEQ ID NO: 48501 - RNA, 41 nt, Mus musculus
gcugggagggagggagggagggagggagaaagggaggaagg

SEQ ID NO: 48502 - RNA, 42 nt, Mus musculus
cugugggagagaagggaaguagagaaaggagaaagggagauc

SEQ ID NO: 48503 - RNA, 45 nt, Mus musculus
ggagagcuggaacaauagcgaaugcccuuggaagaaacuggaugg

SEQ ID NO: 48504 - RNA, 45 nt, Mus musculus
augugcacaugcaagcaugcucaugugcaugcugggcugucuguc

SEQ ID NO: 48505 - RNA, 46 nt, Mus musculus
ucuacaauucaguuuaguuccugaacugucucagugagacugcgga

SEQ ID NO: 48506 - RNA, 45 nt, Mus musculus
augcccuaguguaaguggggaguaggacugguaacugcaggacug

SEQ ID NO: 48507 - RNA, 43 nt, Mus musculus
gcauacauauacuauuuuacuuuuuuaaaucauaaacggcagg

SEQ ID NO: 48508 - RNA, 46 nt, Mus musculus
guguaauauguaauggucguauuaaaaauaaauaaauaaagcccag

SEQ ID NO: 48509 - RNA, 26 nt, Mus musculus
gcuuagggagaguucuacaacccagg

SEQ ID NO: 48510 - RNA, 45 nt, Mus musculus
cuuguuuacaguuaagaauuuuaaggcagugacaaccugcgugga

SEQ ID NO: 48511 - RNA, 56 nt, Mus musculus
aaaaucgucaacccgaagggugaagaaaagccaucgauguacugagcuaaggauua

SEQ ID NO: 48512 - RNA, 46 nt, Mus musculus
gggguggcaauucagguaagaauuggugacugaagacagaguggga

SEQ ID NO: 48513 - RNA, 48 nt, Mus musculus
ccucuccucccuccgggcuccucuggacaucccuaucccagauccucc

SEQ ID NO: 48514 - RNA, 23 nt, Mus musculus
ccucgagccaaucugugcacuga

SEQ ID NO: 48515 - RNA, 86 nt, Mus musculus
ucuucagacacccucuucuggugugucugaagacagcuacaguauacuuacauauaauaauaaauaacucuuugggccagagauca

SEQ ID NO: 48516 - RNA, 42 nt, Mus musculus
cucccuggcucgagugaugccagcuuacaugcaggccgugaa

SEQ ID NO: 48517 - RNA, 43 nt, Mus musculus
cugcugugcacugcauaaggccucucagagaagcuccucagau

SEQ ID NO: 48518 - RNA, 46 nt, Mus musculus
agcucauggaugaagauauggaagaggagggggaugacucugagau

SEQ ID NO: 48519 - RNA, 42 nt, Mus musculus
aggguuaaugggagagggcuugggacccuaccugccucagau

SEQ ID NO: 48520 - RNA, 42 nt, Mus musculus
ucauggaucuucuccgggaguucuuguugacaggccacgaag

SEQ ID NO: 48521 - RNA, 46 nt, Mus musculus
guggagaaccuagguagugaugauggcugcugagaaaacgggagga

SEQ ID NO: 48522 - RNA, 41 nt, Mus musculus
ccaugugguaagugugacucucuugcucuuacuggcccuag

SEQ ID NO: 48523 - RNA, 46 nt, Mus musculus
gacugaauugaauucagccuguccaguggugcugaccgagccagau

SEQ ID NO: 48524 - RNA, 44 nt, Mus musculus
gccacagaacucuggcucuuuccugcuuucaucaugccccauug

SEQ ID NO: 48525 - RNA, 46 nt, Mus musculus
ccugcugcaucucuggcuacgugucgagccacuucuaccggcaaau

SEQ ID NO: 48526 - RNA, 45 nt, Mus musculus
ggccucuggacacauuuggacuuccaccuagaauuccauggagau

SEQ ID NO: 48527 - RNA, 24 nt, Mus musculus
ucugcgaggcuuuguguaaccgac

SEQ ID NO: 48528 - RNA, 46 nt, Mus musculus
uggccgaaucuuuguacgagauccgcuuucgggagaauguggagaa

SEQ ID NO: 48529 - RNA, 42 nt, Mus musculus
ugggauagauaaguucugugguguggggaucgggaggccgaa

SEQ ID NO: 48530 - RNA, 46 nt, Mus musculus
ucugacucucucuucugaagugucugaggacagcuacaguguacuu

SEQ ID NO: 48531 - RNA, 45 nt, Mus musculus
agaguauggggccucuacaucaagaaaaugauggaaaacaaagaa

SEQ ID NO: 48532 - RNA, 48 nt, Mus musculus
ucgaggaaauccugagauuuugacccucccaagcguaagccagagcca

SEQ ID NO: 48533 - RNA, 46 nt, Mus musculus
ugucuuagaaccaaagucauacugagcugggaacuguaaaaugaag

SEQ ID NO: 48534 - RNA, 42 nt, Mus musculus
aagcuguuuuuuugauggugccuuuauagguaccucggccag

SEQ ID NO: 48535 - RNA, 45 nt, Mus musculus
aggggcaggggcugacuuugugauguuggguggcaugcuggccgg

SEQ ID NO: 48536 - RNA, 46 nt, Mus musculus
cuacucacccaugccucuagcugcacaauguuauggcacuacggga

SEQ ID NO: 48537 - RNA, 80 nt, Mus musculus
aagcuuuguagcacuugaaaauuaaauauugauuuguuucacuauugaugggaagaaggggaauaaagacuugcauaggu

SEQ ID NO: 48538 - RNA, 42 nt, Mus musculus
ucuuccaugggcucuaucagauucccugagccagaaguagag

SEQ ID NO: 48539 - RNA, 42 nt, Mus musculus
aacuagaacaagacuauggggaauccuuucuaguugccaugg

SEQ ID NO: 48540 - RNA, 42 nt, Mus musculus
cacuauuaggaggugugccuuguuggaguagauguggccuug

SEQ ID NO: 48541 - RNA, 46 nt, Mus musculus
auuuuaagaagaaagucuaaggagauaguuuuaguuguuuugccag

SEQ ID NO: 48542 - RNA, 46 nt, Mus musculus
caguggacgugcaaauuccuguguaagcacaaaacaaaaccccaac

SEQ ID NO: 48543 - RNA, 45 nt, Mus musculus
uccacugcuaucagcagacaccacccaaaacccauccacugauag

SEQ ID NO: 48544 - RNA, 45 nt, Mus musculus
ugguccuucuuuuuaaagauuuauuuauauguguaagugcaccaa

SEQ ID NO: 48545 - RNA, 44 nt, Mus musculus
aaguugcuucuauuaugaacggaaaaccaaguccucuucccugu

SEQ ID NO: 48546 - RNA, 41 nt, Mus musculus
gcugacccuucugugugugugugugugugugugugugugug

SEQ ID NO: 48547 - RNA, 46 nt, Mus musculus
agggcaaggaagaagaggaaaaggaggaagaugagaagaaagagag

SEQ ID NO: 48548 - RNA, 46 nt, Mus musculus
aguagcacaugguaguucacagccugcuucaacuccaguuccaggg

SEQ ID NO: 48549 - RNA, 45 nt, Mus musculus
gcuuaacacacagguauuucuggguuccccuggaaucuacaccca

SEQ ID NO: 48550 - RNA, 41 nt, Mus musculus
gacauugaggaccuugggucucuguaauccagaaccuucga

SEQ ID NO: 48551 - RNA, 46 nt, Mus musculus
uuccacguacacuaucuuaaagcugccaucauccugccgcugccag

SEQ ID NO: 48552 - RNA, 50 nt, Mus musculus
gaaggaaguagcuggugggacaggcugaguaaccuggagggagcauugca

SEQ ID NO: 48553 - RNA, 46 nt, Mus musculus
cagauguucaaguggcuucauguucucaucaaaguagauguccaua

SEQ ID NO: 48554 - RNA, 42 nt, Mus musculus
acaggcaggcauccagcaccccauggucaaacuagaaggcag

SEQ ID NO: 48555 - RNA, 46 nt, Mus musculus
aaagaaggaaaguaagagagagagagagagagagagagagagagag

SEQ ID NO: 48556 - RNA, 45 nt, Mus musculus
aucucauugcgggggucaaagggcaacuggaacucuccagcuuca

SEQ ID NO: 48557 - RNA, 45 nt, Mus musculus
agagagucaguauggugucugugugugugugugugugugugugug

SEQ ID NO: 48558 - RNA, 41 nt, Mus musculus
ugugaguguguuuaugugugugugugaauguaugucaguau

SEQ ID NO: 48559 - RNA, 46 nt, Mus musculus
ugugugugugugugagugugugugugugugugugaguauggugugu

SEQ ID NO: 48560 - RNA, 42 nt, Mus musculus
uggguaggugacuggagaaaguggacaguggccucuugggag

SEQ ID NO: 48561 - RNA, 41 nt, Mus musculus
gcuucacgauuaaaacuaaagucugaaaucggcuaagccug

SEQ ID NO: 48562 - RNA, 42 nt, Mus musculus
gcucacaacauucugugaggacaguuggaccuacacccaaac

SEQ ID NO: 48563 - RNA, 87 nt, Mus musculus
gggauaacauaaggaauucaugaaaugaggggacagcccauucuaucgcggacaggagcagggagagucauccaagugagaggugag

SEQ ID NO: 48564 - RNA, 45 nt, Mus musculus
uccgggcacaccacagaacauggaaccaugauguagcagucaaga

SEQ ID NO: 48565 - RNA, 42 nt, Mus musculus
ggagcuggaaacccgacgucuacggcucggaguguggacuga

SEQ ID NO: 48566 - RNA, 45 nt, Mus musculus
augucccauaccuuuaaucccagcccucgggagacagaggcaggu

SEQ ID NO: 48567 - RNA, 42 nt, Mus musculus
ugcucuuuauuuauuuauugcaccuucuauaugucaacaguc

SEQ ID NO: 48568 - RNA, 42 nt, Mus musculus
ugugugugagagagagagagagagagagagagaggggggaca

SEQ ID NO: 48569 - RNA, 46 nt, Mus musculus
aaaggcccccuccaggcugccuacggcccaccuccuugcaugagau

SEQ ID NO: 48570 - RNA, 46 nt, Mus musculus
uuaaacggagaugucuagcaucuuucugcccuucccugccccagaa

SEQ ID NO: 48571 - RNA, 41 nt, Mus musculus
gggagcagcagacucgcuuggagcguaucuucaacguggga

SEQ ID NO: 48572 - RNA, 46 nt, Mus musculus
cuaggaauaccugaaggggcucugcagcccagaacuacagagugag

SEQ ID NO: 48573 - RNA, 42 nt, Mus musculus
gaugaucaguggccuaaccgaggcguuugugauggcccagag

SEQ ID NO: 48574 - RNA, 42 nt, Mus musculus
ggcugagcugggaccuucagcuacagucuugucccggagccc

SEQ ID NO: 48575 - RNA, 45 nt, Mus musculus
cucccuugaaugaaggcagggaauucguaggcaccagaguggcag

SEQ ID NO: 48576 - RNA, 45 nt, Mus musculus
agaggucugggagccuggaguggcuuacaggucacagcuagcagg

SEQ ID NO: 48577 - RNA, 39 nt, Mus musculus
aacccccauggcccuguggagaccgagaccgagaucgag

SEQ ID NO: 48578 - RNA, 38 nt, Mus musculus
cugccuccuaagugcugcuguuuuuuuuuuaggccuag

SEQ ID NO: 48579 - RNA, 46 nt, Mus musculus
ugggccucaggugucuuuaaaaaauuuuaaauuuuggguuggagag

SEQ ID NO: 48580 - RNA, 42 nt, Mus musculus
cagaaaggaaucuccuuagguggcuuucacuguaagggcuua

SEQ ID NO: 48581 - RNA, 46 nt, Mus musculus
cugaagggcagcuguggaagaguucuguguaaggggagagcaggug

SEQ ID NO: 48582 - RNA, 46 nt, Mus musculus
cuaccuucuguguaugggaagcggaagcugaagcaucaggaucgag

SEQ ID NO: 48583 - RNA, 45 nt, Mus musculus
gaugagagaccaagcuuauagagggacacugacaucuuacugcag

SEQ ID NO: 48584 - RNA, 83 nt, Mus musculus
cucaccagcucauuuggaaagagagacugagaaaggaaaagaugaggagagauugcauguuaaaacguuaagaacccagcuua

SEQ ID NO: 48585 - RNA, 53 nt, Mus musculus
gccauguaggguaauaguucuucagauaauucuaggggaauauaagccaaaga

SEQ ID NO: 48586 - RNA, 45 nt, Mus musculus
cauauaugagaaccagggcaacaauguaacacagaagccacagaa

SEQ ID NO: 48587 - RNA, 45 nt, Mus musculus
gaaugagauuauauucuugaggcuggaguuucucagauaggggug

SEQ ID NO: 48588 - RNA, 39 nt, Mus musculus
cguaccacagugcuggggacagguaugaaggcugggcgg

SEQ ID NO: 48589 - RNA, 38 nt, Mus musculus
ggcugauaugauccacaaguguaacagagagcagagag

SEQ ID NO: 48590 - RNA, 46 nt, Mus musculus
cacuuccucggguauucaccagaauuuccagcuuuaugccuuggau

SEQ ID NO: 48591 - RNA, 46 nt, Mus musculus
uaaccuuaggaauucacaaucucaagaaaaagaaaaacacccagcu

SEQ ID NO: 48592 - RNA, 45 nt, Mus musculus
aggauguuccugcuccugguccuccugguggcugcccugccaguc

SEQ ID NO: 48593 - RNA, 26 nt, Mus musculus
ggcauuugaggaggaagucggggcag

SEQ ID NO: 48594 - RNA, 41 nt, Mus musculus
ugauaaugaaauucuggagacaagaugagaccaggaggagg

SEQ ID NO: 48595 - RNA, 41 nt, Mus musculus
uuuucauucuuugcugcccacuccacgugguucuugccuga

SEQ ID NO: 48596 - RNA, 42 nt, Mus musculus
aaaaccuguccugcccugaucuaaaguuagccuugccaggag

SEQ ID NO: 48597 - RNA, 46 nt, Mus musculus
aggaggaugaggaaugcaaaaaacguuuccgacacuacacugagac

SEQ ID NO: 48598 - RNA, 50 nt, Mus musculus
acagucacacugggggcccacaacaucaaggcuaaggaggagacacagca

SEQ ID NO: 48599 - RNA, 45 nt, Mus musculus
aggaaggcugcucaguugaaggagagcaaaggagacaaagcccuu

SEQ ID NO: 48600 - RNA, 24 nt, Mus musculus
aaagggggaaguuugaagcuaugg

SEQ ID NO: 48601 - RNA, 46 nt, Mus musculus
guuaaauggucacagaaugucagcacugcuaucauucagcacgugu

SEQ ID NO: 48602 - RNA, 45 nt, Mus musculus
aacuuacacuaagacuuuuaaguuuuuuuuguuaaaagagaccca

SEQ ID NO: 48603 - RNA, 44 nt, Mus musculus; identical to SEQ ID NO: 34367

SEQ ID NO: 48604 - RNA, 56 nt, Mus musculus
ccaccaaaggaacgguggccguuggggacagcgaggaggauggggaggacguuuuc

SEQ ID NO: 48605 - RNA, 45 nt, Mus musculus
ggagaguuaaauaauugaaauucacugucauuauuauggagcuag

SEQ ID NO: 48606 - RNA, 45 nt, Mus musculus
acaaguucaagacugaguuuauccucuaaggucuaccagcagcag

SEQ ID NO: 48607 - RNA, 49 nt, Mus musculus
aaaagaagauauuucaccaaggaagaaaaagaaaaaaauaaagugcaaa

SEQ ID NO: 48608 - RNA, 109 nt, Mus musculus
ugaggaaaaaaaggacaaaaaugggaaaacuaaaagacaaguucaagacagagcuggagagcaccucugaaauaaucgguuucgauguaaagacgaagaaaagaauuug

SEQ ID NO: 48609 - RNA, 48 nt, Mus musculus
aaagggcugaaguaagagauuuaaagauuaaaauaagagaagauguca

SEQ ID NO: 48610 - RNA, 48 nt, Mus musculus
acuuuauuucugacaacagagaagagaaucagaaugugagaaguguaa

SEQ ID NO: 48611 - RNA, 48 nt, Mus musculus
ggaugaccuuauaaguauugaagaggaugcugguacccgaguuagaag

SEQ ID NO: 48612 - RNA, 45 nt, Mus musculus
accaucaccuguguuugcccaaacccugaaaaguuccagacugag

SEQ ID NO: 48613 - RNA, 68 nt, Mus musculus
gggagggcggugauacgauuuauuuguauggcuuggcaguaguaguaccuggugguaguacccaccuu

SEQ ID NO: 48614 - RNA, 46 nt, Mus musculus
cauauagguacacguaucacgugugccuggugcccagagaguccag

SEQ ID NO: 48615 - RNA, 46 nt, Mus musculus
accaaguacucuuaacaucugugccaucacaucacugcagccccaa

SEQ ID NO: 48616 - RNA, 69 nt, Mus musculus
gcuuagcgugucugcagaauagucuugguggcgggagggagcagugggagaaacauuaaauaaucagcu

SEQ ID NO: 48617 - RNA, 46 nt, Mus musculus
gaaaauaccagaaaagguaugauuuggacaaagaagaaaaagccag

SEQ ID NO: 48618 - RNA, 45 nt, Mus musculus
uuuuauauuugggguaucugaacucaggucucaugauugcacaag

SEQ ID NO: 48619 - RNA, 41 nt, Mus musculus
ccuaccuagguucuaucuugagcaccaaaaagcuagaguga

SEQ ID NO: 48620 - RNA, 46 nt, Mus musculus
ccauccccaaaaggacagggaaggaaggaaggaagggagggaggaa

SEQ ID NO: 48621 - RNA, 41 nt, Mus musculus
uuaguacaacagucgucugucagacccaugcauagcuguga

SEQ ID NO: 48622 - RNA, 46 nt, Mus musculus
caagcccuuuguugggggcugcauugagggagguuaguagacuaua

SEQ ID NO: 48623 - RNA, 44 nt, Mus musculus
aaauagaaaauacaagaggguguuguccagugugugugcuauga

SEQ ID NO: 48624 - RNA, 41 nt, Mus musculus
aauguauauuuugauuguagcucacauauacaauugcccag

SEQ ID NO: 48625 - RNA, 46 nt, Mus musculus
ugccuuagguuugccauucauuuuauaccaagaaaacuugaucuag

SEQ ID NO: 48626 - RNA, 41 nt, Mus musculus
aguguauauagaugcacaugcgcaugucagagccugccgag

SEQ ID NO: 48627 - RNA, 27 nt, Mus musculus
ucuggacuuauaugcccaugcccccac

SEQ ID NO: 48628 - RNA, 76 nt, Mus musculus
aguugaaucugugagucuuuuuccuuguuacaaaacagcuagaaggaaggucuugucuuuuaaggaaaucuuggga

SEQ ID NO: 48629 - RNA, 45 nt, Mus musculus
uuuggaagcuggagcuuuugugaauguucagcaaagcaaugguga

SEQ ID NO: 48630 - RNA, 42 nt, Mus musculus
caauuaauacaucuagugccaguucagaaauuuauaucagag

SEQ ID NO: 48631 - RNA, 46 nt, Mus musculus
uacaaucaaggucacuguagucacaugaauagguuuagacacccga

SEQ ID NO: 48632 - RNA, 42 nt, Mus musculus
aggccagccuaggcaauguagugaaauccugcaucaacauag

SEQ ID NO: 48633 - RNA, 42 nt, Mus musculus
ggugcuuccgucaaccuuauaaacaacuuauuggggccagca

SEQ ID NO: 48634 - RNA, 45 nt, Mus musculus
ucuguccuaggugaggguaguggcauuuuaguacugaagucaaga

SEQ ID NO: 48635 - RNA, 45 nt, Mus musculus
aucuugacuucaguacuaaaaugccacuacccucaccuaggacag

SEQ ID NO: 48636 - RNA, 46 nt, Mus musculus
aacuuggauguucuuacaagguggaauuuguguacugacauucauu

SEQ ID NO: 48637 - RNA, 45 nt, Mus musculus
gauaaucgggugaggggacagaauugccucugaccauggaauaga

SEQ ID NO: 48638 - RNA, 45 nt, Mus musculus
agcacgcugugaggaaaaacuccuaaugacgcaaaagccgcaggc

SEQ ID NO: 48639 - RNA, 46 nt, Mus musculus
agugcacacauauacacacauauacuggauuagagaaugcauagau

SEQ ID NO: 48640 - RNA, 83 nt, Mus musculus
uguguguguguuuguuuguuuuuuuuaauuccaggacaguggacuaauauaguucgacccuauuuuaaagaauugggggaaaa

SEQ ID NO: 48641 - RNA, 28 nt, Mus musculus
aauucucccguuuggauugugcuuccua

SEQ ID NO: 48642 - RNA, 44 nt, Mus musculus
cucauacauacaauguaaaauuuaaaaaaauugucaguugcaga

SEQ ID NO: 48643 - RNA, 42 nt, Mus musculus
aaaguaguucucuugauggagcacaaauguacgcggccuuug

SEQ ID NO: 48644 - RNA, 46 nt, Mus musculus
cuguuaagauaucuagcaauuuacgcauuuuuuaagugccucagau

SEQ ID NO: 48645 - RNA, 46 nt, Mus musculus
agucaugaucagugccucuagucccaacuauuugcuaggguaaggc

SEQ ID NO: 48646 - RNA, 23 nt, Mus musculus
uuagagucaagcaugguggcaua

SEQ ID NO: 48647 - RNA, 87 nt, Mus musculus
uaggugaugaauaguguccuugggcaggugaagauggcucaacaguugaagcgucacucagauccaucuguaacuccauucccagga

SEQ ID NO: 48648 - RNA, 45 nt, Mus musculus
guucuuagauuccugaugucugagaggaguuacauaagaccuuga

SEQ ID NO: 48649 - RNA, 58 nt, Mus musculus
aucauguucauuuuugucccaucucaauaccaggccagcuagguguggugaagcaggu

SEQ ID NO: 48650 - RNA, 50 nt, Mus musculus
aauaauggguguuugccauacaucaaaggaagauuuggagcaggcagguc

SEQ ID NO: 48651 - RNA, 94 nt, Mus musculus
aaguaugagcaagccacuagcucucccugcccucuacaaaccagauaagcaguuugauuauucaucauuacacauucgaauuuguauaagaucu

SEQ ID NO: 48652 - RNA, 45 nt, Mus musculus
acugucauuuugacuaauagcaugcugaacuuucagugcugggga

SEQ ID NO: 48653 - RNA, 46 nt, Mus musculus
aaauguaaaguagcuuauuuuagcuuuuuguuagggcgauaauaag

SEQ ID NO: 48654 - RNA, 51 nt, Mus musculus
uuaaauuuuauaaugucaucuuugaguacaauauuaaucauaacuccaaac

SEQ ID NO: 48655 - RNA, 70 nt, Mus musculus
ccugcuagaccgcacuguccagugcucuaugcauggcuggcuguugacuguguguguggaccuagugagu

SEQ ID NO: 48656 - RNA, 46 nt, Mus musculus
augauuaaccaaugagccuguuucuaaauggguuauugccauauag

SEQ ID NO: 48657 - RNA, 42 nt, Mus musculus
agauuaaauuguugggaguguuuugugauccugcccccccuc

SEQ ID NO: 48658 - RNA, 46 nt, Mus musculus
ucauagaguauauucauuuguauaucaaauaaaauguaucccagua

SEQ ID NO: 48659 - RNA, 45 nt, Mus musculus
uuacuuucuagcuaaauauauagguaaggagucuucuuuuuggga

SEQ ID NO: 48660 - RNA, 46 nt, Mus musculus
caggguugcuccaauaaggcccuggauucauucucuaguaccacug

SEQ ID NO: 48661 - RNA, 46 nt, Mus musculus
uggggggaucaucuuaacugugauugacauuuaauagcaauaggau

SEQ ID NO: 48662 - RNA, 46 nt, Mus musculus
auuggaauauuuccauuuuguuaagucuguccaguaacucccaugu

SEQ ID NO: 48663 - RNA, 44 nt, Mus musculus
uagagggagucaagggggcaauuuugaaggcccuaauaagcguc

SEQ ID NO: 48664 - RNA, 45 nt, Mus musculus
uguagacgggccaucccuuuuacauccauugggaucagagagaga

SEQ ID NO: 48665 - RNA, 45 nt, Mus musculus
ggaccagaaggagcugcaaauaugggaacuccaaugauaccagau

SEQ ID NO: 48666 - RNA, 46 nt, Mus musculus
aacguauuguaaauuuuuaagcaauuucugauagugcacauagauc

SEQ ID NO: 48667 - RNA, 46 nt, Mus musculus
uuagguaguauauaagacaauaaauauaguuucaagggcaguuaga

SEQ ID NO: 48668 - RNA, 46 nt, Mus musculus
guauuuaguaugaaaguauuuuucaagagucuucaguggcuuguug

SEQ ID NO: 48669 - RNA, 79 nt, Mus musculus
uugaagcaaaagacuuauaaaacuuacuuguaauucuuuuggggacuguaugcugguuuugguaucuauaugcugagaa

SEQ ID NO: 48670 - RNA, 43 nt, Mus musculus
aggaaaugagaaugggugauauggguccccguggagcaauaaa

SEQ ID NO: 48671 - RNA, 42 nt, Mus musculus
uauuaaugcucgguuuuucucugauauaaggucuaggcaagu

SEQ ID NO: 48672 - RNA, 49 nt, Mus musculus
uugugcuugguagagcugcucuaccauuaaaucucucugcagaugucuu

SEQ ID NO: 48673 - RNA, 46 nt, Mus musculus
aagagaacuuaauggcacaugguugcgaauucuuuaaguuguagau

SEQ ID NO: 48674 - RNA, 46 nt, Mus musculus
uuagaguuggcaauaagguguugggugcugggaacugaacuuaggu

SEQ ID NO: 48675 - RNA, 45 nt, Mus musculus
aaugcuucagaccucauuacagaugguugugaaccaccaugugau

SEQ ID NO: 48676 - RNA, 41 nt, Mus musculus
uggugagugcuuuuaauuacacgcacucaggaagagguggu

SEQ ID NO: 48677 - RNA, 45 nt, Mus musculus
gccaggcaggguuacacagugagagucuauauuacuugcccauaa

SEQ ID NO: 48678 - RNA, 45 nt, Mus musculus
ucucauuuuauguuucagagucuuaauguuuaacuuugugaaguu

SEQ ID NO: 48679 - RNA, 46 nt, Mus musculus
aauuggaauucaaggccagccucagcugcuuuaguaagauacaguc

SEQ ID NO: 48680 - RNA, 42 nt, Mus musculus
cucucuauucguuguuacuuugauuucugauugggcaaagau

SEQ ID NO: 48681 - RNA, 46 nt, Mus musculus
aaucgccuauaucuaacauuugguaacuuuauuuauucauugagau

SEQ ID NO: 48682 - RNA, 45 nt, Mus musculus
uuguaaguaguuugaauuaguaacagauuguaagaagacauauuu

SEQ ID NO: 48683 - RNA, 46 nt, Mus musculus
cagaguguuuaugcagggaaggaccucuaagagauagacuaaagua

SEQ ID NO: 48684 - RNA, 54 nt, Mus musculus
uguacuuuaugauuuacugugccuugguauaucgucguagauuaagcauuuggu

SEQ ID NO: 48685 - RNA, 46 nt, Mus musculus
agaggucaggauuuguuuauauaguuauuuagaagcuaacagaauu

SEQ ID NO: 48686 - RNA, 45 nt, Mus musculus
auguguugaaauuaucauggucguaauacaagacuugggcaaaca

SEQ ID NO: 48687 - RNA, 37 nt, Mus musculus
agggucagaaggucaaggccucaaacuuacaggagau

SEQ ID NO: 48688 - RNA, 48 nt, Mus musculus
cuccagccccuggaguguacauuuuauuucaucaggaauauuguagca

SEQ ID NO: 48689 - RNA, 47 nt, Mus musculus
uuuauuauuauauguuaaguauacuguuagcugucuucagaugcacc

SEQ ID NO: 48690 - RNA, 46 nt, Mus musculus
gcauaaguguuuaaauuacauaaacacaugcauaaugaaugaauga

SEQ ID NO: 48691 - RNA, 44 nt, Mus musculus
ccaggcuugcuuaguuucagcaggaacagugggccagagagggu

SEQ ID NO: 48692 - RNA, 45 nt, Mus musculus
uuugcuaagguaaaauuggcgcgugugaguagggugguugugaau

SEQ ID NO: 48693 - RNA, 46 nt, Mus musculus
uuuuugcuuuguggaaauuaacauagauauuaauaugccuguagau

SEQ ID NO: 48694 - RNA, 45 nt, Mus musculus
ucgugaagaagaaaugauccgucacagagagcaggaggagcugag

SEQ ID NO: 48695 - RNA, 46 nt, Mus musculus
guuuugauauuauuauacacauacauaaaaguuaaguuugcagucu

SEQ ID NO: 48696 - RNA, 42 nt, Mus musculus
gccaucucuccaguuccagaaauuuugccauaagccccugag

SEQ ID NO: 48697 - RNA, 45 nt, Mus musculus
aucuuuucuguugcuagguaacuggggaggaguuuagcugggagg

SEQ ID NO: 48698 - RNA, 45 nt, Mus musculus
ucauuauagaaaggcagggggaaagagagaagguagaaaagagag

SEQ ID NO: 48699 - RNA, 47 nt, Mus musculus
aaaacaacuguucacagcggaauuccauuuaacaguaaagagaaaag

SEQ ID NO: 48700 - RNA, 46 nt, Mus musculus
auauagguagaagcuguacaguacaguucaauaaaaggccccgaaa

SEQ ID NO: 48701 - RNA, 45 nt, Mus musculus
auaauguuacauuuuguuuuugaacuuacagcauacacaucaaaa

SEQ ID NO: 48702 - RNA, 46 nt, Mus musculus
cuaaagagaugacgauugugauugucauaguuuagugaguagagau

SEQ ID NO: 48703 - RNA, 46 nt, Mus musculus
uaauagugcuacuucccaugggccaacaauauguaaagcaccacag

SEQ ID NO: 48704 - RNA, 47 nt, Mus musculus
agaacucagacguuuggaagaacucagaaaucaagaacugcagaaac

SEQ ID NO: 48705 - RNA, 45 nt, Mus musculus
cuaaaaagauugggaacagauuuguuacagauuuagaucucuggg

SEQ ID NO: 48706 - RNA, 64 nt, Mus musculus
cagcagcgggaacaaguugauagaaacaucagagaagccaaagagaaacuggaggcagagaugg

SEQ ID NO: 48707 - RNA, 71 nt, Mus musculus
gguuugcucaaccugggacauuugaauuugaauaugcgucucgauggaaggcucuugaugaaauggaaaag

SEQ ID NO: 48708 - RNA, 88 nt, Mus musculus
uaggaauuguauuacacauuugagauuaaauaguugacugguaaugccuguccuauaagggcaaaacuguuaaauauguaauuacagg

SEQ ID NO: 48709 - RNA, 46 nt, Mus musculus
acaccucguccagucauuguagaacccauggagcaguuugaugaug

SEQ ID NO: 48710 - RNA, 45 nt, Mus musculus
uuguuugaacaagaagcuuagaucuugaauugcaagcacaaagaa

SEQ ID NO: 48711 - RNA, 45 nt, Mus musculus
guuggagaauuuuuaacgaaagaugauugaacaauauugcuagau

SEQ ID NO: 48712 - RNA, 50 nt, Mus musculus
acagaggaagcuuccacaggagugguaggcauugugagaccaaggguaag

SEQ ID NO: 48713 - RNA, 46 nt, Mus musculus
ggaagagcagucagugcucuuaaccgccauuucuccagcccacauu

SEQ ID NO: 48714 - RNA, 64 nt, Mus musculus
caaugagcuucuagagcaagcauuuucccaguuuggcccaguagagaaagcuguugugguugug

SEQ ID NO: 48715 - RNA, 47 nt, Mus musculus
gagaacacuggcugaaauugcaaaagcagaguuggauggcaccauac

SEQ ID NO: 48716 - RNA, 42 nt, Mus musculus
auacuagaacccuguaggcggggauuguagguguuggcuguu

SEQ ID NO: 48717 - RNA, 45 nt, Mus musculus
ggacuaaauagagagacucugucugaaaagcaggauggggguaug

SEQ ID NO: 48718 - RNA, 42 nt, Mus musculus
caucaaccgcgaccgaggcuucggcuucauccgccuggugag

SEQ ID NO: 48719 - RNA, 42 nt, Mus musculus
uuuauaaugcaucgcuaucucccuaugaaaacugccagaguc

SEQ ID NO: 48720 - RNA, 46 nt, Mus musculus
agucacuugugcaaacugcaaaaaaccucuacagaaggggcagaca

SEQ ID NO: 48721 - RNA, 48 nt, Mus musculus
cucgaaaaacaacaacaaccaaaaaagaaagaaagaaagaaagagaga

SEQ ID NO: 48722 - RNA, 46 nt, Mus musculus
accagggcuacacagagaaacccuaucucgaaaaaagaaaaaagaa

SEQ ID NO: 48723 - RNA, 66 nt, Mus musculus
agcaaccacauggugguuuacaaccauccauaaugagaucugauggccucuucuggugcgucugaa

SEQ ID NO: 48724 - RNA, 45 nt, Mus musculus
aacaauuguaauugaugaugaaggggacacagacacaaauggagg

SEQ ID NO: 48725 - RNA, 46 nt, Mus musculus
aacuaguucuuuagccgguacaucuagaaacacacauguggaagau

SEQ ID NO: 48726 - RNA, 42 nt, Mus musculus
uuaauuuuauuuuauguacauuaguguuuugacugcaaagau

SEQ ID NO: 48727 - RNA, 47 nt, Mus musculus
gaccuagaggacacauggccaacauggcagggcugucugggagaaug

SEQ ID NO: 48728 - RNA, 65 nt, Mus musculus
ugugacugcuccaaggagugguugagaagguuuuuauuguagaugugagagagaguacagccaga

SEQ ID NO: 48729 - RNA, 47 nt, Mus musculus
gagcagucagugcucuuacccaccgagccauuucaccagcccuagau

SEQ ID NO: 48730 - RNA, 46 nt, Mus musculus
uaagcuugugucaaguuaacaaaaaaggaaacuaaccagugcaaau

SEQ ID NO: 48731 - RNA, 46 nt, Mus musculus
acacugucccaaaaaaauacaacaacaacaaacaaaacccacagug

SEQ ID NO: 48732 - RNA, 86 nt, Mus musculus
aguuagggcagugucagacuguagaauucugucugccuguuaagauuggagguugcacugggugugggugcauuuacagagcaagu

SEQ ID NO: 48733 - RNA, 45 nt, Mus musculus
caguagauauccuuagcugcugagacaucacuccaguccccauca

SEQ ID NO: 48734 - RNA, 78 nt, Mus musculus
cggugcucuaaacuacugagccaucucuccagcccccagacauguauuucuuacuuuuaaaaaauauuuagagagaga

SEQ ID NO: 48735 - RNA, 46 nt, Mus musculus
gguugugagccacuguguagucucugggaauuaaacuuuggaccuc

SEQ ID NO: 48736 - RNA, 28 nt, Mus musculus
gggggggggggggggggggccggcaggc

SEQ ID NO: 48737 - RNA, 42 nt, Mus musculus
aguuucucguccccacggguucgguucugaugggccccaagu

SEQ ID NO: 48738 - RNA, 45 nt, Mus musculus
ugggauuguaagcaugucaccacugcuuucuugguuuaggcuuag

SEQ ID NO: 48739 - RNA, 46 nt, Mus musculus
aguuccacauaccauaaauuagaacuacaguaguuuauguggcuag

SEQ ID NO: 48740 - RNA, 47 nt, Mus musculus
agagcuguaggccucacaguggugucgcggggucauccgggggccca

SEQ ID NO: 48741 - RNA, 45 nt, Mus musculus
aucucugguuuuccaaagguccuggaaacuucaugguaucccuuu

SEQ ID NO: 48742 - RNA, 44 nt, Mus musculus
aucaucaggcugccacuccugaggagauagacaggaaaagggag

SEQ ID NO: 48743 - RNA, 26 nt, Mus musculus
gaaaacggaacagaaaggugacuaua

SEQ ID NO: 48744 - RNA, 45 nt, Mus musculus
ggcuuuauguagaucccuguugaaagcuuuuuuccccaucugauc

SEQ ID NO: 48745 - RNA, 46 nt, Mus musculus
aguucaugagcaugaagucaguggccucaauacccacuugggcaag

SEQ ID NO: 48746 - RNA, 46 nt, Mus musculus
uguuuguucacuuuacugaguguuaaguuugaucuuuggcccaguu

SEQ ID NO: 48747 - RNA, 137 nt, Mus musculus
aauaacuuguauucagacagaacuauauuuauuacauuugacaagauccuaggaugauauacuccaauucuguuacaccccuguugauggaaggaagauuuauuuuagaugggaccaaauaaugcuuaaaugaucac

SEQ ID NO: 48748 - RNA, 48 nt, Mus musculus
cagaaggcuuugagauccaacuaaauagauaggucacuggccaagaca

SEQ ID NO: 48749 - RNA, 46 nt, Mus musculus
ccuaucuauuuaguuggaucucaaagccuucugucaaaaggcccac

SEQ ID NO: 48750 - RNA, 90 nt, Mus musculus
guuguuuuuagguguuuuuuuucucuuuaauugaucugcagcagcaaucacucauauuuuguauuguucuugaugucuguguuuccucag

SEQ ID NO: 48751 - RNA, 46 nt, Mus musculus
ucagcuauuaagaugcacgugcugugcaguucagguaggaggacag

SEQ ID NO: 48752 - RNA, 62 nt, Mus musculus
uuggcuuuggguauuagcugcuaugauccucuugccccuuugauuauguauuuauguuuauc

SEQ ID NO: 48753 - RNA, 46 nt, Mus musculus
uguaacagguuuugugcuuuccaacauuuccccccuucggugauua

SEQ ID NO: 48754 - RNA, 46 nt, Mus musculus
augccuucaacaagcucacagcgagcagcacuccuccugcccugga

SEQ ID NO: 48755 - RNA, 46 nt, Mus musculus
uucugaacugguugagacauuacugucaagucaacaagacccaguc

SEQ ID NO: 48756 - RNA, 50 nt, Mus musculus
uucagcugguuuuugauaugcuggucuugcaaaagcacaacacggagaug

SEQ ID NO: 48757 - RNA, 45 nt, Mus musculus
caucuccguguugugcuuuugcaagaccagcauaucaaaaaccag

SEQ ID NO: 48758 - RNA, 46 nt, Mus musculus
gggaggcagaggccaguagaucucggaggucaaggccagccuagcc

SEQ ID NO: 48759 - RNA, 45 nt, Mus musculus
ggugguggugguacacaccuuuauuccagcacuuaagaggcaaga

SEQ ID NO: 48760 - RNA, 46 nt, Mus musculus
uguauagauucacaaaaaggcccaugauacacuaaugcagucaaca

SEQ ID NO: 48761 - RNA, 45 nt, Mus musculus
gugcuaaggauguguaggaggccaucuaggacugggugacgagag

SEQ ID NO: 48762 - RNA, 45 nt, Mus musculus
aaacacaacaaaacaagauacaauaagacaaggcaauccaccagg

SEQ ID NO: 48763 - RNA, 44 nt, Mus musculus
aagucuguuguuguauauucuguccauaaagaguccuguuagua

SEQ ID NO: 48764 - RNA, 42 nt, Mus musculus
ggggcaccaugcccagcauuuuuggggucaaaaacaaagggg

SEQ ID NO: 48765 - RNA, 42 nt, Mus musculus
uucagcagcaugcgcuggcaccggagggacaagcgcggcaag

SEQ ID NO: 48766 - RNA, 46 nt, Mus musculus
uguggucucauaaucugaagcucaauuauuaauuuauuuauuggaa

SEQ ID NO: 48767 - RNA, 57 nt, Mus musculus
uugggcaaccuugggaggaaugggcacaggaauguauagaggcuuggauguaggacc

SEQ ID NO: 48768 - RNA, 45 nt, Mus musculus
gaaaccaggcucagcccaucgaagcugguacgucucuucucuggu

SEQ ID NO: 48769 - RNA, 46 nt, Mus musculus
ccaagacaccaguaaauauccauuuuuagccaucguucucugucag

SEQ ID NO: 48770 - RNA, 42 nt, Mus musculus
agagagagagagagagagagagagagagagagagaacgacua

SEQ ID NO: 48771 - RNA, 46 nt, Mus musculus
uugccauaguagccaggaggugauggugugugccuuuaaucucaau

SEQ ID NO: 48772 - RNA, 45 nt, Mus musculus
accgaucaaguuccugcauauagaaacuaugucuuaggggguggg

SEQ ID NO: 48773 - RNA, 46 nt, Mus musculus
uuuuaaaagcugccuagauaugauguuuucuuauggcuauagagaa

SEQ ID NO: 48774 - RNA, 46 nt, Mus musculus
agaacucugaaccugcguuucaguccccagcacucucaucuggcag

SEQ ID NO: 48775 - RNA, 45 nt, Mus musculus
gugugagagagggggggagagagaauuaaugaaauaagaggccau

SEQ ID NO: 48776 - RNA, 46 nt, Mus musculus
caccuguggcauuccuuuugucuuggucauccugacuagccccuag

SEQ ID NO: 48777 - RNA, 46 nt, Mus musculus
guccuggugggaaaaaccugaaacaguuaagucauaucaccuccag

SEQ ID NO: 48778 - RNA, 45 nt, Mus musculus
acuuagauaccagcuaaguuucuccaaguucaguccaguuccuag

SEQ ID NO: 48779 - RNA, 41 nt, Mus musculus
ggagagggagagggcgagagcgcacuaacaaggaacauggu

SEQ ID NO: 48780 - RNA, 46 nt, Mus musculus
auaauaaaauagaucagaugaguugguuuuaauagaaaauauguag

SEQ ID NO: 48781 - RNA, 45 nt, Mus musculus
gaagcacauggccuggagaaacugcaaguucuaaugggucucaua

SEQ ID NO: 48782 - RNA, 74 nt, Mus musculus
agagagggggcaagagagagacagaggcacaaagagacacagacagagagacggagacagagauagaagaaaga

SEQ ID NO: 48783 - RNA, 45 nt, Mus musculus
gcacauuaaauaaauaaauaaacaaauaaauaauuuugagagaaa

SEQ ID NO: 48784 - RNA, 41 nt, Mus musculus
agggagagggagagggagagggagaaaguuaguucaaggcu

SEQ ID NO: 48785 - RNA, 84 nt, Mus musculus
gcucagucagagaaguuuuugccuuguaacaugaaaagaagcagagauggcgucacaucuauaaucccaggcaaagaggaugga

SEQ ID NO: 48786 - RNA, 43 nt, Mus musculus
cagagcuccugccuccaaaguuuccucccuucaucggcccaaa

SEQ ID NO: 48787 - RNA, 46 nt, Mus musculus
uuaauaccaccagcaaagaucuuuuucacaguuaagugggcaccug

SEQ ID NO: 48788 - RNA, 46 nt, Mus musculus
uccacaacucuuccauccaccuuguguggucuugcauucauggcag

SEQ ID NO: 48789 - RNA, 46 nt, Mus musculus
auggcuccucagacucuggucgguuguuucgaagcucagcccucca

SEQ ID NO: 48790 - RNA, 46 nt, Mus musculus
gagguugaggcaggaagaucagaaagucacucucagcugcauagac

SEQ ID NO: 48791 - RNA, 45 nt, Mus musculus
gguaauuagaauacaugugacaugaaggcaggagggcuacugagg

SEQ ID NO: 48792 - RNA, 46 nt, Mus musculus
ucaaacccugguuccaggaagugacugccaugguucucuuacaggu

SEQ ID NO: 48793 - RNA, 46 nt, Mus musculus
ccuuggggcgauauuguaauauucauuugaaagaaagaggcagagg

SEQ ID NO: 48794 - RNA, 45 nt, Mus musculus
ggcaaacuuggcuguuuguuuuugguucuuugauuaaaugaugau

SEQ ID NO: 48795 - RNA, 46 nt, Mus musculus
uggguucugaucccaggccugcugcuguggcagucauggguagaac

SEQ ID NO: 48796 - RNA, 46 nt, Mus musculus
ggauuuuuucuuuucaauacugccuggcuuucuacuugcuacaguu

SEQ ID NO: 48797 - RNA, 45 nt, Mus musculus
ccuuauuuuauuauuuuacucugcuuuuauuuuaucuugauuuau

SEQ ID NO: 48798 - RNA, 61 nt, Mus musculus
uuacacguccuguccagaagaggugaaucuuuagagacggauaacaaauuagugguugcuu

SEQ ID NO: 48799 - RNA, 46 nt, Mus musculus
aagcauaaagcuuccuuccaagcccauguuaacagacaugagagua

SEQ ID NO: 48800 - RNA, 41 nt, Mus musculus
uguguguguguguguguguguguguguggugucuggccuuu

SEQ ID NO: 48801 - RNA, 44 nt, Mus musculus
acugacuucguaggagccaucacuauccacugguuaaugucagg

SEQ ID NO: 48802 - RNA, 62 nt, Mus musculus
aaccugaccgugcacauaagucacccugggguuggcugagauucuguacuugugcaagcucc

SEQ ID NO: 48803 - RNA, 46 nt, Mus musculus
ucuccucagaggguugcuggaaacccaggagucauggggcucacgc

SEQ ID NO: 48804 - RNA, 79 nt, Mus musculus
cuuagagucacggcuacaggccaaucugaucugggcaguuccucaauugaaacuccuucacuacuggcuuuaucaugga

SEQ ID NO: 48805 - RNA, 42 nt, Mus musculus
ccacuugaguacaccuaauccccccgaagaacaaaggcagua

SEQ ID NO: 48806 - RNA, 41 nt, Mus musculus
cacauaggcaguucuggugucuuacucccucccggcuuuua

SEQ ID NO: 48807 - RNA, 46 nt, Mus musculus
gggccuuuauccacugagccaucuccacauucccucgccccauuuu

SEQ ID NO: 48808 - RNA, 42 nt, Mus musculus
gugccuuucuauaaaguugggucaaugguuuucuacccagag

SEQ ID NO: 48809 - RNA, 44 nt, Mus musculus
uauccagaggcugggcgaccuagguggugcgcaggcgcgggaca

SEQ ID NO: 48810 - RNA, 45 nt, Mus musculus
guccauuuugcaccggcgcagcccggccccaguuggcugguggag

SEQ ID NO: 48811 - RNA, 46 nt, Mus musculus
aaugagaccuguucaguguuugcuaaggugaggaaauacguggaga

SEQ ID NO: 48812 - RNA, 45 nt, Mus musculus
guacccagcucauuuuauucauuuucaggauuugucagcucccua

SEQ ID NO: 48813 - RNA, 46 nt, Mus musculus
cuuugaaacuaugaagcuugcaguuaugcaaaccuaugacccggag

SEQ ID NO: 48814 - RNA, 42 nt, Mus musculus
gaugguaguucugcugggucuccucauauucuuuggccccac

SEQ ID NO: 48815 - RNA, 42 nt, Mus musculus
aggaugaguggucaggaccucgucacuuugaaugugggaggg

SEQ ID NO: 48816 - RNA, 46 nt, Mus musculus
ugggagaccaagaaauaaggaaauaauuuauuuggaagaccaagaa

SEQ ID NO: 48817 - RNA, 46 nt, Mus musculus
gcccgguuugacuccuaacuuuuuguuacauguuuggaacagcgcg

SEQ ID NO: 48818 - RNA, 46 nt, Mus musculus
cacuagaaaugcaagcucacauucuccuuuucuuuaguucauccac

SEQ ID NO: 48819 - RNA, 54 nt, Mus musculus
acauauaauaaguaaaucuuuaaaaauaaauaaauaaauaaaaggagagagagg

SEQ ID NO: 48820 - RNA, 46 nt, Mus musculus
ggucagcuagcaugaaauuguucaguaagaauuucaguccucaguu

SEQ ID NO: 48821 - RNA, 46 nt, Mus musculus
uggugagaaacugaauucuuucaaugcaugcuuccuuauaccagau

SEQ ID NO: 48822 - RNA, 44 nt, Mus musculus
ugggcuucccuuccuccagcuuuucauucugccggccauacuuu

SEQ ID NO: 48823 - RNA, 46 nt, Mus musculus
uagaucugaguucaaggccaguguggucuacaagugagcuccaaga

SEQ ID NO: 48824 - RNA, 42 nt, Mus musculus
uugguucccugucucugguacacuuuacauuuuagaccagau

SEQ ID NO: 48825 - RNA, 46 nt, Mus musculus
uuuuaauuccuccaguuugggaauugcuguaccuaagugccuaguu

SEQ ID NO: 48826 - RNA, 46 nt, Mus musculus
cugggucucaccauguagaccaggcugccaugaaacucacugagau

SEQ ID NO: 48827 - RNA, 46 nt, Mus musculus
auuuaaacuuaucucuacauuguuuuuaauguguagugcaguggga

SEQ ID NO: 48828 - RNA, 57 nt, Mus musculus
cacuuguaauccuagaucugaggaaguggaaaaaagagaauuagaggcuuaacauca

SEQ ID NO: 48829 - RNA, 46 nt, Mus musculus
aauaacuauuccaauauugagauaaaucuuguguucauguguagau

SEQ ID NO: 48830 - RNA, 46 nt, Mus musculus
aaaaauuauuuugguccuuaggccagaauauaaaccacugaauuug

SEQ ID NO: 48831 - RNA, 42 nt, Mus musculus
cuguauaguaauccuucuaccuccaucucuagagugccaaaa

SEQ ID NO: 48832 - RNA, 46 nt, Mus musculus
auguuguccuuuguggagcacuugguaacuuuguagugcaguugaa

SEQ ID NO: 48833 - RNA, 45 nt, Mus musculus
aauauguaugaauguguguguguguguguguguguguguguaaua

SEQ ID NO: 48834 - RNA, 46 nt, Mus musculus
gaaacaauugcagcagugcuaguuucacuuauuuuuggccucagac

SEQ ID NO: 48835 - RNA, 46 nt, Mus musculus
aguuagaugcauauguuuugcuuuuuaaauaguaggagcaucaugg

SEQ ID NO: 48836 - RNA, 46 nt, Mus musculus
aagaaguauuauuacaagugguagagcacaugccaaggccccagau

SEQ ID NO: 48837 - RNA, 51 nt, Mus musculus
cagauaauugacacaguuuuaaugaguuaaaugagggagaaagcaguauau

SEQ ID NO: 48838 - RNA, 45 nt, Mus musculus
agguuagagaguaauaaggugaaaauggagugucuuggggguuga

SEQ ID NO: 48839 - RNA, 37 nt, Mus musculus
uagaacacauuauuagguguguuuaagaaugcuagag

SEQ ID NO: 48840 - RNA, 45 nt, Mus musculus
ugauugaaugcccauguaaugcauuggaauaugauaggcgauuaa

SEQ ID NO: 48841 - RNA, 46 nt, Mus musculus
auaguuacuuugaaaaugaaugucauacagagaaaugaaagcagaa

SEQ ID NO: 48842 - RNA, 46 nt, Mus musculus
uuuaauggauuuuucuuugagacagguuucaaguaauggaguuaau

SEQ ID NO: 48843 - RNA, 46 nt, Mus musculus
cuaagguguuugguuuuuccuuugauaaaauuuuuccgucucaguc

SEQ ID NO: 48844 - RNA, 46 nt, Mus musculus
cuguguuuagacagagaacuauucaaauaaauacaaaauguaaaau

SEQ ID NO: 48845 - RNA, 42 nt, Mus musculus
gcgcaaugugauguuuuucaaauugagucuaacggagcuccc

SEQ ID NO: 48846 - RNA, 44 nt, Mus musculus
cacguuaaacucuugugucgcuuuccucccucagcaccccuaga

SEQ ID NO: 48847 - RNA, 42 nt, Mus musculus
cucggaugggcggcguccggccgcgcucggguggcgggagcg

SEQ ID NO: 48848 - RNA, 46 nt, Mus musculus
agccucaaguagcgaagcgggucucgagagguggcagcgaugggac

SEQ ID NO: 48849 - RNA, 45 nt, Mus musculus
aaucccccaaaaaucaucaaaaaaauuaacuuagagcagagggca

SEQ ID NO: 48850 - RNA, 46 nt, Mus musculus
cuuucggcgccauuuucgagugaugccugaucucaucaaucuagcg

SEQ ID NO: 48851 - RNA, 46 nt, Mus musculus
aaaucccagcaaccacaugguggcucacaacuaucuguaacuagau

SEQ ID NO: 48852 - RNA, 46 nt, Mus musculus
ggccuagaaccuugccucuaaaaguccagcuuggaacacagcaggg

SEQ ID NO: 48853 - RNA, 44 nt, Mus musculus
acauauaauaaauaaauaaauaaauuuuaacaauuaucuagagg

SEQ ID NO: 48854 - RNA, 46 nt, Mus musculus
accaagaggcaagcggcugucuaugaggaagcaguaaccaaaagga

SEQ ID NO: 48855 - RNA, 46 nt, Mus musculus
gcuaacaguuuacagugaaugagcacuguagaaacggccuuguguc

SEQ ID NO: 48856 - RNA, 46 nt, Mus musculus
auauccuuauagcugagaacaguaugcuaccuagcuauuuggagaa

SEQ ID NO: 48857 - RNA, 40 nt, Mus musculus
acugguacgggugcugggugggaguugaaaagggguaaga

SEQ ID NO: 48858 - RNA, 41 nt, Mus musculus
ggagcagggagggcgaaaguuggggagaggaggcgggagag

SEQ ID NO: 48859 - RNA, 42 nt, Mus musculus
cacgugacgggguuggcagcgcucgggcccgggcggggggag

SEQ ID NO: 48860 - RNA, 44 nt, Mus musculus
augggaguugggaucucugcuuuucauggagagucucaugugca

SEQ ID NO: 48861 - RNA, 45 nt, Mus musculus
cccacucaccuuuuccuuucagaacauuuaaaagaugccucgaag

SEQ ID NO: 48862 - RNA, 45 nt, Mus musculus
ccugucuuaguucugccuggaaauccaccacaggagcuugcuguu

SEQ ID NO: 48863 - RNA, 46 nt, Mus musculus
gucuacacacaacuggcuagcaagccuuauaaagacuuagcaugag

SEQ ID NO: 48864 - RNA, 46 nt, Mus musculus
gcuggggaagcaggcaggagaaucucugacuuuaaaaagcacacgu

SEQ ID NO: 48865 - RNA, 46 nt, Mus musculus
aaaagggacagugacucaaaacugugguauugccaugaggcuagaa

SEQ ID NO: 48866 - RNA, 45 nt, Mus musculus
aaaaaacaaacaaacaaacaaacaaaacaaaacaaaaaaaagugc

SEQ ID NO: 48867 - RNA, 46 nt, Mus musculus
ugugugugagagagagagagagagagagagagagagauugagagag

SEQ ID NO: 48868 - RNA, 42 nt, Mus musculus
acaacaaaauccaaugcccaaacaaauaaaaagcccaaagac

SEQ ID NO: 48869 - RNA, 42 nt, Mus musculus
auguuuacugugugcaguaugugcccuugauaugcagcagaa

SEQ ID NO: 48870 - RNA, 46 nt, Mus musculus
caguggaugugaauaaauaucuauaguuccuuguauagccccuugu

SEQ ID NO: 48871 - RNA, 46 nt, Mus musculus
ugugaacacugccaaaacuugacuauugucuuaccuaucccuguac

SEQ ID NO: 48872 - RNA, 41 nt, Mus musculus
agcaugccugucaauaaggaaaaauuccaacgaggccacca

SEQ ID NO: 48873 - RNA, 46 nt, Mus musculus
cuggcuacucaauccagcacccucauauuuuuaauuugaaugacua

SEQ ID NO: 48874 - RNA, 45 nt, Mus musculus
ucaguugagcuuugaaauacuucuuaaauaaaauuaugccaagaa

SEQ ID NO: 48875 - RNA, 31 nt, Mus musculus
cuaguugcuuaucuucuuccaucguuucagu

SEQ ID NO: 48876 - RNA, 45 nt, Mus musculus
uuguaaaagguuauacaaccugucgccccaaaauuugcccuuaga

SEQ ID NO: 48877 - RNA, 46 nt, Mus musculus
ugaacuucagcauguagaacuaagauuugaaacugcucggcccuuc

SEQ ID NO: 48878 - RNA, 34 nt, Mus musculus
uuuacugagaaucucuuccuuuugaggccaauaa

SEQ ID NO: 48879 - RNA, 50 nt, Mus musculus
aagggaggauauauuuggggauggguauuuuauucuuugagaucguggaa

SEQ ID NO: 48880 - RNA, 46 nt, Mus musculus
auuguaaguuguacaaauguauuuugaagaauauuuaagaaaagca

SEQ ID NO: 48881 - RNA, 48 nt, Mus musculus
aauggaaucugauacccucuucugucugaagacagccacaguguacuc

SEQ ID NO: 48882 - RNA, 42 nt, Mus musculus
auggucgcuggcucccaaaggcccgcuccgcuucgcagcccg

SEQ ID NO: 48883 - RNA, 46 nt, Mus musculus
ugauaaauucuguguguguuugugugugguuuguauguguugugua

SEQ ID NO: 48884 - RNA, 46 nt, Mus musculus
uuaggucaccauggccagagccuaugggaaacaacuguccccugaa

SEQ ID NO: 48885 - RNA, 45 nt, Mus musculus
aucucaacuguuaaccuguuuuaauuggguuaguaccuggccaag

SEQ ID NO: 48886 - RNA, 46 nt, Mus musculus
ggguggaagagaauaagguugauaaaugcuaaguuaguauccacag

SEQ ID NO: 48887 - RNA, 46 nt, Mus musculus
gugaugcucacccacagggaucacaugucuuuccaacuugcauaag

SEQ ID NO: 48888 - RNA, 45 nt, Mus musculus
gucaaagguauauaaaaccauaucagaauucaaguagccuggcac

SEQ ID NO: 48889 - RNA, 45 nt, Mus musculus
agaagaguuuauuugaauuauacuucuacauuguaguucaucauu

SEQ ID NO: 48890 - RNA, 46 nt, Mus musculus
gucacuggaaacgcagcaguaagugugcuggauaggaaccccgggg

SEQ ID NO: 48891 - RNA, 41 nt, Mus musculus
ggcuauacccaaggcccaaucuuagagcaauggggcaagga

SEQ ID NO: 48892 - RNA, 45 nt, Mus musculus
cacugaccagugcccaugacaagccuuccuuccacccgcugucgg

SEQ ID NO: 48893 - RNA, 44 nt, Mus musculus
uuagcuggacaccugccccagaucuggaggaaaugacggcagga

SEQ ID NO: 48894 - RNA, 46 nt, Mus musculus
aagcuaucugaagaagcuguguggcacuguccuggguggacccaaa

SEQ ID NO: 48895 - RNA, 45 nt, Mus musculus
gagcccuggucucuaaucuguccaauggucgggcaguuggaccau

SEQ ID NO: 48896 - RNA, 60 nt, Mus musculus
ggggcaguggaagccauuucugaccgaaccugcauucacaccaauggccgagucaacgug

SEQ ID NO: 48897 - RNA, 41 nt, Mus musculus
aucccucuggagcauggagcuucuggacaaaaaaaggccug

SEQ ID NO: 48898 - RNA, 46 nt, Mus musculus
ccugcgagcaccaugucaauggcucccgucccccaugcacuggaga

SEQ ID NO: 48899 - RNA, 42 nt, Mus musculus
aggaggaagaagccaaagacauugaguguuaagaguccagag

SEQ ID NO: 48900 - RNA, 46 nt, Mus musculus
guacacuuccuacagcgugucuaacagugugaaggagaucauggca

SEQ ID NO: 48901 - RNA, 46 nt, Mus musculus
ggugccuucacuguguuuucugacuucuugacuuacaaaucaggua

SEQ ID NO: 48902 - RNA, 44 nt, Mus musculus
guuaccagggaauggcaccauauggaaggauuagaaguggcaga

SEQ ID NO: 48903 - RNA, 86 nt, Mus musculus
gccauccgcauccugggcuggggaguagagaauggaguucccuacuggcuggcagccaacucuuggaaccuugacuggggugauaa

SEQ ID NO: 48904 - RNA, 54 nt, Mus musculus
acuguggcauugaaucagaaauuguggcuggaaucccacgcacugaccaguacu

SEQ ID NO: 48905 - RNA, 46 nt, Mus musculus
caaagcagauuagaaucuuccccaguacuggucagugcgugggauu

SEQ ID NO: 48906 - RNA, 137 nt, Mus musculus
acuucauuguccaguccuuaggggcuuuuuccaaaauuuagcggcccuggcagggaaugagguagacaggggagucuuugauucuuugaguucaucuaacaugcaugaagcuuuuggcaagauuuggacgacuggac

SEQ ID NO: 48907 - RNA, 89 nt, Mus musculus
acugugaucacugucgugggaugggcuaggaggaggccagguaaggacaguguuuggaggguagcucugauggcaggcagcucuggucc

SEQ ID NO: 48908 - RNA, 116 nt, Mus musculus
agugcgguuuguagugccugcuguuguggcucugccugccauaccucccacccccauccccaucccagcauccgaggacccaagggcuuugacugcaggacuuccaaaagaacgaa

SEQ ID NO: 48909 - RNA, 47 nt, Mus musculus
agcugcaucuugaagcuggucacuucugggucuguggcaggcauucg

SEQ ID NO: 48910 - RNA, 46 nt, Mus musculus
cgaugcuuuuucaauaggauuuuuaugcuuuguguaccucaaccaa

SEQ ID NO: 48911 - RNA, 72 nt, Mus musculus
aaaaacuugcuuuuuguuguaguuaccacuuaacccuguaguuuaacaaggaaugucugugccaauaaacca

SEQ ID NO: 48912 - RNA, 98 nt, Mus musculus
ucuucacuggcuaugcgagguagggagggaguugcaggugggcauguggugaggcaagaaaggaaguguaggagggaacuauuggguguaguugagac

SEQ ID NO: 48913 - RNA, 41 nt, Mus musculus
aaggucuauuguagaccagucuggccucaaacucccagaga

SEQ ID NO: 48914 - RNA, 62 nt, Mus musculus
uguucuuugugugguccucaaaccugagccaguaugagugccaggccuuugaauagucguuu

SEQ ID NO: 48915 - RNA, 48 nt, Mus musculus
uuagguaacaugccagaucaacuuggucagaagucuuguuccagaucc

SEQ ID NO: 48916 - RNA, 64 nt, Mus musculus
uaauaauuaugucuggauaugggugggccucugagaaagcacacagaugguguaaauuauauug

SEQ ID NO: 48917 - RNA, 47 nt, Mus musculus
ggauuuauuuaauuugaaacagccuuugaauaccuaugacaauagaa

SEQ ID NO: 48918 - RNA, 48 nt, Mus musculus
agcuggauuuugacuucccuuguuuuuccuccuacucuaaaaucuuug

SEQ ID NO: 48919 - RNA, 49 nt, Mus musculus
cacagaagacuauguccagagagaacacugauuuuguuuagccggaagu

SEQ ID NO: 48920 - RNA, 47 nt, Mus musculus
gucaucuccaagaucaggacacagaaccuucccaacugccagcucau

SEQ ID NO: 48921 - RNA, 46 nt, Mus musculus
uuacauguauaucuguguacuaugugugagcagugccuguagagac

SEQ ID NO: 48922 - RNA, 46 nt, Mus musculus
accaguuuguuuuaaaucgcaaucugcccgucccccacccccaagu

SEQ ID NO: 48923 - RNA, 33 nt, Mus musculus
gccgucaaagcuaucauauaccaguacauagaa

SEQ ID NO: 48924 - RNA, 46 nt, Mus musculus
gcugccuguuacaauaaccagcagguauucaaaggaguagugaaga

SEQ ID NO: 48925 - RNA, 45 nt, Mus musculus
aaguuggaagacuuugcuaagccagagaacguagauguggccgug

SEQ ID NO: 48926 - RNA, 42 nt, Mus musculus
ccucacaccaagauuggaggcuuuugaagaccuaaaggaguu

SEQ ID NO: 48927 - RNA, 76 nt, Mus musculus
cagaaggggugcuagguagaaaaaacuacagauauccauuauauaagaagacgauuuaauaauuaaaccaugagcg

SEQ ID NO: 48928 - RNA, 43 nt, Mus musculus
uuggccucaggagguaacugauaaugggguacuuggggaaaaa

SEQ ID NO: 48929 - RNA, 71 nt, Mus musculus
ucaaugggucuguuccugcagaaaacaaauaucauucgugauuaucuggaagaccaacaggaaggaaggaa

SEQ ID NO: 48930 - RNA, 46 nt, Mus musculus
uguagaguaugacaggaguaaagugaagugggaucugccuuuaaaa

SEQ ID NO: 48931 - RNA, 84 nt, Mus musculus
uggucucauuucagaucucccuggaguuuagaaauuuggcugagaaauaucaaacagugaucgaugacaucugccaccggaugg

SEQ ID NO: 48932 - RNA, 46 nt, Mus musculus
caguauccaguauggaaugaaagccugucucgagggggagggguua

SEQ ID NO: 48933 - RNA, 46 nt, Mus musculus
gauauauguaaacuugucuggaaaacaaacaaaaaagcucaaagga

SEQ ID NO: 48934 - RNA, 46 nt, Mus musculus
gcucagaaaccucgugcuugacccuugugucucuuuauuuaaagau

SEQ ID NO: 48935 - RNA, 31 nt, Mus musculus
aaauaugcuuguccauucuggguagauagag

SEQ ID NO: 48936 - RNA, 41 nt, Mus musculus
gcuacacacagagcugcaguaggaggggaaggggacuaagu

SEQ ID NO: 48937 - RNA, 41 nt, Mus musculus
uugaccgagaguuuggaaguagugaaccgucccgggggaga

SEQ ID NO: 48938 - RNA, 46 nt, Mus musculus
cccagcaagguuugagaaagaugggcuguuuccaacuugcugagau

SEQ ID NO: 48939 - RNA, 32 nt, Mus musculus
aggacauuuaucuugugcauaguguucuagag

SEQ ID NO: 48940 - RNA, 46 nt, Mus musculus
aagguagaucuccagaccggaucacaugggccuggugacuguagug

SEQ ID NO: 48941 - RNA, 42 nt, Mus musculus
ggggacauacgguuaguggagagccugacucggggaggaccg

SEQ ID NO: 48942 - RNA, 45 nt, Mus musculus
ucagcagcagcuugaagaccugcuacaaguaucucaaucagacca

SEQ ID NO: 48943 - RNA, 46 nt, Mus musculus
cugucccaugacgaaaaccacaacagaacaagacaguaacugagaa

SEQ ID NO: 48944 - RNA, 46 nt, Mus musculus
aacuaucacugacaaauucuguccuaacaucagucuaaguccaguc

SEQ ID NO: 48945 - RNA, 42 nt, Mus musculus
gaucccuccggcuuucucuuuauucugccucuugcccccccc

SEQ ID NO: 48946 - RNA, 46 nt, Mus musculus
acaaugaugaguaggugaagucucgggcaguaggguagugggagug

SEQ ID NO: 48947 - RNA, 45 nt, Mus musculus
uaaaggaucuuaaagaguaaggcugaaucaaaagggaguauuucu

SEQ ID NO: 48948 - RNA, 41 nt, Mus musculus
uuuauagaaaaggggcuggggcuggggcugggggaggaauu

SEQ ID NO: 48949 - RNA, 45 nt, Mus musculus
uaauauuuaaauaacaacaauaauaauaaaaaggaaaccgagaga

SEQ ID NO: 48950 - RNA, 45 nt, Mus musculus
gcuguccucuauaaaagaggacauuggcccgacgagacccuugga

SEQ ID NO: 48951 - RNA, 49 nt, Mus musculus
gcaggcccaaacuggcuuuugucaaacuuguguucuauugggagagaaa

SEQ ID NO: 48952 - RNA, 48 nt, Mus musculus
uaccaggggagccagguaugagggaggagagaaagccgccuuccugau

SEQ ID NO: 48953 - RNA, 48 nt, Mus musculus
uguagcuaaugaagggaugguuagagcagguuauagccagaaccgggg

SEQ ID NO: 48954 - RNA, 46 nt, Mus musculus
aacccugucucagaaaaauaaaaacaaaacagaaaugugugaagau

SEQ ID NO: 48955 - RNA, 45 nt, Mus musculus
ggcuauuauuuuaccccucaaguugggcauuuguugacuguugau

SEQ ID NO: 48956 - RNA, 41 nt, Mus musculus
aagaaggguguaggcagggauagcauuacagaucaggguaa

SEQ ID NO: 48957 - RNA, 45 nt, Mus musculus
ugcugggaaugguuguccugcaggccauuggaagagagggaggag

SEQ ID NO: 48958 - RNA, 45 nt, Mus musculus
gagcuccuccccuccccccaacucccagcucuggucccacuaacc

SEQ ID NO: 48959 - RNA, 46 nt, Mus musculus
ugcauucaugcacaugcugcauaugccccagcacacguguugagau

SEQ ID NO: 48960 - RNA, 46 nt, Mus musculus
uuauuuauuuauacugugugugugugugagugugugugugagagag

SEQ ID NO: 48961 - RNA, 25 nt, Mus musculus
ugggcuauuaaguuugauaaugugc

SEQ ID NO: 48962 - RNA, 42 nt, Mus musculus
uguucccaguagaucugcugaaacauauaaucuugggaagau

SEQ ID NO: 48963 - RNA, 46 nt, Mus musculus
uaaaauccuuucuuccuucaagagagaaaaauaucagggcacaguc

SEQ ID NO: 48964 - RNA, 48 nt, Mus musculus
ugcaccaccacugcccggccaacccuuacuuucuuauucauccccaag

SEQ ID NO: 48965 - RNA, 42 nt, Mus musculus
ccguaagccagcugugacguaagggcuggacacugucaagga

SEQ ID NO: 48966 - RNA, 34 nt, Mus musculus
uccccccccauacacacacacacacaccacaccu

SEQ ID NO: 48967 - RNA, 46 nt, Mus musculus
guucugccagcacugugguuacagauagagaaccauuucuagagau

SEQ ID NO: 48968 - RNA, 43 nt, Mus musculus
uaggccagcuuggcauuugaaauauaggcaaaccugucucaag

SEQ ID NO: 48969 - RNA, 46 nt, Mus musculus
cuggcaagcuggcuuccagcccggcagcuuucccugaaggucagag

SEQ ID NO: 48970 - RNA, 42 nt, Mus musculus
guaaaugagaaaauuuuuuaguugcugcauuuuggggggcag

SEQ ID NO: 48971 - RNA, 47 nt, Mus musculus
ccuuggauaccccauagaugguccuaggccuuugaauacagagaucg

SEQ ID NO: 48972 - RNA, 45 nt, Mus musculus
aggauaaaauguguuuuacaaagcuaauuaggugugauguuuuag

SEQ ID NO: 48973 - RNA, 44 nt, Mus musculus
gauggaguugcuuuccaugcaggugagaguuuuggaguugccca

SEQ ID NO: 48974 - RNA, 46 nt, Mus musculus
ugaguucaaggcuagucugggacagccaaagcuucauaguagacag

SEQ ID NO: 48975 - RNA, 70 nt, Mus musculus
ccuucaauucuuucuuuuaaagacuuauuaauuuauagugugugugugugugugugugugugugugugug

SEQ ID NO: 48976 - RNA, 46 nt, Mus musculus
uagcccuuauagcuauccuuccaucugcucaggggagggugcccaa

SEQ ID NO: 48977 - RNA, 46 nt, Mus musculus
cuacuuucccuugcauaucugaacaugguucauuucaagccgugca

SEQ ID NO: 48978 - RNA, 46 nt, Mus musculus
cuguccacgacucagagcgguacacaagucucaacaauugguccau

SEQ ID NO: 48979 - RNA, 44 nt, Mus musculus
uuuaaaaagcuucauuuuugauuacuuuuaguuauuuggacuga

SEQ ID NO: 48980 - RNA, 57 nt, Mus musculus
ccagcaaccacaucguggcucacaaccacccguaaugagaucugaugcccucuucag

SEQ ID NO: 48981 - RNA, 41 nt, Mus musculus
gcugugacgacugaaaauguugcuaggacgagcaagacaga

SEQ ID NO: 48982 - RNA, 71 nt, Mus musculus
cugagcaagcuucuuguuccuccuuuuuccaaaaaugcaguccaggucgguuucacuccgagaggacagau

SEQ ID NO: 48983 - RNA, 46 nt, Mus musculus
augaauggggugugugugugugugugugugugugugugugugugug

SEQ ID NO: 48984 - RNA, 45 nt, Mus musculus
gccuugccugccauuagcaaagucaagggcucuccaugugggugu

SEQ ID NO: 48985 - RNA, 42 nt, Mus musculus
gcucuuccccagcaaugagaagaggugacagugggcccagga

SEQ ID NO: 48986 - RNA, 46 nt, Mus musculus
ucaucugcugggcaugcuggguaaaaccugaacaaugggcagucua

SEQ ID NO: 48987 - RNA, 45 nt, Mus musculus
gcagcccagcaugggcagggugugugugugugugugugugugugu

SEQ ID NO: 48988 - RNA, 46 nt, Mus musculus
acgcaaggcugcuguaaaaaccacagaccuaaaaaagguaggagau

SEQ ID NO: 48989 - RNA, 46 nt, Mus musculus
ggacaguguucaacaaaugcaucggauaaaaauguacugccgagag

SEQ ID NO: 48990 - RNA, 42 nt, Mus musculus
gcggggagagcuguccagcaggagaggcucccucccucauca

SEQ ID NO: 48991 - RNA, 104 nt, Mus musculus
gccauucucuuggcaaaauauuccuggauggugaaggcacuagugguggucgugguuguggucagggagguguucaccucauccgcagaggaguugcugcagcc

SEQ ID NO: 48992 - RNA, 44 nt, Mus musculus
cuuucccuuuuuccuuucaacaggggucucugaaaggucagacc

SEQ ID NO: 48993 - RNA, 47 nt, Mus musculus
aggcugcagcucugcucggucucucuucuuggccacagggccccucu

SEQ ID NO: 48994 - RNA, 33 nt, Mus musculus
uccuucuggccuuugcagcuuuuucuuugcuuu

SEQ ID NO: 48995 - RNA, 43 nt, Mus musculus
ccugggggaaauguggaaauguggugcguagaagcagcaaccu

SEQ ID NO: 48996 - RNA, 46 nt, Mus musculus
cugccagagagcccuaaggaaggucaaagggauuggaaaggcaugg

SEQ ID NO: 48997 - RNA, 42 nt, Mus musculus
agauguguccaggucaccuugauaauggggacuugggggcag

SEQ ID NO: 48998 - RNA, 45 nt, Mus musculus
gcacucugagaaaaagggauuggccagcgguuuuguucuggcuaa

SEQ ID NO: 48999 - RNA, 46 nt, Mus musculus
uucagacuaagaaugacagccaagucgagggaccaccagacaggug

SEQ ID NO: 49000 - RNA, 42 nt, Mus musculus
cagaugaggguacagaacuugugccuggccaugaguagccug

SEQ ID NO: 49001 - RNA, 41 nt, Mus musculus
auggaccaugcuugucugguuuaucucaaaccauagggaaa

SEQ ID NO: 49002 - RNA, 46 nt, Mus musculus
cucccauguguguugguacacgugugugugugugugugugugugug

SEQ ID NO: 49003 - RNA, 46 nt, Mus musculus
gacuugacauuagaucauucagaagguuuucagcaugguggaagaa

SEQ ID NO: 49004 - RNA, 46 nt, Mus musculus
cauccauagggcaguauuaaugguaaaacugcuuaaaccaccagug

SEQ ID NO: 49005 - RNA, 41 nt, Mus musculus
cugaucugugccccuguguguccuuggcaucuuaccucaau

SEQ ID NO: 49006 - RNA, 42 nt, Mus musculus
ccuggagcucacaagaagauacauugaaucgugggaggagau

SEQ ID NO: 49007 - RNA, 42 nt, Mus musculus
gacuggcaaaggagaagcuggugacucuggagauggaaguag

SEQ ID NO: 49008 - RNA, 58 nt, Mus musculus
ugacauguacaugcauaaggugacuggacuuguguguaaacagagugauggagagcag

SEQ ID NO: 49009 - RNA, 42 nt, Mus musculus
cagcucugcccugcggcacgcccggccaggcuacacccggac

SEQ ID NO: 49010 - RNA, 45 nt, Mus musculus
aggugugcagcuaccgacagagagggguuugugcagaugcaaaua

SEQ ID NO: 49011 - RNA, 46 nt, Mus musculus
uuucaauuuauuacccuuaaacaaauaauaauaaccaaguacccau

SEQ ID NO: 49012 - RNA, 46 nt, Mus musculus
ccagaagcuacaggaaaaggaggcgcagcccacccccagcccccag

SEQ ID NO: 49013 - RNA, 41 nt, Mus musculus
ccagcucuacaaggaaauuuucucucccacuauugaacuua

SEQ ID NO: 49014 - RNA, 46 nt, Mus musculus
gguuuauuuuuuuuuuuaaagaggaaauuacgaaaguuaggagggg

SEQ ID NO: 49015 - RNA, 46 nt, Mus musculus
ggaaggucagcgauuccguuagaggugggucgaagagacaggcaag

SEQ ID NO: 49016 - RNA, 44 nt, Mus musculus
gaagacacagccaagggacauauuguccugcugcaggaagccga

SEQ ID NO: 49017 - RNA, 45 nt, Mus musculus
cagcuaggaucugccagugugacuuccucguacugcugaccccaa

SEQ ID NO: 49018 - RNA, 42 nt, Mus musculus
caaauuagaaggcaaaccuaucucgcuguucuguggcccguu

SEQ ID NO: 49019 - RNA, 41 nt, Mus musculus
guaggggaugaaggggucaggcuuccagauaaggucaggca

SEQ ID NO: 49020 - RNA, 46 nt, Mus musculus
aggagauggccuuggcccuccuggaauguuuccugaacaguaagag

SEQ ID NO: 49021 - RNA, 41 nt, Mus musculus
uguuuugaccuuuuacuggacacugucuggauuuggcccug

SEQ ID NO: 49022 - RNA, 45 nt, Mus musculus
acuguauucuguuuguuuuuaaaaugugucuguaggaugcaggag

SEQ ID NO: 49023 - RNA, 46 nt, Mus musculus
cauccuuaacgucuuggucuuucugcucagccucccccaugcugag

SEQ ID NO: 49024 - RNA, 45 nt, Mus musculus
cgcacgcgcgcacacacacacacacacacacacacacacacccug

SEQ ID NO: 49025 - RNA, 45 nt, Mus musculus
aucuccuggaccuguugguugugagcugccacgugggugcuggga

SEQ ID NO: 49026 - RNA, 46 nt, Mus musculus
ucuguucccccagcuucuacaacaagauagagugaaagagcagcag

SEQ ID NO: 49027 - RNA, 45 nt, Mus musculus
cacagccgucagaugcagcucugugcacuugcagacgugugcuga

SEQ ID NO: 49028 - RNA, 46 nt, Mus musculus
gauucuggaccaucgaguuuguuuuacuguucugucagguucaguu

SEQ ID NO: 49029 - RNA, 42 nt, Mus musculus
uuaagaaagcaugacaaagccuggcacaggccuuaaccccau

SEQ ID NO: 49030 - RNA, 41 nt, Mus musculus
ucucuauggcccgaacagcauucugguuaugaauuggggaa

SEQ ID NO: 49031 - RNA, 42 nt, Mus musculus
gcucacggucuucuagggugaaaagcauguagagagcuguag

SEQ ID NO: 49032 - RNA, 45 nt, Mus musculus
gagcagcacagcugggccgaggacaaggugaccguccggcugcug

SEQ ID NO: 49033 - RNA, 46 nt, Mus musculus
ccccaaacugaucauggcuuugagacugauccugacccuuuccugu

SEQ ID NO: 49034 - RNA, 49 nt, Mus musculus
ugacucugaucaguucaagcgggaggaagacuuuuacuacacagagaug

SEQ ID NO: 49035 - RNA, 79 nt, Mus musculus
ucauugccuccagccaagguccagucaucuggcccagaacacccuggccuggagucuucucugcccucaguugcacuca

SEQ ID NO: 49036 - RNA, 59 nt, Mus musculus
gcaagucagcuccuggcucuuucuggcacauucaggcugaccaugcauaucagguaugg

SEQ ID NO: 49037 - RNA, 50 nt, Mus musculus
uuccccccacaucuauaccagcaucagcugggcugcugccccuaccacca

SEQ ID NO: 49038 - RNA, 45 nt, Mus musculus
uguccgucuccacccccauacuuaaugaagaucacugugugucuu

SEQ ID NO: 49039 - RNA, 81 nt, Mus musculus
uccgaagccgcucucucagcuucagcgagccccagcagccgccaccuacagugaagucucaccugauugucaccuccccac

SEQ ID NO: 49040 - RNA, 68 nt, Mus musculus
cggcaucgagcaccgggaccaguggugcacagccugccgguggaagaaggccugccagcgcuuccugg

SEQ ID NO: 49041 - RNA, 132 nt, Mus musculus
acugagccugccucacuagccccgcuucucacccugccuggcagccgggaagccuccaggccugcagccaucagcagaacacagggagaugauguggcguggaugugggcagcuggggcuccauuggcuaag

SEQ ID NO: 49042 - RNA, 98 nt, Mus musculus
aaaugaaacuauuuuuccccuuaaaauaggagagagccaaaauugaccaaggguauucugcagcgaaccggagaccaaagaguuaccccuaccccuac

SEQ ID NO: 49043 - RNA, 46 nt, Mus musculus
cagguucugacuuuaccuggggcaaaaacaaaccacaaaaagggag

SEQ ID NO: 49044 - RNA, 46 nt, Mus musculus
uuaggugauguccaucagaagcugccauccuugggguuuuuuugag

SEQ ID NO: 49045 - RNA, 41 nt, Mus musculus
agagccggaggcccuggucaggaccaggccaugcucagaag

SEQ ID NO: 49046 - RNA, 45 nt, Mus musculus
cucaguggcugugccgugucuugaaaugugcuguguuuggagaaa

SEQ ID NO: 49047 - RNA, 46 nt, Mus musculus
ugaaggcugcaggugacccauuuuggcucagacgcugugaccagag

SEQ ID NO: 49048 - RNA, 57 nt, Mus musculus
ugccgcucacuacucugaccccugugacagaggccaaacccaccucuuuaugugccc

SEQ ID NO: 49049 - RNA, 48 nt, Mus musculus
augaccacccagucuaccuucuugcagcauccucccugacagaagauu

SEQ ID NO: 49050 - RNA, 52 nt, Mus musculus
ggggucggcacaagaaauuauuaccgaaagauuggcuacagauuacaaggcc

SEQ ID NO: 49051 - RNA, 44 nt, Mus musculus
ugucuuaacugcaugaaucaggauacauaaaugcagggggaaga

SEQ ID NO: 49052 - RNA, 46 nt, Mus musculus
ugcuuucuccuggcugacuaacacaaggaaaguuaccgugacagag

SEQ ID NO: 49053 - RNA, 41 nt, Mus musculus
agcuguacaagcuugauagaucacacagugauggugagaga

SEQ ID NO: 49054 - RNA, 46 nt, Mus musculus
cauguuacuguuucaguuugccaagcuaauugcuaugcgcuaagau

SEQ ID NO: 49055 - RNA, 45 nt, Mus musculus
gcguccccaugcuaauaaccagcacaucuaaaugguuggagaagg

SEQ ID NO: 49056 - RNA, 45 nt, Mus musculus
aaaugaagacuagaagaugcauguaagcccgaguguuuuagaacu

SEQ ID NO: 49057 - RNA, 46 nt, Mus musculus
ugcaggagaaagaugaauacaaacuaauauaaaaugaggcagacac

SEQ ID NO: 49058 - RNA, 69 nt, Mus musculus
cugggaaaauggcaguuauaucaggugacuggagagauggguuucugacucaucuguucacacugagau

SEQ ID NO: 49059 - RNA, 61 nt, Mus musculus
uagggguucggcaugcugcugauggaagaggcagagagaaucgcucgggaagagcauggau

SEQ ID NO: 49060 - RNA, 35 nt, Mus musculus
gugaugugagaaccagggagguuggaauccaagaa

SEQ ID NO: 49061 - RNA, 46 nt, Mus musculus
uuuuaaaguuuucauuuuucuauuucaguguaaguuauguacagac

SEQ ID NO: 49062 - RNA, 46 nt, Mus musculus
guaaugcuaagugucaggcuguaugggauggacaccgggcugagua

SEQ ID NO: 49063 - RNA, 45 nt, Mus musculus
gcauggcaaccugcgcgagcuggcauuugcaagaaugaaggaucu

SEQ ID NO: 49064 - RNA, 46 nt, Mus musculus
aaggucaaccuauuagggaccuggcucaaguucugaacauccagag

SEQ ID NO: 49065 - RNA, 46 nt, Mus musculus
acuggaugauaaaacuuuaaaugaaaauguaaaugagcgacauaaa

SEQ ID NO: 49066 - RNA, 46 nt, Mus musculus
auuucccacaggcacucccagaggccugucucccagugcugcuagu

SEQ ID NO: 49067 - RNA, 46 nt, Mus musculus
gcaguagaauugcuuacaucaaggaagugaaguggagccgguaaca

SEQ ID NO: 49068 - RNA, 42 nt, Mus musculus
gguuuaaagcacuuauauccagcauuaucuucauggaaacaa

SEQ ID NO: 49069 - RNA, 45 nt, Mus musculus
gauagcaaacauuuugaacucuguuuuuaaauuagaaguagaaua

SEQ ID NO: 49070 - RNA, 46 nt, Mus musculus
uggaaaucaggaagguacaggagcuauucucccagugaccugauug

SEQ ID NO: 49071 - RNA, 41 nt, Mus musculus
gcagccauugggaguguaagauagaagaggucugugccaga

SEQ ID NO: 49072 - RNA, 46 nt, Mus musculus
caugauuuaaaauuuccauagcuagagcacugcuggcuggcuagau

SEQ ID NO: 49073 - RNA, 45 nt, Mus musculus
gaaaguguuguuugcuaccugcugggaagcaagggcuggagagaa

SEQ ID NO: 49074 - RNA, 49 nt, Mus musculus
agcggcaccuaagugacauguugacuuauggcugcacaaggcuggagau

SEQ ID NO: 49075 - RNA, 43 nt, Mus musculus
ucuuuuuuucuuuuaauuuuagaaaguucucugaaguccagua

SEQ ID NO: 49076 - RNA, 46 nt, Mus musculus
agaaauaccaguugagaacacgcacaguuugugguacauguuagau

SEQ ID NO: 49077 - RNA, 45 nt, Mus musculus
aucucuuaucucugugcccucauuuaauuguugguuuggcuugaa

SEQ ID NO: 49078 - RNA, 42 nt, Mus musculus
gagauguauccgauuuuauugagguauuguccagguguggug

SEQ ID NO: 49079 - RNA, 46 nt, Mus musculus
uuccucacaguuuuggaggguccaggcuauauuuuuagaaugugau

SEQ ID NO: 49080 - RNA, 92 nt, Mus musculus
caguucaccuucaguuuugguuuuguugucuuuguuuaguuaguagagacuuguuuuauggccaguguaagugcucuugaugaguaugauau

SEQ ID NO: 49081 - RNA, 52 nt, Mus musculus
gugaguuuuuguuugauaucuuagugauuucugauuuuauuucauuuuguuc

SEQ ID NO: 49082 - RNA, 45 nt, Mus musculus
uuuaaguuauuaucauaucauauuuuaauuauucagugucaaguu

SEQ ID NO: 49083 - RNA, 56 nt, Mus musculus
uagagucucacuauuuagaccagccuggccuugaacucagagaacaaccugcccag

SEQ ID NO: 49084 - RNA, 45 nt, Mus musculus
cuauucuucucugauuacuuaaguuguaaaaccuuggccaccauu

SEQ ID NO: 49085 - RNA, 42 nt, Mus musculus
gaccugagucacccauucaccagagugcgacuguugccagau

SEQ ID NO: 49086 - RNA, 46 nt, Mus musculus
cacguucagagccugaacuuugcuguaaugcuagaaauugcuaggu

SEQ ID NO: 49087 - RNA, 46 nt, Mus musculus
agaugguguacccuaucaaggagcugaauucaugugaaaugcagaa

SEQ ID NO: 49088 - RNA, 28 nt, Mus musculus
ggcauguaggaaugcuguaggagaagua

SEQ ID NO: 49089 - RNA, 45 nt, Mus musculus
auaagguggaguucaucgugauggguggaacguucauggcccuuc

SEQ ID NO: 49090 - RNA, 46 nt, Mus musculus
aguauucuacauauuuaagauguguauuagucagacuucucuagag

SEQ ID NO: 49091 - RNA, 46 nt, Mus musculus
agugagagcaggggauuuacagcgguaugagcagcugauuggagau

SEQ ID NO: 49092 - RNA, 46 nt, Mus musculus
acugccccggaggaccugacuccgauuuugaguauucaacccaguc

SEQ ID NO: 49093 - RNA, 46 nt, Mus musculus
gccugguggauaucaucgcugcagucccuccucacuaucgaaagau

SEQ ID NO: 49094 - RNA, 46 nt, Mus musculus
aguaaugaggcugagaagggguaggggcagaguuguucucuaggau

SEQ ID NO: 49095 - RNA, 46 nt, Mus musculus
cgcacacacgcaugcaugcacacacacacacacucacccaaauaga

SEQ ID NO: 49096 - RNA, 41 nt, Mus musculus
ucuuuccuccaugaaauacuucuuacugguuugcccaagua

SEQ ID NO: 49097 - RNA, 41 nt, Mus musculus
cgcgguaacgugguggcauauugcuacgccagcgcagagau

SEQ ID NO: 49098 - RNA, 42 nt, Mus musculus
cuguuuuuguuuuguuuguagcaaggucucccuguugcccag

SEQ ID NO: 49099 - RNA, 41 nt, Mus musculus
gauaguaugaccgugaguaaagucauuguaucucugggcuu

SEQ ID NO: 49100 - RNA, 41 nt, Mus musculus
aaucuaauagcacaguccggacuuucugucuacucacugau

SEQ ID NO: 49101 - RNA, 46 nt, Mus musculus
ugaauggguauaaaauuguuucguguggaguugaaauagcuguuag

SEQ ID NO: 49102 - RNA, 44 nt, Mus musculus
gcgggcuucaaaaauaaagaacacaugagguuagugguggugga

SEQ ID NO: 49103 - RNA, 46 nt, Mus musculus
guucugagguuuaauuguauuuugauaaguuccuaaucccccauac

SEQ ID NO: 49104 - RNA, 46 nt, Mus musculus
cuuuuccagcagcuguaauucucagaguugcuuugcacauggccag

SEQ ID NO: 49105 - RNA, 47 nt, Mus musculus
uccuacucaaaacgcgaagcuugagauaccgccggcgcgagggugag

SEQ ID NO: 49106 - RNA, 46 nt, Mus musculus
guacuaacauuccagcccuccgauugcucuccgcggcaccccaggc

SEQ ID NO: 49107 - RNA, 45 nt, Mus musculus
agaaacccugucucgaaaaaugcaagagagagagagagagagaga

SEQ ID NO: 49108 - RNA, 46 nt, Mus musculus
auacuuaaggauauuucaaacaaagucuaaaaggaaaggaaagauc

SEQ ID NO: 49109 - RNA, 45 nt, Mus musculus
aucuugcuaguguaugcaauggugucagcauuuggaagccuacug

SEQ ID NO: 49110 - RNA, 42 nt, Mus musculus
gaccuugaaugcuauuggccuucacaaggugggcacagucca

SEQ ID NO: 49111 - RNA, 77 nt, Mus musculus
cauccaugucagcuguuuucuucagguuagaccauggcguguaaaccacauuaacguuguucaucuugcagccugcc

SEQ ID NO: 49112 - RNA, 45 nt, Mus musculus
caccuaagagggcaaggcuuuggcuuuccagggcuuuagccaccc

SEQ ID NO: 49113 - RNA, 45 nt, Mus musculus
cauuccucucuucacggucucugccuuccuucucugcugcaaggu

SEQ ID NO: 49114 - RNA, 46 nt, Mus musculus
aagcguaugaagcuuagauucugugugaugauccccaccuggguga

SEQ ID NO: 49115 - RNA, 46 nt, Mus musculus
cagcgcgcgcccucagccuccucgcgcagcaaggucuccaccaggu

SEQ ID NO: 49116 - RNA, 46 nt, Mus musculus
ggcgucggccuggcaagcacagcacagcagcuccuuguccuccagg

SEQ ID NO: 49117 - RNA, 26 nt, Mus musculus
cuauaagacauccccucugauuggua

SEQ ID NO: 49118 - RNA, 45 nt, Mus musculus
ucguucucuccaguaaguacauuagaggccacuccagggaaggga

SEQ ID NO: 49119 - RNA, 46 nt, Mus musculus
ccacaagccagugugcuccaagugcuguucagcauagccccaaccu

SEQ ID NO: 49120 - RNA, 42 nt, Mus musculus
ucucuuccuucauggcauccaagguggccuguuccuccaccc

SEQ ID NO: 49121 - RNA, 41 nt, Mus musculus
gcaaugcagcaaaugccaaggucuaagcgccuucccacaga

SEQ ID NO: 49122 - RNA, 48 nt, Mus musculus
cuaguaccucaggauauaaccuuauuuagaaauagauuagagauaggc

SEQ ID NO: 49123 - RNA, 42 nt, Mus musculus
gcuguguugggauccaagcugaagggcacuggggacagagag

SEQ ID NO: 49124 - RNA, 46 nt, Mus musculus
aacacaacacaacacaauacaacacaacaguuuuaaaccugaagau

SEQ ID NO: 49125 - RNA, 45 nt, Mus musculus
augggaagaaaacuguacacacugaacgcauagcccgcuuagaga

SEQ ID NO: 49126 - RNA, 46 nt, Mus musculus
cuuuggggauucuagaauguugggacuucucaguguguguguugug

SEQ ID NO: 49127 - RNA, 46 nt, Mus musculus
ccacacggagcugcauccaacaugcagacaugcgccaccaagcaga

SEQ ID NO: 49128 - RNA, 45 nt, Mus musculus
cgcucacucguuucuugucucuucuuucuucucuaggugcucaga

SEQ ID NO: 49129 - RNA, 46 nt, Mus musculus
uggugaacaucgcguggcugguggucaggaacugugagguggagaa

SEQ ID NO: 49130 - RNA, 46 nt, Mus musculus
uaggaguuucucaagccaaaggauggagauaaagauacuagaagau

SEQ ID NO: 49131 - RNA, 46 nt, Mus musculus
agcuuaaccagcugcugggugagucugggaugauuagagcuuugau

SEQ ID NO: 49132 - RNA, 44 nt, Mus musculus
agauauccacuaagcaccaugagucagaauaccgagaugggggc

SEQ ID NO: 49133 - RNA, 42 nt, Mus musculus
gagaaacccugucucgaaagacccuccaaaaaauggccaugg

SEQ ID NO: 49134 - RNA, 46 nt, Mus musculus
ccugggaugaaagggaccaaggucaaggcuguguuuggagaugaau

SEQ ID NO: 49135 - RNA, 42 nt, Mus musculus
caucugggacccugacagugugaagaccaucucugccaagac

SEQ ID NO: 49136 - RNA, 46 nt, Mus musculus
ugaccagcaccaacgcagccaaagucuucaaccuuuacccccggaa

SEQ ID NO: 49137 - RNA, 42 nt, Mus musculus
cuucaccuugauucccgagggcaccaacggcacugaggagcg

SEQ ID NO: 49138 - RNA, 46 nt, Mus musculus
cucuggaagauucuggcacugcucucugauaccuuggcucugugac

SEQ ID NO: 49139 - RNA, 42 nt, Mus musculus
ugaguguguguggaggaggaugguauauggagagugcccugu

SEQ ID NO: 49140 - RNA, 45 nt, Mus musculus
ccugacugagaaggguuuggccuugagggcuguguguuuugagaa

SEQ ID NO: 49141 - RNA, 41 nt, Mus musculus
uagcaaaggucagggaacccagcccuugucaggcagucugg

SEQ ID NO: 49142 - RNA, 72 nt, Mus musculus
caugggcugaccagaguccucacucugcaauggucgaaggaagggaggaaggaaggaaggaaggaaggaagg

SEQ ID NO: 49143 - RNA, 39 nt, Mus musculus
agcagccuucucuuuuguuuuccucugaagcucagagcu

SEQ ID NO: 49144 - RNA, 25 nt, Mus musculus
gcugaagucaucgcucaggcacgga

SEQ ID NO: 49145 - RNA, 45 nt, Mus musculus
acauaagauauaccuccauagcaaggcgguuuucccgguugugua

SEQ ID NO: 49146 - RNA, 42 nt, Mus musculus
cccacuuggcuucuuaauuagaggcacugcacaccccgcuuu

SEQ ID NO: 49147 - RNA, 73 nt, Mus musculus
uacaggaacagcagaggauccuggaucugggcaucacgggccccgagggacacguguugagccggccagagga

SEQ ID NO: 49148 - RNA, 46 nt, Mus musculus
gcgugauccgggauaucggugccauagcucaaguccacgcagagaa

SEQ ID NO: 49149 - RNA, 46 nt, Mus musculus
uaaccucuaaucaggauacuguguggccuagugguagugcugagag

SEQ ID NO: 49150 - RNA, 46 nt, Mus musculus
cguguacauggcuuucaaagaucgauuccagcugacggauucccag

SEQ ID NO: 49151 - RNA, 46 nt, Mus musculus
aagaggaggagaaggaggaggaagagggagaagaagaggaagaaga

SEQ ID NO: 49152 - RNA, 89 nt, Mus musculus
cagccacgaggcagggaugggagcuggagaagcagcaaaggccagaguguuagagaaagcucaguuugaaaggggaagaaagaggagga

SEQ ID NO: 49153 - RNA, 47 nt, Mus musculus
caauggcagguauguugccuggaggagggagggagaaagaccagaga

SEQ ID NO: 49154 - RNA, 58 nt, Mus musculus
cagcuugucauagacuaacugugaccuugggcaauucaugucaacuuugaauucuaau

SEQ ID NO: 49155 - RNA, 45 nt, Mus musculus
acuuguggggaaguuuuacuaacuuuuuguucuuagagguucaga

SEQ ID NO: 49156 - RNA, 92 nt, Mus musculus
acuccuauccacaggagucuuuggggguugggcuuagggaguggagcugaaggacaugguuuuccugggcccccuucaguuuagcuauggau

SEQ ID NO: 49157 - RNA, 31 nt, Mus musculus
uucaaagaaucccaggaauugugggggaagg

SEQ ID NO: 49158 - RNA, 51 nt, Mus musculus
gggguugucuuuggaguuuugaggcaaacacgucacacagaucuggaagaa

SEQ ID NO: 49159 - RNA, 45 nt, Mus musculus
ggggcccuaccccagcacggggagcauaaacaagacagcguggcu

SEQ ID NO: 49160 - RNA, 48 nt, Mus musculus
gcacguggacaucacugaguggcacaagggcauccaggaggagaugga

SEQ ID NO: 49161 - RNA, 51 nt, Mus musculus
gacgagccuauuggcugccuuugaucaguggagggagugggcugacagcaa

SEQ ID NO: 49162 - RNA, 26 nt, Mus musculus
cucauguccucaaggaagcugggcaa

SEQ ID NO: 49163 - RNA, 45 nt, Mus musculus
uugcauagacaggucuuuaugccugugccuaggaagaccccagug

SEQ ID NO: 49164 - RNA, 42 nt, Mus musculus
ucauagcagccuuuuggguugcaugggaaagcugacccuguu

SEQ ID NO: 49165 - RNA, 46 nt, Mus musculus
ugauuugggggagacugguggugguaauugaguagaugugcuagua

SEQ ID NO: 49166 - RNA, 46 nt, Mus musculus
gccaagcuccuccuaucaucaauaccugcaugcugagaaugcauau

SEQ ID NO: 49167 - RNA, 45 nt, Mus musculus
uugauuucauucuaugggcuaccauuuuuuucccuucccccuagu

SEQ ID NO: 49168 - RNA, 40 nt, Mus musculus
caaacaugcauguaugcauacauacaauacuaacaaagca

SEQ ID NO: 49169 - RNA, 52 nt, Mus musculus
uugcugcguucaguguccucuugagagacgaugcggcuuguuggucccuaag

SEQ ID NO: 49170 - RNA, 46 nt, Mus musculus
caagaagaagaguaccucaaagcagcucuguuuccuacugacagga

SEQ ID NO: 49171 - RNA, 45 nt, Mus musculus
ccauugugugaugaacaggccccucacaggccugaguggguggga

SEQ ID NO: 49172 - RNA, 46 nt, Mus musculus
augugaacugacagcgaucagauuagugguugcuuugggcugauga

SEQ ID NO: 49173 - RNA, 46 nt, Mus musculus
aagccagcaaagcuguuaguccuggagagggucauucugggcagac

SEQ ID NO: 49174 - RNA, 45 nt, Mus musculus
gugccugagagcuuacagcugauccacaaccaugaggcagugaga

SEQ ID NO: 49175 - RNA, 46 nt, Mus musculus
gcuuugcauaaguaaauguguguguuacuguuagucucugcuaagg

SEQ ID NO: 49176 - RNA, 46 nt, Mus musculus
guauuauugugagcgcauacuuuauuuaugugugauggggugcuga

SEQ ID NO: 49177 - RNA, 45 nt, Mus musculus
ucaccuacugccugaaugugugcugagacacaguauuugauaaga

SEQ ID NO: 49178 - RNA, 44 nt, Mus musculus
cuuuaaagagcccccuagcuuccuggauacacauugagccagaa

SEQ ID NO: 49179 - RNA, 41 nt, Mus musculus
ucagcaguagaacuugcauauuugagguccugaguuugaau

SEQ ID NO: 49180 - RNA, 42 nt, Mus musculus
gagggcacaacagcuggcucugucuuuugguauggcauguga

SEQ ID NO: 49181 - RNA, 60 nt, Mus musculus
cugugacacuagaaucuucccuugggugaacggagcagagguuugaucuacccaauaagg

SEQ ID NO: 49182 - RNA, 45 nt, Mus musculus
gugaaugaugaccaguccuucuaugcagacauauacauggaagau

SEQ ID NO: 49183 - RNA, 41 nt, Mus musculus
aggguagagguagauugcuguucaggggaggguuacaugcu

SEQ ID NO: 49184 - RNA, 80 nt, Mus musculus
gauguucaaaccaaggaggaaguggauauagcacccuaacacacccucuacaagucucugagaggcacagucaggcacca

SEQ ID NO: 49185 - RNA, 45 nt, Mus musculus
ugccaggcuuucuaaaggcuucuucuaggcacgcauucugcaaag

SEQ ID NO: 49186 - RNA, 45 nt, Mus musculus
gaugacaagagucagcaccacgcaguuacaacaaccagcccucgg

SEQ ID NO: 49187 - RNA, 24 nt, Mus musculus
aucagugugggggaaugucuggag

SEQ ID NO: 49188 - RNA, 45 nt, Mus musculus
gcccacuccccaccuuuuugcagcugaugaaggugauacgugagg

SEQ ID NO: 49189 - RNA, 46 nt, Mus musculus
cuuuagggauccacccucugugcgucgcucaaauguguuuucuuag

SEQ ID NO: 49190 - RNA, 24 nt, Mus musculus
cucuagccugacuccacguggcau

SEQ ID NO: 49191 - RNA, 44 nt, Mus musculus
uuuaaguuuauugaaaacuggcucagauguuuauaagucaagag

SEQ ID NO: 49192 - RNA, 42 nt, Mus musculus
uuggggcauuuuacuaaccuuguucccuuuuuggccuguaag

SEQ ID NO: 49193 - RNA, 71 nt, Mus musculus
gaaaagccccuggaaauucguguggccugugaagugguguauuguaguuugaauuugagaccuauuguaag

SEQ ID NO: 49194 - RNA, 46 nt, Mus musculus
caguagucuuccccuuuaguuacgaggcccucagcaaggcacacac

SEQ ID NO: 49195 - RNA, 45 nt, Mus musculus
agaguuuuccagacaugauagcccaagucuauuaucccagcaguu

SEQ ID NO: 49196 - RNA, 49 nt, Mus musculus
agggaguuagucccaggagagcuugcugggcacacagagaaacuugaca

SEQ ID NO: 49197 - RNA, 48 nt, Mus musculus
ucacacuuuaacagugugguguuuuuaguccaguuaagggaaaugggg

SEQ ID NO: 49198 - RNA, 90 nt, Mus musculus
ugauguuagaaaguuaagaacaguugacugaggcugucucuucuuuaugugcaccugagaggaauagguuuguccagagaaagaagugag

SEQ ID NO: 49199 - RNA, 77 nt, Mus musculus
ccuuuuaaaauugaagaaacaauugaaaaauuagucaccagggauuaggaaaaucauaucucaugaguaagaaaguu

SEQ ID NO: 49200 - RNA, 46 nt, Mus musculus
ggaauaccaguuuccuuugugauacgcuuuauuggauagagaagau

SEQ ID NO: 49201 - RNA, 25 nt, Mus musculus
ugcauaccagcagggaccacagcuc

SEQ ID NO: 49202 - RNA, 46 nt, Mus musculus
ucucuauggaagguuagcuguccuggaacaccuguguagaccagau

SEQ ID NO: 49203 - RNA, 47 nt, Mus musculus
gaauauugagggaugucuaaaaagcagcagcauggguaggacuggag

SEQ ID NO: 49204 - RNA, 46 nt, Mus musculus
ccauucauuaugauuauuauggugaggacuaaaaauacagaaagau

SEQ ID NO: 49205 - RNA, 48 nt, Mus musculus
ggcgguuacagccaugucugugacuguggcucgcaguaagcagugcac

SEQ ID NO: 49206 - RNA, 49 nt, Mus musculus
uuuacccuucacaguaacaggcuggcacacagaaaacacucaguaaaug

SEQ ID NO: 49207 - RNA, 45 nt, Mus musculus
gcuaggccaggcaugauuguacacaccuuuaaucucagagcguga

SEQ ID NO: 49208 - RNA, 45 nt, Mus musculus
caauggagacauggagaagauccuccuggaugcacagcaugaguc

SEQ ID NO: 49209 - RNA, 46 nt, Mus musculus
gguggagcuacccaugaacagcagcaauggcaaugagaauggaaau

SEQ ID NO: 49210 - RNA, 46 nt, Mus musculus
gugccugacuguugguuacuuuccuaaaguacaguauugugcagag

SEQ ID NO: 49211 - RNA, 45 nt, Mus musculus
cccugcugaccuguuagauuacauuuugaagguuuugggggagau

SEQ ID NO: 49212 - RNA, 27 nt, Mus musculus
uacaaacuccuuaguauauaagugagc

SEQ ID NO: 49213 - RNA, 41 nt, Mus musculus
aguagaguuggcaugauggcuuggaaauccuuaagagaaau

SEQ ID NO: 49214 - RNA, 45 nt, Mus musculus
ucauugugcagcccaggauaaccuugauugaacuuguagcaaccc

SEQ ID NO: 49215 - RNA, 46 nt, Mus musculus
aauuaacaaaacuaucaaguuucucaagguaagacacauaggagac

SEQ ID NO: 49216 - RNA, 45 nt, Mus musculus
cagugcaugcucuuaacagcugagccaucucuccagcccaaauua

SEQ ID NO: 49217 - RNA, 47 nt, Mus musculus
uuauuguccuugccucuuacuuugcuugcuuuguuguuguuguuguu

SEQ ID NO: 49218 - RNA, 65 nt, Mus musculus
uuucucaauggcucuuggagacccuccagccuauagaugauaccagauguuacuuugggaaaucu

SEQ ID NO: 49219 - RNA, 52 nt, Mus musculus
agggauuuucauuuuucuuggauucuuuauuaacaacagaacugaaaagggu

SEQ ID NO: 49220 - RNA, 53 nt, Mus musculus
caggccacagguacuagcaauugaaaguugauggucaggauccaguugcaguc

SEQ ID NO: 49221 - RNA, 79 nt, Mus musculus
ugagcacggggccgccgggcucagcggagggaugggggaggaggagccgcucggccgccgccgugcgggcggggggggg

SEQ ID NO: 49222 - RNA, 46 nt, Mus musculus
ccagaugugugaugauccacaguguuccagugcugaggcccuagcc

SEQ ID NO: 49223 - RNA, 68 nt, Mus musculus
aguagacaaguugacuuuucucgcuguucaggcacaguagacuggaauuccgucuggaaguaacgugg

SEQ ID NO: 49224 - RNA, 46 nt, Mus musculus
uauacaugacuguuaagaguucacagucuagaaauggcuagaaggu

SEQ ID NO: 49225 - RNA, 44 nt, Mus musculus
aaggaaaaaaaaaaaaacuacuacugaauaaaagugacaaagaa

SEQ ID NO: 49226 - RNA, 46 nt, Mus musculus
augcaucccaggcuguuuuccaugucugcuagccauuuagggaagg

SEQ ID NO: 49227 - RNA, 46 nt, Mus musculus
gacagccuagacuucaacaagaaaauccuucauacagccuggcauc

SEQ ID NO: 49228 - RNA, 46 nt, Mus musculus
caggaacacaaagcgggauauaacccuagaagcaucacgagagaac

SEQ ID NO: 49229 - RNA, 57 nt, Mus musculus
cucucucuuguuaacauguuugacuggguguucugccuuuacaguguugucaugacu

SEQ ID NO: 49230 - RNA, 45 nt, Mus musculus
uugguuucaugaggauuucaaaaguuguuuuguauaacagguaca

SEQ ID NO: 49231 - RNA, 42 nt, Mus musculus
cugugauauauugagaaggacagaggggucagggauccagug

SEQ ID NO: 49232 - RNA, 46 nt, Mus musculus
gggaucugaugcccucuucuggugugucugaagacagcugccgagg

SEQ ID NO: 49233 - RNA, 42 nt, Mus musculus
gacaccaugaccaaggcacucaggggccagaggcaggcagau

SEQ ID NO: 49234 - RNA, 33 nt, Mus musculus
uaccagguauuugcaguuuguuucuuuugaaga

SEQ ID NO: 49235 - RNA, 46 nt, Mus musculus
caacagcuguaacacguuuguguacagcagcaguaaaggaacuauu

SEQ ID NO: 49236 - RNA, 45 nt, Mus musculus
uuaaugaaaugccaucuagauauuguggauaucaagccugccaau

SEQ ID NO: 49237 - RNA, 91 nt, Mus musculus
cacuuaucacaucaacucaauuucuaucaauagugauuaugaaaccuacuuaucagcagaugauuugcgaauuaaucucuggcaucuggaa

SEQ ID NO: 49238 - RNA, 45 nt, Mus musculus
gaaagagacaaaagaccagaaggcuauaacuugaaagaggaagau

SEQ ID NO: 49239 - RNA, 44 nt, Mus musculus
aaguauguauaagguugaugacuuucaguuggcuggagcuagua

SEQ ID NO: 49240 - RNA, 52 nt, Mus musculus
uucaagaggucaaguagaaacaguagugaaugaugaggcccaguucgagaga

SEQ ID NO: 49241 - RNA, 42 nt, Mus musculus
uaccugggauuugcaaagcucugcuuccccguuuccugagua

SEQ ID NO: 49242 - RNA, 46 nt, Mus musculus
aguacuuuagacccuuguguguguguccaugugccugcaucaagua

SEQ ID NO: 49243 - RNA, 46 nt, Mus musculus
uuggagacccauuuucucucaauuaaauuucuugacucucugccuu

SEQ ID NO: 49244 - RNA, 45 nt, Mus musculus
gccagaauuugacuacuugaaaagcuuagaaauagaagagaagau

SEQ ID NO: 49245 - RNA, 46 nt, Mus musculus
aauaguaacucaauuguagauucauuuauuauuucaugcagcuguu

SEQ ID NO: 49246 - RNA, 44 nt, Mus musculus
agacuccuagugguuguuuguuuguaguauguuuuuguaauaga

SEQ ID NO: 49247 - RNA, 45 nt, Mus musculus
ucuuuuguuguuuuugauuugggacaggcuggccucugccucgau

SEQ ID NO: 49248 - RNA, 45 nt, Mus musculus
gcuucaaggcaacuuggcugcugagcugucuuucaggccccaguu

SEQ ID NO: 49249 - RNA, 42 nt, Mus musculus
cucuuacugcccuggcuaacuaggaauuauaucacuguauug

SEQ ID NO: 49250 - RNA, 24 nt, Mus musculus
cuuccccggccuaaguaaguagag

SEQ ID NO: 49251 - RNA, 42 nt, Mus musculus
gaaagaaaaaugacuccuuucccccaccccccacccccagcc

SEQ ID NO: 49252 - RNA, 46 nt, Mus musculus
uucauucuuguauacauauuuuaacauuucuaccuugcacccuaac

SEQ ID NO: 49253 - RNA, 134 nt, Mus musculus
ucuuuucauuuguuuuauaugcauuauuuugaggaucacucaguauauauaaaauguuuuuaaguuauugguuaaguaacaguaaugauuuauccccaaaccugcauguuguugauauuaauugauguguuucu

SEQ ID NO: 49254 - RNA, 46 nt, Mus musculus
cucucaaauuucugaaaugcuauuuuaaguaaguacuguuugagga

SEQ ID NO: 49255 - RNA, 45 nt, Mus musculus
gguucaucuggcuuccuuauggggggcuuuggcacacccccaguu

SEQ ID NO: 49256 - RNA, 74 nt, Mus musculus
gcaguugucaaagcacucuagaaucuuucuaacaggaccagugauagugcuugguaacaaaaccggacaaaggg

SEQ ID NO: 49257 - RNA, 53 nt, Mus musculus
guguuaauuuguuauuaaagccaaaucagaugcaaaaaaggaugggaauuuag

SEQ ID NO: 49258 - RNA, 51 nt, Mus musculus
uuuaaaaugaaaguugucaacuaaaagcuaacuuggaaauauuuugcaugu

SEQ ID NO: 49259 - RNA, 25 nt, Mus musculus
acuacugcccggcuucuuuuucuuu

SEQ ID NO: 49260 - RNA, 46 nt, Mus musculus
aauccagcuuuaacgcuggacccugaguaaauuuuugucugcagau

SEQ ID NO: 49261 - RNA, 80 nt, Mus musculus
agaguuuaaucauucuggagaauuacuagccacaggagauaaaggugggagaguugucaucuuucaacaagagcaggagg

SEQ ID NO: 49262 - RNA, 46 nt, Mus musculus
cccccaaaugaaaguguuuuauggaaauguuucugaugugcauaga

SEQ ID NO: 49263 - RNA, 49 nt, Mus musculus
augguucaguguuuguagugcaagccuggaaacuuaugugaagaugaag

SEQ ID NO: 49264 - RNA, 58 nt, Mus musculus
uuugaugucaucauaaaauacugcaggacuuucacgaaggaaacuaguuaugaggagu

SEQ ID NO: 49265 - RNA, 45 nt, Mus musculus
uuugggauucuugucuaucuguuaucuguuuauuacgccacacga

SEQ ID NO: 49266 - RNA, 46 nt, Mus musculus
ugguacacuguaguucuauauaucuguccauuaugugcuuggaguc

SEQ ID NO: 49267 - RNA, 46 nt, Mus musculus
agggcauuguugagauuggugacgggaaggaggaagcuuuucagga

SEQ ID NO: 49268 - RNA, 46 nt, Mus musculus
aacagaaagccaugguccuaggaaaaauugaauaguguuugcagau

SEQ ID NO: 49269 - RNA, 42 nt, Mus musculus
ccuccuccuccuccuccuuuucuuuauaaaguaugaggagau

SEQ ID NO: 49270 - RNA, 42 nt, Mus musculus
gaacgagcugacacugacccgccuaagcuucagagccuagcu

SEQ ID NO: 49271 - RNA, 42 nt, Mus musculus
aaagaaaugguguggccuguuugucagggguuuaguuuugaa

SEQ ID NO: 49272 - RNA, 45 nt, Mus musculus
uuucaaaauuaaaaaccucuauagcuacacuucuguguguuuuua

SEQ ID NO: 49273 - RNA, 46 nt, Mus musculus
gaaaugccauaugacuuugagugcuuucuguaaacuccugccagau

SEQ ID NO: 49274 - RNA, 45 nt, Mus musculus
aaucuccaugucaucaagccuaaaauuaaauuucagcccccauug

SEQ ID NO: 49275 - RNA, 46 nt, Mus musculus
cugacuaguacaagcaugacagaagugaugacauacacuuacagau

SEQ ID NO: 49276 - RNA, 44 nt, Mus musculus
uuuuguauuuugaagcagggauuaaaaauccaguagcuugagau

SEQ ID NO: 49277 - RNA, 48 nt, Mus musculus
agagcccccugaagaguaggagaagggaccgguauugauuggccuagg

SEQ ID NO: 49278 - RNA, 46 nt, Mus musculus
acagcauaauagggagaguucaguauccuuggaaacccuggaggag

SEQ ID NO: 49279 - RNA, 45 nt, Mus musculus
uaucacuuuuuaucaaaacaggcuuugaaagaaugugcaaaguac

SEQ ID NO: 49280 - RNA, 45 nt, Mus musculus
cuuuguggaguuuuugugacaguuuauauguucuaggcugcuugu

SEQ ID NO: 49281 - RNA, 46 nt, Mus musculus
uauucucagaaaauagaaugccuaucuuuaggaagguggggcugga

SEQ ID NO: 49282 - RNA, 46 nt, Mus musculus
cauaccacugagaaagggagaaacgcagcaaggauagcaccaagau

SEQ ID NO: 49283 - RNA, 46 nt, Mus musculus
cuugcuuguaggguauaauauuauuucaugcauacucagaccagau

SEQ ID NO: 49284 - RNA, 46 nt, Mus musculus
aaauguggucaucuuuuuugaggaacaguuugcucuaagcagagau

SEQ ID NO: 49285 - RNA, 46 nt, Mus musculus
aaauaaccuguugcuuuaauaagcauugcuugccuuggguggguua

SEQ ID NO: 49286 - RNA, 44 nt, Mus musculus
uuucccuguagcacuuuuuagcuaugaacucauacagcccacuc

SEQ ID NO: 49287 - RNA, 46 nt, Mus musculus
accuccaauucguaauucuccuguuucuaccucuaagggaccuggu

SEQ ID NO: 49288 - RNA, 46 nt, Mus musculus
ucuuucugucuuugauucuugucuuaggauugagaaccugggaguu

SEQ ID NO: 49289 - RNA, 45 nt, Mus musculus
cugcaugaaagacaagacacucagaaaaaugagacuauauaaaga

SEQ ID NO: 49290 - RNA, 46 nt, Mus musculus
uaaauagauuuuuguuuuaaaggggaagaaaauauggcugacagug

SEQ ID NO: 49291 - RNA, 47 nt, Mus musculus
uccagaggacccaacuucaauugccagcaaccauguggugccuuaca

SEQ ID NO: 49292 - RNA, 46 nt, Mus musculus
ggcuacacaaagaaacccugucuuggaaaaacuaaaaaggaaagag

SEQ ID NO: 49293 - RNA, 44 nt, Mus musculus
ucugcuuuaaacuuguucuuuguuugcauauauacugccuuagu

SEQ ID NO: 49294 - RNA, 46 nt, Mus musculus
ccccccucaagacuauuaaauaauauuuuccccuuaucagccacau

SEQ ID NO: 49295 - RNA, 46 nt, Mus musculus
uuuuggaaaauguaugugccaccauggacuuuugacaauugcaggu

SEQ ID NO: 49296 - RNA, 46 nt, Mus musculus
guaaacauagaaucugcaucuuugagaaugugaaguccggguuuuu

SEQ ID NO: 49297 - RNA, 38 nt, Mus musculus
gaguuggccugguuguuaauugacaacagcugcuagga

SEQ ID NO: 49298 - RNA, 45 nt, Mus musculus
gucuacaaagugaguucaggacagccaaggcuauuacccacagaa

SEQ ID NO: 49299 - RNA, 46 nt, Mus musculus
uuaaaaaaccaggcaguuuuggcaccuaacuuuaaucucagcaguc

SEQ ID NO: 49300 - RNA, 46 nt, Mus musculus
uagugggacaauugaaauauugaagauagauacguagcuagcaguc

SEQ ID NO: 49301 - RNA, 46 nt, Mus musculus
guaaaaugauaccucaguaucaguuuuacacacuugcaacucaguu

SEQ ID NO: 49302 - RNA, 45 nt, Mus musculus
uauuuuaugguuauugguguuuugccugcauguaugucugaaggu

SEQ ID NO: 49303 - RNA, 46 nt, Mus musculus
uagacaagguuucuuugugugguuuuuguuuuuuucucagacaagg

SEQ ID NO: 49304 - RNA, 24 nt, Mus musculus
ucuggguuccuguacuuagccaua

SEQ ID NO: 49305 - RNA, 46 nt, Mus musculus
uaaaggggaagcagagagauagaaggucuaggauaguagaggugaa

SEQ ID NO: 49306 - RNA, 46 nt, Mus musculus
uauuuuacauuacuuuguuaaauaaguauauuuaguaccuugaguc

SEQ ID NO: 49307 - RNA, 46 nt, Mus musculus
uugcucccuauugauuaaauaacuuccuaggguauauguagugaca

SEQ ID NO: 49308 - RNA, 45 nt, Mus musculus
uuucuuuucagguggugguaggccaaagacuguugacuaggagau

SEQ ID NO: 49309 - RNA, 45 nt, Mus musculus
cuuugaauuugcuauguagacuagguuguucuugaauucggagau

SEQ ID NO: 49310 - RNA, 51 nt, Mus musculus
uuaauauaguuuguggacucuguguguguauguguguguauuugagaggga

SEQ ID NO: 49311 - RNA, 57 nt, Mus musculus
aaugauauucagugguguuuuucucaggugaaaggagcaguagaugaugacguagca

SEQ ID NO: 49312 - RNA, 45 nt, Mus musculus
ggugcccccauccccccauuuccucuucagugcugagcagugagu

SEQ ID NO: 49313 - RNA, 45 nt, Mus musculus
gguacaguugaguguaagaaaauaagaggccuaguugcauucggc

SEQ ID NO: 49314 - RNA, 46 nt, Mus musculus
cauugcucagggaggaauguauuuuuucaaaacgcuucaccaagau

SEQ ID NO: 49315 - RNA, 46 nt, Mus musculus
caaagacacugucuaauuaauaauccucuuuucugugcagccgagg

SEQ ID NO: 49316 - RNA, 45 nt, Mus musculus
agauuccacauauugcuggauuggugcuguuaucaugguguaguu

SEQ ID NO: 49317 - RNA, 46 nt, Mus musculus
ucugucucaaaagacaaaaagauaaaaaaaagacauuuccccagau

SEQ ID NO: 49318 - RNA, 42 nt, Mus musculus
augguguuucaugucaguaaucucagcacuggagaggcagca

SEQ ID NO: 49319 - RNA, 46 nt, Mus musculus
caaauacacauucccguucaucauggagacuuacuuagagcuagaa

SEQ ID NO: 49320 - RNA, 45 nt, Mus musculus
guauguauggauacauuagauagauagauagauagauagauagau

SEQ ID NO: 49321 - RNA, 46 nt, Mus musculus
cuguggcuugaacuucucuuauauuuucccucaguuuuuaucagaa

SEQ ID NO: 49322 - RNA, 46 nt, Mus musculus
gugggucuacccucacagaugcuaacagugccacccagccaccaga

SEQ ID NO: 49323 - RNA, 40 nt, Mus musculus
ccugcaguggggaaaacuuuguggaaauuaguuuagaaag

SEQ ID NO: 49324 - RNA, 45 nt, Mus musculus
gggaaggaaaugugcagggaauggcagcccuggcagugggagaga

SEQ ID NO: 49325 - RNA, 45 nt, Mus musculus
cugcacauuuccuucccacauucucacuguggcuugcggguucuu

SEQ ID NO: 49326 - RNA, 45 nt, Mus musculus
guuaaggucucuuuuugagucaguagagacagggcugcccugcag

SEQ ID NO: 49327 - RNA, 65 nt, Mus musculus
ucaaaauuuggaaaauccuugugagauccuuauuguuucagaaaguaugaaucuaaagugugaga

SEQ ID NO: 49328 - RNA, 88 nt, Mus musculus
ggagaguaagugucaaagugcaaaggagccaaaacccgggaccaagauggaaagcggucuugugccucgggcuucugugacccaagau

SEQ ID NO: 49329 - RNA, 92 nt, Mus musculus
cucugaaacagcccgagaagcaggccaaggagauggacgaggaagacaaggcuuucaagcagaaauaaaaggaggaacagaagaaacucgag

SEQ ID NO: 49330 - RNA, 42 nt, Mus musculus
gacaucuggauucccugccauagcaucuuugccaccuacagc

SEQ ID NO: 49331 - RNA, 45 nt, Mus musculus
gaaaaaaaaaagccaacaacuuagcggaaacuucucagagaaugc

SEQ ID NO: 49332 - RNA, 45 nt, Mus musculus
ugggauguacgacauuuguaaauccuucuuguacagugcugcuaa

SEQ ID NO: 49333 - RNA, 42 nt, Mus musculus
gaaaagcauuugucaaagagagcuuaaagugcaucgccaaug

SEQ ID NO: 49334 - RNA, 45 nt, Mus musculus
aagcgcaacccggaagccaucacugaagucauacagcugcccaau

SEQ ID NO: 49335 - RNA, 46 nt, Mus musculus
uccagagugggaaaagugacaaagcguccaacucucuagggcaugg

SEQ ID NO: 49336 - RNA, 46 nt, Mus musculus
cuuuguuucccuugaucaauauuauucuucuguuuccuguucccaa

SEQ ID NO: 49337 - RNA, 45 nt, Mus musculus
aacuguauccuccaagaacuaaaauaccuucuaaaguagacccca

SEQ ID NO: 49338 - RNA, 67 nt, Mus musculus
cucuggggugugucugggcacaguggucugucugcaggauguggaagaggcuggccauguugggccc

SEQ ID NO: 49339 - RNA, 51 nt, Mus musculus
cauggccagccucuuccacauccugcagacagaccacugugcccagacaca

SEQ ID NO: 49340 - RNA, 92 nt, Mus musculus
gauuauggaagccuaguuucaugcaauuuuucuuuaacggggggauagaaaauagguacuacuuaaaaaaaaucaaaccaggcacaguacac

SEQ ID NO: 49341 - RNA, 48 nt, Mus musculus
aauguacccucuuccauccccccucucucugaauucuuuucccagauc

SEQ ID NO: 49342 - RNA, 45 nt, Mus musculus
agaguagauagggaucugggaaaagaauucagagagaggggggau

SEQ ID NO: 49343 - RNA, 57 nt, Mus musculus
ccauucauguaacuacccagucauuguaaucugaaaauguagaucccuuuagaaugg

SEQ ID NO: 49344 - RNA, 46 nt, Mus musculus
uuaaaugcaugucuuaaaugcucauaaauauguuaaauggaauucg

SEQ ID NO: 49345 - RNA, 46 nt, Mus musculus
cucagagcuuuaaaaguaucuuuaacaauugucuuaaaaaacggag

SEQ ID NO: 49346 - RNA, 75 nt, Mus musculus
uaguuucucagggucauuguccuugaacccaacagccccaauuaugagugucacugcucaccaaaggucaaugcu

SEQ ID NO: 49347 - RNA, 46 nt, Mus musculus
cagauuguuaagggcauuuucauacuuagaacugucccauccccag

SEQ ID NO: 49348 - RNA, 42 nt, Mus musculus
ccuuagccucuuggaaaucagguagcacauauucuaagcuag

SEQ ID NO: 49349 - RNA, 42 nt, Mus musculus
ugugcauuguugguacauauaccaaugucacuguggggagaa

SEQ ID NO: 49350 - RNA, 46 nt, Mus musculus
gcauuauguauuuauaauuuaaaugauauuuagguuuuuggcugag

SEQ ID NO: 49351 - RNA, 46 nt, Mus musculus
cagcaaggacaugggccuguccuccagguaggcagucugcuggaca

SEQ ID NO: 49352 - RNA, 114 nt, Mus musculus
cugccucuccgccuccgcugugcacaccgaccccaccagaggccaccggcgccuuuuacgcuucuccucccagauccacaacaauggccagucugacuuccgccccaagaaugg

SEQ ID NO: 49353 - RNA, 47 nt, Mus musculus
cggccauucuuggggcggaagucagacuggccauuguuguggaucug

SEQ ID NO: 49354 - RNA, 42 nt, Mus musculus
gggggaacuugcaucucucagggggagugggaguguugacaa

SEQ ID NO: 49355 - RNA, 45 nt, Mus musculus
cgaggguaugaggguuuuguuguuguuguuguuguuguggagauu

SEQ ID NO: 49356 - RNA, 41 nt, Mus musculus
ccggcacucaugaggcuaaugauguuguccuggcaccaguu

SEQ ID NO: 49357 - RNA, 42 nt, Mus musculus
gcucuuucucccccaaagaucaaccuguccugaggccuaaga

SEQ ID NO: 49358 - RNA, 45 nt, Mus musculus
cagagagcacccuucucuuaagucuccacuucaaaagggccaccc

SEQ ID NO: 49359 - RNA, 42 nt, Mus musculus
ugguuccgggugucuuugucccccuggugucguggcccuggc

SEQ ID NO: 49360 - RNA, 42 nt, Mus musculus
cguuccacaguuggagcgggauggcaggcuggugugggggaa

SEQ ID NO: 49361 - RNA, 46 nt, Mus musculus
guuaaaugaccugggaagggugugaugcuggaggcaaacaggagug

SEQ ID NO: 49362 - RNA, 46 nt, Mus musculus
caaucggcuccguuggaggagcccucgacuuccugagccuccuguu

SEQ ID NO: 49363 - RNA, 46 nt, Mus musculus
ggaguuugagagcauucggaaggaccuggaggcccguaagaagcag

SEQ ID NO: 49364 - RNA, 46 nt, Mus musculus
cgggaacaaaugauuaaugaucgaauugguuauaaaccccaacuca

SEQ ID NO: 49365 - RNA, 45 nt, Mus musculus
accaugcccuauuuuuaccauaaaacccagggacagaaccaccag

SEQ ID NO: 49366 - RNA, 44 nt, Mus musculus
ccagggaaucucagagaacugaaggauuucagaaguaagaccua

SEQ ID NO: 49367 - RNA, 44 nt, Mus musculus
uuaaaaugguuacuuugcaugaguuggggguacguagaugugga

SEQ ID NO: 49368 - RNA, 46 nt, Mus musculus
acaccagggcaccccagccaauaaacagaaaguguuacagccaaua

SEQ ID NO: 49369 - RNA, 59 nt, Mus musculus
ggugucccuaaucuuuauuguaacguacauuuccugccccuucuccagccuugauuugg

SEQ ID NO: 49370 - RNA, 50 nt, Mus musculus
cuccugucaguggggccggggaaccggagcuuucacugagacacuugaag

SEQ ID NO: 49371 - RNA, 59 nt, Mus musculus
guagcgggaacuggaguccugcuucccucaaucacccagacuggacagcaggggugaca

SEQ ID NO: 49372 - RNA, 60 nt, Mus musculus
acaccaucuccaagaaaggcuuccaccugcgguacacaagcaccaaguuccaggacacac

SEQ ID NO: 49373 - RNA, 44 nt, Mus musculus
ggagucagagcaaacauugggucuagagccauaacuggggcagg

SEQ ID NO: 49374 - RNA, 29 nt, Mus musculus
cccagacuggggcgcuacugugguucugg

SEQ ID NO: 49375 - RNA, 46 nt, Mus musculus
uggcuacaggcaaccgcauguucuugcgcuucuacucagacaacuc

SEQ ID NO: 49376 - RNA, 41 nt, Mus musculus
ugauaggguuggaggagggaggaaaggaagaagggagggag

SEQ ID NO: 49377 - RNA, 45 nt, Mus musculus
accaggcuggagguuugggacaguugcugauagauggacuuagug

SEQ ID NO: 49378 - RNA, 46 nt, Mus musculus
uuggcuggacagaacuggugcucuccucucccccccgcccccuccc

SEQ ID NO: 49379 - RNA, 46 nt, Mus musculus
gagguccuaggacagggaguucaauugccugagaacacggggauag

SEQ ID NO: 49380 - RNA, 46 nt, Mus musculus
agaacagaaacuucccaguacacagaagcucagagggcuugcgggg

SEQ ID NO: 49381 - RNA, 41 nt, Mus musculus
cucccaacaaaaacugcaucuggcaguugguggcccccacc

SEQ ID NO: 49382 - RNA, 46 nt, Mus musculus
agcuacaagugcagcugugacccuggcuaugagcuggccccagaca

SEQ ID NO: 49383 - RNA, 45 nt, Mus musculus
acuguggcuaugagaagccugaugacaucaaaagcacauccaguc

SEQ ID NO: 49384 - RNA, 42 nt, Mus musculus
ugucugaggguuuccacgugggccucacguuccaguccuuug

SEQ ID NO: 49385 - RNA, 52 nt, Mus musculus
aaggauaauggccauauccagucucccaauuacccagacgauuaucggccca

SEQ ID NO: 49386 - RNA, 45 nt, Mus musculus
uagauuauucuaaacuucacauccauggaccuguaccguagccgc

SEQ ID NO: 49387 - RNA, 41 nt, Mus musculus
ggugugaccagcuuguaguuuuuaggugagaacaguuaagu

SEQ ID NO: 49388 - RNA, 42 nt, Mus musculus
ucuccuccccugaguaucccaauggcuacucugcccacaugc

SEQ ID NO: 49389 - RNA, 46 nt, Mus musculus
uauuuuaugugcauuaguguuuuaccugcaugugugucugucagau

SEQ ID NO: 49390 - RNA, 45 nt, Mus musculus
gggaccgccaugucucuauuguacgcgagaacauacagccaggua

SEQ ID NO: 49391 - RNA, 47 nt, Mus musculus
ugggagaagcauaccugugucaccuucuuggagcgcacagaugagga

SEQ ID NO: 49392 - RNA, 51 nt, Mus musculus
cccuggguggucagggcacuaguggacagccgcagagggaaagcaggggca

SEQ ID NO: 49393 - RNA, 46 nt, Mus musculus
ccucccaccaugaguuugugugugugugugugugugugugugugug

SEQ ID NO: 49394 - RNA, 47 nt, Mus musculus
uaucacaacuuuuccucgacuucccgcuucugacuucagccugucug

SEQ ID NO: 49395 - RNA, 45 nt, Mus musculus
cuucucccaucugccguuguugcaguucuuguauggauagcuuug

SEQ ID NO: 49396 - RNA, 46 nt, Mus musculus
guugauuugaauuaacauuaaagaacgcaagcauaucugcagccau

SEQ ID NO: 49397 - RNA, 42 nt, Mus musculus
gcaaaccacgguuaauugugucuagcagcucgcaagcaccug

SEQ ID NO: 49398 - RNA, 24 nt, Mus musculus
cgcuaccuggcccugggcagugac

SEQ ID NO: 49399 - RNA, 46 nt, Mus musculus
aggcacccaguguccaggcucucuaugugcgcaccaacagccccug

SEQ ID NO: 49400 - RNA, 42 nt, Mus musculus
acaguccugugagaaggugauuagguacugcugugggcggag

SEQ ID NO: 49401 - RNA, 44 nt, Mus musculus
ggugaggcccuucccaaccccauggccugccaauccuugggccg

SEQ ID NO: 49402 - RNA, 44 nt, Mus musculus
cagccugcuuuaccgaaaguuuguccacccaucccuaucccgcc

SEQ ID NO: 49403 - RNA, 45 nt, Mus musculus
caaaacugagcaugguuucauagcugcgcuccuuugccugcacga

SEQ ID NO: 49404 - RNA, 45 nt, Mus musculus
gccccagagauuagcugaagggcagcuuccccguuacagcccuuc

SEQ ID NO: 49405 - RNA, 88 nt, Mus musculus
agaccugcgcucuaucccugacaccccuguccccaccuaccaagauccccucuaccuggaagaccagguaccccgacguagacccccu

SEQ ID NO: 49406 - RNA, 46 nt, Mus musculus
cucuaggccgcagccagagccuucggguggucaagaggaagccauu

SEQ ID NO: 49407 - RNA, 45 nt, Mus musculus
gccuuuuccaaggccuggugugugugugugugugugugugugugu

SEQ ID NO: 49408 - RNA, 45 nt, Mus musculus
aacccgcgcggacaagugcgugcugggugaauuagcuaaucgcua

SEQ ID NO: 49409 - RNA, 45 nt, Mus musculus
aaagggguugcuggugcagagcugugacucggagccggcugggaa

SEQ ID NO: 49410 - RNA, 46 nt, Mus musculus
aggaaaaggaagcaaaaggggcucuggccugcuccuccuugcccag

SEQ ID NO: 49411 - RNA, 52 nt, Mus musculus
uaugucuaugucauggauucccuggggcugagggccagagcauguuagggcg

SEQ ID NO: 49412 - RNA, 46 nt, Mus musculus
cugguggcgggagcugggggaggcuuuguggagggcugaaggccag

SEQ ID NO: 49413 - RNA, 46 nt, Mus musculus
ugugagggauccagggacugucccuccaagucggagaaguuucuga

SEQ ID NO: 49414 - RNA, 43 nt, Mus musculus
uggagugaguuauggcaauuagucacgggaauuguuccauuag

SEQ ID NO: 49415 - RNA, 45 nt, Mus musculus
cucagcaagggaggggugugugugugugugugugugugugugugu

SEQ ID NO: 49416 - RNA, 46 nt, Mus musculus
uccaaggccaggucaagaagucuguuuuuguuuuuaaggcugcaag

SEQ ID NO: 49417 - RNA, 42 nt, Mus musculus
uguggugacagcaaaccuuuaauccuaguggucagagggcag

SEQ ID NO: 49418 - RNA, 42 nt, Mus musculus
ugcacuuccagaaaaaaggggccuaaacacaaacugagagag

SEQ ID NO: 49419 - RNA, 45 nt, Mus musculus
aacgagaaaggaaggcugccgggcggaggaggaggcgugggggca

SEQ ID NO: 49420 - RNA, 41 nt, Mus musculus
gagaagaguuacaaagcuagcggaagcucucgaggcacagg

SEQ ID NO: 49421 - RNA, 44 nt, Mus musculus
aucaagggagcauggcucaggaucacgagagucgggcuuaggau

SEQ ID NO: 49422 - RNA, 45 nt, Mus musculus
auccuugaaacagaccugcgagagcaagguuuguuugacccaaca

SEQ ID NO: 49423 - RNA, 46 nt, Mus musculus
gcugcgugcccaagguggggcugagugugcaguuugauuggaagau

SEQ ID NO: 49424 - RNA, 51 nt, Mus musculus
ccaccuuuccaggggcucuaugagacagaaagcuaucuuuuguagcuagag

SEQ ID NO: 49425 - RNA, 45 nt, Mus musculus
cauauguggacagacaggacuggaagugcaauuagguagggcagg

SEQ ID NO: 49426 - RNA, 46 nt, Mus musculus
acgggugcaaacauugugugcuggaguccgggcuggguuugucuag

SEQ ID NO: 49427 - RNA, 52 nt, Mus musculus
gugaggaauggagcccaacguuucugcccugccucccgcugcucccagccag

SEQ ID NO: 49428 - RNA, 46 nt, Mus musculus
ggauggaucgggggaacucccugcccugugugcuggagcagaaggu

SEQ ID NO: 49429 - RNA, 24 nt, Mus musculus
uccagggcagaacucuuuggaaga

SEQ ID NO: 49430 - RNA, 42 nt, Mus musculus
guauaacuucaguuccuaaagauccgacacccucacacagac

SEQ ID NO: 49431 - RNA, 45 nt, Mus musculus
ucugugugagggugucggaucuuuaggaacugaaguuauacagga

SEQ ID NO: 49432 - RNA, 46 nt, Mus musculus
auauggggccuauagggcgaugauucuuauucaaacuaccacagac

SEQ ID NO: 49433 - RNA, 49 nt, Mus musculus
guuacuuccaacuugggaaagaugaucuugaaagaagagauggaaaagu

SEQ ID NO: 49434 - RNA, 109 nt, Mus musculus
agacagaauggaggaaacggaaggcaucucgaaagggggcagaggaagaggaggaagaggaagacgaugacucugaagaggagauuaaggccaucagggaacggcagaa

SEQ ID NO: 49435 - RNA, 48 nt, Mus musculus
uccaaguuuccugcagcgcagcccccugaccccaaccagccagccaag

SEQ ID NO: 49436 - RNA, 70 nt, Mus musculus
cagcugaucuuguucugucucucagagacuacccgcccggauuccaacaucuacaagaagccacccaucu

SEQ ID NO: 49437 - RNA, 45 nt, Mus musculus
cugagagacagaacaagaucagcugagaaaggggacacgaugaca

SEQ ID NO: 49438 - RNA, 45 nt, Mus musculus
uaccguaggguccagcuagaucuaaacccaaagaguagggaccag

SEQ ID NO: 49439 - RNA, 52 nt, Mus musculus
uucaaccccaaggaccacagggacccccaggaccagccugccccacuuccac

SEQ ID NO: 49440 - RNA, 46 nt, Mus musculus
gggucccugugguccuugggguugaagccugagagaugauuccaag

SEQ ID NO: 49441 - RNA, 24 nt, Mus musculus
gaaggaugaaggccaggccagaga

SEQ ID NO: 49442 - RNA, 44 nt, Mus musculus
acagcugucacccuggaaaacuugaguaccgaguggcccaggag

SEQ ID NO: 49443 - RNA, 46 nt, Mus musculus
aaaaggcuacauagugaaaccuugucugagagagagagagagagag

SEQ ID NO: 49444 - RNA, 31 nt, Mus musculus
acaguggugacauggggagagguccuauagg

SEQ ID NO: 49445 - RNA, 87 nt, Mus musculus
gccauccuggacauugagcgaccugaccucaugaucuaugagccccacuuuaccuauucccuccuggaacauguagagcugcccaga

SEQ ID NO: 49446 - RNA, 93 nt, Mus musculus
ggagggaauagguaaaguggggcucauagaucaugaggucaggucgcucaauguccaggauggccuuguccuuggggauggcagccagauccu

SEQ ID NO: 49447 - RNA, 44 nt, Mus musculus
uucugcagacguuccaugcggcagccacuggccggccgcucccu

SEQ ID NO: 49448 - RNA, 46 nt, Mus musculus
gacacgggcagcggaaugguagagguaacauacagaugaaaaagau

SEQ ID NO: 49449 - RNA, 41 nt, Mus musculus
guuguuguugccacagcaacugugcaaguggggcugggagg

SEQ ID NO: 49450 - RNA, 42 nt, Mus musculus
ggaaaaggaucagaaagcauuugcaugagcgagagagagaga

SEQ ID NO: 49451 - RNA, 61 nt, Mus musculus
acuaacucggucaagaggggaaccuaagaaaacucuaaugagcucaggcauguuugcaggg

SEQ ID NO: 49452 - RNA, 45 nt, Mus musculus
cuggcaaggagggcggcagagucccugugugcacccaugugcagu

SEQ ID NO: 49453 - RNA, 42 nt, Mus musculus
augcuaggacagggucagcuuuggaaaauggucagugggaga

SEQ ID NO: 49454 - RNA, 46 nt, Mus musculus
cauuaugaaugggguuugaauugcagguucuuggagagccgggugg

SEQ ID NO: 49455 - RNA, 47 nt, Mus musculus
agauagaaggauggaaggaaccaggucauaaauacaucagauucaga

SEQ ID NO: 49456 - RNA, 23 nt, Mus musculus
agacagguaagacuauggccuca

SEQ ID NO: 49457 - RNA, 46 nt, Mus musculus
auaagggucuccagagguaugcugggaacgagaugaugucagaaag

SEQ ID NO: 49458 - RNA, 48 nt, Mus musculus
agagacuagaagaggcucucuuggacucagacuuuugucuagguaggg

SEQ ID NO: 49459 - RNA, 42 nt, Mus musculus
acuguggcaccagugaccuuuauggagaacgaagcccagaag

SEQ ID NO: 49460 - RNA, 46 nt, Mus musculus
aaaagguuacucgaccccccaagggucacacaauccacaaguggag

SEQ ID NO: 49461 - RNA, 46 nt, Mus musculus
cuggacauuguugaacaaugugacuuaaguagaaccagcugugugg

SEQ ID NO: 49462 - RNA, 42 nt, Mus musculus
acacccagcaauuacuugaggacaaagaguugggcccccaag

SEQ ID NO: 49463 - RNA, 42 nt, Mus musculus
cccagcucugaguugguucugucugcugcagcccaccuccgg

SEQ ID NO: 49464 - RNA, 41 nt, Mus musculus
cuuccgcucgccccagaccuccucccacucccagcccagcu

SEQ ID NO: 49465 - RNA, 41 nt, Mus musculus
acagccuggggacgccagaagucaccucgcagggagcaaga

SEQ ID NO: 49466 - RNA, 44 nt, Mus musculus
cgaggugacuucuggcguccccaggcugugauccugccaccccc

SEQ ID NO: 49467 - RNA, 42 nt, Mus musculus
auuucucgccccaggccugcguccccaccccaagccccagaa

SEQ ID NO: 49468 - RNA, 46 nt, Mus musculus
agaccguagggacuuacgguuuuguuuucaaaaacagacagagaca

SEQ ID NO: 49469 - RNA, 45 nt, Mus musculus
agaaguacaucuguaugaacaagaggggcaagcugauugggaagg

SEQ ID NO: 49470 - RNA, 46 nt, Mus musculus
ggucuagcucugucuugguccaagugacugguauucagccugagau

SEQ ID NO: 49471 - RNA, 46 nt, Mus musculus
cucuagcccguuccaggccuuuugcuucacacaucuagggagagua

SEQ ID NO: 49472 - RNA, 41 nt, Mus musculus
uuugcgcccggggaccucugcccgaagccaguagcccaaga

SEQ ID NO: 49473 - RNA, 41 nt, Mus musculus
gaccggcagguuggugcgggucaggaauaaaucaagagaga

SEQ ID NO: 49474 - RNA, 33 nt, Mus musculus
cagugagcagggugauaaguggauaagguaggu

SEQ ID NO: 49475 - RNA, 45 nt, Mus musculus
cugcuguucauuaugcaggugaagacacauucaaccaaccagcaa

SEQ ID NO: 49476 - RNA, 32 nt, Mus musculus
ggccagggcggugcgcaggcuguaggccacaa

SEQ ID NO: 49477 - RNA, 72 nt, Mus musculus
auacccugccccuuuguauuuugugcagugauuguuuuuuaaaaucuucuuuucauguaaguagcaaacagg

SEQ ID NO: 49478 - RNA, 72 nt, Mus musculus
auuugcuguggagacuuuaauuuguucuugagaagucaagaaaaaacguggggaggaauucaaugccacagc

SEQ ID NO: 49479 - RNA, 52 nt, Mus musculus
caucuaccgacugugucacgacaaggagaccuacaaacugcagcgccgggaa

SEQ ID NO: 49480 - RNA, 56 nt, Mus musculus
caguccuaccuuauccaugagcacauggugaucaccgaccgcaucgagaacgugga

SEQ ID NO: 49481 - RNA, 41 nt, Mus musculus
gcgauggcggcuucuucaaguggugagaaggaaaaggagcg

SEQ ID NO: 49482 - RNA, 47 nt, Mus musculus
gaacucauagaaaugcuugcaauuucaagaaaucagaagcuauuaca

SEQ ID NO: 49483 - RNA, 39 nt, Mus musculus
gaaggaaaggaaagagaauggaugaacaguauacauagc

SEQ ID NO: 49484 - RNA, 45 nt, Mus musculus
cucacccauaccuucaccaucagcucuagcucagguggugcagac

SEQ ID NO: 49485 - RNA, 57 nt, Mus musculus
aaauuagcacuuaaucagggaaaaguucaccacgaaaugcaggcuuuagagaaagaa

SEQ ID NO: 49486 - RNA, 46 nt, Mus musculus
ccuguugauaaauagcuguuagaaagccauggccgugcagggaggg

SEQ ID NO: 49487 - RNA, 42 nt, Mus musculus
cagaugaaugcagguuugaaaggacugagguaucuaaauaag

SEQ ID NO: 49488 - RNA, 41 nt, Mus musculus
accuuguuagauccuugguacuacaagguaggugggugggu

SEQ ID NO: 49489 - RNA, 42 nt, Mus musculus
gcaacauuugcccauuuucagauacuuacugagagaccugag

SEQ ID NO: 49490 - RNA, 41 nt, Mus musculus
ggauuuguuuuuaagagauggagaaguggguuggggaggag

SEQ ID NO: 49491 - RNA, 46 nt, Mus musculus
gguaagauggaaugggucgugagucccaagcauucucuacuaccug

SEQ ID NO: 49492 - RNA, 46 nt, Mus musculus
cacuuuguauaccaggcuguucucgaacgccugguucuccagggau

SEQ ID NO: 49493 - RNA, 45 nt, Mus musculus
ccaaagcucaaaucacaauucuccacuguacaacuaaguauccag

SEQ ID NO: 49494 - RNA, 43 nt, Mus musculus
cgcucaaacagauuuccagcaacaggugcuuuggcgggcucca

SEQ ID NO: 49495 - RNA, 42 nt, Mus musculus
guaaaaugagauuugcugucuaccuaccaccccaggccgaga

SEQ ID NO: 49496 - RNA, 46 nt, Mus musculus
caaauuuagauuuucuuaaaaguguguuagacauaccagcagcagu

SEQ ID NO: 49497 - RNA, 46 nt, Mus musculus
auuuauagugagcuaguuaagucuuacccuucuuuuagagacccag

SEQ ID NO: 49498 - RNA, 49 nt, Mus musculus
gucaguucugucucuagucuucagaggaacaaauggaggucaguaagga

SEQ ID NO: 49499 - RNA, 41 nt, Mus musculus
ccagcacaaguggcacguaccauucaagguuaaaggacaca

SEQ ID NO: 49500 - RNA, 46 nt, Mus musculus
ugggacuucggcacuggugcuggguuuuaugugaaugccacugaag

SEQ ID NO: 49501 - RNA, 42 nt, Mus musculus
aaguagccuuagaauugggaauuaaacaugucuauggguggg

SEQ ID NO: 49502 - RNA, 42 nt, Mus musculus
aucgaucaaggaaaagaugacgaguuucuuucaaaugggcag

SEQ ID NO: 49503 - RNA, 46 nt, Mus musculus
uggccagccagccccagggauucaccuccucacacuagaauuacag

SEQ ID NO: 49504 - RNA, 112 nt, Mus musculus
ucauagcuacuacuucauugcaacuuucaucgcugaccacaucagacaccaugcuaaguaccugaaugcaugaaaagccucagccaagagaaucucaucaggaggccggaag

SEQ ID NO: 49505 - RNA, 45 nt, Mus musculus
caccaugacuaaaagcaacauaaggaggaaaagguuuauuuguca

SEQ ID NO: 49506 - RNA, 46 nt, Mus musculus
cagggcagggccccuggugggcagcuaugugcacagcgaggcagac

SEQ ID NO: 49507 - RNA, 61 nt, Mus musculus
ccagcagcccucuugucccccaauauaauaaacugacugaaaucaagagagcaccccaaag

SEQ ID NO: 49508 - RNA, 42 nt, Mus musculus
gcgggucagggagcuggcggagaacugaguagcagcacauca

SEQ ID NO: 49509 - RNA, 46 nt, Mus musculus
acaaaauauugccugacugacucucuucuaauuuaauaccagauac

SEQ ID NO: 49510 - RNA, 45 nt, Mus musculus
ugguuaaaggaagaaauguuagacucuaaucauguuggcccauau

SEQ ID NO: 49511 - RNA, 46 nt, Mus musculus
aguagauggggcaggcacuuuggguggaagaaggggacuagcugga

SEQ ID NO: 49512 - RNA, 24 nt, Mus musculus
uuuuuuaaagggaaaacuggggca

SEQ ID NO: 49513 - RNA, 40 nt, Mus musculus
uuaugccccuucuguggugcuucuaacaguguagguaacu

SEQ ID NO: 49514 - RNA, 42 nt, Mus musculus
ucacuuccugugagaaaaagaaggaaggaagggaaauuagau

SEQ ID NO: 49515 - RNA, 27 nt, Mus musculus
gcaaacagcaaacuguuagaauagggu

SEQ ID NO: 49516 - RNA, 46 nt, Mus musculus
uaacuguaaucuuguuucuguuaugagucaucuuuguugucugcca

SEQ ID NO: 49517 - RNA, 46 nt, Mus musculus
cccauuccccuccugaacuguccauuugaauuuaaaccccacauaa

SEQ ID NO: 49518 - RNA, 25 nt, Mus musculus
uuuccgcugccugaaugaccaaguu

SEQ ID NO: 49519 - RNA, 46 nt, Mus musculus
auacacaauuccucuauagucauuuuguuucuaaauaucagaugca

SEQ ID NO: 49520 - RNA, 61 nt, Mus musculus
uaccaaguuagagauugccuugaaccugcaguguacaccauucagguucuguggagagaug

SEQ ID NO: 49521 - RNA, 64 nt, Mus musculus
uuacaauuaaguuguaaaauggauccacagacuuuuaaugcaucuauagagccuaaaccaagcu

SEQ ID NO: 49522 - RNA, 42 nt, Mus musculus
guucugggagaaauggaggucacugcuauuauaccccccugc

SEQ ID NO: 49523 - RNA, 46 nt, Mus musculus
gcacuaccacugagcgguaucucuagcccuagagaauguuacagau

SEQ ID NO: 49524 - RNA, 42 nt, Mus musculus
gacagccagccugaugcaaaaaggaagucaugugaugaagga

SEQ ID NO: 49525 - RNA, 42 nt, Mus musculus
guucagugggagcuuugguuacaagacaaguuugaggcaggu

SEQ ID NO: 49526 - RNA, 46 nt, Mus musculus
gcuuguauuuaguugaaacacuccauuguuauaucaccccauuuua

SEQ ID NO: 49527 - RNA, 46 nt, Mus musculus
gaaauauuuuuaacuuuaaaagaauauaaaaauaaauuucaggguc

SEQ ID NO: 49528 - RNA, 45 nt, Mus musculus
cccaggucccccaaaagagcaagugucucuccacaaagacucagu

SEQ ID NO: 49529 - RNA, 46 nt, Mus musculus
acuggagcagggaagaauaaaacccucagcggggcaaacuccagau

SEQ ID NO: 49530 - RNA, 45 nt, Mus musculus
gggagaagauaaggauaaguuagauacagucauguggagugaaau

SEQ ID NO: 49531 - RNA, 46 nt, Mus musculus
gagaaugcuugggaagauuaaaagaauauauagggaguugggggug

SEQ ID NO: 49532 - RNA, 46 nt, Mus musculus
cauagagagaaguauuuugaaccuguuccccauggacucaggagaa

SEQ ID NO: 49533 - RNA, 46 nt, Mus musculus
gcugugcuugucaguuaaguguuucaccugcacggagcccguagag

SEQ ID NO: 49534 - RNA, 46 nt, Mus musculus
aaaaauggaaauuuaaaacuucuacuuauuucugguagugccagau

SEQ ID NO: 49535 - RNA, 46 nt, Mus musculus
aaguuugacuacuauaaguaucucauauguguagaaucaugcagug

SEQ ID NO: 49536 - RNA, 42 nt, Mus musculus
aagauuaaucagcaucucagcauuguauuucagccccacuua

SEQ ID NO: 49537 - RNA, 41 nt, Mus musculus
acugcugaauugauucauauaaacuuuauaacaauauggag

SEQ ID NO: 49538 - RNA, 27 nt, Mus musculus
auuaagcagagagacugugauggaaac

SEQ ID NO: 49539 - RNA, 46 nt, Mus musculus
agcagauaggucuauuucccacaagaugugcuauaaugcuguauau

SEQ ID NO: 49540 - RNA, 46 nt, Mus musculus
guuucaucagucgggcaugacagaacuuccauuagugauagcugua

SEQ ID NO: 49541 - RNA, 45 nt, Mus musculus
agcugugggcagcuucgaaggcgaugggacgaagcccagccagau

SEQ ID NO: 49542 - RNA, 47 nt, Mus musculus
cgaaagccucagccauguagauaaggaaaagggacuaacugcuagug

SEQ ID NO: 49543 - RNA, 42 nt, Mus musculus
auuuuuaacagaaugguaguagauucuaccuuggggccuuuu

SEQ ID NO: 49544 - RNA, 44 nt, Mus musculus
agagcccugcugcuuaccagagcugaaggaaagauguggggaga

SEQ ID NO: 49545 - RNA, 46 nt, Mus musculus
aacuccacguggugacugcaugguuaggguguaggaggcaagagag

SEQ ID NO: 49546 - RNA, 26 nt, Mus musculus
aggcuuuuguuuuuguaguuacagau

SEQ ID NO: 49547 - RNA, 45 nt, Mus musculus
ugcugucuuucuuccacuggaugguuuuagcucccuugccaaaga

SEQ ID NO: 49548 - RNA, 45 nt, Mus musculus
ggagaaaauauuucccagagguuacagauucuuucacgucuagau

SEQ ID NO: 49549 - RNA, 46 nt, Mus musculus
gaagaagaagaagaagaagaagaagaagaagaagaaagcagcucau

SEQ ID NO: 49550 - RNA, 46 nt, Mus musculus
ucagaaaugaugcaccuaacccucaaaagacuggaggccccaggga

SEQ ID NO: 49551 - RNA, 41 nt, Mus musculus
gagagagagacuggaggggauggggagagaagcaauagaga

SEQ ID NO: 49552 - RNA, 41 nt, Mus musculus
ugcaaaaagagccaacuuccugauagucacagaacccguau

SEQ ID NO: 49553 - RNA, 46 nt, Mus musculus
gguuuggagcuauugccaguguagagguuugucugguccacaagau

SEQ ID NO: 49554 - RNA, 42 nt, Mus musculus
ccccccuccuucucucccucuccuuuucccucaccccccccc

SEQ ID NO: 49555 - RNA, 46 nt, Mus musculus
acacagcagugucuguaguuucugguucccugacuucucaagagau

SEQ ID NO: 49556 - RNA, 46 nt, Mus musculus
gugugugugcaugugugugugugugugugugugcauguguaugugu

SEQ ID NO: 49557 - RNA, 45 nt, Mus musculus
auuauuggugugugugugugugugugugugugugugugcgcgugu

SEQ ID NO: 49558 - RNA, 46 nt, Mus musculus
gauugcugagaggaugugaaccagcagguagcugaacucaggagag

SEQ ID NO: 49559 - RNA, 36 nt, Mus musculus
cagccugcacuguaaacacuguagucgggagacuac

SEQ ID NO: 49560 - RNA, 45 nt, Mus musculus
ccugugcagagcaugcugagguagggaucacacugggccuggggg

SEQ ID NO: 49561 - RNA, 45 nt, Mus musculus
aggcucacagugacaugacuuuggguggugcgggguuggggucaa

SEQ ID NO: 49562 - RNA, 42 nt, Mus musculus
gugugugugugggugugugugugugugugugugggugugugu

SEQ ID NO: 49563 - RNA, 46 nt, Mus musculus
aaaucccagcagccacaugguggcucacaaccaucugucaugagau

SEQ ID NO: 49564 - RNA, 45 nt, Mus musculus
augucugucugucugucugucucucucucucucucucucugcaug

SEQ ID NO: 49565 - RNA, 45 nt, Mus musculus
ccuuuggcaguuaggcagugaucuguagaaagucuagcuugguga

SEQ ID NO: 49566 - RNA, 45 nt, Mus musculus
uuuuuugcaaauguaaacauggcuuaggauugcaaugcauuuggc

SEQ ID NO: 49567 - RNA, 46 nt, Mus musculus
auuggcuauguuuucauaagugaaggcucauugauaauggcuuggu

SEQ ID NO: 49568 - RNA, 45 nt, Mus musculus
ccuccagugaauucuggguaacuuguucucucuuuuccaugugua

SEQ ID NO: 49569 - RNA, 45 nt, Mus musculus
gagaaacaagacuacaguugugauaauggcuguguagcuggagua

SEQ ID NO: 49570 - RNA, 46 nt, Mus musculus
uucucucuugucauugucugacaagugagacacaccagugacgaca

SEQ ID NO: 49571 - RNA, 46 nt, Mus musculus
gucuccuggaaacaguuauucccaggccauggugcaaugcuuaguu

SEQ ID NO: 49572 - RNA, 44 nt, Mus musculus
uuugugugucagcgcggaggaggaagaguuggauggguggggaa

SEQ ID NO: 49573 - RNA, 46 nt, Mus musculus
cacacacacacacacacacacacacacacacacagaggauguaggu

SEQ ID NO: 49574 - RNA, 74 nt, Mus musculus
cauuguaaagugacucugacuuacagaauaauggguaauauucaacaauacaugaaacuuuagaaaaucucugu

SEQ ID NO: 49575 - RNA, 85 nt, Mus musculus
aucccagcaaccacaugguggcucauaaccaucugaaacaagaucugacgcccucuucuggagugucugaagacagcuacugugu

SEQ ID NO: 49576 - RNA, 46 nt, Mus musculus
uuaccuauuucuuaccugcgugugugcaugugcaguguguggagau

SEQ ID NO: 49577 - RNA, 46 nt, Mus musculus
aggguuaaugacgugcccgaugucacacagcccauaagaggcagag

SEQ ID NO: 49578 - RNA, 24 nt, Mus musculus
gggggguagugggaggggugagga

SEQ ID NO: 49579 - RNA, 46 nt, Mus musculus
ggaagaggagaggaagacagagaggaagagaagagaaagacagagg

SEQ ID NO: 49580 - RNA, 23 nt, Mus musculus
agauguguauaggugccagaggu

SEQ ID NO: 49581 - RNA, 45 nt, Mus musculus
agagaggcaauucuuaguuccaucuaaugcuuuuaaccagcaagg

SEQ ID NO: 49582 - RNA, 49 nt, Mus musculus
cccuguuuauuuucugagagacagaaggguuuacucuggaugggagggg

SEQ ID NO: 49583 - RNA, 45 nt, Mus musculus
guuuacaucaucaucauuacauauuuauuuuauuuauagcccucc

SEQ ID NO: 49584 - RNA, 46 nt, Mus musculus
caaggcacagcugugaucuugcacacugccugucagacccccuccc

SEQ ID NO: 49585 - RNA, 45 nt, Mus musculus
ugcaguuuaaaguagaugugugugugugugugugugugugugugu

SEQ ID NO: 49586 - RNA, 46 nt, Mus musculus
acaagugucauuuugguuggagaccaagaaguugaggacccagaac

SEQ ID NO: 49587 - RNA, 45 nt, Mus musculus
ugugguuccuggauacuuagcauggucccuacuugguucccaggu

SEQ ID NO: 49588 - RNA, 76 nt, Mus musculus
uugccucuggaaggucauucuucuagcuaugcccagcuaugcccagagaccuuagagggucucugucuccacccca

SEQ ID NO: 49589 - RNA, 46 nt, Mus musculus
aauaagaucugucacccucuucuggugucugaagacagcuacagug

SEQ ID NO: 49590 - RNA, 45 nt, Mus musculus
auuaauaguuuagccaggccuguuggcaagggccuguaccugagg

SEQ ID NO: 49591 - RNA, 45 nt, Mus musculus
ccccguccccgcuagcguugauuuaucacauagcaccaguucaga

SEQ ID NO: 49592 - RNA, 41 nt, Mus musculus
ccagagagaggggggaggaggaggaggaagaagaggaggag

SEQ ID NO: 49593 - RNA, 61 nt, Mus musculus
ggaagaggaggaagaggaggaagaagaggaggaggaagaagagaaggaggaggaagaggag

SEQ ID NO: 49594 - RNA, 46 nt, Mus musculus
gaaaaugggcaugcugccacaggccuguaauucuagcauucagagg

SEQ ID NO: 49595 - RNA, 42 nt, Mus musculus
uaaaauagaaaacaugauucuccccuugggauggauggaggu

SEQ ID NO: 49596 - RNA, 46 nt, Mus musculus
uuggcacugggaauaaggccgacacaugcaugaggcaaaggucaaa

SEQ ID NO: 49597 - RNA, 42 nt, Mus musculus
ccucugggaggagacuagcaaagauaagaaaccaggugugag

SEQ ID NO: 49598 - RNA, 46 nt, Mus musculus
ugggagucaccacagcauaaggaacuguauuaaaggguugcccccu

SEQ ID NO: 49599 - RNA, 46 nt, Mus musculus
ucuaaaacucguugaaaaagaaaauacccggaaccucugucaccga

SEQ ID NO: 49600 - RNA, 41 nt, Mus musculus
uucuauuugcagagaggaauggaaagagagaaagagggaga

SEQ ID NO: 49601 - RNA, 45 nt, Mus musculus
uggcccauugauguuauaaaacuauccugacaagggaaacuugag

SEQ ID NO: 49602 - RNA, 42 nt, Mus musculus
agauugacuguagcagcuagggugugugugugugugugugug

SEQ ID NO: 49603 - RNA, 42 nt, Mus musculus
caaguccaguucagugaccucuaaaguauuuuagugacgaug

SEQ ID NO: 49604 - RNA, 46 nt, Mus musculus
uacgguuuggugaagaagucauaaggugguuaaccaucuuugagag

SEQ ID NO: 49605 - RNA, 46 nt, Mus musculus
uuauuuccuuuagucaggagcaauucuggguuaaauuuuuugagau

SEQ ID NO: 49606 - RNA, 46 nt, Mus musculus
agcuuucguuuccugucagugaagagauuuuacauugggacaguug

SEQ ID NO: 49607 - RNA, 45 nt, Mus musculus
ggcaccucucacagugggcuaggaccucccccacugcucacuaau

SEQ ID NO: 49608 - RNA, 45 nt, Mus musculus
uuauguucacaggcaaauauaggcuaacuauaacucaguuuagca

SEQ ID NO: 49609 - RNA, 42 nt, Mus musculus
uuuucuuuugagacagggugugugugugugugugugugugug

SEQ ID NO: 49610 - RNA, 45 nt, Mus musculus
ugacugcucccaggucugguagagaagagaguuuaugguagaugu

SEQ ID NO: 49611 - RNA, 46 nt, Mus musculus
uguagcuauaacccccacgucacccccauccccacaggagacagaa

SEQ ID NO: 49612 - RNA, 31 nt, Mus musculus
gauucaaggccagacaaaugaugccaacuuc

SEQ ID NO: 49613 - RNA, 42 nt, Mus musculus
cuuucuccccuuugccgcugaaaauccauuuggcugcaagaa

SEQ ID NO: 49614 - RNA, 45 nt, Mus musculus
ugagaauggcugacaguucagagguguagucauuaucauccuggc

SEQ ID NO: 49615 - RNA, 46 nt, Mus musculus
agauaaugaacucaauaacuagugacuaguaaugguugcuggagga

SEQ ID NO: 49616 - RNA, 46 nt, Mus musculus
agauaaugaacucaauaacuaguaacuaguaaugguugcuggagga

SEQ ID NO: 49617 - RNA, 46 nt, Mus musculus
uauuaacacagauagaacuaaagauagcucagaaauagcaacagga

SEQ ID NO: 49618 - RNA, 42 nt, Mus musculus
gguaggugauccuuagauguugccgacuuccagccagcagcc

SEQ ID NO: 49619 - RNA, 23 nt, Mus musculus
cccacgauaacuggagcucuguc

SEQ ID NO: 49620 - RNA, 47 nt, Mus musculus
ugugugugagugugugugaguguguguguguguguguaugugugugu

SEQ ID NO: 49621 - RNA, 50 nt, Mus musculus
gagaguaugugugagugugugugagugugugugaguaugugaguguggau

SEQ ID NO: 49622 - RNA, 42 nt, Mus musculus
uauagagggcacgcucggcuacgucaccguccgcggcucccc

SEQ ID NO: 49623 - RNA, 42 nt, Mus musculus
gaagcgagcgcggugcagccggagcggcgcgcggggggaggg

SEQ ID NO: 49624 - RNA, 45 nt, Mus musculus
cuuaaagaaaaucaugaauggagucacaccaucuucacgguaguc

SEQ ID NO: 49625 - RNA, 45 nt, Mus musculus
ucaaaucucagcaaccacaugauggcucacaaccauccguaauga

SEQ ID NO: 49626 - RNA, 29 nt, Mus musculus
agcuugccuuuucuccccuuccugguugg

SEQ ID NO: 49627 - RNA, 45 nt, Mus musculus
acagccccguggaaaaaaaagagagagggcgggagggagcaagcu

SEQ ID NO: 49628 - RNA, 42 nt, Mus musculus
cucuuuuuuuuccacggggcuguuuuuuuaauuuggcugcaa

SEQ ID NO: 49629 - RNA, 41 nt, Mus musculus
ugcucuauuuuguugucgauagcuaccacacuugcaccaga

SEQ ID NO: 49630 - RNA, 42 nt, Mus musculus
caugucuuggaaacgacuagugcaucccuuagcuaaauccag

SEQ ID NO: 49631 - RNA, 45 nt, Mus musculus
ucucggccugcgccuggauuucuccgauuuuuuauuuccgccuug

SEQ ID NO: 49632 - RNA, 94 nt, Mus musculus
gaagaacaggagcagcauggagaugaaaaagaggaagaaaggaagggaagacagguggauaggacggacgaggaaagggaaaugaagaagggac

SEQ ID NO: 49633 - RNA, 45 nt, Mus musculus
acagcagcuaaacugaggggcuggggagagggcagaggucugugc

SEQ ID NO: 49634 - RNA, 45 nt, Mus musculus
gguaaugggccuagguaggaugugaugguaaagaagggagccaag

SEQ ID NO: 49635 - RNA, 46 nt, Mus musculus
auugguuuucuuucaucacgucuguuucucccacuguaaaagguag

SEQ ID NO: 49636 - RNA, 46 nt, Mus musculus
aagcucaaggacgguuagcugcugccuggaacucuucacggcugaa

SEQ ID NO: 49637 - RNA, 55 nt, Mus musculus
gaucuccagcaucacauaaaacacaacuauaaucuagcuuuugggaaggaagugg

SEQ ID NO: 49638 - RNA, 47 nt, Mus musculus
uccaucucuccagccucugcuuccucucacccaucaugcuccacgca

SEQ ID NO: 49639 - RNA, 82 nt, Mus musculus
agaaccccauccugcaugcugaagaggcagggugugaggacuagaucugagagcuugcugucuggagaucuguugccccccc

SEQ ID NO: 49640 - RNA, 25 nt, Mus musculus
aagucacacagcugauuaccagaaa

SEQ ID NO: 49641 - RNA, 46 nt, Mus musculus
acaugugagaagauguaaugaaucauaagaaaacacuaagccauuu

SEQ ID NO: 49642 - RNA, 46 nt, Mus musculus
cccuuccaaccuuguucacagaacucucgggccaaacuuucugaag

SEQ ID NO: 49643 - RNA, 42 nt, Mus musculus
uuacuacacccacacuuuccucuacauggggagcuaggacag

SEQ ID NO: 49644 - RNA, 46 nt, Mus musculus
ugauuaagcauuggcuggauauauuuuuaaaaauacgauaugaaag

SEQ ID NO: 49645 - RNA, 32 nt, Mus musculus
gcuuguguucaugcucuagcaggagaaacaga

SEQ ID NO: 49646 - RNA, 42 nt, Mus musculus
acguauguauguauaccacaugugugccuggugcccauggag

SEQ ID NO: 49647 - RNA, 41 nt, Mus musculus
acuaggcuccuuggauaggcaaacccgggcagggcuggugc

SEQ ID NO: 49648 - RNA, 42 nt, Mus musculus
cuucugaacacaccugaccuugaagucaccccagcugggcug

SEQ ID NO: 49649 - RNA, 45 nt, Mus musculus
uucuugagccuagauuuauuuuugagacuuaccuaaagcccacau

SEQ ID NO: 49650 - RNA, 46 nt, Mus musculus
agcccuggcagugucaaggcaucuuuaaacacacucgugagcacac

SEQ ID NO: 49651 - RNA, 46 nt, Mus musculus
uagaccacaugaucaccuuccagggacacccagcacaaggcugcaa

SEQ ID NO: 49652 - RNA, 42 nt, Mus musculus
aggugcaucuagaaagcagaccucaauuuuaaaagcccugua

SEQ ID NO: 49653 - RNA, 45 nt, Mus musculus
aaccuccaaaggaggucugguggcaguagaaagcaucuugcaguu

SEQ ID NO: 49654 - RNA, 45 nt, Mus musculus
ucagugcccaggcccugggcuccuuccucaguaaaaugcauagau

SEQ ID NO: 49655 - RNA, 42 nt, Mus musculus
agauagagagaaagaagauggaagauggacagauggacagac

SEQ ID NO: 49656 - RNA, 24 nt, Mus musculus
cuuaaauuuggguaguuaggggaa

SEQ ID NO: 49657 - RNA, 45 nt, Mus musculus
aaaggaguuuaauaacauuccuuccucucuguaagaguaucagau

SEQ ID NO: 49658 - RNA, 46 nt, Mus musculus
aagaggaggaauucuuccacagaacauucaagaccagaaggaagau

SEQ ID NO: 49659 - RNA, 42 nt, Mus musculus
acucaccgagacccuacguugacauccgaaaagccaccaggu

SEQ ID NO: 49660 - RNA, 45 nt, Mus musculus
uguguuucguguuagacugaucacgccagugaaguguggguuaug

SEQ ID NO: 49661 - RNA, 45 nt, Mus musculus
agaaaugccagcaaggaaaaggauggggaguauggccucugugaa

SEQ ID NO: 49662 - RNA, 46 nt, Mus musculus
gaguccagauggcuaauucuaaauauauacuuuuuucaccauaaaa

SEQ ID NO: 49663 - RNA, 46 nt, Mus musculus
caucgauguggccaaagucaauacccugauaaggcccgacggagag

SEQ ID NO: 49664 - RNA, 45 nt, Mus musculus; identical to SEQ ID NO: 36576

SEQ ID NO: 49665 - RNA, 57 nt, Mus musculus; identical to SEQ ID NO: 30074

SEQ ID NO: 49666 - RNA, 56 nt, Mus musculus
ccgaacgucacccaccuuccggcggcccaagacccugcggcuccggaggcagccaa

SEQ ID NO: 49667 - RNA, 46 nt, Mus musculus
aggguguaagacuguguuuguuggaggauuaccagaaaaugcaacg

SEQ ID NO: 49668 - RNA, 42 nt, Mus musculus
ugcucuaccaucauuauccggaggaccaggcuuuaggagaag

SEQ ID NO: 49669 - RNA, 27 nt, Mus musculus
gacgcuaacaaagaugaacagugccaa

SEQ ID NO: 49670 - RNA, 46 nt, Mus musculus
cucccuuucucuagcagcccccccucccagauaugcuccugcuaag

SEQ ID NO: 49671 - RNA, 46 nt, Mus musculus
caacauugcaaaauugccuggguaauuguggcuuugguagcggcag

SEQ ID NO: 49672 - RNA, 42 nt, Mus musculus
aggauuccggccgccugcacguggauuuugcucaggccaggg

SEQ ID NO: 49673 - RNA, 41 nt, Mus musculus
ggauuccugacgaaaggagagaugugauugguucuuggcaa

SEQ ID NO: 49674 - RNA, 46 nt, Mus musculus
cuaccccuccaaugagaaaaaauaugcaauguaaauucagccuaga

SEQ ID NO: 49675 - RNA, 46 nt, Mus musculus
ucuucauuaauuaacgaguuaaaugacaucauuggaacaugcccag

SEQ ID NO: 49676 - RNA, 41 nt, Mus musculus
uauaacagggucccuucagcaaaaucuuucugucugccaca

SEQ ID NO: 49677 - RNA, 46 nt, Mus musculus
cuuaccaaacaugaagaagaggucgcacaaagucggaaauaaccag

SEQ ID NO: 49678 - RNA, 46 nt, Mus musculus
cagauguagaacaagauagcauagauucagcuggagucacugagag

SEQ ID NO: 49679 - RNA, 46 nt, Mus musculus
aggcacaucugcacacuccaguuucuaaacuucacuuccugcucag

SEQ ID NO: 49680 - RNA, 46 nt, Mus musculus
acuccauauugaauggcacaccucauaaccgacucauguucugugg

SEQ ID NO: 49681 - RNA, 46 nt, Mus musculus
uucccauucuaccuuaaguauccuucacccuucucagcugccacag

SEQ ID NO: 49682 - RNA, 45 nt, Mus musculus
ggcaagcggguaggcaggacccacgugauguccaguuugccucag

SEQ ID NO: 49683 - RNA, 46 nt, Mus musculus
gaaaaagaauuuuaugaaguguuaaaauguuuucccaugccuguag

SEQ ID NO: 49684 - RNA, 45 nt, Mus musculus
acuagaacauuaaaugcuuuaaauauuauuucuaagagaaaggga

SEQ ID NO: 49685 - RNA, 41 nt, Mus musculus
aaaggaaaggaaaggaaaggaaaggaaaggaaagaggggaa

SEQ ID NO: 49686 - RNA, 42 nt, Mus musculus
cauagcugggaaccgggaguacacugcacagccugcaggcag

SEQ ID NO: 49687 - RNA, 45 nt, Mus musculus
ucuuuguccucgaaaauuuuacuugccuugaagucacagcccacu

SEQ ID NO: 49688 - RNA, 45 nt, Mus musculus
gugcucaaagacuuuggucuauguggguaaguauggauagaugag

SEQ ID NO: 49689 - RNA, 42 nt, Mus musculus
uaccuagauagugucaacuagucagguaccuccacaccccag

SEQ ID NO: 49690 - RNA, 46 nt, Mus musculus
ccacuaaacaauucucucagaaucauuuggaccccaguggacaccc

SEQ ID NO: 49691 - RNA, 45 nt, Mus musculus
ugaaacaaagcaaggugcaggaacagugucagcacaaaaggcgca

SEQ ID NO: 49692 - RNA, 46 nt, Mus musculus
uugagucaguaguggagacuagucaggacaccugucagauuuauaa

SEQ ID NO: 49693 - RNA, 42 nt, Mus musculus
caaggaacacaaaguggagccagaggaauccuaagaggcacu

SEQ ID NO: 49694 - RNA, 45 nt, Mus musculus
gguccaucaguguccuauaaggacaaccauuacaucacagcagga

SEQ ID NO: 49695 - RNA, 44 nt, Mus musculus
uugcaaccaaauggcccuaccacgaguguggccaccauaagaag

SEQ ID NO: 49696 - RNA, 50 nt, Mus musculus
gcaaugguuuucaguguauuccuuagucaugcagucccuaucacagccag

SEQ ID NO: 49697 - RNA, 42 nt, Mus musculus
uucuaaggagaacucuauaagagauggagauaacacccggag

SEQ ID NO: 49698 - RNA, 45 nt, Mus musculus
acauuagaagaucugaaagagaauucucuuuuguaacagagcccu

SEQ ID NO: 49699 - RNA, 46 nt, Mus musculus
ucauuguccccuccacauccagcuccacuucauuucuuguccagag

SEQ ID NO: 49700 - RNA, 53 nt, Mus musculus
cuccuacauguugcuuaauugauuaaauaccaguuguaauuucacauugugga

SEQ ID NO: 49701 - RNA, 35 nt, Mus musculus
guuaauuaucugcaacaccucuacagauuuauuag

SEQ ID NO: 49702 - RNA, 46 nt, Mus musculus
ucuuuccaccugguuuuuccuuguuuggauguuuuccagccaccuc

SEQ ID NO: 49703 - RNA, 46 nt, Mus musculus
aaaauuccccgcuaaucacacaugauauccaccgccaaagccugag

SEQ ID NO: 49704 - RNA, 46 nt, Mus musculus
gaacgcucaaagcgagcagcucaugggcauccgccgugaggaggag

SEQ ID NO: 49705 - RNA, 46 nt, Mus musculus
gggaacacagugauuuaaauugcuccaguuguuucuccauaugcag

SEQ ID NO: 49706 - RNA, 55 nt, Mus musculus
aaggaccagcuguuuucccauauccugucggccugggauaccuccugagagaaua

SEQ ID NO: 49707 - RNA, 42 nt, Mus musculus
ucuuaccaacggacaucaaauaaaggcauauuuuaggucgau

SEQ ID NO: 49708 - RNA, 46 nt, Mus musculus
cugucucccugcucccaggguuuuucuuuaugagauaugccucuaa

SEQ ID NO: 49709 - RNA, 42 nt, Mus musculus
cauuuacugaauccuuacagugugucugggaccagggcuuuu

SEQ ID NO: 49710 - RNA, 45 nt, Mus musculus
ugaaugagcuguccuuucaggucauuaaauccugagcaaacaggg

SEQ ID NO: 49711 - RNA, 45 nt, Mus musculus
aggcuccuaaggaauauucuaauugaugccggaucaucagcccug

SEQ ID NO: 49712 - RNA, 46 nt, Mus musculus
uccuccuccuccuccuccuccuccucuucuuuuucuucuaaauaag

SEQ ID NO: 49713 - RNA, 111 nt, Mus musculus
acaaaggauggagagggauuuuaacaugagggucaaugguucuuugugguaggugggaagggaaagagcaagauaagacaagguaacaggaugagagagagagagagagag

SEQ ID NO: 49714 - RNA, 46 nt, Mus musculus
augguaccaugugcgugcgugugugugugugugugugugugugugu

SEQ ID NO: 49715 - RNA, 23 nt, Mus musculus
agaggcuggggacauagggaaua

SEQ ID NO: 49716 - RNA, 46 nt, Mus musculus
ucaaagaaaucuuuacacagaguuuaaagauguuggguccacacac

SEQ ID NO: 49717 - RNA, 62 nt, Mus musculus
auguugguuuucuaaaguugaaagugcccaggcguguuucagcugcugguguaguuauuuga

SEQ ID NO: 49718 - RNA, 44 nt, Mus musculus
acuguaguuuuuccucaauugaacauagagacacggggccugcc

SEQ ID NO: 49719 - RNA, 52 nt, Mus musculus
gaauuaguaauuauggugaaguuauuuuuauagagaugucagauuugcuuug

SEQ ID NO: 49720 - RNA, 83 nt, Mus musculus
aggugaccaggcugugucucugugucugagauuugugaagaugggagggucuccccuaaccgauucuggaaucuaaagcaggu

SEQ ID NO: 49721 - RNA, 46 nt, Mus musculus
aauucagguuguaaaauaaauugaaauuuuaaaaauuaauguagaa

SEQ ID NO: 49722 - RNA, 46 nt, Mus musculus
aaaaccacuauuaacauuaaauaaaacgucuaaauauugugcagua

SEQ ID NO: 49723 - RNA, 42 nt, Mus musculus
ugaggccccaaguagaugagugccauacuggaaggugcuacg

SEQ ID NO: 49724 - RNA, 34 nt, Mus musculus
acaauuguauuucaaaaaauauaaacauauuagg

SEQ ID NO: 49725 - RNA, 46 nt, Mus musculus
ugugaauagaaggcugauacaaugaaaaaucaauauaagguuagau

SEQ ID NO: 49726 - RNA, 46 nt, Mus musculus
cagaugaguuagugaaugucucaguuuccuuaauugcaugugggau

SEQ ID NO: 49727 - RNA, 46 nt, Mus musculus
ugauuggauaaacuuuacuuccuauuguuuaaauuuacuacuagau

SEQ ID NO: 49728 - RNA, 47 nt, Mus musculus
auacuuaaacucacuccaaauaguauuuuacauuugugccaucagua

SEQ ID NO: 49729 - RNA, 95 nt, Mus musculus
cuagagugccuuauauacuauaacagaaaaauguccaucaaccacaaagaaauucaccaacauuuccauuaucaguacauaccggcuuaaggacu

SEQ ID NO: 49730 - RNA, 49 nt, Mus musculus
cauaggaaagacaacauacacuuacuuuugauugauacuggcacaaaga

SEQ ID NO: 49731 - RNA, 46 nt, Mus musculus
ggguauuuugccuauaucugugugcaguauccaacaaggccaaaag

SEQ ID NO: 49732 - RNA, 42 nt, Mus musculus
gugacaaaaugcuugccaaaugggaaggagguucaugcaggg

SEQ ID NO: 49733 - RNA, 41 nt, Mus musculus
gagcagucuugguuuagaaggagauuuguaugaggacaauu

SEQ ID NO: 49734 - RNA, 46 nt, Mus musculus
aauaaauguaaguuuagaaugauuccauguuguuuugaggacaaug

SEQ ID NO: 49735 - RNA, 45 nt, Mus musculus
aagguuggcaguaagcaguuugaauuuacacuuuaaauaggaagg

SEQ ID NO: 49736 - RNA, 46 nt, Mus musculus
uacaugcaaauuuucuaguuaacuuuguucacaauagccuccuuug

SEQ ID NO: 49737 - RNA, 45 nt, Mus musculus
gguaacaggaaaaaguguuaaauaaaauaaaguugugguggaaga

SEQ ID NO: 49738 - RNA, 46 nt, Mus musculus
gcauucgucagaaaucaagaauuuuucaucuugauguaccucagau

SEQ ID NO: 49739 - RNA, 45 nt, Mus musculus
ggacccacaguuuuucauaauucagagaccacagcaucagcagau

SEQ ID NO: 49740 - RNA, 45 nt, Mus musculus
uuugcaaauaccagacaugugaaaggacacaggauccguguagaa

SEQ ID NO: 49741 - RNA, 45 nt, Mus musculus
ccuaccggucugucacugcagcagcucgggaagcagcuaagacag

SEQ ID NO: 49742 - RNA, 93 nt, Mus musculus
gacgugcacuuuugcaagugauauggcagcugaugucauugcagaagccgagaagauugcaaacgcuagaagcuguaugcuuuucaggcauga

SEQ ID NO: 49743 - RNA, 48 nt, Mus musculus
aaguugagagcagugaaggugaagaacacccaggaaugcauguaaagg

SEQ ID NO: 49744 - RNA, 46 nt, Mus musculus
agcaaacaacucaagggggaguuagccaaagaauuugcacccgcaa

SEQ ID NO: 49745 - RNA, 46 nt, Mus musculus
uaaaagcaagucaaugcuuccaaauagagauaaaaaacccgguagu

SEQ ID NO: 49746 - RNA, 46 nt, Mus musculus
aauaaagggaaaagccuguucuccuucccuuugugaccaagcagca

SEQ ID NO: 49747 - RNA, 46 nt, Mus musculus
uacccaagaacacauugccauagaacgcagugcagaggaaguagau

SEQ ID NO: 49748 - RNA, 42 nt, Mus musculus
cugucacagacuaaugugacguuuacaacaaaggcagcaguu

SEQ ID NO: 49749 - RNA, 46 nt, Mus musculus
gucauuugacuuugaagacaaagucgugaaguccuaugccaaagau

SEQ ID NO: 49750 - RNA, 53 nt, Mus musculus
aaaaguaaauguaaaaaaucuucagugauuacagguagcguucagaaguuugc

SEQ ID NO: 49751 - RNA, 46 nt, Mus musculus
cuaggcucaguucuucauacucaacaugcaaacacaaugucagaua

SEQ ID NO: 49752 - RNA, 48 nt, Mus musculus
uuccauagaggaugacuuugucacugcuuuugagcaguuagaggagga

SEQ ID NO: 49753 - RNA, 36 nt, Mus musculus
acacacccuggacaugcacgcgcauccgcagcacca

SEQ ID NO: 49754 - RNA, 46 nt, Mus musculus
agagacuagagugauagaagguucuauaacauccaaggaguuagau

SEQ ID NO: 49755 - RNA, 46 nt, Mus musculus
ugcagucuaagugaaaaugaaaucauuuguaugaaggauaccagua

SEQ ID NO: 49756 - RNA, 28 nt, Mus musculus
ggacaguccagugauggcggaaguaaga

SEQ ID NO: 49757 - RNA, 36 nt, Mus musculus
ucagccuuggugugauaggguucuauagggcaggau

SEQ ID NO: 49758 - RNA, 45 nt, Mus musculus
gcucugguucuuuuaauugcugguuuguguuuagaaaccacaauc

SEQ ID NO: 49759 - RNA, 46 nt, Mus musculus
ccaauuuagccuuugagcgcuucucuguauucuggcacaguuagau

SEQ ID NO: 49760 - RNA, 46 nt, Mus musculus
aaucuuaguauuuauggaaauuauaacauuaaaauacuaugaaggc

SEQ ID NO: 49761 - RNA, 46 nt, Mus musculus
uguguguguguguguguguguguguguguguaagagauugaguggu

SEQ ID NO: 49762 - RNA, 46 nt, Mus musculus
auuaaacuauucuuggcuuagucuguuuuguguugcucuaacaaaa

SEQ ID NO: 49763 - RNA, 46 nt, Mus musculus
gaaaauucacccccaacaaccuacauagcaccuuccagcacuauua

SEQ ID NO: 49764 - RNA, 46 nt, Mus musculus
cacugcucacuguuuuuguuaauucuguuugguuucucuggugguc

SEQ ID NO: 49765 - RNA, 46 nt, Mus musculus
guuuguguauuuucuuuuugaaguuguauuuacagucgcuuuagag

SEQ ID NO: 49766 - RNA, 46 nt, Mus musculus
ugguugugagccaccaugugguugcugggaauugaacucauuaccu

SEQ ID NO: 49767 - RNA, 45 nt, Mus musculus
uaguccuaaaaaggacuugagccuuucagacugcuucagcaaggu

SEQ ID NO: 49768 - RNA, 46 nt, Mus musculus
cacagggaaaacaugcuuuaccaucuuaaaagcaaauggggcagau

SEQ ID NO: 49769 - RNA, 41 nt, Mus musculus
uuuucauuuuuucuuuuucuuuuugugaaguggccccagua

SEQ ID NO: 49770 - RNA, 45 nt, Mus musculus
uaauuccaaagacuuagugucugggaaaggaacucagccaauucc

SEQ ID NO: 49771 - RNA, 46 nt, Mus musculus
aggggacacauuucugugucccuuagcaaaagaaaggucucaacuu

SEQ ID NO: 49772 - RNA, 46 nt, Mus musculus
uaaucacagugcucuguaaguuaaauuucuugaauaaacaccaguc

SEQ ID NO: 49773 - RNA, 91 nt, Mus musculus
uuucucgauuuuuguagucacagcguauagcuagcacauaauaggucuuugacauaauguuuuugaauauuauuuucauacugucgcaaau

SEQ ID NO: 49774 - RNA, 45 nt, Mus musculus
ggugguuguuuaauccaucucaaugauaacuuucaggccaauauu

SEQ ID NO: 49775 - RNA, 46 nt, Mus musculus
agugcuuuugcuucagucugccuacagcauguuuuuguugguuguu

SEQ ID NO: 49776 - RNA, 42 nt, Mus musculus
uagauagugcaggaacuugagacgguuugccaaggcccagga

SEQ ID NO: 49777 - RNA, 45 nt, Mus musculus
cucugaagcaccucucccgacugauauuuugcugugggugaaagu

SEQ ID NO: 49778 - RNA, 45 nt, Mus musculus
aaggaagaaggaaggaaggaaggaaggaaggaaggaaggaaagaa

SEQ ID NO: 49779 - RNA, 46 nt, Mus musculus
aucuguggccauuuauuguugcaguuaucaguaagagucaguagag

SEQ ID NO: 49780 - RNA, 50 nt, Mus musculus
cauaaggggaaaaaaaguagguuuuugcauggaagauuugaaagaacagu

SEQ ID NO: 49781 - RNA, 45 nt, Mus musculus
gagccuccucuggauuguaccaaaagaaacaacaaaagcacaguc

SEQ ID NO: 49782 - RNA, 45 nt, Mus musculus
cgagagacacugccaccgagauagccaucaacgucaaggcgcucu

SEQ ID NO: 49783 - RNA, 46 nt, Mus musculus
guguguguguaugugugugugugugugugugugugugugcuugcau

SEQ ID NO: 49784 - RNA, 46 nt, Mus musculus
agaugcuaugugauggaaaaaagaagcuaaaaacaguaaaguagaa

SEQ ID NO: 49785 - RNA, 42 nt, Mus musculus
uaaccuugguaggagcugucucuguaagggugcagcuucagg

SEQ ID NO: 49786 - RNA, 45 nt, Mus musculus
gaauuuaauaauaagagagaggagcacccugaaaaaugcagguaa

SEQ ID NO: 49787 - RNA, 46 nt, Mus musculus
gagauggauacucugaaaaaugugucaugaacaacuacuuugggau

SEQ ID NO: 49788 - RNA, 46 nt, Mus musculus
ugaauucagaaguugcuuucuuacaguuuguccacuauuaaggguu

SEQ ID NO: 49789 - RNA, 46 nt, Mus musculus
gguuucauuugucauuuuuaaucuggauuuuugucaacagccaaaa

SEQ ID NO: 49790 - RNA, 45 nt, Mus musculus
aucaguauaucucccuuggaagauauccuccacaugucucaagag

SEQ ID NO: 49791 - RNA, 45 nt, Mus musculus
uugaauuugaaaagauuugcuuuuuauuuuugcuucugugcacgc

SEQ ID NO: 49792 - RNA, 46 nt, Mus musculus
caaggcagcgucuuuacuuuuaaaguccaugaaggggucucuguac

SEQ ID NO: 49793 - RNA, 46 nt, Mus musculus
cucaaccuguggguugugacuccauugggucaggcauccugcagau

SEQ ID NO: 49794 - RNA, 46 nt, Mus musculus
cguuucuauuggaaaaucccgaguuuauagcauggaaugcauauga

SEQ ID NO: 49795 - RNA, 46 nt, Mus musculus
cucugugugugucucugugugugucugugucugugucucugugugu

SEQ ID NO: 49796 - RNA, 42 nt, Mus musculus
gacuuaacacuaaaaaugaauguuuuacuuucagcuugagau

SEQ ID NO: 49797 - RNA, 46 nt, Mus musculus
aguuuauucaguguauggagaggggaguuaagagagaugggggagg

SEQ ID NO: 49798 - RNA, 52 nt, Mus musculus
gugucccccauguuguauuuauaaaaagagagaaggaauauguuuuggugga

SEQ ID NO: 49799 - RNA, 59 nt, Mus musculus
ggcauugcuguuauaggugaugcauguuggcuuucuggaaugucuuuuuuucucuguuc

SEQ ID NO: 49800 - RNA, 41 nt, Mus musculus
gcugacccgcugcagcagggacugccuuccccugggcuagg

SEQ ID NO: 49801 - RNA, 45 nt, Mus musculus
ccucugguugguuacugaugaucauuagaucgaaccgucccuuuc

SEQ ID NO: 49802 - RNA, 46 nt, Mus musculus
cuugcuggaaucguuuagaacggaagcaccugucuaguucugagau

SEQ ID NO: 49803 - RNA, 46 nt, Mus musculus
guaagcugacauuugaaaagcaagcaaaccagaagauugugagaua

SEQ ID NO: 49804 - RNA, 46 nt, Mus musculus
ugaauggucuccccaguaccccaccauuauuauuucugaauaagaa

SEQ ID NO: 49805 - RNA, 46 nt, Mus musculus
cauuucucacacacuguaaaacccccaacgccacgccauaugagau

SEQ ID NO: 49806 - RNA, 46 nt, Mus musculus
caaaggcguguuuuuguuuugaggggaaaacagacuaguaacagaa

SEQ ID NO: 49807 - RNA, 46 nt, Mus musculus
ucuccgaggaaggcaacaugguuuacuugaacuucagcgugugugu

SEQ ID NO: 49808 - RNA, 46 nt, Mus musculus
gcccauuguuagaacuccacagucaucuucuuccuugucagcagaa

SEQ ID NO: 49809 - RNA, 41 nt, Mus musculus
agaagaagaagaagaagaagaaaaagaaagaaaggaaggaa

SEQ ID NO: 49810 - RNA, 64 nt, Mus musculus
uuaaaaaaugggauguaaauugaauaaguaauaaaaaagaagaagaaagaagaggaggaggaga

SEQ ID NO: 49811 - RNA, 46 nt, Mus musculus
gcucccccuggcugugccugaugaaauccuuccucuugccccauuc

SEQ ID NO: 49812 - RNA, 45 nt, Mus musculus
ggccaguggucaccugggcccauugcuuguguccuguggugagau

SEQ ID NO: 49813 - RNA, 46 nt, Mus musculus
uacugaaguuucagaagcauuuuguuaccguuaaauugcauugauu

SEQ ID NO: 49814 - RNA, 23 nt, Mus musculus
ucauaggaauguaagcgugggac

SEQ ID NO: 49815 - RNA, 46 nt, Mus musculus
ugacaugggcuuuugaaaccucaaagccauccccacauccccagag

SEQ ID NO: 49816 - RNA, 46 nt, Mus musculus
uaucucccccgagcccugggccucucacucuuuuauacucucaggu

SEQ ID NO: 49817 - RNA, 46 nt, Mus musculus; identical to SEQ ID NO: 49816

SEQ ID NO: 49818 - RNA, 45 nt, Mus musculus
gauuggagcugucguggagggaguucacuuagauuugcacacagg

SEQ ID NO: 49819 - RNA, 41 nt, Mus musculus
cuuagggagaugaugguguugcugacaagcgagguccccgg

SEQ ID NO: 49820 - RNA, 46 nt, Mus musculus
aaauuaagaguagacucauuccagacauguggguccaaccggagag

SEQ ID NO: 49821 - RNA, 45 nt, Mus musculus
ccuuccaaggggaauguacagagggauuuccugacuuugcacagg

SEQ ID NO: 49822 - RNA, 44 nt, Mus musculus
uaguuguaagccacugaugugcgugcuaggaacugcggccaggu

SEQ ID NO: 49823 - RNA, 46 nt, Mus musculus
ugugcgccacuacucccggcgcuaaaauguuuuuaauagacuagag

SEQ ID NO: 49824 - RNA, 46 nt, Mus musculus
aacagugacaggaaaaagguggaagaggaaagaucacagccaagug

SEQ ID NO: 49825 - RNA, 42 nt, Mus musculus
cagccuuguucugcugugggagacagacauuuggggcaaagc

SEQ ID NO: 49826 - RNA, 46 nt, Mus musculus
ccucagagccugagagggacuucacaguuuguucuuguugccagug

SEQ ID NO: 49827 - RNA, 46 nt, Mus musculus
aguagcacuuucaagaagguuaugugagcacucacgaugcagagga

SEQ ID NO: 49828 - RNA, 45 nt, Mus musculus
uuucccggaaacaacuacaauuaauauuauguauccuguuccaga

SEQ ID NO: 49829 - RNA, 42 nt, Mus musculus
uaaccuauaaagaaaacaccuucauucucuuaauuugcagau

SEQ ID NO: 49830 - RNA, 42 nt, Mus musculus
aggugugcugacgugaugcuguagaauauguccggggcagga

SEQ ID NO: 49831 - RNA, 42 nt, Mus musculus
cuccucuuauauacgugucagagugcggacauggggaaaggu

SEQ ID NO: 49832 - RNA, 46 nt, Mus musculus
acaaaaaagaaaacagaaaucaaaaguuuacuauauccuggcauau

SEQ ID NO: 49833 - RNA, 81 nt, Mus musculus
cauaggcacgggaagaauggugguugucaagcuuggggaggggaugguaguagguaguuguuuaaugguuuuacuuccaga

SEQ ID NO: 49834 - RNA, 46 nt, Mus musculus
auggaauuaagccugagauugaaacuuuguucaaauuaggaaagga

SEQ ID NO: 49835 - RNA, 45 nt, Mus musculus
cagaguggguucuagaaguuauuuggacacgagugacugcgagaa

SEQ ID NO: 49836 - RNA, 45 nt, Mus musculus
ugucagccugguauagacccugaucagcugcagggcugggguaaa

SEQ ID NO: 49837 - RNA, 53 nt, Mus musculus
caauaaaaugggaagcuaaguuaucagcugggaaucacgguggaaaagauggu

SEQ ID NO: 49838 - RNA, 44 nt, Mus musculus
uuccuaggagcccguccacuuggccucagcauuaagcagaggga

SEQ ID NO: 49839 - RNA, 46 nt, Mus musculus
gaggacuguccaucugggagugugugugugugugugugugugugug

SEQ ID NO: 49840 - RNA, 42 nt, Mus musculus
cgggguccauacccuuaaaaugucuuucccuugcccagaaac

SEQ ID NO: 49841 - RNA, 41 nt, Mus musculus
ugcaaucaucuggggcagaacucugccuacuucccuaaaga

SEQ ID NO: 49842 - RNA, 41 nt, Mus musculus
caaaaacaaacaaacaaaaaaagaauuaucucggccaaggu

SEQ ID NO: 49843 - RNA, 45 nt, Mus musculus
gaacucugaugcccgcaaagacacuuccuugggucggguugucag

SEQ ID NO: 49844 - RNA, 45 nt, Mus musculus
aaggucucaucugagagaucuaaaacuucacugaagggcugugag

SEQ ID NO: 49845 - RNA, 42 nt, Mus musculus
uucagcuacacugagacgaauuaccauggcaaauaucagaag

SEQ ID NO: 49846 - RNA, 46 nt, Mus musculus
aaagaaacaaacaaaaaaaacgaaagcaauuucuagggcuggagag

SEQ ID NO: 49847 - RNA, 43 nt, Mus musculus
gugugugugugugugugugugagagagagagagagagcacaga

SEQ ID NO: 49848 - RNA, 45 nt, Mus musculus
uucugugucagcuugaaacaaucggcaaucacaagacugucuagc

SEQ ID NO: 49849 - RNA, 44 nt, Mus musculus
gcguccucuuaggcugcugaugaaaaauuaaguaauggccggau

SEQ ID NO: 49850 - RNA, 45 nt, Mus musculus
cgcccucuucuggggcaucugaagacagcuacaguguacuuacau

SEQ ID NO: 49851 - RNA, 66 nt, Mus musculus
auaggagcagguagauuucugugucuuucagggcuacuuagugagauccuaucuuggauggaugga

SEQ ID NO: 49852 - RNA, 45 nt, Mus musculus
caugaucugaaaauuaauagaauuauuuuguuuucaaaggaacag

SEQ ID NO: 49853 - RNA, 46 nt, Mus musculus
auuauagaaggucauaagccaccauguggcugggaauugaacucau

SEQ ID NO: 49854 - RNA, 46 nt, Mus musculus
uccaagauguacauuuuaaaaaauauuuauuuugggggcuggugag

SEQ ID NO: 49855 - RNA, 42 nt, Mus musculus
gcaaaaaccauuaaccugcugaaccaucuugccagcccccaa

SEQ ID NO: 49856 - RNA, 46 nt, Mus musculus
gcugaagccucucgucuagagaaccuaguaucgguaaaaaggugag

SEQ ID NO: 49857 - RNA, 46 nt, Mus musculus
acaaaacaaaaaccuuauuaaaagagauucuuuauagagguaacag

SEQ ID NO: 49858 - RNA, 45 nt, Mus musculus
gcugugagccaccaugugguugcuaggauuugaacucagggcuuu

SEQ ID NO: 49859 - RNA, 45 nt, Mus musculus
caaaucccagcaaccacauggugucucacaaccauccguaacgag

SEQ ID NO: 49860 - RNA, 41 nt, Mus musculus
aaagaagcagaugcaagggaguccagaguuuacggcagccu

SEQ ID NO: 49861 - RNA, 45 nt, Mus musculus
uccauacccugagauggucggucaacuugacacauucuaggauca

SEQ ID NO: 49862 - RNA, 45 nt, Mus musculus
ucgauaaccuucaaggucucucaucugaaucugcaauagagagag

SEQ ID NO: 49863 - RNA, 46 nt, Mus musculus
aaaacuaccauacuuacauggccuuucucuacacuauaggguaaag

SEQ ID NO: 49864 - RNA, 46 nt, Mus musculus
cuauuaacucauuuucuuuucuaaaucuuuaagagccccgcaacau

SEQ ID NO: 49865 - RNA, 80 nt, Mus musculus
gacaagccucacggcacugucggugguguuaacaugcugccccccugcuccucuggcucgaaaugugucuacucgcagau

SEQ ID NO: 49866 - RNA, 46 nt, Mus musculus
uggugugaugcagggcggcaagguuauaagcccggcacuuggggag

SEQ ID NO: 49867 - RNA, 24 nt, Mus musculus
gggaaggacugaaaaaggagaagg

SEQ ID NO: 49868 - RNA, 45 nt, Mus musculus
auuuguuuagagaccauaaaguuagaaggauagggagguggaagg

SEQ ID NO: 49869 - RNA, 24 nt, Mus musculus
acucaauccaaauaauuguacugc

SEQ ID NO: 49870 - RNA, 44 nt, Mus musculus
gguacagauaccaauuuugacaccuggauuaaaagaugccaaga

SEQ ID NO: 49871 - RNA, 46 nt, Mus musculus
ggcuauaaagagaaacccugucucaaaaaacaaaaaacaaaaaaag

SEQ ID NO: 49872 - RNA, 49 nt, Mus musculus
cuguucgggccuuagaauauuuggaauugaaucuaggugugugccuggg

SEQ ID NO: 49873 - RNA, 50 nt, Mus musculus
uuauauguaaguacacuguagcugacuucagacacacccgaagagggcau

SEQ ID NO: 49874 - RNA, 45 nt, Mus musculus
gguaugacugguaucaaaccgagucucacguaaucaucacccuua

SEQ ID NO: 49875 - RNA, 45 nt, Mus musculus
gaacuguaggguauggugacuccuaccuguaauuccagcauccag

SEQ ID NO: 49876 - RNA, 45 nt, Mus musculus
ugaaaucuuugaucauuuccuuuuucaaacagcagagggaggcag

SEQ ID NO: 49877 - RNA, 42 nt, Mus musculus
ggcuguucgugcuucucagcauccaggagauaagcacaggag

SEQ ID NO: 49878 - RNA, 46 nt, Mus musculus
auaugggcucuaaaaaaagcagagaaggcaaucccugcuaccacag

SEQ ID NO: 49879 - RNA, 23 nt, Mus musculus
aaguagaacuucaaguuggauca

SEQ ID NO: 49880 - RNA, 45 nt, Mus musculus
uuuguacccuggccuccugaaguucacggucauuguguagcugaa

SEQ ID NO: 49881 - RNA, 42 nt, Mus musculus
uuuguauaaguuuugacuguguguuugugugugugccuggug

SEQ ID NO: 49882 - RNA, 46 nt, Mus musculus
gcugggucauuuaguuugucuguuuuccaguuauuugagugccaag

SEQ ID NO: 49883 - RNA, 51 nt, Mus musculus
gcuuccaugugggugcugggaauugaaccuggguccucuggaagaguagcc

SEQ ID NO: 49884 - RNA, 46 nt, Mus musculus
uaauauuuucuauugaaguaaucuaauguguguguguguguaggag

SEQ ID NO: 49885 - RNA, 55 nt, Mus musculus
caucucacuauacccggaacugggauaaguugguuggcgaaaucaaagaagaaga

SEQ ID NO: 49886 - RNA, 45 nt, Mus musculus
aaauguugaauuuauauugaauuauuuuuaguagccuacauaugg

SEQ ID NO: 49887 - RNA, 42 nt, Mus musculus
aaggaaaguugaaaucaacccucccgaugauauggaauggaa

SEQ ID NO: 49888 - RNA, 46 nt, Mus musculus
cagacucugugagccuccuccaugugggugcugauaaccacgccag

SEQ ID NO: 49889 - RNA, 45 nt, Mus musculus
auagagacuaugacaggacagucacuuuacucuccccuccccguc

SEQ ID NO: 49890 - RNA, 46 nt, Mus musculus
uaugucaaguuaucuucauggaaagcaugugccauccucuccagcu

SEQ ID NO: 49891 - RNA, 42 nt, Mus musculus
cgcgccgucggggccuucgcugcagugggacacgccgcugau

SEQ ID NO: 49892 - RNA, 46 nt, Mus musculus
uuuuguagaugacaucucuaauccucauacuguagaagaugaagca

SEQ ID NO: 49893 - RNA, 46 nt, Mus musculus
gagagcgugugugugugugugugugugugugugugugugguguaug

SEQ ID NO: 49894 - RNA, 46 nt, Mus musculus
agaagauugauuguacauuauucuacgauuagguauuugggguaag

SEQ ID NO: 49895 - RNA, 46 nt, Mus musculus
uucaaaaucauccaccaagccaggcuuggccacauuggcccuguag

SEQ ID NO: 49896 - RNA, 44 nt, Mus musculus
uuagcacccgucucgucuccagcugcuuugccagagcugccgcc

SEQ ID NO: 49897 - RNA, 45 nt, Mus musculus
ggucugccacuucuugaccauggagcacauuuugucccggguaag

SEQ ID NO: 49898 - RNA, 46 nt, Mus musculus
cagugauuagcuugaauuuucuaaacgcaacuucaucauucuguag

SEQ ID NO: 49899 - RNA, 46 nt, Mus musculus
gugacuagugucuucccgauguuccuaauauugaacauggcuggag

SEQ ID NO: 49900 - RNA, 46 nt, Mus musculus
uauuuggcuuucgacucuuuuuuucuugucuaagagguagcagcag

SEQ ID NO: 49901 - RNA, 42 nt, Mus musculus
uucaucucggugacagcuuuggucgccucuucaggagaggag

SEQ ID NO: 49902 - RNA, 46 nt, Mus musculus
uuaauuucucaucaucaauggugucauccaaguucuuaauguagag

SEQ ID NO: 49903 - RNA, 48 nt, Mus musculus
auauggcuuucccgcucauuuccuuuccauucauuucuuccacagccu

SEQ ID NO: 49904 - RNA, 37 nt, Mus musculus
caccuugacacuuagggucuuaccaaacuggcugaag

SEQ ID NO: 49905 - RNA, 96 nt, Mus musculus
ccagauuuucucaacgagggaucccucugcgaccacaugaugcggaucggcuuucccuucaucacgucgaaguucaugguguccaaggcccucuca

SEQ ID NO: 49906 - RNA, 42 nt, Mus musculus
cuugcugagcccaaacgcaacacugacggcugcgacccgggg

SEQ ID NO: 49907 - RNA, 46 nt, Mus musculus
guucaucagggagaggaaccgcauccuacggcagcagaaccagcua

SEQ ID NO: 49908 - RNA, 42 nt, Mus musculus
uuugccaggaaucccuuuccuuacaggacauacacacagcag

SEQ ID NO: 49909 - RNA, 46 nt, Mus musculus
gcccucacuccucuccugucccccaaacaaacccccuuuauaccag

SEQ ID NO: 49910 - RNA, 45 nt, Mus musculus
gccuuucucuuuucuccuuuuguacuuugugacauuuggaugcag

SEQ ID NO: 49911 - RNA, 42 nt, Mus musculus
uaagaugaaagaaaaaagaaaaaaaaaaaagacaggcuggag

SEQ ID NO: 49912 - RNA, 78 nt, Mus musculus
agcuggggugguagaccagcuggauggggaaacugauggcagcguuuauugucgcguuggacaaacuccugaagagca

SEQ ID NO: 49913 - RNA, 41 nt, Mus musculus
ggagcuuggggguggcgggagcggguuccggcgagagggug

SEQ ID NO: 49914 - RNA, 24 nt, Mus musculus
gcggccccccgccgaguccgccgu

SEQ ID NO: 49915 - RNA, 24 nt, Mus musculus
gcgaacccggcccgcgacgcggcg

SEQ ID NO: 49916 - RNA, 47 nt, Mus musculus
gcuagucccaaggaaaaaaaaaauuggaaacagacccacaugcaaac

SEQ ID NO: 49917 - RNA, 46 nt, Mus musculus
gaaaccacuaaccgccacgggagcgcagugcacgaaaggguuuaag

SEQ ID NO: 49918 - RNA, 58 nt, Mus musculus
caaugucaaaaaaaaaaucaagagaaagcguucguuauauuagagaagagagcugggg

SEQ ID NO: 49919 - RNA, 80 nt, Mus musculus
cuggaagauauuugguuauuuuauucugguaguuuucgcucaggagauagcaagaugacugcgcuuuuuacagaggaagg

SEQ ID NO: 49920 - RNA, 45 nt, Mus musculus
uuuaguuuucaaguguaauggaugugaacagauuugaggcaguuu

SEQ ID NO: 49921 - RNA, 46 nt, Mus musculus
ugugugcgcgugugcgcgcgcgugugugugacuugauugcaucaga

SEQ ID NO: 49922 - RNA, 82 nt, Mus musculus
gagaacuggccucuacaaaucccagagaccaugcguaacacagaucaagacagaaccuguuaccauuuucagccaccagagc

SEQ ID NO: 49923 - RNA, 50 nt, Mus musculus
ccggcccccacccaggcucuccccgaguucacuaguaucuucagcuccca

SEQ ID NO: 49924 - RNA, 48 nt, Mus musculus
agggccaccuguaccagcuguugaauacaccggaucuagacaugccca

SEQ ID NO: 49925 - RNA, 51 nt, Mus musculus
guacaccaugccaagucaguuucuuccacagcaggccaccuacuuuccccc

SEQ ID NO: 49926 - RNA, 46 nt, Mus musculus
ucgccaacucucccaccugucagauacaacagaaggaguaacccgg

SEQ ID NO: 49927 - RNA, 45 nt, Mus musculus
accagccauggcaauucaugccuuuaaucuuagcaaugaggccga

SEQ ID NO: 49928 - RNA, 46 nt, Mus musculus
ggcugagguuuccccagugagaccuugcccugucacccucacguag

SEQ ID NO: 49929 - RNA, 41 nt, Mus musculus
acccuccuugguaaaucgucguugcuucaauaaggccccuu

SEQ ID NO: 49930 - RNA, 45 nt, Mus musculus
gagcuguuguuucuucucucucaucagaaguccuugaaacuggag

SEQ ID NO: 49931 - RNA, 44 nt, Mus musculus
ugaaugcuuguaccugggauccuggaacuugaccugcuggcaga

SEQ ID NO: 49932 - RNA, 41 nt, Mus musculus
ccucugacuuaauagcuuguccuguuuuucuuucuguccca

SEQ ID NO: 49933 - RNA, 78 nt, Mus musculus
ugaaacaccccagccuuucuguaauuguaguaauuguagcugcuuuuuuaaaaaaauguauacuuaccauaugccaca

SEQ ID NO: 49934 - RNA, 46 nt, Mus musculus
ggcacccuuuaugugggugagaggguguuuguguauguuauuugag

SEQ ID NO: 49935 - RNA, 82 nt, Mus musculus
gacgguacacuuuaccaucaaucugcaauuucuuaucagcaccuuucaaaaaacaacccaacucugguaucguaagucacca

SEQ ID NO: 49936 - RNA, 44 nt, Mus musculus
gcuguccguuaaagacagaacuuuaugcauucuaggcuaccuca

SEQ ID NO: 49937 - RNA, 57 nt, Mus musculus
gaggagagggcuccuauguagauaaaguagaauugcuggaacugagcuggaagcagu

SEQ ID NO: 49938 - RNA, 44 nt, Mus musculus
aguggccacucguggucugucagguuuuuuuuucuagagggagg

SEQ ID NO: 49939 - RNA, 45 nt, Mus musculus
auaauuccuuaauuguauucuguuuuccccuuuugaguauuagca

SEQ ID NO: 49940 - RNA, 77 nt, Mus musculus
cugugguuuuuauacagaguauacuaaugagcuuuaccagcaaggggagugaguguguuuaacuugggccuauucuu

SEQ ID NO: 49941 - RNA, 46 nt, Mus musculus
cguagcuugacgcuagcagcaagacuuaaaaauaaauacaguggau

SEQ ID NO: 49942 - RNA, 46 nt, Mus musculus
agacuuuucugugugaggcuuucuucugugugauugacaccccuga

SEQ ID NO: 49943 - RNA, 41 nt, Mus musculus
gagguguuguucauuugacuuuuuuuuuuuuguugagguag

SEQ ID NO: 49944 - RNA, 46 nt, Mus musculus
uuauaaauauuaagugauuuuuggaaguggcuggcacauuugggag

SEQ ID NO: 49945 - RNA, 45 nt, Mus musculus
guuaaaagcagaugacuggggauaaaaaccagaaagauuaggcag

SEQ ID NO: 49946 - RNA, 42 nt, Mus musculus
cuggucuucuuguuuuguuuauuguauuccucgccuggacaa

SEQ ID NO: 49947 - RNA, 46 nt, Mus musculus
cagggcuacacagagaaaccuugucucaacacccccccacccccac

SEQ ID NO: 49948 - RNA, 46 nt, Mus musculus
agcccuacaagugcaccugggagggcugcgacuggagguuugcccg

SEQ ID NO: 49949 - RNA, 46 nt, Mus musculus
cccgccugacgccuugcaguccgcucugccauccuuuaaaccgcag

SEQ ID NO: 49950 - RNA, 48 nt, Mus musculus
caaaggaacuggaaauguauauuuuguacauuugaggccacagggaau

SEQ ID NO: 49951 - RNA, 54 nt, Mus musculus
caagauuuuacuugacguggacucguuuuuuuucugaagauuugauuauuucca

SEQ ID NO: 49952 - RNA, 78 nt, Mus musculus
aaucagcuuuauagauuuaucacaaguuuuuaaggauuguugggggggggggaagaaaucguacuuuugaaaauaauu

SEQ ID NO: 49953 - RNA, 92 nt, Mus musculus
augaauacauuuccaauuagaauuuguggugagauaccucucagaaaaauuaccaaauccauuucuuuggggaggggauaaucauucaaaug

SEQ ID NO: 49954 - RNA, 47 nt, Mus musculus
aguaucuuuuuuuuuuguuuuguuuucuuuuuuuuuuguuuuuuaag

SEQ ID NO: 49955 - RNA, 51 nt, Mus musculus
uuccaggauuucuaggauguuugcucaugcagugcuguuggcgaaaugaca

SEQ ID NO: 49956 - RNA, 45 nt, Mus musculus
gaugcuguuaaccaaaggacagaaaccacaagcaaaaugccaaaa

SEQ ID NO: 49957 - RNA, 29 nt, Mus musculus
gcagcugucgagcuguagaauuuuuugag

SEQ ID NO: 49958 - RNA, 43 nt, Mus musculus
aaaauuaucuuccacuccugguucugggauaauacaggccggu

SEQ ID NO: 49959 - RNA, 46 nt, Mus musculus
cuacacaccaucugaauccaguggcuuguggcagaaaggccuccac

SEQ ID NO: 49960 - RNA, 46 nt, Mus musculus
auucuuagacauugacugagcugcucucauggcaauccuugcccag

SEQ ID NO: 49961 - RNA, 46 nt, Mus musculus
ucccggaacacucuucgggaguggugucgguaucauaacuugagca

SEQ ID NO: 49962 - RNA, 46 nt, Mus musculus
uuuguaaaaacuggaguugauuucuuuuuuugccauguccgcugga

SEQ ID NO: 49963 - RNA, 46 nt, Mus musculus
uggacacagagaacacuguguuuuauucacuacuugagagagagag

SEQ ID NO: 49964 - RNA, 26 nt, Mus musculus
gacgcccagaggauuuguggcugcag

SEQ ID NO: 49965 - RNA, 49 nt, Mus musculus
ggaaacagggaggaagcgagggcaucuauaauccugucccccgagggga

SEQ ID NO: 49966 - RNA, 41 nt, Mus musculus
gcuagcaaaagcgcaggugcccguggagcugcacgccacca

SEQ ID NO: 49967 - RNA, 35 nt, Mus musculus
agcugcaagucccgcagguaauccaggauguagcg

SEQ ID NO: 49968 - RNA, 46 nt, Mus musculus
aagagaguagcgaaccaucuuggcagguggccucuggccgcuuaca

SEQ ID NO: 49969 - RNA, 46 nt, Mus musculus
uguucuuaaagugaacacgaagguuugacccucuugauuugcguga

SEQ ID NO: 49970 - RNA, 45 nt, Mus musculus
aacugcccaggccaucgaggguaugcauauccgcaaagccacuga

SEQ ID NO: 49971 - RNA, 45 nt, Mus musculus
cgaaacaagaagcgcucggucuucgggguugcgggggacaggggu

SEQ ID NO: 49972 - RNA, 46 nt, Mus musculus
auucagcuauuacuuugacuuaaaugaguagucaaaugguuacuag

SEQ ID NO: 49973 - RNA, 46 nt, Mus musculus
aucaaguggcuggaggcugcugggugucacucaucauaucauuccc

SEQ ID NO: 49974 - RNA, 45 nt, Mus musculus
agucaagcugggguacaggauaccacugucucaaacacagagcaa

SEQ ID NO: 49975 - RNA, 46 nt, Mus musculus
uguguguguguguguguguguguguguguguguguaaagccaaggu

SEQ ID NO: 49976 - RNA, 46 nt, Mus musculus
gcaaacucucucccgugggugaccugggccuacgguuaccucgcag

SEQ ID NO: 49977 - RNA, 49 nt, Mus musculus
guaugaacuuuuccagcugggcaacuguacauuuccccaccuccggccu

SEQ ID NO: 49978 - RNA, 102 nt, Mus musculus
ucccuucugguguaaccaaggggcagccugcuuuuuugaaggaauagaugauaaacacuggaaggaaaacgggacacugucagucguugcaaccauauccgg

SEQ ID NO: 49979 - RNA, 46 nt, Mus musculus
agccaucucuccagcccaauagccugccaucuuuuaacacggccac

SEQ ID NO: 49980 - RNA, 45 nt, Mus musculus
agcagaauacaggaggaagcggguagcugguauucacguguguga

SEQ ID NO: 49981 - RNA, 46 nt, Mus musculus
uuaacaaaguggccgagugggugaagcaggacaaugaaacugggau

SEQ ID NO: 49982 - RNA, 98 nt, Mus musculus
aggacauauaagaaauuggcugaauuuggaacagaauucaagaagauagaaacaaacuauacgaaaauauuucuuuacaguggagagccuauuuaccu

SEQ ID NO: 49983 - RNA, 78 nt, Mus musculus
gggaaaugaaacaucuauuuuugggcccaaaggaaacaagacucuugcuuuggccauaaaaaaauuuuauggccccuu

SEQ ID NO: 49984 - RNA, 46 nt, Mus musculus
gaugaauuucuugaaaauuuuugauacagugauuauacacagacag

SEQ ID NO: 49985 - RNA, 46 nt, Mus musculus
gugucuacaguggugucuuuauucaccuucccucccuggggcucac

SEQ ID NO: 49986 - RNA, 47 nt, Mus musculus
ggucaucuaaagaauugcuguuuuuauaguuauuaccgccuuagguu

SEQ ID NO: 49987 - RNA, 57 nt, Mus musculus
gugauucaucuaccaggaguauguagauugggggcaccuauguaggcacaggaaggc

SEQ ID NO: 49988 - RNA, 42 nt, Mus musculus
ugagucuguaggugaaaagcaggagguagaaacuggccaggc

SEQ ID NO: 49989 - RNA, 46 nt, Mus musculus
auuaauuuguagcagacugugaaagaagcaaauggagacuguucug

SEQ ID NO: 49990 - RNA, 42 nt, Mus musculus
uuuauaacccugugcucaagcuuuuaggcuuucccaucuuua

SEQ ID NO: 49991 - RNA, 44 nt, Mus musculus
augauaauggacugaaccuuggaaccuguaagccagccccaguu

SEQ ID NO: 49992 - RNA, 45 nt, Mus musculus
cacgcaaacuuuauaugccccaguacaggggaacaccaaggccaa

SEQ ID NO: 49993 - RNA, 43 nt, Mus musculus
ggugugugcacacaucguccaagcuauucgcauggaagccaca

SEQ ID NO: 49994 - RNA, 46 nt, Mus musculus
gcugaccugaaggaacacaugguuggaaucauauucagcaggagua

SEQ ID NO: 49995 - RNA, 70 nt, Mus musculus
uuggaaagcucaucucuggagacgcugaacccacaccagagcaagaggaaaaggcgcuccuguccucccc

SEQ ID NO: 49996 - RNA, 124 nt, Mus musculus
gauuccaggcacauuggcugggucacaagugaacucccaggaggggauaaucagaucaucaaaauagaguuaaagggcccagaaaauacauuaagaguucgacaaguaaaaguccuggguugga

SEQ ID NO: 49997 - RNA, 42 nt, Mus musculus
ccguguaagaaaucauuucucacaaaacaguaaguugaaacu

SEQ ID NO: 49998 - RNA, 43 nt, Mus musculus
uaaaguuaccucaaugaccuucuuaacugggaaagcaguagaa

SEQ ID NO: 49999 - RNA, 46 nt, Mus musculus
cggguacuuuguuuucuuuuguuuguuuguauuacuuuggccacag

SEQ ID NO: 50000 - RNA, 42 nt, Mus musculus
cuaaaaguauuagucuugggggaauucuccaaccagacaguu

SEQ ID NO: 50001 - RNA, 69 nt, Mus musculus
ugacagauggcuccacagaaaccuuuugggaaucaggagaugaagauaaaaacaaaacuaaaaauauca

SEQ ID NO: 50002 - RNA, 96 nt, Mus musculus
ucuucccucuugcgacauccaucgccagagcuuucccggcucauaucagcccacagcucucuuuccaaaggagaacggaacuuccaguggccaguu

SEQ ID NO: 50003 - RNA, 45 nt, Mus musculus
gaaaguaauacagcuacagaguaugguugcuuccuuaccacuaau

SEQ ID NO: 50004 - RNA, 46 nt, Mus musculus
cagcauaggcaaagcaccgcugaaagaugaacaggaaaugagagca

SEQ ID NO: 50005 - RNA, 32 nt, Mus musculus
cagcaccugcgaugacagcggugacuugaaga

SEQ ID NO: 50006 - RNA, 46 nt, Mus musculus
accucgggaacguuccaagucagacucauauacacuugauccagau

SEQ ID NO: 50007 - RNA, 63 nt, Mus musculus
cagccugacuguauugcuucaaagaaaccauaauaugcagaauagugaaauuaagggaaggcc

SEQ ID NO: 50008 - RNA, 44 nt, Mus musculus
cuagcugcuuugcuuuuucaugacacuugaauagcuccaucaga

SEQ ID NO: 50009 - RNA, 46 nt, Mus musculus
acugcucucacauaaaggugacugcaguaugacuucauacacaggc

SEQ ID NO: 50010 - RNA, 46 nt, Mus musculus
uugaucaacuauguucauagcagcuauuuucauaauagccagaaac

SEQ ID NO: 50011 - RNA, 46 nt, Mus musculus
ucaguuugguauuuucucagaaauuggaaauaguucuuccucaaga

SEQ ID NO: 50012 - RNA, 46 nt, Mus musculus
cuuggaggugcucccugcccucaccucaccucugucagcugcagau

SEQ ID NO: 50013 - RNA, 24 nt, Mus musculus
ucuuauuauagaaauucaaauuga

SEQ ID NO: 50014 - RNA, 46 nt, Mus musculus
aaggcauuuguuuuaaauaaauauaaaguacauagaguugcuagau

SEQ ID NO: 50015 - RNA, 41 nt, Mus musculus
caacucuuaaaugagaacuucacugcuuacuuacugccauu

SEQ ID NO: 50016 - RNA, 45 nt, Mus musculus
uuuugacuauuuauuuuagauaagggguugggaauugaaugagaa

SEQ ID NO: 50017 - RNA, 46 nt, Mus musculus
agauccacaaugaugauggcgugugguugagacugaaugaggagac

SEQ ID NO: 50018 - RNA, 46 nt, Mus musculus
cuggucuccgcauccggagccacccuucccuucagagugaacagau

SEQ ID NO: 50019 - RNA, 45 nt, Mus musculus
agugauaaaagagccugguagaguaaaagaaauaagugaugugug

SEQ ID NO: 50020 - RNA, 42 nt, Mus musculus
cuaucagcucugagacgcugcuaagagacugccaaggaggaa

SEQ ID NO: 50021 - RNA, 46 nt, Mus musculus
uucauauuuaaguagagauauagcugugcagcugcaaauaguuuga

SEQ ID NO: 50022 - RNA, 70 nt, Mus musculus
acauguuuauaauaauaaaaaaaggcucucaauuugagaguggggaguguugaggggcugaagggaagaa

SEQ ID NO: 50023 - RNA, 45 nt, Mus musculus
agcccagaaacuaauuacacaaacaacaaaaacagacuugguggg

SEQ ID NO: 50024 - RNA, 49 nt, Mus musculus
gguguguguacuuuccuccauaaguaaguacuggggaagcuggaagggc

SEQ ID NO: 50025 - RNA, 46 nt, Mus musculus
uacucccaagcugucucugagagaaucauucaugcucugggcagac

SEQ ID NO: 50026 - RNA, 46 nt, Mus musculus
aaaggguuuggcucuuucucauucaccaacuaucuuagaggcacuu

SEQ ID NO: 50027 - RNA, 44 nt, Mus musculus
uaacuucagagaaaacuauuuuaaaacauaugggucuugguuac

SEQ ID NO: 50028 - RNA, 46 nt, Mus musculus
ugugaauaguuaaugaaggggagauaccuuuuagaaucccugagua

SEQ ID NO: 50029 - RNA, 46 nt, Mus musculus
agcacaugcagcuugagcaguaauggcacaaaccaaaccagaggac

SEQ ID NO: 50030 - RNA, 47 nt, Mus musculus
ugugcgcuugaggaacuauggcagucgcacagccaauggagauggag

SEQ ID NO: 50031 - RNA, 49 nt, Mus musculus
uaaaggaacuuauacaacagacgauucacccagugacauagcugaaauc

SEQ ID NO: 50032 - RNA, 49 nt, Mus musculus
aauucucuucacucugucaaagccagugcuaaccgauucacaaaaacaa

SEQ ID NO: 50033 - RNA, 46 nt, Mus musculus
acacacacacacaccuccacacauacacacauacacacacacacac

SEQ ID NO: 50034 - RNA, 45 nt, Mus musculus
cacacacacacaccuccacacauacacacauacacacauacacac

SEQ ID NO: 50035 - RNA, 46 nt, Mus musculus
gacccugggcaaaggcuuuccauuauaagaacagggagagggaggg

SEQ ID NO: 50036 - RNA, 46 nt, Mus musculus
cugcugagcauucuucacuggagcuggaccaccuuagucuuaggag

SEQ ID NO: 50037 - RNA, 45 nt, Mus musculus
ccaaacaggugauagaaaugaacaaaaccauacuagacccaaaaa

SEQ ID NO: 50038 - RNA, 45 nt, Mus musculus
gacauuuuacuugguggucuuggccuguuuggaggaagaggagaa

SEQ ID NO: 50039 - RNA, 46 nt, Mus musculus
uauuccaaggaggacuacaguguagucaacagguuugaaaguaugu

SEQ ID NO: 50040 - RNA, 46 nt, Mus musculus
cugcuaugcaggacuuaaagaugggcauugcaaguacagaggagga

SEQ ID NO: 50041 - RNA, 46 nt, Mus musculus
uuaucugcagucaaaagaauguauugcuacaauagaacaauaaaga

SEQ ID NO: 50042 - RNA, 45 nt, Mus musculus
uuuauuuucaguuauucauuuaaauuguugcuucauuuugguaga

SEQ ID NO: 50043 - RNA, 45 nt, Mus musculus
gaaagucuuguugaauucugcugcgaaucuauuugguccuggccu

SEQ ID NO: 50044 - RNA, 23 nt, Mus musculus
guauagaaacuugguucacagau

SEQ ID NO: 50045 - RNA, 46 nt, Mus musculus
uguauuaagauaauuacauaugcauauuuccuuccuaccccaacac

SEQ ID NO: 50046 - RNA, 45 nt, Mus musculus
guucauauuuuuaugagaacauaccauaacuucugugauucuagu

SEQ ID NO: 50047 - RNA, 61 nt, Mus musculus
guuguuucuaucaucuacuuuuuguuuccuuuccccauacuugacaauuuucuaaggcuga

SEQ ID NO: 50048 - RNA, 46 nt, Mus musculus
guugcuuaugucuacauagagacuuauuuaucacuucuggagaguc

SEQ ID NO: 50049 - RNA, 46 nt, Mus musculus
aauccuuugaaucaagaguccuaccuuagguacaaaaggcccacau

SEQ ID NO: 50050 - RNA, 25 nt, Mus musculus
ugugaaggaguagauaaggcaggau

SEQ ID NO: 50051 - RNA, 45 nt, Mus musculus
gaucuaagauguucuuagauaccaccauuuggaacuuacggagaa

SEQ ID NO: 50052 - RNA, 45 nt, Mus musculus
aaaucaucuuccccucuguccugugaagauuccugagccuuugag

SEQ ID NO: 50053 - RNA, 46 nt, Mus musculus
accggcuaacuuacagcaggugagggaggccacacuaaacacugag

SEQ ID NO: 50054 - RNA, 85 nt, Mus musculus
uuucuauaucaaauauagaaagcagugguugagagaagccuaaagggagggaaaauuaucaaugaacaaacuaaagauagaaaga

SEQ ID NO: 50055 - RNA, 46 nt, Mus musculus
gucuuauuuacacauuucuaaauucaaguuuuaaaauucuagaaug

SEQ ID NO: 50056 - RNA, 71 nt, Mus musculus
uaagaauaaaagauuggacuuuuccuuuauaaacuguacuugagauaauaaugugucggauugaaguaguu

SEQ ID NO: 50057 - RNA, 46 nt, Mus musculus
augccuuaaagauuauuuuaguauaacuucuaguaauccacuugag

SEQ ID NO: 50058 - RNA, 46 nt, Mus musculus
gucagggacaaguuuaccuugguuuuauagcaaagguguuagagau

SEQ ID NO: 50059 - RNA, 46 nt, Mus musculus
gaauuggaugguccuuuccacuaucaguaugagacacaguccaggu

SEQ ID NO: 50060 - RNA, 46 nt, Mus musculus
aaagugaucuuuacaaaaaaauuuuuaaauuauuuugacuguagau

SEQ ID NO: 50061 - RNA, 46 nt, Mus musculus
acuuucaaauuuacagguuuuuuuaaacuuuggcuuuguugaaguu

SEQ ID NO: 50062 - RNA, 50 nt, Mus musculus
cuaaagauacccuauauuuaaacuauuuagaagaguaauuaugacuguag

SEQ ID NO: 50063 - RNA, 45 nt, Mus musculus
uguaggcaucuuuauucacuaaucaggauaacucgggggccaggu

SEQ ID NO: 50064 - RNA, 92 nt, Mus musculus
ggugccucuccucucuccacuuucuccuucucuccuuuauccagaucccuuccucccaucccaaucccagaaaguuaaaccucugccuaucu

SEQ ID NO: 50065 - RNA, 47 nt, Mus musculus
caagaagaaaaacggcaacgugucauuagaagacacagauuagaaga

SEQ ID NO: 50066 - RNA, 46 nt, Mus musculus
uguugcaaggcaugugcaagagaguuggacggucaagaagcaagac

SEQ ID NO: 50067 - RNA, 27 nt, Mus musculus
agcaaggauuagguaguuacaugcaga

SEQ ID NO: 50068 - RNA, 23 nt, Mus musculus
aguaaaaauuuagcacauuuauu

SEQ ID NO: 50069 - RNA, 46 nt, Mus musculus
acuuguauuuuuguuuuuugaagaaguaauguuccuagcuguuuaa

SEQ ID NO: 50070 - RNA, 48 nt, Mus musculus
aauggguaaagcucacacauguguuuuaaugaagaauggagagguuug

SEQ ID NO: 50071 - RNA, 67 nt, Mus musculus
gaagggaagauugugguguauacagccugcaauaauggaaguaguucuguuauuucuaaagauggag

SEQ ID NO: 50072 - RNA, 46 nt, Mus musculus
uuuccagaaucuaauauaagagcauacauuaauuaucaggggagau

SEQ ID NO: 50073 - RNA, 46 nt, Mus musculus
uacauagauauguucaaugcuggcaaauagggguaguagcggagau

SEQ ID NO: 50074 - RNA, 42 nt, Mus musculus
auauaggaauguuuuaguuuuuagaguuugagagggagagag

SEQ ID NO: 50075 - RNA, 46 nt, Mus musculus
gucugcuucagaaugauggguuuuuucuuuauuuguuaugcaagga

SEQ ID NO: 50076 - RNA, 45 nt, Mus musculus
uggagcagucaugcuuucuucuuuucuacugugucacuacauagc

SEQ ID NO: 50077 - RNA, 45 nt, Mus musculus
aaagacuagcgggagaugugcagaucaggggcagauuaaagaaga

SEQ ID NO: 50078 - RNA, 46 nt, Mus musculus
uauucuaccuacacucugccaugugcuugcuuaggugccauguguc

SEQ ID NO: 50079 - RNA, 36 nt, Mus musculus
aacaaauguguuuuucuauauaguuccuugccuuaa

SEQ ID NO: 50080 - RNA, 45 nt, Mus musculus
cgggggagccaaaguuuuccaacugcuggauacuuuugacaagga

SEQ ID NO: 50081 - RNA, 46 nt, Mus musculus
cucaaguguacaacuguuucucaagagaggacauuucuuuguauac

SEQ ID NO: 50082 - RNA, 46 nt, Mus musculus
ggaaaacaauuuuccaagcaucaguucaaagaaacaaacuggagua

SEQ ID NO: 50083 - RNA, 46 nt, Mus musculus
cuuacuaacagaaaccaagaccauucggcaucaucagaacccagua

SEQ ID NO: 50084 - RNA, 25 nt, Mus musculus
aguacagaguggagagucagacagu

SEQ ID NO: 50085 - RNA, 46 nt, Mus musculus
ccuggauuuucuggauguuuugaguuaggagcuuuuugcauuucac

SEQ ID NO: 50086 - RNA, 45 nt, Mus musculus
uacauccaucuauuugcuaguucuuucucuguaacccgugugugu

SEQ ID NO: 50087 - RNA, 45 nt, Mus musculus
gugagucaccaugugguugcugggaauugaacucaaggccucugg

SEQ ID NO: 50088 - RNA, 45 nt, Mus musculus
aaggguaguauaaugugcccacuguugcuaaaugacauugauaga

SEQ ID NO: 50089 - RNA, 46 nt, Mus musculus
ucaugcugauccccaucgaaauuccaacucaauucuucacugagau

SEQ ID NO: 50090 - RNA, 41 nt, Mus musculus
aaacauuauuauagaaguaggcuacggaaugaugcgggguu

SEQ ID NO: 50091 - RNA, 46 nt, Mus musculus
guaagaauucauugcaggauuggagagauuagccaaaaggacagua

SEQ ID NO: 50092 - RNA, 42 nt, Mus musculus
uguggggaaggggaagcagugcugggagggaagugguaagcu

SEQ ID NO: 50093 - RNA, 46 nt, Mus musculus
uuccaaucugcuuauuauaauaaaccuuccuaguuagaagauagau

SEQ ID NO: 50094 - RNA, 83 nt, Mus musculus
gugucagcugccugaauguuugguuuuauguguuugaggugggaucucauguaacccuaacaggaucacuauguagcccagaa

SEQ ID NO: 50095 - RNA, 109 nt, Mus musculus
ggcaagauaaguuuccauuugggaagugccacacuucugugauaggauuucacagcauguagauuaccuuugaugccaguuuuaccuuuuuauguguuagguugcagug

SEQ ID NO: 50096 - RNA, 46 nt, Mus musculus
acuggaugaaauuauaacauuuucucagagaaagugaccagccagg

SEQ ID NO: 50097 - RNA, 46 nt, Mus musculus
ucuugcuuguaacucuugguuuuuggaucaauaauugcugacuaug

SEQ ID NO: 50098 - RNA, 51 nt, Mus musculus
gaauguuacauaacuuucaugucuugguuuucuuauagaguggagauaaua

SEQ ID NO: 50099 - RNA, 50 nt, Mus musculus
agccuaagguaggcuugauuuugaagguauuuuaacaaaauggcucagag

SEQ ID NO: 50100 - RNA, 48 nt, Mus musculus
gagaucuggaagugcauaugaggaaauuauaaaagccuuaagagaaga

SEQ ID NO: 50101 - RNA, 45 nt, Mus musculus
ugcacuguuguagacauuaaaggcacagccuuaaguacaacagau

SEQ ID NO: 50102 - RNA, 46 nt, Mus musculus
ugagugccauagguauucuuucuggugaucugaauggguggcauca

SEQ ID NO: 50103 - RNA, 62 nt, Mus musculus
gaauaugcaagaagguuauuggagggcaaugggauagucaaguaugggaacuuaaguagaga

SEQ ID NO: 50104 - RNA, 79 nt, Mus musculus
auaacuucugagccaaguggucauaacugggauaagcauaaagaggggagggcagauggaaaggauuggauaaccuggg

SEQ ID NO: 50105 - RNA, 50 nt, Mus musculus
aaggauggcagggaagaauugggaauuaguuuauuuauguagggcauuga

SEQ ID NO: 50106 - RNA, 45 nt, Mus musculus
gccacggggucugugcgugcgugcuuguguguguggugugugugu

SEQ ID NO: 50107 - RNA, 45 nt, Mus musculus
cucucuucucucucucucucucucugugugugugugugugugugu

SEQ ID NO: 50108 - RNA, 42 nt, Mus musculus
ggaugacuagaaacaggagcccaguguccugacuuugcucug

SEQ ID NO: 50109 - RNA, 45 nt, Mus musculus
uugcuaggcaucuagauuccuucaacuuacccugaaucuguugac

SEQ ID NO: 50110 - RNA, 83 nt, Mus musculus
agcuaauccuaguaguguaugucccauuaguuaaccgguagagaccagcagaagacacauaccacacacacacacacacacac

SEQ ID NO: 50111 - RNA, 94 nt, Mus musculus
acacacacacacacagagacagagagagagagacagagacagagagagagagagacagagagagagagacagagagacagagacauacaggcag

SEQ ID NO: 50112 - RNA, 128 nt, Mus musculus
agacagacagauagacagauugacagagacagagaagcaggcagacagacagagucaggcagagacagacagacagacagauagauaggagauagguagguagauagacacacacagaguuagacaga

SEQ ID NO: 50113 - RNA, 45 nt, Mus musculus
ggucaagauuucuguguuuuccuuuugcuuuauccuauccuugag

SEQ ID NO: 50114 - RNA, 46 nt, Mus musculus
gaguucccguagcggccucucccuuucucuucuguaagguguccuu

SEQ ID NO: 50115 - RNA, 46 nt, Mus musculus
uuucuccacacaacuuccuucccaccguggaccuugcagcagcagc

SEQ ID NO: 50116 - RNA, 45 nt, Mus musculus
aggggucguuugacucccaccccagagggggucaccacccacagg

SEQ ID NO: 50117 - RNA, 46 nt, Mus musculus
cuucuucaggauucucuucagguuaacucuuccagggccgguucag

SEQ ID NO: 50118 - RNA, 44 nt, Mus musculus
ggacacagugaucaaacauggccuuggggaugcuuagggccuga

SEQ ID NO: 50119 - RNA, 46 nt, Mus musculus
gaagaaauguauuggaauuuuuauggagauuguauugaaccuguag

SEQ ID NO: 50120 - RNA, 31 nt, Mus musculus
agcuguguaguccacuggaauuggaggcaag

SEQ ID NO: 50121 - RNA, 44 nt, Mus musculus
guagucggugcagaggguuacugugcauuggguagggguguagu

SEQ ID NO: 50122 - RNA, 41 nt, Mus musculus
uuacugcgcauuggguaggguguagucagugcagaggguua

SEQ ID NO: 50123 - RNA, 41 nt, Mus musculus; identical to SEQ ID NO: 50122

SEQ ID NO: 50124 - RNA, 41 nt, Mus musculus
agucagugcagaggguuacugugcauuggguagggguguag

SEQ ID NO: 50125 - RNA, 45 nt, Mus musculus
guguagucggugcagaggguuacugugcauuggguagggguguag

SEQ ID NO: 50126 - RNA, 78 nt, Mus musculus
agucggugcagaggguuacugugcauuggguagggguguagucggugcagaggguuacugugcauuggguaggggugu

SEQ ID NO: 50127 - RNA, 46 nt, Mus musculus
acugcgcauuggguaggguguagucagugcagaggguuacugugca

SEQ ID NO: 50128 - RNA, 46 nt, Mus musculus; identical to SEQ ID NO: 50127

SEQ ID NO: 50129 - RNA, 45 nt, Mus musculus
uugacauagugucugcgugcuacagcuuugccuuguaugugugag

SEQ ID NO: 50130 - RNA, 45 nt, Mus musculus
gaagcagcgugccuguaaggaucgaaggucugggcccuuuuggag

SEQ ID NO: 50131 - RNA, 46 nt, Mus musculus
gacuccccuuuagcuaauuuuuacagguugguuuucccagucacag

SEQ ID NO: 50132 - RNA, 49 nt, Mus musculus
uuagcugggguggggguggggucacaagauuaauacugaugaauucagg

SEQ ID NO: 50133 - RNA, 46 nt, Mus musculus
uguagcugucagaguaggaacgguaggcugguuuuaaaguaaguag

SEQ ID NO: 50134 - RNA, 46 nt, Mus musculus
gcagggguuggaauucaguaaaaagcacacuucacgucacguccag

SEQ ID NO: 50135 - RNA, 46 nt, Mus musculus
ccagccucaauuacauaguaaguuugaggccagcauguccuguggg

SEQ ID NO: 50136 - RNA, 46 nt, Mus musculus
aaaacaaacuccaaagcaaacaaaucaaccaaaugaaacugccccu

SEQ ID NO: 50137 - RNA, 45 nt, Mus musculus
guaacuauuucuguaaccuuuugaaauuauaggccuugggaagug

SEQ ID NO: 50138 - RNA, 42 nt, Mus musculus
augugucuaauucccaacuucaaauugauagccacagagcag

SEQ ID NO: 50139 - RNA, 45 nt, Mus musculus
ggucugagggaaccgacuaaguguguuuuguggaguggguggcaa

SEQ ID NO: 50140 - RNA, 80 nt, Mus musculus
ucaggauuggucgauagcauuagaaaggaggaggagaaacagccuugucggaggaagugcgucauugggggugggccuug

SEQ ID NO: 50141 - RNA, 41 nt, Mus musculus
agggagggagggagggaggaagggagaaagggaggaaggaa

SEQ ID NO: 50142 - RNA, 45 nt, Mus musculus
ggaagacugcagacaacagagugaagccagagagaggagggaggg

SEQ ID NO: 50143 - RNA, 45 nt, Mus musculus
gaguguacaugaccuugagcugggccacgugaaagaggggaugga

SEQ ID NO: 50144 - RNA, 42 nt, Mus musculus
agucgucagugauacaaauuuuuaauguuuagggcuggagaa

SEQ ID NO: 50145 - RNA, 44 nt, Mus musculus
ugucagaggugcucuguggcgcgguagggagguccagcgguuga

SEQ ID NO: 50146 - RNA, 44 nt, Mus musculus; identical to SEQ ID NO: 50145

SEQ ID NO: 50147 - RNA, 42 nt, Mus musculus
agaaagugaaacucagggacaauugaggaagccauggcauua

SEQ ID NO: 50148 - RNA, 45 nt, Mus musculus
cagacuacuuauguuauugucacuucucccacaguggcggcagau

SEQ ID NO: 50149 - RNA, 46 nt, Mus musculus
acugagucgccugaaaaaggaaucuuuuugcccuacuccaccagua

SEQ ID NO: 50150 - RNA, 42 nt, Mus musculus
cuuccaugguuuggagaaccuggaauucuugcaggcugauaa

SEQ ID NO: 50151 - RNA, 46 nt, Mus musculus
ccaucacgaccuuuccacuuaaguuuauuaaauaauggcuugacaa

SEQ ID NO: 50152 - RNA, 46 nt, Mus musculus
gcaaacucagcacgggucucugccuccuugaguuuaucaguaagaa

SEQ ID NO: 50153 - RNA, 67 nt, Mus musculus
gucagcuucagggaggcuggccucuggcggagucaaggucagagggaggaauggccgcggggcaggg

SEQ ID NO: 50154 - RNA, 45 nt, Mus musculus
ggaaaaggcugacacaguuuugugaaaaagacaagagggguaaaa

SEQ ID NO: 50155 - RNA, 45 nt, Mus musculus
ugaccucuaaggggucuccacaacacuaaggggcggcaugaucca

SEQ ID NO: 50156 - RNA, 45 nt, Mus musculus
cccccuacaauccuuuaggucccccaaccaaguucacaccccuca

SEQ ID NO: 50157 - RNA, 41 nt, Mus musculus
aacccaucccuucuaugucugccccggaccccaccgaaguc

SEQ ID NO: 50158 - RNA, 44 nt, Mus musculus
uugagggcuugcaggauuacaccauaagggauguaguuauagag

SEQ ID NO: 50159 - RNA, 41 nt, Mus musculus
uccgauaacccggccccgaugggauuauaauacggcaucag

SEQ ID NO: 50160 - RNA, 42 nt, Mus musculus
ccuuaauuuguaaaauaaaggagaccugaugauugggcaguu

SEQ ID NO: 50161 - RNA, 45 nt, Mus musculus
cuacaaggaaacugugucugguuuaggauugaauugcagugacag

SEQ ID NO: 50162 - RNA, 41 nt, Mus musculus
cugacugacaagacaacggcugcauuucaacaagggaagau

SEQ ID NO: 50163 - RNA, 47 nt, Mus musculus
guggucggaaacacaaagagaaugugaaagacuauuaccagaaaugg

SEQ ID NO: 50164 - RNA, 46 nt, Mus musculus
guguuugcuuugcacuucggaaccuguugcguuuugacccacagag

SEQ ID NO: 50165 - RNA, 45 nt, Mus musculus
gcaggccggacgacgacgacgagaucucugccaucuuggagccca

SEQ ID NO: 50166 - RNA, 46 nt, Mus musculus
aaacuucuccucgguguccccacuccgcggugucacucugcccucu

SEQ ID NO: 50167 - RNA, 45 nt, Mus musculus
ggagaggggagagcagaaccaggcagcggccaccugcagggaguu

SEQ ID NO: 50168 - RNA, 23 nt, Mus musculus
ugcacacccagcgcccgcugccg

SEQ ID NO: 50169 - RNA, 45 nt, Mus musculus
gcaaacuauagagauaauaaugaaaguaggaagaaggcuugggag

SEQ ID NO: 50170 - RNA, 42 nt, Mus musculus
cggaaaacugaaggagggaacucaagugagcagcagccucau

SEQ ID NO: 50171 - RNA, 50 nt, Mus musculus
gugaguauguguguguguaugugugugugaguguguguggugagugugug

SEQ ID NO: 50172 - RNA, 48 nt, Mus musculus
aaugaugcagagagaagcuccugcccauccgaugaagagagcagcccc

SEQ ID NO: 50173 - RNA, 41 nt, Mus musculus
cuuguccucauucaguuguuuuauuccuuuuccuugacaga

SEQ ID NO: 50174 - RNA, 46 nt, Mus musculus
uucuacccaaacccguagugacaauaaaaaccuguugaugugagag

SEQ ID NO: 50175 - RNA, 46 nt, Mus musculus
cucaaacaucaucuuguuuuuuaacuggaauggauccuuagcagag

SEQ ID NO: 50176 - RNA, 42 nt, Mus musculus
agugagaugguagagcauagcuacaaugaucugugcaccgag

SEQ ID NO: 50177 - RNA, 50 nt, Mus musculus
gugacguaucagucauaaaacuagagaagaggccacagauggggaaaagc

SEQ ID NO: 50178 - RNA, 66 nt, Mus musculus
gcagacagacaaauacugagugcugucucucgugggcagauccuggguuuuaauauuuauguaugu

SEQ ID NO: 50179 - RNA, 49 nt, Mus musculus
uucacuguguaacauagcuauaaaaauguccauucaccaagauaaguga

SEQ ID NO: 50180 - RNA, 46 nt, Mus musculus
caauauagaagauucucgaaaaacuaaaauuagaauugccauauga

SEQ ID NO: 50181 - RNA, 42 nt, Mus musculus
augacauuuaucugaugacagacauuucccuccugggcaacg

SEQ ID NO: 50182 - RNA, 46 nt, Mus musculus
gguugugagccaccaugugguugcugggauuugaacucaaucaaga

SEQ ID NO: 50183 - RNA, 46 nt, Mus musculus
cuucacacauacuggaaccaauagaagaacuuucuucagaggagga

SEQ ID NO: 50184 - RNA, 47 nt, Mus musculus
cuugaguccucgaaauauguaauuuaaaaauaauugaaguuaauaga

SEQ ID NO: 50185 - RNA, 42 nt, Mus musculus
caugugcaaggccaaggccaggugcagcagccucaggaauaa

SEQ ID NO: 50186 - RNA, 41 nt, Mus musculus
agagagagggagagaguagauaaguagaggccagccauggu

SEQ ID NO: 50187 - RNA, 44 nt, Mus musculus
auuauuucucagagaaguuauuuuuagagacucgagguuguagc

SEQ ID NO: 50188 - RNA, 42 nt, Mus musculus
ccagcucaaaguuugaggguacagccuaccacggcggcagga

SEQ ID NO: 50189 - RNA, 45 nt, Mus musculus
guguacuuuaucugcugaucuuucuagccucauccuggucuuuuu

SEQ ID NO: 50190 - RNA, 45 nt, Mus musculus
ggccggggauaguuugucagccuuguuguuguggaagcuaaagau

SEQ ID NO: 50191 - RNA, 44 nt, Mus musculus
ugacagauggaaagaggaggagaaggagaaguuacucgaggaga

SEQ ID NO: 50192 - RNA, 46 nt, Mus musculus
gugugugucaguguguaugugucagugugugugugugugugugugu

SEQ ID NO: 50193 - RNA, 45 nt, Mus musculus
ggggaaaagguuccggaaagguggcaguggucaaguguaucagau

SEQ ID NO: 50194 - RNA, 46 nt, Mus musculus
gaagucacuggaggacugggcuggcugaagucaucuaguuagagau

SEQ ID NO: 50195 - RNA, 76 nt, Mus musculus
ggaccuacuucuguuuagaagaauguuuucugugacagagggcuaggggguaggagggagcuuaaaagugagagga

SEQ ID NO: 50196 - RNA, 57 nt, Mus musculus
guguugacacaaagccuacagagcuaugacuugggggucaaagugagagaccuauga

SEQ ID NO: 50197 - RNA, 69 nt, Mus musculus
uguuguggaggagaaugaagaugugaguagugcccuaaagagagcauucuggcugucgaugauagaagg

SEQ ID NO: 50198 - RNA, 45 nt, Mus musculus
acacacacacacacacacacacacacaccccuacaccuguauuag

SEQ ID NO: 50199 - RNA, 46 nt, Mus musculus
ccaggcccauuuccuucucuuugucuucaucccucugcuucaagaa

SEQ ID NO: 50200 - RNA, 46 nt, Mus musculus
guccugucagcaaaaucuugcuggcauaugcaauggugucagcguu

SEQ ID NO: 50201 - RNA, 46 nt, Mus musculus
uacuuguagggugaugucuaugcuuuggcgcauuugggguuuagau

SEQ ID NO: 50202 - RNA, 43 nt, Mus musculus
uaauaguauguauuuuaauagcaaacuuacaggaacagcacag

SEQ ID NO: 50203 - RNA, 46 nt, Mus musculus
uauugcuggaucuaccgguaguacuauguccaguuuucacacacag

SEQ ID NO: 50204 - RNA, 45 nt, Mus musculus
cuggaugacuuaauguuauuaaagcgacuuagaaaagaacagaca

SEQ ID NO: 50205 - RNA, 47 nt, Mus musculus
gggaagagacacugucauccuggcaauaauaaauacuuacauugaag

SEQ ID NO: 50206 - RNA, 42 nt, Mus musculus
ccuacuuauaucguuccccugauuuucuaaucacagccccaa

SEQ ID NO: 50207 - RNA, 46 nt, Mus musculus
ccugauacaugucaccuucuuuucauuguuaaggaagugcacagag

SEQ ID NO: 50208 - RNA, 46 nt, Mus musculus
uuuuguuguuugguugcagcucaaaucuaaccccagugagcaggag

SEQ ID NO: 50209 - RNA, 46 nt, Mus musculus
ugcagcggcugcgcucccaagcgcucgacgccuuugacggugccga

SEQ ID NO: 50210 - RNA, 46 nt, Mus musculus
gccucccaagugcugggaucaaaggcgugcgccaccacugccccac

SEQ ID NO: 50211 - RNA, 51 nt, Mus musculus
gaugcagaacugcgugaacugcgagcagaaugcuucauaaaggaaggagag

SEQ ID NO: 50212 - RNA, 42 nt, Mus musculus
gccauuaggauauguucugaaguuuuacagauggagcccgac

SEQ ID NO: 50213 - RNA, 46 nt, Mus musculus
aaauugucuuacuuucuuugcggugcagugcucauuuaagucuuag

SEQ ID NO: 50214 - RNA, 43 nt, Mus musculus
auccagauaauuuccagaaugaagaagaaaagaaaaaagcaga

SEQ ID NO: 50215 - RNA, 45 nt, Mus musculus
gcccagcaugacuuugggaguugucuuugcaauugcuuucuacaa

SEQ ID NO: 50216 - RNA, 46 nt, Mus musculus
acccuggagcagacagauucuaugcaggcuguguauuaaccgugag

SEQ ID NO: 50217 - RNA, 45 nt, Mus musculus
ccaaguuguuuggucgaaauucccugucacaaaauugguuagaag

SEQ ID NO: 50218 - RNA, 62 nt, Mus musculus
gaagaauuacucugguaagaauuauugccucuauucuagaaaaaaaaauuuuaaacauugug

SEQ ID NO: 50219 - RNA, 44 nt, Mus musculus
uuuaguuaauugugggaaggaagcaugaauguagcagccaagca

SEQ ID NO: 50220 - RNA, 68 nt, Mus musculus
ucaacuugagcagauauagaaaaagauuuuguuaacugcaagaacaugaauuacauaaguugaguugg

SEQ ID NO: 50221 - RNA, 45 nt, Mus musculus
accuuucagcuuucauuuugcuucagugucucacaguucaaggca

SEQ ID NO: 50222 - RNA, 36 nt, Mus musculus
gguagggguguccagccugccccaggcgagucacag

SEQ ID NO: 50223 - RNA, 47 nt, Mus musculus
cuauuaguggcagaguugauucuguaauuucaaaugauguucaaagg

SEQ ID NO: 50224 - RNA, 46 nt, Mus musculus
ucuaugguugaaauaccugugcaaagaaaugcagggcacaggggag

SEQ ID NO: 50225 - RNA, 42 nt, Mus musculus
aaauuauuacucuuaaguuuauauuuguuuuaaaugggacac

SEQ ID NO: 50226 - RNA, 41 nt, Mus musculus
aaaaaaaagaagaagaagaagaagaagaagaagaagcaaac

SEQ ID NO: 50227 - RNA, 26 nt, Mus musculus
gcagauggaggagaugcuuucugcaa

SEQ ID NO: 50228 - RNA, 45 nt, Mus musculus
cagaagguuaguuagaccaauuauagaaauaacaacagagaugag

SEQ ID NO: 50229 - RNA, 43 nt, Mus musculus
gaaagacagggguaagguuguccagaauucagucaucaagcag

SEQ ID NO: 50230 - RNA, 44 nt, Mus musculus
aaugaaugacugugucgugaaaaguuggugacuaaauccuguca

SEQ ID NO: 50231 - RNA, 46 nt, Mus musculus
uuccaggcuaauggcguaaaguuaucaauaauuuuuaaucgguuag

SEQ ID NO: 50232 - RNA, 46 nt, Mus musculus
gaaauuugaugcggcuaaaauguuggaguuguacccuaacucacag

SEQ ID NO: 50233 - RNA, 45 nt, Mus musculus
gagaguucucagugacuuugauucagccuuugugugcuaacgugg

SEQ ID NO: 50234 - RNA, 46 nt, Mus musculus
guguguaugguguguguguguguguguguguguguguguguguugc

SEQ ID NO: 50235 - RNA, 46 nt, Mus musculus
uuucauguccagggucaugcuguucucuaauguuggccuucccuag

SEQ ID NO: 50236 - RNA, 45 nt, Mus musculus
gcuagugaagacaagagccuugauuuuagacuugcugcaugugag

SEQ ID NO: 50237 - RNA, 46 nt, Mus musculus
uauugauuguagguuggccaccaucucuuggaacuuuaaccuccag

SEQ ID NO: 50238 - RNA, 45 nt, Mus musculus
uuuauuuguuuguuuguuugagaucaagcucagacuggccaccaa

SEQ ID NO: 50239 - RNA, 24 nt, Mus musculus
ucuuugcagaaauugugcggcaga

SEQ ID NO: 50240 - RNA, 46 nt, Mus musculus
guggguguuagagagucuuagaaaauucaugaucuucagcgccauu

SEQ ID NO: 50241 - RNA, 55 nt, Mus musculus
caaaggagagcuggcccagugauauuucuuuaaaagcccaauccaccuagcaacc

SEQ ID NO: 50242 - RNA, 45 nt, Mus musculus
cccaaugagaccaaugaaaucaccaaugccaacucccgucagcag

SEQ ID NO: 50243 - RNA, 49 nt, Mus musculus
ccaaggaagcacgaaagugccgggaggagcgccuccaggccaagaagga

SEQ ID NO: 50244 - RNA, 45 nt, Mus musculus; identical to SEQ ID NO: 37764

SEQ ID NO: 50245 - RNA, 46 nt, Mus musculus; identical to SEQ ID NO: 37067

SEQ ID NO: 50246 - RNA, 46 nt, Mus musculus
uuuuguauuuacagggucugucauuaauaauaauuaaccccccucc

SEQ ID NO: 50247 - RNA, 46 nt, Mus musculus
cucccccgggagacagagagucgcucugguggaucaguguacagau

SEQ ID NO: 50248 - RNA, 46 nt, Mus musculus
aguggcggaggagccucagcgcacugaaggcccauggcgcccgggu

SEQ ID NO: 50249 - RNA, 46 nt, Mus musculus
gagagagagagagagagagagagagagagagagagacagccucagu

SEQ ID NO: 50250 - RNA, 46 nt, Mus musculus
aucucagacacuaugguggcacagcuugugcagcggcugcagaggu

SEQ ID NO: 50251 - RNA, 24 nt, Mus musculus
gagggaacuuggggucaauagaag

SEQ ID NO: 50252 - RNA, 42 nt, Mus musculus
gagguaagaucccuggcuguuauucuugggaggggaggaagg

SEQ ID NO: 50253 - RNA, 51 nt, Mus musculus
ggugggcuuggaugugaaguuuccugugugagaauuccagaaguagcuguu

SEQ ID NO: 50254 - RNA, 87 nt, Mus musculus
uggaggcagcgacucuggggacuggaucuucacuauccgggagaaagaucccaagaaucuggagaacggaacucuucagcucucgga

SEQ ID NO: 50255 - RNA, 45 nt, Mus musculus
augcaaagaaaacguccuacuugaccgagcuuaucgacagguaca

SEQ ID NO: 50256 - RNA, 45 nt, Mus musculus
uuguguuucuuaguucagaauaguggucuuuuucagaaccugaga

SEQ ID NO: 50257 - RNA, 46 nt, Mus musculus
gccugggaaagcuccaaguucaguagcuccauuucuacugcuagua

SEQ ID NO: 50258 - RNA, 45 nt, Mus musculus
ucagauaaagcagcucuggaaacuuuuaugguuuuuaagcaguug

SEQ ID NO: 50259 - RNA, 46 nt, Mus musculus
guaccgugcacagaggugacaguccgacacagggguuugggcaguu

SEQ ID NO: 50260 - RNA, 41 nt, Mus musculus
gacgcccuggaaagccugaggcuucagauucccagagaugg

SEQ ID NO: 50261 - RNA, 49 nt, Mus musculus
aauguucugcucucugaacauggagaggugaagcuggcagacuuuggag

SEQ ID NO: 50262 - RNA, 41 nt, Mus musculus
agaaauucugaaaggacuugauuaucuacacucggagaaga

SEQ ID NO: 50263 - RNA, 46 nt, Mus musculus
gauccaaaaugaaugccagacagauacacgguaguugguucaaguc

SEQ ID NO: 50264 - RNA, 41 nt, Mus musculus
cuggaaggcagaucacucacauagugcaguuaguagguggg

SEQ ID NO: 50265 - RNA, 46 nt, Mus musculus
uggggcuauaguuuggggguuauucgguuauucuggcccagcagag

SEQ ID NO: 50266 - RNA, 46 nt, Mus musculus
ccuugucaaaaugggggaggugagccaggcuuaugaguccccauca

SEQ ID NO: 50267 - RNA, 45 nt, Mus musculus
cuuuucagcaaaaacaguuucuaaucaccuauuagggccucagag

SEQ ID NO: 50268 - RNA, 46 nt, Mus musculus
gcugcuguggaaaacgaauguaccacaugggcuugcaggaggaacg

SEQ ID NO: 50269 - RNA, 44 nt, Mus musculus
uuuuaugucuaagccaguuacugggcuguucccauguugaagaa

SEQ ID NO: 50270 - RNA, 46 nt, Mus musculus
caucaauuacaaagacuucuaccaauguaagaugauggcugcacaa

SEQ ID NO: 50271 - RNA, 90 nt, Mus musculus
caaaacaaaaccucuucucucagacauaaauugaguacaaccacaagaaugauguaaaucauagauaugguauacaauuaacccccaguc

SEQ ID NO: 50272 - RNA, 46 nt, Mus musculus
agaaacuuugauguugaacgaucaaagaccaugugggcaccgagag

SEQ ID NO: 50273 - RNA, 39 nt, Mus musculus
uuauauaauuauaagggauuccugauuacgcagcugaga

SEQ ID NO: 50274 - RNA, 54 nt, Mus musculus
ccagaagcugccuccuccuaccacagacccaguaccaagcuuucuacugcagua

SEQ ID NO: 50275 - RNA, 54 nt, Mus musculus
cacuguugguuaaguuguuuaauuugggagaaauuaaaccagcuaggagauuaa

SEQ ID NO: 50276 - RNA, 42 nt, Mus musculus
uguucagugagaggccaguggggagaaggaugccggcagagu

SEQ ID NO: 50277 - RNA, 45 nt, Mus musculus
gaaagugguggccauaaaaaucauugaucuggaagaagccgagga

SEQ ID NO: 50278 - RNA, 45 nt, Mus musculus
cuuugcaguuacgcagcacagugcugugcuucaaguacaaaugau

SEQ ID NO: 50279 - RNA, 41 nt, Mus musculus
gcucauguggaggcugauugaacuugcaucuuggcccagag

SEQ ID NO: 50280 - RNA, 44 nt, Mus musculus
cuacagcccagacaggccuugauucaucuuugaacagcagcagu

SEQ ID NO: 50281 - RNA, 48 nt, Mus musculus
ccuuagggauccuguggucuuguuguauaaagauggaucaaaugcagu

SEQ ID NO: 50282 - RNA, 46 nt, Mus musculus
ugagggcuuugugaggaaggguguuauuacaucaacagaagcaacc

SEQ ID NO: 50283 - RNA, 46 nt, Mus musculus
aaauacuuuaaaguggcugacguacuguuuagcauuggggcuggug

SEQ ID NO: 50284 - RNA, 41 nt, Mus musculus
aguggugugugugugugugugugugugugugugugcucggg

SEQ ID NO: 50285 - RNA, 46 nt, Mus musculus
uaauuuaggguagagaauuccugucuguuagccugugugcgugaug

SEQ ID NO: 50286 - RNA, 46 nt, Mus musculus
guacgugcaggcaagcucucagguaugucagcuugaauugcuagau

SEQ ID NO: 50287 - RNA, 26 nt, Mus musculus
guaguaagggguggaguuguggcagg

SEQ ID NO: 50288 - RNA, 45 nt, Mus musculus
agagauacgcuaaguaggucaccagugguuucaagcaaccuagga

SEQ ID NO: 50289 - RNA, 45 nt, Mus musculus
gaguccuuggaaggccuuggcagugauuaauaauaggcguggagc

SEQ ID NO: 50290 - RNA, 33 nt, Mus musculus
cuaauuauuagagaaugaaagguucucacagcg

SEQ ID NO: 50291 - RNA, 45 nt, Mus musculus
uccuacugguuuuucgagggugagcuaguucagccuguacccaaa

SEQ ID NO: 50292 - RNA, 45 nt, Mus musculus
aggggccugauuuuauuggguguuguacucauuaggguggugacu

SEQ ID NO: 50293 - RNA, 61 nt, Mus musculus
gaacucagguaccucuguggagauagcucugugggagauuaguuacauauuacugggcaaa

SEQ ID NO: 50294 - RNA, 46 nt, Mus musculus
ugcuuuauucuguugucuuguguugugcaaaauaauugaggaaggu

SEQ ID NO: 50295 - RNA, 46 nt, Mus musculus
gguucuggguguccacuagaaguuaucagaguauuugagcagaaga

SEQ ID NO: 50296 - RNA, 46 nt, Mus musculus
aaguugugaggucuagguuucaagaccaucucaggugaggcugaac

SEQ ID NO: 50297 - RNA, 42 nt, Mus musculus
acggguaagauguacguggaaguuaauauugagggggcagau

SEQ ID NO: 50298 - RNA, 42 nt, Mus musculus
gcccaaggcgcaucuggccguuuagcggguggccaccgggag

SEQ ID NO: 50299 - RNA, 42 nt, Mus musculus
cgccgccacuguugguggcaguguagcccgagagggcaggag

SEQ ID NO: 50300 - RNA, 45 nt, Mus musculus
auuaaacuauauuggucacaaaacaauuugauggagcgcggcaaa

SEQ ID NO: 50301 - RNA, 41 nt, Mus musculus
gaagaaaggaaggacagaaggaaggagugaaggcaggcaga

SEQ ID NO: 50302 - RNA, 47 nt, Mus musculus
ugugugugugugugugugugugugugugccugugugugccugugugu

SEQ ID NO: 50303 - RNA, 46 nt, Mus musculus
gacuuugaacuugguucagcuccucuguuuccugcagugagaggag

SEQ ID NO: 50304 - RNA, 46 nt, Mus musculus
gcucagcaaagaagaaaucaaagcgaaaggagagaauaggucaaaa

SEQ ID NO: 50305 - RNA, 42 nt, Mus musculus
gggagggauacccgggcgggagacccggcggguacgcggggg

SEQ ID NO: 50306 - RNA, 80 nt, Mus musculus
cuuccucucucgcggcugcagugggcagccuucgccaccgccucuguuuauuucggugggcgcugaggccgcagcagcag

SEQ ID NO: 50307 - RNA, 44 nt, Mus musculus
aaauaaacagaggcgguggcgaaggcugcccacugcagccgcga

SEQ ID NO: 50308 - RNA, 36 nt, Mus musculus
ugcgagcacucauucccggacuagcgcccagaacag

SEQ ID NO: 50309 - RNA, 45 nt, Mus musculus
gacgccuagccuccuccucccggcugcccagcgccccugcggaga

SEQ ID NO: 50310 - RNA, 46 nt, Mus musculus
agaguugaaagcuggaaagccgucgguucugcacagaggagcaguc

SEQ ID NO: 50311 - RNA, 41 nt, Mus musculus
agcgagccgggcucuccgcgguagcaucuaaggcucccaga

SEQ ID NO: 50312 - RNA, 45 nt, Mus musculus
uuccaagucaaccuaagcuacuuagugauauuuaguaaagggagu

SEQ ID NO: 50313 - RNA, 46 nt, Mus musculus
uuuuuuuaagucucuuugcaacaguguaacuugaaguuuguaagaa

SEQ ID NO: 50314 - RNA, 76 nt, Mus musculus
uaauguuuugaguuugugagugugugcaugaagccucuguucagauuguguguuuagucauuuaaaagucucagac

SEQ ID NO: 50315 - RNA, 46 nt, Mus musculus
aauagagucucacaggauugguaggcuucucuucuaguccagggau

SEQ ID NO: 50316 - RNA, 41 nt, Mus musculus
cugaggcccuuaggaugacacagagagacuccaggaaaaga

SEQ ID NO: 50317 - RNA, 46 nt, Mus musculus
gcuucaagguaucuguuuuagaaguugcauuuuuauauugggagau

SEQ ID NO: 50318 - RNA, 46 nt, Mus musculus
auacuuuggaucugucugagccaaaacggauuguacauacagagau

SEQ ID NO: 50319 - RNA, 41 nt, Mus musculus
cagagcagagcuaccggacagcgauuaaacacaggaggaaa

SEQ ID NO: 50320 - RNA, 57 nt, Mus musculus
agacuaaaucccaaguacguucaugccaugaauaaccucgggaauaucuuaaaagaa

SEQ ID NO: 50321 - RNA, 58 nt, Mus musculus
gcaaaaaccuggcugaucaaggcaaccaaacagcggccaucaaauauuaccgggaagc

SEQ ID NO: 50322 - RNA, 46 nt, Mus musculus
uaaaggauaugccaggacaaacaauacaccccaggacaugccagga

SEQ ID NO: 50323 - RNA, 46 nt, Mus musculus
cuuuccgggauuacuacuggccuuaggguuuaugccuccugauucu

SEQ ID NO: 50324 - RNA, 25 nt, Mus musculus
uuugaguagaaaagcaggcaguaug

SEQ ID NO: 50325 - RNA, 45 nt, Mus musculus
guuaggguuaggguuaggguuaggguuaggguuagggucagcucu

SEQ ID NO: 50326 - RNA, 42 nt, Mus musculus
uugagaucuagaggacaaaguuguugacaaggacaaggagcc

SEQ ID NO: 50327 - RNA, 46 nt, Mus musculus; identical to SEQ ID NO: 45353

SEQ ID NO: 50328 - RNA, 46 nt, Mus musculus
gcuuugucucagcguggcauguaauggugaagguguuugcugccag

SEQ ID NO: 50329 - RNA, 45 nt, Mus musculus
guuaaaauagaucacuguuccuugguuuguaaacauguucacccc

SEQ ID NO: 50330 - RNA, 58 nt, Mus musculus
cgagcaguuccuuuuccaccaaugcgcacuugugccugcaguuuggagaguuucuccu

SEQ ID NO: 50331 - RNA, 46 nt, Mus musculus
ugacaaaguugucauugagagcaaugacagccccggcaucgaaggu

SEQ ID NO: 50332 - RNA, 42 nt, Mus musculus
guuauuaugggguucugggauggaaauugugagggagaugcu

SEQ ID NO: 50333 - RNA, 42 nt, Mus musculus
gagcaaagucuggaggcagauccaaguaagcugccccccaga

SEQ ID NO: 50334 - RNA, 46 nt, Mus musculus
uguguaccacgugugugccuggcccagggaagaggguguuggacuc

SEQ ID NO: 50335 - RNA, 47 nt, Mus musculus
aagaaguacccguacuggccccaccagcccaucgagaaccugugaag

SEQ ID NO: 50336 - RNA, 48 nt, Mus musculus
gccugaggauaaauacacagcccugguggaccaggaggagaaggagga

SEQ ID NO: 50337 - RNA, 46 nt, Mus musculus; identical to SEQ ID NO: 49895

SEQ ID NO: 50338 - RNA, 65 nt, Mus musculus
ugccccaaaaucagaaggcaauuggaaaugcccugaaguccuggaaugagaccuuccacgccagg

SEQ ID NO: 50339 - RNA, 23 nt, Mus musculus
augguauaugcuauaauaucuag

SEQ ID NO: 50340 - RNA, 34 nt, Mus musculus
agcaauucaggagaaacugagagaagccagauug

SEQ ID NO: 50341 - RNA, 45 nt, Mus musculus
auuugagaagguuuagguguggccuuggaguagugugggcuuguu

SEQ ID NO: 50342 - RNA, 46 nt, Mus musculus
uaaaaaaaaaaucccccuuguggcacuuuauuuaacaugcccaauc

SEQ ID NO: 50343 - RNA, 46 nt, Mus musculus
gcuaugcuccuuaaacagaaagguaagcaauucaggauucucagag

SEQ ID NO: 50344 - RNA, 46 nt, Mus musculus
ucucaguccucauccacucacagcaggccacgucaccucaccaggc

SEQ ID NO: 50345 - RNA, 46 nt, Mus musculus
auuucaucaguaacucacacgguacaaaacaaaacaaacccuaaau

SEQ ID NO: 50346 - RNA, 42 nt, Mus musculus
aagcaggcugaccacaauucaucuacacaagaaggaggagaa

SEQ ID NO: 50347 - RNA, 46 nt, Mus musculus
acuagauggggauuccccauggggaaggaguccaggagucaccagg

SEQ ID NO: 50348 - RNA, 41 nt, Mus musculus
gacacgcuuggugucggcaccuucgggaaagugaaggguga

SEQ ID NO: 50349 - RNA, 42 nt, Mus musculus
ccgcgggcugcagagcugugggguccgccgcggugggguggg

SEQ ID NO: 50350 - RNA, 46 nt, Mus musculus
gcucugauggaagugauaaggcagacuugaacucagaaggcuccuu

SEQ ID NO: 50351 - RNA, 45 nt, Mus musculus
gagagggacacugaauucagaguuacuggucaccucuggggagag

SEQ ID NO: 50352 - RNA, 45 nt, Mus musculus
gugaguacacuguugcugucuucagacacacuagaagagggcgcc

SEQ ID NO: 50353 - RNA, 52 nt, Mus musculus
uaggguuucauucuuuagaccgugaggccuugaacucggagauucacuugcc

SEQ ID NO: 50354 - RNA, 46 nt, Mus musculus
gacuggugcuguguguaugagcgaccuguugaauauuaacuguuga

SEQ ID NO: 50355 - RNA, 46 nt, Mus musculus
guguguguguauauguauggaugugugcauguguauguguguauau

SEQ ID NO: 50356 - RNA, 45 nt, Mus musculus
ugugcauguguguguguguguguguguguguguguaugagugugu

SEQ ID NO: 50357 - RNA, 83 nt, Mus musculus
ugaccggacauaaaguggcugugaagauacucaaccggcagaagauucggagccuugacguggugggaaaaauccgccgggag

SEQ ID NO: 50358 - RNA, 59 nt, Mus musculus
cucuuaucccgcugcucucccucaaaucaucaaacuguaaguccaccucuuaucccgcu

SEQ ID NO: 50359 - RNA, 26 nt, Mus musculus
cucuuaucccgcugcucacccucaca

SEQ ID NO: 50360 - RNA, 73 nt, Mus musculus
caucaucaaacuguaaguccaccucucaucccgcugcucucccucacaucaucaaacuguaaguccaccucuc

SEQ ID NO: 50361 - RNA, 117 nt, Mus musculus
aucccgcugcucucccucacaucaucaaacuguaaguccaccucucaucccgcugcucucccucacaucaucaaacuguaaguccaccucucaucccgcugcucucccucacaucau

SEQ ID NO: 50362 - RNA, 73 nt, Mus musculus; identical to SEQ ID NO: 50360

SEQ ID NO: 50363 - RNA, 71 nt, Mus musculus
aucccgcugcucucccucacaucaucaaacuguaaguccaccucucaucccgcugcucucccucacaucau

SEQ ID NO: 50364 - RNA, 25 nt, Mus musculus
ucucaucccgcugcucacccucaca

SEQ ID NO: 50365 - RNA, 52 nt, Mus musculus
acccucacaucaucaaacuguaaguccaccucuuaucccgcugcucucccuc

SEQ ID NO: 50366 - RNA, 25 nt, Mus musculus
ucucaucccgcugcucacccucaca

SEQ ID NO: 50367 - RNA, 46 nt, Mus musculus
uccagcucuuaucccgcugcucucccucacaucaucaaacuguaag

SEQ ID NO: 50368 - RNA, 43 nt, Mus musculus
uagccuguccucucccucacaucaucaaacuguaagcccagcu

SEQ ID NO: 50369 - RNA, 43 nt, Mus musculus; identical to SEQ ID NO: 50368

SEQ ID NO: 50370 - RNA, 25 nt, Mus musculus
ucucaucccgcugcucacccucaca

SEQ ID NO: 50371 - RNA, 25 nt, Mus musculus
ucucaucccgcugcucacccucaca

SEQ ID NO: 50372 - RNA, 45 nt, Mus musculus
caggcucccaacugggcccuggcccuggcuguuccuucccccugc

SEQ ID NO: 50373 - RNA, 49 nt, Mus musculus
ucaucaguacaccaucugauauuuucauggugauggaauaugucucugg

SEQ ID NO: 50374 - RNA, 80 nt, Mus musculus
cuguuccagcagauccuuuccgguguggauuauugucacaggcauauggugguccacagagauuugaaaccugagaacgu

SEQ ID NO: 50375 - RNA, 44 nt, Mus musculus
ccagugauggccgacuagaccaucguuugauacauaugcagcua

SEQ ID NO: 50376 - RNA, 46 nt, Mus musculus
guugcuuauuucucuuaaguuuguuagucuguacugucgccuugag

SEQ ID NO: 50377 - RNA, 42 nt, Mus musculus
aagcaguuacauacauggaugcaccucaacacacacacacac

SEQ ID NO: 50378 - RNA, 45 nt, Mus musculus
aucuuuuauaccccucaguacuuaaacccuucaguaaucagccuu

SEQ ID NO: 50379 - RNA, 46 nt, Mus musculus
aacaccacgggcccggcacacccuggaugaauuaaacccacagaaa

SEQ ID NO: 50380 - RNA, 46 nt, Mus musculus
cagaugagauuacagaagccaaaucagggacugcuacuccacagag

SEQ ID NO: 50381 - RNA, 45 nt, Mus musculus
auuaaaguugauuucucaugaaaggaacuuuucuaccaagucggg

SEQ ID NO: 50382 - RNA, 45 nt, Mus musculus
agucuuuacuagaguugagggcaucaugguuaagcuacccugaga

SEQ ID NO: 50383 - RNA, 44 nt, Mus musculus
accuaauaaaaaauggaaagaaaaaaaaaauaaaguggcuguua

SEQ ID NO: 50384 - RNA, 42 nt, Mus musculus
aauuuuugacucuggaaauuuugaacaguuucuacaggagaa

SEQ ID NO: 50385 - RNA, 45 nt, Mus musculus
ggaaauuuuccuuugucaaaauuagagaccacaaccagucaauau

SEQ ID NO: 50386 - RNA, 42 nt, Mus musculus
gugggugggggagcaagguagagguuguuauuuagguugcug

SEQ ID NO: 50387 - RNA, 46 nt, Mus musculus
cuuaccauuaaccagcuuucagaaacacuauagaaaaaaggucaag

SEQ ID NO: 50388 - RNA, 82 nt, Mus musculus
ggugcugaguaaagaagagauuuggugugaaauaauaagcaaucagauuguuugagggacagaaguggugucgcagcagcca

SEQ ID NO: 50389 - RNA, 45 nt, Mus musculus
gcugccugccgaauccagcacacuguggaaagggaaagucggugg

SEQ ID NO: 50390 - RNA, 45 nt, Mus musculus
aguuguuauucugaauuuaugauuugaguauuuuuuguauagguu

SEQ ID NO: 50391 - RNA, 46 nt, Mus musculus
ggagggaagggaacagguuaaaauauuuaguaaauaaucgauguau

SEQ ID NO: 50392 - RNA, 46 nt, Mus musculus
acagaaaagguauaauugccuuuuauuauuuugagauaggagcuaa

SEQ ID NO: 50393 - RNA, 45 nt, Mus musculus
uccuauuucucaccuguguuaagagaagugcuuuaauugggccaa

SEQ ID NO: 50394 - RNA, 45 nt, Mus musculus
cggagggaagacaggccugagaggaacacugggaaacacagagaa

SEQ ID NO: 50395 - RNA, 49 nt, Mus musculus
guuguacucuuuaguucuucagucgacagcagagaguagguggugaggg

SEQ ID NO: 50396 - RNA, 84 nt, Mus musculus
agacagacgucagagacaagauaugugacaaaauaauuaggagaaguguaagaaugaacuuaggaauuagaacauauggagccg

SEQ ID NO: 50397 - RNA, 46 nt, Mus musculus
gaaacccugucucgaaaaacaaaaaaacaaacaaaaaaaaagaaua

SEQ ID NO: 50398 - RNA, 42 nt, Mus musculus
aacuuuuucaguucaauaaaguguaguuaaauauggggggaa

SEQ ID NO: 50399 - RNA, 48 nt, Mus musculus
gugauuauuauauuuuuagguguuuguuuuuauuuccuuguuuguugc

SEQ ID NO: 50400 - RNA, 46 nt, Mus musculus
uacaguucugaaagauaauuguacuuuaaauaugauaaaaucuuag

SEQ ID NO: 50401 - RNA, 45 nt, Mus musculus
uaaaaauguaagaaacuauccuuucccuuuuuuacuuacaagaaa

SEQ ID NO: 50402 - RNA, 46 nt, Mus musculus
uuuguacuuauaagccauauuguaaaaucaacuuuugccugugcug

SEQ ID NO: 50403 - RNA, 46 nt, Mus musculus
uugauuggccuagaagaugaaaagguaauaauuauaaugcuagaag

SEQ ID NO: 50404 - RNA, 45 nt, Mus musculus
guggcugccaagccugauggcccgaguuuaauaccaggaccccgu

SEQ ID NO: 50405 - RNA, 45 nt, Mus musculus
gcucuuccagaggaccaggguuuaguucccaacacugaugcccau

SEQ ID NO: 50406 - RNA, 45 nt, Mus musculus
uggcuaugaguugucugaggagagagggcuggaguugaaggauaa

SEQ ID NO: 50407 - RNA, 45 nt, Mus musculus
aaaacaacuguaaaccuaggcaaaaguaagaucacaacaugagca

SEQ ID NO: 50408 - RNA, 31 nt, Mus musculus
agacaaaagacaggcaguucaaaaagucgag

SEQ ID NO: 50409 - RNA, 48 nt, Mus musculus
uagaaauucauuaaagaaaaagguuccauuuuucagcccaaaauugug

SEQ ID NO: 50410 - RNA, 46 nt, Mus musculus
guguaaagcuuaauuuugcaaaggugcaugaucaaguaagaccaag

SEQ ID NO: 50411 - RNA, 45 nt, Mus musculus
uuuuaauuguggcuuacuuugcuugguugauacagcacuguugag

SEQ ID NO: 50412 - RNA, 46 nt, Mus musculus
gguugugagccaccaugugguugcugggaauugaacucaugacaga

SEQ ID NO: 50413 - RNA, 46 nt, Mus musculus
auaauguauuauacauguuuucuugauaguaacuauauaggcuaag

SEQ ID NO: 50414 - RNA, 46 nt, Mus musculus
auaacaauaauaucuacuaaaaucuagccuuccuugauugaugaua

SEQ ID NO: 50415 - RNA, 46 nt, Mus musculus
uuacuaucuggcacaaacaagugagugcugcagagcagacaagcag

SEQ ID NO: 50416 - RNA, 46 nt, Mus musculus
auacguaucauaaacugaagcaaaauguaaaugggugacaaaccag

SEQ ID NO: 50417 - RNA, 45 nt, Mus musculus
aacacgagggaaaacccgauucugaagucauccaggagaauaaac

SEQ ID NO: 50418 - RNA, 46 nt, Mus musculus
ucucaacagacguaaaguauaaaaaucaauuugagaaaugugcugg

SEQ ID NO: 50419 - RNA, 46 nt, Mus musculus
aaauauucaguaaacuauuguucaaagacauuuuaaaagucaggcu

SEQ ID NO: 50420 - RNA, 46 nt, Mus musculus
auacaaaacuuugcuuugaaauuuugaaauguagacucgggugcua

SEQ ID NO: 50421 - RNA, 45 nt, Mus musculus
aguacuaaaaagaaaccuuuuuaaauaucucauucuggcuguuaa

SEQ ID NO: 50422 - RNA, 45 nt, Mus musculus
aacuggcaucgcauagacaagccggguaugguggagcaugcagag

SEQ ID NO: 50423 - RNA, 72 nt, Mus musculus
uacgauuucuauucauacacaaagauaugaucguguuacuggaaacucaaaagaaaaaauguuuuucuuaga

SEQ ID NO: 50424 - RNA, 46 nt, Mus musculus
ugcucccccccuuuugguuuguuuauauaauguaucacauagacag

SEQ ID NO: 50425 - RNA, 42 nt, Mus musculus
gacgacuucagguaaaccacaguuaaauuguucuggguggaa

SEQ ID NO: 50426 - RNA, 42 nt, Mus musculus
gggcucuaaccaccaaggucaccuacugcucacucagcccuc

SEQ ID NO: 50427 - RNA, 46 nt, Mus musculus
uauauaauguauauuugaaaccuaaaugaauuuguuaugcccacau

SEQ ID NO: 50428 - RNA, 46 nt, Mus musculus
cugcucgaagugcucuaugacaucuuucgucucccucugcccguug

SEQ ID NO: 50429 - RNA, 46 nt, Mus musculus
uuucuuucuggugauuagagaauucauaagaugccuaagucuccaa

SEQ ID NO: 50430 - RNA, 46 nt, Mus musculus
uuuacaaaccuuuaucuuacauuguuuuucaaaaacuuccuaggag

SEQ ID NO: 50431 - RNA, 46 nt, Mus musculus
gcuguaucuugguucucagagaccacuuccucuacaaacacuggaa

SEQ ID NO: 50432 - RNA, 45 nt, Mus musculus
uaucuguccugcagagcuaucucauucuuacugaaauuugauggg

SEQ ID NO: 50433 - RNA, 46 nt, Mus musculus
uaguaguaauuuguauuugaggcuguaaaguguuaguaagugguag

SEQ ID NO: 50434 - RNA, 46 nt, Mus musculus
caguguguguggauguguacagaugcguguggggucaagagagcag

SEQ ID NO: 50435 - RNA, 45 nt, Mus musculus
uuacucagguugugaugcuagcccugacacaaggauggcauuaau

SEQ ID NO: 50436 - RNA, 27 nt, Mus musculus
uagucccuaccuagguauaaaaccuua

SEQ ID NO: 50437 - RNA, 23 nt, Mus musculus
ucaaaaugcuggaaaagugcagu

SEQ ID NO: 50438 - RNA, 41 nt, Mus musculus
cuaggcuugcagacuguaugcaacaaaacauuuaaggguuu

SEQ ID NO: 50439 - RNA, 42 nt, Mus musculus
cuacaugauaaaaacaaaacaauuucuucugaagcgcuggau

SEQ ID NO: 50440 - RNA, 45 nt, Mus musculus
cuaagguuugcuauaauguggugaagauaauuaugaaaacagaag

SEQ ID NO: 50441 - RNA, 46 nt, Mus musculus
gauggugauaacuacguucgucgcaguaaucaaagguaugauccag

SEQ ID NO: 50442 - RNA, 46 nt, Mus musculus
acuuaagcauguuaauaacuuucucggucauauuucgucacaccag

SEQ ID NO: 50443 - RNA, 46 nt, Mus musculus
auuaguuuuaagaagaugcuauuuucuaacuaaaagaaacaaacau

SEQ ID NO: 50444 - RNA, 46 nt, Mus musculus
gcugugauauuuugaaaugucacagcugggauucuguaaggcacag

SEQ ID NO: 50445 - RNA, 45 nt, Mus musculus
ucucucccuugcuuuugagauagcuuuaggaauuuuguaaucaga

SEQ ID NO: 50446 - RNA, 45 nt, Mus musculus
uucuuaaaaagauagcaugucagaaauaaaugauuugugaagcag

SEQ ID NO: 50447 - RNA, 51 nt, Mus musculus
gaucauaacacaagugagcaagguggcacacacuuuaauccuagcacuugg

SEQ ID NO: 50448 - RNA, 103 nt, Mus musculus
uccccaagaguuuugguaccgagacucacagagaaaacacaagccgagaaagguugguuguggaaggcucagcaagcucccacaucaagauccgcagccagag

SEQ ID NO: 50449 - RNA, 45 nt, Mus musculus
cagucccuuaaagcgcccuccauugcaacaauaaaaagucuagca

SEQ ID NO: 50450 - RNA, 46 nt, Mus musculus
aaaaguacuuuagcuuaaauguuugguugacuugaaaaugccacug

SEQ ID NO: 50451 - RNA, 45 nt, Mus musculus
gaggauucagccagacuugaaacacaauaucuaaaagcggggcca

SEQ ID NO: 50452 - RNA, 46 nt, Mus musculus
ugguucauuaccaugguuuuaauucaguuaccaucauaugcaagag

SEQ ID NO: 50453 - RNA, 45 nt, Mus musculus
aaggaaaagacagcuuugccugcaguuuacacauuccaugggaaa

SEQ ID NO: 50454 - RNA, 46 nt, Mus musculus
ggucuuggacaauaaaacugccuuuccagagaaccaaaugucagag

SEQ ID NO: 50455 - RNA, 42 nt, Mus musculus
auaaaaguagacuuuuaugacgaaaacgacaugcagugccaa

SEQ ID NO: 50456 - RNA, 42 nt, Mus musculus
auaauccauaaaacauuucugcuguuucaauaaagcccaaau

SEQ ID NO: 50457 - RNA, 46 nt, Mus musculus
aacaauuuccauagcacuuacacgcaccagguauuaggccacagca

SEQ ID NO: 50458 - RNA, 46 nt, Mus musculus
aucuguggguuucacaucaagauucaaccaauuucagaaagaagau

SEQ ID NO: 50459 - RNA, 42 nt, Mus musculus
uuuacauauaauauacaccaccucccgccccugcccccaccc

SEQ ID NO: 50460 - RNA, 46 nt, Mus musculus
gaaagaacucucuucgugucuacaccuuauguaacuaaccaguaag

SEQ ID NO: 50461 - RNA, 31 nt, Mus musculus
uauaauaugguguucacccugaaggcguucc

SEQ ID NO: 50462 - RNA, 46 nt, Mus musculus
gcuggcuucacccaugugcggagacaaggacacgcuugccacagaa

SEQ ID NO: 50463 - RNA, 116 nt, Mus musculus
cugguucccauggccucauuccagguccccuaaaagacacagcacaccaacuuggacuauuggcuccaccuaacaaguuccagaacguauuaaaaaaugacuacaugaagccccug

SEQ ID NO: 50464 - RNA, 43 nt, Mus musculus
ucacauugaagauguacccacuaagccgccaaucgugccaaca

SEQ ID NO: 50465 - RNA, 46 nt, Mus musculus
agacucuccuucaagaaaaacuaaagugugugugugugugugugug

SEQ ID NO: 50466 - RNA, 42 nt, Mus musculus
ccaggacccaaugaaacguucacaaaggucacaacuccagau

SEQ ID NO: 50467 - RNA, 46 nt, Mus musculus
agacacucaccguggaaaaccuucagccagagucccucuaugaguu

SEQ ID NO: 50468 - RNA, 69 nt, Mus musculus
ccuuuggugaauccaaaaguggagauuccuuacucgaccccuaacuccuucguucuaagauggccagau

SEQ ID NO: 50469 - RNA, 33 nt, Mus musculus
aaggccuaguggaaggggggaauacucguggaa

SEQ ID NO: 50470 - RNA, 44 nt, Mus musculus
agaucaaagaugcucaagcguguggcuuaaguaggaagcgcagg

SEQ ID NO: 50471 - RNA, 46 nt, Mus musculus
uggacuggugugcacauucccaggaccaacgcugugauuugcagug

SEQ ID NO: 50472 - RNA, 45 nt, Mus musculus
ggggcaucuccugaguccuugaugguccuuucuaaugauucugga

SEQ ID NO: 50473 - RNA, 68 nt, Mus musculus
uauaauauaguuguagaaaaugaagccaaaccaacugagucagaacacuacugugucugggcaccagc

SEQ ID NO: 50474 - RNA, 87 nt, Mus musculus
ugguucagcucccucacaggcucuugauguauggagacaaguguggucggagaauggaagacgcauugugacuuuauucuggaaggu

SEQ ID NO: 50475 - RNA, 44 nt, Mus musculus
ucauuuacauuuccaauacuaucgcaaaagauagcuggcaggau

SEQ ID NO: 50476 - RNA, 46 nt, Mus musculus
gaaauggagcgacuggacccaaaaagaguucagcacacccgagacu

SEQ ID NO: 50477 - RNA, 45 nt, Mus musculus
agagggagcaagggagcaggaggcaagagaauaagagaacaagag

SEQ ID NO: 50478 - RNA, 46 nt, Mus musculus
aauggcagagagaaggagagaguagagaaguagaggcugaccauga

SEQ ID NO: 50479 - RNA, 46 nt, Mus musculus
cagcccuuacucaugaagaauuaaacaugauauuucagauagagau

SEQ ID NO: 50480 - RNA, 41 nt, Mus musculus
uguagugaagaauuaugcugguuuaguaaaauggccauaau

SEQ ID NO: 50481 - RNA, 46 nt, Mus musculus
gugucugucugugugucucugugugugugucugucugucugugugu
